United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 103

SEQ ID NO: 4360420 - DNA, 18 bp, Homo sapiens
aggtaagatcataacaat

SEQ ID NO: 4360421 - DNA, 17 bp, Homo sapiens
aggtaatatacctggtt

SEQ ID NO: 4360422 - DNA, 20 bp, Homo sapiens
aggtaatatacctggtttac

SEQ ID NO: 4360423 - DNA, 21 bp, Homo sapiens
aggtaatatacctggtttact

SEQ ID NO: 4360424 - DNA, 14 bp, Homo sapiens
aggtcactccacca

SEQ ID NO: 4360425 - DNA, 18 bp, Homo sapiens
aggtcactccaccatccc

SEQ ID NO: 4360426 - DNA, 18 bp, Homo sapiens
aggtcactcctggggcct

SEQ ID NO: 4360427 - DNA, 19 bp, Homo sapiens
aggtcactcctggggcctc

SEQ ID NO: 4360428 - DNA, 16 bp, Homo sapiens
aggtgcctcatagcat

SEQ ID NO: 4360429 - DNA, 20 bp, Homo sapiens
aggtgcgtgttcagcagaac

SEQ ID NO: 4360430 - DNA, 22 bp, Homo sapiens
aggtgcgtgttcagcagaacct

SEQ ID NO: 4360431 - DNA, 22 bp, Homo sapiens
aggtggatgttatgaacagctg

SEQ ID NO: 4360432 - DNA, 23 bp, Homo sapiens
aggtggatgttatgaacagctgt

SEQ ID NO: 4360433 - DNA, 18 bp, Homo sapiens
aggtgtcgggacatggtt

SEQ ID NO: 4360434 - DNA, 16 bp, Homo sapiens
aggttagaaaggcagc

SEQ ID NO: 4360435 - DNA, 14 bp, Homo sapiens
aggttataggtcac

SEQ ID NO: 4360436 - DNA, 19 bp, Homo sapiens
aggttataggtcactcctg

SEQ ID NO: 4360437 - DNA, 17 bp, Homo sapiens
agtaaaacataatgtat

SEQ ID NO: 4360438 - DNA, 19 bp, Homo sapiens
agtacagaacagtaaagtt

SEQ ID NO: 4360439 - DNA, 23 bp, Homo sapiens
agtacagtattttttaaggcaaa

SEQ ID NO: 4360440 - DNA, 17 bp, Homo sapiens
agtagagtcatctccat

SEQ ID NO: 4360441 - DNA, 18 bp, Homo sapiens
agtataaagtaacccata

SEQ ID NO: 4360442 - DNA, 17 bp, Homo sapiens
agtatatggcatatgaa

SEQ ID NO: 4360443 - DNA, 14 bp, Homo sapiens
agtatatttatagt

SEQ ID NO: 4360444 - DNA, 20 bp, Homo sapiens
agtatcactctaatataata

SEQ ID NO: 4360445 - DNA, 23 bp, Homo sapiens
agtatcactctaatataatatgg

SEQ ID NO: 4360446 - DNA, 15 bp, Homo sapiens
agtatgccttaagca

SEQ ID NO: 4360447 - DNA, 23 bp, Homo sapiens
agtatggtaggggagggcaggct

SEQ ID NO: 4360448 - DNA, 22 bp, Homo sapiens
agtatttaaatccttttcccat

SEQ ID NO: 4360449 - DNA, 16 bp, Homo sapiens
agtcacaagagcccag

SEQ ID NO: 4360450 - DNA, 14 bp, Homo sapiens
agtcaggtaatata

SEQ ID NO: 4360451 - DNA, 18 bp, Homo sapiens
agtcatctccatcagctg

SEQ ID NO: 4360452 - DNA, 15 bp, Homo sapiens
agtcatctgtaagag

SEQ ID NO: 4360453 - DNA, 15 bp, Homo sapiens
agtcttctttcccaa

SEQ ID NO: 4360454 - DNA, 21 bp, Homo sapiens
agtcttggttctaaaggtacc

SEQ ID NO: 4360455 - DNA, 19 bp, Homo sapiens
agtgaacattcccagccca

SEQ ID NO: 4360456 - DNA, 20 bp, Homo sapiens
agtgaacattcccagcccag

SEQ ID NO: 4360457 - DNA, 17 bp, Homo sapiens
agtgaatgctagacaga

SEQ ID NO: 4360458 - DNA, 15 bp, Homo sapiens
agtgacagctttctg

SEQ ID NO: 4360459 - DNA, 18 bp, Homo sapiens
agtgacagctttctggga

SEQ ID NO: 4360460 - DNA, 21 bp, Homo sapiens
agtgacagctttctgggatgt

SEQ ID NO: 4360461 - DNA, 15 bp, Homo sapiens
agtgagcagaacagg

SEQ ID NO: 4360462 - DNA, 17 bp, Homo sapiens
agtgagcagaacaggta

SEQ ID NO: 4360463 - DNA, 16 bp, Homo sapiens
agtgatcaataaaatg

SEQ ID NO: 4360464 - DNA, 17 bp, Homo sapiens
agtgatcaataaaatgt

SEQ ID NO: 4360465 - DNA, 19 bp, Homo sapiens
agtgatcaataaaatgtga

SEQ ID NO: 4360466 - DNA, 15 bp, Homo sapiens
agtgcattttcccag

SEQ ID NO: 4360467 - DNA, 17 bp, Homo sapiens
agtgcattttcccagat

SEQ ID NO: 4360468 - DNA, 18 bp, Homo sapiens
agtgccactgccccccga

SEQ ID NO: 4360469 - DNA, 18 bp, Homo sapiens
agtgcctgggaatgtatt

SEQ ID NO: 4360470 - DNA, 15 bp, Homo sapiens
agtgctgaatttccc

SEQ ID NO: 4360471 - DNA, 12 bp, Homo sapiens
agtggcacagga

SEQ ID NO: 4360472 - DNA, 21 bp, Homo sapiens
agtggggtcccccctgagtgg

SEQ ID NO: 4360473 - DNA, 13 bp, Homo sapiens
agtggtctttctg

SEQ ID NO: 4360474 - DNA, 13 bp, Homo sapiens
ttactcctcctgc

SEQ ID NO: 4360475 - DNA, 19 bp, Homo sapiens
ttactgtaactgtcagtgt

SEQ ID NO: 4360476 - DNA, 19 bp, Homo sapiens
ttactgttttgggcctcca

SEQ ID NO: 4360477 - DNA, 17 bp, Homo sapiens
ttacttgaaataagttg

SEQ ID NO: 4360478 - DNA, 20 bp, Homo sapiens
ttaggaagtgtaacagctga

SEQ ID NO: 4360479 - DNA, 21 bp, Homo sapiens
ttaggaagtgtaacagctgag

SEQ ID NO: 4360480 - DNA, 17 bp, Homo sapiens
ttaggcatgtcccaccc

SEQ ID NO: 4360481 - DNA, 19 bp, Homo sapiens
ttaggcatgtcccacccac

SEQ ID NO: 4360482 - DNA, 17 bp, Homo sapiens
ttataggtcactcctgg

SEQ ID NO: 4360483 - DNA, 21 bp, Homo sapiens
ttatataattctgaaatgttt

SEQ ID NO: 4360484 - DNA, 23 bp, Homo sapiens
ttatcccttccttttagcctagt

SEQ ID NO: 4360485 - DNA, 15 bp, Homo sapiens
ttatgaacagctgtg

SEQ ID NO: 4360486 - DNA, 12 bp, Homo sapiens
ttatgcactgtg

SEQ ID NO: 4360487 - DNA, 13 bp, Homo sapiens
ttatgcactgtgg

SEQ ID NO: 4360488 - DNA, 21 bp, Homo sapiens
ttattcccaagtatgccttaa

SEQ ID NO: 4360489 - DNA, 23 bp, Homo sapiens
ttcaaactgctgcatactttgac

SEQ ID NO: 4360490 - DNA, 17 bp, Homo sapiens
ttcaaattgctgcttgg

SEQ ID NO: 4360491 - DNA, 14 bp, Homo sapiens
ttcaccttggaagg

SEQ ID NO: 4360492 - DNA, 19 bp, Homo sapiens
ttcactttcacatagatgt

SEQ ID NO: 4360493 - DNA, 22 bp, Homo sapiens
ttcactttgaaaagttggaagg

SEQ ID NO: 4360494 - DNA, 18 bp, Homo sapiens
ttcagatgtgcaataatt

SEQ ID NO: 4360495 - DNA, 22 bp, Homo sapiens
ttcagatgtgcaataatttgta

SEQ ID NO: 4360496 - DNA, 13 bp, Homo sapiens
ttcagcagaacct

SEQ ID NO: 4360497 - DNA, 17 bp, Homo sapiens
ttcagtattttttactt

SEQ ID NO: 4360498 - DNA, 20 bp, Homo sapiens
ttcatccaatcctcactggg

SEQ ID NO: 4360499 - DNA, 22 bp, Homo sapiens
ttcatccaatcctcactgggtg

SEQ ID NO: 4360500 - DNA, 21 bp, Homo sapiens
ttccatcttgtggggccagga

SEQ ID NO: 4360501 - DNA, 12 bp, Homo sapiens
ttccatgaatgt

SEQ ID NO: 4360502 - DNA, 17 bp, Homo sapiens
ttcccaagtatgcctta

SEQ ID NO: 4360503 - DNA, 19 bp, Homo sapiens
ttcccaagtatgccttaag

SEQ ID NO: 4360504 - DNA, 14 bp, Homo sapiens
ttcccagatacttc

SEQ ID NO: 4360505 - DNA, 13 bp, Homo sapiens
ttcccccatccct

SEQ ID NO: 4360506 - DNA, 15 bp, Homo sapiens
ttcccccatccctac

SEQ ID NO: 4360507 - DNA, 17 bp, Homo sapiens
ttcccccatccctacca

SEQ ID NO: 4360508 - DNA, 19 bp, Homo sapiens
ttccccgatgtcccctgcg

SEQ ID NO: 4360509 - DNA, 21 bp, Homo sapiens
ttccccgatgtcccctgcggg

SEQ ID NO: 4360510 - DNA, 20 bp, Homo sapiens
ttcccgccttgggcttgcag

SEQ ID NO: 4360511 - DNA, 12 bp, Homo sapiens
ttccctgaggaa

SEQ ID NO: 4360512 - DNA, 13 bp, Homo sapiens
ttccttaaactgt

SEQ ID NO: 4360513 - DNA, 15 bp, Homo sapiens
ttccttaaactgtgt

SEQ ID NO: 4360514 - DNA, 16 bp, Homo sapiens
ttccttaaactgtgtg

SEQ ID NO: 4360515 - DNA, 14 bp, Homo sapiens
ttccttgccttaat

SEQ ID NO: 4360516 - DNA, 17 bp, Homo sapiens
ttccttttgtgtacagt

SEQ ID NO: 4360517 - DNA, 23 bp, Homo sapiens
ttcgaatgacggtaagtgttctc

SEQ ID NO: 4360518 - DNA, 17 bp, Homo sapiens
ttcgcattaagcacaca

SEQ ID NO: 4360519 - DNA, 16 bp, Homo sapiens
ttcgtcactcaaatga

SEQ ID NO: 4360520 - DNA, 22 bp, Homo sapiens
ttctaaatccgacttgaatatt

SEQ ID NO: 4360521 - DNA, 14 bp, Homo sapiens
ttctaatttgtatc

SEQ ID NO: 4360522 - DNA, 13 bp, Homo sapiens
ttctactgctctc

SEQ ID NO: 4360523 - DNA, 20 bp, Homo sapiens
ttctactgctctcctccacc

SEQ ID NO: 4360524 - DNA, 22 bp, Homo sapiens
ttctatcattccaattctaaat

SEQ ID NO: 4360525 - DNA, 20 bp, Homo sapiens
ttctctatgacatgaaatga

SEQ ID NO: 4360526 - DNA, 12 bp, Homo sapiens
ttctgaaatgtt

SEQ ID NO: 4360527 - DNA, 15 bp, Homo sapiens
ttctgaataaagcaa

SEQ ID NO: 4360528 - DNA, 21 bp, Homo sapiens
ttctgcagcatgacctgtgac

SEQ ID NO: 4360529 - DNA, 23 bp, Homo sapiens
ttctgcagcatgacctgtgacca

SEQ ID NO: 4360530 - DNA, 18 bp, Homo sapiens
ttctgccctgcctgagga

SEQ ID NO: 4360531 - DNA, 13 bp, Homo sapiens
ttctgctgccctc

SEQ ID NO: 4360532 - DNA, 14 bp, Homo sapiens
ttctgctgccctct

SEQ ID NO: 4360533 - DNA, 16 bp, Homo sapiens
ttctgtgcttggattt

SEQ ID NO: 4360534 - DNA, 13 bp, Homo sapiens
ttcttcttcagaa

SEQ ID NO: 4360535 - DNA, 18 bp, Homo sapiens
ttcttgggagaaaatcaa

SEQ ID NO: 4360536 - DNA, 22 bp, Homo sapiens
ttcttggtggcagaatgaaaat

SEQ ID NO: 4360537 - DNA, 20 bp, Homo sapiens
ttctttagcatttttatgca

SEQ ID NO: 4360538 - DNA, 22 bp, Homo sapiens
ttctttagcatttttatgcaga

SEQ ID NO: 4360539 - DNA, 18 bp, Homo sapiens
ttgaaataagttgtttca

SEQ ID NO: 4360540 - DNA, 14 bp, Homo sapiens
ttgaagggtcctgc

SEQ ID NO: 4360541 - DNA, 23 bp, Homo sapiens
ttgaattgtgtattgatgcaata

SEQ ID NO: 4360542 - DNA, 19 bp, Homo sapiens
ttgacctctgtgaccaact

SEQ ID NO: 4360543 - DNA, 22 bp, Homo sapiens
ttgagaaatgaataatttccca

SEQ ID NO: 4360544 - DNA, 13 bp, Homo sapiens
ttgcacacttgtg

SEQ ID NO: 4360545 - DNA, 15 bp, Homo sapiens
ttgcatgtacttgaa

SEQ ID NO: 4360546 - DNA, 15 bp, Homo sapiens
ttgccacaaccctgt

SEQ ID NO: 4360547 - DNA, 19 bp, Homo sapiens
ttgcctctgggtaggaaaa

SEQ ID NO: 4360548 - DNA, 15 bp, Homo sapiens
ttgcctgaactccag

SEQ ID NO: 4360549 - DNA, 12 bp, Homo sapiens
ttgcctgtgcca

SEQ ID NO: 4360550 - DNA, 20 bp, Homo sapiens
ttgccttaataaatatgtaa

SEQ ID NO: 4360551 - DNA, 17 bp, Homo sapiens
ttgctagttctgctgcc

SEQ ID NO: 4360552 - DNA, 14 bp, Homo sapiens
ttgctatcctgcag

SEQ ID NO: 4360553 - DNA, 14 bp, Homo sapiens
ttgctcagagctag

SEQ ID NO: 4360554 - DNA, 17 bp, Homo sapiens
ttgctccagattctgat

SEQ ID NO: 4360555 - DNA, 12 bp, Homo sapiens
ttgctgcagctt

SEQ ID NO: 4360556 - DNA, 12 bp, Homo sapiens
ttgctgggccag

SEQ ID NO: 4360557 - DNA, 14 bp, Homo sapiens
ttgctgggccaggg

SEQ ID NO: 4360558 - DNA, 17 bp, Homo sapiens
ttgcttacttttactgt

SEQ ID NO: 4360559 - DNA, 21 bp, Homo sapiens
ttggaaacatttttgagatat

SEQ ID NO: 4360560 - DNA, 17 bp, Homo sapiens
ttggaaggatctgctga

SEQ ID NO: 4360561 - DNA, 22 bp, Homo sapiens
ttggagagcagcaggtgctgtg

SEQ ID NO: 4360562 - DNA, 13 bp, Homo sapiens
ttggccatgcaga

SEQ ID NO: 4360563 - DNA, 19 bp, Homo sapiens
ttggccatgcagaaagcat

SEQ ID NO: 4360564 - DNA, 17 bp, Homo sapiens
ttgggcctccatgcccc

SEQ ID NO: 4360565 - DNA, 13 bp, Homo sapiens
ttgggggaatgca

SEQ ID NO: 4360566 - DNA, 16 bp, Homo sapiens
ttgggggaatgcacct

SEQ ID NO: 4360567 - DNA, 14 bp, Homo sapiens
ttggtaaaaatgct

SEQ ID NO: 4360568 - DNA, 17 bp, Homo sapiens
ttggtctcaggcagcac

SEQ ID NO: 4360569 - DNA, 21 bp, Homo sapiens
ttggtgagtcttggttctaaa

SEQ ID NO: 4360570 - DNA, 17 bp, Homo sapiens
ttggtgtttgtctgtgt

SEQ ID NO: 4360571 - DNA, 13 bp, Homo sapiens
ttgtacaatggtt

SEQ ID NO: 4360572 - DNA, 21 bp, Homo sapiens
ttgtagaaagcaaacaaaatt

SEQ ID NO: 4360573 - DNA, 19 bp, Homo sapiens
ttgtatcatttgaacaact

SEQ ID NO: 4360574 - DNA, 22 bp, Homo sapiens
ttgtatcggagggaaacagaag

SEQ ID NO: 4360575 - DNA, 13 bp, Homo sapiens
ttgtattttgcat

SEQ ID NO: 4360576 - DNA, 21 bp, Homo sapiens
ttgtcaaggaagaagaaatct

SEQ ID NO: 4360577 - DNA, 13 bp, Homo sapiens
ttgtcacttgcca

SEQ ID NO: 4360578 - DNA, 15 bp, Homo sapiens
ttgtcacttgccaca

SEQ ID NO: 4360579 - DNA, 17 bp, Homo sapiens
ttgtcacttgccacatg

SEQ ID NO: 4360580 - DNA, 20 bp, Homo sapiens
ttgtgaggcccatggttgag

SEQ ID NO: 4360581 - DNA, 19 bp, Homo sapiens
ttgtgatgtaaggcactgt

SEQ ID NO: 4360582 - DNA, 14 bp, Homo sapiens
ttgtggagtttgta

SEQ ID NO: 4360583 - DNA, 16 bp, Homo sapiens
ttgtgtattgatgcaa

SEQ ID NO: 4360584 - DNA, 18 bp, Homo sapiens
ttgtgtattgatgcaata

SEQ ID NO: 4360585 - DNA, 14 bp, Homo sapiens
tttaaaatactata

SEQ ID NO: 4360586 - DNA, 14 bp, Homo sapiens
tttaaataaaccta

SEQ ID NO: 4360587 - DNA, 17 bp, Homo sapiens
tttatgcagacagtctg

SEQ ID NO: 4360588 - DNA, 13 bp, Homo sapiens
tttcacagttttt

SEQ ID NO: 4360589 - DNA, 14 bp, Homo sapiens
tttcacatagatgt

SEQ ID NO: 4360590 - DNA, 19 bp, Homo sapiens
tttcactatttttatttat

SEQ ID NO: 4360591 - DNA, 21 bp, Homo sapiens
tttcactttcacatagatgtc

SEQ ID NO: 4360592 - DNA, 13 bp, Homo sapiens
tttcaggatactc

SEQ ID NO: 4360593 - DNA, 16 bp, Homo sapiens
tttcaggatactctgt

SEQ ID NO: 4360594 - DNA, 19 bp, Homo sapiens
tttcaggatactctgtcag

SEQ ID NO: 4360595 - DNA, 21 bp, Homo sapiens
tttcaggatactctgtcagat

SEQ ID NO: 4360596 - DNA, 13 bp, Homo sapiens
tttccctgaggaa

SEQ ID NO: 4360597 - DNA, 23 bp, Homo sapiens
tttccttaaactgtgtggactgt

SEQ ID NO: 4360598 - DNA, 14 bp, Homo sapiens
tttctgaaacacac

SEQ ID NO: 4360599 - DNA, 21 bp, Homo sapiens
tttctggactgaagcctgcag

SEQ ID NO: 4360600 - DNA, 14 bp, Homo sapiens
tttctgtgcttgga

SEQ ID NO: 4360601 - DNA, 16 bp, Homo sapiens
tttctgtgcttggatt

SEQ ID NO: 4360602 - DNA, 20 bp, Homo sapiens
tttgcatcatttaactgaac

SEQ ID NO: 4360603 - DNA, 12 bp, Homo sapiens
tttgcctgtgcc

SEQ ID NO: 4360604 - DNA, 21 bp, Homo sapiens
tttgctagttctgctgccctc

SEQ ID NO: 4360605 - DNA, 11 bp, Homo sapiens
tttggccctgg

SEQ ID NO: 4360606 - DNA, 14 bp, Homo sapiens
tttggccctggagc

SEQ ID NO: 4360607 - DNA, 15 bp, Homo sapiens
tttggccctggagcc

SEQ ID NO: 4360608 - DNA, 16 bp, Homo sapiens
tttggccctggagcca

SEQ ID NO: 4360609 - DNA, 18 bp, Homo sapiens
tttggccctggagccagg

SEQ ID NO: 4360610 - DNA, 21 bp, Homo sapiens
tttgggcctccatgccccagc

SEQ ID NO: 4360611 - DNA, 20 bp, Homo sapiens
tttggggagcagagacacta

SEQ ID NO: 4360612 - DNA, 16 bp, Homo sapiens
tttggtaaaaatgctg

SEQ ID NO: 4360613 - DNA, 16 bp, Homo sapiens
tttgtacaatggttta

SEQ ID NO: 4360614 - DNA, 19 bp, Homo sapiens
tttgtcacttgccacatgg

SEQ ID NO: 4360615 - DNA, 23 bp, Homo sapiens
tttgtcacttgccacatggtgtc

SEQ ID NO: 4360616 - DNA, 23 bp, Homo sapiens
tttgtccaccttttaagttaatg

SEQ ID NO: 4360617 - DNA, 17 bp, Homo sapiens
tttgtcctttttcactt

SEQ ID NO: 4360618 - DNA, 21 bp, Homo sapiens
tttgtttttcaagaaatgatt

SEQ ID NO: 4360619 - DNA, 23 bp, Homo sapiens
ttttaagtatctaggagtattta

SEQ ID NO: 4360620 - DNA, 21 bp, Homo sapiens
ttttacttttcacactgtctt

SEQ ID NO: 4360621 - DNA, 19 bp, Homo sapiens
ttttagcctagttcatcca

SEQ ID NO: 4360622 - DNA, 22 bp, Homo sapiens
ttttatgcagacagtctgttat

SEQ ID NO: 4360623 - DNA, 20 bp, Homo sapiens
ttttattaaacttaaaactt

SEQ ID NO: 4360624 - DNA, 14 bp, Homo sapiens
ttttcaagaaatga

SEQ ID NO: 4360625 - DNA, 18 bp, Homo sapiens
ttttcacactgtcttccc

SEQ ID NO: 4360626 - DNA, 20 bp, Homo sapiens
ttttcccagatacttcccat

SEQ ID NO: 4360627 - DNA, 15 bp, Homo sapiens
ttttctatatagttc

SEQ ID NO: 4360628 - DNA, 18 bp, Homo sapiens
ttttctatatagttcctt

SEQ ID NO: 4360629 - DNA, 18 bp, Homo sapiens
ttttcttggtggcagaat

SEQ ID NO: 4360630 - DNA, 17 bp, Homo sapiens
ttttggggaggaaaaca

SEQ ID NO: 4360631 - DNA, 17 bp, Homo sapiens
tttttacttttcacact

SEQ ID NO: 4360632 - DNA, 21 bp, Homo sapiens
tttttacttttcacactgtct

SEQ ID NO: 4360633 - DNA, 22 bp, Homo sapiens
tttttacttttcacactgtctt

SEQ ID NO: 4360634 - DNA, 15 bp, Homo sapiens
tttttatgcagacag

SEQ ID NO: 4360635 - DNA, 11 bp, Homo sapiens
tttttctatat

SEQ ID NO: 4360636 - DNA, 16 bp, Homo sapiens
tttttctttataaact

SEQ ID NO: 4360637 - DNA, 13 bp, Homo sapiens
tttttgtttgcat

SEQ ID NO: 4360638 - DNA, 22 bp, Homo sapiens
tgcagacagtctgttatgcact

SEQ ID NO: 4360639 - DNA, 23 bp, Homo sapiens
tgcagacagtctgttatgcactg

SEQ ID NO: 4360640 - DNA, 14 bp, Homo sapiens
tctgccaaacacat

SEQ ID NO: 4360641 - DNA, 13 bp, Homo sapiens
tctgccctgcctg

SEQ ID NO: 4360642 - DNA, 14 bp, Homo sapiens
tctgccctgcctga

SEQ ID NO: 4360643 - DNA, 16 bp, Homo sapiens
tctgccctgcctgagg

SEQ ID NO: 4360644 - DNA, 17 bp, Homo sapiens
tctgccctgcctgagga

SEQ ID NO: 4360645 - DNA, 18 bp, Homo sapiens
tctgccctgcctgaggag

SEQ ID NO: 4360646 - DNA, 19 bp, Homo sapiens
tcaggcataggcctgggtg

SEQ ID NO: 4360647 - DNA, 22 bp, Homo sapiens
tcaggtacagaaaacatgttta

SEQ ID NO: 4360648 - DNA, 20 bp, Homo sapiens
tcagtatgctttccctgagg

SEQ ID NO: 4360649 - DNA, 14 bp, Homo sapiens
tcataacaatgtct

SEQ ID NO: 4360650 - DNA, 15 bp, Homo sapiens
tcatccaatcctcac

SEQ ID NO: 4360651 - DNA, 19 bp, Homo sapiens
tcatccaatcctcactggg

SEQ ID NO: 4360652 - DNA, 13 bp, Homo sapiens
tcatctccatcag

SEQ ID NO: 4360653 - DNA, 16 bp, Homo sapiens
tcatgaagcaggaggc

SEQ ID NO: 4360654 - DNA, 20 bp, Homo sapiens
tcatggtcaagttcccaact

SEQ ID NO: 4360655 - DNA, 20 bp, Homo sapiens
tacaatcatggtcaagttcc

SEQ ID NO: 4360656 - DNA, 14 bp, Homo sapiens
tacaatggtttatt

SEQ ID NO: 4360657 - DNA, 20 bp, Homo sapiens
tacaatggtttattcccaag

SEQ ID NO: 4360658 - DNA, 17 bp, Homo sapiens
tacacgtctggaccccg

SEQ ID NO: 4360659 - DNA, 19 bp, Homo sapiens
tacactgaatggaaataaa

SEQ ID NO: 4360660 - DNA, 15 bp, Homo sapiens
tacagaaaacatgtt

SEQ ID NO: 4360661 - DNA, 14 bp, Homo sapiens
tacagacttctcca

SEQ ID NO: 4360662 - DNA, 15 bp, Homo sapiens
tacagacttctccag

SEQ ID NO: 4360663 - DNA, 17 bp, Homo sapiens
tacaggctaaaattagt

SEQ ID NO: 4360664 - DNA, 21 bp, Homo sapiens
tacatatggaaatgttactgt

SEQ ID NO: 4360665 - DNA, 17 bp, Homo sapiens
tacatcagaagtttgca

SEQ ID NO: 4360666 - DNA, 13 bp, Homo sapiens
tacattgtcctgt

SEQ ID NO: 4360667 - DNA, 15 bp, Homo sapiens
tacatttaggataat

SEQ ID NO: 4360668 - DNA, 23 bp, Homo sapiens
ggggctcctgaatatcagtcact

SEQ ID NO: 4360669 - DNA, 17 bp, Homo sapiens
gggggaatgcacctccc

SEQ ID NO: 4360670 - DNA, 14 bp, Homo sapiens
ggggtacaggcagt

SEQ ID NO: 4360671 - DNA, 18 bp, Homo sapiens
ggggtccatccccttccc

SEQ ID NO: 4360672 - DNA, 19 bp, Homo sapiens
gggtcccccctgagtgggc

SEQ ID NO: 4360673 - DNA, 14 bp, Homo sapiens
gggtctcgcagcct

SEQ ID NO: 4360674 - DNA, 18 bp, Homo sapiens
gggtctgcgcttggtctt

SEQ ID NO: 4360675 - DNA, 14 bp, Homo sapiens
gggtctgtgactgg

SEQ ID NO: 4360676 - DNA, 15 bp, Homo sapiens
gggtgaggaccactc

SEQ ID NO: 4360677 - DNA, 19 bp, Homo sapiens
gggtgctggctgcccagac

SEQ ID NO: 4360678 - DNA, 13 bp, Homo sapiens
gggtggtcctgac

SEQ ID NO: 4360679 - DNA, 14 bp, Homo sapiens
gggttctgccctgc

SEQ ID NO: 4360680 - DNA, 15 bp, Homo sapiens
gggttctttggaagc

SEQ ID NO: 4360681 - DNA, 13 bp, Homo sapiens
ggtaatatacctg

SEQ ID NO: 4360682 - DNA, 18 bp, Homo sapiens
ggtaatatacctggttta

SEQ ID NO: 4360683 - DNA, 20 bp, Homo sapiens
ggtacagaaaacatgtttaa

SEQ ID NO: 4360684 - DNA, 21 bp, Homo sapiens
ggtacaggcagttaggtgctg

SEQ ID NO: 4360685 - DNA, 18 bp, Homo sapiens
ggtacatggtgtttgtgg

SEQ ID NO: 4360686 - DNA, 16 bp, Homo sapiens
ggtaccaaacaaggaa

SEQ ID NO: 4360687 - DNA, 18 bp, Homo sapiens
ggtattccttttgtgtac

SEQ ID NO: 4360688 - DNA, 18 bp, Homo sapiens
ggtcaagttcccaactga

SEQ ID NO: 4360689 - DNA, 23 bp, Homo sapiens
ggtccatccccttcccccatccc

SEQ ID NO: 4360690 - DNA, 16 bp, Homo sapiens
ggagactcctggtctg

SEQ ID NO: 4360691 - DNA, 16 bp, Homo sapiens
ggagagcagcaggtgc

SEQ ID NO: 4360692 - DNA, 18 bp, Homo sapiens
ggagagcagcaggtgctg

SEQ ID NO: 4360693 - DNA, 21 bp, Homo sapiens
ggagaggttataggtcactcc

SEQ ID NO: 4360694 - DNA, 21 bp, Homo sapiens
ggagagtggcaggtgggctgc

SEQ ID NO: 4360695 - DNA, 11 bp, Homo sapiens
ggagccagggc

SEQ ID NO: 4360696 - DNA, 14 bp, Homo sapiens
ggagccagggcaga

SEQ ID NO: 4360697 - DNA, 21 bp, Homo sapiens
ggagccttgataatacttgac

SEQ ID NO: 4360698 - DNA, 18 bp, Homo sapiens
ggagctactgacattcct

SEQ ID NO: 4360699 - DNA, 21 bp, Homo sapiens
ggagcttagccaatgtgggag

SEQ ID NO: 4360700 - DNA, 20 bp, Homo sapiens
ggaggagccttgctgggcca

SEQ ID NO: 4360701 - DNA, 12 bp, Homo sapiens
ggaggaggacac

SEQ ID NO: 4360702 - DNA, 16 bp, Homo sapiens
ggaggaggacacagca

SEQ ID NO: 4360703 - DNA, 16 bp, Homo sapiens
ggaggaggaggagcct

SEQ ID NO: 4360704 - DNA, 19 bp, Homo sapiens
ggaggcccttgtcgtggga

SEQ ID NO: 4360705 - DNA, 21 bp, Homo sapiens
ggaggcccttgtcgtgggatg

SEQ ID NO: 4360706 - DNA, 21 bp, Homo sapiens
ggagggagttttgtctgtctc

SEQ ID NO: 4360707 - DNA, 17 bp, Homo sapiens
ggaggggtggtcctgac

SEQ ID NO: 4360708 - DNA, 15 bp, Homo sapiens
ggagttcaccttgga

SEQ ID NO: 4360709 - DNA, 19 bp, Homo sapiens
ggagttgacagtgaaacaa

SEQ ID NO: 4360710 - DNA, 14 bp, Homo sapiens
ggatagacttggga

SEQ ID NO: 4360711 - DNA, 15 bp, Homo sapiens
ggatctgctgaggcc

SEQ ID NO: 4360712 - DNA, 20 bp, Homo sapiens
ggatcttctatcattccaat

SEQ ID NO: 4360713 - DNA, 23 bp, Homo sapiens
ggatgaaggcaaaaactgtactg

SEQ ID NO: 4360714 - DNA, 17 bp, Homo sapiens
ggatggcatttggtctc

SEQ ID NO: 4360715 - DNA, 16 bp, Homo sapiens
ggatgttatgaacagc

SEQ ID NO: 4360716 - DNA, 12 bp, Homo sapiens
ggcaaataaaga

SEQ ID NO: 4360717 - DNA, 14 bp, Homo sapiens
ggcagaaagtggcc

SEQ ID NO: 4360718 - DNA, 19 bp, Homo sapiens
ggcagaatgaaaatcagca

SEQ ID NO: 4360719 - DNA, 15 bp, Homo sapiens
ggcagcaccacactg

SEQ ID NO: 4360720 - DNA, 17 bp, Homo sapiens
ggcagcaccacactggg

SEQ ID NO: 4360721 - DNA, 12 bp, Homo sapiens
ggcagccaccca

SEQ ID NO: 4360722 - DNA, 17 bp, Homo sapiens
ggcaggcttggggaaaa

SEQ ID NO: 4360723 - DNA, 13 bp, Homo sapiens
ggcagggctctga

SEQ ID NO: 4360724 - DNA, 18 bp, Homo sapiens
ggcaggtgggctgcctgc

SEQ ID NO: 4360725 - DNA, 23 bp, Homo sapiens
ggcaggtgggctgcctgctgtgt

SEQ ID NO: 4360726 - DNA, 22 bp, Homo sapiens
ggcagtctaagtgtaaatgtta

SEQ ID NO: 4360727 - DNA, 16 bp, Homo sapiens
ggcatctcctgtgcat

SEQ ID NO: 4360728 - DNA, 17 bp, Homo sapiens
ggcatctcctgtgcatg

SEQ ID NO: 4360729 - DNA, 21 bp, Homo sapiens
ggcatctcctgtgcatgggtg

SEQ ID NO: 4360730 - DNA, 20 bp, Homo sapiens
ggcatgtcccacccacccgc

SEQ ID NO: 4360731 - DNA, 16 bp, Homo sapiens
ggccagggtgggaaga

SEQ ID NO: 4360732 - DNA, 15 bp, Homo sapiens
ggccagtccccgagg

SEQ ID NO: 4360733 - DNA, 15 bp, Homo sapiens
ggccatgcaggaggt

SEQ ID NO: 4360734 - DNA, 14 bp, Homo sapiens
ggcccagtgccact

SEQ ID NO: 4360735 - DNA, 19 bp, Homo sapiens
ggcccagtgccactgcccc

SEQ ID NO: 4360736 - DNA, 18 bp, Homo sapiens
ggccccccgcacagccac

SEQ ID NO: 4360737 - DNA, 21 bp, Homo sapiens
ggccccctccccccagactct

SEQ ID NO: 4360738 - DNA, 18 bp, Homo sapiens
ggcccggccacacccagc

SEQ ID NO: 4360739 - DNA, 15 bp, Homo sapiens
ggcccgtcatgttcc

SEQ ID NO: 4360740 - DNA, 16 bp, Homo sapiens
ggccctctgtccacat

SEQ ID NO: 4360741 - DNA, 11 bp, Homo sapiens
ggccctggagc

SEQ ID NO: 4360742 - DNA, 13 bp, Homo sapiens
ggccctggagcca

SEQ ID NO: 4360743 - DNA, 14 bp, Homo sapiens
ggccctggagccag

SEQ ID NO: 4360744 - DNA, 17 bp, Homo sapiens
ggccgaagccccttgga

SEQ ID NO: 4360745 - DNA, 18 bp, Homo sapiens
ggccgaagccccttggag

SEQ ID NO: 4360746 - DNA, 17 bp, Homo sapiens
ggccggggtccaggccc

SEQ ID NO: 4360747 - DNA, 22 bp, Homo sapiens
ggcctcaaagttggggcaggct

SEQ ID NO: 4360748 - DNA, 20 bp, Homo sapiens
ggcctccatgccccagctct

SEQ ID NO: 4360749 - DNA, 16 bp, Homo sapiens
ggcctgtccaccctgc

SEQ ID NO: 4360750 - DNA, 18 bp, Homo sapiens
ggcgcaaaggtgcctcat

SEQ ID NO: 4360751 - DNA, 11 bp, Homo sapiens
ggcgggccagg

SEQ ID NO: 4360752 - DNA, 20 bp, Homo sapiens
ggcgggccagggtgggaaga

SEQ ID NO: 4360753 - DNA, 23 bp, Homo sapiens
ggcgggccagggtgggaagagaa

SEQ ID NO: 4360754 - DNA, 22 bp, Homo sapiens
ggcgttctaggtaggaagagcc

SEQ ID NO: 4360755 - DNA, 16 bp, Homo sapiens
ggctcagagctttgtc

SEQ ID NO: 4360756 - DNA, 14 bp, Homo sapiens
ggctcagcccgctg

SEQ ID NO: 4360757 - DNA, 16 bp, Homo sapiens
ggctcagggttggcca

SEQ ID NO: 4360758 - DNA, 22 bp, Homo sapiens
ggctcagggttggccatttgct

SEQ ID NO: 4360759 - DNA, 22 bp, Homo sapiens
ggctgacatgaagctgttgtgt

SEQ ID NO: 4360760 - DNA, 13 bp, Homo sapiens
ggctgcctcagcc

SEQ ID NO: 4360761 - DNA, 18 bp, Homo sapiens
ggctgcctcagccagtgg

SEQ ID NO: 4360762 - DNA, 18 bp, Homo sapiens
ggctgggccctctgtcca

SEQ ID NO: 4360763 - DNA, 19 bp, Homo sapiens
ggctgggcctcgtgcgccc

SEQ ID NO: 4360764 - DNA, 11 bp, Homo sapiens
ggctgtgagtg

SEQ ID NO: 4360765 - DNA, 14 bp, Homo sapiens
ggctgtgtacttta

SEQ ID NO: 4360766 - DNA, 19 bp, Homo sapiens
gggaaaccttggagaggag

SEQ ID NO: 4360767 - DNA, 20 bp, Homo sapiens
gggaacatgacccagcctga

SEQ ID NO: 4360768 - DNA, 13 bp, Homo sapiens
gggaaggagccca

SEQ ID NO: 4360769 - DNA, 18 bp, Homo sapiens
gggaatgcacctccccaa

SEQ ID NO: 4360770 - DNA, 14 bp, Homo sapiens
gggacaccagagct

SEQ ID NO: 4360771 - DNA, 22 bp, Homo sapiens
gggatcagccccgcctgtcaca

SEQ ID NO: 4360772 - DNA, 23 bp, Homo sapiens
gggatcagccccgcctgtcacaa

SEQ ID NO: 4360773 - DNA, 22 bp, Homo sapiens
gggatggcatttggtctcaggc

SEQ ID NO: 4360774 - DNA, 15 bp, Homo sapiens
gggcagaaagtggcc

SEQ ID NO: 4360775 - DNA, 12 bp, Homo sapiens
gggcaggcttgg

SEQ ID NO: 4360776 - DNA, 14 bp, Homo sapiens
gggccaggaccatg

SEQ ID NO: 4360777 - DNA, 17 bp, Homo sapiens
gggccagggtgggaaga

SEQ ID NO: 4360778 - DNA, 15 bp, Homo sapiens
gggcctgcatggaga

SEQ ID NO: 4360779 - DNA, 12 bp, Homo sapiens
gggcgggccagg

SEQ ID NO: 4360780 - DNA, 13 bp, Homo sapiens
gggcgggccaggg

SEQ ID NO: 4360781 - DNA, 14 bp, Homo sapiens
gggcgggctcagag

SEQ ID NO: 4360782 - DNA, 15 bp, Homo sapiens
gggcgggctcagagc

SEQ ID NO: 4360783 - DNA, 21 bp, Homo sapiens
ggggaaaatggccatgcagga

SEQ ID NO: 4360784 - DNA, 15 bp, Homo sapiens
ggggacaccagagct

SEQ ID NO: 4360785 - DNA, 15 bp, Homo sapiens
ggggcgggccagggt

SEQ ID NO: 4360786 - DNA, 14 bp, Homo sapiens
ggggcgggctcaga

SEQ ID NO: 4360787 - DNA, 14 bp, Homo sapiens
ctgactcctgggtg

SEQ ID NO: 4360788 - DNA, 21 bp, Homo sapiens
ctgaggaggaggacacagcac

SEQ ID NO: 4360789 - DNA, 21 bp, Homo sapiens
ctgaggtctcttgagggagct

SEQ ID NO: 4360790 - DNA, 19 bp, Homo sapiens
ctgatattccatgaatgta

SEQ ID NO: 4360791 - DNA, 23 bp, Homo sapiens
ctgatgcatacggctatattggt

SEQ ID NO: 4360792 - DNA, 23 bp, Homo sapiens
ctgcacagatggatttgcctgtg

SEQ ID NO: 4360793 - DNA, 21 bp, Homo sapiens
ctgcacaggcacacagggccc

SEQ ID NO: 4360794 - DNA, 15 bp, Homo sapiens
ctgcaggacattaat

SEQ ID NO: 4360795 - DNA, 22 bp, Homo sapiens
ctgcagtttggccctggagcca

SEQ ID NO: 4360796 - DNA, 21 bp, Homo sapiens
ctgcatactttgacaaggaaa

SEQ ID NO: 4360797 - DNA, 13 bp, Homo sapiens
ctgcatggagaag

SEQ ID NO: 4360798 - DNA, 13 bp, Homo sapiens
ctgccaaacacat

SEQ ID NO: 4360799 - DNA, 16 bp, Homo sapiens
ctgccaaataaatcat

SEQ ID NO: 4360800 - DNA, 23 bp, Homo sapiens
ctgccaccggaggtcactccacc

SEQ ID NO: 4360801 - DNA, 20 bp, Homo sapiens
ctgccatccttgctgcagct

SEQ ID NO: 4360802 - DNA, 17 bp, Homo sapiens
ctgcccacatttgggct

SEQ ID NO: 4360803 - DNA, 19 bp, Homo sapiens
ctgcccacatttgggctca

SEQ ID NO: 4360804 - DNA, 21 bp, Homo sapiens
ctgcccacatttgggctcagg

SEQ ID NO: 4360805 - DNA, 22 bp, Homo sapiens
ctgcccacatttgggctcaggg

SEQ ID NO: 4360806 - DNA, 18 bp, Homo sapiens
ctgccccccgaggctgct

SEQ ID NO: 4360807 - DNA, 16 bp, Homo sapiens
ctgccctgcctgagga

SEQ ID NO: 4360808 - DNA, 17 bp, Homo sapiens
ctgccctgcctgaggag

SEQ ID NO: 4360809 - DNA, 15 bp, Homo sapiens
ctgccgacttggaga

SEQ ID NO: 4360810 - DNA, 22 bp, Homo sapiens
ctgccgacttggagactcctgg

SEQ ID NO: 4360811 - DNA, 21 bp, Homo sapiens
ctgccggtgggaccctgtccg

SEQ ID NO: 4360812 - DNA, 13 bp, Homo sapiens
ctgcctcagccag

SEQ ID NO: 4360813 - DNA, 21 bp, Homo sapiens
ctgcctccctggggaccagga

SEQ ID NO: 4360814 - DNA, 23 bp, Homo sapiens
ctgcctccctggggaccaggagc

SEQ ID NO: 4360815 - DNA, 14 bp, Homo sapiens
ctgcctgaggagga

SEQ ID NO: 4360816 - DNA, 21 bp, Homo sapiens
ctgcctgaggaggaggacaca

SEQ ID NO: 4360817 - DNA, 16 bp, Homo sapiens
ctgctctcagcctccc

SEQ ID NO: 4360818 - DNA, 13 bp, Homo sapiens
ctgctctggtggc

SEQ ID NO: 4360819 - DNA, 17 bp, Homo sapiens
ctgctgaggcccagtgc

SEQ ID NO: 4360820 - DNA, 19 bp, Homo sapiens
ctgctgaggcccagtgcat

SEQ ID NO: 4360821 - DNA, 23 bp, Homo sapiens
ctgctgcctccctggggaccagg

SEQ ID NO: 4360822 - DNA, 19 bp, Homo sapiens
ctgctggctgcggccccct

SEQ ID NO: 4360823 - DNA, 23 bp, Homo sapiens
ctggaaaactattgagccttgca

SEQ ID NO: 4360824 - DNA, 20 bp, Homo sapiens
ctggaaaccttccacccagt

SEQ ID NO: 4360825 - DNA, 16 bp, Homo sapiens
ctggactgaagcctgc

SEQ ID NO: 4360826 - DNA, 23 bp, Homo sapiens
ctggactgaagcctgcaggagtt

SEQ ID NO: 4360827 - DNA, 16 bp, Homo sapiens
ctggacttacaaaatg

SEQ ID NO: 4360828 - DNA, 15 bp, Homo sapiens
ctggagccagggcag

SEQ ID NO: 4360829 - DNA, 19 bp, Homo sapiens
ctggagccagggcagagga

SEQ ID NO: 4360830 - DNA, 23 bp, Homo sapiens
ctggagctgtccttcattccgtt

SEQ ID NO: 4360831 - DNA, 19 bp, Homo sapiens
ctggaggaagccagtgggg

SEQ ID NO: 4360832 - DNA, 13 bp, Homo sapiens
ctggatgaaggca

SEQ ID NO: 4360833 - DNA, 12 bp, Homo sapiens
ctggccaggatg

SEQ ID NO: 4360834 - DNA, 21 bp, Homo sapiens
ctggcccgtcatgttcctcaa

SEQ ID NO: 4360835 - DNA, 16 bp, Homo sapiens
ctgggaacatgaccca

SEQ ID NO: 4360836 - DNA, 20 bp, Homo sapiens
ctgggaagataggctctgca

SEQ ID NO: 4360837 - DNA, 22 bp, Homo sapiens
ctgggaagataggctctgcaca

SEQ ID NO: 4360838 - DNA, 22 bp, Homo sapiens
ctgggaatgtattattctgcag

SEQ ID NO: 4360839 - DNA, 12 bp, Homo sapiens
ctgggcagggtg

SEQ ID NO: 4360840 - DNA, 13 bp, Homo sapiens
ctgggcagggtga

SEQ ID NO: 4360841 - DNA, 14 bp, Homo sapiens
ctgggcccctgcac

SEQ ID NO: 4360842 - DNA, 20 bp, Homo sapiens
ctgggcccctgcacaggcac

SEQ ID NO: 4360843 - DNA, 18 bp, Homo sapiens
ctgggctctccctgcacg

SEQ ID NO: 4360844 - DNA, 19 bp, Homo sapiens
ctgggtgcgtctccagtca

SEQ ID NO: 4360845 - DNA, 17 bp, Homo sapiens
ctggtagagacccccag

SEQ ID NO: 4360846 - DNA, 22 bp, Homo sapiens
ctggtagagacccccaggcctg

SEQ ID NO: 4360847 - DNA, 11 bp, Homo sapiens
ctggtctgtga

SEQ ID NO: 4360848 - DNA, 17 bp, Homo sapiens
ctggtggcttaagtgag

SEQ ID NO: 4360849 - DNA, 13 bp, Homo sapiens
ctggttgcctccc

SEQ ID NO: 4360850 - DNA, 19 bp, Homo sapiens
ctggttgcctcccccgcct

SEQ ID NO: 4360851 - DNA, 14 bp, Homo sapiens
ctggttgtcatttt

SEQ ID NO: 4360852 - DNA, 17 bp, Homo sapiens
ctgtaagaagagactgg

SEQ ID NO: 4360853 - DNA, 22 bp, Homo sapiens
ctgtaagaagagactgggaaga

SEQ ID NO: 4360854 - DNA, 19 bp, Homo sapiens
ctgtagggaaaccttggag

SEQ ID NO: 4360855 - DNA, 15 bp, Homo sapiens
ctgtagttacattta

SEQ ID NO: 4360856 - DNA, 20 bp, Homo sapiens
ctgtcacaataaagtttatt

SEQ ID NO: 4360857 - DNA, 16 bp, Homo sapiens
ctgtccaccctgccaa

SEQ ID NO: 4360858 - DNA, 17 bp, Homo sapiens
ctgtccggcccagtgcc

SEQ ID NO: 4360859 - DNA, 19 bp, Homo sapiens
ctgtctaggactgcagtgt

SEQ ID NO: 4360860 - DNA, 22 bp, Homo sapiens
ctgtctccctcccctctcagaa

SEQ ID NO: 4360861 - DNA, 13 bp, Homo sapiens
ctgtctgactaca

SEQ ID NO: 4360862 - DNA, 21 bp, Homo sapiens
gcccccaaattgccttcagcc

SEQ ID NO: 4360863 - DNA, 16 bp, Homo sapiens
gccccccgaggctgct

SEQ ID NO: 4360864 - DNA, 22 bp, Homo sapiens
gccccccgcacagccacccgtg

SEQ ID NO: 4360865 - DNA, 15 bp, Homo sapiens
gcccccgcctgccac

SEQ ID NO: 4360866 - DNA, 20 bp, Homo sapiens
gccccctccccccagactct

SEQ ID NO: 4360867 - DNA, 12 bp, Homo sapiens
gccccctctcgg

SEQ ID NO: 4360868 - DNA, 16 bp, Homo sapiens
gcccctgcacaggcac

SEQ ID NO: 4360869 - DNA, 19 bp, Homo sapiens
gcccctgcagtttggccct

SEQ ID NO: 4360870 - DNA, 23 bp, Homo sapiens
gcccctgcagtttggccctggag

SEQ ID NO: 4360871 - DNA, 14 bp, Homo sapiens
gccccttggagaga

SEQ ID NO: 4360872 - DNA, 20 bp, Homo sapiens
gcccgcaggaactgggctgg

SEQ ID NO: 4360873 - DNA, 13 bp, Homo sapiens
gcccgcagggcca

SEQ ID NO: 4360874 - DNA, 19 bp, Homo sapiens
gcccgcagggccatgcaga

SEQ ID NO: 4360875 - DNA, 15 bp, Homo sapiens
gcccgctgagtgggg

SEQ ID NO: 4360876 - DNA, 22 bp, Homo sapiens
gcccggccacacccagcggccc

SEQ ID NO: 4360877 - DNA, 17 bp, Homo sapiens
gcccgtggggtctgcgc

SEQ ID NO: 4360878 - DNA, 16 bp, Homo sapiens
gccctcttaagatctg

SEQ ID NO: 4360879 - DNA, 11 bp, Homo sapiens
gccctgcctga

SEQ ID NO: 4360880 - DNA, 13 bp, Homo sapiens
gccctgcctgagg

SEQ ID NO: 4360881 - DNA, 16 bp, Homo sapiens
gccctgcctgaggagg

SEQ ID NO: 4360882 - DNA, 17 bp, Homo sapiens
gccctgcctgaggagga

SEQ ID NO: 4360883 - DNA, 16 bp, Homo sapiens
gccctggagccagggc

SEQ ID NO: 4360884 - DNA, 18 bp, Homo sapiens
gcccttgtcgtgggatgg

SEQ ID NO: 4360885 - DNA, 16 bp, Homo sapiens
gccggggtccaggccc

SEQ ID NO: 4360886 - DNA, 20 bp, Homo sapiens
gccggggtccaggcccgtgg

SEQ ID NO: 4360887 - DNA, 21 bp, Homo sapiens
gcctagttcatccaatcctca

SEQ ID NO: 4360888 - DNA, 19 bp, Homo sapiens
gcctcagccagtggcacag

SEQ ID NO: 4360889 - DNA, 17 bp, Homo sapiens
gcctcatagcatagcca

SEQ ID NO: 4360890 - DNA, 16 bp, Homo sapiens
gcctccagtcatggta

SEQ ID NO: 4360891 - DNA, 13 bp, Homo sapiens
gcctcccacggca

SEQ ID NO: 4360892 - DNA, 14 bp, Homo sapiens
gcctcccccgcctc

SEQ ID NO: 4360893 - DNA, 22 bp, Homo sapiens
gcctccctggggaccaggagct

SEQ ID NO: 4360894 - DNA, 15 bp, Homo sapiens
gcctcgttggagagc

SEQ ID NO: 4360895 - DNA, 16 bp, Homo sapiens
gcctcgttggagagca

SEQ ID NO: 4360896 - DNA, 16 bp, Homo sapiens
gcctctggaaaactat

SEQ ID NO: 4360897 - DNA, 19 bp, Homo sapiens
gcctctggttgcctccccc

SEQ ID NO: 4360898 - DNA, 22 bp, Homo sapiens
gcctctggttgcctcccccgcc

SEQ ID NO: 4360899 - DNA, 22 bp, Homo sapiens
gcctgaaagatacaggggatca

SEQ ID NO: 4360900 - DNA, 13 bp, Homo sapiens
gcctgaactccag

SEQ ID NO: 4360901 - DNA, 15 bp, Homo sapiens
gcctgactcctgggt

SEQ ID NO: 4360902 - DNA, 10 bp, Homo sapiens
gcctgaggag

SEQ ID NO: 4360903 - DNA, 19 bp, Homo sapiens
gcctgaggaggaggacaca

SEQ ID NO: 4360904 - DNA, 14 bp, Homo sapiens
gcctgctggctgcg

SEQ ID NO: 4360905 - DNA, 18 bp, Homo sapiens
gcctggattccagcagtg

SEQ ID NO: 4360906 - DNA, 23 bp, Homo sapiens
gcctgggaatgtattattctgca

SEQ ID NO: 4360907 - DNA, 15 bp, Homo sapiens
gcctgtcacaataaa

SEQ ID NO: 4360908 - DNA, 21 bp, Homo sapiens
gcctgtccaccctgccaagac

SEQ ID NO: 4360909 - DNA, 16 bp, Homo sapiens
gccttaagcagaacaa

SEQ ID NO: 4360910 - DNA, 20 bp, Homo sapiens
gccttaagcagaacaaatgt

SEQ ID NO: 4360911 - DNA, 22 bp, Homo sapiens
gccttaataaatatgtaatata

SEQ ID NO: 4360912 - DNA, 18 bp, Homo sapiens
gccttgcatgtacttgaa

SEQ ID NO: 4360913 - DNA, 17 bp, Homo sapiens
gccttgctgggccaggg

SEQ ID NO: 4360914 - DNA, 22 bp, Homo sapiens
gcgaactgggttctttggaagc

SEQ ID NO: 4360915 - DNA, 14 bp, Homo sapiens
gcgcaaaggtgcct

SEQ ID NO: 4360916 - DNA, 18 bp, Homo sapiens
gcgcagtgcttctctaca

SEQ ID NO: 4360917 - DNA, 20 bp, Homo sapiens
gcggccccccgcacagccac

SEQ ID NO: 4360918 - DNA, 23 bp, Homo sapiens
gcgggacgagaccctacaggaga

SEQ ID NO: 4360919 - DNA, 13 bp, Homo sapiens
gcgggctcagagc

SEQ ID NO: 4360920 - DNA, 16 bp, Homo sapiens
gcgggctcagagcttt

SEQ ID NO: 4360921 - DNA, 14 bp, Homo sapiens
gcggtttggggagc

SEQ ID NO: 4360922 - DNA, 22 bp, Homo sapiens
gcgtgtgggtcccgcactctgc

SEQ ID NO: 4360923 - DNA, 17 bp, Homo sapiens
gcgtgttcagcagaacc

SEQ ID NO: 4360924 - DNA, 19 bp, Homo sapiens
gctagagtttgaaaaacta

SEQ ID NO: 4360925 - DNA, 12 bp, Homo sapiens
gctagttctgct

SEQ ID NO: 4360926 - DNA, 14 bp, Homo sapiens
gctatcctgcagga

SEQ ID NO: 4360927 - DNA, 15 bp, Homo sapiens
gctcagagctaggcc

SEQ ID NO: 4360928 - DNA, 11 bp, Homo sapiens
gctcagagctt

SEQ ID NO: 4360929 - DNA, 13 bp, Homo sapiens
gctccagattctg

SEQ ID NO: 4360930 - DNA, 11 bp, Homo sapiens
gctcctcaccc

SEQ ID NO: 4360931 - DNA, 21 bp, Homo sapiens
gctctgatattccatgaatgt

SEQ ID NO: 4360932 - DNA, 16 bp, Homo sapiens
gctctggatgaaggca

SEQ ID NO: 4360933 - DNA, 17 bp, Homo sapiens
gctctggatgaaggcaa

SEQ ID NO: 4360934 - DNA, 22 bp, Homo sapiens
gctctggtggcttaagtgagca

SEQ ID NO: 4360935 - DNA, 16 bp, Homo sapiens
gctgaatgaagctgcc

SEQ ID NO: 4360936 - DNA, 21 bp, Homo sapiens
gctgaatgaagctgccatcct

SEQ ID NO: 4360937 - DNA, 24 bp, Homo sapiens
gctgaatttccctctctcataccc

SEQ ID NO: 4360938 - DNA, 21 bp, Homo sapiens
gctgcatactttgacaaggaa

SEQ ID NO: 4360939 - DNA, 14 bp, Homo sapiens
gctgcctcagccag

SEQ ID NO: 4360940 - DNA, 14 bp, Homo sapiens
gctgcctccctggg

SEQ ID NO: 4360941 - DNA, 15 bp, Homo sapiens
gctgctgcaggacat

SEQ ID NO: 4360942 - DNA, 16 bp, Homo sapiens
gctgctgcaggacatt

SEQ ID NO: 4360943 - DNA, 17 bp, Homo sapiens
gctgctgcctccctggg

SEQ ID NO: 4360944 - DNA, 14 bp, Homo sapiens
gctggatagacttg

SEQ ID NO: 4360945 - DNA, 17 bp, Homo sapiens
gctggctgcggccccct

SEQ ID NO: 4360946 - DNA, 21 bp, Homo sapiens
gctgggaacatgacccagcct

SEQ ID NO: 4360947 - DNA, 15 bp, Homo sapiens
gctgggccagggaaa

SEQ ID NO: 4360948 - DNA, 15 bp, Homo sapiens
gctgggcccctgcac

SEQ ID NO: 4360949 - DNA, 20 bp, Homo sapiens
gctgggcccctgcacaggca

SEQ ID NO: 4360950 - DNA, 13 bp, Homo sapiens
gctgggccctctg

SEQ ID NO: 4360951 - DNA, 18 bp, Homo sapiens
gctggtagagacccccag

SEQ ID NO: 4360952 - DNA, 18 bp, Homo sapiens
gcttatcaactaatgatt

SEQ ID NO: 4360953 - DNA, 17 bp, Homo sapiens
gcttcagcatatttata

SEQ ID NO: 4360954 - DNA, 14 bp, Homo sapiens
gcttctctacagac

SEQ ID NO: 4360955 - DNA, 12 bp, Homo sapiens
aaaaaatattaa

SEQ ID NO: 4360956 - DNA, 14 bp, Homo sapiens
aaaaactgtactgt

SEQ ID NO: 4360957 - DNA, 23 bp, Homo sapiens
aaaaatcgatgagcgccacctct

SEQ ID NO: 4360958 - DNA, 12 bp, Homo sapiens
aaaaatgctgct

SEQ ID NO: 4360959 - DNA, 14 bp, Homo sapiens
aaaagcaaatgaga

SEQ ID NO: 4360960 - DNA, 21 bp, Homo sapiens
aaaagtgatcaataaaatgtg

SEQ ID NO: 4360961 - DNA, 21 bp, Homo sapiens
aaaagttggaaggatctgctg

SEQ ID NO: 4360962 - DNA, 20 bp, Homo sapiens
aaaagttttttattatgcat

SEQ ID NO: 4360963 - DNA, 15 bp, Homo sapiens
aaaatactatattaa

SEQ ID NO: 4360964 - DNA, 15 bp, Homo sapiens
aaaatatttttaaat

SEQ ID NO: 4360965 - DNA, 16 bp, Homo sapiens
aaaatatttttaaatg

SEQ ID NO: 4360966 - DNA, 18 bp, Homo sapiens
aaaatatttttaaatgga

SEQ ID NO: 4360967 - DNA, 23 bp, Homo sapiens
aaaatctatatttgtcttccgat

SEQ ID NO: 4360968 - DNA, 19 bp, Homo sapiens
aaaatgaaagcatgtctca

SEQ ID NO: 4360969 - DNA, 16 bp, Homo sapiens
aaaatgaacattttgt

SEQ ID NO: 4360970 - DNA, 20 bp, Homo sapiens
aaaatgaggaatccaaaaga

SEQ ID NO: 4360971 - DNA, 13 bp, Homo sapiens
aaaatttgaaact

SEQ ID NO: 4360972 - DNA, 16 bp, Homo sapiens
aaaattttaagtatct

SEQ ID NO: 4360973 - DNA, 17 bp, Homo sapiens
aaacaaaattgttcttg

SEQ ID NO: 4360974 - DNA, 16 bp, Homo sapiens
aaacaaggaagccaaa

SEQ ID NO: 4360975 - DNA, 16 bp, Homo sapiens
aaacacccctctgtct

SEQ ID NO: 4360976 - DNA, 12 bp, Homo sapiens
aaacatgttgat

SEQ ID NO: 4360977 - DNA, 19 bp, Homo sapiens
aaacatgtttaaatagcct

SEQ ID NO: 4360978 - DNA, 23 bp, Homo sapiens
aaaccaagccattaatgagatgt

SEQ ID NO: 4360979 - DNA, 12 bp, Homo sapiens
aaaccacagctg

SEQ ID NO: 4360980 - DNA, 13 bp, Homo sapiens
aaaccacagctgg

SEQ ID NO: 4360981 - DNA, 14 bp, Homo sapiens
aaacctactgccca

SEQ ID NO: 4360982 - DNA, 17 bp, Homo sapiens
aaacctactgcccacat

SEQ ID NO: 4360983 - DNA, 16 bp, Homo sapiens
aaactaacaagattaa

SEQ ID NO: 4360984 - DNA, 16 bp, Homo sapiens
aaactacaaagtaaaa

SEQ ID NO: 4360985 - DNA, 17 bp, Homo sapiens
aaactattgagccttgc

SEQ ID NO: 4360986 - DNA, 21 bp, Homo sapiens
aaactcactcagtaaaacata

SEQ ID NO: 4360987 - DNA, 14 bp, Homo sapiens
aaactgtactgtgt

SEQ ID NO: 4360988 - DNA, 20 bp, Homo sapiens
aaactgtgtggactgtgatg

SEQ ID NO: 4360989 - DNA, 17 bp, Homo sapiens
aaacttaaaataaaatt

SEQ ID NO: 4360990 - DNA, 21 bp, Homo sapiens
aaactttagagtagcatgaga

SEQ ID NO: 4360991 - DNA, 18 bp, Homo sapiens
aaactttgtagaaagcaa

SEQ ID NO: 4360992 - DNA, 17 bp, Homo sapiens
aaagaatttttttgtct

SEQ ID NO: 4360993 - DNA, 19 bp, Homo sapiens
aaagacaaaaatcaaagaa

SEQ ID NO: 4360994 - DNA, 16 bp, Homo sapiens
aaagatcaccttgtat

SEQ ID NO: 4360995 - DNA, 20 bp, Homo sapiens
aaagatccagggatggagat

SEQ ID NO: 4360996 - DNA, 20 bp, Homo sapiens
aaagcactacaatcatggtc

SEQ ID NO: 4360997 - DNA, 20 bp, Homo sapiens
aaagcagcaggcctctggtt

SEQ ID NO: 4360998 - DNA, 15 bp, Homo sapiens
aaagcatccctcacc

SEQ ID NO: 4360999 - DNA, 16 bp, Homo sapiens
aaagcggagaaacatg

SEQ ID NO: 4361000 - DNA, 20 bp, Homo sapiens
aaaggcagccctcacctctg

SEQ ID NO: 4361001 - DNA, 22 bp, Homo sapiens
aaaggcagccctcacctctgag

SEQ ID NO: 4361002 - DNA, 20 bp, Homo sapiens
aaagggcagggcatctcctg

SEQ ID NO: 4361003 - DNA, 15 bp, Homo sapiens
aaaggtgcctcatag

SEQ ID NO: 4361004 - DNA, 13 bp, Homo sapiens
aaagtaaaatgaa

SEQ ID NO: 4361005 - DNA, 12 bp, Homo sapiens
aaagttgctttt

SEQ ID NO: 4361006 - DNA, 16 bp, Homo sapiens
aaagtttacattgtcc

SEQ ID NO: 4361007 - DNA, 19 bp, Homo sapiens
aaagtttacattgtcctgt

SEQ ID NO: 4361008 - DNA, 16 bp, Homo sapiens
aaataaaagtgatcaa

SEQ ID NO: 4361009 - DNA, 15 bp, Homo sapiens
aaataagttgtttca

SEQ ID NO: 4361010 - DNA, 16 bp, Homo sapiens
aaatagacagtatatt

SEQ ID NO: 4361011 - DNA, 13 bp, Homo sapiens
aaatagcagagcc

SEQ ID NO: 4361012 - DNA, 12 bp, Homo sapiens
aaatatgtaata

SEQ ID NO: 4361013 - DNA, 21 bp, Homo sapiens
aaatatgtaatataaatttaa

SEQ ID NO: 4361014 - DNA, 14 bp, Homo sapiens
aaatatttttaaat

SEQ ID NO: 4361015 - DNA, 13 bp, Homo sapiens
aaatcaactttta

SEQ ID NO: 4361016 - DNA, 15 bp, Homo sapiens
aaatcatcctcatgt

SEQ ID NO: 4361017 - DNA, 17 bp, Homo sapiens
aaatcctttttctttat

SEQ ID NO: 4361018 - DNA, 20 bp, Homo sapiens
aaatcgatgagcgccacctc

SEQ ID NO: 4361019 - DNA, 11 bp, Homo sapiens
aaatctatatt

SEQ ID NO: 4361020 - DNA, 14 bp, Homo sapiens
aaatgaaaatttta

SEQ ID NO: 4361021 - DNA, 19 bp, Homo sapiens
aaatgaggaatccaaaaga

SEQ ID NO: 4361022 - DNA, 18 bp, Homo sapiens
aaatgattcaaattgctg

SEQ ID NO: 4361023 - DNA, 19 bp, Homo sapiens
aatatttccttaaactgtg

SEQ ID NO: 4361024 - DNA, 21 bp, Homo sapiens
aatatttccttaaactgtgtg

SEQ ID NO: 4361025 - DNA, 20 bp, Homo sapiens
aatcaactttatcatatgct

SEQ ID NO: 4361026 - DNA, 20 bp, Homo sapiens
aatcagattgacagcatata

SEQ ID NO: 4361027 - DNA, 14 bp, Homo sapiens
aatcaggaaaaatg

SEQ ID NO: 4361028 - DNA, 16 bp, Homo sapiens
aatcaggtaagatcat

SEQ ID NO: 4361029 - DNA, 20 bp, Homo sapiens
aatcatggtcaagttcccaa

SEQ ID NO: 4361030 - DNA, 16 bp, Homo sapiens
aatccaaaagacaaaa

SEQ ID NO: 4361031 - DNA, 19 bp, Homo sapiens
aatccttttcccataaata

SEQ ID NO: 4361032 - DNA, 19 bp, Homo sapiens
aatctatatttgtcttccg

SEQ ID NO: 4361033 - DNA, 20 bp, Homo sapiens
aatctgcttggcaatagtta

SEQ ID NO: 4361034 - DNA, 23 bp, Homo sapiens
aatgaaaggaagtataaagtaac

SEQ ID NO: 4361035 - DNA, 21 bp, Homo sapiens
aatgaaataaaatttgaaact

SEQ ID NO: 4361036 - DNA, 15 bp, Homo sapiens
aatgaaatactgcct

SEQ ID NO: 4361037 - DNA, 23 bp, Homo sapiens
aatgaacattttgtggagtttgt

SEQ ID NO: 4361038 - DNA, 16 bp, Homo sapiens
aatgaataatttccca

SEQ ID NO: 4361039 - DNA, 22 bp, Homo sapiens
aatgacggtaagtgttctcatg

SEQ ID NO: 4361040 - DNA, 14 bp, Homo sapiens
aatgagacatccag

SEQ ID NO: 4361041 - DNA, 19 bp, Homo sapiens
aatgattcaaattgctgct

SEQ ID NO: 4361042 - DNA, 21 bp, Homo sapiens
aatgattcaaattgctgcttg

SEQ ID NO: 4361043 - DNA, 13 bp, Homo sapiens
aatgcacactagc

SEQ ID NO: 4361044 - DNA, 22 bp, Homo sapiens
aatgccaagggggtgactggaa

SEQ ID NO: 4361045 - DNA, 20 bp, Homo sapiens
aatgccgcgaactgggttct

SEQ ID NO: 4361046 - DNA, 22 bp, Homo sapiens
aatggactgtacaataagttac

SEQ ID NO: 4361047 - DNA, 23 bp, Homo sapiens
aatggccatgcaggaggtggaga

SEQ ID NO: 4361048 - DNA, 19 bp, Homo sapiens
aatggcgtctgctctggtg

SEQ ID NO: 4361049 - DNA, 19 bp, Homo sapiens
aatggggggcgggccaggg

SEQ ID NO: 4361050 - DNA, 20 bp, Homo sapiens
aatggggggcgggccagggt

SEQ ID NO: 4361051 - DNA, 17 bp, Homo sapiens
aatgtattattctgcag

SEQ ID NO: 4361052 - DNA, 18 bp, Homo sapiens
aatgttgccttggaaaca

SEQ ID NO: 4361053 - DNA, 21 bp, Homo sapiens
aattaggaagtgtaacagctg

SEQ ID NO: 4361054 - DNA, 22 bp, Homo sapiens
aattagttttaaaatactatat

SEQ ID NO: 4361055 - DNA, 22 bp, Homo sapiens
aattattttaataatgttgcct

SEQ ID NO: 4361056 - DNA, 21 bp, Homo sapiens
aattgtgcagtactttgtgca

SEQ ID NO: 4361057 - DNA, 21 bp, Homo sapiens
aattgtgtattgatgcaatat

SEQ ID NO: 4361058 - DNA, 23 bp, Homo sapiens
aattgtgtattgatgcaatataa

SEQ ID NO: 4361059 - DNA, 11 bp, Homo sapiens
aattgttcttg

SEQ ID NO: 4361060 - DNA, 21 bp, Homo sapiens
aatttacatcagaagtttgca

SEQ ID NO: 4361061 - DNA, 13 bp, Homo sapiens
aatttgtacaatg

SEQ ID NO: 4361062 - DNA, 16 bp, Homo sapiens
aatttgtacaatggtt

SEQ ID NO: 4361063 - DNA, 21 bp, Homo sapiens
aatttgtacaatggtttattc

SEQ ID NO: 4361064 - DNA, 17 bp, Homo sapiens
aattttaaataaaagtg

SEQ ID NO: 4361065 - DNA, 22 bp, Homo sapiens
acaaaaatgaaagcatgtctca

SEQ ID NO: 4361066 - DNA, 23 bp, Homo sapiens
acaaacctactgcccacatttgg

SEQ ID NO: 4361067 - DNA, 22 bp, Homo sapiens
acaaaggagccttgataatact

SEQ ID NO: 4361068 - DNA, 15 bp, Homo sapiens
acaaagtaaaatgaa

SEQ ID NO: 4361069 - DNA, 19 bp, Homo sapiens
acaaagtttacattgtcct

SEQ ID NO: 4361070 - DNA, 15 bp, Homo sapiens
acaaatttacatcag

SEQ ID NO: 4361071 - DNA, 18 bp, Homo sapiens
acaaccctgttttatact

SEQ ID NO: 4361072 - DNA, 16 bp, Homo sapiens
acaactaggcttcagc

SEQ ID NO: 4361073 - DNA, 19 bp, Homo sapiens
acaactaggcttcagcata

SEQ ID NO: 4361074 - DNA, 13 bp, Homo sapiens
acaagagcccagc

SEQ ID NO: 4361075 - DNA, 15 bp, Homo sapiens
acaagatctttcagg

SEQ ID NO: 4361076 - DNA, 16 bp, Homo sapiens
acaagatctttcagga

SEQ ID NO: 4361077 - DNA, 20 bp, Homo sapiens
acaagatctttcaggaaaga

SEQ ID NO: 4361078 - DNA, 11 bp, Homo sapiens
acaaggaaaat

SEQ ID NO: 4361079 - DNA, 15 bp, Homo sapiens
acaaggaagccaaag

SEQ ID NO: 4361080 - DNA, 12 bp, Homo sapiens
acaataagttac

SEQ ID NO: 4361081 - DNA, 20 bp, Homo sapiens
acaataagttacttgaaata

SEQ ID NO: 4361082 - DNA, 19 bp, Homo sapiens
acaatagctttaccctcag

SEQ ID NO: 4361083 - DNA, 17 bp, Homo sapiens
acaatcaggtaagatca

SEQ ID NO: 4361084 - DNA, 20 bp, Homo sapiens
acaatcatggtcaagttccc

SEQ ID NO: 4361085 - DNA, 18 bp, Homo sapiens
acaattaaaccgcatgtg

SEQ ID NO: 4361086 - DNA, 18 bp, Homo sapiens
acacaaacctactgccca

SEQ ID NO: 4361087 - DNA, 20 bp, Homo sapiens
acacacaaacctactgccca

SEQ ID NO: 4361088 - DNA, 14 bp, Homo sapiens
acacacgagcaaac

SEQ ID NO: 4361089 - DNA, 15 bp, Homo sapiens
acacatctggccctg

SEQ ID NO: 4361090 - DNA, 16 bp, Homo sapiens
acacatctggccctga

SEQ ID NO: 4361091 - DNA, 23 bp, Homo sapiens
acaccaatttggtaaaaatgctg

SEQ ID NO: 4361092 - DNA, 17 bp, Homo sapiens
acaccaccggccccctc

SEQ ID NO: 4361093 - DNA, 12 bp, Homo sapiens
acaccagagctg

SEQ ID NO: 4361094 - DNA, 18 bp, Homo sapiens
acacccagcggccccccg

SEQ ID NO: 4361095 - DNA, 13 bp, Homo sapiens
acacccctctgtc

SEQ ID NO: 4361096 - DNA, 21 bp, Homo sapiens
acacccctctgtctaggactg

SEQ ID NO: 4361097 - DNA, 17 bp, Homo sapiens
acacccgactcctcaaa

SEQ ID NO: 4361098 - DNA, 20 bp, Homo sapiens
acacgagcaaacccagaggt

SEQ ID NO: 4361099 - DNA, 17 bp, Homo sapiens
acactgcagccctctcc

SEQ ID NO: 4361100 - DNA, 16 bp, Homo sapiens
acactgccagaagaga

SEQ ID NO: 4361101 - DNA, 23 bp, Homo sapiens
acactgccagaagagaattcagt

SEQ ID NO: 4361102 - DNA, 15 bp, Homo sapiens
acagacttctccaga

SEQ ID NO: 4361103 - DNA, 14 bp, Homo sapiens
acagcacaagggca

SEQ ID NO: 4361104 - DNA, 20 bp, Homo sapiens
acagcatatagaatatatta

SEQ ID NO: 4361105 - DNA, 16 bp, Homo sapiens
acagctgaggtctctt

SEQ ID NO: 4361106 - DNA, 12 bp, Homo sapiens
acagctgtgtct

SEQ ID NO: 4361107 - DNA, 13 bp, Homo sapiens
acagctgtgtctg

SEQ ID NO: 4361108 - DNA, 16 bp, Homo sapiens
acagctgtgtctgcca

SEQ ID NO: 4361109 - DNA, 12 bp, Homo sapiens
acagctttctgg

SEQ ID NO: 4361110 - DNA, 17 bp, Homo sapiens
acagctttctgggatgt

SEQ ID NO: 4361111 - DNA, 19 bp, Homo sapiens
acagctttctgggatgtca

SEQ ID NO: 4361112 - DNA, 20 bp, Homo sapiens
acagctttctgggatgtcac

SEQ ID NO: 4361113 - DNA, 22 bp, Homo sapiens
acagctttctgggatgtcacag

SEQ ID NO: 4361114 - DNA, 14 bp, Homo sapiens
acagtccaaccaga

SEQ ID NO: 4361115 - DNA, 17 bp, Homo sapiens
acagtccaaccagaaac

SEQ ID NO: 4361116 - DNA, 20 bp, Homo sapiens
acagtccaaccagaaacacc

SEQ ID NO: 4361117 - DNA, 12 bp, Homo sapiens
acagtctgttat

SEQ ID NO: 4361118 - DNA, 22 bp, Homo sapiens
acagtgcctcttccagtgaaca

SEQ ID NO: 4361119 - DNA, 18 bp, Homo sapiens
acagtgcctgggaatgta

SEQ ID NO: 4361120 - DNA, 23 bp, Homo sapiens
acagtggatatgacccacactgc

SEQ ID NO: 4361121 - DNA, 18 bp, Homo sapiens
acatcagaagtttgcatc

SEQ ID NO: 4361122 - DNA, 12 bp, Homo sapiens
acatgaaatgaa

SEQ ID NO: 4361123 - DNA, 20 bp, Homo sapiens
acatgactacatagtaagta

SEQ ID NO: 4361124 - DNA, 12 bp, Homo sapiens
acatgggaggga

SEQ ID NO: 4361125 - DNA, 19 bp, Homo sapiens
acatgggagggatcagccc

SEQ ID NO: 4361126 - DNA, 20 bp, Homo sapiens
acatgtggggacagggctgg

SEQ ID NO: 4361127 - DNA, 17 bp, Homo sapiens
acatgtttaaatagcct

SEQ ID NO: 4361128 - DNA, 20 bp, Homo sapiens
acatgtttaaatagcctaaa

SEQ ID NO: 4361129 - DNA, 20 bp, Homo sapiens
acattgcccatggctgggaa

SEQ ID NO: 4361130 - DNA, 16 bp, Homo sapiens
acattgtcctgtagct

SEQ ID NO: 4361131 - DNA, 13 bp, Homo sapiens
acatttatgacct

SEQ ID NO: 4361132 - DNA, 15 bp, Homo sapiens
acatttgggctcagg

SEQ ID NO: 4361133 - DNA, 14 bp, Homo sapiens
accacaaaaatgaa

SEQ ID NO: 4361134 - DNA, 23 bp, Homo sapiens
accaccggccccctccccccaga

SEQ ID NO: 4361135 - DNA, 17 bp, Homo sapiens
accagaaacacccctct

SEQ ID NO: 4361136 - DNA, 21 bp, Homo sapiens
accagaaacacccctctgtct

SEQ ID NO: 4361137 - DNA, 22 bp, Homo sapiens
accagaaacacccctctgtcta

SEQ ID NO: 4361138 - DNA, 15 bp, Homo sapiens
accaggagctagccc

SEQ ID NO: 4361139 - DNA, 18 bp, Homo sapiens
accaggagctagcccagt

SEQ ID NO: 4361140 - DNA, 21 bp, Homo sapiens
accaggagctagcccagtccc

SEQ ID NO: 4361141 - DNA, 23 bp, Homo sapiens
accagggcgaacgacaatagctt

SEQ ID NO: 4361142 - DNA, 17 bp, Homo sapiens
accatccccaccccacc

SEQ ID NO: 4361143 - DNA, 15 bp, Homo sapiens
acccaagcctgctgg

SEQ ID NO: 4361144 - DNA, 21 bp, Homo sapiens
aaatgattcaaattgctgctt

SEQ ID NO: 4361145 - DNA, 13 bp, Homo sapiens
aaatgctgctctc

SEQ ID NO: 4361146 - DNA, 18 bp, Homo sapiens
aaatgctgctctcagcct

SEQ ID NO: 4361147 - DNA, 14 bp, Homo sapiens
aaatggcgtctgct

SEQ ID NO: 4361148 - DNA, 17 bp, Homo sapiens
aaatgtgatttttctga

SEQ ID NO: 4361149 - DNA, 19 bp, Homo sapiens
aaatgtgtttttctatata

SEQ ID NO: 4361150 - DNA, 23 bp, Homo sapiens
aaattagttttaaaatactatat

SEQ ID NO: 4361151 - DNA, 20 bp, Homo sapiens
aaattcagatatatttttca

SEQ ID NO: 4361152 - DNA, 14 bp, Homo sapiens
aaattcataaccaa

SEQ ID NO: 4361153 - DNA, 21 bp, Homo sapiens
aaattcttcaagaaagaattc

SEQ ID NO: 4361154 - DNA, 13 bp, Homo sapiens
aaattggaactct

SEQ ID NO: 4361155 - DNA, 12 bp, Homo sapiens
aaattgttcttg

SEQ ID NO: 4361156 - DNA, 12 bp, Homo sapiens
aaatttacatca

SEQ ID NO: 4361157 - DNA, 20 bp, Homo sapiens
aaatttcaattagatttaaa

SEQ ID NO: 4361158 - DNA, 18 bp, Homo sapiens
aacaaagtgagaaatgaa

SEQ ID NO: 4361159 - DNA, 19 bp, Homo sapiens
aacaaatgtgtttttctat

SEQ ID NO: 4361160 - DNA, 12 bp, Homo sapiens
aacaaatttaca

SEQ ID NO: 4361161 - DNA, 18 bp, Homo sapiens
aacaaatttacatcagaa

SEQ ID NO: 4361162 - DNA, 17 bp, Homo sapiens
aacaagatctttcagga

SEQ ID NO: 4361163 - DNA, 14 bp, Homo sapiens
aacaaggaagccaa

SEQ ID NO: 4361164 - DNA, 15 bp, Homo sapiens
aacaaggaagccaaa

SEQ ID NO: 4361165 - DNA, 16 bp, Homo sapiens
aacaaggaagccaaag

SEQ ID NO: 4361166 - DNA, 18 bp, Homo sapiens
aacactgcagccctctcc

SEQ ID NO: 4361167 - DNA, 22 bp, Homo sapiens
aacagaagctttttgtttgcat

SEQ ID NO: 4361168 - DNA, 13 bp, Homo sapiens
aacagctgtgtct

SEQ ID NO: 4361169 - DNA, 16 bp, Homo sapiens
aacagctgtgtctgcc

SEQ ID NO: 4361170 - DNA, 12 bp, Homo sapiens
aacatgggaggg

SEQ ID NO: 4361171 - DNA, 23 bp, Homo sapiens
aacatgggagggatcagccccgc

SEQ ID NO: 4361172 - DNA, 22 bp, Homo sapiens
aacatgtttaaatagcctaaat

SEQ ID NO: 4361173 - DNA, 17 bp, Homo sapiens
aacattcccagcccagc

SEQ ID NO: 4361174 - DNA, 19 bp, Homo sapiens
aaccagaaacacccctctg

SEQ ID NO: 4361175 - DNA, 13 bp, Homo sapiens
aacctactgccca

SEQ ID NO: 4361176 - DNA, 14 bp, Homo sapiens
aacctactgcccac

SEQ ID NO: 4361177 - DNA, 13 bp, Homo sapiens
aacctgcacacag

SEQ ID NO: 4361178 - DNA, 20 bp, Homo sapiens
aacctgcacacaggacagcg

SEQ ID NO: 4361179 - DNA, 13 bp, Homo sapiens
aaccttccaccca

SEQ ID NO: 4361180 - DNA, 14 bp, Homo sapiens
aacgacaatagctt

SEQ ID NO: 4361181 - DNA, 12 bp, Homo sapiens
aactacaaagta

SEQ ID NO: 4361182 - DNA, 15 bp, Homo sapiens
aactattgagccttg

SEQ ID NO: 4361183 - DNA, 16 bp, Homo sapiens
aactattgagccttgc

SEQ ID NO: 4361184 - DNA, 19 bp, Homo sapiens
aactctactcaacccattg

SEQ ID NO: 4361185 - DNA, 10 bp, Homo sapiens
aactgaaggg

SEQ ID NO: 4361186 - DNA, 21 bp, Homo sapiens
aactgaaggggtgcacccacc

SEQ ID NO: 4361187 - DNA, 20 bp, Homo sapiens
aactgacaaaggagccttga

SEQ ID NO: 4361188 - DNA, 17 bp, Homo sapiens
aactgggttctttggaa

SEQ ID NO: 4361189 - DNA, 15 bp, Homo sapiens
aacttctagcatata

SEQ ID NO: 4361190 - DNA, 15 bp, Homo sapiens
aactttgtagaaagc

SEQ ID NO: 4361191 - DNA, 11 bp, Homo sapiens
aagaaatgatt

SEQ ID NO: 4361192 - DNA, 18 bp, Homo sapiens
aagaaatggcgtctgctc

SEQ ID NO: 4361193 - DNA, 21 bp, Homo sapiens
aagaccagaattcccttgaat

SEQ ID NO: 4361194 - DNA, 22 bp, Homo sapiens
aagaccagaattcccttgaatt

SEQ ID NO: 4361195 - DNA, 23 bp, Homo sapiens
aagagcttgctccagattctgat

SEQ ID NO: 4361196 - DNA, 15 bp, Homo sapiens
aagagtggaggagga

SEQ ID NO: 4361197 - DNA, 16 bp, Homo sapiens
aagagtggaggaggag

SEQ ID NO: 4361198 - DNA, 19 bp, Homo sapiens
aagataacaagatctttca

SEQ ID NO: 4361199 - DNA, 22 bp, Homo sapiens
aagataacaagatctttcagga

SEQ ID NO: 4361200 - DNA, 18 bp, Homo sapiens
aagatctgactgccaaat

SEQ ID NO: 4361201 - DNA, 13 bp, Homo sapiens
aagatctttcagg

SEQ ID NO: 4361202 - DNA, 16 bp, Homo sapiens
aagcagaacaaatgtg

SEQ ID NO: 4361203 - DNA, 17 bp, Homo sapiens
aagcagaacaaatgtgt

SEQ ID NO: 4361204 - DNA, 20 bp, Homo sapiens
aagcagaacaaatgtgtttt

SEQ ID NO: 4361205 - DNA, 18 bp, Homo sapiens
aagcagcaggcctctggt

SEQ ID NO: 4361206 - DNA, 17 bp, Homo sapiens
aagcaggaggcccttgt

SEQ ID NO: 4361207 - DNA, 18 bp, Homo sapiens
aagcaggaggcccttgtc

SEQ ID NO: 4361208 - DNA, 12 bp, Homo sapiens
aagcataaaaga

SEQ ID NO: 4361209 - DNA, 14 bp, Homo sapiens
aagcatccctcacc

SEQ ID NO: 4361210 - DNA, 17 bp, Homo sapiens
aagcatgtctcaatagt

SEQ ID NO: 4361211 - DNA, 13 bp, Homo sapiens
aagccccttggag

SEQ ID NO: 4361212 - DNA, 14 bp, Homo sapiens
aagcctgcaggagt

SEQ ID NO: 4361213 - DNA, 12 bp, Homo sapiens
aagcctgctggc

SEQ ID NO: 4361214 - DNA, 14 bp, Homo sapiens
aagcctgctggctg

SEQ ID NO: 4361215 - DNA, 22 bp, Homo sapiens
aagcctgctggctgcggccccc

SEQ ID NO: 4361216 - DNA, 15 bp, Homo sapiens
aaggaaaatctatat

SEQ ID NO: 4361217 - DNA, 22 bp, Homo sapiens
aaggagccttgataatacttga

SEQ ID NO: 4361218 - DNA, 15 bp, Homo sapiens
aaggatctgctgagg

SEQ ID NO: 4361219 - DNA, 24 bp, Homo sapiens
aaggatctgctgaggcccagtgca

SEQ ID NO: 4361220 - DNA, 17 bp, Homo sapiens
aagggattgaggagttg

SEQ ID NO: 4361221 - DNA, 23 bp, Homo sapiens
aagggattgaggagttgcctgac

SEQ ID NO: 4361222 - DNA, 19 bp, Homo sapiens
aagggggtgactggaagtt

SEQ ID NO: 4361223 - DNA, 16 bp, Homo sapiens
aaggggtgcacccacc

SEQ ID NO: 4361224 - DNA, 21 bp, Homo sapiens
aagggttctgccctgcctgag

SEQ ID NO: 4361225 - DNA, 23 bp, Homo sapiens
aagggttctgccctgcctgagga

SEQ ID NO: 4361226 - DNA, 19 bp, Homo sapiens
aaggtaccaaacaaggaag

SEQ ID NO: 4361227 - DNA, 22 bp, Homo sapiens
aaggtatgtagttacagaattc

SEQ ID NO: 4361228 - DNA, 18 bp, Homo sapiens
aaggtattccttttgtgt

SEQ ID NO: 4361229 - DNA, 23 bp, Homo sapiens
aaggtccttgcctgaactccaga

SEQ ID NO: 4361230 - DNA, 14 bp, Homo sapiens
aagtaaaatgaaca

SEQ ID NO: 4361231 - DNA, 18 bp, Homo sapiens
aagtaaaatgaacatttt

SEQ ID NO: 4361232 - DNA, 13 bp, Homo sapiens
aagtatgccttaa

SEQ ID NO: 4361233 - DNA, 14 bp, Homo sapiens
aagtatgccttaag

SEQ ID NO: 4361234 - DNA, 20 bp, Homo sapiens
aagtatgccttaagcagaac

SEQ ID NO: 4361235 - DNA, 21 bp, Homo sapiens
aagtatgccttaagcagaaca

SEQ ID NO: 4361236 - DNA, 13 bp, Homo sapiens
aagtatgtggtac

SEQ ID NO: 4361237 - DNA, 12 bp, Homo sapiens
aagtgagcagaa

SEQ ID NO: 4361238 - DNA, 22 bp, Homo sapiens
aagtgatcaataaaatgtgatt

SEQ ID NO: 4361239 - DNA, 14 bp, Homo sapiens
aagtgtaaatgtta

SEQ ID NO: 4361240 - DNA, 21 bp, Homo sapiens
aagtgtaacagctgaggtctc

SEQ ID NO: 4361241 - DNA, 21 bp, Homo sapiens
aagtgtgagtaagagctggtg

SEQ ID NO: 4361242 - DNA, 13 bp, Homo sapiens
aagttacttgaaa

SEQ ID NO: 4361243 - DNA, 21 bp, Homo sapiens
aagttgattaaaaatgctttt

SEQ ID NO: 4361244 - DNA, 11 bp, Homo sapiens
aagttggaagg

SEQ ID NO: 4361245 - DNA, 22 bp, Homo sapiens
aagttgtttcagataaatttca

SEQ ID NO: 4361246 - DNA, 15 bp, Homo sapiens
aagttttcaaactgc

SEQ ID NO: 4361247 - DNA, 12 bp, Homo sapiens
aataaagcaatt

SEQ ID NO: 4361248 - DNA, 16 bp, Homo sapiens
aataaatatgtaatat

SEQ ID NO: 4361249 - DNA, 14 bp, Homo sapiens
aataaattcagata

SEQ ID NO: 4361250 - DNA, 13 bp, Homo sapiens
aataatgttgcct

SEQ ID NO: 4361251 - DNA, 16 bp, Homo sapiens
aataatgttgccttgg

SEQ ID NO: 4361252 - DNA, 22 bp, Homo sapiens
aataatttcccaattaggaagt

SEQ ID NO: 4361253 - DNA, 15 bp, Homo sapiens
aatacttgacctctg

SEQ ID NO: 4361254 - DNA, 15 bp, Homo sapiens
aatagacagtatatt

SEQ ID NO: 4361255 - DNA, 17 bp, Homo sapiens
aatagatgtaaataaaa

SEQ ID NO: 4361256 - DNA, 19 bp, Homo sapiens
aatagatgtaaataaaatt

SEQ ID NO: 4361257 - DNA, 18 bp, Homo sapiens
aatagcctaaatgatggt

SEQ ID NO: 4361258 - DNA, 21 bp, Homo sapiens
aatagctttaccctcaggcat

SEQ ID NO: 4361259 - DNA, 13 bp, Homo sapiens
aatataaacttaa

SEQ ID NO: 4361260 - DNA, 16 bp, Homo sapiens
aatataaatttaagca

SEQ ID NO: 4361261 - DNA, 18 bp, Homo sapiens
aatataaatttaagcaaa

SEQ ID NO: 4361262 - DNA, 20 bp, Homo sapiens
aatataaatttaagcaaacg

SEQ ID NO: 4361263 - DNA, 17 bp, Homo sapiens
aatataagcataaaaga

SEQ ID NO: 4361264 - DNA, 11 bp, Homo sapiens
aatataatatg

SEQ ID NO: 4361265 - DNA, 14 bp, Homo sapiens
aatatacctggttt

SEQ ID NO: 4361266 - DNA, 18 bp, Homo sapiens
aatatgtaatataaattt

SEQ ID NO: 4361267 - DNA, 16 bp, Homo sapiens
agcctggattccagca

SEQ ID NO: 4361268 - DNA, 17 bp, Homo sapiens
agcctggattccagcag

SEQ ID NO: 4361269 - DNA, 11 bp, Homo sapiens
agccttgctgg

SEQ ID NO: 4361270 - DNA, 23 bp, Homo sapiens
agcggccccccgcacagccaccc

SEQ ID NO: 4361271 - DNA, 14 bp, Homo sapiens
agcgtgtgggtccc

SEQ ID NO: 4361272 - DNA, 15 bp, Homo sapiens
agctagatgcccctg

SEQ ID NO: 4361273 - DNA, 23 bp, Homo sapiens
agctagcccagtccctggagctg

SEQ ID NO: 4361274 - DNA, 11 bp, Homo sapiens
agctctctgac

SEQ ID NO: 4361275 - DNA, 21 bp, Homo sapiens
agctctctgacgcttgtgaca

SEQ ID NO: 4361276 - DNA, 23 bp, Homo sapiens
agctctctgacgcttgtgacagt

SEQ ID NO: 4361277 - DNA, 17 bp, Homo sapiens
agctctggatgaaggca

SEQ ID NO: 4361278 - DNA, 21 bp, Homo sapiens
agctgaggtctcttgagggag

SEQ ID NO: 4361279 - DNA, 19 bp, Homo sapiens
agctgccatccttgctgca

SEQ ID NO: 4361280 - DNA, 22 bp, Homo sapiens
agctgccatccttgctgcagct

SEQ ID NO: 4361281 - DNA, 23 bp, Homo sapiens
agctgtaagaagagactgggaag

SEQ ID NO: 4361282 - DNA, 22 bp, Homo sapiens
agctgtgtctgccaaacacatt

SEQ ID NO: 4361283 - DNA, 19 bp, Homo sapiens
agcttaaattcttcaagaa

SEQ ID NO: 4361284 - DNA, 22 bp, Homo sapiens
agcttaaattcttcaagaaaga

SEQ ID NO: 4361285 - DNA, 17 bp, Homo sapiens
agcttagccaatgtggg

SEQ ID NO: 4361286 - DNA, 21 bp, Homo sapiens
agcttgctccagattctgatg

SEQ ID NO: 4361287 - DNA, 19 bp, Homo sapiens
agctttaaaaccacagctg

SEQ ID NO: 4361288 - DNA, 18 bp, Homo sapiens
agctttaccctcaggcat

SEQ ID NO: 4361289 - DNA, 21 bp, Homo sapiens
agctttgtcacttgccacatg

SEQ ID NO: 4361290 - DNA, 15 bp, Homo sapiens
aggaagaaattcagg

SEQ ID NO: 4361291 - DNA, 14 bp, Homo sapiens
aggaataacactgc

SEQ ID NO: 4361292 - DNA, 15 bp, Homo sapiens
aggaataacactgca

SEQ ID NO: 4361293 - DNA, 14 bp, Homo sapiens
aggacacagcacaa

SEQ ID NO: 4361294 - DNA, 22 bp, Homo sapiens
aggacagaggccggggtccagg

SEQ ID NO: 4361295 - DNA, 23 bp, Homo sapiens
aggacagaggccggggtccaggc

SEQ ID NO: 4361296 - DNA, 16 bp, Homo sapiens
aggaccactcctgtac

SEQ ID NO: 4361297 - DNA, 13 bp, Homo sapiens
aggactgcagtgt

SEQ ID NO: 4361298 - DNA, 15 bp, Homo sapiens
aggactgcagtgtgg

SEQ ID NO: 4361299 - DNA, 23 bp, Homo sapiens
aggagcccttctatacccaccca

SEQ ID NO: 4361300 - DNA, 21 bp, Homo sapiens
aggagccttgataatacttga

SEQ ID NO: 4361301 - DNA, 22 bp, Homo sapiens
aggagccttgataatacttgac

SEQ ID NO: 4361302 - DNA, 19 bp, Homo sapiens
aggagccttgctgggccag

SEQ ID NO: 4361303 - DNA, 22 bp, Homo sapiens
aggagccttgctgggccaggga

SEQ ID NO: 4361304 - DNA, 18 bp, Homo sapiens
aggagctactgacattcc

SEQ ID NO: 4361305 - DNA, 19 bp, Homo sapiens
aggaggacacagcacaagg

SEQ ID NO: 4361306 - DNA, 14 bp, Homo sapiens
aggaggagccttgc

SEQ ID NO: 4361307 - DNA, 14 bp, Homo sapiens
aggaggaggacaca

SEQ ID NO: 4361308 - DNA, 17 bp, Homo sapiens
aggaggtacaaaagtta

SEQ ID NO: 4361309 - DNA, 12 bp, Homo sapiens
aggagttgcctg

SEQ ID NO: 4361310 - DNA, 14 bp, Homo sapiens
aggagttgcctgac

SEQ ID NO: 4361311 - DNA, 13 bp, Homo sapiens
aggatactctgtc

SEQ ID NO: 4361312 - DNA, 13 bp, Homo sapiens
aggatctgctgag

SEQ ID NO: 4361313 - DNA, 15 bp, Homo sapiens
aggatctgctgaggc

SEQ ID NO: 4361314 - DNA, 12 bp, Homo sapiens
aggatggagggg

SEQ ID NO: 4361315 - DNA, 19 bp, Homo sapiens
aggcaaaaactgtactgtg

SEQ ID NO: 4361316 - DNA, 15 bp, Homo sapiens
aggcacacagggccc

SEQ ID NO: 4361317 - DNA, 18 bp, Homo sapiens
aggcactgtcaggaatgg

SEQ ID NO: 4361318 - DNA, 13 bp, Homo sapiens
aggcagcaccaca

SEQ ID NO: 4361319 - DNA, 19 bp, Homo sapiens
aggcagcaccacactgggt

SEQ ID NO: 4361320 - DNA, 23 bp, Homo sapiens
aggcagcaccacactgggtgcgt

SEQ ID NO: 4361321 - DNA, 16 bp, Homo sapiens
aggcataggcctgggt

SEQ ID NO: 4361322 - DNA, 22 bp, Homo sapiens
aggcccccaaattgccttcagc

SEQ ID NO: 4361323 - DNA, 16 bp, Homo sapiens
aggccggggtccaggc

SEQ ID NO: 4361324 - DNA, 12 bp, Homo sapiens
aggcctctggtt

SEQ ID NO: 4361325 - DNA, 23 bp, Homo sapiens
aggcctgggtgctggctgcccag

SEQ ID NO: 4361326 - DNA, 21 bp, Homo sapiens
aggcgcagtgcttctctacag

SEQ ID NO: 4361327 - DNA, 13 bp, Homo sapiens
aggctctgcacag

SEQ ID NO: 4361328 - DNA, 15 bp, Homo sapiens
aggctctgcacagat

SEQ ID NO: 4361329 - DNA, 22 bp, Homo sapiens
aggctgcctcagccagtggcac

SEQ ID NO: 4361330 - DNA, 10 bp, Homo sapiens
aggctgctag

SEQ ID NO: 4361331 - DNA, 22 bp, Homo sapiens
aggctggctggcccgtcatgtt

SEQ ID NO: 4361332 - DNA, 16 bp, Homo sapiens
aggcttggggaaaatg

SEQ ID NO: 4361333 - DNA, 22 bp, Homo sapiens
aggcttggggaaaatggccatg

SEQ ID NO: 4361334 - DNA, 17 bp, Homo sapiens
agggaaaccttggagag

SEQ ID NO: 4361335 - DNA, 19 bp, Homo sapiens
agggaaaccttggagagga

SEQ ID NO: 4361336 - DNA, 18 bp, Homo sapiens
agggaagaccagaattcc

SEQ ID NO: 4361337 - DNA, 19 bp, Homo sapiens
agggagttttgtctgtctc

SEQ ID NO: 4361338 - DNA, 14 bp, Homo sapiens
agggcacattgccc

SEQ ID NO: 4361339 - DNA, 21 bp, Homo sapiens
agggcacattgcccatggctg

SEQ ID NO: 4361340 - DNA, 15 bp, Homo sapiens
agggcaggcttgggg

SEQ ID NO: 4361341 - DNA, 13 bp, Homo sapiens
agggcagggcatc

SEQ ID NO: 4361342 - DNA, 12 bp, Homo sapiens
agggcatctcct

SEQ ID NO: 4361343 - DNA, 16 bp, Homo sapiens
agggcccggccacacc

SEQ ID NO: 4361344 - DNA, 17 bp, Homo sapiens
agggcccggccacaccc

SEQ ID NO: 4361345 - DNA, 18 bp, Homo sapiens
agggcccggccacaccca

SEQ ID NO: 4361346 - DNA, 15 bp, Homo sapiens
agggctctgatattc

SEQ ID NO: 4361347 - DNA, 17 bp, Homo sapiens
agggctctgatattcca

SEQ ID NO: 4361348 - DNA, 22 bp, Homo sapiens
agggctctgatattccatgaat

SEQ ID NO: 4361349 - DNA, 21 bp, Homo sapiens
agggctggtgtggctgctccc

SEQ ID NO: 4361350 - DNA, 14 bp, Homo sapiens
aggggagggcaggc

SEQ ID NO: 4361351 - DNA, 17 bp, Homo sapiens
aggggagggcaggcttg

SEQ ID NO: 4361352 - DNA, 23 bp, Homo sapiens
aggggcgggctcagagctttgtc

SEQ ID NO: 4361353 - DNA, 14 bp, Homo sapiens
agggtgagaagcta

SEQ ID NO: 4361354 - DNA, 14 bp, Homo sapiens
agggtgggaagaga

SEQ ID NO: 4361355 - DNA, 14 bp, Homo sapiens
agggttctgccctg

SEQ ID NO: 4361356 - DNA, 15 bp, Homo sapiens
aggtacaaaagttac

SEQ ID NO: 4361357 - DNA, 20 bp, Homo sapiens
aggtaccaaacaaggaagcc

SEQ ID NO: 4361358 - DNA, 21 bp, Homo sapiens
aggtaccaaacaaggaagcca

SEQ ID NO: 4361359 - DNA, 13 bp, Homo sapiens
aggtaggaagagc

SEQ ID NO: 4361360 - DNA, 18 bp, Homo sapiens
aggtagtattacaccacc

SEQ ID NO: 4361361 - DNA, 22 bp, Homo sapiens
aggtattccttttgtgtacagt

SEQ ID NO: 4361362 - DNA, 15 bp, Homo sapiens
aggtcactcctgggg

SEQ ID NO: 4361363 - DNA, 23 bp, Homo sapiens
aggtccttgcctgaactccagag

SEQ ID NO: 4361364 - DNA, 19 bp, Homo sapiens
aggtgcgtgttcagcagaa

SEQ ID NO: 4361365 - DNA, 19 bp, Homo sapiens
aggtggagaaaattggaac

SEQ ID NO: 4361366 - DNA, 15 bp, Homo sapiens
aggtgggctgcctgc

SEQ ID NO: 4361367 - DNA, 17 bp, Homo sapiens
aggtgggctgcctgctg

SEQ ID NO: 4361368 - DNA, 23 bp, Homo sapiens
aggtggtgaattttccaagaaca

SEQ ID NO: 4361369 - DNA, 22 bp, Homo sapiens
aggttagaaaggcagccctcac

SEQ ID NO: 4361370 - DNA, 12 bp, Homo sapiens
agtaagagctgg

SEQ ID NO: 4361371 - DNA, 22 bp, Homo sapiens
agtaagtacagaacagtaaagt

SEQ ID NO: 4361372 - DNA, 13 bp, Homo sapiens
agtactttgtgca

SEQ ID NO: 4361373 - DNA, 15 bp, Homo sapiens
agtactttgtgcatt

SEQ ID NO: 4361374 - DNA, 16 bp, Homo sapiens
agtagagtcatctcca

SEQ ID NO: 4361375 - DNA, 21 bp, Homo sapiens
agtatgccttaagcagaacaa

SEQ ID NO: 4361376 - DNA, 20 bp, Homo sapiens
agtatgctttccctgaggaa

SEQ ID NO: 4361377 - DNA, 18 bp, Homo sapiens
agtcagacacgattgaga

SEQ ID NO: 4361378 - DNA, 18 bp, Homo sapiens
agtcagagtcacttgtag

SEQ ID NO: 4361379 - DNA, 20 bp, Homo sapiens
agtcatctccatcagctgta

SEQ ID NO: 4361380 - DNA, 19 bp, Homo sapiens
agtcatctgtaagagcttg

SEQ ID NO: 4361381 - DNA, 22 bp, Homo sapiens
agtcatcttgtgagtggataat

SEQ ID NO: 4361382 - DNA, 18 bp, Homo sapiens
agtcatggtactacccca

SEQ ID NO: 4361383 - DNA, 19 bp, Homo sapiens
agtccccgaggagctgggc

SEQ ID NO: 4361384 - DNA, 22 bp, Homo sapiens
agtccccgaggagctgggcccc

SEQ ID NO: 4361385 - DNA, 16 bp, Homo sapiens
agtctaaatatttcct

SEQ ID NO: 4361386 - DNA, 21 bp, Homo sapiens
agtctgttatgcactgtggtt

SEQ ID NO: 4361387 - DNA, 13 bp, Homo sapiens
agtcttggttcta

SEQ ID NO: 4361388 - DNA, 15 bp, Homo sapiens
agtgaaacaaattta

SEQ ID NO: 4361389 - DNA, 22 bp, Homo sapiens
agaaaggcagccctcacctctg

SEQ ID NO: 4361390 - DNA, 22 bp, Homo sapiens
agaaatgattcaaattgctgct

SEQ ID NO: 4361391 - DNA, 20 bp, Homo sapiens
agaaatggcgtctgctctgg

SEQ ID NO: 4361392 - DNA, 23 bp, Homo sapiens
agaaatggcgtctgctctggtgg

SEQ ID NO: 4361393 - DNA, 20 bp, Homo sapiens
agaaattcaggtacagaaaa

SEQ ID NO: 4361394 - DNA, 21 bp, Homo sapiens
agaacaaatgtgtttttctat

SEQ ID NO: 4361395 - DNA, 22 bp, Homo sapiens
agaacatagtttaagttgatta

SEQ ID NO: 4361396 - DNA, 20 bp, Homo sapiens
agaacctgcacacaggacag

SEQ ID NO: 4361397 - DNA, 21 bp, Homo sapiens
agaactgacaaaggagccttg

SEQ ID NO: 4361398 - DNA, 22 bp, Homo sapiens
agaactgacaaaggagccttga

SEQ ID NO: 4361399 - DNA, 13 bp, Homo sapiens
agaagagaattca

SEQ ID NO: 4361400 - DNA, 16 bp, Homo sapiens
agaagagaattcagta

SEQ ID NO: 4361401 - DNA, 20 bp, Homo sapiens
agaagagaattcagtatttt

SEQ ID NO: 4361402 - DNA, 13 bp, Homo sapiens
agaagaggaagaa

SEQ ID NO: 4361403 - DNA, 19 bp, Homo sapiens
agaagctagatgcccctgc

SEQ ID NO: 4361404 - DNA, 14 bp, Homo sapiens
agaagggaatttgg

SEQ ID NO: 4361405 - DNA, 16 bp, Homo sapiens
agaagggttctgccct

SEQ ID NO: 4361406 - DNA, 24 bp, Homo sapiens
agaagggttctgccctgcctgagg

SEQ ID NO: 4361407 - DNA, 21 bp, Homo sapiens
agaaggtattccttttgtgta

SEQ ID NO: 4361408 - DNA, 12 bp, Homo sapiens
agaagtttgcat

SEQ ID NO: 4361409 - DNA, 14 bp, Homo sapiens
agaagtttgcatct

SEQ ID NO: 4361410 - DNA, 20 bp, Homo sapiens
agaatgaaaatcagcaactt

SEQ ID NO: 4361411 - DNA, 22 bp, Homo sapiens
agaattcccttgaattgtgtat

SEQ ID NO: 4361412 - DNA, 23 bp, Homo sapiens
agaattgagcagttctgttgcat

SEQ ID NO: 4361413 - DNA, 15 bp, Homo sapiens
agaattgtatcattt

SEQ ID NO: 4361414 - DNA, 18 bp, Homo sapiens
agacagtatatttatagt

SEQ ID NO: 4361415 - DNA, 22 bp, Homo sapiens
agacagtctgttatgcactgtg

SEQ ID NO: 4361416 - DNA, 17 bp, Homo sapiens
agacatgaatgcacact

SEQ ID NO: 4361417 - DNA, 13 bp, Homo sapiens
agaccagaattcc

SEQ ID NO: 4361418 - DNA, 19 bp, Homo sapiens
agacccctctggccaggat

SEQ ID NO: 4361419 - DNA, 13 bp, Homo sapiens
agacctcatgccc

SEQ ID NO: 4361420 - DNA, 14 bp, Homo sapiens
agacggattgcatt

SEQ ID NO: 4361421 - DNA, 23 bp, Homo sapiens
agactcagtatgctttccctgag

SEQ ID NO: 4361422 - DNA, 17 bp, Homo sapiens
agactcctggtctgtga

SEQ ID NO: 4361423 - DNA, 18 bp, Homo sapiens
agactctttttttgagtg

SEQ ID NO: 4361424 - DNA, 21 bp, Homo sapiens
agactctttttttgagtgaca

SEQ ID NO: 4361425 - DNA, 16 bp, Homo sapiens
agactggatggaaact

SEQ ID NO: 4361426 - DNA, 15 bp, Homo sapiens
agagacccccaggcc

SEQ ID NO: 4361427 - DNA, 13 bp, Homo sapiens
agagactgggaag

SEQ ID NO: 4361428 - DNA, 14 bp, Homo sapiens
agagagaggctgcc

SEQ ID NO: 4361429 - DNA, 13 bp, Homo sapiens
agagaggctgcct

SEQ ID NO: 4361430 - DNA, 16 bp, Homo sapiens
agagaggctgcctcag

SEQ ID NO: 4361431 - DNA, 14 bp, Homo sapiens
agagcagcaggtgc

SEQ ID NO: 4361432 - DNA, 19 bp, Homo sapiens
agagccggtggtgcccgtg

SEQ ID NO: 4361433 - DNA, 23 bp, Homo sapiens
agagctaggcccccaaattgcct

SEQ ID NO: 4361434 - DNA, 11 bp, Homo sapiens
agagctggtgt

SEQ ID NO: 4361435 - DNA, 17 bp, Homo sapiens
agagctggtgtctgatt

SEQ ID NO: 4361436 - DNA, 13 bp, Homo sapiens
agagcttgctcca

SEQ ID NO: 4361437 - DNA, 15 bp, Homo sapiens
agagcttgctccaga

SEQ ID NO: 4361438 - DNA, 23 bp, Homo sapiens
agagcttgctccagattctgatg

SEQ ID NO: 4361439 - DNA, 15 bp, Homo sapiens
agagctttgtcactt

SEQ ID NO: 4361440 - DNA, 21 bp, Homo sapiens
agagctttgtcacttgccaca

SEQ ID NO: 4361441 - DNA, 13 bp, Homo sapiens
agaggagagtggc

SEQ ID NO: 4361442 - DNA, 23 bp, Homo sapiens
agaggccaggcaggagcccttct

SEQ ID NO: 4361443 - DNA, 21 bp, Homo sapiens
agaggccggggtccaggcccg

SEQ ID NO: 4361444 - DNA, 17 bp, Homo sapiens
agaggctgcctcagcca

SEQ ID NO: 4361445 - DNA, 14 bp, Homo sapiens
agaggggcgggctc

SEQ ID NO: 4361446 - DNA, 19 bp, Homo sapiens
agaggggcgggctcagagc

SEQ ID NO: 4361447 - DNA, 17 bp, Homo sapiens
agagtcacttgtagtcc

SEQ ID NO: 4361448 - DNA, 14 bp, Homo sapiens
agagtcatctccat

SEQ ID NO: 4361449 - DNA, 15 bp, Homo sapiens
agagtggaggaggag

SEQ ID NO: 4361450 - DNA, 23 bp, Homo sapiens
agagtggaggaggaggaggagcc

SEQ ID NO: 4361451 - DNA, 16 bp, Homo sapiens
agagtttgaaaaacta

SEQ ID NO: 4361452 - DNA, 21 bp, Homo sapiens
agataggctctgcacagatgg

SEQ ID NO: 4361453 - DNA, 22 bp, Homo sapiens
agataggctctgcacagatgga

SEQ ID NO: 4361454 - DNA, 14 bp, Homo sapiens
agatatatttttca

SEQ ID NO: 4361455 - DNA, 13 bp, Homo sapiens
agatattaaagat

SEQ ID NO: 4361456 - DNA, 12 bp, Homo sapiens
agatcaccttgt

SEQ ID NO: 4361457 - DNA, 12 bp, Homo sapiens
agatctgactgc

SEQ ID NO: 4361458 - DNA, 12 bp, Homo sapiens
agatctttcagg

SEQ ID NO: 4361459 - DNA, 15 bp, Homo sapiens
agatggatttgcctg

SEQ ID NO: 4361460 - DNA, 19 bp, Homo sapiens
agatggggtctgtgactgg

SEQ ID NO: 4361461 - DNA, 21 bp, Homo sapiens
agatggggtctgtgactggat

SEQ ID NO: 4361462 - DNA, 16 bp, Homo sapiens
agatgtatgttgctat

SEQ ID NO: 4361463 - DNA, 16 bp, Homo sapiens
agattgacagcatata

SEQ ID NO: 4361464 - DNA, 17 bp, Homo sapiens
agattgacagcatatag

SEQ ID NO: 4361465 - DNA, 19 bp, Homo sapiens
agcaaacccagaggtggat

SEQ ID NO: 4361466 - DNA, 19 bp, Homo sapiens
agcaacctgggcatcttag

SEQ ID NO: 4361467 - DNA, 20 bp, Homo sapiens
agcaacttctagcatataga

SEQ ID NO: 4361468 - DNA, 20 bp, Homo sapiens
agcaatccatgttagttttt

SEQ ID NO: 4361469 - DNA, 14 bp, Homo sapiens
agcacaagggcaca

SEQ ID NO: 4361470 - DNA, 21 bp, Homo sapiens
agcacaagggcacattgccca

SEQ ID NO: 4361471 - DNA, 20 bp, Homo sapiens
agcacacacatctggccctg

SEQ ID NO: 4361472 - DNA, 15 bp, Homo sapiens
agcagaacaaatgtg

SEQ ID NO: 4361473 - DNA, 14 bp, Homo sapiens
agcagaacaggtag

SEQ ID NO: 4361474 - DNA, 15 bp, Homo sapiens
agcagaacaggtagt

SEQ ID NO: 4361475 - DNA, 20 bp, Homo sapiens
agcagaacctgcacacagga

SEQ ID NO: 4361476 - DNA, 24 bp, Homo sapiens
agcagaacctgcacacaggacagc

SEQ ID NO: 4361477 - DNA, 15 bp, Homo sapiens
agcagagacactaac

SEQ ID NO: 4361478 - DNA, 11 bp, Homo sapiens
agcagagccta

SEQ ID NO: 4361479 - DNA, 18 bp, Homo sapiens
agcagcaggcctctggtt

SEQ ID NO: 4361480 - DNA, 14 bp, Homo sapiens
agcagcaggtgctg

SEQ ID NO: 4361481 - DNA, 21 bp, Homo sapiens
agcagcaggtgctgtgcgcct

SEQ ID NO: 4361482 - DNA, 16 bp, Homo sapiens
agcagccccctgtggc

SEQ ID NO: 4361483 - DNA, 17 bp, Homo sapiens
agcagcggtttggggag

SEQ ID NO: 4361484 - DNA, 22 bp, Homo sapiens
agcaggagaagttaagaattga

SEQ ID NO: 4361485 - DNA, 14 bp, Homo sapiens
agcaggcctctggt

SEQ ID NO: 4361486 - DNA, 15 bp, Homo sapiens
agcaggcctctggtt

SEQ ID NO: 4361487 - DNA, 19 bp, Homo sapiens
agcataaaagatcaccttg

SEQ ID NO: 4361488 - DNA, 23 bp, Homo sapiens
agcatagccagcattcagcacac

SEQ ID NO: 4361489 - DNA, 16 bp, Homo sapiens
agcatatagaatatat

SEQ ID NO: 4361490 - DNA, 23 bp, Homo sapiens
agcatgacctgtgaccagcactg

SEQ ID NO: 4361491 - DNA, 16 bp, Homo sapiens
agcattcagcacacac

SEQ ID NO: 4361492 - DNA, 17 bp, Homo sapiens
agcatttttatgcagac

SEQ ID NO: 4361493 - DNA, 17 bp, Homo sapiens
agccacccaagcctgct

SEQ ID NO: 4361494 - DNA, 20 bp, Homo sapiens
agccacccaagcctgctggc

SEQ ID NO: 4361495 - DNA, 23 bp, Homo sapiens
agccacccaagcctgctggctgc

SEQ ID NO: 4361496 - DNA, 21 bp, Homo sapiens
agccagaaagcactacaatca

SEQ ID NO: 4361497 - DNA, 15 bp, Homo sapiens
agccagcattcagca

SEQ ID NO: 4361498 - DNA, 19 bp, Homo sapiens
agccagcattcagcacaca

SEQ ID NO: 4361499 - DNA, 20 bp, Homo sapiens
agccagcattcagcacacac

SEQ ID NO: 4361500 - DNA, 17 bp, Homo sapiens
agccagggcagaggaat

SEQ ID NO: 4361501 - DNA, 23 bp, Homo sapiens
agccccgccccgttgtgagctgg

SEQ ID NO: 4361502 - DNA, 12 bp, Homo sapiens
agccccttggag

SEQ ID NO: 4361503 - DNA, 15 bp, Homo sapiens
agccctcacctctga

SEQ ID NO: 4361504 - DNA, 20 bp, Homo sapiens
agccctcacctctgaggaca

SEQ ID NO: 4361505 - DNA, 19 bp, Homo sapiens
agcccttctatacccaccc

SEQ ID NO: 4361506 - DNA, 17 bp, Homo sapiens
agcctagttcatccaat

SEQ ID NO: 4361507 - DNA, 11 bp, Homo sapiens
agcctcccaca

SEQ ID NO: 4361508 - DNA, 18 bp, Homo sapiens
agcctcgttggagagcag

SEQ ID NO: 4361509 - DNA, 20 bp, Homo sapiens
agcctgaaagatacagggga

SEQ ID NO: 4361510 - DNA, 16 bp, Homo sapiens
agcctgaagcctggat

SEQ ID NO: 4361511 - DNA, 20 bp, Homo sapiens
acccaagcctgctggctgcg

SEQ ID NO: 4361512 - DNA, 19 bp, Homo sapiens
acccacctgttttctgaaa

SEQ ID NO: 4361513 - DNA, 20 bp, Homo sapiens
acccagaatgagacatccag

SEQ ID NO: 4361514 - DNA, 13 bp, Homo sapiens
acccagaggtgga

SEQ ID NO: 4361515 - DNA, 17 bp, Homo sapiens
acccagcggccccccgc

SEQ ID NO: 4361516 - DNA, 17 bp, Homo sapiens
acccattgttgtcaagg

SEQ ID NO: 4361517 - DNA, 18 bp, Homo sapiens
acccattgttgtcaagga

SEQ ID NO: 4361518 - DNA, 18 bp, Homo sapiens
accccacccccgccatgc

SEQ ID NO: 4361519 - DNA, 13 bp, Homo sapiens
acccctctggcca

SEQ ID NO: 4361520 - DNA, 21 bp, Homo sapiens
acccctgtagggaaaccttgg

SEQ ID NO: 4361521 - DNA, 22 bp, Homo sapiens
acccctgtagggaaaccttgga

SEQ ID NO: 4361522 - DNA, 13 bp, Homo sapiens
accctaaccaagt

SEQ ID NO: 4361523 - DNA, 14 bp, Homo sapiens
accctaaccaagtt

SEQ ID NO: 4361524 - DNA, 18 bp, Homo sapiens
accctgtccggcccagtg

SEQ ID NO: 4361525 - DNA, 21 bp, Homo sapiens
accctgtccggcccagtgcca

SEQ ID NO: 4361526 - DNA, 16 bp, Homo sapiens
accctgttttatactg

SEQ ID NO: 4361527 - DNA, 17 bp, Homo sapiens
acccttcacactgttat

SEQ ID NO: 4361528 - DNA, 21 bp, Homo sapiens
acccttgtgcctctcatcttt

SEQ ID NO: 4361529 - DNA, 12 bp, Homo sapiens
acctactgccca

SEQ ID NO: 4361530 - DNA, 13 bp, Homo sapiens
acctactgcccac

SEQ ID NO: 4361531 - DNA, 22 bp, Homo sapiens
acctactgcccacatttgggct

SEQ ID NO: 4361532 - DNA, 17 bp, Homo sapiens
acctcatgcccagctct

SEQ ID NO: 4361533 - DNA, 20 bp, Homo sapiens
acctcatgcccagctctctg

SEQ ID NO: 4361534 - DNA, 22 bp, Homo sapiens
acctcatgcccagctctctgac

SEQ ID NO: 4361535 - DNA, 15 bp, Homo sapiens
acctgcacacaggac

SEQ ID NO: 4361536 - DNA, 19 bp, Homo sapiens
acctgtcaccgtgagcagc

SEQ ID NO: 4361537 - DNA, 14 bp, Homo sapiens
acctgtgaccagca

SEQ ID NO: 4361538 - DNA, 13 bp, Homo sapiens
acctgttttctga

SEQ ID NO: 4361539 - DNA, 15 bp, Homo sapiens
acctgttttctgaaa

SEQ ID NO: 4361540 - DNA, 14 bp, Homo sapiens
accttggagaggag

SEQ ID NO: 4361541 - DNA, 18 bp, Homo sapiens
accttgtattctctttac

SEQ ID NO: 4361542 - DNA, 14 bp, Homo sapiens
accttttaagttaa

SEQ ID NO: 4361543 - DNA, 23 bp, Homo sapiens
accttttaagttaatgaaataaa

SEQ ID NO: 4361544 - DNA, 21 bp, Homo sapiens
acgctgctgcaggacattaat

SEQ ID NO: 4361545 - DNA, 15 bp, Homo sapiens
acgcttgtgacagtg

SEQ ID NO: 4361546 - DNA, 16 bp, Homo sapiens
acgcttgtgacagtgc

SEQ ID NO: 4361547 - DNA, 15 bp, Homo sapiens
acggtaagtgttctc

SEQ ID NO: 4361548 - DNA, 18 bp, Homo sapiens
acggtgggcatttgtgag

SEQ ID NO: 4361549 - DNA, 17 bp, Homo sapiens
acgtcaagtctccttcc

SEQ ID NO: 4361550 - DNA, 17 bp, Homo sapiens
actacaaagtaaaatga

SEQ ID NO: 4361551 - DNA, 15 bp, Homo sapiens
actacatagtaagta

SEQ ID NO: 4361552 - DNA, 17 bp, Homo sapiens
actagattccacaggga

SEQ ID NO: 4361553 - DNA, 20 bp, Homo sapiens
actatataatcagattgaca

SEQ ID NO: 4361554 - DNA, 18 bp, Homo sapiens
actatattaaattctgaa

SEQ ID NO: 4361555 - DNA, 18 bp, Homo sapiens
actattgagccttgcatg

SEQ ID NO: 4361556 - DNA, 22 bp, Homo sapiens
actattgagccttgcatgtact

SEQ ID NO: 4361557 - DNA, 15 bp, Homo sapiens
actattgctcataat

SEQ ID NO: 4361558 - DNA, 17 bp, Homo sapiens
actcaacatgttactga

SEQ ID NO: 4361559 - DNA, 20 bp, Homo sapiens
actcaacatgttactgacca

SEQ ID NO: 4361560 - DNA, 19 bp, Homo sapiens
actcaacccattgttgtca

SEQ ID NO: 4361561 - DNA, 20 bp, Homo sapiens
actccatgtttggtgtttgt

SEQ ID NO: 4361562 - DNA, 13 bp, Homo sapiens
actcctggtctgt

SEQ ID NO: 4361563 - DNA, 15 bp, Homo sapiens
actcctgtacactga

SEQ ID NO: 4361564 - DNA, 16 bp, Homo sapiens
actcctgtacactgaa

SEQ ID NO: 4361565 - DNA, 14 bp, Homo sapiens
actcgactaaaaca

SEQ ID NO: 4361566 - DNA, 21 bp, Homo sapiens
actctgcccccatttccccga

SEQ ID NO: 4361567 - DNA, 16 bp, Homo sapiens
actctgtcagatggga

SEQ ID NO: 4361568 - DNA, 15 bp, Homo sapiens
actctttttttgagt

SEQ ID NO: 4361569 - DNA, 23 bp, Homo sapiens
actctttttttgagtgacagctt

SEQ ID NO: 4361570 - DNA, 12 bp, Homo sapiens
actgaactgtga

SEQ ID NO: 4361571 - DNA, 12 bp, Homo sapiens
actgaagcctgc

SEQ ID NO: 4361572 - DNA, 19 bp, Homo sapiens
actgaagcctgcaggagtt

SEQ ID NO: 4361573 - DNA, 15 bp, Homo sapiens
actgaaggggtgcac

SEQ ID NO: 4361574 - DNA, 15 bp, Homo sapiens
actgaatatttatat

SEQ ID NO: 4361575 - DNA, 22 bp, Homo sapiens
actgaatatttatatttcacta

SEQ ID NO: 4361576 - DNA, 21 bp, Homo sapiens
actgacattcctaagagtgga

SEQ ID NO: 4361577 - DNA, 20 bp, Homo sapiens
actgagtcatcttgtgagtg

SEQ ID NO: 4361578 - DNA, 18 bp, Homo sapiens
actgatgttgtgttttta

SEQ ID NO: 4361579 - DNA, 20 bp, Homo sapiens
actgccaaataaatcatcct

SEQ ID NO: 4361580 - DNA, 21 bp, Homo sapiens
actgccagaagagaattcagt

SEQ ID NO: 4361581 - DNA, 23 bp, Homo sapiens
actgcccacatttgggctcaggg

SEQ ID NO: 4361582 - DNA, 13 bp, Homo sapiens
actgccccccgag

SEQ ID NO: 4361583 - DNA, 18 bp, Homo sapiens
actgccccccgaggctgc

SEQ ID NO: 4361584 - DNA, 20 bp, Homo sapiens
actgccccccgaggctgcta

SEQ ID NO: 4361585 - DNA, 15 bp, Homo sapiens
actgctctcctccac

SEQ ID NO: 4361586 - DNA, 21 bp, Homo sapiens
actgctctcctccacctcaac

SEQ ID NO: 4361587 - DNA, 19 bp, Homo sapiens
actgctgcatactttgaca

SEQ ID NO: 4361588 - DNA, 23 bp, Homo sapiens
actgggctgggcctcgtgcgccc

SEQ ID NO: 4361589 - DNA, 16 bp, Homo sapiens
actgggtgcgtctcca

SEQ ID NO: 4361590 - DNA, 20 bp, Homo sapiens
actgggttctttggaagcag

SEQ ID NO: 4361591 - DNA, 14 bp, Homo sapiens
actgtaactgtcag

SEQ ID NO: 4361592 - DNA, 11 bp, Homo sapiens
actgtactgtg

SEQ ID NO: 4361593 - DNA, 15 bp, Homo sapiens
actgtctatatatat

SEQ ID NO: 4361594 - DNA, 14 bp, Homo sapiens
actgtcttcccgat

SEQ ID NO: 4361595 - DNA, 14 bp, Homo sapiens
actgtggccccaag

SEQ ID NO: 4361596 - DNA, 15 bp, Homo sapiens
actgtggtttcagat

SEQ ID NO: 4361597 - DNA, 19 bp, Homo sapiens
actgtggtttcagatgtgc

SEQ ID NO: 4361598 - DNA, 22 bp, Homo sapiens
actgtggtttcagatgtgcaat

SEQ ID NO: 4361599 - DNA, 17 bp, Homo sapiens
actgtgtggactgtgat

SEQ ID NO: 4361600 - DNA, 15 bp, Homo sapiens
actgttggattcaga

SEQ ID NO: 4361601 - DNA, 17 bp, Homo sapiens
actgttggattcagaaa

SEQ ID NO: 4361602 - DNA, 14 bp, Homo sapiens
actgttttgggcct

SEQ ID NO: 4361603 - DNA, 13 bp, Homo sapiens
acttaataaattc

SEQ ID NO: 4361604 - DNA, 17 bp, Homo sapiens
acttaataaattcagat

SEQ ID NO: 4361605 - DNA, 16 bp, Homo sapiens
acttacaaaatgccaa

SEQ ID NO: 4361606 - DNA, 20 bp, Homo sapiens
acttcagggcagggctctga

SEQ ID NO: 4361607 - DNA, 23 bp, Homo sapiens
acttcagggcagggctctgatat

SEQ ID NO: 4361608 - DNA, 19 bp, Homo sapiens
acttcccattttggaagtt

SEQ ID NO: 4361609 - DNA, 15 bp, Homo sapiens
acttcctgtaatgta

SEQ ID NO: 4361610 - DNA, 14 bp, Homo sapiens
acttctaatttgta

SEQ ID NO: 4361611 - DNA, 22 bp, Homo sapiens
acttctagcatatagactatat

SEQ ID NO: 4361612 - DNA, 22 bp, Homo sapiens
acttgaaggatggatgagtcag

SEQ ID NO: 4361613 - DNA, 20 bp, Homo sapiens
acttgaatattcctggactt

SEQ ID NO: 4361614 - DNA, 20 bp, Homo sapiens
acttgtgtgtgggctgtgag

SEQ ID NO: 4361615 - DNA, 21 bp, Homo sapiens
actttagagtagcatgagaga

SEQ ID NO: 4361616 - DNA, 19 bp, Homo sapiens
actttgaaaagttggaagg

SEQ ID NO: 4361617 - DNA, 23 bp, Homo sapiens
actttgaagggcaagaaatggcg

SEQ ID NO: 4361618 - DNA, 14 bp, Homo sapiens
actttgacaaggaa

SEQ ID NO: 4361619 - DNA, 18 bp, Homo sapiens
actttgtgcattctggat

SEQ ID NO: 4361620 - DNA, 13 bp, Homo sapiens
acttttcacactg

SEQ ID NO: 4361621 - DNA, 14 bp, Homo sapiens
acttttcacactgt

SEQ ID NO: 4361622 - DNA, 20 bp, Homo sapiens
acttttcacactgtcttccc

SEQ ID NO: 4361623 - DNA, 23 bp, Homo sapiens
acttttcacactgtcttcccgat

SEQ ID NO: 4361624 - DNA, 15 bp, Homo sapiens
agaaaacaagcgttt

SEQ ID NO: 4361625 - DNA, 21 bp, Homo sapiens
agaaaattggaactctactca

SEQ ID NO: 4361626 - DNA, 18 bp, Homo sapiens
agaaacacccctctgtct

SEQ ID NO: 4361627 - DNA, 20 bp, Homo sapiens
agaaacacccctctgtctag

SEQ ID NO: 4361628 - DNA, 14 bp, Homo sapiens
agaaaccaagccat

SEQ ID NO: 4361629 - DNA, 20 bp, Homo sapiens
agaaagcactacaatcatgg

SEQ ID NO: 4361630 - DNA, 17 bp, Homo sapiens
agaaagcatccctcacc

SEQ ID NO: 4361631 - DNA, 22 bp, Homo sapiens
agaaagcatccctcacccatcc

SEQ ID NO: 4361632 - DNA, 14 bp, Homo sapiens
agaaaggcagccct

SEQ ID NO: 4361633 - DNA, 13 bp, Homo sapiens
cagtcatggtact

SEQ ID NO: 4361634 - DNA, 21 bp, Homo sapiens
cagtcatggtactaccccagc

SEQ ID NO: 4361635 - DNA, 19 bp, Homo sapiens
cagtccaaccagaaacacc

SEQ ID NO: 4361636 - DNA, 14 bp, Homo sapiens
cagtccctggagct

SEQ ID NO: 4361637 - DNA, 15 bp, Homo sapiens
cagtccctggagctg

SEQ ID NO: 4361638 - DNA, 18 bp, Homo sapiens
cagtctaagtgtaaatgt

SEQ ID NO: 4361639 - DNA, 21 bp, Homo sapiens
cagtctgttatgcactgtggt

SEQ ID NO: 4361640 - DNA, 18 bp, Homo sapiens
cagtgaaacaaatttaca

SEQ ID NO: 4361641 - DNA, 12 bp, Homo sapiens
cagtgaacattc

SEQ ID NO: 4361642 - DNA, 18 bp, Homo sapiens
cagtgaacattcccagcc

SEQ ID NO: 4361643 - DNA, 18 bp, Homo sapiens
cagtgaatgctagacaga

SEQ ID NO: 4361644 - DNA, 17 bp, Homo sapiens
cagtgcatatgcaatgt

SEQ ID NO: 4361645 - DNA, 15 bp, Homo sapiens
cagtgcctcttccag

SEQ ID NO: 4361646 - DNA, 20 bp, Homo sapiens
cagtgcctgggaatgtatta

SEQ ID NO: 4361647 - DNA, 20 bp, Homo sapiens
cagtggggtcccccctgagt

SEQ ID NO: 4361648 - DNA, 21 bp, Homo sapiens
cagtggggtcccccctgagtg

SEQ ID NO: 4361649 - DNA, 14 bp, Homo sapiens
cagtggtgattacc

SEQ ID NO: 4361650 - DNA, 16 bp, Homo sapiens
cagtgtacacgtctgg

SEQ ID NO: 4361651 - DNA, 19 bp, Homo sapiens
cagtgtacacgtctggacc

SEQ ID NO: 4361652 - DNA, 21 bp, Homo sapiens
cagtgtacacgtctggacccc

SEQ ID NO: 4361653 - DNA, 23 bp, Homo sapiens
cagtgtggagttcaccttggaag

SEQ ID NO: 4361654 - DNA, 13 bp, Homo sapiens
cagtttggccctg

SEQ ID NO: 4361655 - DNA, 14 bp, Homo sapiens
cagtttggccctgg

SEQ ID NO: 4361656 - DNA, 19 bp, Homo sapiens
cagtttggccctggagcca

SEQ ID NO: 4361657 - DNA, 21 bp, Homo sapiens
cataaaagatcaccttgtatt

SEQ ID NO: 4361658 - DNA, 14 bp, Homo sapiens
catactcaaggtga

SEQ ID NO: 4361659 - DNA, 20 bp, Homo sapiens
catactgattgggaggtgcg

SEQ ID NO: 4361660 - DNA, 23 bp, Homo sapiens
catactgattgggaggtgcgtgt

SEQ ID NO: 4361661 - DNA, 14 bp, Homo sapiens
catactttgacaag

SEQ ID NO: 4361662 - DNA, 18 bp, Homo sapiens
catactttgacaaggaaa

SEQ ID NO: 4361663 - DNA, 18 bp, Homo sapiens
catagcatagccagcatt

SEQ ID NO: 4361664 - DNA, 21 bp, Homo sapiens
catagccagcattcagcacac

SEQ ID NO: 4361665 - DNA, 22 bp, Homo sapiens
catagccagcattcagcacaca

SEQ ID NO: 4361666 - DNA, 16 bp, Homo sapiens
catatagaatatatta

SEQ ID NO: 4361667 - DNA, 15 bp, Homo sapiens
catatggaaatgtta

SEQ ID NO: 4361668 - DNA, 22 bp, Homo sapiens
catatttatagcaatccatgtt

SEQ ID NO: 4361669 - DNA, 16 bp, Homo sapiens
catatttattgcattg

SEQ ID NO: 4361670 - DNA, 21 bp, Homo sapiens
catatttattgcattgctggt

SEQ ID NO: 4361671 - DNA, 15 bp, Homo sapiens
catcagaagtttgca

SEQ ID NO: 4361672 - DNA, 17 bp, Homo sapiens
catcagctgtaagaaga

SEQ ID NO: 4361673 - DNA, 23 bp, Homo sapiens
catcagctgtaagaagagactgg

SEQ ID NO: 4361674 - DNA, 13 bp, Homo sapiens
catccaatcctca

SEQ ID NO: 4361675 - DNA, 15 bp, Homo sapiens
catccaatcctcact

SEQ ID NO: 4361676 - DNA, 16 bp, Homo sapiens
catccaatcctcactg

SEQ ID NO: 4361677 - DNA, 21 bp, Homo sapiens
catccaatcctcactgggtgg

SEQ ID NO: 4361678 - DNA, 15 bp, Homo sapiens
catccccttccccca

SEQ ID NO: 4361679 - DNA, 20 bp, Homo sapiens
catccccttcccccatccct

SEQ ID NO: 4361680 - DNA, 16 bp, Homo sapiens
catccctaccactgtg

SEQ ID NO: 4361681 - DNA, 13 bp, Homo sapiens
catccctcaccca

SEQ ID NO: 4361682 - DNA, 21 bp, Homo sapiens
catcggagttgacagtgaaac

SEQ ID NO: 4361683 - DNA, 14 bp, Homo sapiens
catctccatcagct

SEQ ID NO: 4361684 - DNA, 19 bp, Homo sapiens
catctcctgtgcatgggtg

SEQ ID NO: 4361685 - DNA, 17 bp, Homo sapiens
catctgtaagagcttgc

SEQ ID NO: 4361686 - DNA, 19 bp, Homo sapiens
catctgtaagagcttgctc

SEQ ID NO: 4361687 - DNA, 15 bp, Homo sapiens
catgaagctgttgtg

SEQ ID NO: 4361688 - DNA, 16 bp, Homo sapiens
catgaatgcacactag

SEQ ID NO: 4361689 - DNA, 13 bp, Homo sapiens
catgaatgtatca

SEQ ID NO: 4361690 - DNA, 18 bp, Homo sapiens
catgaatgtatcaggaaa

SEQ ID NO: 4361691 - DNA, 12 bp, Homo sapiens
catgacccagcc

SEQ ID NO: 4361692 - DNA, 16 bp, Homo sapiens
catgacccagcctgaa

SEQ ID NO: 4361693 - DNA, 18 bp, Homo sapiens
catgacctgtgaccagca

SEQ ID NO: 4361694 - DNA, 15 bp, Homo sapiens
catgatgtaaaaaat

SEQ ID NO: 4361695 - DNA, 20 bp, Homo sapiens
catgcactgatgttgtgttt

SEQ ID NO: 4361696 - DNA, 14 bp, Homo sapiens
catgcagaaagcat

SEQ ID NO: 4361697 - DNA, 16 bp, Homo sapiens
catgccccagctctgg

SEQ ID NO: 4361698 - DNA, 18 bp, Homo sapiens
catgccccagctctggat

SEQ ID NO: 4361699 - DNA, 21 bp, Homo sapiens
catggagaagggttctgccct

SEQ ID NO: 4361700 - DNA, 21 bp, Homo sapiens
catggccgaagccccttggag

SEQ ID NO: 4361701 - DNA, 14 bp, Homo sapiens
catgggagggatca

SEQ ID NO: 4361702 - DNA, 15 bp, Homo sapiens
catgggagggatcag

SEQ ID NO: 4361703 - DNA, 19 bp, Homo sapiens
catgggagggatcagcccc

SEQ ID NO: 4361704 - DNA, 20 bp, Homo sapiens
catgggagggatcagccccg

SEQ ID NO: 4361705 - DNA, 19 bp, Homo sapiens
catgggtgaagggagagcc

SEQ ID NO: 4361706 - DNA, 17 bp, Homo sapiens
catggtgtctcccaaca

SEQ ID NO: 4361707 - DNA, 18 bp, Homo sapiens
catggttgggggaatgca

SEQ ID NO: 4361708 - DNA, 12 bp, Homo sapiens
catgtacttgaa

SEQ ID NO: 4361709 - DNA, 18 bp, Homo sapiens
catgtacttgaaggatgg

SEQ ID NO: 4361710 - DNA, 17 bp, Homo sapiens
catgtggggacagggct

SEQ ID NO: 4361711 - DNA, 16 bp, Homo sapiens
cattaagcacacacat

SEQ ID NO: 4361712 - DNA, 23 bp, Homo sapiens
cattaagcacacacatctggccc

SEQ ID NO: 4361713 - DNA, 17 bp, Homo sapiens
cattaatctcaaagaga

SEQ ID NO: 4361714 - DNA, 13 bp, Homo sapiens
cattccgttagga

SEQ ID NO: 4361715 - DNA, 23 bp, Homo sapiens
cattccgttaggaataacactgc

SEQ ID NO: 4361716 - DNA, 19 bp, Homo sapiens
cattgcccatggctgggaa

SEQ ID NO: 4361717 - DNA, 19 bp, Homo sapiens
cattgctggtagagacccc

SEQ ID NO: 4361718 - DNA, 19 bp, Homo sapiens
cattggctcagcccgctga

SEQ ID NO: 4361719 - DNA, 17 bp, Homo sapiens
cattgggctcacttcta

SEQ ID NO: 4361720 - DNA, 11 bp, Homo sapiens
cattgtcctgt

SEQ ID NO: 4361721 - DNA, 19 bp, Homo sapiens
cattgttataattactaat

SEQ ID NO: 4361722 - DNA, 18 bp, Homo sapiens
catttatgacctaagtca

SEQ ID NO: 4361723 - DNA, 19 bp, Homo sapiens
catttatgacctaagtcag

SEQ ID NO: 4361724 - DNA, 22 bp, Homo sapiens
catttatgacctaagtcaggta

SEQ ID NO: 4361725 - DNA, 18 bp, Homo sapiens
catttggtctcaggcagc

SEQ ID NO: 4361726 - DNA, 15 bp, Homo sapiens
cattttattaaactt

SEQ ID NO: 4361727 - DNA, 16 bp, Homo sapiens
cattttattaaactta

SEQ ID NO: 4361728 - DNA, 22 bp, Homo sapiens
cattttggaagttttcaggact

SEQ ID NO: 4361729 - DNA, 12 bp, Homo sapiens
ccaaacaaggaa

SEQ ID NO: 4361730 - DNA, 19 bp, Homo sapiens
ccaaagcagcaggcctctg

SEQ ID NO: 4361731 - DNA, 23 bp, Homo sapiens
ccaacatgcactgatgttgtgtt

SEQ ID NO: 4361732 - DNA, 19 bp, Homo sapiens
ccaacatgggagggatcag

SEQ ID NO: 4361733 - DNA, 21 bp, Homo sapiens
ccaagaggggcgggctcagag

SEQ ID NO: 4361734 - DNA, 22 bp, Homo sapiens
ccaagaggggcgggctcagagc

SEQ ID NO: 4361735 - DNA, 14 bp, Homo sapiens
ccaagcctgctggc

SEQ ID NO: 4361736 - DNA, 13 bp, Homo sapiens
ccaagtatgcctt

SEQ ID NO: 4361737 - DNA, 15 bp, Homo sapiens
ccaatcctcactggg

SEQ ID NO: 4361738 - DNA, 17 bp, Homo sapiens
ccaatcctcactgggtg

SEQ ID NO: 4361739 - DNA, 23 bp, Homo sapiens
ccaattaggaagtgtaacagctg

SEQ ID NO: 4361740 - DNA, 18 bp, Homo sapiens
ccacaaccctgttttata

SEQ ID NO: 4361741 - DNA, 14 bp, Homo sapiens
ccacacccagcggc

SEQ ID NO: 4361742 - DNA, 22 bp, Homo sapiens
ccacactgggtgcgtctccagt

SEQ ID NO: 4361743 - DNA, 14 bp, Homo sapiens
ccacagctgggcag

SEQ ID NO: 4361744 - DNA, 19 bp, Homo sapiens
ccacagctgggcagggtga

SEQ ID NO: 4361745 - DNA, 20 bp, Homo sapiens
ccacatggtgtctcccaaca

SEQ ID NO: 4361746 - DNA, 16 bp, Homo sapiens
ccacatttgggctcag

SEQ ID NO: 4361747 - DNA, 17 bp, Homo sapiens
ccacatttgggctcagg

SEQ ID NO: 4361748 - DNA, 14 bp, Homo sapiens
ccaccatccccacc

SEQ ID NO: 4361749 - DNA, 15 bp, Homo sapiens
ccacccaagcctgct

SEQ ID NO: 4361750 - DNA, 18 bp, Homo sapiens
ccacccaagcctgctggc

SEQ ID NO: 4361751 - DNA, 15 bp, Homo sapiens
ccacccgccgcctcc

SEQ ID NO: 4361752 - DNA, 18 bp, Homo sapiens
ccacccgtggggtgctgc

SEQ ID NO: 4361753 - DNA, 13 bp, Homo sapiens
ccaccctgccaag

SEQ ID NO: 4361754 - DNA, 21 bp, Homo sapiens
ccaccggaggtcactccacca

SEQ ID NO: 4361755 - DNA, 12 bp, Homo sapiens
atttttatgcag

SEQ ID NO: 4361756 - DNA, 15 bp, Homo sapiens
atttttatgcagaca

SEQ ID NO: 4361757 - DNA, 14 bp, Homo sapiens
atttttatttatat

SEQ ID NO: 4361758 - DNA, 21 bp, Homo sapiens
atttttgagatattaaagatt

SEQ ID NO: 4361759 - DNA, 17 bp, Homo sapiens
caaaaactgtactgtgt

SEQ ID NO: 4361760 - DNA, 18 bp, Homo sapiens
caaaaatcaaagaacaga

SEQ ID NO: 4361761 - DNA, 19 bp, Homo sapiens
caaaaatcaaagaacagat

SEQ ID NO: 4361762 - DNA, 13 bp, Homo sapiens
caaaagacaaaaa

SEQ ID NO: 4361763 - DNA, 21 bp, Homo sapiens
caaaagacaaaaatcaaagaa

SEQ ID NO: 4361764 - DNA, 15 bp, Homo sapiens
caaaatttaagttaa

SEQ ID NO: 4361765 - DNA, 16 bp, Homo sapiens
caaacaaggaagccaa

SEQ ID NO: 4361766 - DNA, 19 bp, Homo sapiens
caaacctactgcccacatt

SEQ ID NO: 4361767 - DNA, 20 bp, Homo sapiens
caaacctactgcccacattt

SEQ ID NO: 4361768 - DNA, 23 bp, Homo sapiens
caaacgtctattttgtatatttg

SEQ ID NO: 4361769 - DNA, 19 bp, Homo sapiens
caaagagattcgaatgacg

SEQ ID NO: 4361770 - DNA, 19 bp, Homo sapiens
caaagcagcaggcctctgg

SEQ ID NO: 4361771 - DNA, 12 bp, Homo sapiens
caaagtaaaatg

SEQ ID NO: 4361772 - DNA, 14 bp, Homo sapiens
caaagttttcaaac

SEQ ID NO: 4361773 - DNA, 20 bp, Homo sapiens
caaataaatcatcctcatgt

SEQ ID NO: 4361774 - DNA, 22 bp, Homo sapiens
caaataaatcatcctcatgtcc

SEQ ID NO: 4361775 - DNA, 14 bp, Homo sapiens
caaatctaccactg

SEQ ID NO: 4361776 - DNA, 16 bp, Homo sapiens
caaatgaatttgctaa

SEQ ID NO: 4361777 - DNA, 20 bp, Homo sapiens
caaatgaatttgctaaatac

SEQ ID NO: 4361778 - DNA, 15 bp, Homo sapiens
caaattgccttcagc

SEQ ID NO: 4361779 - DNA, 12 bp, Homo sapiens
caaattgctgct

SEQ ID NO: 4361780 - DNA, 19 bp, Homo sapiens
caacatgggagggatcagc

SEQ ID NO: 4361781 - DNA, 20 bp, Homo sapiens
caacatgttactgaccagca

SEQ ID NO: 4361782 - DNA, 23 bp, Homo sapiens
caacatttatgacctaagtcagg

SEQ ID NO: 4361783 - DNA, 18 bp, Homo sapiens
caaccagaaacacccctc

SEQ ID NO: 4361784 - DNA, 22 bp, Homo sapiens
caacccattgttgtcaaggaag

SEQ ID NO: 4361785 - DNA, 19 bp, Homo sapiens
caaccctgttttatactgt

SEQ ID NO: 4361786 - DNA, 21 bp, Homo sapiens
caactgaaggggtgcacccac

SEQ ID NO: 4361787 - DNA, 19 bp, Homo sapiens
caactgttggattcagaaa

SEQ ID NO: 4361788 - DNA, 21 bp, Homo sapiens
caagaaatgattcaaattgct

SEQ ID NO: 4361789 - DNA, 12 bp, Homo sapiens
caagaaatggcg

SEQ ID NO: 4361790 - DNA, 17 bp, Homo sapiens
caagaggggcgggctca

SEQ ID NO: 4361791 - DNA, 20 bp, Homo sapiens
caagaggggcgggctcagag

SEQ ID NO: 4361792 - DNA, 23 bp, Homo sapiens
caagaggggcgggctcagagctt

SEQ ID NO: 4361793 - DNA, 13 bp, Homo sapiens
caagatctttcag

SEQ ID NO: 4361794 - DNA, 14 bp, Homo sapiens
caagatctttcagg

SEQ ID NO: 4361795 - DNA, 14 bp, Homo sapiens
caagcctgctggct

SEQ ID NO: 4361796 - DNA, 16 bp, Homo sapiens
caagcctgctggctgc

SEQ ID NO: 4361797 - DNA, 20 bp, Homo sapiens
caagcctgctggctgcggcc

SEQ ID NO: 4361798 - DNA, 14 bp, Homo sapiens
caaggaagccaaag

SEQ ID NO: 4361799 - DNA, 21 bp, Homo sapiens
caaggaagccaaagttttcaa

SEQ ID NO: 4361800 - DNA, 17 bp, Homo sapiens
caagggcacattgccca

SEQ ID NO: 4361801 - DNA, 18 bp, Homo sapiens
caagggcacattgcccat

SEQ ID NO: 4361802 - DNA, 12 bp, Homo sapiens
caagtatgcctt

SEQ ID NO: 4361803 - DNA, 14 bp, Homo sapiens
caagtatgccttaa

SEQ ID NO: 4361804 - DNA, 22 bp, Homo sapiens
caagtatggtaggggagggcag

SEQ ID NO: 4361805 - DNA, 18 bp, Homo sapiens
caagtgtataactaaact

SEQ ID NO: 4361806 - DNA, 21 bp, Homo sapiens
caataaaatgtgatttttctg

SEQ ID NO: 4361807 - DNA, 19 bp, Homo sapiens
caataagttacttgaaata

SEQ ID NO: 4361808 - DNA, 20 bp, Homo sapiens
caataagttacttgaaataa

SEQ ID NO: 4361809 - DNA, 18 bp, Homo sapiens
caataatttgtacaatgg

SEQ ID NO: 4361810 - DNA, 22 bp, Homo sapiens
caatataagcataaaagatcac

SEQ ID NO: 4361811 - DNA, 19 bp, Homo sapiens
caatcaggtaagatcataa

SEQ ID NO: 4361812 - DNA, 23 bp, Homo sapiens
caatccatgttagtttttacttt

SEQ ID NO: 4361813 - DNA, 17 bp, Homo sapiens
caatcctcactgggtgg

SEQ ID NO: 4361814 - DNA, 15 bp, Homo sapiens
caattaggaagtgta

SEQ ID NO: 4361815 - DNA, 23 bp, Homo sapiens
caattaggaagtgtaacagctga

SEQ ID NO: 4361816 - DNA, 11 bp, Homo sapiens
caattctaaat

SEQ ID NO: 4361817 - DNA, 13 bp, Homo sapiens
caattctaaatcc

SEQ ID NO: 4361818 - DNA, 18 bp, Homo sapiens
caattctgggagaatgaa

SEQ ID NO: 4361819 - DNA, 19 bp, Homo sapiens
caattttatataattctga

SEQ ID NO: 4361820 - DNA, 17 bp, Homo sapiens
cacaaacctactgccca

SEQ ID NO: 4361821 - DNA, 18 bp, Homo sapiens
cacaaacctactgcccac

SEQ ID NO: 4361822 - DNA, 21 bp, Homo sapiens
cacaagagcccagcagggcct

SEQ ID NO: 4361823 - DNA, 21 bp, Homo sapiens
cacacaaacctactgcccaca

SEQ ID NO: 4361824 - DNA, 22 bp, Homo sapiens
cacacacaaacctactgcccac

SEQ ID NO: 4361825 - DNA, 14 bp, Homo sapiens
cacacagagtggtc

SEQ ID NO: 4361826 - DNA, 22 bp, Homo sapiens
cacacagggcccggccacaccc

SEQ ID NO: 4361827 - DNA, 20 bp, Homo sapiens
cacactgggtgcgtctccag

SEQ ID NO: 4361828 - DNA, 13 bp, Homo sapiens
cacacttgtgtgt

SEQ ID NO: 4361829 - DNA, 20 bp, Homo sapiens
cacactttttttcctctttc

SEQ ID NO: 4361830 - DNA, 22 bp, Homo sapiens
cacagagtggtctttctggaga

SEQ ID NO: 4361831 - DNA, 17 bp, Homo sapiens
cacagatggatttgcct

SEQ ID NO: 4361832 - DNA, 12 bp, Homo sapiens
cacagccacccg

SEQ ID NO: 4361833 - DNA, 13 bp, Homo sapiens
cacatctggccct

SEQ ID NO: 4361834 - DNA, 15 bp, Homo sapiens
cacatggtgtctccc

SEQ ID NO: 4361835 - DNA, 22 bp, Homo sapiens
cacatggtgtctcccaacatgg

SEQ ID NO: 4361836 - DNA, 16 bp, Homo sapiens
cacattaatctcaaag

SEQ ID NO: 4361837 - DNA, 17 bp, Homo sapiens
cacattgcccatggctg

SEQ ID NO: 4361838 - DNA, 18 bp, Homo sapiens
cacatttaccctttggcc

SEQ ID NO: 4361839 - DNA, 17 bp, Homo sapiens
cacccaagcctgctggc

SEQ ID NO: 4361840 - DNA, 14 bp, Homo sapiens
cacccacctgtttt

SEQ ID NO: 4361841 - DNA, 18 bp, Homo sapiens
cacccacctgttttctga

SEQ ID NO: 4361842 - DNA, 19 bp, Homo sapiens
cacccacctgttttctgaa

SEQ ID NO: 4361843 - DNA, 10 bp, Homo sapiens
caccccaccc

SEQ ID NO: 4361844 - DNA, 14 bp, Homo sapiens
cacccgactcctca

SEQ ID NO: 4361845 - DNA, 15 bp, Homo sapiens
cacccgactcctcaa

SEQ ID NO: 4361846 - DNA, 18 bp, Homo sapiens
cacccgtggggtgctgcc

SEQ ID NO: 4361847 - DNA, 19 bp, Homo sapiens
cacccgtggggtgctgccc

SEQ ID NO: 4361848 - DNA, 19 bp, Homo sapiens
caccctccggccagcgagt

SEQ ID NO: 4361849 - DNA, 17 bp, Homo sapiens
caccggaggtcactcca

SEQ ID NO: 4361850 - DNA, 15 bp, Homo sapiens
cacctcggggacacc

SEQ ID NO: 4361851 - DNA, 16 bp, Homo sapiens
cacctctgaggacaga

SEQ ID NO: 4361852 - DNA, 12 bp, Homo sapiens
cacctctttaaa

SEQ ID NO: 4361853 - DNA, 14 bp, Homo sapiens
cacctgttttctga

SEQ ID NO: 4361854 - DNA, 12 bp, Homo sapiens
caccttggaagg

SEQ ID NO: 4361855 - DNA, 18 bp, Homo sapiens
caccttttaagttaatga

SEQ ID NO: 4361856 - DNA, 23 bp, Homo sapiens
caccttttaagttaatgaaataa

SEQ ID NO: 4361857 - DNA, 14 bp, Homo sapiens
cacgagcaaaccca

SEQ ID NO: 4361858 - DNA, 17 bp, Homo sapiens
cacgagcaaacccagag

SEQ ID NO: 4361859 - DNA, 18 bp, Homo sapiens
cacgtgacagtgcctggg

SEQ ID NO: 4361860 - DNA, 12 bp, Homo sapiens
cactacaatcat

SEQ ID NO: 4361861 - DNA, 23 bp, Homo sapiens
cactatttttatttatatttttg

SEQ ID NO: 4361862 - DNA, 16 bp, Homo sapiens
cactcaaatgaatttg

SEQ ID NO: 4361863 - DNA, 16 bp, Homo sapiens
cactcagtaaaacata

SEQ ID NO: 4361864 - DNA, 11 bp, Homo sapiens
cactcctgggg

SEQ ID NO: 4361865 - DNA, 19 bp, Homo sapiens
cactcctggggcctcttgg

SEQ ID NO: 4361866 - DNA, 13 bp, Homo sapiens
cactcctgtacac

SEQ ID NO: 4361867 - DNA, 13 bp, Homo sapiens
cactctaatataa

SEQ ID NO: 4361868 - DNA, 12 bp, Homo sapiens
cactctgccccc

SEQ ID NO: 4361869 - DNA, 15 bp, Homo sapiens
cactctgcccccatt

SEQ ID NO: 4361870 - DNA, 19 bp, Homo sapiens
cactgatgttgtgttttta

SEQ ID NO: 4361871 - DNA, 21 bp, Homo sapiens
cactgccccccgaggctgcta

SEQ ID NO: 4361872 - DNA, 22 bp, Homo sapiens
cactgccccccgaggctgctag

SEQ ID NO: 4361873 - DNA, 18 bp, Homo sapiens
cactgggtgcgtctccag

SEQ ID NO: 4361874 - DNA, 15 bp, Homo sapiens
cactgggtggggtga

SEQ ID NO: 4361875 - DNA, 15 bp, Homo sapiens
cactgtatgagtgga

SEQ ID NO: 4361876 - DNA, 12 bp, Homo sapiens
cactgtctcagt

SEQ ID NO: 4361877 - DNA, 15 bp, Homo sapiens
cactgtggtttcaga

SEQ ID NO: 4361878 - DNA, 13 bp, Homo sapiens
atctttatcatcg

SEQ ID NO: 4361879 - DNA, 22 bp, Homo sapiens
atctttatcatcggagttgaca

SEQ ID NO: 4361880 - DNA, 12 bp, Homo sapiens
atgaaagcatgt

SEQ ID NO: 4361881 - DNA, 17 bp, Homo sapiens
atgaaataaaatttgaa

SEQ ID NO: 4361882 - DNA, 13 bp, Homo sapiens
atgaacagctgtg

SEQ ID NO: 4361883 - DNA, 15 bp, Homo sapiens
atgaagcaggaggcc

SEQ ID NO: 4361884 - DNA, 13 bp, Homo sapiens
atgaagctgttgt

SEQ ID NO: 4361885 - DNA, 22 bp, Homo sapiens
atgaataccaggatagctttat

SEQ ID NO: 4361886 - DNA, 13 bp, Homo sapiens
atgaatgtatcag

SEQ ID NO: 4361887 - DNA, 14 bp, Homo sapiens
atgacatgaaatga

SEQ ID NO: 4361888 - DNA, 15 bp, Homo sapiens
atgacccacactgcc

SEQ ID NO: 4361889 - DNA, 19 bp, Homo sapiens
atgacccacactgccagaa

SEQ ID NO: 4361890 - DNA, 14 bp, Homo sapiens
atgacccagcctga

SEQ ID NO: 4361891 - DNA, 22 bp, Homo sapiens
atgacctaagtcaggtaatata

SEQ ID NO: 4361892 - DNA, 19 bp, Homo sapiens
atgacggtaagtgttctca

SEQ ID NO: 4361893 - DNA, 21 bp, Homo sapiens
atgacttacaggctaaaatta

SEQ ID NO: 4361894 - DNA, 14 bp, Homo sapiens
atgagcgccacctc

SEQ ID NO: 4361895 - DNA, 17 bp, Homo sapiens
atgaggaatccaaaaga

SEQ ID NO: 4361896 - DNA, 21 bp, Homo sapiens
atgagtggaaattaagacttt

SEQ ID NO: 4361897 - DNA, 21 bp, Homo sapiens
atgatgttagaagaagaggaa

SEQ ID NO: 4361898 - DNA, 23 bp, Homo sapiens
atgatttcccaaatgaaatactg

SEQ ID NO: 4361899 - DNA, 21 bp, Homo sapiens
atgcaatataagcataaaaga

SEQ ID NO: 4361900 - DNA, 22 bp, Homo sapiens
atgcacactagcctctccagga

SEQ ID NO: 4361901 - DNA, 16 bp, Homo sapiens
atgcactgatgttgtg

SEQ ID NO: 4361902 - DNA, 15 bp, Homo sapiens
atgcactgtggtttc

SEQ ID NO: 4361903 - DNA, 22 bp, Homo sapiens
atgcactgtggtttcagatgtg

SEQ ID NO: 4361904 - DNA, 16 bp, Homo sapiens
atgcagaaagcatccc

SEQ ID NO: 4361905 - DNA, 23 bp, Homo sapiens
atgcagacctcatgcccagctct

SEQ ID NO: 4361906 - DNA, 16 bp, Homo sapiens
atgcaggaggtggaga

SEQ ID NO: 4361907 - DNA, 21 bp, Homo sapiens
atgccaagggggtgactggaa

SEQ ID NO: 4361908 - DNA, 16 bp, Homo sapiens
atgccacacagagtgg

SEQ ID NO: 4361909 - DNA, 13 bp, Homo sapiens
atgcccagctctc

SEQ ID NO: 4361910 - DNA, 15 bp, Homo sapiens
atgcccagctctctg

SEQ ID NO: 4361911 - DNA, 13 bp, Homo sapiens
atgccccagctct

SEQ ID NO: 4361912 - DNA, 23 bp, Homo sapiens
atgcccctgcagtttggccctgg

SEQ ID NO: 4361913 - DNA, 17 bp, Homo sapiens
atgcccggcgccgggca

SEQ ID NO: 4361914 - DNA, 16 bp, Homo sapiens
atgccttaagcagaac

SEQ ID NO: 4361915 - DNA, 23 bp, Homo sapiens
atgccttaagcagaacaaatgtg

SEQ ID NO: 4361916 - DNA, 20 bp, Homo sapiens
atgctacaatggaaaccatt

SEQ ID NO: 4361917 - DNA, 11 bp, Homo sapiens
atgctgctctc

SEQ ID NO: 4361918 - DNA, 22 bp, Homo sapiens
atgctgctctcagcctcccaca

SEQ ID NO: 4361919 - DNA, 16 bp, Homo sapiens
atgctttccctgagga

SEQ ID NO: 4361920 - DNA, 14 bp, Homo sapiens
atggagacttctaa

SEQ ID NO: 4361921 - DNA, 16 bp, Homo sapiens
atggatcagagcattt

SEQ ID NO: 4361922 - DNA, 18 bp, Homo sapiens
atggatccttccatcttg

SEQ ID NO: 4361923 - DNA, 14 bp, Homo sapiens
atggatttgcctgt

SEQ ID NO: 4361924 - DNA, 20 bp, Homo sapiens
atggcatttggtctcaggca

SEQ ID NO: 4361925 - DNA, 20 bp, Homo sapiens
atggccgaagccccttggag

SEQ ID NO: 4361926 - DNA, 13 bp, Homo sapiens
atggcgtctgctc

SEQ ID NO: 4361927 - DNA, 15 bp, Homo sapiens
atggcgtctgctctg

SEQ ID NO: 4361928 - DNA, 13 bp, Homo sapiens
atgggagggatca

SEQ ID NO: 4361929 - DNA, 16 bp, Homo sapiens
atgggagggatcagcc

SEQ ID NO: 4361930 - DNA, 18 bp, Homo sapiens
atggggggcgggccaggg

SEQ ID NO: 4361931 - DNA, 22 bp, Homo sapiens
atggggtccatccccttccccc

SEQ ID NO: 4361932 - DNA, 16 bp, Homo sapiens
atggggtctgtgactg

SEQ ID NO: 4361933 - DNA, 14 bp, Homo sapiens
atggtactacccca

SEQ ID NO: 4361934 - DNA, 14 bp, Homo sapiens
atggtgtctcccaa

SEQ ID NO: 4361935 - DNA, 16 bp, Homo sapiens
atggttgagaaatgaa

SEQ ID NO: 4361936 - DNA, 15 bp, Homo sapiens
atggtttattcccaa

SEQ ID NO: 4361937 - DNA, 16 bp, Homo sapiens
atggtttattcccaag

SEQ ID NO: 4361938 - DNA, 13 bp, Homo sapiens
atgtaatataaat

SEQ ID NO: 4361939 - DNA, 16 bp, Homo sapiens
atgtacatatggaaat

SEQ ID NO: 4361940 - DNA, 21 bp, Homo sapiens
atgtacgctgctgcaggacat

SEQ ID NO: 4361941 - DNA, 18 bp, Homo sapiens
atgtagtcagttgcattc

SEQ ID NO: 4361942 - DNA, 20 bp, Homo sapiens
atgtagtttttatatgttgt

SEQ ID NO: 4361943 - DNA, 21 bp, Homo sapiens
atgtagtttttatatgttgta

SEQ ID NO: 4361944 - DNA, 13 bp, Homo sapiens
atgtatcaggaaa

SEQ ID NO: 4361945 - DNA, 13 bp, Homo sapiens
atgtattattctg

SEQ ID NO: 4361946 - DNA, 13 bp, Homo sapiens
atgtcacagtcca

SEQ ID NO: 4361947 - DNA, 19 bp, Homo sapiens
atgtcacagtccaaccaga

SEQ ID NO: 4361948 - DNA, 15 bp, Homo sapiens
atgtcccacccaccc

SEQ ID NO: 4361949 - DNA, 16 bp, Homo sapiens
atgtccctttcttggc

SEQ ID NO: 4361950 - DNA, 20 bp, Homo sapiens
atgtccctttcttggccagt

SEQ ID NO: 4361951 - DNA, 17 bp, Homo sapiens
atgtgatacactgaatg

SEQ ID NO: 4361952 - DNA, 18 bp, Homo sapiens
atgtgcaataatttgtac

SEQ ID NO: 4361953 - DNA, 17 bp, Homo sapiens
atgttaaaaatagcagt

SEQ ID NO: 4361954 - DNA, 14 bp, Homo sapiens
atgttactgaccag

SEQ ID NO: 4361955 - DNA, 15 bp, Homo sapiens
atgttagaagaagag

SEQ ID NO: 4361956 - DNA, 22 bp, Homo sapiens
atgttatgaacagctgtgtctg

SEQ ID NO: 4361957 - DNA, 17 bp, Homo sapiens
atgttattactgttttg

SEQ ID NO: 4361958 - DNA, 12 bp, Homo sapiens
atgttgccttgg

SEQ ID NO: 4361959 - DNA, 19 bp, Homo sapiens
atgttgccttggaaacatt

SEQ ID NO: 4361960 - DNA, 14 bp, Homo sapiens
atgttgtaatattt

SEQ ID NO: 4361961 - DNA, 14 bp, Homo sapiens
attaaaaaaatttt

SEQ ID NO: 4361962 - DNA, 24 bp, Homo sapiens
attaaaaaaattttaagtatctag

SEQ ID NO: 4361963 - DNA, 14 bp, Homo sapiens
attaaaaatgcttt

SEQ ID NO: 4361964 - DNA, 14 bp, Homo sapiens
attaaaccgcatgt

SEQ ID NO: 4361965 - DNA, 19 bp, Homo sapiens
attaagcacacacatctgg

SEQ ID NO: 4361966 - DNA, 24 bp, Homo sapiens
attaagcacacacatctggccctg

SEQ ID NO: 4361967 - DNA, 17 bp, Homo sapiens
attaataaagttgcttt

SEQ ID NO: 4361968 - DNA, 16 bp, Homo sapiens
attagaaatagacagt

SEQ ID NO: 4361969 - DNA, 20 bp, Homo sapiens
attagttttaaaatactata

SEQ ID NO: 4361970 - DNA, 18 bp, Homo sapiens
attcaaattgctgcttgg

SEQ ID NO: 4361971 - DNA, 18 bp, Homo sapiens
attcaggtacagaaaaca

SEQ ID NO: 4361972 - DNA, 19 bp, Homo sapiens
attccaattctaaatccga

SEQ ID NO: 4361973 - DNA, 13 bp, Homo sapiens
attccatgaatgt

SEQ ID NO: 4361974 - DNA, 17 bp, Homo sapiens
attccatgaatgtatca

SEQ ID NO: 4361975 - DNA, 18 bp, Homo sapiens
attccatgaatgtatcag

SEQ ID NO: 4361976 - DNA, 18 bp, Homo sapiens
attcccaagtatgcctta

SEQ ID NO: 4361977 - DNA, 19 bp, Homo sapiens
attcccaagtatgccttaa

SEQ ID NO: 4361978 - DNA, 13 bp, Homo sapiens
attccgttaggaa

SEQ ID NO: 4361979 - DNA, 23 bp, Homo sapiens
attccgttaggaataacactgca

SEQ ID NO: 4361980 - DNA, 21 bp, Homo sapiens
attcctaagagtggaggagga

SEQ ID NO: 4361981 - DNA, 21 bp, Homo sapiens
attctaaatccgacttgaata

SEQ ID NO: 4361982 - DNA, 16 bp, Homo sapiens
attctgaatgcaattt

SEQ ID NO: 4361983 - DNA, 18 bp, Homo sapiens
attgacagcatatagaat

SEQ ID NO: 4361984 - DNA, 21 bp, Homo sapiens
attgagaactgacaaaggagc

SEQ ID NO: 4361985 - DNA, 23 bp, Homo sapiens
attgagccttgcatgtacttgaa

SEQ ID NO: 4361986 - DNA, 16 bp, Homo sapiens
attgatgcaatataag

SEQ ID NO: 4361987 - DNA, 22 bp, Homo sapiens
attgctggtagagacccccagg

SEQ ID NO: 4361988 - DNA, 22 bp, Homo sapiens
attggaactctactcaacccat

SEQ ID NO: 4361989 - DNA, 18 bp, Homo sapiens
attgtgtattgatgcaat

SEQ ID NO: 4361990 - DNA, 19 bp, Homo sapiens
attgtgtattgatgcaata

SEQ ID NO: 4361991 - DNA, 21 bp, Homo sapiens
atttacatcagaagtttgcat

SEQ ID NO: 4361992 - DNA, 22 bp, Homo sapiens
atttacatcagaagtttgcatc

SEQ ID NO: 4361993 - DNA, 14 bp, Homo sapiens
atttcactattttt

SEQ ID NO: 4361994 - DNA, 22 bp, Homo sapiens
atttcactatttttatttatat

SEQ ID NO: 4361995 - DNA, 17 bp, Homo sapiens
atttcccaattaggaag

SEQ ID NO: 4361996 - DNA, 17 bp, Homo sapiens
atttgcatatttattgc

SEQ ID NO: 4361997 - DNA, 19 bp, Homo sapiens
atttgcatatttattgcat

SEQ ID NO: 4361998 - DNA, 21 bp, Homo sapiens
atttggtaaaaatgctgctct

SEQ ID NO: 4361999 - DNA, 22 bp, Homo sapiens
atttgtatcggagggaaacaga

SEQ ID NO: 4362000 - DNA, 15 bp, Homo sapiens
agtgaacattcccag

SEQ ID NO: 4362001 - DNA, 18 bp, Homo sapiens
agtgagcagaacaggtag

SEQ ID NO: 4362002 - DNA, 14 bp, Homo sapiens
agtgcatatgcaat

SEQ ID NO: 4362003 - DNA, 13 bp, Homo sapiens
agtgccactgccc

SEQ ID NO: 4362004 - DNA, 21 bp, Homo sapiens
agtgcctcttccagtgaacat

SEQ ID NO: 4362005 - DNA, 13 bp, Homo sapiens
agtgcctgggaat

SEQ ID NO: 4362006 - DNA, 19 bp, Homo sapiens
agtgctgaatttccctctc

SEQ ID NO: 4362007 - DNA, 22 bp, Homo sapiens
agtggatatgacccacactgcc

SEQ ID NO: 4362008 - DNA, 16 bp, Homo sapiens
agtggcaggtgggctg

SEQ ID NO: 4362009 - DNA, 23 bp, Homo sapiens
agtggcaggtgggctgcctgctg

SEQ ID NO: 4362010 - DNA, 18 bp, Homo sapiens
agtggggggtcgtgggcc

SEQ ID NO: 4362011 - DNA, 14 bp, Homo sapiens
agtgtaaatccttt

SEQ ID NO: 4362012 - DNA, 16 bp, Homo sapiens
agtgtaacagctgagg

SEQ ID NO: 4362013 - DNA, 13 bp, Homo sapiens
agtgtaagtgtga

SEQ ID NO: 4362014 - DNA, 16 bp, Homo sapiens
agtgtctattatcaca

SEQ ID NO: 4362015 - DNA, 17 bp, Homo sapiens
agtgtgagtaagagctg

SEQ ID NO: 4362016 - DNA, 14 bp, Homo sapiens
agtgttctcatgaa

SEQ ID NO: 4362017 - DNA, 12 bp, Homo sapiens
agttaagaattg

SEQ ID NO: 4362018 - DNA, 12 bp, Homo sapiens
agttaatgaaat

SEQ ID NO: 4362019 - DNA, 15 bp, Homo sapiens
agttaatgaaataaa

SEQ ID NO: 4362020 - DNA, 23 bp, Homo sapiens
agttaatgaaataaaatttgaaa

SEQ ID NO: 4362021 - DNA, 12 bp, Homo sapiens
agttacttgaaa

SEQ ID NO: 4362022 - DNA, 16 bp, Homo sapiens
agttcaccttggaagg

SEQ ID NO: 4362023 - DNA, 18 bp, Homo sapiens
agttcaccttggaagggc

SEQ ID NO: 4362024 - DNA, 18 bp, Homo sapiens
agttcatccaatcctcac

SEQ ID NO: 4362025 - DNA, 22 bp, Homo sapiens
agttcatccaatcctcactggg

SEQ ID NO: 4362026 - DNA, 14 bp, Homo sapiens
agttccttgcctta

SEQ ID NO: 4362027 - DNA, 12 bp, Homo sapiens
agttctgctgcc

SEQ ID NO: 4362028 - DNA, 14 bp, Homo sapiens
agttctgctgccct

SEQ ID NO: 4362029 - DNA, 21 bp, Homo sapiens
agttgtttcagataaatttca

SEQ ID NO: 4362030 - DNA, 20 bp, Homo sapiens
agtttggccctggagccagg

SEQ ID NO: 4362031 - DNA, 23 bp, Homo sapiens
agtttggccctggagccagggca

SEQ ID NO: 4362032 - DNA, 12 bp, Homo sapiens
agttttaaaata

SEQ ID NO: 4362033 - DNA, 13 bp, Homo sapiens
agttttaaaatac

SEQ ID NO: 4362034 - DNA, 22 bp, Homo sapiens
agttttcaaactgctgcatact

SEQ ID NO: 4362035 - DNA, 15 bp, Homo sapiens
agttttgtctgtctc

SEQ ID NO: 4362036 - DNA, 17 bp, Homo sapiens
agttttgtctgtctccc

SEQ ID NO: 4362037 - DNA, 13 bp, Homo sapiens
ataaaagtgatca

SEQ ID NO: 4362038 - DNA, 16 bp, Homo sapiens
ataaataaaagtacag

SEQ ID NO: 4362039 - DNA, 15 bp, Homo sapiens
ataaattatatccgt

SEQ ID NO: 4362040 - DNA, 12 bp, Homo sapiens
ataaattcagat

SEQ ID NO: 4362041 - DNA, 16 bp, Homo sapiens
ataaattcagatatat

SEQ ID NO: 4362042 - DNA, 14 bp, Homo sapiens
ataacaagatcttt

SEQ ID NO: 4362043 - DNA, 16 bp, Homo sapiens
ataacaagatctttca

SEQ ID NO: 4362044 - DNA, 19 bp, Homo sapiens
ataacaagatctttcagga

SEQ ID NO: 4362045 - DNA, 20 bp, Homo sapiens
ataacactgcagccctctcc

SEQ ID NO: 4362046 - DNA, 14 bp, Homo sapiens
ataagttacttgaa

SEQ ID NO: 4362047 - DNA, 18 bp, Homo sapiens
ataagttacttgaaataa

SEQ ID NO: 4362048 - DNA, 20 bp, Homo sapiens
ataatatggatcagagcatt

SEQ ID NO: 4362049 - DNA, 13 bp, Homo sapiens
ataatcagaacac

SEQ ID NO: 4362050 - DNA, 16 bp, Homo sapiens
ataatcaggaaaaatg

SEQ ID NO: 4362051 - DNA, 18 bp, Homo sapiens
ataatcaggaaaaatgag

SEQ ID NO: 4362052 - DNA, 18 bp, Homo sapiens
ataatttcccaattagga

SEQ ID NO: 4362053 - DNA, 22 bp, Homo sapiens
ataatttcccaattaggaagtg

SEQ ID NO: 4362054 - DNA, 19 bp, Homo sapiens
ataatttgtacaatggttt

SEQ ID NO: 4362055 - DNA, 20 bp, Homo sapiens
ataatttgtacaatggttta

SEQ ID NO: 4362056 - DNA, 22 bp, Homo sapiens
ataccctccctccctaccctaa

SEQ ID NO: 4362057 - DNA, 17 bp, Homo sapiens
atactatattaaattct

SEQ ID NO: 4362058 - DNA, 12 bp, Homo sapiens
atactctgtcag

SEQ ID NO: 4362059 - DNA, 17 bp, Homo sapiens
atactgattgggaggtg

SEQ ID NO: 4362060 - DNA, 18 bp, Homo sapiens
atactgattgggaggtgc

SEQ ID NO: 4362061 - DNA, 16 bp, Homo sapiens
atactgtcttatctgc

SEQ ID NO: 4362062 - DNA, 17 bp, Homo sapiens
atactttgacaaggaaa

SEQ ID NO: 4362063 - DNA, 20 bp, Homo sapiens
atagacagtatatttatagt

SEQ ID NO: 4362064 - DNA, 20 bp, Homo sapiens
atagccagcattcagcacac

SEQ ID NO: 4362065 - DNA, 11 bp, Homo sapiens
ataggctctgc

SEQ ID NO: 4362066 - DNA, 12 bp, Homo sapiens
ataggctctgca

SEQ ID NO: 4362067 - DNA, 13 bp, Homo sapiens
ataggctctgcac

SEQ ID NO: 4362068 - DNA, 22 bp, Homo sapiens
ataggctctgcacagatggatt

SEQ ID NO: 4362069 - DNA, 18 bp, Homo sapiens
atagtaaaagataacaag

SEQ ID NO: 4362070 - DNA, 22 bp, Homo sapiens
atagttccttgccttaataaat

SEQ ID NO: 4362071 - DNA, 14 bp, Homo sapiens
atataagcataaaa

SEQ ID NO: 4362072 - DNA, 16 bp, Homo sapiens
atataattctgaaatg

SEQ ID NO: 4362073 - DNA, 19 bp, Homo sapiens
atataattctgaaatgttt

SEQ ID NO: 4362074 - DNA, 16 bp, Homo sapiens
atatacctggtttact

SEQ ID NO: 4362075 - DNA, 16 bp, Homo sapiens
atatagactatataat

SEQ ID NO: 4362076 - DNA, 18 bp, Homo sapiens
atatagttccttgcctta

SEQ ID NO: 4362077 - DNA, 19 bp, Homo sapiens
atatatgtgtgtgtatgtt

SEQ ID NO: 4362078 - DNA, 15 bp, Homo sapiens
atatatttttcacag

SEQ ID NO: 4362079 - DNA, 21 bp, Homo sapiens
atatatttttcacagtttttc

SEQ ID NO: 4362080 - DNA, 18 bp, Homo sapiens
atatgacccacactgcca

SEQ ID NO: 4362081 - DNA, 17 bp, Homo sapiens
atatggatcagagcatt

SEQ ID NO: 4362082 - DNA, 18 bp, Homo sapiens
atatgtaatataaattta

SEQ ID NO: 4362083 - DNA, 21 bp, Homo sapiens
atatgttgtaatatttcttca

SEQ ID NO: 4362084 - DNA, 18 bp, Homo sapiens
atattatcagacaagatg

SEQ ID NO: 4362085 - DNA, 14 bp, Homo sapiens
atattcctggactt

SEQ ID NO: 4362086 - DNA, 22 bp, Homo sapiens
atattcctggacttacaaaatg

SEQ ID NO: 4362087 - DNA, 17 bp, Homo sapiens
atattggtttatgtagt

SEQ ID NO: 4362088 - DNA, 21 bp, Homo sapiens
atatttattgcattgctggta

SEQ ID NO: 4362089 - DNA, 17 bp, Homo sapiens
atatttgtcttccgatc

SEQ ID NO: 4362090 - DNA, 15 bp, Homo sapiens
atcaaagaacagatg

SEQ ID NO: 4362091 - DNA, 14 bp, Homo sapiens
atcaacatttatga

SEQ ID NO: 4362092 - DNA, 16 bp, Homo sapiens
atcaataaaatgtgat

SEQ ID NO: 4362093 - DNA, 15 bp, Homo sapiens
atcagaagtttgcat

SEQ ID NO: 4362094 - DNA, 21 bp, Homo sapiens
atcagattgacagcatataga

SEQ ID NO: 4362095 - DNA, 21 bp, Homo sapiens
atcaggaaatatatatgtgtg

SEQ ID NO: 4362096 - DNA, 15 bp, Homo sapiens
atcataacaatgtct

SEQ ID NO: 4362097 - DNA, 13 bp, Homo sapiens
atcatcctcatgt

SEQ ID NO: 4362098 - DNA, 22 bp, Homo sapiens
atcatcggagttgacagtgaaa

SEQ ID NO: 4362099 - DNA, 20 bp, Homo sapiens
atcatggtcaagttcccaac

SEQ ID NO: 4362100 - DNA, 11 bp, Homo sapiens
atcatttaact

SEQ ID NO: 4362101 - DNA, 12 bp, Homo sapiens
atcatttaactg

SEQ ID NO: 4362102 - DNA, 14 bp, Homo sapiens
atcatttaactgaa

SEQ ID NO: 4362103 - DNA, 18 bp, Homo sapiens
atccaatcctcactgggt

SEQ ID NO: 4362104 - DNA, 19 bp, Homo sapiens
atccaatcctcactgggtg

SEQ ID NO: 4362105 - DNA, 20 bp, Homo sapiens
atccaatcctcactgggtgg

SEQ ID NO: 4362106 - DNA, 20 bp, Homo sapiens
atccatgttagtttttactt

SEQ ID NO: 4362107 - DNA, 20 bp, Homo sapiens
atccccaacatgcactgatg

SEQ ID NO: 4362108 - DNA, 12 bp, Homo sapiens
atccctcaccca

SEQ ID NO: 4362109 - DNA, 15 bp, Homo sapiens
atccttgctgcagct

SEQ ID NO: 4362110 - DNA, 19 bp, Homo sapiens
atccttgctgcagcttcta

SEQ ID NO: 4362111 - DNA, 18 bp, Homo sapiens
atcgatgagcgccacctc

SEQ ID NO: 4362112 - DNA, 17 bp, Homo sapiens
atcggagggaaacagaa

SEQ ID NO: 4362113 - DNA, 18 bp, Homo sapiens
atcggagttgacagtgaa

SEQ ID NO: 4362114 - DNA, 20 bp, Homo sapiens
atcgttatagagagcaattt

SEQ ID NO: 4362115 - DNA, 18 bp, Homo sapiens
atctatatttgtcttccg

SEQ ID NO: 4362116 - DNA, 14 bp, Homo sapiens
atctcctgtgcatg

SEQ ID NO: 4362117 - DNA, 12 bp, Homo sapiens
atctgactgcca

SEQ ID NO: 4362118 - DNA, 14 bp, Homo sapiens
atctgactgccaaa

SEQ ID NO: 4362119 - DNA, 16 bp, Homo sapiens
atctgactgccaaata

SEQ ID NO: 4362120 - DNA, 17 bp, Homo sapiens
atctgactgccaaataa

SEQ ID NO: 4362121 - DNA, 16 bp, Homo sapiens
atcttgtgagtggata

SEQ ID NO: 4362122 - DNA, 14 bp, Homo sapiens
atcttgtggggcca

SEQ ID NO: 4362123 - DNA, 15 bp, Homo sapiens
atcttgtggggccag

SEQ ID NO: 4362124 - DNA, 22 bp, Homo sapiens
cgcctgtcacaataaagtttat

SEQ ID NO: 4362125 - DNA, 17 bp, Homo sapiens
cgcgggcagccacccaa

SEQ ID NO: 4362126 - DNA, 23 bp, Homo sapiens
cgctgagtggggggtcgtgggcc

SEQ ID NO: 4362127 - DNA, 21 bp, Homo sapiens
cggagttgacagtgaaacaaa

SEQ ID NO: 4362128 - DNA, 14 bp, Homo sapiens
cggccacacccagc

SEQ ID NO: 4362129 - DNA, 16 bp, Homo sapiens
cggccacacccagcgg

SEQ ID NO: 4362130 - DNA, 17 bp, Homo sapiens
cggccacacccagcggc

SEQ ID NO: 4362131 - DNA, 18 bp, Homo sapiens
cggccacacccagcggcc

SEQ ID NO: 4362132 - DNA, 19 bp, Homo sapiens
cggccacacccagcggccc

SEQ ID NO: 4362133 - DNA, 21 bp, Homo sapiens
cggccaggcattggctcagcc

SEQ ID NO: 4362134 - DNA, 16 bp, Homo sapiens
cggcccagtgccactg

SEQ ID NO: 4362135 - DNA, 17 bp, Homo sapiens
cggcccagtgccactgc

SEQ ID NO: 4362136 - DNA, 22 bp, Homo sapiens
cggccccccgcacagccacccg

SEQ ID NO: 4362137 - DNA, 20 bp, Homo sapiens
cggccccctccccccagact

SEQ ID NO: 4362138 - DNA, 19 bp, Homo sapiens
cgggacatggttgggggaa

SEQ ID NO: 4362139 - DNA, 21 bp, Homo sapiens
cgggacgagaccctacaggag

SEQ ID NO: 4362140 - DNA, 13 bp, Homo sapiens
cgggccagggtgg

SEQ ID NO: 4362141 - DNA, 18 bp, Homo sapiens
cgggcgcgggcagccacc

SEQ ID NO: 4362142 - DNA, 23 bp, Homo sapiens
cgggcgcgggcagccacccaagc

SEQ ID NO: 4362143 - DNA, 12 bp, Homo sapiens
cgggctcagagc

SEQ ID NO: 4362144 - DNA, 15 bp, Homo sapiens
cgggctcagagcttt

SEQ ID NO: 4362145 - DNA, 18 bp, Homo sapiens
cgggtctcgcagcctgaa

SEQ ID NO: 4362146 - DNA, 19 bp, Homo sapiens
cggtgggaccctgtccggc

SEQ ID NO: 4362147 - DNA, 20 bp, Homo sapiens
cggtggtgcccgtgcccgca

SEQ ID NO: 4362148 - DNA, 15 bp, Homo sapiens
cgtcatgttcctcaa

SEQ ID NO: 4362149 - DNA, 16 bp, Homo sapiens
cgtctccagtcatctg

SEQ ID NO: 4362150 - DNA, 16 bp, Homo sapiens
cgtgacagtgcctggg

SEQ ID NO: 4362151 - DNA, 17 bp, Homo sapiens
cgtgacagtgcctggga

SEQ ID NO: 4362152 - DNA, 20 bp, Homo sapiens
cgtgcccccgcctgccaccg

SEQ ID NO: 4362153 - DNA, 15 bp, Homo sapiens
cgtgcccgcaggaac

SEQ ID NO: 4362154 - DNA, 21 bp, Homo sapiens
cgtgcgcccgtggggtctgcg

SEQ ID NO: 4362155 - DNA, 18 bp, Homo sapiens
cgtgggatggcatttggt

SEQ ID NO: 4362156 - DNA, 21 bp, Homo sapiens
cgtgggcgcaaaggtgcctca

SEQ ID NO: 4362157 - DNA, 21 bp, Homo sapiens
cgtgtgggtcccgcactctgc

SEQ ID NO: 4362158 - DNA, 15 bp, Homo sapiens
cgtgttcagcagaac

SEQ ID NO: 4362159 - DNA, 14 bp, Homo sapiens
cgttggagagcagc

SEQ ID NO: 4362160 - DNA, 21 bp, Homo sapiens
cgttggagagcagcaggtgct

SEQ ID NO: 4362161 - DNA, 12 bp, Homo sapiens
cgttgtgagctg

SEQ ID NO: 4362162 - DNA, 18 bp, Homo sapiens
ctaaaattagttttaaaa

SEQ ID NO: 4362163 - DNA, 14 bp, Homo sapiens
ctaaatatttcctt

SEQ ID NO: 4362164 - DNA, 20 bp, Homo sapiens
ctaacatagtgtctgctgct

SEQ ID NO: 4362165 - DNA, 20 bp, Homo sapiens
ctaacgacttcagggcaggg

SEQ ID NO: 4362166 - DNA, 17 bp, Homo sapiens
ctaagagtggaggagga

SEQ ID NO: 4362167 - DNA, 16 bp, Homo sapiens
ctacagacttctccag

SEQ ID NO: 4362168 - DNA, 18 bp, Homo sapiens
ctacaggagagggaagag

SEQ ID NO: 4362169 - DNA, 21 bp, Homo sapiens
ctacaggagagggaagagtgc

SEQ ID NO: 4362170 - DNA, 21 bp, Homo sapiens
ctaccactgtggccccaagag

SEQ ID NO: 4362171 - DNA, 14 bp, Homo sapiens
ctactgcccacatt

SEQ ID NO: 4362172 - DNA, 22 bp, Homo sapiens
ctactgcccacatttgggctca

SEQ ID NO: 4362173 - DNA, 18 bp, Homo sapiens
ctagaaaacaagcgttta

SEQ ID NO: 4362174 - DNA, 19 bp, Homo sapiens
ctagacagaaaccaagcca

SEQ ID NO: 4362175 - DNA, 13 bp, Homo sapiens
ctagcccagtccc

SEQ ID NO: 4362176 - DNA, 15 bp, Homo sapiens
ctaggactgcagtgt

SEQ ID NO: 4362177 - DNA, 24 bp, Homo sapiens
ctagttcatccaatcctcactggg

SEQ ID NO: 4362178 - DNA, 23 bp, Homo sapiens
ctatattggtttatgtagtcagt

SEQ ID NO: 4362179 - DNA, 22 bp, Homo sapiens
ctatcctgcaggaaatataaac

SEQ ID NO: 4362180 - DNA, 12 bp, Homo sapiens
ctattatcacat

SEQ ID NO: 4362181 - DNA, 14 bp, Homo sapiens
ctattgagccttgc

SEQ ID NO: 4362182 - DNA, 15 bp, Homo sapiens
ctattttgtatattt

SEQ ID NO: 4362183 - DNA, 16 bp, Homo sapiens
ctatttttatttatat

SEQ ID NO: 4362184 - DNA, 14 bp, Homo sapiens
ctcaaatgaatttg

SEQ ID NO: 4362185 - DNA, 18 bp, Homo sapiens
ctcacccctgtagggaaa

SEQ ID NO: 4362186 - DNA, 14 bp, Homo sapiens
ctcacctctgagga

SEQ ID NO: 4362187 - DNA, 16 bp, Homo sapiens
ctcactctagtgataa

SEQ ID NO: 4362188 - DNA, 10 bp, Homo sapiens
ctcagagctt

SEQ ID NO: 4362189 - DNA, 11 bp, Homo sapiens
ctcagagcttt

SEQ ID NO: 4362190 - DNA, 14 bp, Homo sapiens
ctcagagctttgtc

SEQ ID NO: 4362191 - DNA, 15 bp, Homo sapiens
ctcagagctttgtca

SEQ ID NO: 4362192 - DNA, 19 bp, Homo sapiens
ctcagagctttgtcacttg

SEQ ID NO: 4362193 - DNA, 22 bp, Homo sapiens
ctcagagctttgtcacttgcca

SEQ ID NO: 4362194 - DNA, 16 bp, Homo sapiens
ctcagccagtggcaca

SEQ ID NO: 4362195 - DNA, 16 bp, Homo sapiens
ctcagcccgctgagtg

SEQ ID NO: 4362196 - DNA, 16 bp, Homo sapiens
ctcaggcagcaccaca

SEQ ID NO: 4362197 - DNA, 17 bp, Homo sapiens
ctcaggcagcaccacac

SEQ ID NO: 4362198 - DNA, 21 bp, Homo sapiens
ctcaggcagcaccacactggg

SEQ ID NO: 4362199 - DNA, 20 bp, Homo sapiens
ctcagtatgctttccctgag

SEQ ID NO: 4362200 - DNA, 23 bp, Homo sapiens
ctcagtatgctttccctgaggaa

SEQ ID NO: 4362201 - DNA, 17 bp, Homo sapiens
ctcataccctccctccc

SEQ ID NO: 4362202 - DNA, 17 bp, Homo sapiens
ctcatgaagcaggaggc

SEQ ID NO: 4362203 - DNA, 15 bp, Homo sapiens
ctcatgcccagctct

SEQ ID NO: 4362204 - DNA, 23 bp, Homo sapiens
ctcatgcccagctctctgacgct

SEQ ID NO: 4362205 - DNA, 17 bp, Homo sapiens
ctccaccatccccaccc

SEQ ID NO: 4362206 - DNA, 13 bp, Homo sapiens
ctccagattctga

SEQ ID NO: 4362207 - DNA, 18 bp, Homo sapiens
ctccatgccccagctctg

SEQ ID NO: 4362208 - DNA, 21 bp, Homo sapiens
ctccatgccccagctctggat

SEQ ID NO: 4362209 - DNA, 16 bp, Homo sapiens
ctccccccagactctt

SEQ ID NO: 4362210 - DNA, 11 bp, Homo sapiens
ctcccccgcct

SEQ ID NO: 4362211 - DNA, 13 bp, Homo sapiens
ctcccctctcaga

SEQ ID NO: 4362212 - DNA, 13 bp, Homo sapiens
ctccctaccctaa

SEQ ID NO: 4362213 - DNA, 13 bp, Homo sapiens
ctccctcaactga

SEQ ID NO: 4362214 - DNA, 19 bp, Homo sapiens
ctccctggggaccaggagc

SEQ ID NO: 4362215 - DNA, 21 bp, Homo sapiens
ctccctggggaccaggagcta

SEQ ID NO: 4362216 - DNA, 19 bp, Homo sapiens
ctccggccagcgagtggtc

SEQ ID NO: 4362217 - DNA, 17 bp, Homo sapiens
ctcctcacccctgtagg

SEQ ID NO: 4362218 - DNA, 15 bp, Homo sapiens
ctcctccacctcaac

SEQ ID NO: 4362219 - DNA, 16 bp, Homo sapiens
ctcctgacctgtcacc

SEQ ID NO: 4362220 - DNA, 23 bp, Homo sapiens
ctcctgggtgggtggggtacagg

SEQ ID NO: 4362221 - DNA, 16 bp, Homo sapiens
ctcctgtgcatgggtg

SEQ ID NO: 4362222 - DNA, 20 bp, Homo sapiens
ctcctgtgcatgggtgaagg

SEQ ID NO: 4362223 - DNA, 12 bp, Homo sapiens
ctcgcagcctga

SEQ ID NO: 4362224 - DNA, 21 bp, Homo sapiens
ctcgcagcctgaagcctggat

SEQ ID NO: 4362225 - DNA, 20 bp, Homo sapiens
ctctcaattccctgaaaaac

SEQ ID NO: 4362226 - DNA, 12 bp, Homo sapiens
ctctcagaacat

SEQ ID NO: 4362227 - DNA, 13 bp, Homo sapiens
ctctcagaacata

SEQ ID NO: 4362228 - DNA, 16 bp, Homo sapiens
ctctcagaaggtattc

SEQ ID NO: 4362229 - DNA, 14 bp, Homo sapiens
ctctcagcctccca

SEQ ID NO: 4362230 - DNA, 17 bp, Homo sapiens
ctctgacgcttgtgaca

SEQ ID NO: 4362231 - DNA, 22 bp, Homo sapiens
ctctgaggacagaggccggggt

SEQ ID NO: 4362232 - DNA, 16 bp, Homo sapiens
ctctgattacatgtat

SEQ ID NO: 4362233 - DNA, 18 bp, Homo sapiens
ctctggaaaactattgag

SEQ ID NO: 4362234 - DNA, 15 bp, Homo sapiens
ctctggatgaaggca

SEQ ID NO: 4362235 - DNA, 15 bp, Homo sapiens
ctctggccaggatgg

SEQ ID NO: 4362236 - DNA, 15 bp, Homo sapiens
ctctgggtaggaaaa

SEQ ID NO: 4362237 - DNA, 21 bp, Homo sapiens
ctctggtggcttaagtgagca

SEQ ID NO: 4362238 - DNA, 14 bp, Homo sapiens
ctctggttgcctcc

SEQ ID NO: 4362239 - DNA, 10 bp, Homo sapiens
ctcttctgaa

SEQ ID NO: 4362240 - DNA, 17 bp, Homo sapiens
ctctttaaaaactcact

SEQ ID NO: 4362241 - DNA, 13 bp, Homo sapiens
ctgaaaaactagt

SEQ ID NO: 4362242 - DNA, 17 bp, Homo sapiens
ctgaaagatacagggga

SEQ ID NO: 4362243 - DNA, 12 bp, Homo sapiens
ctgaactccaga

SEQ ID NO: 4362244 - DNA, 12 bp, Homo sapiens
ctgaactgtgaa

SEQ ID NO: 4362245 - DNA, 13 bp, Homo sapiens
ctgaataaagcaa

SEQ ID NO: 4362246 - DNA, 15 bp, Homo sapiens
ctgaataaagcaatt

SEQ ID NO: 4362247 - DNA, 14 bp, Homo sapiens
ccctgcacaggcac

SEQ ID NO: 4362248 - DNA, 22 bp, Homo sapiens
ccctgcacaggcacacagggcc

SEQ ID NO: 4362249 - DNA, 18 bp, Homo sapiens
ccctgcagtttggccctg

SEQ ID NO: 4362250 - DNA, 23 bp, Homo sapiens
ccctgcagtttggccctggagcc

SEQ ID NO: 4362251 - DNA, 22 bp, Homo sapiens
ccctgcctgaggaggaggacac

SEQ ID NO: 4362252 - DNA, 24 bp, Homo sapiens
ccctgcgggcgcgggcagccaccc

SEQ ID NO: 4362253 - DNA, 19 bp, Homo sapiens
ccctggaaaccttccaccc

SEQ ID NO: 4362254 - DNA, 22 bp, Homo sapiens
ccctggaaaccttccacccagt

SEQ ID NO: 4362255 - DNA, 12 bp, Homo sapiens
ccctggagccag

SEQ ID NO: 4362256 - DNA, 14 bp, Homo sapiens
ccctggagccaggg

SEQ ID NO: 4362257 - DNA, 15 bp, Homo sapiens
ccctggagccagggc

SEQ ID NO: 4362258 - DNA, 16 bp, Homo sapiens
ccctggagccagggca

SEQ ID NO: 4362259 - DNA, 18 bp, Homo sapiens
ccctggagccagggcaga

SEQ ID NO: 4362260 - DNA, 12 bp, Homo sapiens
ccctggagctgt

SEQ ID NO: 4362261 - DNA, 15 bp, Homo sapiens
ccctggagctgtcct

SEQ ID NO: 4362262 - DNA, 22 bp, Homo sapiens
ccctgtccggcccagtgccact

SEQ ID NO: 4362263 - DNA, 14 bp, Homo sapiens
ccctgttttatact

SEQ ID NO: 4362264 - DNA, 20 bp, Homo sapiens
cccttctatacccacccaga

SEQ ID NO: 4362265 - DNA, 22 bp, Homo sapiens
ccgaagccccttggagagagag

SEQ ID NO: 4362266 - DNA, 13 bp, Homo sapiens
ccgacttgaatat

SEQ ID NO: 4362267 - DNA, 19 bp, Homo sapiens
ccgacttggagactcctgg

SEQ ID NO: 4362268 - DNA, 12 bp, Homo sapiens
ccgatcaacatt

SEQ ID NO: 4362269 - DNA, 20 bp, Homo sapiens
ccgatgagggaaggagccca

SEQ ID NO: 4362270 - DNA, 14 bp, Homo sapiens
ccgcacagccaccc

SEQ ID NO: 4362271 - DNA, 20 bp, Homo sapiens
ccgcaggaactgggctgggc

SEQ ID NO: 4362272 - DNA, 14 bp, Homo sapiens
ccgcagggccatgc

SEQ ID NO: 4362273 - DNA, 17 bp, Homo sapiens
ccgcagggccatgcaga

SEQ ID NO: 4362274 - DNA, 17 bp, Homo sapiens
ccgcctgtcacaataaa

SEQ ID NO: 4362275 - DNA, 19 bp, Homo sapiens
ccggcattttattaaactt

SEQ ID NO: 4362276 - DNA, 13 bp, Homo sapiens
ccggcccagtgcc

SEQ ID NO: 4362277 - DNA, 23 bp, Homo sapiens
ccggccccctccccccagactct

SEQ ID NO: 4362278 - DNA, 16 bp, Homo sapiens
ccggggggtctcttct

SEQ ID NO: 4362279 - DNA, 15 bp, Homo sapiens
ccggggtccaggccc

SEQ ID NO: 4362280 - DNA, 18 bp, Homo sapiens
ccgggtctcgcagcctga

SEQ ID NO: 4362281 - DNA, 17 bp, Homo sapiens
ccgtgcccgcaggaact

SEQ ID NO: 4362282 - DNA, 19 bp, Homo sapiens
ccgtggggtgctgccctta

SEQ ID NO: 4362283 - DNA, 19 bp, Homo sapiens
ccgttaggaataacactgc

SEQ ID NO: 4362284 - DNA, 12 bp, Homo sapiens
ccgttgtgagct

SEQ ID NO: 4362285 - DNA, 13 bp, Homo sapiens
ccgttgtgagctg

SEQ ID NO: 4362286 - DNA, 15 bp, Homo sapiens
ccgttgtgagctgga

SEQ ID NO: 4362287 - DNA, 12 bp, Homo sapiens
cctaaatgatgg

SEQ ID NO: 4362288 - DNA, 14 bp, Homo sapiens
cctaagtcaggtaa

SEQ ID NO: 4362289 - DNA, 15 bp, Homo sapiens
cctaagtcaggtaat

SEQ ID NO: 4362290 - DNA, 15 bp, Homo sapiens
cctaccctaaccaag

SEQ ID NO: 4362291 - DNA, 16 bp, Homo sapiens
cctaccctaaccaagt

SEQ ID NO: 4362292 - DNA, 12 bp, Homo sapiens
cctactgcccac

SEQ ID NO: 4362293 - DNA, 16 bp, Homo sapiens
cctactgcccacattt

SEQ ID NO: 4362294 - DNA, 20 bp, Homo sapiens
cctactggagcttgatgtta

SEQ ID NO: 4362295 - DNA, 23 bp, Homo sapiens
cctagctctaagagcaattctgg

SEQ ID NO: 4362296 - DNA, 16 bp, Homo sapiens
cctcacctctgaggac

SEQ ID NO: 4362297 - DNA, 19 bp, Homo sapiens
cctcacctctgaggacaga

SEQ ID NO: 4362298 - DNA, 12 bp, Homo sapiens
cctcactgggtg

SEQ ID NO: 4362299 - DNA, 20 bp, Homo sapiens
cctcagccagtggcacagga

SEQ ID NO: 4362300 - DNA, 18 bp, Homo sapiens
cctcaggcataggcctgg

SEQ ID NO: 4362301 - DNA, 19 bp, Homo sapiens
cctcatagcatagccagca

SEQ ID NO: 4362302 - DNA, 12 bp, Homo sapiens
cctccacctcaa

SEQ ID NO: 4362303 - DNA, 24 bp, Homo sapiens
cctccctggggaccaggagctagc

SEQ ID NO: 4362304 - DNA, 17 bp, Homo sapiens
cctcctgctcctcaccc

SEQ ID NO: 4362305 - DNA, 19 bp, Homo sapiens
cctcggggacaccagagct

SEQ ID NO: 4362306 - DNA, 14 bp, Homo sapiens
cctcgttggagagc

SEQ ID NO: 4362307 - DNA, 17 bp, Homo sapiens
cctctccaccctccggc

SEQ ID NO: 4362308 - DNA, 17 bp, Homo sapiens
cctctggaaaactattg

SEQ ID NO: 4362309 - DNA, 15 bp, Homo sapiens
cctctggccaggatg

SEQ ID NO: 4362310 - DNA, 16 bp, Homo sapiens
cctctggttgcctccc

SEQ ID NO: 4362311 - DNA, 12 bp, Homo sapiens
cctctgtccaca

SEQ ID NO: 4362312 - DNA, 15 bp, Homo sapiens
cctcttccagtgaac

SEQ ID NO: 4362313 - DNA, 18 bp, Homo sapiens
cctcttccagtgaacatt

SEQ ID NO: 4362314 - DNA, 16 bp, Homo sapiens
cctcttcttcttcaga

SEQ ID NO: 4362315 - DNA, 18 bp, Homo sapiens
cctcttgctcagagctag

SEQ ID NO: 4362316 - DNA, 13 bp, Homo sapiens
cctgaactccaga

SEQ ID NO: 4362317 - DNA, 13 bp, Homo sapiens
cctgaagcctgga

SEQ ID NO: 4362318 - DNA, 18 bp, Homo sapiens
cctgaagcctggattcca

SEQ ID NO: 4362319 - DNA, 12 bp, Homo sapiens
cctgaggaggag

SEQ ID NO: 4362320 - DNA, 17 bp, Homo sapiens
cctgaggaggaggacac

SEQ ID NO: 4362321 - DNA, 19 bp, Homo sapiens
cctgaggaggaggacacag

SEQ ID NO: 4362322 - DNA, 14 bp, Homo sapiens
cctgagtgggctgg

SEQ ID NO: 4362323 - DNA, 11 bp, Homo sapiens
cctgcacacag

SEQ ID NO: 4362324 - DNA, 20 bp, Homo sapiens
cctgcacacaggacagcggg

SEQ ID NO: 4362325 - DNA, 20 bp, Homo sapiens
cctgcacaggcacacagggc

SEQ ID NO: 4362326 - DNA, 18 bp, Homo sapiens
cctgcagtttggccctgg

SEQ ID NO: 4362327 - DNA, 14 bp, Homo sapiens
cctgcatggagaag

SEQ ID NO: 4362328 - DNA, 15 bp, Homo sapiens
cctgcatggagaagg

SEQ ID NO: 4362329 - DNA, 17 bp, Homo sapiens
cctgccaagactcctca

SEQ ID NO: 4362330 - DNA, 15 bp, Homo sapiens
cctgcctgaggagga

SEQ ID NO: 4362331 - DNA, 17 bp, Homo sapiens
cctgcgggcgcgggcag

SEQ ID NO: 4362332 - DNA, 20 bp, Homo sapiens
cctgctcctcacccctgtag

SEQ ID NO: 4362333 - DNA, 12 bp, Homo sapiens
cctgctggctgc

SEQ ID NO: 4362334 - DNA, 17 bp, Homo sapiens
cctgctggctgcggccc

SEQ ID NO: 4362335 - DNA, 14 bp, Homo sapiens
cctggagccagggc

SEQ ID NO: 4362336 - DNA, 17 bp, Homo sapiens
cctggattccagcagtg

SEQ ID NO: 4362337 - DNA, 19 bp, Homo sapiens
cctggggaccaggagctag

SEQ ID NO: 4362338 - DNA, 21 bp, Homo sapiens
cctggtttacttctttagcat

SEQ ID NO: 4362339 - DNA, 20 bp, Homo sapiens
cctgtaatgtacaattttat

SEQ ID NO: 4362340 - DNA, 17 bp, Homo sapiens
cctgtccaccctgccaa

SEQ ID NO: 4362341 - DNA, 19 bp, Homo sapiens
cctgtccggcccagtgcca

SEQ ID NO: 4362342 - DNA, 21 bp, Homo sapiens
cctgtgccacccaccagggcg

SEQ ID NO: 4362343 - DNA, 12 bp, Homo sapiens
cctgttttctga

SEQ ID NO: 4362344 - DNA, 19 bp, Homo sapiens
cctgttttctgaaacacac

SEQ ID NO: 4362345 - DNA, 19 bp, Homo sapiens
ccttaagcagaacaaatgt

SEQ ID NO: 4362346 - DNA, 13 bp, Homo sapiens
ccttccacccagt

SEQ ID NO: 4362347 - DNA, 22 bp, Homo sapiens
ccttccgggtctcgcagcctga

SEQ ID NO: 4362348 - DNA, 16 bp, Homo sapiens
ccttgaattgtgtatt

SEQ ID NO: 4362349 - DNA, 16 bp, Homo sapiens
ccttgataatacttga

SEQ ID NO: 4362350 - DNA, 17 bp, Homo sapiens
ccttgcatgtacttgaa

SEQ ID NO: 4362351 - DNA, 19 bp, Homo sapiens
ccttgcctgaactccagag

SEQ ID NO: 4362352 - DNA, 20 bp, Homo sapiens
ccttgccttaataaatatgt

SEQ ID NO: 4362353 - DNA, 18 bp, Homo sapiens
ccttttaagttaatgaaa

SEQ ID NO: 4362354 - DNA, 16 bp, Homo sapiens
cctttttctttataaa

SEQ ID NO: 4362355 - DNA, 20 bp, Homo sapiens
cctttttctttataaacttt

SEQ ID NO: 4362356 - DNA, 20 bp, Homo sapiens
cgaagccccttggagagaga

SEQ ID NO: 4362357 - DNA, 16 bp, Homo sapiens
cgacttggagactcct

SEQ ID NO: 4362358 - DNA, 22 bp, Homo sapiens
cgacttggagactcctggtctg

SEQ ID NO: 4362359 - DNA, 20 bp, Homo sapiens
cgagcaaacccagaggtgga

SEQ ID NO: 4362360 - DNA, 13 bp, Homo sapiens
cgaggagctgggc

SEQ ID NO: 4362361 - DNA, 13 bp, Homo sapiens
cgatcaacattta

SEQ ID NO: 4362362 - DNA, 19 bp, Homo sapiens
cgatcaacatttatgacct

SEQ ID NO: 4362363 - DNA, 19 bp, Homo sapiens
cgatgagcgccacctcttt

SEQ ID NO: 4362364 - DNA, 12 bp, Homo sapiens
cgatgagggaag

SEQ ID NO: 4362365 - DNA, 13 bp, Homo sapiens
cgcagcctgaagc

SEQ ID NO: 4362366 - DNA, 16 bp, Homo sapiens
cgcccgtggggtctgc

SEQ ID NO: 4362367 - DNA, 13 bp, Homo sapiens
cgccgggcaccaa

SEQ ID NO: 4362368 - DNA, 18 bp, Homo sapiens
cgccgggcaccaactcca

SEQ ID NO: 4362369 - DNA, 12 bp, Homo sapiens
cgcctgccaccg

SEQ ID NO: 4362370 - DNA, 18 bp, Homo sapiens
cgcctgtcacaataaagt

SEQ ID NO: 4362371 - DNA, 16 bp, Homo sapiens
ccacctgttttctgaa

SEQ ID NO: 4362372 - DNA, 21 bp, Homo sapiens
ccaccttttaagttaatgaaa

SEQ ID NO: 4362373 - DNA, 19 bp, Homo sapiens
ccactgtggccccaagagg

SEQ ID NO: 4362374 - DNA, 19 bp, Homo sapiens
ccactttgaagggcaagaa

SEQ ID NO: 4362375 - DNA, 20 bp, Homo sapiens
ccagaaacacccctctgtct

SEQ ID NO: 4362376 - DNA, 12 bp, Homo sapiens
ccagaattccct

SEQ ID NO: 4362377 - DNA, 17 bp, Homo sapiens
ccagacccctctggcca

SEQ ID NO: 4362378 - DNA, 20 bp, Homo sapiens
ccagacccctctggccagga

SEQ ID NO: 4362379 - DNA, 23 bp, Homo sapiens
ccagacccctctggccaggatgg

SEQ ID NO: 4362380 - DNA, 18 bp, Homo sapiens
ccagactctttttttgag

SEQ ID NO: 4362381 - DNA, 11 bp, Homo sapiens
ccagaggtgga

SEQ ID NO: 4362382 - DNA, 21 bp, Homo sapiens
ccagcaacttgtctttttctg

SEQ ID NO: 4362383 - DNA, 14 bp, Homo sapiens
ccagcagtgaatgc

SEQ ID NO: 4362384 - DNA, 15 bp, Homo sapiens
ccagcagtgaatgct

SEQ ID NO: 4362385 - DNA, 11 bp, Homo sapiens
ccagctctgga

SEQ ID NO: 4362386 - DNA, 14 bp, Homo sapiens
ccagctctggatga

SEQ ID NO: 4362387 - DNA, 18 bp, Homo sapiens
ccagctctggatgaaggc

SEQ ID NO: 4362388 - DNA, 19 bp, Homo sapiens
ccagctctggatgaaggca

SEQ ID NO: 4362389 - DNA, 21 bp, Homo sapiens
ccagctctggatgaaggcaaa

SEQ ID NO: 4362390 - DNA, 22 bp, Homo sapiens
ccaggatggaggggtggtcctg

SEQ ID NO: 4362391 - DNA, 12 bp, Homo sapiens
ccaggcccgtgg

SEQ ID NO: 4362392 - DNA, 18 bp, Homo sapiens
ccaggcccgtgggcgcaa

SEQ ID NO: 4362393 - DNA, 18 bp, Homo sapiens
ccaggcctgtccaccctg

SEQ ID NO: 4362394 - DNA, 19 bp, Homo sapiens
ccaggcctgtccaccctgc

SEQ ID NO: 4362395 - DNA, 15 bp, Homo sapiens
ccagtcatctgtaag

SEQ ID NO: 4362396 - DNA, 21 bp, Homo sapiens
ccagtcatggtactaccccag

SEQ ID NO: 4362397 - DNA, 17 bp, Homo sapiens
ccagtccccgaggagct

SEQ ID NO: 4362398 - DNA, 14 bp, Homo sapiens
ccagtccctggagc

SEQ ID NO: 4362399 - DNA, 17 bp, Homo sapiens
ccagtgaacattcccag

SEQ ID NO: 4362400 - DNA, 15 bp, Homo sapiens
ccagtgcatatgcaa

SEQ ID NO: 4362401 - DNA, 19 bp, Homo sapiens
ccagtgcatatgcaatgta

SEQ ID NO: 4362402 - DNA, 19 bp, Homo sapiens
ccatcagctgtaagaagag

SEQ ID NO: 4362403 - DNA, 12 bp, Homo sapiens
ccatccctacca

SEQ ID NO: 4362404 - DNA, 13 bp, Homo sapiens
ccatccttgctgc

SEQ ID NO: 4362405 - DNA, 17 bp, Homo sapiens
ccatccttgctgcagct

SEQ ID NO: 4362406 - DNA, 17 bp, Homo sapiens
ccatcttgtggggccag

SEQ ID NO: 4362407 - DNA, 19 bp, Homo sapiens
ccatcttgtggggccagga

SEQ ID NO: 4362408 - DNA, 14 bp, Homo sapiens
ccatgcaggaggtg

SEQ ID NO: 4362409 - DNA, 21 bp, Homo sapiens
ccatgccccagctctggatga

SEQ ID NO: 4362410 - DNA, 23 bp, Homo sapiens
ccatggccgaagccccttggaga

SEQ ID NO: 4362411 - DNA, 18 bp, Homo sapiens
ccatgttagtttttactt

SEQ ID NO: 4362412 - DNA, 15 bp, Homo sapiens
ccattattatgatgt

SEQ ID NO: 4362413 - DNA, 17 bp, Homo sapiens
ccattgttgtcaaggaa

SEQ ID NO: 4362414 - DNA, 18 bp, Homo sapiens
ccattgttgtcaaggaag

SEQ ID NO: 4362415 - DNA, 21 bp, Homo sapiens
ccattgttgtcaaggaagaag

SEQ ID NO: 4362416 - DNA, 17 bp, Homo sapiens
cccaaattgccttcagc

SEQ ID NO: 4362417 - DNA, 22 bp, Homo sapiens
cccaacatgggagggatcagcc

SEQ ID NO: 4362418 - DNA, 23 bp, Homo sapiens
cccaacatgggagggatcagccc

SEQ ID NO: 4362419 - DNA, 20 bp, Homo sapiens
cccaagaggggcgggctcag

SEQ ID NO: 4362420 - DNA, 22 bp, Homo sapiens
cccaagcctgctggctgcggcc

SEQ ID NO: 4362421 - DNA, 22 bp, Homo sapiens
cccaagtatgccttaagcagaa

SEQ ID NO: 4362422 - DNA, 14 bp, Homo sapiens
cccaattaggaagt

SEQ ID NO: 4362423 - DNA, 16 bp, Homo sapiens
cccacactgccagaag

SEQ ID NO: 4362424 - DNA, 19 bp, Homo sapiens
cccacaggctgtgtacttt

SEQ ID NO: 4362425 - DNA, 14 bp, Homo sapiens
cccacccacccgcc

SEQ ID NO: 4362426 - DNA, 17 bp, Homo sapiens
cccacccccgccatgca

SEQ ID NO: 4362427 - DNA, 22 bp, Homo sapiens
cccacccgccgcctcccacggc

SEQ ID NO: 4362428 - DNA, 19 bp, Homo sapiens
cccacggcacctcggggac

SEQ ID NO: 4362429 - DNA, 23 bp, Homo sapiens
cccacggcacctcggggacacca

SEQ ID NO: 4362430 - DNA, 22 bp, Homo sapiens
cccactccctggctctcagaag

SEQ ID NO: 4362431 - DNA, 20 bp, Homo sapiens
cccagacccctctggccagg

SEQ ID NO: 4362432 - DNA, 13 bp, Homo sapiens
cccagcagggcct

SEQ ID NO: 4362433 - DNA, 19 bp, Homo sapiens
cccagcagggcctcaaagt

SEQ ID NO: 4362434 - DNA, 14 bp, Homo sapiens
cccagccatggggt

SEQ ID NO: 4362435 - DNA, 10 bp, Homo sapiens
cccagcctga

SEQ ID NO: 4362436 - DNA, 23 bp, Homo sapiens
cccagcggccccccgcacagcca

SEQ ID NO: 4362437 - DNA, 16 bp, Homo sapiens
cccaggcctgtccacc

SEQ ID NO: 4362438 - DNA, 14 bp, Homo sapiens
cccagtccctggag

SEQ ID NO: 4362439 - DNA, 15 bp, Homo sapiens
cccagtccctggagc

SEQ ID NO: 4362440 - DNA, 12 bp, Homo sapiens
cccagtgccact

SEQ ID NO: 4362441 - DNA, 14 bp, Homo sapiens
cccagtgccactgc

SEQ ID NO: 4362442 - DNA, 15 bp, Homo sapiens
cccagtgccactgcc

SEQ ID NO: 4362443 - DNA, 18 bp, Homo sapiens
cccagtgccactgccccc

SEQ ID NO: 4362444 - DNA, 15 bp, Homo sapiens
cccatccctaccact

SEQ ID NO: 4362445 - DNA, 19 bp, Homo sapiens
cccattgttgtcaaggaag

SEQ ID NO: 4362446 - DNA, 20 bp, Homo sapiens
cccattgttgtcaaggaaga

SEQ ID NO: 4362447 - DNA, 23 bp, Homo sapiens
ccccaaagcagcaggcctctggt

SEQ ID NO: 4362448 - DNA, 18 bp, Homo sapiens
ccccaaattgccttcagc

SEQ ID NO: 4362449 - DNA, 21 bp, Homo sapiens
ccccaagaggggcgggctcag

SEQ ID NO: 4362450 - DNA, 13 bp, Homo sapiens
ccccactttgaag

SEQ ID NO: 4362451 - DNA, 22 bp, Homo sapiens
cccccaggcctgtccaccctgc

SEQ ID NO: 4362452 - DNA, 18 bp, Homo sapiens
cccccatccctaccactg

SEQ ID NO: 4362453 - DNA, 15 bp, Homo sapiens
cccccgaggctgcta

SEQ ID NO: 4362454 - DNA, 21 bp, Homo sapiens
cccccgcacagccacccgtgg

SEQ ID NO: 4362455 - DNA, 15 bp, Homo sapiens
cccccgcctgccacc

SEQ ID NO: 4362456 - DNA, 16 bp, Homo sapiens
ccccctgagtgggctg

SEQ ID NO: 4362457 - DNA, 14 bp, Homo sapiens
ccccctgtggcggc

SEQ ID NO: 4362458 - DNA, 17 bp, Homo sapiens
ccccgaggagctgggcc

SEQ ID NO: 4362459 - DNA, 13 bp, Homo sapiens
ccccgatgtcccc

SEQ ID NO: 4362460 - DNA, 16 bp, Homo sapiens
ccccgcacagccaccc

SEQ ID NO: 4362461 - DNA, 19 bp, Homo sapiens
ccccgcacagccacccgtg

SEQ ID NO: 4362462 - DNA, 15 bp, Homo sapiens
ccccgcctgccaccg

SEQ ID NO: 4362463 - DNA, 22 bp, Homo sapiens
cccctctcagaacatactgatt

SEQ ID NO: 4362464 - DNA, 20 bp, Homo sapiens
cccctgcagtttggccctgg

SEQ ID NO: 4362465 - DNA, 23 bp, Homo sapiens
cccctgcagtttggccctggagc

SEQ ID NO: 4362466 - DNA, 23 bp, Homo sapiens
cccctgtagggaaaccttggaga

SEQ ID NO: 4362467 - DNA, 14 bp, Homo sapiens
cccgactcctcaaa

SEQ ID NO: 4362468 - DNA, 19 bp, Homo sapiens
cccgaggagctgggcccct

SEQ ID NO: 4362469 - DNA, 16 bp, Homo sapiens
cccgatgtcccctgcg

SEQ ID NO: 4362470 - DNA, 16 bp, Homo sapiens
cccgcacagccacccg

SEQ ID NO: 4362471 - DNA, 13 bp, Homo sapiens
cccgcctgccacc

SEQ ID NO: 4362472 - DNA, 20 bp, Homo sapiens
cccgctttcttgctggttgt

SEQ ID NO: 4362473 - DNA, 15 bp, Homo sapiens
cccggccacacccag

SEQ ID NO: 4362474 - DNA, 16 bp, Homo sapiens
cccggccacacccagc

SEQ ID NO: 4362475 - DNA, 16 bp, Homo sapiens
cccggcgccgggcacc

SEQ ID NO: 4362476 - DNA, 16 bp, Homo sapiens
cccgtggggtgctgcc

SEQ ID NO: 4362477 - DNA, 16 bp, Homo sapiens
ccctaacatagtgtct

SEQ ID NO: 4362478 - DNA, 17 bp, Homo sapiens
ccctcacccatcctaga

SEQ ID NO: 4362479 - DNA, 10 bp, Homo sapiens
ccctcacctc

SEQ ID NO: 4362480 - DNA, 16 bp, Homo sapiens
ccctcacctctgagga

SEQ ID NO: 4362481 - DNA, 20 bp, Homo sapiens
ccctcaggcataggcctggg

SEQ ID NO: 4362482 - DNA, 21 bp, Homo sapiens
ccctcaggcataggcctgggt

SEQ ID NO: 4362483 - DNA, 16 bp, Homo sapiens
ccctcccctctcagaa

SEQ ID NO: 4362484 - DNA, 16 bp, Homo sapiens
ccctctcggccaggca

SEQ ID NO: 4362485 - DNA, 18 bp, Homo sapiens
ccctctctcataccctcc

SEQ ID NO: 4362486 - DNA, 18 bp, Homo sapiens
ccctctggccaggatgga

SEQ ID NO: 4362487 - DNA, 22 bp, Homo sapiens
ccctctggccaggatggagggg

SEQ ID NO: 4362488 - DNA, 13 bp, Homo sapiens
ccctctgtccaca

SEQ ID NO: 4362489 - DNA, 14 bp, Homo sapiens
ccctctgtctagga

SEQ ID NO: 4362490 - DNA, 13 bp, Homo sapiens
ccctgacttctgg

SEQ ID NO: 4362491 - DNA, 16 bp, Homo sapiens
ccctgacttctggaga

SEQ ID NO: 4362492 - DNA, 23 bp, Homo sapiens
ccctgagtgggctgggccctctg

SEQ ID NO: 4362493 - DNA, 20 bp, Homo sapiens
cactgttatcacctatcctg

SEQ ID NO: 4362494 - DNA, 22 bp, Homo sapiens
cacttctaataactgcagtgtt

SEQ ID NO: 4362495 - DNA, 23 bp, Homo sapiens
cacttgccacatggtgtctccca

SEQ ID NO: 4362496 - DNA, 19 bp, Homo sapiens
cacttgtgtgtgggctgtg

SEQ ID NO: 4362497 - DNA, 23 bp, Homo sapiens
cacttgtgtgtgggctgtgagtg

SEQ ID NO: 4362498 - DNA, 14 bp, Homo sapiens
cactttgaaaagtt

SEQ ID NO: 4362499 - DNA, 17 bp, Homo sapiens
cactttgaaaagttgga

SEQ ID NO: 4362500 - DNA, 23 bp, Homo sapiens
cagaaaacatgtttaaatagcct

SEQ ID NO: 4362501 - DNA, 19 bp, Homo sapiens
cagaaaggtctctggaggg

SEQ ID NO: 4362502 - DNA, 22 bp, Homo sapiens
cagaaagtggccatgccaccct

SEQ ID NO: 4362503 - DNA, 23 bp, Homo sapiens
cagaaagtggccatgccaccctg

SEQ ID NO: 4362504 - DNA, 21 bp, Homo sapiens
cagaacaaatgtgtttttcta

SEQ ID NO: 4362505 - DNA, 22 bp, Homo sapiens
cagaacaaatgtgtttttctat

SEQ ID NO: 4362506 - DNA, 13 bp, Homo sapiens
cagaacctgcaca

SEQ ID NO: 4362507 - DNA, 18 bp, Homo sapiens
cagaacctgcacacagga

SEQ ID NO: 4362508 - DNA, 22 bp, Homo sapiens
cagaacctgcacacaggacagc

SEQ ID NO: 4362509 - DNA, 19 bp, Homo sapiens
cagaagacactgcaaaggc

SEQ ID NO: 4362510 - DNA, 22 bp, Homo sapiens
cagaagagaattcagtattttt

SEQ ID NO: 4362511 - DNA, 15 bp, Homo sapiens
cagaaggtattcctt

SEQ ID NO: 4362512 - DNA, 14 bp, Homo sapiens
cagaattcccttga

SEQ ID NO: 4362513 - DNA, 13 bp, Homo sapiens
cagacagcttgac

SEQ ID NO: 4362514 - DNA, 15 bp, Homo sapiens
cagacagtctgttat

SEQ ID NO: 4362515 - DNA, 19 bp, Homo sapiens
cagacagtctgttatgcac

SEQ ID NO: 4362516 - DNA, 17 bp, Homo sapiens
cagacccctctggccag

SEQ ID NO: 4362517 - DNA, 21 bp, Homo sapiens
cagacccctctggccaggatg

SEQ ID NO: 4362518 - DNA, 15 bp, Homo sapiens
cagacctcatgccca

SEQ ID NO: 4362519 - DNA, 16 bp, Homo sapiens
cagacctcatgcccag

SEQ ID NO: 4362520 - DNA, 20 bp, Homo sapiens
cagactctttttttgagtga

SEQ ID NO: 4362521 - DNA, 23 bp, Homo sapiens
cagactctttttttgagtgacag

SEQ ID NO: 4362522 - DNA, 14 bp, Homo sapiens
cagacttctccaga

SEQ ID NO: 4362523 - DNA, 17 bp, Homo sapiens
cagaggccggggtccag

SEQ ID NO: 4362524 - DNA, 18 bp, Homo sapiens
cagaggccggggtccagg

SEQ ID NO: 4362525 - DNA, 18 bp, Homo sapiens
cagaggtggatgttatga

SEQ ID NO: 4362526 - DNA, 22 bp, Homo sapiens
cagagtggtctttctggagagg

SEQ ID NO: 4362527 - DNA, 15 bp, Homo sapiens
cagataaatttcaat

SEQ ID NO: 4362528 - DNA, 13 bp, Homo sapiens
cagatatattttt

SEQ ID NO: 4362529 - DNA, 14 bp, Homo sapiens
cagatatatttttc

SEQ ID NO: 4362530 - DNA, 18 bp, Homo sapiens
cagatatatttttcacag

SEQ ID NO: 4362531 - DNA, 15 bp, Homo sapiens
cagatggatttgcct

SEQ ID NO: 4362532 - DNA, 19 bp, Homo sapiens
cagatggggtctgtgactg

SEQ ID NO: 4362533 - DNA, 14 bp, Homo sapiens
cagatgtgcaataa

SEQ ID NO: 4362534 - DNA, 18 bp, Homo sapiens
cagatgtgcaataatttg

SEQ ID NO: 4362535 - DNA, 14 bp, Homo sapiens
cagattctgatgca

SEQ ID NO: 4362536 - DNA, 15 bp, Homo sapiens
cagattctgatgcat

SEQ ID NO: 4362537 - DNA, 18 bp, Homo sapiens
cagattgacagcatatag

SEQ ID NO: 4362538 - DNA, 20 bp, Homo sapiens
cagcaacttgtctttttctg

SEQ ID NO: 4362539 - DNA, 22 bp, Homo sapiens
cagcaacttgtctttttctgga

SEQ ID NO: 4362540 - DNA, 23 bp, Homo sapiens
cagcaccacactgggtgcgtctc

SEQ ID NO: 4362541 - DNA, 14 bp, Homo sapiens
cagcactgtctcag

SEQ ID NO: 4362542 - DNA, 16 bp, Homo sapiens
cagcagaacctgcaca

SEQ ID NO: 4362543 - DNA, 19 bp, Homo sapiens
cagcagaacctgcacacag

SEQ ID NO: 4362544 - DNA, 21 bp, Homo sapiens
cagcatgacctgtgaccagca

SEQ ID NO: 4362545 - DNA, 23 bp, Homo sapiens
cagcatgacctgtgaccagcact

SEQ ID NO: 4362546 - DNA, 11 bp, Homo sapiens
cagccacccaa

SEQ ID NO: 4362547 - DNA, 15 bp, Homo sapiens
cagccacccaagcct

SEQ ID NO: 4362548 - DNA, 17 bp, Homo sapiens
cagccacccaagcctgc

SEQ ID NO: 4362549 - DNA, 20 bp, Homo sapiens
cagccacccaagcctgctgg

SEQ ID NO: 4362550 - DNA, 21 bp, Homo sapiens
cagccacccgtggggtgctgc

SEQ ID NO: 4362551 - DNA, 20 bp, Homo sapiens
cagccagaaagcactacaat

SEQ ID NO: 4362552 - DNA, 23 bp, Homo sapiens
cagccagaaagcactacaatcat

SEQ ID NO: 4362553 - DNA, 14 bp, Homo sapiens
cagccccctgtggc

SEQ ID NO: 4362554 - DNA, 15 bp, Homo sapiens
cagcccgctgagtgg

SEQ ID NO: 4362555 - DNA, 18 bp, Homo sapiens
cagccctcacctctgagg

SEQ ID NO: 4362556 - DNA, 17 bp, Homo sapiens
cagcctcttgctcagag

SEQ ID NO: 4362557 - DNA, 13 bp, Homo sapiens
cagcctgaagcct

SEQ ID NO: 4362558 - DNA, 20 bp, Homo sapiens
cagcctgaagcctggattcc

SEQ ID NO: 4362559 - DNA, 21 bp, Homo sapiens
cagcctgaagcctggattcca

SEQ ID NO: 4362560 - DNA, 14 bp, Homo sapiens
cagcgagtggtcaa

SEQ ID NO: 4362561 - DNA, 22 bp, Homo sapiens
cagctaaagcccaacctcctga

SEQ ID NO: 4362562 - DNA, 22 bp, Homo sapiens
cagctcccccgacggtgggcat

SEQ ID NO: 4362563 - DNA, 16 bp, Homo sapiens
cagctctggatgaagg

SEQ ID NO: 4362564 - DNA, 19 bp, Homo sapiens
cagctgaggtctcttgagg

SEQ ID NO: 4362565 - DNA, 15 bp, Homo sapiens
cagctgggcagggtg

SEQ ID NO: 4362566 - DNA, 16 bp, Homo sapiens
cagctgggcagggtga

SEQ ID NO: 4362567 - DNA, 21 bp, Homo sapiens
cagctgtaagaagagactggg

SEQ ID NO: 4362568 - DNA, 22 bp, Homo sapiens
cagctgtaagaagagactggga

SEQ ID NO: 4362569 - DNA, 21 bp, Homo sapiens
cagctgtgtctgccaaacaca

SEQ ID NO: 4362570 - DNA, 15 bp, Homo sapiens
cagctttctgggatg

SEQ ID NO: 4362571 - DNA, 21 bp, Homo sapiens
cagctttctgggatgtcacag

SEQ ID NO: 4362572 - DNA, 17 bp, Homo sapiens
caggaaaaatgaggaat

SEQ ID NO: 4362573 - DNA, 13 bp, Homo sapiens
caggaaatatata

SEQ ID NO: 4362574 - DNA, 22 bp, Homo sapiens
caggaacacccgactcctcaaa

SEQ ID NO: 4362575 - DNA, 14 bp, Homo sapiens
caggaactgggctg

SEQ ID NO: 4362576 - DNA, 18 bp, Homo sapiens
caggaactgggctgggcc

SEQ ID NO: 4362577 - DNA, 23 bp, Homo sapiens
caggaatggggggcgggccaggg

SEQ ID NO: 4362578 - DNA, 14 bp, Homo sapiens
caggacagcgggaa

SEQ ID NO: 4362579 - DNA, 13 bp, Homo sapiens
caggagaagttaa

SEQ ID NO: 4362580 - DNA, 14 bp, Homo sapiens
caggagaagttaag

SEQ ID NO: 4362581 - DNA, 18 bp, Homo sapiens
caggagactccaaggagc

SEQ ID NO: 4362582 - DNA, 21 bp, Homo sapiens
caggagctagcccagtccctg

SEQ ID NO: 4362583 - DNA, 23 bp, Homo sapiens
caggagctagcccagtccctgga

SEQ ID NO: 4362584 - DNA, 23 bp, Homo sapiens
caggatagctttataaagcagtt

SEQ ID NO: 4362585 - DNA, 21 bp, Homo sapiens
caggatggaggggtggtcctg

SEQ ID NO: 4362586 - DNA, 22 bp, Homo sapiens
caggatggaggggtggtcctga

SEQ ID NO: 4362587 - DNA, 12 bp, Homo sapiens
caggcagcacca

SEQ ID NO: 4362588 - DNA, 15 bp, Homo sapiens
caggcagcaccacac

SEQ ID NO: 4362589 - DNA, 18 bp, Homo sapiens
caggcagcaccacactgg

SEQ ID NO: 4362590 - DNA, 18 bp, Homo sapiens
caggcagttaggtgctga

SEQ ID NO: 4362591 - DNA, 15 bp, Homo sapiens
caggcataggcctgg

SEQ ID NO: 4362592 - DNA, 16 bp, Homo sapiens
caggcataggcctggg

SEQ ID NO: 4362593 - DNA, 16 bp, Homo sapiens
caggcccgtgggcgca

SEQ ID NO: 4362594 - DNA, 21 bp, Homo sapiens
caggcccgtgggcgcaaaggt

SEQ ID NO: 4362595 - DNA, 14 bp, Homo sapiens
cagggatggagatg

SEQ ID NO: 4362596 - DNA, 19 bp, Homo sapiens
cagggatggagatgggaag

SEQ ID NO: 4362597 - DNA, 16 bp, Homo sapiens
cagggcagggctctga

SEQ ID NO: 4362598 - DNA, 17 bp, Homo sapiens
cagggcagggctctgat

SEQ ID NO: 4362599 - DNA, 13 bp, Homo sapiens
cagggcatctcct

SEQ ID NO: 4362600 - DNA, 15 bp, Homo sapiens
cagggcatctcctgt

SEQ ID NO: 4362601 - DNA, 14 bp, Homo sapiens
cagggccatgcaga

SEQ ID NO: 4362602 - DNA, 17 bp, Homo sapiens
cagggccatgcagacct

SEQ ID NO: 4362603 - DNA, 20 bp, Homo sapiens
cagggctggtgtggctgctc

SEQ ID NO: 4362604 - DNA, 12 bp, Homo sapiens
cagggtgggaag

SEQ ID NO: 4362605 - DNA, 16 bp, Homo sapiens
cagggtgggaagagaa

SEQ ID NO: 4362606 - DNA, 18 bp, Homo sapiens
caggtaatatacctggtt

SEQ ID NO: 4362607 - DNA, 20 bp, Homo sapiens
caggtagtattacaccaccg

SEQ ID NO: 4362608 - DNA, 18 bp, Homo sapiens
caggtggtgaattttcca

SEQ ID NO: 4362609 - DNA, 15 bp, Homo sapiens
cagtagagtcatctc

SEQ ID NO: 4362610 - DNA, 16 bp, Homo sapiens
cagtagagtcatctcc

SEQ ID NO: 4362611 - DNA, 15 bp, Homo sapiens
cagtatatttatagt

SEQ ID NO: 4362612 - DNA, 18 bp, Homo sapiens
cagtatgctttccctgag

SEQ ID NO: 4362613 - DNA, 20 bp, Homo sapiens
cagtatgctttccctgagga

SEQ ID NO: 4362614 - DNA, 23 bp, Homo sapiens
cagtatgctttccctgaggaatg

SEQ ID NO: 4362615 - DNA, 15 bp, Homo sapiens
gtgcagtactttgtg

SEQ ID NO: 4362616 - DNA, 17 bp, Homo sapiens
gtgcattttcccagata

SEQ ID NO: 4362617 - DNA, 18 bp, Homo sapiens
gtgccacccaccagggcg

SEQ ID NO: 4362618 - DNA, 12 bp, Homo sapiens
gtgccactgccc

SEQ ID NO: 4362619 - DNA, 18 bp, Homo sapiens
gtgcccccgcctgccacc

SEQ ID NO: 4362620 - DNA, 17 bp, Homo sapiens
gtgcccgcaggaactgg

SEQ ID NO: 4362621 - DNA, 21 bp, Homo sapiens
gtgcctcatagcatagccagc

SEQ ID NO: 4362622 - DNA, 23 bp, Homo sapiens
gtgcctcatagcatagccagcat

SEQ ID NO: 4362623 - DNA, 17 bp, Homo sapiens
gtgcctggctagaaaac

SEQ ID NO: 4362624 - DNA, 15 bp, Homo sapiens
gtgcctgggaatgta

SEQ ID NO: 4362625 - DNA, 17 bp, Homo sapiens
gtgcctgggaatgtatt

SEQ ID NO: 4362626 - DNA, 19 bp, Homo sapiens
gtggagttcaccttggaag

SEQ ID NO: 4362627 - DNA, 15 bp, Homo sapiens
gtggataatcaggaa

SEQ ID NO: 4362628 - DNA, 16 bp, Homo sapiens
gtggatgttatgaaca

SEQ ID NO: 4362629 - DNA, 16 bp, Homo sapiens
gtggcagaatgaaaat

SEQ ID NO: 4362630 - DNA, 21 bp, Homo sapiens
gtggcaggtgggctgcctgct

SEQ ID NO: 4362631 - DNA, 15 bp, Homo sapiens
gtggccccaagaggg

SEQ ID NO: 4362632 - DNA, 14 bp, Homo sapiens
gtggcggccttccg

SEQ ID NO: 4362633 - DNA, 20 bp, Homo sapiens
gtggcttaagtgagcagaac

SEQ ID NO: 4362634 - DNA, 21 bp, Homo sapiens
gtgggcgcaaaggtgcctcat

SEQ ID NO: 4362635 - DNA, 22 bp, Homo sapiens
gtgggcgcaaaggtgcctcata

SEQ ID NO: 4362636 - DNA, 13 bp, Homo sapiens
gtgggctgcctgc

SEQ ID NO: 4362637 - DNA, 13 bp, Homo sapiens
gtgggctgtgagt

SEQ ID NO: 4362638 - DNA, 12 bp, Homo sapiens
gtgtacagtgtg

SEQ ID NO: 4362639 - DNA, 22 bp, Homo sapiens
gtgtatgtttgcacacttgtgt

SEQ ID NO: 4362640 - DNA, 15 bp, Homo sapiens
gtgtctcccaacatg

SEQ ID NO: 4362641 - DNA, 17 bp, Homo sapiens
gtgtctcccaacatggg

SEQ ID NO: 4362642 - DNA, 17 bp, Homo sapiens
gtgtgagtaagagctgg

SEQ ID NO: 4362643 - DNA, 12 bp, Homo sapiens
gtgtgtgtatgt

SEQ ID NO: 4362644 - DNA, 16 bp, Homo sapiens
gtgttcagcagaacct

SEQ ID NO: 4362645 - DNA, 14 bp, Homo sapiens
gtgtttgtctgtgt

SEQ ID NO: 4362646 - DNA, 15 bp, Homo sapiens
gttaagaattgagca

SEQ ID NO: 4362647 - DNA, 18 bp, Homo sapiens
gttagaagaagaggaaga

SEQ ID NO: 4362648 - DNA, 13 bp, Homo sapiens
gttatgaacagct

SEQ ID NO: 4362649 - DNA, 22 bp, Homo sapiens
gttcaccttggaagggcgttct

SEQ ID NO: 4362650 - DNA, 22 bp, Homo sapiens
gttcagcagaacctgcacacag

SEQ ID NO: 4362651 - DNA, 15 bp, Homo sapiens
gttcatccaatcctc

SEQ ID NO: 4362652 - DNA, 13 bp, Homo sapiens
gttccttgcctta

SEQ ID NO: 4362653 - DNA, 18 bp, Homo sapiens
gttccttggccatgcaga

SEQ ID NO: 4362654 - DNA, 23 bp, Homo sapiens
gttctgccctgcctgaggaggag

SEQ ID NO: 4362655 - DNA, 12 bp, Homo sapiens
gttcttgggaga

SEQ ID NO: 4362656 - DNA, 13 bp, Homo sapiens
gttctttggaagc

SEQ ID NO: 4362657 - DNA, 12 bp, Homo sapiens
gttgagaaatga

SEQ ID NO: 4362658 - DNA, 17 bp, Homo sapiens
gttggaaggatctgctg

SEQ ID NO: 4362659 - DNA, 18 bp, Homo sapiens
gttggaaggatctgctga

SEQ ID NO: 4362660 - DNA, 14 bp, Homo sapiens
gttggagagcagca

SEQ ID NO: 4362661 - DNA, 22 bp, Homo sapiens
gttgggggagggaagaccagaa

SEQ ID NO: 4362662 - DNA, 17 bp, Homo sapiens
gttgtaatatttcttca

SEQ ID NO: 4362663 - DNA, 17 bp, Homo sapiens
gttgtggatatcagggt

SEQ ID NO: 4362664 - DNA, 20 bp, Homo sapiens
gtttaaatagcctaaatgat

SEQ ID NO: 4362665 - DNA, 14 bp, Homo sapiens
gtttggccctggag

SEQ ID NO: 4362666 - DNA, 15 bp, Homo sapiens
gtttggggagcagag

SEQ ID NO: 4362667 - DNA, 20 bp, Homo sapiens
gtttggggagcagagacact

SEQ ID NO: 4362668 - DNA, 18 bp, Homo sapiens
gttttatactgtacttaa

SEQ ID NO: 4362669 - DNA, 23 bp, Homo sapiens
gttttatactgtacttaataaat

SEQ ID NO: 4362670 - DNA, 18 bp, Homo sapiens
gttttcaaactgctgcat

SEQ ID NO: 4362671 - DNA, 13 bp, Homo sapiens
gttttctgaaaca

SEQ ID NO: 4362672 - DNA, 17 bp, Homo sapiens
gttttcttggtggcaga

SEQ ID NO: 4362673 - DNA, 15 bp, Homo sapiens
gttttgggcctccat

SEQ ID NO: 4362674 - DNA, 13 bp, Homo sapiens
gtttttctatata

SEQ ID NO: 4362675 - DNA, 15 bp, Homo sapiens
taaaaaatattaaag

SEQ ID NO: 4362676 - DNA, 17 bp, Homo sapiens
taaaaatagcagtatta

SEQ ID NO: 4362677 - DNA, 13 bp, Homo sapiens
taaaaccacagct

SEQ ID NO: 4362678 - DNA, 13 bp, Homo sapiens
taaaagtgatcaa

SEQ ID NO: 4362679 - DNA, 14 bp, Homo sapiens
taaaataaaattat

SEQ ID NO: 4362680 - DNA, 19 bp, Homo sapiens
taaaatgtgatttttctga

SEQ ID NO: 4362681 - DNA, 20 bp, Homo sapiens
taaaattagttttaaaatac

SEQ ID NO: 4362682 - DNA, 20 bp, Homo sapiens
taaaggtaccaaacaaggaa

SEQ ID NO: 4362683 - DNA, 16 bp, Homo sapiens
taaagtgtaaatcctt

SEQ ID NO: 4362684 - DNA, 12 bp, Homo sapiens
taaagttgcttt

SEQ ID NO: 4362685 - DNA, 13 bp, Homo sapiens
taaagttgctttt

SEQ ID NO: 4362686 - DNA, 14 bp, Homo sapiens
taaataaaagtaca

SEQ ID NO: 4362687 - DNA, 19 bp, Homo sapiens
taaataaaagtgatcaata

SEQ ID NO: 4362688 - DNA, 14 bp, Homo sapiens
taaatagatgtaaa

SEQ ID NO: 4362689 - DNA, 16 bp, Homo sapiens
taaatagcctaaatga

SEQ ID NO: 4362690 - DNA, 15 bp, Homo sapiens
taaatatgtaatata

SEQ ID NO: 4362691 - DNA, 13 bp, Homo sapiens
taaatatttcctt

SEQ ID NO: 4362692 - DNA, 14 bp, Homo sapiens
taaatcatcctcat

SEQ ID NO: 4362693 - DNA, 15 bp, Homo sapiens
taaatccgacttgaa

SEQ ID NO: 4362694 - DNA, 21 bp, Homo sapiens
taaatccgacttgaatattcc

SEQ ID NO: 4362695 - DNA, 23 bp, Homo sapiens
taaatccgacttgaatattcctg

SEQ ID NO: 4362696 - DNA, 17 bp, Homo sapiens
taaatcctttttcttta

SEQ ID NO: 4362697 - DNA, 19 bp, Homo sapiens
taaatcctttttctttata

SEQ ID NO: 4362698 - DNA, 15 bp, Homo sapiens
taaatgatggtgctt

SEQ ID NO: 4362699 - DNA, 21 bp, Homo sapiens
taaattctgaatgcaattttt

SEQ ID NO: 4362700 - DNA, 13 bp, Homo sapiens
taaatttaagcaa

SEQ ID NO: 4362701 - DNA, 22 bp, Homo sapiens
taaatttaagcaaacgtctatt

SEQ ID NO: 4362702 - DNA, 21 bp, Homo sapiens
taaatttcaattagatttaaa

SEQ ID NO: 4362703 - DNA, 17 bp, Homo sapiens
taacaagatctttcagg

SEQ ID NO: 4362704 - DNA, 18 bp, Homo sapiens
taacaagatctttcagga

SEQ ID NO: 4362705 - DNA, 16 bp, Homo sapiens
taacaagattaaatat

SEQ ID NO: 4362706 - DNA, 19 bp, Homo sapiens
taacactgcagccctctcc

SEQ ID NO: 4362707 - DNA, 11 bp, Homo sapiens
taaccaagttc

SEQ ID NO: 4362708 - DNA, 12 bp, Homo sapiens
taaccaagttcc

SEQ ID NO: 4362709 - DNA, 14 bp, Homo sapiens
taactgaactgtga

SEQ ID NO: 4362710 - DNA, 16 bp, Homo sapiens
taagagcaattctggg

SEQ ID NO: 4362711 - DNA, 14 bp, Homo sapiens
taagatctgactgc

SEQ ID NO: 4362712 - DNA, 22 bp, Homo sapiens
taagcaaacgtctattttgtat

SEQ ID NO: 4362713 - DNA, 23 bp, Homo sapiens
taagcacacacatctggccctga

SEQ ID NO: 4362714 - DNA, 18 bp, Homo sapiens
taagctgcacatgactac

SEQ ID NO: 4362715 - DNA, 18 bp, Homo sapiens
taagtacagaacagtaaa

SEQ ID NO: 4362716 - DNA, 18 bp, Homo sapiens
taagtcaggtaatatacc

SEQ ID NO: 4362717 - DNA, 16 bp, Homo sapiens
taagtgagcagaacag

SEQ ID NO: 4362718 - DNA, 20 bp, Homo sapiens
taagtgttctcatgaagcag

SEQ ID NO: 4362719 - DNA, 16 bp, Homo sapiens
taagttaatgaaataa

SEQ ID NO: 4362720 - DNA, 22 bp, Homo sapiens
taagttaatgaaataaaatttg

SEQ ID NO: 4362721 - DNA, 14 bp, Homo sapiens
taagttacttgaaa

SEQ ID NO: 4362722 - DNA, 19 bp, Homo sapiens
taagttacttgaaataagt

SEQ ID NO: 4362723 - DNA, 23 bp, Homo sapiens
taagttacttgaaataagttgtt

SEQ ID NO: 4362724 - DNA, 13 bp, Homo sapiens
taataaattcaga

SEQ ID NO: 4362725 - DNA, 13 bp, Homo sapiens
taataactgcagt

SEQ ID NO: 4362726 - DNA, 17 bp, Homo sapiens
taatactttaggaaata

SEQ ID NO: 4362727 - DNA, 19 bp, Homo sapiens
taatactttaggaaatacg

SEQ ID NO: 4362728 - DNA, 16 bp, Homo sapiens
taatatacctggttta

SEQ ID NO: 4362729 - DNA, 16 bp, Homo sapiens
taatcaggaaaaatga

SEQ ID NO: 4362730 - DNA, 17 bp, Homo sapiens
taatcaggaaaaatgag

SEQ ID NO: 4362731 - DNA, 20 bp, Homo sapiens
taatgaaataaaatttgaaa

SEQ ID NO: 4362732 - DNA, 20 bp, Homo sapiens
taatgagatgttattactgt

SEQ ID NO: 4362733 - DNA, 14 bp, Homo sapiens
taatttgtacaatg

SEQ ID NO: 4362734 - DNA, 23 bp, Homo sapiens
taatttgtacaatggtttattcc

SEQ ID NO: 4362735 - DNA, 20 bp, Homo sapiens
tacaaagtaaaatgaacatt

SEQ ID NO: 4362736 - DNA, 18 bp, Homo sapiens
tacaataagttacttgaa

SEQ ID NO: 4362737 - DNA, 19 bp, Homo sapiens
tacaataagttacttgaaa

SEQ ID NO: 4362738 - DNA, 13 bp, Homo sapiens
ggggaccaggagc

SEQ ID NO: 4362739 - DNA, 12 bp, Homo sapiens
ggggagggcagg

SEQ ID NO: 4362740 - DNA, 10 bp, Homo sapiens
ggggccagga

SEQ ID NO: 4362741 - DNA, 11 bp, Homo sapiens
ggggccaggac

SEQ ID NO: 4362742 - DNA, 12 bp, Homo sapiens
ggggccaggacc

SEQ ID NO: 4362743 - DNA, 14 bp, Homo sapiens
ggggcgggccaggg

SEQ ID NO: 4362744 - DNA, 17 bp, Homo sapiens
ggggcgggctcagagct

SEQ ID NO: 4362745 - DNA, 12 bp, Homo sapiens
gggggtgactgg

SEQ ID NO: 4362746 - DNA, 13 bp, Homo sapiens
ggggtgactggaa

SEQ ID NO: 4362747 - DNA, 11 bp, Homo sapiens
gggtccaggcc

SEQ ID NO: 4362748 - DNA, 13 bp, Homo sapiens
gggtgactggaag

SEQ ID NO: 4362749 - DNA, 15 bp, Homo sapiens
gggtgcacccacctg

SEQ ID NO: 4362750 - DNA, 19 bp, Homo sapiens
gggtgcgtctccagtcatc

SEQ ID NO: 4362751 - DNA, 11 bp, Homo sapiens
gggtgggaaga

SEQ ID NO: 4362752 - DNA, 12 bp, Homo sapiens
gggtgggaagag

SEQ ID NO: 4362753 - DNA, 19 bp, Homo sapiens
gggttctgccctgcctgag

SEQ ID NO: 4362754 - DNA, 20 bp, Homo sapiens
gggttctgccctgcctgagg

SEQ ID NO: 4362755 - DNA, 21 bp, Homo sapiens
gggttctgccctgcctgagga

SEQ ID NO: 4362756 - DNA, 16 bp, Homo sapiens
ggtaagtgttctcatg

SEQ ID NO: 4362757 - DNA, 13 bp, Homo sapiens
ggtactaccccag

SEQ ID NO: 4362758 - DNA, 19 bp, Homo sapiens
ggtattccttttgtgtaca

SEQ ID NO: 4362759 - DNA, 17 bp, Homo sapiens
ggtcactccaccatccc

SEQ ID NO: 4362760 - DNA, 12 bp, Homo sapiens
ggtccaggcccg

SEQ ID NO: 4362761 - DNA, 13 bp, Homo sapiens
ggtccaggcccgt

SEQ ID NO: 4362762 - DNA, 16 bp, Homo sapiens
ggtcccccctgagtgg

SEQ ID NO: 4362763 - DNA, 20 bp, Homo sapiens
ggtcccgcactctgccccca

SEQ ID NO: 4362764 - DNA, 22 bp, Homo sapiens
ggtccttgcctgaactccagag

SEQ ID NO: 4362765 - DNA, 15 bp, Homo sapiens
ggtctcgcagcctga

SEQ ID NO: 4362766 - DNA, 16 bp, Homo sapiens
ggtgaagggagagcca

SEQ ID NO: 4362767 - DNA, 17 bp, Homo sapiens
ggtgactggaagttgtg

SEQ ID NO: 4362768 - DNA, 18 bp, Homo sapiens
ggtgagtcttggttctaa

SEQ ID NO: 4362769 - DNA, 20 bp, Homo sapiens
ggtgagtcttggttctaaag

SEQ ID NO: 4362770 - DNA, 14 bp, Homo sapiens
ggtgcacccacctg

SEQ ID NO: 4362771 - DNA, 22 bp, Homo sapiens
ggtgcacccacctgttttctga

SEQ ID NO: 4362772 - DNA, 14 bp, Homo sapiens
ggtgcgtctccagt

SEQ ID NO: 4362773 - DNA, 17 bp, Homo sapiens
ggtgcgtctccagtcat

SEQ ID NO: 4362774 - DNA, 16 bp, Homo sapiens
ggtgcgtgttcagcag

SEQ ID NO: 4362775 - DNA, 22 bp, Homo sapiens
ggtgggaccctgtccggcccag

SEQ ID NO: 4362776 - DNA, 14 bp, Homo sapiens
ggtgtctcccaaca

SEQ ID NO: 4362777 - DNA, 19 bp, Homo sapiens
ggttagaaaggcagccctc

SEQ ID NO: 4362778 - DNA, 13 bp, Homo sapiens
ggttctgccctgc

SEQ ID NO: 4362779 - DNA, 18 bp, Homo sapiens
ggttctgccctgcctgag

SEQ ID NO: 4362780 - DNA, 21 bp, Homo sapiens
ggttctgccctgcctgaggag

SEQ ID NO: 4362781 - DNA, 13 bp, Homo sapiens
ggttgagaaatga

SEQ ID NO: 4362782 - DNA, 13 bp, Homo sapiens
ggttgcctccccc

SEQ ID NO: 4362783 - DNA, 13 bp, Homo sapiens
gtaaaaatgctgc

SEQ ID NO: 4362784 - DNA, 14 bp, Homo sapiens
gtaaaaatgctgct

SEQ ID NO: 4362785 - DNA, 16 bp, Homo sapiens
gtaaaaatgctgctct

SEQ ID NO: 4362786 - DNA, 16 bp, Homo sapiens
gtaaaatgaacatttt

SEQ ID NO: 4362787 - DNA, 16 bp, Homo sapiens
gtaacagctgaggtct

SEQ ID NO: 4362788 - DNA, 14 bp, Homo sapiens
gtaagagctggtgt

SEQ ID NO: 4362789 - DNA, 16 bp, Homo sapiens
gtaagatcataacaat

SEQ ID NO: 4362790 - DNA, 21 bp, Homo sapiens
gtaagtgtgagtaagagctgg

SEQ ID NO: 4362791 - DNA, 17 bp, Homo sapiens
gtaagtgttctcatgaa

SEQ ID NO: 4362792 - DNA, 12 bp, Homo sapiens
gtaatataaatt

SEQ ID NO: 4362793 - DNA, 14 bp, Homo sapiens
gtacactgaatatt

SEQ ID NO: 4362794 - DNA, 15 bp, Homo sapiens
gtacttgaaggatgg

SEQ ID NO: 4362795 - DNA, 17 bp, Homo sapiens
gtacttgaaggatggat

SEQ ID NO: 4362796 - DNA, 15 bp, Homo sapiens
gtagagacccccagg

SEQ ID NO: 4362797 - DNA, 12 bp, Homo sapiens
gtagcatgagag

SEQ ID NO: 4362798 - DNA, 23 bp, Homo sapiens
gtagggaaaccttggagaggaga

SEQ ID NO: 4362799 - DNA, 18 bp, Homo sapiens
gtaggggagggcaggctt

SEQ ID NO: 4362800 - DNA, 20 bp, Homo sapiens
gtaggggagggcaggcttgg

SEQ ID NO: 4362801 - DNA, 13 bp, Homo sapiens
gtatatttatagt

SEQ ID NO: 4362802 - DNA, 21 bp, Homo sapiens
gtatcaggaaatatatatgtg

SEQ ID NO: 4362803 - DNA, 18 bp, Homo sapiens
gtatgctttccctgagga

SEQ ID NO: 4362804 - DNA, 22 bp, Homo sapiens
gtatggtaggggagggcaggct

SEQ ID NO: 4362805 - DNA, 15 bp, Homo sapiens
gtattattctgcagc

SEQ ID NO: 4362806 - DNA, 22 bp, Homo sapiens
gtattctctttaccttctaaaa

SEQ ID NO: 4362807 - DNA, 21 bp, Homo sapiens
gtattttttacttttcacact

SEQ ID NO: 4362808 - DNA, 16 bp, Homo sapiens
gtcacaataaagttta

SEQ ID NO: 4362809 - DNA, 15 bp, Homo sapiens
gtcactcaaatgaat

SEQ ID NO: 4362810 - DNA, 20 bp, Homo sapiens
gtcactcaaatgaatttgct

SEQ ID NO: 4362811 - DNA, 16 bp, Homo sapiens
gtcactccaccatccc

SEQ ID NO: 4362812 - DNA, 22 bp, Homo sapiens
gtcaggtaatatacctggttta

SEQ ID NO: 4362813 - DNA, 18 bp, Homo sapiens
gtcatcttgtgagtggat

SEQ ID NO: 4362814 - DNA, 14 bp, Homo sapiens
gtcatggtactacc

SEQ ID NO: 4362815 - DNA, 19 bp, Homo sapiens
gtccacgtttttggaaaat

SEQ ID NO: 4362816 - DNA, 23 bp, Homo sapiens
gtccagacagcttgactgctttt

SEQ ID NO: 4362817 - DNA, 20 bp, Homo sapiens
gtccaggtggtgaattttcc

SEQ ID NO: 4362818 - DNA, 22 bp, Homo sapiens
gtccatccccttcccccatccc

SEQ ID NO: 4362819 - DNA, 13 bp, Homo sapiens
gtcccccctgagt

SEQ ID NO: 4362820 - DNA, 16 bp, Homo sapiens
gtcccgcactctgccc

SEQ ID NO: 4362821 - DNA, 17 bp, Homo sapiens
gtcccgcactctgcccc

SEQ ID NO: 4362822 - DNA, 17 bp, Homo sapiens
gtccctggagctgtcct

SEQ ID NO: 4362823 - DNA, 19 bp, Homo sapiens
gtcctgccggtgggaccct

SEQ ID NO: 4362824 - DNA, 21 bp, Homo sapiens
gtccttcattccgttaggaat

SEQ ID NO: 4362825 - DNA, 19 bp, Homo sapiens
gtccttgcctgaactccag

SEQ ID NO: 4362826 - DNA, 21 bp, Homo sapiens
gtccttgcctgaactccagag

SEQ ID NO: 4362827 - DNA, 13 bp, Homo sapiens
gtctaaatatttc

SEQ ID NO: 4362828 - DNA, 23 bp, Homo sapiens
gtctaaatatttccttaaactgt

SEQ ID NO: 4362829 - DNA, 17 bp, Homo sapiens
gtctaagtgtaaatgtt

SEQ ID NO: 4362830 - DNA, 18 bp, Homo sapiens
gtctaagtgtaaatgtta

SEQ ID NO: 4362831 - DNA, 20 bp, Homo sapiens
gtctaggactgcagtgtgga

SEQ ID NO: 4362832 - DNA, 16 bp, Homo sapiens
gtctcaggcagcacca

SEQ ID NO: 4362833 - DNA, 16 bp, Homo sapiens
gtctcccaacatggga

SEQ ID NO: 4362834 - DNA, 19 bp, Homo sapiens
gtctccctcccctctcaga

SEQ ID NO: 4362835 - DNA, 22 bp, Homo sapiens
gtctccctcccctctcagaaca

SEQ ID NO: 4362836 - DNA, 23 bp, Homo sapiens
gtctccctcccctctcagaacat

SEQ ID NO: 4362837 - DNA, 14 bp, Homo sapiens
gtctcgcagcctga

SEQ ID NO: 4362838 - DNA, 20 bp, Homo sapiens
gtctcgcagcctgaagcctg

SEQ ID NO: 4362839 - DNA, 23 bp, Homo sapiens
gtctcgcagcctgaagcctggat

SEQ ID NO: 4362840 - DNA, 23 bp, Homo sapiens
gtctcttgagggagcttagccaa

SEQ ID NO: 4362841 - DNA, 12 bp, Homo sapiens
gtctgctctggt

SEQ ID NO: 4362842 - DNA, 16 bp, Homo sapiens
gtctggactagaaaat

SEQ ID NO: 4362843 - DNA, 24 bp, Homo sapiens
gtctgtctccctcccctctcagaa

SEQ ID NO: 4362844 - DNA, 13 bp, Homo sapiens
gtctgtgaagagc

SEQ ID NO: 4362845 - DNA, 14 bp, Homo sapiens
gtctgtgaagagcc

SEQ ID NO: 4362846 - DNA, 22 bp, Homo sapiens
gtcttccgatcaacatttatga

SEQ ID NO: 4362847 - DNA, 14 bp, Homo sapiens
gtcttggttctaaa

SEQ ID NO: 4362848 - DNA, 17 bp, Homo sapiens
gtcttggttctaaaggt

SEQ ID NO: 4362849 - DNA, 21 bp, Homo sapiens
gtgaacaaagtgagaaatgaa

SEQ ID NO: 4362850 - DNA, 15 bp, Homo sapiens
gtgaacattcccagc

SEQ ID NO: 4362851 - DNA, 20 bp, Homo sapiens
gtgaacattcccagcccagc

SEQ ID NO: 4362852 - DNA, 23 bp, Homo sapiens
gtgacagtgcctgggaatgtatt

SEQ ID NO: 4362853 - DNA, 12 bp, Homo sapiens
gtgagcagaaca

SEQ ID NO: 4362854 - DNA, 16 bp, Homo sapiens
gtgaggaccactcctg

SEQ ID NO: 4362855 - DNA, 14 bp, Homo sapiens
gtgagtaagagctg

SEQ ID NO: 4362856 - DNA, 18 bp, Homo sapiens
gtgatcaataaaatgtga

SEQ ID NO: 4362857 - DNA, 15 bp, Homo sapiens
gtgatgccacacaga

SEQ ID NO: 4362858 - DNA, 13 bp, Homo sapiens
gtgattaatatgc

SEQ ID NO: 4362859 - DNA, 23 bp, Homo sapiens
gtgcaataatttgtacaatggtt

SEQ ID NO: 4362860 - DNA, 22 bp, Homo sapiens
gtgcacatgtacatatggaaat

SEQ ID NO: 4362861 - DNA, 14 bp, Homo sapiens
gctttccctgagga

SEQ ID NO: 4362862 - DNA, 19 bp, Homo sapiens
gctttctgggatgtcacag

SEQ ID NO: 4362863 - DNA, 22 bp, Homo sapiens
gctttctgggatgtcacagtcc

SEQ ID NO: 4362864 - DNA, 12 bp, Homo sapiens
gctttcttgctg

SEQ ID NO: 4362865 - DNA, 18 bp, Homo sapiens
gctttgtcacttgccaca

SEQ ID NO: 4362866 - DNA, 20 bp, Homo sapiens
gctttgtcacttgccacatg

SEQ ID NO: 4362867 - DNA, 16 bp, Homo sapiens
gcttttagaatgcagg

SEQ ID NO: 4362868 - DNA, 21 bp, Homo sapiens
ggaaaatggccatgcaggagg

SEQ ID NO: 4362869 - DNA, 16 bp, Homo sapiens
ggaaacagaagctttt

SEQ ID NO: 4362870 - DNA, 15 bp, Homo sapiens
ggaaaccttggagag

SEQ ID NO: 4362871 - DNA, 15 bp, Homo sapiens
ggaagaaaatatttt

SEQ ID NO: 4362872 - DNA, 22 bp, Homo sapiens
ggaagaaattcaggtacagaaa

SEQ ID NO: 4362873 - DNA, 17 bp, Homo sapiens
ggaagagcccgcagggc

SEQ ID NO: 4362874 - DNA, 18 bp, Homo sapiens
ggaagagcccgcagggcc

SEQ ID NO: 4362875 - DNA, 17 bp, Homo sapiens
ggaagataggctctgca

SEQ ID NO: 4362876 - DNA, 18 bp, Homo sapiens
ggaagataggctctgcac

SEQ ID NO: 4362877 - DNA, 13 bp, Homo sapiens
ggaagccaaagtt

SEQ ID NO: 4362878 - DNA, 15 bp, Homo sapiens
ggaaggatctgctga

SEQ ID NO: 4362879 - DNA, 17 bp, Homo sapiens
ggaagtgtaacagctga

SEQ ID NO: 4362880 - DNA, 21 bp, Homo sapiens
ggaagtgtaacagctgaggtc

SEQ ID NO: 4362881 - DNA, 23 bp, Homo sapiens
ggaagttgtggatatcagggtat

SEQ ID NO: 4362882 - DNA, 11 bp, Homo sapiens
ggaagttttca

SEQ ID NO: 4362883 - DNA, 16 bp, Homo sapiens
ggaatgtagggcctgc

SEQ ID NO: 4362884 - DNA, 13 bp, Homo sapiens
ggacacagcacaa

SEQ ID NO: 4362885 - DNA, 14 bp, Homo sapiens
ggacagaggccggg

SEQ ID NO: 4362886 - DNA, 11 bp, Homo sapiens
ggaccaggagc

SEQ ID NO: 4362887 - DNA, 13 bp, Homo sapiens
ggacttacaaaat

SEQ ID NO: 4362888 - DNA, 19 bp, Homo sapiens
ggacttacaaaatgccaag

SEQ ID NO: 4362889 - DNA, 18 bp, Homo sapiens
ggagactccaaggagcta

SEQ ID NO: 4362890 - DNA, 21 bp, Homo sapiens
ggagactccaaggagctactg

SEQ ID NO: 4362891 - DNA, 22 bp, Homo sapiens
ggagagagaggctgcctcagcc

SEQ ID NO: 4362892 - DNA, 23 bp, Homo sapiens
ggagagagaggctgcctcagcca

SEQ ID NO: 4362893 - DNA, 23 bp, Homo sapiens
ggagaggttataggtcactcctg

SEQ ID NO: 4362894 - DNA, 20 bp, Homo sapiens
ggagagtggcaggtgggctg

SEQ ID NO: 4362895 - DNA, 20 bp, Homo sapiens
ggagccttgctgggccaggg

SEQ ID NO: 4362896 - DNA, 17 bp, Homo sapiens
ggagctactgacattcc

SEQ ID NO: 4362897 - DNA, 15 bp, Homo sapiens
ggagctagcccagtc

SEQ ID NO: 4362898 - DNA, 21 bp, Homo sapiens
ggaggacacagcacaagggca

SEQ ID NO: 4362899 - DNA, 14 bp, Homo sapiens
ggaggagccttgct

SEQ ID NO: 4362900 - DNA, 11 bp, Homo sapiens
ggaggaggagc

SEQ ID NO: 4362901 - DNA, 17 bp, Homo sapiens
ggaggaggagccttgct

SEQ ID NO: 4362902 - DNA, 15 bp, Homo sapiens
ggaggaggaggagga

SEQ ID NO: 4362903 - DNA, 14 bp, Homo sapiens
ggagggaagaccag

SEQ ID NO: 4362904 - DNA, 22 bp, Homo sapiens
ggagggatcagccccgcctgtc

SEQ ID NO: 4362905 - DNA, 18 bp, Homo sapiens
ggagggcaggcttgggga

SEQ ID NO: 4362906 - DNA, 20 bp, Homo sapiens
ggaggtgcgtgttcagcaga

SEQ ID NO: 4362907 - DNA, 21 bp, Homo sapiens
ggagttcaccttggaagggcg

SEQ ID NO: 4362908 - DNA, 13 bp, Homo sapiens
ggagttgcctgac

SEQ ID NO: 4362909 - DNA, 18 bp, Homo sapiens
ggagttttgtctgtctcc

SEQ ID NO: 4362910 - DNA, 20 bp, Homo sapiens
ggagttttgtctgtctccct

SEQ ID NO: 4362911 - DNA, 13 bp, Homo sapiens
ggatatcagggta

SEQ ID NO: 4362912 - DNA, 12 bp, Homo sapiens
ggatcagccccg

SEQ ID NO: 4362913 - DNA, 14 bp, Homo sapiens
ggatctgctgaggc

SEQ ID NO: 4362914 - DNA, 17 bp, Homo sapiens
ggatggagatgggaagg

SEQ ID NO: 4362915 - DNA, 16 bp, Homo sapiens
ggatggatgagtcaga

SEQ ID NO: 4362916 - DNA, 12 bp, Homo sapiens
ggatgtcacagt

SEQ ID NO: 4362917 - DNA, 18 bp, Homo sapiens
ggatgttatgaacagctg

SEQ ID NO: 4362918 - DNA, 18 bp, Homo sapiens
ggcacctcggggacacca

SEQ ID NO: 4362919 - DNA, 20 bp, Homo sapiens
ggcacctcggggacaccaga

SEQ ID NO: 4362920 - DNA, 16 bp, Homo sapiens
ggcagaaagtggccat

SEQ ID NO: 4362921 - DNA, 17 bp, Homo sapiens
ggcagaatgaaaatcag

SEQ ID NO: 4362922 - DNA, 23 bp, Homo sapiens
ggcagaggaatgtagggcctgca

SEQ ID NO: 4362923 - DNA, 14 bp, Homo sapiens
ggcagccacccaag

SEQ ID NO: 4362924 - DNA, 22 bp, Homo sapiens
ggcagccacccaagcctgctgg

SEQ ID NO: 4362925 - DNA, 20 bp, Homo sapiens
ggcagccctcacctctgagg

SEQ ID NO: 4362926 - DNA, 22 bp, Homo sapiens
ggcagccctcacctctgaggac

SEQ ID NO: 4362927 - DNA, 14 bp, Homo sapiens
ggcagggctctgat

SEQ ID NO: 4362928 - DNA, 14 bp, Homo sapiens
ggcataggcctggg

SEQ ID NO: 4362929 - DNA, 16 bp, Homo sapiens
ggcataggcctgggtg

SEQ ID NO: 4362930 - DNA, 20 bp, Homo sapiens
ggcatttggtctcaggcagc

SEQ ID NO: 4362931 - DNA, 20 bp, Homo sapiens
ggccagcgagtggtcaagga

SEQ ID NO: 4362932 - DNA, 11 bp, Homo sapiens
ggccagggtgg

SEQ ID NO: 4362933 - DNA, 13 bp, Homo sapiens
ggccatgcagacc

SEQ ID NO: 4362934 - DNA, 17 bp, Homo sapiens
ggcccagtgccactgcc

SEQ ID NO: 4362935 - DNA, 11 bp, Homo sapiens
ggccccacttt

SEQ ID NO: 4362936 - DNA, 17 bp, Homo sapiens
ggccccactttgaaggg

SEQ ID NO: 4362937 - DNA, 21 bp, Homo sapiens
ggcccccaaattgccttcagc

SEQ ID NO: 4362938 - DNA, 21 bp, Homo sapiens
ggccccccgcacagccacccg

SEQ ID NO: 4362939 - DNA, 20 bp, Homo sapiens
ggccccctctcggccaggca

SEQ ID NO: 4362940 - DNA, 18 bp, Homo sapiens
ggccctgacttctggaga

SEQ ID NO: 4362941 - DNA, 12 bp, Homo sapiens
ggccctggagcc

SEQ ID NO: 4362942 - DNA, 20 bp, Homo sapiens
ggccctggagccagggcaga

SEQ ID NO: 4362943 - DNA, 21 bp, Homo sapiens
ggccctggagccagggcagag

SEQ ID NO: 4362944 - DNA, 14 bp, Homo sapiens
ggccggggtccagg

SEQ ID NO: 4362945 - DNA, 15 bp, Homo sapiens
ggcctcgtgcgcccg

SEQ ID NO: 4362946 - DNA, 10 bp, Homo sapiens
ggcctctggt

SEQ ID NO: 4362947 - DNA, 14 bp, Homo sapiens
ggcctgcatggaga

SEQ ID NO: 4362948 - DNA, 21 bp, Homo sapiens
ggcctgggtgctggctgccca

SEQ ID NO: 4362949 - DNA, 15 bp, Homo sapiens
ggcgggccagggtgg

SEQ ID NO: 4362950 - DNA, 13 bp, Homo sapiens
ggcgggctcagag

SEQ ID NO: 4362951 - DNA, 12 bp, Homo sapiens
ggcgtctgctct

SEQ ID NO: 4362952 - DNA, 11 bp, Homo sapiens
ggctcagagct

SEQ ID NO: 4362953 - DNA, 12 bp, Homo sapiens
ggctcagagctt

SEQ ID NO: 4362954 - DNA, 20 bp, Homo sapiens
ggctcagagctttgtcactt

SEQ ID NO: 4362955 - DNA, 23 bp, Homo sapiens
ggctcagagctttgtcacttgcc

SEQ ID NO: 4362956 - DNA, 12 bp, Homo sapiens
ggctctgcacag

SEQ ID NO: 4362957 - DNA, 16 bp, Homo sapiens
ggctgcctcagccagt

SEQ ID NO: 4362958 - DNA, 14 bp, Homo sapiens
ggctgcctgctgtg

SEQ ID NO: 4362959 - DNA, 21 bp, Homo sapiens
ggctgggaacatgacccagcc

SEQ ID NO: 4362960 - DNA, 16 bp, Homo sapiens
ggctggtgtggctgct

SEQ ID NO: 4362961 - DNA, 21 bp, Homo sapiens
ggcttaagtgagcagaacagg

SEQ ID NO: 4362962 - DNA, 17 bp, Homo sapiens
ggcttcagcatatttat

SEQ ID NO: 4362963 - DNA, 20 bp, Homo sapiens
ggcttcagcatatttatagc

SEQ ID NO: 4362964 - DNA, 20 bp, Homo sapiens
gggaaaatggccatgcagga

SEQ ID NO: 4362965 - DNA, 17 bp, Homo sapiens
gggaacatgacccagcc

SEQ ID NO: 4362966 - DNA, 22 bp, Homo sapiens
gggaagataggctctgcacaga

SEQ ID NO: 4362967 - DNA, 21 bp, Homo sapiens
gggaaggttagaaaggcagcc

SEQ ID NO: 4362968 - DNA, 21 bp, Homo sapiens
gggaatgtattattctgcagc

SEQ ID NO: 4362969 - DNA, 14 bp, Homo sapiens
gggagaaaatcaac

SEQ ID NO: 4362970 - DNA, 11 bp, Homo sapiens
gggagggaggg

SEQ ID NO: 4362971 - DNA, 15 bp, Homo sapiens
gggatcagccccgcc

SEQ ID NO: 4362972 - DNA, 15 bp, Homo sapiens
gggcagccacccaag

SEQ ID NO: 4362973 - DNA, 16 bp, Homo sapiens
gggcaggcttggggaa

SEQ ID NO: 4362974 - DNA, 16 bp, Homo sapiens
gggcagggtgagaagc

SEQ ID NO: 4362975 - DNA, 22 bp, Homo sapiens
gggccagggtgggaagagaaga

SEQ ID NO: 4362976 - DNA, 16 bp, Homo sapiens
gggcccggccacaccc

SEQ ID NO: 4362977 - DNA, 17 bp, Homo sapiens
gggcctccatgccccag

SEQ ID NO: 4362978 - DNA, 18 bp, Homo sapiens
gggcctgcatggagaagg

SEQ ID NO: 4362979 - DNA, 21 bp, Homo sapiens
gggcgggctcagagctttgtc

SEQ ID NO: 4362980 - DNA, 19 bp, Homo sapiens
gggctcagggttggccatt

SEQ ID NO: 4362981 - DNA, 17 bp, Homo sapiens
gggctctccctgcacgc

SEQ ID NO: 4362982 - DNA, 18 bp, Homo sapiens
gggctgggccctctgtcc

SEQ ID NO: 4362983 - DNA, 16 bp, Homo sapiens
ggggaatgcacctccc

SEQ ID NO: 4362984 - DNA, 19 bp, Homo sapiens
gccccactttgaagggcaa

SEQ ID NO: 4362985 - DNA, 18 bp, Homo sapiens
gccccccgcacagccacc

SEQ ID NO: 4362986 - DNA, 19 bp, Homo sapiens
gccccctccccccagactc

SEQ ID NO: 4362987 - DNA, 15 bp, Homo sapiens
gccccgccccgttgt

SEQ ID NO: 4362988 - DNA, 20 bp, Homo sapiens
gccccgcctgtcacaataaa

SEQ ID NO: 4362989 - DNA, 15 bp, Homo sapiens
gcccctgcacaggca

SEQ ID NO: 4362990 - DNA, 20 bp, Homo sapiens
gcccctgcagtttggccctg

SEQ ID NO: 4362991 - DNA, 22 bp, Homo sapiens
gcccctgcagtttggccctgga

SEQ ID NO: 4362992 - DNA, 19 bp, Homo sapiens
gcccgcaggaactgggctg

SEQ ID NO: 4362993 - DNA, 12 bp, Homo sapiens
gcccgcagggcc

SEQ ID NO: 4362994 - DNA, 20 bp, Homo sapiens
gcccggcgccgggcaccaac

SEQ ID NO: 4362995 - DNA, 21 bp, Homo sapiens
gcccggcgccgggcaccaact

SEQ ID NO: 4362996 - DNA, 21 bp, Homo sapiens
gcccgtgcccccgcctgccac

SEQ ID NO: 4362997 - DNA, 23 bp, Homo sapiens
gcccgtgcccccgcctgccaccg

SEQ ID NO: 4362998 - DNA, 16 bp, Homo sapiens
gcccgtgcccgcagga

SEQ ID NO: 4362999 - DNA, 19 bp, Homo sapiens
gcccgtgcccgcaggaact

SEQ ID NO: 4363000 - DNA, 13 bp, Homo sapiens
gccctcacctctg

SEQ ID NO: 4363001 - DNA, 16 bp, Homo sapiens
gccctcacctctgagg

SEQ ID NO: 4363002 - DNA, 19 bp, Homo sapiens
gccctcatccgtattcttt

SEQ ID NO: 4363003 - DNA, 16 bp, Homo sapiens
gccctgacttctggag

SEQ ID NO: 4363004 - DNA, 15 bp, Homo sapiens
gccctgcctgaggag

SEQ ID NO: 4363005 - DNA, 11 bp, Homo sapiens
gccctggagcc

SEQ ID NO: 4363006 - DNA, 19 bp, Homo sapiens
gccctggagccagggcaga

SEQ ID NO: 4363007 - DNA, 22 bp, Homo sapiens
gcccttctatacccacccagaa

SEQ ID NO: 4363008 - DNA, 16 bp, Homo sapiens
gccgaagccccttgga

SEQ ID NO: 4363009 - DNA, 22 bp, Homo sapiens
gccgaagccccttggagagaga

SEQ ID NO: 4363010 - DNA, 16 bp, Homo sapiens
gccgcctcccacggca

SEQ ID NO: 4363011 - DNA, 13 bp, Homo sapiens
gccggtgggaccc

SEQ ID NO: 4363012 - DNA, 16 bp, Homo sapiens
gccggtgggaccctgt

SEQ ID NO: 4363013 - DNA, 12 bp, Homo sapiens
gcctaaatgatg

SEQ ID NO: 4363014 - DNA, 17 bp, Homo sapiens
gcctagttcatccaatc

SEQ ID NO: 4363015 - DNA, 16 bp, Homo sapiens
gcctcagccagtggca

SEQ ID NO: 4363016 - DNA, 20 bp, Homo sapiens
gcctcatagcatagccagca

SEQ ID NO: 4363017 - DNA, 21 bp, Homo sapiens
gcctcatagcatagccagcat

SEQ ID NO: 4363018 - DNA, 23 bp, Homo sapiens
gcctccagtcatggtactacccc

SEQ ID NO: 4363019 - DNA, 17 bp, Homo sapiens
gcctccatgccccagct

SEQ ID NO: 4363020 - DNA, 14 bp, Homo sapiens
gcctcccacggcac

SEQ ID NO: 4363021 - DNA, 12 bp, Homo sapiens
gcctctggttgc

SEQ ID NO: 4363022 - DNA, 14 bp, Homo sapiens
gcctctggttgcct

SEQ ID NO: 4363023 - DNA, 17 bp, Homo sapiens
gcctctggttgcctccc

SEQ ID NO: 4363024 - DNA, 18 bp, Homo sapiens
gcctctggttgcctcccc

SEQ ID NO: 4363025 - DNA, 15 bp, Homo sapiens
gcctcttcttcttca

SEQ ID NO: 4363026 - DNA, 21 bp, Homo sapiens
gcctcttcttcttcagaagac

SEQ ID NO: 4363027 - DNA, 15 bp, Homo sapiens
gcctgaactccagag

SEQ ID NO: 4363028 - DNA, 17 bp, Homo sapiens
gcctgactcctgggtgg

SEQ ID NO: 4363029 - DNA, 23 bp, Homo sapiens
gcctgaggaggaggacacagcac

SEQ ID NO: 4363030 - DNA, 12 bp, Homo sapiens
gcctgctggctg

SEQ ID NO: 4363031 - DNA, 21 bp, Homo sapiens
gcctgctggctgcggccccct

SEQ ID NO: 4363032 - DNA, 15 bp, Homo sapiens
gcctggctagaaaac

SEQ ID NO: 4363033 - DNA, 12 bp, Homo sapiens
gcctgggtgctg

SEQ ID NO: 4363034 - DNA, 13 bp, Homo sapiens
gcctgtcacaata

SEQ ID NO: 4363035 - DNA, 18 bp, Homo sapiens
gcctgtccaccctgccaa

SEQ ID NO: 4363036 - DNA, 14 bp, Homo sapiens
gccttaagcagaac

SEQ ID NO: 4363037 - DNA, 19 bp, Homo sapiens
gccttaagcagaacaaatg

SEQ ID NO: 4363038 - DNA, 22 bp, Homo sapiens
gccttaagcagaacaaatgtgt

SEQ ID NO: 4363039 - DNA, 23 bp, Homo sapiens
gccttaagcagaacaaatgtgtt

SEQ ID NO: 4363040 - DNA, 15 bp, Homo sapiens
gccttaataaatatg

SEQ ID NO: 4363041 - DNA, 23 bp, Homo sapiens
gccttccgggtctcgcagcctga

SEQ ID NO: 4363042 - DNA, 19 bp, Homo sapiens
gccttgataatacttgacc

SEQ ID NO: 4363043 - DNA, 16 bp, Homo sapiens
gccttgcatgtacttg

SEQ ID NO: 4363044 - DNA, 19 bp, Homo sapiens
gccttgcatgtacttgaag

SEQ ID NO: 4363045 - DNA, 21 bp, Homo sapiens
gccttgcatgtacttgaagga

SEQ ID NO: 4363046 - DNA, 13 bp, Homo sapiens
gccttgctgggcc

SEQ ID NO: 4363047 - DNA, 20 bp, Homo sapiens
gccttggctgacatgaagct

SEQ ID NO: 4363048 - DNA, 14 bp, Homo sapiens
gcgagtggtcaagg

SEQ ID NO: 4363049 - DNA, 17 bp, Homo sapiens
gcgcaaaggtgcctcat

SEQ ID NO: 4363050 - DNA, 18 bp, Homo sapiens
gcgcgggcagccacccaa

SEQ ID NO: 4363051 - DNA, 20 bp, Homo sapiens
gcgcttggtctttctgtgct

SEQ ID NO: 4363052 - DNA, 22 bp, Homo sapiens
gcggccccctctcggccaggca

SEQ ID NO: 4363053 - DNA, 16 bp, Homo sapiens
gcggccttccgggtct

SEQ ID NO: 4363054 - DNA, 19 bp, Homo sapiens
gcgggccagggtgggaaga

SEQ ID NO: 4363055 - DNA, 11 bp, Homo sapiens
gcgggctcaga

SEQ ID NO: 4363056 - DNA, 14 bp, Homo sapiens
gcgggctcagagct

SEQ ID NO: 4363057 - DNA, 15 bp, Homo sapiens
gcgggctcagagctt

SEQ ID NO: 4363058 - DNA, 15 bp, Homo sapiens
gcgtgttcagcagaa

SEQ ID NO: 4363059 - DNA, 19 bp, Homo sapiens
gctagcccagtccctggag

SEQ ID NO: 4363060 - DNA, 22 bp, Homo sapiens
gctagcccagtccctggagctg

SEQ ID NO: 4363061 - DNA, 17 bp, Homo sapiens
gctagttctgctgccct

SEQ ID NO: 4363062 - DNA, 12 bp, Homo sapiens
gctcagagcttt

SEQ ID NO: 4363063 - DNA, 13 bp, Homo sapiens
gctcagagctttg

SEQ ID NO: 4363064 - DNA, 14 bp, Homo sapiens
gctcagagctttgt

SEQ ID NO: 4363065 - DNA, 17 bp, Homo sapiens
gctcagagctttgtcac

SEQ ID NO: 4363066 - DNA, 12 bp, Homo sapiens
gctcagcccgct

SEQ ID NO: 4363067 - DNA, 18 bp, Homo sapiens
gctcagcccgctgagtgg

SEQ ID NO: 4363068 - DNA, 16 bp, Homo sapiens
gctcagggttggccat

SEQ ID NO: 4363069 - DNA, 15 bp, Homo sapiens
gctccagattctgat

SEQ ID NO: 4363070 - DNA, 20 bp, Homo sapiens
gctctaagagcaattctggg

SEQ ID NO: 4363071 - DNA, 18 bp, Homo sapiens
gctctcagcctcccacaa

SEQ ID NO: 4363072 - DNA, 17 bp, Homo sapiens
gctctcctccacctcaa

SEQ ID NO: 4363073 - DNA, 22 bp, Homo sapiens
gctctgaccaagccgagatgcc

SEQ ID NO: 4363074 - DNA, 11 bp, Homo sapiens
gctctgcacag

SEQ ID NO: 4363075 - DNA, 13 bp, Homo sapiens
gctctgcacagat

SEQ ID NO: 4363076 - DNA, 14 bp, Homo sapiens
gctctgcacagatg

SEQ ID NO: 4363077 - DNA, 15 bp, Homo sapiens
gctctggatgaaggc

SEQ ID NO: 4363078 - DNA, 23 bp, Homo sapiens
gctctggtggcttaagtgagcag

SEQ ID NO: 4363079 - DNA, 17 bp, Homo sapiens
gctgaatttccctctct

SEQ ID NO: 4363080 - DNA, 13 bp, Homo sapiens
gctgaggcccagt

SEQ ID NO: 4363081 - DNA, 17 bp, Homo sapiens
gctgaggtctcttgagg

SEQ ID NO: 4363082 - DNA, 21 bp, Homo sapiens
gctgcccttatgcccggcgcc

SEQ ID NO: 4363083 - DNA, 24 bp, Homo sapiens
gctgccgacttggagactcctggt

SEQ ID NO: 4363084 - DNA, 19 bp, Homo sapiens
gctgcctcagccagtggca

SEQ ID NO: 4363085 - DNA, 22 bp, Homo sapiens
gctgcctcagccagtggcacag

SEQ ID NO: 4363086 - DNA, 23 bp, Homo sapiens
gctgcctccctggggaccaggag

SEQ ID NO: 4363087 - DNA, 19 bp, Homo sapiens
gctgctcccagcctcttgc

SEQ ID NO: 4363088 - DNA, 18 bp, Homo sapiens
gctgctgcctccctgggg

SEQ ID NO: 4363089 - DNA, 16 bp, Homo sapiens
gctggatagacttggg

SEQ ID NO: 4363090 - DNA, 14 bp, Homo sapiens
gctggctgcggccc

SEQ ID NO: 4363091 - DNA, 23 bp, Homo sapiens
gctgggaacatgacccagcctga

SEQ ID NO: 4363092 - DNA, 14 bp, Homo sapiens
gctgggcagggtga

SEQ ID NO: 4363093 - DNA, 13 bp, Homo sapiens
gctgggccaggga

SEQ ID NO: 4363094 - DNA, 15 bp, Homo sapiens
gctggtagagacccc

SEQ ID NO: 4363095 - DNA, 24 bp, Homo sapiens
gctggttgtcatttttgcagtaga

SEQ ID NO: 4363096 - DNA, 16 bp, Homo sapiens
gctgtaagaagagact

SEQ ID NO: 4363097 - DNA, 18 bp, Homo sapiens
gctgtgagtgtaagtgtg

SEQ ID NO: 4363098 - DNA, 22 bp, Homo sapiens
gctgtgagtgtaagtgtgagta

SEQ ID NO: 4363099 - DNA, 21 bp, Homo sapiens
gctgtgtctgccaaacacatt

SEQ ID NO: 4363100 - DNA, 19 bp, Homo sapiens
gcttcagcatatttatagc

SEQ ID NO: 4363101 - DNA, 13 bp, Homo sapiens
gcttgactgcttt

SEQ ID NO: 4363102 - DNA, 21 bp, Homo sapiens
gcttgctccagattctgatgc

SEQ ID NO: 4363103 - DNA, 22 bp, Homo sapiens
gcttgctccagattctgatgca

SEQ ID NO: 4363104 - DNA, 14 bp, Homo sapiens
gcttgtgacagtgc

SEQ ID NO: 4363105 - DNA, 22 bp, Homo sapiens
gcttgtgacagtgcctcttcca

SEQ ID NO: 4363106 - DNA, 18 bp, Homo sapiens
gataatcaggaaaaatga

SEQ ID NO: 4363107 - DNA, 22 bp, Homo sapiens
gatacactgaatggaaataaat

SEQ ID NO: 4363108 - DNA, 17 bp, Homo sapiens
gatactctgtcagatgg

SEQ ID NO: 4363109 - DNA, 18 bp, Homo sapiens
gatatcaatactaagtga

SEQ ID NO: 4363110 - DNA, 16 bp, Homo sapiens
gatattccatgaatgt

SEQ ID NO: 4363111 - DNA, 18 bp, Homo sapiens
gatattccatgaatgtat

SEQ ID NO: 4363112 - DNA, 21 bp, Homo sapiens
gatattccatgaatgtatcag

SEQ ID NO: 4363113 - DNA, 12 bp, Homo sapiens
gatcaacattta

SEQ ID NO: 4363114 - DNA, 19 bp, Homo sapiens
gatcaataaaatgtgattt

SEQ ID NO: 4363115 - DNA, 20 bp, Homo sapiens
gatcagccccgcctgtcaca

SEQ ID NO: 4363116 - DNA, 21 bp, Homo sapiens
gatcagccccgcctgtcacaa

SEQ ID NO: 4363117 - DNA, 19 bp, Homo sapiens
gatccagggatggagatgg

SEQ ID NO: 4363118 - DNA, 13 bp, Homo sapiens
gatccttccatct

SEQ ID NO: 4363119 - DNA, 15 bp, Homo sapiens
gatctttcaggaaag

SEQ ID NO: 4363120 - DNA, 15 bp, Homo sapiens
gatgagcgccacctc

SEQ ID NO: 4363121 - DNA, 12 bp, Homo sapiens
gatgagggaagg

SEQ ID NO: 4363122 - DNA, 14 bp, Homo sapiens
gatgagtcagacac

SEQ ID NO: 4363123 - DNA, 23 bp, Homo sapiens
gatgagtcagacacgattgagaa

SEQ ID NO: 4363124 - DNA, 17 bp, Homo sapiens
gatgccacacagagtgg

SEQ ID NO: 4363125 - DNA, 18 bp, Homo sapiens
gatgccataatcagaaca

SEQ ID NO: 4363126 - DNA, 21 bp, Homo sapiens
gatgcccctgcagtttggccc

SEQ ID NO: 4363127 - DNA, 16 bp, Homo sapiens
gatggagatgggaagg

SEQ ID NO: 4363128 - DNA, 21 bp, Homo sapiens
gatggaggggtggtcctgact

SEQ ID NO: 4363129 - DNA, 16 bp, Homo sapiens
gatggatgagtcagac

SEQ ID NO: 4363130 - DNA, 14 bp, Homo sapiens
gatggatttgcctg

SEQ ID NO: 4363131 - DNA, 22 bp, Homo sapiens
gatggcatttggtctcaggcag

SEQ ID NO: 4363132 - DNA, 23 bp, Homo sapiens
gatgggaaggttagaaaggcagc

SEQ ID NO: 4363133 - DNA, 20 bp, Homo sapiens
gatgtgcaataatttgtaca

SEQ ID NO: 4363134 - DNA, 15 bp, Homo sapiens
gatgttatgaacagc

SEQ ID NO: 4363135 - DNA, 17 bp, Homo sapiens
gatgttatgaacagctg

SEQ ID NO: 4363136 - DNA, 18 bp, Homo sapiens
gattcaaattgctgcttg

SEQ ID NO: 4363137 - DNA, 16 bp, Homo sapiens
gattgaggagttgcct

SEQ ID NO: 4363138 - DNA, 18 bp, Homo sapiens
gcaacttctagcatatag

SEQ ID NO: 4363139 - DNA, 21 bp, Homo sapiens
gcaacttgtctttttctggac

SEQ ID NO: 4363140 - DNA, 22 bp, Homo sapiens
gcaacttgtctttttctggact

SEQ ID NO: 4363141 - DNA, 23 bp, Homo sapiens
gcaagaaatggcgtctgctctgg

SEQ ID NO: 4363142 - DNA, 16 bp, Homo sapiens
gcaataatttgtacaa

SEQ ID NO: 4363143 - DNA, 22 bp, Homo sapiens
gcaataatttgtacaatggttt

SEQ ID NO: 4363144 - DNA, 22 bp, Homo sapiens
gcaatccatgttagtttttact

SEQ ID NO: 4363145 - DNA, 23 bp, Homo sapiens
gcaatttgtctggactagaaaat

SEQ ID NO: 4363146 - DNA, 19 bp, Homo sapiens
gcacaagggcacattgccc

SEQ ID NO: 4363147 - DNA, 23 bp, Homo sapiens
gcacacacaaacctactgcccac

SEQ ID NO: 4363148 - DNA, 19 bp, Homo sapiens
gcacacacatctggccctg

SEQ ID NO: 4363149 - DNA, 21 bp, Homo sapiens
gcacacacatctggccctgac

SEQ ID NO: 4363150 - DNA, 14 bp, Homo sapiens
gcacacagggcccg

SEQ ID NO: 4363151 - DNA, 23 bp, Homo sapiens
gcacacagggcccggccacaccc

SEQ ID NO: 4363152 - DNA, 18 bp, Homo sapiens
gcacagatggatttgcct

SEQ ID NO: 4363153 - DNA, 14 bp, Homo sapiens
gcacagccacccgt

SEQ ID NO: 4363154 - DNA, 18 bp, Homo sapiens
gcacatgtacatatggaa

SEQ ID NO: 4363155 - DNA, 20 bp, Homo sapiens
gcacccacctgttttctgaa

SEQ ID NO: 4363156 - DNA, 21 bp, Homo sapiens
gcacctcggggacaccagagc

SEQ ID NO: 4363157 - DNA, 13 bp, Homo sapiens
gcactacaatcat

SEQ ID NO: 4363158 - DNA, 16 bp, Homo sapiens
gcactgtcaggaatgg

SEQ ID NO: 4363159 - DNA, 20 bp, Homo sapiens
gcactgtctcagtttcactt

SEQ ID NO: 4363160 - DNA, 18 bp, Homo sapiens
gcactttaaacttaatgc

SEQ ID NO: 4363161 - DNA, 18 bp, Homo sapiens
gcagaacaaatgtgtttt

SEQ ID NO: 4363162 - DNA, 21 bp, Homo sapiens
gcagaacctgcacacaggaca

SEQ ID NO: 4363163 - DNA, 14 bp, Homo sapiens
gcagaatgaaaatc

SEQ ID NO: 4363164 - DNA, 21 bp, Homo sapiens
gcagacagtctgttatgcact

SEQ ID NO: 4363165 - DNA, 13 bp, Homo sapiens
gcagagacactaa

SEQ ID NO: 4363166 - DNA, 10 bp, Homo sapiens
gcagagccta

SEQ ID NO: 4363167 - DNA, 12 bp, Homo sapiens
gcagaggaatgt

SEQ ID NO: 4363168 - DNA, 15 bp, Homo sapiens
gcagcaccacactgg

SEQ ID NO: 4363169 - DNA, 15 bp, Homo sapiens
gcagccccctgtggc

SEQ ID NO: 4363170 - DNA, 18 bp, Homo sapiens
gcagccccctgtggcggc

SEQ ID NO: 4363171 - DNA, 16 bp, Homo sapiens
gcagccctcacctctg

SEQ ID NO: 4363172 - DNA, 12 bp, Homo sapiens
gcagccctctcc

SEQ ID NO: 4363173 - DNA, 20 bp, Homo sapiens
gcagcgtgtgggtcccgcac

SEQ ID NO: 4363174 - DNA, 19 bp, Homo sapiens
gcaggaactgggctgggcc

SEQ ID NO: 4363175 - DNA, 17 bp, Homo sapiens
gcaggagcctacttcta

SEQ ID NO: 4363176 - DNA, 15 bp, Homo sapiens
gcaggctggctggcc

SEQ ID NO: 4363177 - DNA, 15 bp, Homo sapiens
gcaggcttggggaaa

SEQ ID NO: 4363178 - DNA, 21 bp, Homo sapiens
gcaggcttggggaaaatggcc

SEQ ID NO: 4363179 - DNA, 15 bp, Homo sapiens
gcagggcatctcctg

SEQ ID NO: 4363180 - DNA, 16 bp, Homo sapiens
gcagggccatgcagac

SEQ ID NO: 4363181 - DNA, 18 bp, Homo sapiens
gcagggccatgcagacct

SEQ ID NO: 4363182 - DNA, 23 bp, Homo sapiens
gcaggtgctgtgcgccttgtaga

SEQ ID NO: 4363183 - DNA, 16 bp, Homo sapiens
gcaggtgggctgcctg

SEQ ID NO: 4363184 - DNA, 17 bp, Homo sapiens
gcaggtgggctgcctgc

SEQ ID NO: 4363185 - DNA, 17 bp, Homo sapiens
gcagtctaagtgtaaat

SEQ ID NO: 4363186 - DNA, 16 bp, Homo sapiens
gcagtttggccctgga

SEQ ID NO: 4363187 - DNA, 22 bp, Homo sapiens
gcagtttggccctggagccagg

SEQ ID NO: 4363188 - DNA, 23 bp, Homo sapiens
gcatagccagcattcagcacaca

SEQ ID NO: 4363189 - DNA, 21 bp, Homo sapiens
gcatatttattgcattgctgg

SEQ ID NO: 4363190 - DNA, 23 bp, Homo sapiens
gcatatttattgcattgctggta

SEQ ID NO: 4363191 - DNA, 14 bp, Homo sapiens
gcatcatttaactg

SEQ ID NO: 4363192 - DNA, 15 bp, Homo sapiens
gcatctcctgtgcat

SEQ ID NO: 4363193 - DNA, 16 bp, Homo sapiens
gcatgacctgtgacca

SEQ ID NO: 4363194 - DNA, 13 bp, Homo sapiens
gcatgtcccaccc

SEQ ID NO: 4363195 - DNA, 19 bp, Homo sapiens
gcatgtcccacccacccgc

SEQ ID NO: 4363196 - DNA, 13 bp, Homo sapiens
gcatgtgatctcc

SEQ ID NO: 4363197 - DNA, 13 bp, Homo sapiens
gcattaagcacac

SEQ ID NO: 4363198 - DNA, 15 bp, Homo sapiens
gcattaagcacacac

SEQ ID NO: 4363199 - DNA, 21 bp, Homo sapiens
gcattagaaatagacagtata

SEQ ID NO: 4363200 - DNA, 17 bp, Homo sapiens
gcattcagcacacacaa

SEQ ID NO: 4363201 - DNA, 17 bp, Homo sapiens
gcatttggtctcaggca

SEQ ID NO: 4363202 - DNA, 19 bp, Homo sapiens
gcatttggtctcaggcagc

SEQ ID NO: 4363203 - DNA, 19 bp, Homo sapiens
gccaaagttttcaaactgc

SEQ ID NO: 4363204 - DNA, 20 bp, Homo sapiens
gccaagggggtgactggaag

SEQ ID NO: 4363205 - DNA, 16 bp, Homo sapiens
gccacatggtgtctcc

SEQ ID NO: 4363206 - DNA, 17 bp, Homo sapiens
gccacatggtgtctccc

SEQ ID NO: 4363207 - DNA, 18 bp, Homo sapiens
gccacatggtgtctccca

SEQ ID NO: 4363208 - DNA, 20 bp, Homo sapiens
gccacatggtgtctcccaac

SEQ ID NO: 4363209 - DNA, 23 bp, Homo sapiens
gccacatggtgtctcccaacatg

SEQ ID NO: 4363210 - DNA, 19 bp, Homo sapiens
gccacccaagcctgctggc

SEQ ID NO: 4363211 - DNA, 20 bp, Homo sapiens
gccacccgtggggtgctgcc

SEQ ID NO: 4363212 - DNA, 21 bp, Homo sapiens
gccacccgtggggtgctgccc

SEQ ID NO: 4363213 - DNA, 16 bp, Homo sapiens
gccagaagagaattca

SEQ ID NO: 4363214 - DNA, 13 bp, Homo sapiens
gccagcattcagc

SEQ ID NO: 4363215 - DNA, 15 bp, Homo sapiens
gccagggtgggaaga

SEQ ID NO: 4363216 - DNA, 19 bp, Homo sapiens
gccagggtgggaagagaag

SEQ ID NO: 4363217 - DNA, 22 bp, Homo sapiens
gccagtccccgaggagctgggc

SEQ ID NO: 4363218 - DNA, 18 bp, Homo sapiens
gccatccttgctgcagct

SEQ ID NO: 4363219 - DNA, 13 bp, Homo sapiens
gccatgcaggagg

SEQ ID NO: 4363220 - DNA, 18 bp, Homo sapiens
gccatggggtccatcccc

SEQ ID NO: 4363221 - DNA, 17 bp, Homo sapiens
gcccacatttgggctca

SEQ ID NO: 4363222 - DNA, 16 bp, Homo sapiens
gcccagacccctctgg

SEQ ID NO: 4363223 - DNA, 15 bp, Homo sapiens
gcccagctctctgac

SEQ ID NO: 4363224 - DNA, 15 bp, Homo sapiens
gcccagtccctggag

SEQ ID NO: 4363225 - DNA, 19 bp, Homo sapiens
gcccagtccctggagctgt

SEQ ID NO: 4363226 - DNA, 20 bp, Homo sapiens
gcccagtgcatatgcaatgt

SEQ ID NO: 4363227 - DNA, 15 bp, Homo sapiens
gcccagtgccactgc

SEQ ID NO: 4363228 - DNA, 17 bp, Homo sapiens
gaatgcacctccccaaa

SEQ ID NO: 4363229 - DNA, 21 bp, Homo sapiens
gaatgccgcgaactgggttct

SEQ ID NO: 4363230 - DNA, 13 bp, Homo sapiens
gaatgcctcctcc

SEQ ID NO: 4363231 - DNA, 19 bp, Homo sapiens
gaatggggggcgggccagg

SEQ ID NO: 4363232 - DNA, 23 bp, Homo sapiens
gaatggggggcgggccagggtgg

SEQ ID NO: 4363233 - DNA, 13 bp, Homo sapiens
gaatgtagggcct

SEQ ID NO: 4363234 - DNA, 16 bp, Homo sapiens
gaatgtattattctgc

SEQ ID NO: 4363235 - DNA, 18 bp, Homo sapiens
gaatgtattattctgcag

SEQ ID NO: 4363236 - DNA, 21 bp, Homo sapiens
gaatgtattattctgcagcat

SEQ ID NO: 4363237 - DNA, 16 bp, Homo sapiens
gaatgtgaatagtgtt

SEQ ID NO: 4363238 - DNA, 19 bp, Homo sapiens
gaattcctgcagcagttat

SEQ ID NO: 4363239 - DNA, 22 bp, Homo sapiens
gaattgtgtattgatgcaatat

SEQ ID NO: 4363240 - DNA, 14 bp, Homo sapiens
gaatttccctctct

SEQ ID NO: 4363241 - DNA, 18 bp, Homo sapiens
gaattttccaagaacata

SEQ ID NO: 4363242 - DNA, 14 bp, Homo sapiens
gacaaggaaaatct

SEQ ID NO: 4363243 - DNA, 15 bp, Homo sapiens
gacaccagagctgcc

SEQ ID NO: 4363244 - DNA, 15 bp, Homo sapiens
gacactaacgacttc

SEQ ID NO: 4363245 - DNA, 22 bp, Homo sapiens
gacagcatatagaatatattat

SEQ ID NO: 4363246 - DNA, 13 bp, Homo sapiens
gacagctttctgg

SEQ ID NO: 4363247 - DNA, 14 bp, Homo sapiens
gacagctttctggg

SEQ ID NO: 4363248 - DNA, 18 bp, Homo sapiens
gacagctttctgggatgt

SEQ ID NO: 4363249 - DNA, 17 bp, Homo sapiens
gacagtgcctcttccag

SEQ ID NO: 4363250 - DNA, 20 bp, Homo sapiens
gacagtgcctcttccagtga

SEQ ID NO: 4363251 - DNA, 17 bp, Homo sapiens
gacagtgcctgggaatg

SEQ ID NO: 4363252 - DNA, 15 bp, Homo sapiens
gacagtggatatgac

SEQ ID NO: 4363253 - DNA, 20 bp, Homo sapiens
gacagtggatatgacccaca

SEQ ID NO: 4363254 - DNA, 13 bp, Homo sapiens
gacatccagcaga

SEQ ID NO: 4363255 - DNA, 22 bp, Homo sapiens
gacatggttgggggaatgcacc

SEQ ID NO: 4363256 - DNA, 20 bp, Homo sapiens
gaccagcaacttgtcttttt

SEQ ID NO: 4363257 - DNA, 13 bp, Homo sapiens
gacccctctggcc

SEQ ID NO: 4363258 - DNA, 15 bp, Homo sapiens
gacccctctggccag

SEQ ID NO: 4363259 - DNA, 16 bp, Homo sapiens
gacctaagtcaggtaa

SEQ ID NO: 4363260 - DNA, 14 bp, Homo sapiens
gacctcatgcccag

SEQ ID NO: 4363261 - DNA, 17 bp, Homo sapiens
gacctcatgcccagctc

SEQ ID NO: 4363262 - DNA, 23 bp, Homo sapiens
gacctcatgcccagctctctgac

SEQ ID NO: 4363263 - DNA, 12 bp, Homo sapiens
gacctgtgacca

SEQ ID NO: 4363264 - DNA, 18 bp, Homo sapiens
gacgcttgtgacagtgcc

SEQ ID NO: 4363265 - DNA, 21 bp, Homo sapiens
gacggtaagtgttctcatgaa

SEQ ID NO: 4363266 - DNA, 21 bp, Homo sapiens
gacggtgggcatttgtgaggc

SEQ ID NO: 4363267 - DNA, 14 bp, Homo sapiens
gacgtcaagtctcc

SEQ ID NO: 4363268 - DNA, 18 bp, Homo sapiens
gacgtcaagtctccttcc

SEQ ID NO: 4363269 - DNA, 14 bp, Homo sapiens
gactagaaaatctg

SEQ ID NO: 4363270 - DNA, 24 bp, Homo sapiens
gactcagtatgctttccctgagga

SEQ ID NO: 4363271 - DNA, 17 bp, Homo sapiens
gactcctggtctgtgaa

SEQ ID NO: 4363272 - DNA, 20 bp, Homo sapiens
gactgcagtgtggagttcac

SEQ ID NO: 4363273 - DNA, 20 bp, Homo sapiens
gactgggaagataggctctg

SEQ ID NO: 4363274 - DNA, 13 bp, Homo sapiens
gactgtgatgcca

SEQ ID NO: 4363275 - DNA, 18 bp, Homo sapiens
gacttacaggctaaaatt

SEQ ID NO: 4363276 - DNA, 13 bp, Homo sapiens
gacttagagctgg

SEQ ID NO: 4363277 - DNA, 15 bp, Homo sapiens
gacttctggagatgg

SEQ ID NO: 4363278 - DNA, 22 bp, Homo sapiens
gacttgaatattcctggactta

SEQ ID NO: 4363279 - DNA, 18 bp, Homo sapiens
gacttggagactcctggt

SEQ ID NO: 4363280 - DNA, 19 bp, Homo sapiens
gacttggagactcctggtc

SEQ ID NO: 4363281 - DNA, 21 bp, Homo sapiens
gacttggagactcctggtctg

SEQ ID NO: 4363282 - DNA, 12 bp, Homo sapiens
gacttgggatgg

SEQ ID NO: 4363283 - DNA, 14 bp, Homo sapiens
gacttggtctgatt

SEQ ID NO: 4363284 - DNA, 17 bp, Homo sapiens
gactttatgtagttttt

SEQ ID NO: 4363285 - DNA, 20 bp, Homo sapiens
gagaagctagatgcccctgc

SEQ ID NO: 4363286 - DNA, 13 bp, Homo sapiens
gagaagggttctg

SEQ ID NO: 4363287 - DNA, 17 bp, Homo sapiens
gagaagggttctgccct

SEQ ID NO: 4363288 - DNA, 23 bp, Homo sapiens
gagaagggttctgccctgcctga

SEQ ID NO: 4363289 - DNA, 23 bp, Homo sapiens
gagaattaagttttaaataaacc

SEQ ID NO: 4363290 - DNA, 15 bp, Homo sapiens
gagaattgtatcatt

SEQ ID NO: 4363291 - DNA, 20 bp, Homo sapiens
gagacactaacgacttcagg

SEQ ID NO: 4363292 - DNA, 13 bp, Homo sapiens
gagacccccaggc

SEQ ID NO: 4363293 - DNA, 16 bp, Homo sapiens
gagacccccaggcctg

SEQ ID NO: 4363294 - DNA, 13 bp, Homo sapiens
gagactgggaaga

SEQ ID NO: 4363295 - DNA, 17 bp, Homo sapiens
gagagaggctgcctcag

SEQ ID NO: 4363296 - DNA, 16 bp, Homo sapiens
gagagcagcaggtgct

SEQ ID NO: 4363297 - DNA, 20 bp, Homo sapiens
gagagcagcaggtgctgtgc

SEQ ID NO: 4363298 - DNA, 17 bp, Homo sapiens
gagatcccgcctcttct

SEQ ID NO: 4363299 - DNA, 17 bp, Homo sapiens
gagatgttattactgtt

SEQ ID NO: 4363300 - DNA, 13 bp, Homo sapiens
gagcaaacccaga

SEQ ID NO: 4363301 - DNA, 12 bp, Homo sapiens
gagcagcaggtg

SEQ ID NO: 4363302 - DNA, 15 bp, Homo sapiens
gagccagggcagagg

SEQ ID NO: 4363303 - DNA, 20 bp, Homo sapiens
gagcccgcagggccatgcag

SEQ ID NO: 4363304 - DNA, 22 bp, Homo sapiens
gagcccttctatacccacccag

SEQ ID NO: 4363305 - DNA, 16 bp, Homo sapiens
gagccggtggtgcccg

SEQ ID NO: 4363306 - DNA, 20 bp, Homo sapiens
gagccttgataatacttgac

SEQ ID NO: 4363307 - DNA, 13 bp, Homo sapiens
gagccttgcatgt

SEQ ID NO: 4363308 - DNA, 15 bp, Homo sapiens
gagccttgcatgtac

SEQ ID NO: 4363309 - DNA, 21 bp, Homo sapiens
gagccttgcatgtacttgaag

SEQ ID NO: 4363310 - DNA, 16 bp, Homo sapiens
gagccttgctgggcca

SEQ ID NO: 4363311 - DNA, 20 bp, Homo sapiens
gagccttgctgggccaggga

SEQ ID NO: 4363312 - DNA, 14 bp, Homo sapiens
gagcttgctccaga

SEQ ID NO: 4363313 - DNA, 15 bp, Homo sapiens
gagcttgctccagat

SEQ ID NO: 4363314 - DNA, 18 bp, Homo sapiens
gagcttgctccagattct

SEQ ID NO: 4363315 - DNA, 16 bp, Homo sapiens
gagctttgtcacttgc

SEQ ID NO: 4363316 - DNA, 20 bp, Homo sapiens
gagctttgtcacttgccaca

SEQ ID NO: 4363317 - DNA, 10 bp, Homo sapiens
gaggacagag

SEQ ID NO: 4363318 - DNA, 16 bp, Homo sapiens
gaggagccttgctggg

SEQ ID NO: 4363319 - DNA, 18 bp, Homo sapiens
gaggagccttgctgggcc

SEQ ID NO: 4363320 - DNA, 20 bp, Homo sapiens
gaggagccttgctgggccag

SEQ ID NO: 4363321 - DNA, 14 bp, Homo sapiens
gaggagctgggccc

SEQ ID NO: 4363322 - DNA, 16 bp, Homo sapiens
gaggagctgggcccct

SEQ ID NO: 4363323 - DNA, 14 bp, Homo sapiens
gaggaggacacagc

SEQ ID NO: 4363324 - DNA, 16 bp, Homo sapiens
gaggaggaggacacag

SEQ ID NO: 4363325 - DNA, 14 bp, Homo sapiens
gaggaggaggagcc

SEQ ID NO: 4363326 - DNA, 15 bp, Homo sapiens
gaggaggaggagcct

SEQ ID NO: 4363327 - DNA, 23 bp, Homo sapiens
gaggcccttgtcgtgggatggca

SEQ ID NO: 4363328 - DNA, 11 bp, Homo sapiens
gaggctgctag

SEQ ID NO: 4363329 - DNA, 19 bp, Homo sapiens
gagggaagaccagaattcc

SEQ ID NO: 4363330 - DNA, 16 bp, Homo sapiens
gagggagttttgtctg

SEQ ID NO: 4363331 - DNA, 22 bp, Homo sapiens
gagggagttttgtctgtctccc

SEQ ID NO: 4363332 - DNA, 18 bp, Homo sapiens
gagggcaggcttggggaa

SEQ ID NO: 4363333 - DNA, 19 bp, Homo sapiens
gagggcaggcttggggaaa

SEQ ID NO: 4363334 - DNA, 15 bp, Homo sapiens
gaggggcgggctcag

SEQ ID NO: 4363335 - DNA, 21 bp, Homo sapiens
gaggtcactccaccatcccca

SEQ ID NO: 4363336 - DNA, 19 bp, Homo sapiens
gaggtgcgtgttcagcaga

SEQ ID NO: 4363337 - DNA, 20 bp, Homo sapiens
gaggtgcgtgttcagcagaa

SEQ ID NO: 4363338 - DNA, 13 bp, Homo sapiens
gaggtggagaaaa

SEQ ID NO: 4363339 - DNA, 20 bp, Homo sapiens
gagtcatcttgtgagtggat

SEQ ID NO: 4363340 - DNA, 13 bp, Homo sapiens
gagtcttggttct

SEQ ID NO: 4363341 - DNA, 23 bp, Homo sapiens
gagtcttggttctaaaggtacca

SEQ ID NO: 4363342 - DNA, 16 bp, Homo sapiens
gagtgacagctttctg

SEQ ID NO: 4363343 - DNA, 17 bp, Homo sapiens
gagtgacagctttctgg

SEQ ID NO: 4363344 - DNA, 22 bp, Homo sapiens
gagtgacagctttctgggatgt

SEQ ID NO: 4363345 - DNA, 14 bp, Homo sapiens
gagtggtctttctg

SEQ ID NO: 4363346 - DNA, 14 bp, Homo sapiens
gagttcaccttgga

SEQ ID NO: 4363347 - DNA, 15 bp, Homo sapiens
gagttgacagtgaaa

SEQ ID NO: 4363348 - DNA, 23 bp, Homo sapiens
gagttgcctgactcctgggtggg

SEQ ID NO: 4363349 - DNA, 14 bp, Homo sapiens
gagtttgtattttg

SEQ ID NO: 4363350 - DNA, 13 bp, Homo sapiens
gataatacttgac

SEQ ID NO: 4363351 - DNA, 18 bp, Homo sapiens
cttaataaattcagatat

SEQ ID NO: 4363352 - DNA, 16 bp, Homo sapiens
cttacaaaatgccaag

SEQ ID NO: 4363353 - DNA, 20 bp, Homo sapiens
cttacaggctaaaattagtt

SEQ ID NO: 4363354 - DNA, 21 bp, Homo sapiens
cttcaagaaagaattcctgca

SEQ ID NO: 4363355 - DNA, 22 bp, Homo sapiens
cttcaagaaagaattcctgcag

SEQ ID NO: 4363356 - DNA, 23 bp, Homo sapiens
cttcaagaaagaattcctgcagc

SEQ ID NO: 4363357 - DNA, 18 bp, Homo sapiens
cttcagggcagggctctg

SEQ ID NO: 4363358 - DNA, 19 bp, Homo sapiens
cttcattccgttaggaata

SEQ ID NO: 4363359 - DNA, 14 bp, Homo sapiens
cttccacccagtgc

SEQ ID NO: 4363360 - DNA, 17 bp, Homo sapiens
cttccatcttgtggggc

SEQ ID NO: 4363361 - DNA, 19 bp, Homo sapiens
cttccatcttgtggggcca

SEQ ID NO: 4363362 - DNA, 20 bp, Homo sapiens
cttccatcttgtggggccag

SEQ ID NO: 4363363 - DNA, 21 bp, Homo sapiens
cttccatcttgtggggccagg

SEQ ID NO: 4363364 - DNA, 22 bp, Homo sapiens
cttccgggtctcgcagcctgaa

SEQ ID NO: 4363365 - DNA, 21 bp, Homo sapiens
cttccttttagcctagttcat

SEQ ID NO: 4363366 - DNA, 14 bp, Homo sapiens
cttctaaaagccat

SEQ ID NO: 4363367 - DNA, 16 bp, Homo sapiens
cttctaaaagccatta

SEQ ID NO: 4363368 - DNA, 17 bp, Homo sapiens
cttctaactggtaaaaa

SEQ ID NO: 4363369 - DNA, 18 bp, Homo sapiens
cttctatacccacccaga

SEQ ID NO: 4363370 - DNA, 16 bp, Homo sapiens
cttctatcattccaat

SEQ ID NO: 4363371 - DNA, 23 bp, Homo sapiens
cttctggagatggatccttccat

SEQ ID NO: 4363372 - DNA, 13 bp, Homo sapiens
cttcttcttcaga

SEQ ID NO: 4363373 - DNA, 19 bp, Homo sapiens
cttgacctctgtgaccaac

SEQ ID NO: 4363374 - DNA, 15 bp, Homo sapiens
cttgcatgtacttga

SEQ ID NO: 4363375 - DNA, 19 bp, Homo sapiens
cttgcatgtacttgaagga

SEQ ID NO: 4363376 - DNA, 21 bp, Homo sapiens
cttgccacatggtgtctccca

SEQ ID NO: 4363377 - DNA, 17 bp, Homo sapiens
cttgcctgaactccaga

SEQ ID NO: 4363378 - DNA, 20 bp, Homo sapiens
cttgcctgaactccagaggt

SEQ ID NO: 4363379 - DNA, 16 bp, Homo sapiens
cttgccttaataaata

SEQ ID NO: 4363380 - DNA, 13 bp, Homo sapiens
cttgctgggccag

SEQ ID NO: 4363381 - DNA, 15 bp, Homo sapiens
cttgctgggccaggg

SEQ ID NO: 4363382 - DNA, 21 bp, Homo sapiens
cttggaagggcgttctaggta

SEQ ID NO: 4363383 - DNA, 22 bp, Homo sapiens
cttggaagggcgttctaggtag

SEQ ID NO: 4363384 - DNA, 17 bp, Homo sapiens
cttggagagagaggctg

SEQ ID NO: 4363385 - DNA, 20 bp, Homo sapiens
cttggagagagaggctgcct

SEQ ID NO: 4363386 - DNA, 21 bp, Homo sapiens
cttggagaggagagtggcagg

SEQ ID NO: 4363387 - DNA, 22 bp, Homo sapiens
cttggctagagtttgaaaaact

SEQ ID NO: 4363388 - DNA, 23 bp, Homo sapiens
cttggggaaaatggccatgcagg

SEQ ID NO: 4363389 - DNA, 23 bp, Homo sapiens
cttgggtcccccacgtgacagtg

SEQ ID NO: 4363390 - DNA, 22 bp, Homo sapiens
cttggtgagtcttggttctaaa

SEQ ID NO: 4363391 - DNA, 13 bp, Homo sapiens
cttggttctaaag

SEQ ID NO: 4363392 - DNA, 15 bp, Homo sapiens
cttgtcgtgggatgg

SEQ ID NO: 4363393 - DNA, 19 bp, Homo sapiens
cttgtgacagtgcctcttc

SEQ ID NO: 4363394 - DNA, 22 bp, Homo sapiens
cttgtgacagtgcctcttccag

SEQ ID NO: 4363395 - DNA, 18 bp, Homo sapiens
cttgtgcctctcatcttt

SEQ ID NO: 4363396 - DNA, 21 bp, Homo sapiens
cttgtgtgtgggctgtgagtg

SEQ ID NO: 4363397 - DNA, 17 bp, Homo sapiens
ctttaaaaccacagctg

SEQ ID NO: 4363398 - DNA, 15 bp, Homo sapiens
ctttaccttctaaaa

SEQ ID NO: 4363399 - DNA, 19 bp, Homo sapiens
ctttagcatttttatgcag

SEQ ID NO: 4363400 - DNA, 23 bp, Homo sapiens
ctttagcatttttatgcagacag

SEQ ID NO: 4363401 - DNA, 13 bp, Homo sapiens
ctttataaacttt

SEQ ID NO: 4363402 - DNA, 12 bp, Homo sapiens
ctttccctgagg

SEQ ID NO: 4363403 - DNA, 21 bp, Homo sapiens
ctttctccctcaactgaaggg

SEQ ID NO: 4363404 - DNA, 12 bp, Homo sapiens
ctttctgggatg

SEQ ID NO: 4363405 - DNA, 16 bp, Homo sapiens
ctttctgttgccacaa

SEQ ID NO: 4363406 - DNA, 16 bp, Homo sapiens
ctttcttgctggttgt

SEQ ID NO: 4363407 - DNA, 21 bp, Homo sapiens
ctttcttgctggttgtcattt

SEQ ID NO: 4363408 - DNA, 13 bp, Homo sapiens
ctttcttggccag

SEQ ID NO: 4363409 - DNA, 14 bp, Homo sapiens
ctttgaagggcaag

SEQ ID NO: 4363410 - DNA, 16 bp, Homo sapiens
ctttgacaaggaaaat

SEQ ID NO: 4363411 - DNA, 15 bp, Homo sapiens
ctttgcttactttta

SEQ ID NO: 4363412 - DNA, 17 bp, Homo sapiens
ctttggaaacaggacca

SEQ ID NO: 4363413 - DNA, 15 bp, Homo sapiens
ctttggaagcagccc

SEQ ID NO: 4363414 - DNA, 17 bp, Homo sapiens
ctttgtcacttgccaca

SEQ ID NO: 4363415 - DNA, 19 bp, Homo sapiens
cttttaagttaatgaaata

SEQ ID NO: 4363416 - DNA, 20 bp, Homo sapiens
cttttaagttaatgaaataa

SEQ ID NO: 4363417 - DNA, 21 bp, Homo sapiens
cttttaagttaatgaaataaa

SEQ ID NO: 4363418 - DNA, 14 bp, Homo sapiens
cttttcacactgtc

SEQ ID NO: 4363419 - DNA, 20 bp, Homo sapiens
cttttcacactgtcttcccg

SEQ ID NO: 4363420 - DNA, 16 bp, Homo sapiens
ctttttctttataaac

SEQ ID NO: 4363421 - DNA, 16 bp, Homo sapiens
gaaaacatgtttaaat

SEQ ID NO: 4363422 - DNA, 18 bp, Homo sapiens
gaaaactattgagccttg

SEQ ID NO: 4363423 - DNA, 21 bp, Homo sapiens
gaaaactattgagccttgcat

SEQ ID NO: 4363424 - DNA, 16 bp, Homo sapiens
gaaaagttggaaggat

SEQ ID NO: 4363425 - DNA, 21 bp, Homo sapiens
gaaaatctatatttgtcttcc

SEQ ID NO: 4363426 - DNA, 23 bp, Homo sapiens
gaaaatctatatttgtcttccga

SEQ ID NO: 4363427 - DNA, 17 bp, Homo sapiens
gaaacacccctctgtct

SEQ ID NO: 4363428 - DNA, 17 bp, Homo sapiens
gaaaccttccacccagt

SEQ ID NO: 4363429 - DNA, 13 bp, Homo sapiens
gaaaccttggaga

SEQ ID NO: 4363430 - DNA, 15 bp, Homo sapiens
gaaagatacagggga

SEQ ID NO: 4363431 - DNA, 22 bp, Homo sapiens
gaaagcaaacaaaattgttctt

SEQ ID NO: 4363432 - DNA, 18 bp, Homo sapiens
gaaaggcagccctcacct

SEQ ID NO: 4363433 - DNA, 13 bp, Homo sapiens
gaaataaaatttg

SEQ ID NO: 4363434 - DNA, 18 bp, Homo sapiens
gaaatgaataatttccca

SEQ ID NO: 4363435 - DNA, 23 bp, Homo sapiens
gaaatgattcaaattgctgcttg

SEQ ID NO: 4363436 - DNA, 23 bp, Homo sapiens
gaaattaagactttatgtagttt

SEQ ID NO: 4363437 - DNA, 13 bp, Homo sapiens
gaaattcaggtac

SEQ ID NO: 4363438 - DNA, 20 bp, Homo sapiens
gaacaaatgtgtttttctat

SEQ ID NO: 4363439 - DNA, 21 bp, Homo sapiens
gaacaaatgtgtttttctata

SEQ ID NO: 4363440 - DNA, 21 bp, Homo sapiens
gaacacccgactcctcaaaag

SEQ ID NO: 4363441 - DNA, 22 bp, Homo sapiens
gaacagatggggtctgtgactg

SEQ ID NO: 4363442 - DNA, 14 bp, Homo sapiens
gaacatgacccagc

SEQ ID NO: 4363443 - DNA, 23 bp, Homo sapiens
gaaccagtccaggtggtgaattt

SEQ ID NO: 4363444 - DNA, 16 bp, Homo sapiens
gaacctgcacacagga

SEQ ID NO: 4363445 - DNA, 18 bp, Homo sapiens
gaacctgcacacaggaca

SEQ ID NO: 4363446 - DNA, 21 bp, Homo sapiens
gaacgacaatagctttaccct

SEQ ID NO: 4363447 - DNA, 16 bp, Homo sapiens
gaactgacaaaggagc

SEQ ID NO: 4363448 - DNA, 22 bp, Homo sapiens
gaactgacaaaggagccttgat

SEQ ID NO: 4363449 - DNA, 14 bp, Homo sapiens
gaagaaaatatttt

SEQ ID NO: 4363450 - DNA, 17 bp, Homo sapiens
gaagaaattcaggtaca

SEQ ID NO: 4363451 - DNA, 20 bp, Homo sapiens
gaagaaattcaggtacagaa

SEQ ID NO: 4363452 - DNA, 21 bp, Homo sapiens
gaagaaattcaggtacagaaa

SEQ ID NO: 4363453 - DNA, 17 bp, Homo sapiens
gaagagcccgcagggcc

SEQ ID NO: 4363454 - DNA, 18 bp, Homo sapiens
gaagcagccccctgtggc

SEQ ID NO: 4363455 - DNA, 20 bp, Homo sapiens
gaaggatggatgagtcagac

SEQ ID NO: 4363456 - DNA, 22 bp, Homo sapiens
gaaggcaaaaactgtactgtgt

SEQ ID NO: 4363457 - DNA, 15 bp, Homo sapiens
gaagggttctgccct

SEQ ID NO: 4363458 - DNA, 21 bp, Homo sapiens
gaaggtccttgcctgaactcc

SEQ ID NO: 4363459 - DNA, 18 bp, Homo sapiens
gaaggttagaaaggcagc

SEQ ID NO: 4363460 - DNA, 15 bp, Homo sapiens
gaagtgtaacagctg

SEQ ID NO: 4363461 - DNA, 18 bp, Homo sapiens
gaagtgtaacagctgagg

SEQ ID NO: 4363462 - DNA, 12 bp, Homo sapiens
gaagtttgcatc

SEQ ID NO: 4363463 - DNA, 13 bp, Homo sapiens
gaagttttcagga

SEQ ID NO: 4363464 - DNA, 16 bp, Homo sapiens
gaataacactgcagcc

SEQ ID NO: 4363465 - DNA, 23 bp, Homo sapiens
gaataatttcccaattaggaagt

SEQ ID NO: 4363466 - DNA, 16 bp, Homo sapiens
gaatattcctggactt

SEQ ID NO: 4363467 - DNA, 20 bp, Homo sapiens
gaatattcctggacttacaa

SEQ ID NO: 4363468 - DNA, 18 bp, Homo sapiens
gaatatttatatttcact

SEQ ID NO: 4363469 - DNA, 16 bp, Homo sapiens
gaatgaagctgccatc

SEQ ID NO: 4363470 - DNA, 19 bp, Homo sapiens
gaatgacggtaagtgttct

SEQ ID NO: 4363471 - DNA, 16 bp, Homo sapiens
gaatgcacctccccaa

SEQ ID NO: 4363472 - DNA, 16 bp, Homo sapiens
ctgaatatttatattt

SEQ ID NO: 4363473 - DNA, 13 bp, Homo sapiens
ctgaatgcaattt

SEQ ID NO: 4363474 - DNA, 23 bp, Homo sapiens
ctgacaaaggagccttgataata

SEQ ID NO: 4363475 - DNA, 23 bp, Homo sapiens
ctgacatgaagctgttgtgtgag

SEQ ID NO: 4363476 - DNA, 13 bp, Homo sapiens
ctgacgcttgtga

SEQ ID NO: 4363477 - DNA, 19 bp, Homo sapiens
ctgacgcttgtgacagtgc

SEQ ID NO: 4363478 - DNA, 20 bp, Homo sapiens
ctgacgcttgtgacagtgcc

SEQ ID NO: 4363479 - DNA, 14 bp, Homo sapiens
ctgacttctggaga

SEQ ID NO: 4363480 - DNA, 15 bp, Homo sapiens
ctgacttctggagat

SEQ ID NO: 4363481 - DNA, 20 bp, Homo sapiens
ctgaggaggaggacacagca

SEQ ID NO: 4363482 - DNA, 15 bp, Homo sapiens
ctgaggcccagtgca

SEQ ID NO: 4363483 - DNA, 16 bp, Homo sapiens
ctgaggcccagtgcat

SEQ ID NO: 4363484 - DNA, 13 bp, Homo sapiens
ctgagtgggctgg

SEQ ID NO: 4363485 - DNA, 19 bp, Homo sapiens
ctgattgggaggtgcgtgt

SEQ ID NO: 4363486 - DNA, 14 bp, Homo sapiens
ctgcacacaggaca

SEQ ID NO: 4363487 - DNA, 15 bp, Homo sapiens
ctgcacacaggacag

SEQ ID NO: 4363488 - DNA, 16 bp, Homo sapiens
ctgcacacaggacagc

SEQ ID NO: 4363489 - DNA, 11 bp, Homo sapiens
ctgcagcatga

SEQ ID NO: 4363490 - DNA, 19 bp, Homo sapiens
ctgcagcatgacctgtgac

SEQ ID NO: 4363491 - DNA, 16 bp, Homo sapiens
ctgcaggagttaaaaa

SEQ ID NO: 4363492 - DNA, 17 bp, Homo sapiens
ctgcagtttggccctgg

SEQ ID NO: 4363493 - DNA, 15 bp, Homo sapiens
ctgccatccttgctg

SEQ ID NO: 4363494 - DNA, 16 bp, Homo sapiens
ctgcccacatttgggc

SEQ ID NO: 4363495 - DNA, 23 bp, Homo sapiens
ctgcccacatttgggctcagggt

SEQ ID NO: 4363496 - DNA, 21 bp, Homo sapiens
ctgcccagacccctctggcca

SEQ ID NO: 4363497 - DNA, 22 bp, Homo sapiens
ctgcccagacccctctggccag

SEQ ID NO: 4363498 - DNA, 19 bp, Homo sapiens
ctgccccccgaggctgcta

SEQ ID NO: 4363499 - DNA, 15 bp, Homo sapiens
ctgccggtgggaccc

SEQ ID NO: 4363500 - DNA, 15 bp, Homo sapiens
ctgcctcagccagtg

SEQ ID NO: 4363501 - DNA, 20 bp, Homo sapiens
ctgcctcagccagtggcaca

SEQ ID NO: 4363502 - DNA, 21 bp, Homo sapiens
ctgcctcagccagtggcacag

SEQ ID NO: 4363503 - DNA, 23 bp, Homo sapiens
ctgcctcagccagtggcacagga

SEQ ID NO: 4363504 - DNA, 15 bp, Homo sapiens
ctgcctccctgggga

SEQ ID NO: 4363505 - DNA, 15 bp, Homo sapiens
ctgcctgaggaggag

SEQ ID NO: 4363506 - DNA, 20 bp, Homo sapiens
ctgcctgaggaggaggacac

SEQ ID NO: 4363507 - DNA, 22 bp, Homo sapiens
ctgcgggcgcgggcagccaccc

SEQ ID NO: 4363508 - DNA, 13 bp, Homo sapiens
ctgctcctcaccc

SEQ ID NO: 4363509 - DNA, 19 bp, Homo sapiens
ctgctctcagcctcccaca

SEQ ID NO: 4363510 - DNA, 21 bp, Homo sapiens
ctgctctggtggcttaagtga

SEQ ID NO: 4363511 - DNA, 11 bp, Homo sapiens
ctgctgaggcc

SEQ ID NO: 4363512 - DNA, 22 bp, Homo sapiens
ctgctgaggcccagtgcatatg

SEQ ID NO: 4363513 - DNA, 13 bp, Homo sapiens
ctgctgcaggaca

SEQ ID NO: 4363514 - DNA, 21 bp, Homo sapiens
ctgctgcctccctggggacca

SEQ ID NO: 4363515 - DNA, 14 bp, Homo sapiens
ctgctgctgcctcc

SEQ ID NO: 4363516 - DNA, 18 bp, Homo sapiens
ctgctgctgcctccctgg

SEQ ID NO: 4363517 - DNA, 18 bp, Homo sapiens
ctgctgtgttaagaggac

SEQ ID NO: 4363518 - DNA, 21 bp, Homo sapiens
ctggaaaactattgagccttg

SEQ ID NO: 4363519 - DNA, 17 bp, Homo sapiens
ctggaaaccttccaccc

SEQ ID NO: 4363520 - DNA, 15 bp, Homo sapiens
ctggaagttgtggat

SEQ ID NO: 4363521 - DNA, 19 bp, Homo sapiens
ctggactgaagcctgcagg

SEQ ID NO: 4363522 - DNA, 13 bp, Homo sapiens
ctggacttacaaa

SEQ ID NO: 4363523 - DNA, 15 bp, Homo sapiens
ctggagatggatcct

SEQ ID NO: 4363524 - DNA, 13 bp, Homo sapiens
ctggagccagggc

SEQ ID NO: 4363525 - DNA, 18 bp, Homo sapiens
ctggagccagggcagagg

SEQ ID NO: 4363526 - DNA, 21 bp, Homo sapiens
ctggagccagggcagaggaat

SEQ ID NO: 4363527 - DNA, 22 bp, Homo sapiens
ctggagccagggcagaggaatg

SEQ ID NO: 4363528 - DNA, 16 bp, Homo sapiens
ctggagctgtccttca

SEQ ID NO: 4363529 - DNA, 13 bp, Homo sapiens
ctggatagacttg

SEQ ID NO: 4363530 - DNA, 14 bp, Homo sapiens
ctggatagacttgg

SEQ ID NO: 4363531 - DNA, 22 bp, Homo sapiens
ctggatagacttgggatgggga

SEQ ID NO: 4363532 - DNA, 17 bp, Homo sapiens
ctggatcttctatcatt

SEQ ID NO: 4363533 - DNA, 16 bp, Homo sapiens
ctggatggaaacttcc

SEQ ID NO: 4363534 - DNA, 21 bp, Homo sapiens
ctggctagaaaacaagcgttt

SEQ ID NO: 4363535 - DNA, 18 bp, Homo sapiens
ctggctgcccagacccct

SEQ ID NO: 4363536 - DNA, 21 bp, Homo sapiens
ctgggaacatgacccagcctg

SEQ ID NO: 4363537 - DNA, 24 bp, Homo sapiens
ctgggaagataggctctgcacaga

SEQ ID NO: 4363538 - DNA, 13 bp, Homo sapiens
ctgggaatgtatt

SEQ ID NO: 4363539 - DNA, 23 bp, Homo sapiens
ctgggaatgtattattctgcagc

SEQ ID NO: 4363540 - DNA, 15 bp, Homo sapiens
ctgggatgtcacagt

SEQ ID NO: 4363541 - DNA, 18 bp, Homo sapiens
ctgggatgtcacagtcca

SEQ ID NO: 4363542 - DNA, 21 bp, Homo sapiens
ctgggccagggaaacaaagtt

SEQ ID NO: 4363543 - DNA, 18 bp, Homo sapiens
ctgggccctctgtccaca

SEQ ID NO: 4363544 - DNA, 23 bp, Homo sapiens
ctgggctctccctgcacgcattt

SEQ ID NO: 4363545 - DNA, 16 bp, Homo sapiens
ctggggaccaggagct

SEQ ID NO: 4363546 - DNA, 17 bp, Homo sapiens
ctggggaccaggagcta

SEQ ID NO: 4363547 - DNA, 23 bp, Homo sapiens
ctgggtaggaaaagatgtatgtt

SEQ ID NO: 4363548 - DNA, 15 bp, Homo sapiens
ctgggtgctggctgc

SEQ ID NO: 4363549 - DNA, 16 bp, Homo sapiens
ctgggtggggtgagga

SEQ ID NO: 4363550 - DNA, 21 bp, Homo sapiens
ctgggtggggtgaggaccact

SEQ ID NO: 4363551 - DNA, 18 bp, Homo sapiens
ctggtagagacccccagg

SEQ ID NO: 4363552 - DNA, 17 bp, Homo sapiens
ctggtctgtgaagagcc

SEQ ID NO: 4363553 - DNA, 20 bp, Homo sapiens
ctggtggcttaagtgagcag

SEQ ID NO: 4363554 - DNA, 15 bp, Homo sapiens
ctggttgtcattttt

SEQ ID NO: 4363555 - DNA, 19 bp, Homo sapiens
ctggtttacttctttagca

SEQ ID NO: 4363556 - DNA, 13 bp, Homo sapiens
ctggttttatctt

SEQ ID NO: 4363557 - DNA, 17 bp, Homo sapiens
ctgtaagagacatgaat

SEQ ID NO: 4363558 - DNA, 12 bp, Homo sapiens
ctgtaagagctt

SEQ ID NO: 4363559 - DNA, 17 bp, Homo sapiens
ctgtaagagcttgctcc

SEQ ID NO: 4363560 - DNA, 21 bp, Homo sapiens
ctgtacaataagttacttgaa

SEQ ID NO: 4363561 - DNA, 19 bp, Homo sapiens
ctgtacactgaatatttat

SEQ ID NO: 4363562 - DNA, 13 bp, Homo sapiens
ctgtagctttaaa

SEQ ID NO: 4363563 - DNA, 11 bp, Homo sapiens
ctgtcacaata

SEQ ID NO: 4363564 - DNA, 13 bp, Homo sapiens
ctgtcaggaatgg

SEQ ID NO: 4363565 - DNA, 14 bp, Homo sapiens
ctgtccaccctgcc

SEQ ID NO: 4363566 - DNA, 15 bp, Homo sapiens
ctgtccggcccagtg

SEQ ID NO: 4363567 - DNA, 20 bp, Homo sapiens
ctgtccggcccagtgccact

SEQ ID NO: 4363568 - DNA, 23 bp, Homo sapiens
ctgtccggcccagtgccactgcc

SEQ ID NO: 4363569 - DNA, 15 bp, Homo sapiens
ctgtctaggactgca

SEQ ID NO: 4363570 - DNA, 21 bp, Homo sapiens
ctgtctccctcccctctcaga

SEQ ID NO: 4363571 - DNA, 20 bp, Homo sapiens
ctgtgaccagcactgtctca

SEQ ID NO: 4363572 - DNA, 12 bp, Homo sapiens
ctgtgactggat

SEQ ID NO: 4363573 - DNA, 23 bp, Homo sapiens
ctgtgactggatcttctatcatt

SEQ ID NO: 4363574 - DNA, 14 bp, Homo sapiens
ctgtgagtgtaagt

SEQ ID NO: 4363575 - DNA, 16 bp, Homo sapiens
ctgtgatgccacacag

SEQ ID NO: 4363576 - DNA, 17 bp, Homo sapiens
ctgtgcatgggtgaagg

SEQ ID NO: 4363577 - DNA, 22 bp, Homo sapiens
ctgtgcatgggtgaagggagag

SEQ ID NO: 4363578 - DNA, 13 bp, Homo sapiens
ctgtgccacccac

SEQ ID NO: 4363579 - DNA, 15 bp, Homo sapiens
ctgtgcgccttgtag

SEQ ID NO: 4363580 - DNA, 16 bp, Homo sapiens
ctgtgcgccttgtaga

SEQ ID NO: 4363581 - DNA, 20 bp, Homo sapiens
ctgtgcgccttgtagaatgc

SEQ ID NO: 4363582 - DNA, 17 bp, Homo sapiens
ctgtggccccaagaggg

SEQ ID NO: 4363583 - DNA, 16 bp, Homo sapiens
ctgtggcggccttccg

SEQ ID NO: 4363584 - DNA, 21 bp, Homo sapiens
ctgtggtttcagatgtgcaat

SEQ ID NO: 4363585 - DNA, 15 bp, Homo sapiens
ctgtgtactttactg

SEQ ID NO: 4363586 - DNA, 13 bp, Homo sapiens
ctgttgccacaac

SEQ ID NO: 4363587 - DNA, 14 bp, Homo sapiens
ctgttttatactgt

SEQ ID NO: 4363588 - DNA, 13 bp, Homo sapiens
ctgttttgggcct

SEQ ID NO: 4363589 - DNA, 17 bp, Homo sapiens
ctgttttgggcctccat

SEQ ID NO: 4363590 - DNA, 15 bp, Homo sapiens
cttaaaactttgtag

SEQ ID NO: 4363591 - DNA, 15 bp, Homo sapiens
cttaaactgtgtgga

SEQ ID NO: 4363592 - DNA, 16 bp, Homo sapiens
cttaagatctgactgc

SEQ ID NO: 4363593 - DNA, 19 bp, Homo sapiens
cttaagcagaacaaatgtg

SEQ ID NO: 4363594 - DNA, 12 bp, Homo sapiens
cttaataaattc

SEQ ID NO: 4363595 - DNA, 14 bp, Homo sapiens
tttggaagttttca

SEQ ID NO: 4363596 - DNA, 13 bp, Homo sapiens
tttggccccactt

SEQ ID NO: 4363597 - DNA, 22 bp, Homo sapiens
tttgggcctccatgccccagct

SEQ ID NO: 4363598 - DNA, 13 bp, Homo sapiens
tttgtcacttgcc

SEQ ID NO: 4363599 - DNA, 13 bp, Homo sapiens
tttgtctgtctcc

SEQ ID NO: 4363600 - DNA, 13 bp, Homo sapiens
tttgtgcattctg

SEQ ID NO: 4363601 - DNA, 17 bp, Homo sapiens
tttgtggagtttgtatt

SEQ ID NO: 4363602 - DNA, 14 bp, Homo sapiens
tttgtgtacagtgt

SEQ ID NO: 4363603 - DNA, 17 bp, Homo sapiens
ttttaaataaaagtgat

SEQ ID NO: 4363604 - DNA, 12 bp, Homo sapiens
ttttaaatgacc

SEQ ID NO: 4363605 - DNA, 17 bp, Homo sapiens
ttttacttttcacactg

SEQ ID NO: 4363606 - DNA, 19 bp, Homo sapiens
ttttagattaaaaaaattt

SEQ ID NO: 4363607 - DNA, 18 bp, Homo sapiens
ttttatgcagacagtctg

SEQ ID NO: 4363608 - DNA, 14 bp, Homo sapiens
ttttattatgcatt

SEQ ID NO: 4363609 - DNA, 20 bp, Homo sapiens
ttttcaaactgctgcatact

SEQ ID NO: 4363610 - DNA, 11 bp, Homo sapiens
ttttctatata

SEQ ID NO: 4363611 - DNA, 23 bp, Homo sapiens
ttttctatatagttccttgcctt

SEQ ID NO: 4363612 - DNA, 15 bp, Homo sapiens
ttttctgaaacacac

SEQ ID NO: 4363613 - DNA, 15 bp, Homo sapiens
tttttcactttgaaa

SEQ ID NO: 4363614 - DNA, 13 bp, Homo sapiens
tttttctttataa

SEQ ID NO: 4363615 - DNA, 17 bp, Homo sapiens
tttttctttataaactt

SEQ ID NO: 4363616 - DNA, 15 bp, Homo sapiens
tttttgagtgacagc

SEQ ID NO: 4363617 - DNA, 18 bp, Homo sapiens
ttataggtcactcctggg

SEQ ID NO: 4363618 - DNA, 18 bp, Homo sapiens
ttatatgttgtaatattt

SEQ ID NO: 4363619 - DNA, 16 bp, Homo sapiens
ttatcagacaagatga

SEQ ID NO: 4363620 - DNA, 18 bp, Homo sapiens
ttatgaacagctgtgtct

SEQ ID NO: 4363621 - DNA, 22 bp, Homo sapiens
ttatgacctaagtcaggtaata

SEQ ID NO: 4363622 - DNA, 19 bp, Homo sapiens
ttatgatgttagaagaaga

SEQ ID NO: 4363623 - DNA, 11 bp, Homo sapiens
ttatgtagttt

SEQ ID NO: 4363624 - DNA, 15 bp, Homo sapiens
ttattaaacttaaaa

SEQ ID NO: 4363625 - DNA, 20 bp, Homo sapiens
ttattatgatgttagaagaa

SEQ ID NO: 4363626 - DNA, 17 bp, Homo sapiens
ttattttaataatgttg

SEQ ID NO: 4363627 - DNA, 17 bp, Homo sapiens
ttcaaactgctgcatac

SEQ ID NO: 4363628 - DNA, 15 bp, Homo sapiens
ttcaaattgctgctt

SEQ ID NO: 4363629 - DNA, 17 bp, Homo sapiens
ttcacactgtcttcccg

SEQ ID NO: 4363630 - DNA, 15 bp, Homo sapiens
ttcaccttggaaggg

SEQ ID NO: 4363631 - DNA, 14 bp, Homo sapiens
ttcactttgaaaag

SEQ ID NO: 4363632 - DNA, 15 bp, Homo sapiens
ttcagatgtgcaata

SEQ ID NO: 4363633 - DNA, 23 bp, Homo sapiens
ttcagatgtgcaataatttgtac

SEQ ID NO: 4363634 - DNA, 16 bp, Homo sapiens
ttcagcatatttatag

SEQ ID NO: 4363635 - DNA, 21 bp, Homo sapiens
ttcaggatactctgtcagatg

SEQ ID NO: 4363636 - DNA, 9 bp, Homo sapiens
ttcaggtac

SEQ ID NO: 4363637 - DNA, 17 bp, Homo sapiens
ttcaggtacagaaaaca

SEQ ID NO: 4363638 - DNA, 15 bp, Homo sapiens
ttcatcattgggctc

SEQ ID NO: 4363639 - DNA, 18 bp, Homo sapiens
ttcatccaatcctcactg

SEQ ID NO: 4363640 - DNA, 21 bp, Homo sapiens
ttcatccaatcctcactgggt

SEQ ID NO: 4363641 - DNA, 12 bp, Homo sapiens
ttcattccgtta

SEQ ID NO: 4363642 - DNA, 23 bp, Homo sapiens
ttccacccagtgctgaatttccc

SEQ ID NO: 4363643 - DNA, 20 bp, Homo sapiens
ttccatgaatgtatcaggaa

SEQ ID NO: 4363644 - DNA, 21 bp, Homo sapiens
ttcccaagtatgccttaagca

SEQ ID NO: 4363645 - DNA, 13 bp, Homo sapiens
ttcccattttgga

SEQ ID NO: 4363646 - DNA, 14 bp, Homo sapiens
ttcccccatcccta

SEQ ID NO: 4363647 - DNA, 15 bp, Homo sapiens
ttccctgaggaatga

SEQ ID NO: 4363648 - DNA, 14 bp, Homo sapiens
ttccgatcaacatt

SEQ ID NO: 4363649 - DNA, 16 bp, Homo sapiens
ttccgatcaacattta

SEQ ID NO: 4363650 - DNA, 13 bp, Homo sapiens
ttccttgccttaa

SEQ ID NO: 4363651 - DNA, 20 bp, Homo sapiens
ttccttttagcctagttcat

SEQ ID NO: 4363652 - DNA, 12 bp, Homo sapiens
ttctaaaagcca

SEQ ID NO: 4363653 - DNA, 13 bp, Homo sapiens
ttctaaaagccat

SEQ ID NO: 4363654 - DNA, 23 bp, Homo sapiens
ttctaaaggtaccaaacaaggaa

SEQ ID NO: 4363655 - DNA, 18 bp, Homo sapiens
ttctaaatccgacttgaa

SEQ ID NO: 4363656 - DNA, 14 bp, Homo sapiens
ttctaataactgca

SEQ ID NO: 4363657 - DNA, 23 bp, Homo sapiens
ttctagcatatagactatataat

SEQ ID NO: 4363658 - DNA, 20 bp, Homo sapiens
ttctatcattccaattctaa

SEQ ID NO: 4363659 - DNA, 13 bp, Homo sapiens
ttctgaaatgttt

SEQ ID NO: 4363660 - DNA, 16 bp, Homo sapiens
ttctgaataaagcaat

SEQ ID NO: 4363661 - DNA, 22 bp, Homo sapiens
ttctgcagcatgacctgtgacc

SEQ ID NO: 4363662 - DNA, 16 bp, Homo sapiens
ttctgccctgcctgag

SEQ ID NO: 4363663 - DNA, 17 bp, Homo sapiens
ttctgccctgcctgagg

SEQ ID NO: 4363664 - DNA, 17 bp, Homo sapiens
ttctggagatggatcct

SEQ ID NO: 4363665 - DNA, 16 bp, Homo sapiens
ttctgggatgtcacag

SEQ ID NO: 4363666 - DNA, 14 bp, Homo sapiens
ttcttcagaagaca

SEQ ID NO: 4363667 - DNA, 14 bp, Homo sapiens
ttcttgctggttgt

SEQ ID NO: 4363668 - DNA, 14 bp, Homo sapiens
ttcttggtggcaga

SEQ ID NO: 4363669 - DNA, 14 bp, Homo sapiens
ttctttataaactt

SEQ ID NO: 4363670 - DNA, 14 bp, Homo sapiens
ttgaaaaactaatt

SEQ ID NO: 4363671 - DNA, 17 bp, Homo sapiens
ttgacaaggaaaatcta

SEQ ID NO: 4363672 - DNA, 23 bp, Homo sapiens
ttgacagcatatagaatatatta

SEQ ID NO: 4363673 - DNA, 13 bp, Homo sapiens
ttgacagtgaaac

SEQ ID NO: 4363674 - DNA, 15 bp, Homo sapiens
ttgagaaatgaataa

SEQ ID NO: 4363675 - DNA, 16 bp, Homo sapiens
ttgagaaatgaataat

SEQ ID NO: 4363676 - DNA, 17 bp, Homo sapiens
ttgaggagttgcctgac

SEQ ID NO: 4363677 - DNA, 14 bp, Homo sapiens
ttgagtgacagctt

SEQ ID NO: 4363678 - DNA, 15 bp, Homo sapiens
ttgataatacttgac

SEQ ID NO: 4363679 - DNA, 16 bp, Homo sapiens
ttgataatacttgacc

SEQ ID NO: 4363680 - DNA, 12 bp, Homo sapiens
ttgatgcaatat

SEQ ID NO: 4363681 - DNA, 20 bp, Homo sapiens
ttgcagtagagtcatctcca

SEQ ID NO: 4363682 - DNA, 16 bp, Homo sapiens
ttgcatcatttaactg

SEQ ID NO: 4363683 - DNA, 23 bp, Homo sapiens
ttgccacatggtgtctcccaaca

SEQ ID NO: 4363684 - DNA, 16 bp, Homo sapiens
ttgctagttctgctgc

SEQ ID NO: 4363685 - DNA, 16 bp, Homo sapiens
ttgctgggccagggaa

SEQ ID NO: 4363686 - DNA, 23 bp, Homo sapiens
ttgctggtagagacccccaggcc

SEQ ID NO: 4363687 - DNA, 13 bp, Homo sapiens
ttggaaggatctg

SEQ ID NO: 4363688 - DNA, 20 bp, Homo sapiens
ttggaaggatctgctgaggc

SEQ ID NO: 4363689 - DNA, 16 bp, Homo sapiens
ttggccccactttgaa

SEQ ID NO: 4363690 - DNA, 17 bp, Homo sapiens
ttggccccactttgaag

SEQ ID NO: 4363691 - DNA, 10 bp, Homo sapiens
ttggccctgg

SEQ ID NO: 4363692 - DNA, 16 bp, Homo sapiens
ttggccctggagccag

SEQ ID NO: 4363693 - DNA, 19 bp, Homo sapiens
ttgggaggtgcgtgttcag

SEQ ID NO: 4363694 - DNA, 23 bp, Homo sapiens
ttgggcctccatgccccagctct

SEQ ID NO: 4363695 - DNA, 20 bp, Homo sapiens
ttggtaaaaatgctgctctc

SEQ ID NO: 4363696 - DNA, 21 bp, Homo sapiens
ttggtctcaggcagcaccaca

SEQ ID NO: 4363697 - DNA, 16 bp, Homo sapiens
ttgtacaatggtttat

SEQ ID NO: 4363698 - DNA, 21 bp, Homo sapiens
ttgtccaccttttaagttaat

SEQ ID NO: 4363699 - DNA, 11 bp, Homo sapiens
ttgtctgtctc

SEQ ID NO: 4363700 - DNA, 17 bp, Homo sapiens
ttgtctgtctccctccc

SEQ ID NO: 4363701 - DNA, 19 bp, Homo sapiens
ttgtgacagtgcctcttcc

SEQ ID NO: 4363702 - DNA, 21 bp, Homo sapiens
ttgtgacagtgcctcttccag

SEQ ID NO: 4363703 - DNA, 14 bp, Homo sapiens
ttgtggggccagga

SEQ ID NO: 4363704 - DNA, 15 bp, Homo sapiens
ttgtgtattgatgca

SEQ ID NO: 4363705 - DNA, 19 bp, Homo sapiens
ttgtgtgtgggctgtgagt

SEQ ID NO: 4363706 - DNA, 16 bp, Homo sapiens
ttgtttgcatcattta

SEQ ID NO: 4363707 - DNA, 17 bp, Homo sapiens
tttaaaaccacagctgg

SEQ ID NO: 4363708 - DNA, 11 bp, Homo sapiens
tttaaaatact

SEQ ID NO: 4363709 - DNA, 19 bp, Homo sapiens
tttaaataaaagtgatcaa

SEQ ID NO: 4363710 - DNA, 13 bp, Homo sapiens
tttaaatagccta

SEQ ID NO: 4363711 - DNA, 22 bp, Homo sapiens
tttaaggaacttctgaagattt

SEQ ID NO: 4363712 - DNA, 15 bp, Homo sapiens
tttaagttaatgaaa

SEQ ID NO: 4363713 - DNA, 16 bp, Homo sapiens
tttacatcagaagttt

SEQ ID NO: 4363714 - DNA, 20 bp, Homo sapiens
tttacatcagaagtttgcat

SEQ ID NO: 4363715 - DNA, 15 bp, Homo sapiens
tttacattgtcctgt

SEQ ID NO: 4363716 - DNA, 18 bp, Homo sapiens
tttacattgtcctgtagc

SEQ ID NO: 4363717 - DNA, 14 bp, Homo sapiens
tttaccttctaaaa

SEQ ID NO: 4363718 - DNA, 18 bp, Homo sapiens
tttactgtaactgtcagt

SEQ ID NO: 4363719 - DNA, 15 bp, Homo sapiens
tttagcctagttcat

SEQ ID NO: 4363720 - DNA, 14 bp, Homo sapiens
tttaggataatctt

SEQ ID NO: 4363721 - DNA, 19 bp, Homo sapiens
tttatgacctaagtcaggt

SEQ ID NO: 4363722 - DNA, 14 bp, Homo sapiens
tttatgcagacagt

SEQ ID NO: 4363723 - DNA, 12 bp, Homo sapiens
tttattcccaag

SEQ ID NO: 4363724 - DNA, 21 bp, Homo sapiens
tttattcccaagtatgcctta

SEQ ID NO: 4363725 - DNA, 22 bp, Homo sapiens
tttattcccaagtatgccttaa

SEQ ID NO: 4363726 - DNA, 12 bp, Homo sapiens
tttattgcattg

SEQ ID NO: 4363727 - DNA, 14 bp, Homo sapiens
tttcaatgcagttt

SEQ ID NO: 4363728 - DNA, 13 bp, Homo sapiens
tttcactttgaaa

SEQ ID NO: 4363729 - DNA, 17 bp, Homo sapiens
tttcagatgtgcaataa

SEQ ID NO: 4363730 - DNA, 15 bp, Homo sapiens
tttcccaattaggaa

SEQ ID NO: 4363731 - DNA, 17 bp, Homo sapiens
tttcccgccttgggctt

SEQ ID NO: 4363732 - DNA, 16 bp, Homo sapiens
tttccctgaggaatga

SEQ ID NO: 4363733 - DNA, 13 bp, Homo sapiens
tttctgaaacaca

SEQ ID NO: 4363734 - DNA, 23 bp, Homo sapiens
tttctggactgaagcctgcagga

SEQ ID NO: 4363735 - DNA, 14 bp, Homo sapiens
tttctgttgccaca

SEQ ID NO: 4363736 - DNA, 17 bp, Homo sapiens
tttgaagggcaagaaat

SEQ ID NO: 4363737 - DNA, 18 bp, Homo sapiens
tttgagatattaaagatt

SEQ ID NO: 4363738 - DNA, 22 bp, Homo sapiens
tttgagtgacagctttctggga

SEQ ID NO: 4363739 - DNA, 13 bp, Homo sapiens
tttgctaaataca

SEQ ID NO: 4363740 - DNA, 22 bp, Homo sapiens
tttgctagttctgctgccctct

SEQ ID NO: 4363741 - DNA, 15 bp, Homo sapiens
tggtttattcccaag

SEQ ID NO: 4363742 - DNA, 17 bp, Homo sapiens
tgtaaagtgtaaatcct

SEQ ID NO: 4363743 - DNA, 19 bp, Homo sapiens
tgtaaatcctttttcttta

SEQ ID NO: 4363744 - DNA, 20 bp, Homo sapiens
tgtaaatcctttttctttat

SEQ ID NO: 4363745 - DNA, 22 bp, Homo sapiens
tgtaaatcctttttctttataa

SEQ ID NO: 4363746 - DNA, 15 bp, Homo sapiens
tgtaacagctgaggt

SEQ ID NO: 4363747 - DNA, 15 bp, Homo sapiens
tgtaactaagttatt

SEQ ID NO: 4363748 - DNA, 15 bp, Homo sapiens
tgtaagagacatgaa

SEQ ID NO: 4363749 - DNA, 22 bp, Homo sapiens
tgtaaggcactgtcaggaatgg

SEQ ID NO: 4363750 - DNA, 14 bp, Homo sapiens
tgtaagtgtgagta

SEQ ID NO: 4363751 - DNA, 17 bp, Homo sapiens
tgtaagtgtgagtaaga

SEQ ID NO: 4363752 - DNA, 15 bp, Homo sapiens
tgtaatgtacaattt

SEQ ID NO: 4363753 - DNA, 20 bp, Homo sapiens
tgtacaataagttacttgaa

SEQ ID NO: 4363754 - DNA, 18 bp, Homo sapiens
tgtacaatggtttattcc

SEQ ID NO: 4363755 - DNA, 22 bp, Homo sapiens
tgtacaatggtttattcccaag

SEQ ID NO: 4363756 - DNA, 16 bp, Homo sapiens
tgtacactgaatattt

SEQ ID NO: 4363757 - DNA, 19 bp, Homo sapiens
tgtacactgaatatttata

SEQ ID NO: 4363758 - DNA, 15 bp, Homo sapiens
tgtacatatggaaat

SEQ ID NO: 4363759 - DNA, 19 bp, Homo sapiens
tgtacatatggaaatgtta

SEQ ID NO: 4363760 - DNA, 15 bp, Homo sapiens
tgtacgctgctgcag

SEQ ID NO: 4363761 - DNA, 16 bp, Homo sapiens
tgtacttaataaattc

SEQ ID NO: 4363762 - DNA, 20 bp, Homo sapiens
tgtacttaataaattcagat

SEQ ID NO: 4363763 - DNA, 20 bp, Homo sapiens
tgtagtttttatatgttgta

SEQ ID NO: 4363764 - DNA, 20 bp, Homo sapiens
tgtatcggagggaaacagaa

SEQ ID NO: 4363765 - DNA, 16 bp, Homo sapiens
tgtattattctgcagc

SEQ ID NO: 4363766 - DNA, 15 bp, Homo sapiens
tgtattgatgcaata

SEQ ID NO: 4363767 - DNA, 21 bp, Homo sapiens
tgtattgatgcaatataagca

SEQ ID NO: 4363768 - DNA, 11 bp, Homo sapiens
tgtcacaataa

SEQ ID NO: 4363769 - DNA, 13 bp, Homo sapiens
tgtcacaataaag

SEQ ID NO: 4363770 - DNA, 19 bp, Homo sapiens
tgtcacaataaagtttatt

SEQ ID NO: 4363771 - DNA, 16 bp, Homo sapiens
tgtcaccgtgagcagc

SEQ ID NO: 4363772 - DNA, 22 bp, Homo sapiens
tgtcaccgtgagcagctttgga

SEQ ID NO: 4363773 - DNA, 16 bp, Homo sapiens
tgtcacttgccacatg

SEQ ID NO: 4363774 - DNA, 20 bp, Homo sapiens
tgtcatttataacttctgta

SEQ ID NO: 4363775 - DNA, 15 bp, Homo sapiens
tgtcatttttgcagt

SEQ ID NO: 4363776 - DNA, 21 bp, Homo sapiens
tgtccacgtttttggaaaatg

SEQ ID NO: 4363777 - DNA, 18 bp, Homo sapiens
tgtccggcccagtgccac

SEQ ID NO: 4363778 - DNA, 18 bp, Homo sapiens
tgtcctttttcactttga

SEQ ID NO: 4363779 - DNA, 20 bp, Homo sapiens
tgtcctttttcactttgaaa

SEQ ID NO: 4363780 - DNA, 14 bp, Homo sapiens
tgtcgtgggatggc

SEQ ID NO: 4363781 - DNA, 17 bp, Homo sapiens
tgtctaggactgcagtg

SEQ ID NO: 4363782 - DNA, 18 bp, Homo sapiens
tgtctattatcacattaa

SEQ ID NO: 4363783 - DNA, 22 bp, Homo sapiens
tgtctcatgatgtaaaaaatat

SEQ ID NO: 4363784 - DNA, 17 bp, Homo sapiens
tgtctccctcccctctc

SEQ ID NO: 4363785 - DNA, 20 bp, Homo sapiens
tgtctccctcccctctcaga

SEQ ID NO: 4363786 - DNA, 15 bp, Homo sapiens
tgtctgccaaacaca

SEQ ID NO: 4363787 - DNA, 15 bp, Homo sapiens
tgtctgctgctgcct

SEQ ID NO: 4363788 - DNA, 18 bp, Homo sapiens
tgtctgctgctgcctccc

SEQ ID NO: 4363789 - DNA, 20 bp, Homo sapiens
tgtcttcccgatgagggaag

SEQ ID NO: 4363790 - DNA, 21 bp, Homo sapiens
tgtcttccgatcaacatttat

SEQ ID NO: 4363791 - DNA, 17 bp, Homo sapiens
tgtctttttctggactg

SEQ ID NO: 4363792 - DNA, 20 bp, Homo sapiens
tgtctttttctggactgaag

SEQ ID NO: 4363793 - DNA, 13 bp, Homo sapiens
tgtgacagtgcct

SEQ ID NO: 4363794 - DNA, 14 bp, Homo sapiens
tgtgacagtgcctc

SEQ ID NO: 4363795 - DNA, 20 bp, Homo sapiens
tgtgacagtgcctcttccag

SEQ ID NO: 4363796 - DNA, 15 bp, Homo sapiens
tgtgactggatcttc

SEQ ID NO: 4363797 - DNA, 18 bp, Homo sapiens
tgtgagctggatagactt

SEQ ID NO: 4363798 - DNA, 18 bp, Homo sapiens
tgtgagtggataatcagg

SEQ ID NO: 4363799 - DNA, 21 bp, Homo sapiens
tgtgatacactgaatggaaat

SEQ ID NO: 4363800 - DNA, 22 bp, Homo sapiens
tgtgatacactgaatggaaata

SEQ ID NO: 4363801 - DNA, 16 bp, Homo sapiens
tgtgatgtaaggcact

SEQ ID NO: 4363802 - DNA, 19 bp, Homo sapiens
tgtgcagtactttgtgcat

SEQ ID NO: 4363803 - DNA, 19 bp, Homo sapiens
tgtgcatgggtgaagggag

SEQ ID NO: 4363804 - DNA, 20 bp, Homo sapiens
tgtggagttcaccttggaag

SEQ ID NO: 4363805 - DNA, 13 bp, Homo sapiens
tgtgggagcagcg

SEQ ID NO: 4363806 - DNA, 14 bp, Homo sapiens
tgtgggctgtgagt

SEQ ID NO: 4363807 - DNA, 13 bp, Homo sapiens
tgtggggccagga

SEQ ID NO: 4363808 - DNA, 22 bp, Homo sapiens
tgtggggccaggaccatggccg

SEQ ID NO: 4363809 - DNA, 20 bp, Homo sapiens
tgtggtttcagatgtgcaat

SEQ ID NO: 4363810 - DNA, 19 bp, Homo sapiens
tgtgtacagtgtgtaaagt

SEQ ID NO: 4363811 - DNA, 17 bp, Homo sapiens
tgtgtattgatgcaata

SEQ ID NO: 4363812 - DNA, 12 bp, Homo sapiens
tgtgtctgccaa

SEQ ID NO: 4363813 - DNA, 15 bp, Homo sapiens
tgtgtctgccaaaca

SEQ ID NO: 4363814 - DNA, 19 bp, Homo sapiens
tgtgtgtgggctgtgagtg

SEQ ID NO: 4363815 - DNA, 20 bp, Homo sapiens
tgtgtttcgcattaagcaca

SEQ ID NO: 4363816 - DNA, 22 bp, Homo sapiens
tgtgtttcgcattaagcacaca

SEQ ID NO: 4363817 - DNA, 23 bp, Homo sapiens
tgtgtttgtttttcaagaaatga

SEQ ID NO: 4363818 - DNA, 15 bp, Homo sapiens
tgtgtttttaacatg

SEQ ID NO: 4363819 - DNA, 14 bp, Homo sapiens
tgttatgaacagct

SEQ ID NO: 4363820 - DNA, 15 bp, Homo sapiens
tgttatgaacagctg

SEQ ID NO: 4363821 - DNA, 17 bp, Homo sapiens
tgttatgaacagctgtg

SEQ ID NO: 4363822 - DNA, 15 bp, Homo sapiens
tgttcagcagaacct

SEQ ID NO: 4363823 - DNA, 12 bp, Homo sapiens
tgttcccagaaa

SEQ ID NO: 4363824 - DNA, 15 bp, Homo sapiens
tgttctcatgaagca

SEQ ID NO: 4363825 - DNA, 19 bp, Homo sapiens
tgttcttgggagaaaatca

SEQ ID NO: 4363826 - DNA, 16 bp, Homo sapiens
tgttgccttggaaaca

SEQ ID NO: 4363827 - DNA, 16 bp, Homo sapiens
tgttgctatcctgcag

SEQ ID NO: 4363828 - DNA, 21 bp, Homo sapiens
tgttgctatcctgcaggaaat

SEQ ID NO: 4363829 - DNA, 14 bp, Homo sapiens
tgtttaaatagcct

SEQ ID NO: 4363830 - DNA, 18 bp, Homo sapiens
tgtttaaatagcctaaat

SEQ ID NO: 4363831 - DNA, 14 bp, Homo sapiens
tgtttgcatcattt

SEQ ID NO: 4363832 - DNA, 17 bp, Homo sapiens
tgttttgggcctccatg

SEQ ID NO: 4363833 - DNA, 15 bp, Homo sapiens
ttaaaaccacagctg

SEQ ID NO: 4363834 - DNA, 13 bp, Homo sapiens
ttaaaactttgta

SEQ ID NO: 4363835 - DNA, 20 bp, Homo sapiens
ttaaactgtgtggactgtga

SEQ ID NO: 4363836 - DNA, 14 bp, Homo sapiens
ttaaatagcctaaa

SEQ ID NO: 4363837 - DNA, 19 bp, Homo sapiens
ttaaatagcctaaatgatg

SEQ ID NO: 4363838 - DNA, 23 bp, Homo sapiens
ttaaattcttcaagaaagaattc

SEQ ID NO: 4363839 - DNA, 17 bp, Homo sapiens
ttaagcagaacaaatgt

SEQ ID NO: 4363840 - DNA, 19 bp, Homo sapiens
ttaagcagaacaaatgtgt

SEQ ID NO: 4363841 - DNA, 15 bp, Homo sapiens
ttaagttaatgaaat

SEQ ID NO: 4363842 - DNA, 18 bp, Homo sapiens
ttaagttaatgaaataaa

SEQ ID NO: 4363843 - DNA, 23 bp, Homo sapiens
ttaagttaatgaaataaaatttg

SEQ ID NO: 4363844 - DNA, 19 bp, Homo sapiens
ttaagttttaaataaacct

SEQ ID NO: 4363845 - DNA, 17 bp, Homo sapiens
ttaataaatatgtaata

SEQ ID NO: 4363846 - DNA, 21 bp, Homo sapiens
ttaatgaaataaaatttgaaa

SEQ ID NO: 4363847 - DNA, 22 bp, Homo sapiens
ttaatgagatgttattactgtt

SEQ ID NO: 4363848 - DNA, 14 bp, Homo sapiens
ttacaaaatgccaa

SEQ ID NO: 4363849 - DNA, 16 bp, Homo sapiens
ttacaggctaaaatta

SEQ ID NO: 4363850 - DNA, 18 bp, Homo sapiens
ttacatcagaagtttgca

SEQ ID NO: 4363851 - DNA, 11 bp, Homo sapiens
ttactttctgt

SEQ ID NO: 4363852 - DNA, 16 bp, Homo sapiens
ttacttttcacactgt

SEQ ID NO: 4363853 - DNA, 13 bp, Homo sapiens
ttagaaaggcagc

SEQ ID NO: 4363854 - DNA, 13 bp, Homo sapiens
ttagaaatagaca

SEQ ID NO: 4363855 - DNA, 15 bp, Homo sapiens
ttagatttaaaataa

SEQ ID NO: 4363856 - DNA, 12 bp, Homo sapiens
ttagcaacaaca

SEQ ID NO: 4363857 - DNA, 16 bp, Homo sapiens
ttagcatttttatgca

SEQ ID NO: 4363858 - DNA, 18 bp, Homo sapiens
ttagcatttttatgcaga

SEQ ID NO: 4363859 - DNA, 20 bp, Homo sapiens
ttagcatttttatgcagaca

SEQ ID NO: 4363860 - DNA, 19 bp, Homo sapiens
ttaggaagtgtaacagctg

SEQ ID NO: 4363861 - DNA, 17 bp, Homo sapiens
ttaggaataacactgca

SEQ ID NO: 4363862 - DNA, 17 bp, Homo sapiens
ttagtcttctttcccaa

SEQ ID NO: 4363863 - DNA, 22 bp, Homo sapiens
ttatactgtacttaataaattc

SEQ ID NO: 4363864 - DNA, 16 bp, Homo sapiens
tgcccacatttgggct

SEQ ID NO: 4363865 - DNA, 18 bp, Homo sapiens
tgcccacatttgggctca

SEQ ID NO: 4363866 - DNA, 19 bp, Homo sapiens
tgcccacatttgggctcag

SEQ ID NO: 4363867 - DNA, 13 bp, Homo sapiens
tgcccagctctct

SEQ ID NO: 4363868 - DNA, 21 bp, Homo sapiens
tgcccagctctctgacgcttg

SEQ ID NO: 4363869 - DNA, 16 bp, Homo sapiens
tgcccattctcttagt

SEQ ID NO: 4363870 - DNA, 14 bp, Homo sapiens
tgccccagctctgg

SEQ ID NO: 4363871 - DNA, 23 bp, Homo sapiens
tgccccagctctggatgaaggca

SEQ ID NO: 4363872 - DNA, 17 bp, Homo sapiens
tgccccccgaggctgct

SEQ ID NO: 4363873 - DNA, 13 bp, Homo sapiens
tgcccccgcctgc

SEQ ID NO: 4363874 - DNA, 23 bp, Homo sapiens
tgcccctgcagtttggccctgga

SEQ ID NO: 4363875 - DNA, 16 bp, Homo sapiens
tgcccggcgccgggca

SEQ ID NO: 4363876 - DNA, 13 bp, Homo sapiens
tgccggtgggacc

SEQ ID NO: 4363877 - DNA, 20 bp, Homo sapiens
tgcctcagccagtggcacag

SEQ ID NO: 4363878 - DNA, 18 bp, Homo sapiens
tgcctcatagcatagcca

SEQ ID NO: 4363879 - DNA, 22 bp, Homo sapiens
tgcctcatagcatagccagcat

SEQ ID NO: 4363880 - DNA, 14 bp, Homo sapiens
tgcctgaactccag

SEQ ID NO: 4363881 - DNA, 15 bp, Homo sapiens
tgcctgaactccaga

SEQ ID NO: 4363882 - DNA, 16 bp, Homo sapiens
tgcctgaactccagag

SEQ ID NO: 4363883 - DNA, 16 bp, Homo sapiens
tgcctgactcctgggt

SEQ ID NO: 4363884 - DNA, 19 bp, Homo sapiens
tgcctgtgccacccaccag

SEQ ID NO: 4363885 - DNA, 19 bp, Homo sapiens
tgccttaagcagaacaaat

SEQ ID NO: 4363886 - DNA, 23 bp, Homo sapiens
tgccttaagcagaacaaatgtgt

SEQ ID NO: 4363887 - DNA, 13 bp, Homo sapiens
tgccttaataaat

SEQ ID NO: 4363888 - DNA, 17 bp, Homo sapiens
tgccttaataaatatgt

SEQ ID NO: 4363889 - DNA, 17 bp, Homo sapiens
tgcgccttgtagaatgc

SEQ ID NO: 4363890 - DNA, 20 bp, Homo sapiens
tgcgtctccagtcatctgta

SEQ ID NO: 4363891 - DNA, 22 bp, Homo sapiens
tgctagacagaaaccaagccat

SEQ ID NO: 4363892 - DNA, 16 bp, Homo sapiens
tgctagttctgctgcc

SEQ ID NO: 4363893 - DNA, 17 bp, Homo sapiens
tgctagttctgctgccc

SEQ ID NO: 4363894 - DNA, 19 bp, Homo sapiens
tgctagttctgctgccctc

SEQ ID NO: 4363895 - DNA, 19 bp, Homo sapiens
tgctataaactttacatat

SEQ ID NO: 4363896 - DNA, 23 bp, Homo sapiens
tgctatcctgcaggaaatataaa

SEQ ID NO: 4363897 - DNA, 15 bp, Homo sapiens
tgctccagattctga

SEQ ID NO: 4363898 - DNA, 12 bp, Homo sapiens
tgctcctcaccc

SEQ ID NO: 4363899 - DNA, 16 bp, Homo sapiens
tgctgaggcccagtgc

SEQ ID NO: 4363900 - DNA, 23 bp, Homo sapiens
tgctgcatactttgacaaggaaa

SEQ ID NO: 4363901 - DNA, 14 bp, Homo sapiens
tgctgccctcttaa

SEQ ID NO: 4363902 - DNA, 16 bp, Homo sapiens
tgctgccctcttaaga

SEQ ID NO: 4363903 - DNA, 14 bp, Homo sapiens
tgctgcttggattt

SEQ ID NO: 4363904 - DNA, 13 bp, Homo sapiens
tgctggctgccca

SEQ ID NO: 4363905 - DNA, 14 bp, Homo sapiens
tgctggctgcccag

SEQ ID NO: 4363906 - DNA, 23 bp, Homo sapiens
tgctggttgtcatttttgcagta

SEQ ID NO: 4363907 - DNA, 16 bp, Homo sapiens
tgcttacttttactgt

SEQ ID NO: 4363908 - DNA, 22 bp, Homo sapiens
tgcttggcaatagttaagtcaa

SEQ ID NO: 4363909 - DNA, 18 bp, Homo sapiens
tgctttccctgaggaatg

SEQ ID NO: 4363910 - DNA, 20 bp, Homo sapiens
tggaaaactattgagccttg

SEQ ID NO: 4363911 - DNA, 19 bp, Homo sapiens
tggaaaccttccacccagt

SEQ ID NO: 4363912 - DNA, 22 bp, Homo sapiens
tggaagaaaatatttttaaatg

SEQ ID NO: 4363913 - DNA, 20 bp, Homo sapiens
tggaaggatctgctgaggcc

SEQ ID NO: 4363914 - DNA, 23 bp, Homo sapiens
tggaaggatctgctgaggcccag

SEQ ID NO: 4363915 - DNA, 18 bp, Homo sapiens
tggaagggcgttctaggt

SEQ ID NO: 4363916 - DNA, 17 bp, Homo sapiens
tggactgaagcctgcag

SEQ ID NO: 4363917 - DNA, 15 bp, Homo sapiens
tggactgtgatgcca

SEQ ID NO: 4363918 - DNA, 21 bp, Homo sapiens
tggactgtgatgccacacaga

SEQ ID NO: 4363919 - DNA, 16 bp, Homo sapiens
tggagactcctggtct

SEQ ID NO: 4363920 - DNA, 17 bp, Homo sapiens
tggagactcctggtctg

SEQ ID NO: 4363921 - DNA, 13 bp, Homo sapiens
tggagagcagcag

SEQ ID NO: 4363922 - DNA, 11 bp, Homo sapiens
tggagaggaga

SEQ ID NO: 4363923 - DNA, 14 bp, Homo sapiens
tggagatgggaagg

SEQ ID NO: 4363924 - DNA, 11 bp, Homo sapiens
tggagccaggg

SEQ ID NO: 4363925 - DNA, 14 bp, Homo sapiens
tggagccagggcag

SEQ ID NO: 4363926 - DNA, 15 bp, Homo sapiens
tggagccagggcaga

SEQ ID NO: 4363927 - DNA, 22 bp, Homo sapiens
tggagccagggcagaggaatgt

SEQ ID NO: 4363928 - DNA, 16 bp, Homo sapiens
tggaggaggaggagga

SEQ ID NO: 4363929 - DNA, 21 bp, Homo sapiens
tggaggaggaggaggagcctt

SEQ ID NO: 4363930 - DNA, 23 bp, Homo sapiens
tggaggaggaggaggagccttgc

SEQ ID NO: 4363931 - DNA, 19 bp, Homo sapiens
tggatatcagggtataaat

SEQ ID NO: 4363932 - DNA, 21 bp, Homo sapiens
tggatcttctatcattccaat

SEQ ID NO: 4363933 - DNA, 19 bp, Homo sapiens
tggatgttatgaacagctg

SEQ ID NO: 4363934 - DNA, 20 bp, Homo sapiens
tggatgttatgaacagctgt

SEQ ID NO: 4363935 - DNA, 13 bp, Homo sapiens
tggattcagaaat

SEQ ID NO: 4363936 - DNA, 17 bp, Homo sapiens
tggatttgcctgtgcca

SEQ ID NO: 4363937 - DNA, 17 bp, Homo sapiens
tggcagaatgaaaatca

SEQ ID NO: 4363938 - DNA, 20 bp, Homo sapiens
tggcagaatgaaaatcagca

SEQ ID NO: 4363939 - DNA, 18 bp, Homo sapiens
tggcaggtgggctgcctg

SEQ ID NO: 4363940 - DNA, 19 bp, Homo sapiens
tggcaggtgggctgcctgc

SEQ ID NO: 4363941 - DNA, 17 bp, Homo sapiens
tggcatttggtctcagg

SEQ ID NO: 4363942 - DNA, 20 bp, Homo sapiens
tggcatttggtctcaggcag

SEQ ID NO: 4363943 - DNA, 19 bp, Homo sapiens
tggccatgcaggaggtgga

SEQ ID NO: 4363944 - DNA, 19 bp, Homo sapiens
tggccccactttgaagggc

SEQ ID NO: 4363945 - DNA, 19 bp, Homo sapiens
tggccctggagccagggca

SEQ ID NO: 4363946 - DNA, 18 bp, Homo sapiens
tggcctggttgtttccgt

SEQ ID NO: 4363947 - DNA, 13 bp, Homo sapiens
tggcgtctgctct

SEQ ID NO: 4363948 - DNA, 14 bp, Homo sapiens
tggcgtctgctctg

SEQ ID NO: 4363949 - DNA, 15 bp, Homo sapiens
tggcgtctgctctgg

SEQ ID NO: 4363950 - DNA, 18 bp, Homo sapiens
tggctgacatgaagctgt

SEQ ID NO: 4363951 - DNA, 20 bp, Homo sapiens
tggctgcccagacccctctg

SEQ ID NO: 4363952 - DNA, 20 bp, Homo sapiens
tggctgctcccagcctcttg

SEQ ID NO: 4363953 - DNA, 17 bp, Homo sapiens
tggctggcccgtcatgt

SEQ ID NO: 4363954 - DNA, 22 bp, Homo sapiens
tggctgggaacatgacccagcc

SEQ ID NO: 4363955 - DNA, 17 bp, Homo sapiens
tggcttaagtgagcaga

SEQ ID NO: 4363956 - DNA, 19 bp, Homo sapiens
tgggaacatgacccagcct

SEQ ID NO: 4363957 - DNA, 12 bp, Homo sapiens
tgggaagagaag

SEQ ID NO: 4363958 - DNA, 14 bp, Homo sapiens
tgggaagagaagaa

SEQ ID NO: 4363959 - DNA, 20 bp, Homo sapiens
tgggaagataggctctgcac

SEQ ID NO: 4363960 - DNA, 22 bp, Homo sapiens
tgggaagataggctctgcacag

SEQ ID NO: 4363961 - DNA, 21 bp, Homo sapiens
tgggaatgtattattctgcag

SEQ ID NO: 4363962 - DNA, 16 bp, Homo sapiens
tgggatgtcacagtcc

SEQ ID NO: 4363963 - DNA, 17 bp, Homo sapiens
tgggatgtcacagtcca

SEQ ID NO: 4363964 - DNA, 12 bp, Homo sapiens
tgggcagggtga

SEQ ID NO: 4363965 - DNA, 15 bp, Homo sapiens
tgggcatttgtgagg

SEQ ID NO: 4363966 - DNA, 16 bp, Homo sapiens
tgggcatttgtgaggc

SEQ ID NO: 4363967 - DNA, 16 bp, Homo sapiens
tgggctcagggttggc

SEQ ID NO: 4363968 - DNA, 14 bp, Homo sapiens
tggggaaaatggcc

SEQ ID NO: 4363969 - DNA, 19 bp, Homo sapiens
tggggaaaatggccatgca

SEQ ID NO: 4363970 - DNA, 13 bp, Homo sapiens
tggggacagggct

SEQ ID NO: 4363971 - DNA, 18 bp, Homo sapiens
tgggggagggaagaccag

SEQ ID NO: 4363972 - DNA, 21 bp, Homo sapiens
tgggggagggaagaccagaat

SEQ ID NO: 4363973 - DNA, 16 bp, Homo sapiens
tggggtctgtgactgg

SEQ ID NO: 4363974 - DNA, 17 bp, Homo sapiens
tgggtcccccacgtgac

SEQ ID NO: 4363975 - DNA, 15 bp, Homo sapiens
tgggtgcgtctccag

SEQ ID NO: 4363976 - DNA, 20 bp, Homo sapiens
tgggtggggtgaggaccact

SEQ ID NO: 4363977 - DNA, 19 bp, Homo sapiens
tggtaaaaatgctgctctc

SEQ ID NO: 4363978 - DNA, 16 bp, Homo sapiens
tggtaggggagggcag

SEQ ID NO: 4363979 - DNA, 19 bp, Homo sapiens
tggtcaagttcccaactga

SEQ ID NO: 4363980 - DNA, 17 bp, Homo sapiens
tggtctttctggagagg

SEQ ID NO: 4363981 - DNA, 21 bp, Homo sapiens
tggtggcagaatgaaaatcag

SEQ ID NO: 4363982 - DNA, 16 bp, Homo sapiens
tggtgtggctgctccc

SEQ ID NO: 4363983 - DNA, 15 bp, Homo sapiens
tggtgtttgtctgtg

SEQ ID NO: 4363984 - DNA, 12 bp, Homo sapiens
tggttgcctccc

SEQ ID NO: 4363985 - DNA, 15 bp, Homo sapiens
tggttgggggaatgc

SEQ ID NO: 4363986 - DNA, 13 bp, Homo sapiens
tctgccaaacaca

SEQ ID NO: 4363987 - DNA, 23 bp, Homo sapiens
tctgcgcttggtctttctgtgct

SEQ ID NO: 4363988 - DNA, 20 bp, Homo sapiens
tctgctgaggcccagtgcat

SEQ ID NO: 4363989 - DNA, 15 bp, Homo sapiens
tctggaaaactattg

SEQ ID NO: 4363990 - DNA, 21 bp, Homo sapiens
tctggaccccgtttcattttt

SEQ ID NO: 4363991 - DNA, 18 bp, Homo sapiens
tctggactagaaaatctg

SEQ ID NO: 4363992 - DNA, 13 bp, Homo sapiens
tctggactgaagc

SEQ ID NO: 4363993 - DNA, 13 bp, Homo sapiens
tctggatgaaggc

SEQ ID NO: 4363994 - DNA, 19 bp, Homo sapiens
tctggccaggatggagggg

SEQ ID NO: 4363995 - DNA, 11 bp, Homo sapiens
tctggccctga

SEQ ID NO: 4363996 - DNA, 22 bp, Homo sapiens
tctggccctgacttctggagat

SEQ ID NO: 4363997 - DNA, 15 bp, Homo sapiens
tctgggatgtcacag

SEQ ID NO: 4363998 - DNA, 14 bp, Homo sapiens
tctggttgcctccc

SEQ ID NO: 4363999 - DNA, 13 bp, Homo sapiens
tctgtaagagctt

SEQ ID NO: 4364000 - DNA, 15 bp, Homo sapiens
tctgtacagtaagac

SEQ ID NO: 4364001 - DNA, 18 bp, Homo sapiens
tctgtcagatgggaagac

SEQ ID NO: 4364002 - DNA, 11 bp, Homo sapiens
tctgtgactgg

SEQ ID NO: 4364003 - DNA, 20 bp, Homo sapiens
tctgtgactggatcttctat

SEQ ID NO: 4364004 - DNA, 12 bp, Homo sapiens
tctgtgcttgga

SEQ ID NO: 4364005 - DNA, 22 bp, Homo sapiens
tctgttatgcactgtggtttca

SEQ ID NO: 4364006 - DNA, 23 bp, Homo sapiens
tcttcaagaaagaattcctgcag

SEQ ID NO: 4364007 - DNA, 16 bp, Homo sapiens
tcttcttcagaagaca

SEQ ID NO: 4364008 - DNA, 14 bp, Homo sapiens
tcttcttcttcaga

SEQ ID NO: 4364009 - DNA, 14 bp, Homo sapiens
tcttgctcagagct

SEQ ID NO: 4364010 - DNA, 14 bp, Homo sapiens
tcttggttctaaag

SEQ ID NO: 4364011 - DNA, 15 bp, Homo sapiens
tcttggttctaaagg

SEQ ID NO: 4364012 - DNA, 15 bp, Homo sapiens
tcttgtggggccagg

SEQ ID NO: 4364013 - DNA, 18 bp, Homo sapiens
tctttaaaaactcactta

SEQ ID NO: 4364014 - DNA, 13 bp, Homo sapiens
tctttctccctca

SEQ ID NO: 4364015 - DNA, 15 bp, Homo sapiens
tctttggaagcagcc

SEQ ID NO: 4364016 - DNA, 14 bp, Homo sapiens
tctttttctggact

SEQ ID NO: 4364017 - DNA, 19 bp, Homo sapiens
tctttttttgagtgacagc

SEQ ID NO: 4364018 - DNA, 21 bp, Homo sapiens
tgaaaagttggaaggatctgc

SEQ ID NO: 4364019 - DNA, 15 bp, Homo sapiens
tgaaacacacgagca

SEQ ID NO: 4364020 - DNA, 17 bp, Homo sapiens
tgaaacacacgagcaaa

SEQ ID NO: 4364021 - DNA, 15 bp, Homo sapiens
tgaaataagttgttt

SEQ ID NO: 4364022 - DNA, 13 bp, Homo sapiens
tgaacagctgtgt

SEQ ID NO: 4364023 - DNA, 15 bp, Homo sapiens
tgaacagctgtgtct

SEQ ID NO: 4364024 - DNA, 17 bp, Homo sapiens
tgaacagctgtgtctgc

SEQ ID NO: 4364025 - DNA, 13 bp, Homo sapiens
tgaagaaaatgag

SEQ ID NO: 4364026 - DNA, 22 bp, Homo sapiens
tgaaggcaaaaactgtactgtg

SEQ ID NO: 4364027 - DNA, 14 bp, Homo sapiens
tgaagggagagcca

SEQ ID NO: 4364028 - DNA, 21 bp, Homo sapiens
tgaaggggtgcacccacctgt

SEQ ID NO: 4364029 - DNA, 19 bp, Homo sapiens
tgaatatttatatttcact

SEQ ID NO: 4364030 - DNA, 15 bp, Homo sapiens
tgaatgtatcaggaa

SEQ ID NO: 4364031 - DNA, 16 bp, Homo sapiens
tgaatgtatcaggaaa

SEQ ID NO: 4364032 - DNA, 23 bp, Homo sapiens
tgaattgtgtattgatgcaatat

SEQ ID NO: 4364033 - DNA, 21 bp, Homo sapiens
tgacaaaggagccttgataat

SEQ ID NO: 4364034 - DNA, 13 bp, Homo sapiens
tgacaaggaaaat

SEQ ID NO: 4364035 - DNA, 13 bp, Homo sapiens
tgacagtgaaaca

SEQ ID NO: 4364036 - DNA, 14 bp, Homo sapiens
tgacagtgaaacaa

SEQ ID NO: 4364037 - DNA, 14 bp, Homo sapiens
tgacagtgcctctt

SEQ ID NO: 4364038 - DNA, 20 bp, Homo sapiens
tgacagtgcctgggaatgta

SEQ ID NO: 4364039 - DNA, 19 bp, Homo sapiens
tgacattcctaagagtgga

SEQ ID NO: 4364040 - DNA, 18 bp, Homo sapiens
tgacctgtgaccagcact

SEQ ID NO: 4364041 - DNA, 22 bp, Homo sapiens
tgacctgtgaccagcactgtct

SEQ ID NO: 4364042 - DNA, 21 bp, Homo sapiens
tgacgcttgtgacagtgcctc

SEQ ID NO: 4364043 - DNA, 19 bp, Homo sapiens
tgacgtcaagtctccttcc

SEQ ID NO: 4364044 - DNA, 14 bp, Homo sapiens
tgactcaacatgtt

SEQ ID NO: 4364045 - DNA, 19 bp, Homo sapiens
tgactggatcttctatcat

SEQ ID NO: 4364046 - DNA, 15 bp, Homo sapiens
tgagaactgacaaag

SEQ ID NO: 4364047 - DNA, 16 bp, Homo sapiens
tgagaattaagtttta

SEQ ID NO: 4364048 - DNA, 10 bp, Homo sapiens
tgagacatcc

SEQ ID NO: 4364049 - DNA, 15 bp, Homo sapiens
tgagaccaaaattta

SEQ ID NO: 4364050 - DNA, 23 bp, Homo sapiens
tgagaccaaaatttaagttaact

SEQ ID NO: 4364051 - DNA, 18 bp, Homo sapiens
tgagagaattgtatcatt

SEQ ID NO: 4364052 - DNA, 21 bp, Homo sapiens
tgagccttgcatgtacttgaa

SEQ ID NO: 4364053 - DNA, 19 bp, Homo sapiens
tgagctggatagacttggg

SEQ ID NO: 4364054 - DNA, 16 bp, Homo sapiens
tgaggaggaggacaca

SEQ ID NO: 4364055 - DNA, 22 bp, Homo sapiens
tgaggaggaggacacagcacaa

SEQ ID NO: 4364056 - DNA, 23 bp, Homo sapiens
tgaggaggaggacacagcacaag

SEQ ID NO: 4364057 - DNA, 13 bp, Homo sapiens
tgaggaggtacaa

SEQ ID NO: 4364058 - DNA, 21 bp, Homo sapiens
tgagggaaggagcccagccag

SEQ ID NO: 4364059 - DNA, 17 bp, Homo sapiens
tgaggtctcttgaggga

SEQ ID NO: 4364060 - DNA, 14 bp, Homo sapiens
tgagtaagagctgg

SEQ ID NO: 4364061 - DNA, 16 bp, Homo sapiens
tgagtaagagctggtg

SEQ ID NO: 4364062 - DNA, 17 bp, Homo sapiens
tgagtaagagctggtgt

SEQ ID NO: 4364063 - DNA, 18 bp, Homo sapiens
tgagtaagagctggtgtc

SEQ ID NO: 4364064 - DNA, 21 bp, Homo sapiens
tgagtaagagctggtgtctga

SEQ ID NO: 4364065 - DNA, 15 bp, Homo sapiens
tgagtcttggttcta

SEQ ID NO: 4364066 - DNA, 15 bp, Homo sapiens
tgagtgtaagtgtga

SEQ ID NO: 4364067 - DNA, 22 bp, Homo sapiens
tgataatacttgacctctgtga

SEQ ID NO: 4364068 - DNA, 22 bp, Homo sapiens
tgatattccatgaatgtatcag

SEQ ID NO: 4364069 - DNA, 15 bp, Homo sapiens
tgatcaataaaatgt

SEQ ID NO: 4364070 - DNA, 19 bp, Homo sapiens
tgatcaataaaatgtgatt

SEQ ID NO: 4364071 - DNA, 21 bp, Homo sapiens
tgatcaataaaatgtgatttt

SEQ ID NO: 4364072 - DNA, 14 bp, Homo sapiens
tgatgcaatataag

SEQ ID NO: 4364073 - DNA, 19 bp, Homo sapiens
tgatgtaaaaaatattaaa

SEQ ID NO: 4364074 - DNA, 21 bp, Homo sapiens
tgatgttagaagaagaggaag

SEQ ID NO: 4364075 - DNA, 22 bp, Homo sapiens
tgattaatatgcaagtgaacaa

SEQ ID NO: 4364076 - DNA, 19 bp, Homo sapiens
tgattcaaattgctgcttg

SEQ ID NO: 4364077 - DNA, 18 bp, Homo sapiens
tgatttcaggatactctg

SEQ ID NO: 4364078 - DNA, 23 bp, Homo sapiens
tgatttcaggatactctgtcaga

SEQ ID NO: 4364079 - DNA, 20 bp, Homo sapiens
tgcaataatttgtacaatgg

SEQ ID NO: 4364080 - DNA, 16 bp, Homo sapiens
tgcaatataagcataa

SEQ ID NO: 4364081 - DNA, 16 bp, Homo sapiens
tgcacacaggacagcg

SEQ ID NO: 4364082 - DNA, 19 bp, Homo sapiens
tgcacactagcctctccag

SEQ ID NO: 4364083 - DNA, 21 bp, Homo sapiens
tgcacactagcctctccagga

SEQ ID NO: 4364084 - DNA, 20 bp, Homo sapiens
tgcacccacctgttttctga

SEQ ID NO: 4364085 - DNA, 22 bp, Homo sapiens
tgcacccacctgttttctgaaa

SEQ ID NO: 4364086 - DNA, 15 bp, Homo sapiens
tgcacctccccaaag

SEQ ID NO: 4364087 - DNA, 14 bp, Homo sapiens
tgcactgatgttgt

SEQ ID NO: 4364088 - DNA, 18 bp, Homo sapiens
tgcagacagtctgttatg

SEQ ID NO: 4364089 - DNA, 21 bp, Homo sapiens
tgcagacagtctgttatgcac

SEQ ID NO: 4364090 - DNA, 22 bp, Homo sapiens
tgcagcatgacctgtgaccagc

SEQ ID NO: 4364091 - DNA, 20 bp, Homo sapiens
tgcagtgtggagttcacctt

SEQ ID NO: 4364092 - DNA, 21 bp, Homo sapiens
tgcagtgtggagttcaccttg

SEQ ID NO: 4364093 - DNA, 23 bp, Homo sapiens
tgcagttttttggaagaaaatat

SEQ ID NO: 4364094 - DNA, 16 bp, Homo sapiens
tgcatactcaaggtga

SEQ ID NO: 4364095 - DNA, 18 bp, Homo sapiens
tgcatactttgacaagga

SEQ ID NO: 4364096 - DNA, 19 bp, Homo sapiens
tgcatactttgacaaggaa

SEQ ID NO: 4364097 - DNA, 20 bp, Homo sapiens
tgcatactttgacaaggaaa

SEQ ID NO: 4364098 - DNA, 14 bp, Homo sapiens
tgcatgtacttgaa

SEQ ID NO: 4364099 - DNA, 19 bp, Homo sapiens
tgcattagaaatagacagt

SEQ ID NO: 4364100 - DNA, 20 bp, Homo sapiens
tgcattagaaatagacagta

SEQ ID NO: 4364101 - DNA, 22 bp, Homo sapiens
tgcattagaaatagacagtata

SEQ ID NO: 4364102 - DNA, 22 bp, Homo sapiens
tgcattatatcaaatctaccac

SEQ ID NO: 4364103 - DNA, 20 bp, Homo sapiens
tgccaagggggtgactggaa

SEQ ID NO: 4364104 - DNA, 20 bp, Homo sapiens
tgccacacagagtggtcttt

SEQ ID NO: 4364105 - DNA, 19 bp, Homo sapiens
tgccacatggtgtctccca

SEQ ID NO: 4364106 - DNA, 17 bp, Homo sapiens
tgccacccaccagggcg

SEQ ID NO: 4364107 - DNA, 16 bp, Homo sapiens
tgccataatcagaaca

SEQ ID NO: 4364108 - DNA, 22 bp, Homo sapiens
tacaatcatggtcaagttccca

SEQ ID NO: 4364109 - DNA, 13 bp, Homo sapiens
tacaatggtttat

SEQ ID NO: 4364110 - DNA, 17 bp, Homo sapiens
tacaatggtttattccc

SEQ ID NO: 4364111 - DNA, 23 bp, Homo sapiens
tacaatggtttattcccaagtat

SEQ ID NO: 4364112 - DNA, 22 bp, Homo sapiens
tacaccaatttggtaaaaatgc

SEQ ID NO: 4364113 - DNA, 18 bp, Homo sapiens
tacactgaatatttatat

SEQ ID NO: 4364114 - DNA, 17 bp, Homo sapiens
tacactgaatggaaata

SEQ ID NO: 4364115 - DNA, 15 bp, Homo sapiens
tacatcagaagtttg

SEQ ID NO: 4364116 - DNA, 14 bp, Homo sapiens
tacattgtcctgta

SEQ ID NO: 4364117 - DNA, 16 bp, Homo sapiens
tacattgtcctgtagc

SEQ ID NO: 4364118 - DNA, 12 bp, Homo sapiens
tacatttaggat

SEQ ID NO: 4364119 - DNA, 22 bp, Homo sapiens
taccaaacagcttaaattcttc

SEQ ID NO: 4364120 - DNA, 12 bp, Homo sapiens
tacccacccaga

SEQ ID NO: 4364121 - DNA, 17 bp, Homo sapiens
taccctaaccaagttcc

SEQ ID NO: 4364122 - DNA, 22 bp, Homo sapiens
tactactgtaagagacatgaat

SEQ ID NO: 4364123 - DNA, 19 bp, Homo sapiens
tactattgctcataatgac

SEQ ID NO: 4364124 - DNA, 21 bp, Homo sapiens
tactattgctcataatgactt

SEQ ID NO: 4364125 - DNA, 22 bp, Homo sapiens
tactcaacccattgttgtcaag

SEQ ID NO: 4364126 - DNA, 21 bp, Homo sapiens
tactcacagctgaagaaaatg

SEQ ID NO: 4364127 - DNA, 17 bp, Homo sapiens
tacttttcacactgtct

SEQ ID NO: 4364128 - DNA, 20 bp, Homo sapiens
tacttttcacactgtcttcc

SEQ ID NO: 4364129 - DNA, 21 bp, Homo sapiens
tacttttcacactgtcttccc

SEQ ID NO: 4364130 - DNA, 13 bp, Homo sapiens
tagaaaggcagcc

SEQ ID NO: 4364131 - DNA, 14 bp, Homo sapiens
tagaatatattatc

SEQ ID NO: 4364132 - DNA, 15 bp, Homo sapiens
tagagacccccaggc

SEQ ID NO: 4364133 - DNA, 23 bp, Homo sapiens
tagagtcatctccatcagctgta

SEQ ID NO: 4364134 - DNA, 21 bp, Homo sapiens
tagcaatccatgttagttttt

SEQ ID NO: 4364135 - DNA, 12 bp, Homo sapiens
tagcccagtccc

SEQ ID NO: 4364136 - DNA, 19 bp, Homo sapiens
tagctttaaaaccacagct

SEQ ID NO: 4364137 - DNA, 17 bp, Homo sapiens
taggaagtgtaacagct

SEQ ID NO: 4364138 - DNA, 20 bp, Homo sapiens
taggaagtgtaacagctgag

SEQ ID NO: 4364139 - DNA, 22 bp, Homo sapiens
taggaagtgtaacagctgaggt

SEQ ID NO: 4364140 - DNA, 13 bp, Homo sapiens
taggcctgggtgc

SEQ ID NO: 4364141 - DNA, 11 bp, Homo sapiens
taggctctgca

SEQ ID NO: 4364142 - DNA, 20 bp, Homo sapiens
taggctctgcacagatggat

SEQ ID NO: 4364143 - DNA, 23 bp, Homo sapiens
tagggaaaccttggagaggagag

SEQ ID NO: 4364144 - DNA, 18 bp, Homo sapiens
tagggcctgcatggagaa

SEQ ID NO: 4364145 - DNA, 15 bp, Homo sapiens
tagtaatactgtctt

SEQ ID NO: 4364146 - DNA, 19 bp, Homo sapiens
tagtgatcaaattgtgcag

SEQ ID NO: 4364147 - DNA, 13 bp, Homo sapiens
tagttttaaaata

SEQ ID NO: 4364148 - DNA, 17 bp, Homo sapiens
tagttttaaaatactat

SEQ ID NO: 4364149 - DNA, 15 bp, Homo sapiens
tagtttttatatgtt

SEQ ID NO: 4364150 - DNA, 17 bp, Homo sapiens
tataaacttaaaataaa

SEQ ID NO: 4364151 - DNA, 13 bp, Homo sapiens
tataaactttaga

SEQ ID NO: 4364152 - DNA, 12 bp, Homo sapiens
tataacttctgt

SEQ ID NO: 4364153 - DNA, 15 bp, Homo sapiens
tataatattttatct

SEQ ID NO: 4364154 - DNA, 14 bp, Homo sapiens
tatacccacccaga

SEQ ID NO: 4364155 - DNA, 15 bp, Homo sapiens
tatacccacccagaa

SEQ ID NO: 4364156 - DNA, 14 bp, Homo sapiens
tatacctggtttac

SEQ ID NO: 4364157 - DNA, 23 bp, Homo sapiens
tatagcaatccatgttagttttt

SEQ ID NO: 4364158 - DNA, 14 bp, Homo sapiens
tataggtcactcct

SEQ ID NO: 4364159 - DNA, 17 bp, Homo sapiens
tatagttccttgcctta

SEQ ID NO: 4364160 - DNA, 23 bp, Homo sapiens
tatagttccttgccttaataaat

SEQ ID NO: 4364161 - DNA, 13 bp, Homo sapiens
tatatagttcctt

SEQ ID NO: 4364162 - DNA, 18 bp, Homo sapiens
tatatagttccttgcctt

SEQ ID NO: 4364163 - DNA, 19 bp, Homo sapiens
tatatagttccttgcctta

SEQ ID NO: 4364164 - DNA, 17 bp, Homo sapiens
tatatgccgtataaaag

SEQ ID NO: 4364165 - DNA, 18 bp, Homo sapiens
tatatgccgtataaaaga

SEQ ID NO: 4364166 - DNA, 13 bp, Homo sapiens
tatatttgtcttc

SEQ ID NO: 4364167 - DNA, 14 bp, Homo sapiens
tatatttgtcttcc

SEQ ID NO: 4364168 - DNA, 15 bp, Homo sapiens
tatatttttcacagt

SEQ ID NO: 4364169 - DNA, 18 bp, Homo sapiens
tatcacattaatctcaaa

SEQ ID NO: 4364170 - DNA, 20 bp, Homo sapiens
tatcacattaatctcaaaga

SEQ ID NO: 4364171 - DNA, 16 bp, Homo sapiens
tatcactctaatataa

SEQ ID NO: 4364172 - DNA, 19 bp, Homo sapiens
tatcattccaattctaaat

SEQ ID NO: 4364173 - DNA, 16 bp, Homo sapiens
tatgaacagctgtgtc

SEQ ID NO: 4364174 - DNA, 22 bp, Homo sapiens
tatgaataccaggatagcttta

SEQ ID NO: 4364175 - DNA, 14 bp, Homo sapiens
tatgacccacactg

SEQ ID NO: 4364176 - DNA, 15 bp, Homo sapiens
tatgacccacactgc

SEQ ID NO: 4364177 - DNA, 17 bp, Homo sapiens
tatgatgttagaagaag

SEQ ID NO: 4364178 - DNA, 19 bp, Homo sapiens
tatgcccggcgccgggcac

SEQ ID NO: 4364179 - DNA, 14 bp, Homo sapiens
tatgccttaagcag

SEQ ID NO: 4364180 - DNA, 15 bp, Homo sapiens
tatgctttccctgag

SEQ ID NO: 4364181 - DNA, 16 bp, Homo sapiens
tatgctttccctgagg

SEQ ID NO: 4364182 - DNA, 19 bp, Homo sapiens
tatgtgtgtgtatgtttgc

SEQ ID NO: 4364183 - DNA, 20 bp, Homo sapiens
tattaaagatatcaatacta

SEQ ID NO: 4364184 - DNA, 22 bp, Homo sapiens
tattatcacattaatctcaaag

SEQ ID NO: 4364185 - DNA, 19 bp, Homo sapiens
tattatgcattatatcaaa

SEQ ID NO: 4364186 - DNA, 22 bp, Homo sapiens
tattccatgaatgtatcaggaa

SEQ ID NO: 4364187 - DNA, 15 bp, Homo sapiens
tattcccaagtatgc

SEQ ID NO: 4364188 - DNA, 18 bp, Homo sapiens
tattcccaagtatgcctt

SEQ ID NO: 4364189 - DNA, 20 bp, Homo sapiens
tattcccaagtatgccttaa

SEQ ID NO: 4364190 - DNA, 23 bp, Homo sapiens
tattctctttaccttctaaaagc

SEQ ID NO: 4364191 - DNA, 18 bp, Homo sapiens
tattctttgtgttgataa

SEQ ID NO: 4364192 - DNA, 15 bp, Homo sapiens
tatttatatttcact

SEQ ID NO: 4364193 - DNA, 20 bp, Homo sapiens
tatttattgcattgctggta

SEQ ID NO: 4364194 - DNA, 16 bp, Homo sapiens
tattttttaaggcaaa

SEQ ID NO: 4364195 - DNA, 18 bp, Homo sapiens
tcaaaagcaaatgagatc

SEQ ID NO: 4364196 - DNA, 15 bp, Homo sapiens
tcaaagagattcgaa

SEQ ID NO: 4364197 - DNA, 15 bp, Homo sapiens
tcaacatgttactga

SEQ ID NO: 4364198 - DNA, 19 bp, Homo sapiens
tcaacatgttactgaccag

SEQ ID NO: 4364199 - DNA, 21 bp, Homo sapiens
tcaacatgttactgaccagca

SEQ ID NO: 4364200 - DNA, 16 bp, Homo sapiens
tcaaggaagaagaaat

SEQ ID NO: 4364201 - DNA, 13 bp, Homo sapiens
tcaagttcccaac

SEQ ID NO: 4364202 - DNA, 23 bp, Homo sapiens
tcaagttcccaactgagtcatct

SEQ ID NO: 4364203 - DNA, 18 bp, Homo sapiens
tcaataaaatgtgatttt

SEQ ID NO: 4364204 - DNA, 19 bp, Homo sapiens
tcaatagtaaaagataaca

SEQ ID NO: 4364205 - DNA, 15 bp, Homo sapiens
tcacactgtcttccc

SEQ ID NO: 4364206 - DNA, 18 bp, Homo sapiens
tcacagctgaagaaaatg

SEQ ID NO: 4364207 - DNA, 15 bp, Homo sapiens
tcacagtccaaccag

SEQ ID NO: 4364208 - DNA, 15 bp, Homo sapiens
tcacatagatgtccc

SEQ ID NO: 4364209 - DNA, 18 bp, Homo sapiens
tcacattaatctcaaaga

SEQ ID NO: 4364210 - DNA, 20 bp, Homo sapiens
tcacattaatctcaaagaga

SEQ ID NO: 4364211 - DNA, 15 bp, Homo sapiens
tcacccctgtttctg

SEQ ID NO: 4364212 - DNA, 14 bp, Homo sapiens
tcacctctgaggac

SEQ ID NO: 4364213 - DNA, 20 bp, Homo sapiens
tcactatttttatttatatt

SEQ ID NO: 4364214 - DNA, 17 bp, Homo sapiens
tcactccaccatcccca

SEQ ID NO: 4364215 - DNA, 12 bp, Homo sapiens
tcactcctgggg

SEQ ID NO: 4364216 - DNA, 20 bp, Homo sapiens
tcactcctggggcctcttgg

SEQ ID NO: 4364217 - DNA, 11 bp, Homo sapiens
tcactgggtgg

SEQ ID NO: 4364218 - DNA, 18 bp, Homo sapiens
tcactgggtggggtgagg

SEQ ID NO: 4364219 - DNA, 20 bp, Homo sapiens
tcactgttcgtcactcaaat

SEQ ID NO: 4364220 - DNA, 11 bp, Homo sapiens
tcacttgccac

SEQ ID NO: 4364221 - DNA, 17 bp, Homo sapiens
tcactttcacatagatg

SEQ ID NO: 4364222 - DNA, 18 bp, Homo sapiens
tcactttcacatagatgt

SEQ ID NO: 4364223 - DNA, 19 bp, Homo sapiens
tcactttcacatagatgtc

SEQ ID NO: 4364224 - DNA, 21 bp, Homo sapiens
tcactttgaaaagttggaagg

SEQ ID NO: 4364225 - DNA, 22 bp, Homo sapiens
tcactttgaaaagttggaagga

SEQ ID NO: 4364226 - DNA, 14 bp, Homo sapiens
tcagaacacacttt

SEQ ID NO: 4364227 - DNA, 16 bp, Homo sapiens
tcagagctttgtcact

SEQ ID NO: 4364228 - DNA, 17 bp, Homo sapiens
tcagagctttgtcactt

SEQ ID NO: 4364229 - DNA, 21 bp, Homo sapiens
tcagagctttgtcacttgcca

SEQ ID NO: 4364230 - DNA, 22 bp, Homo sapiens
tcagagctttgtcacttgccac

SEQ ID NO: 4364231 - DNA, 16 bp, Homo sapiens
tcagatatatttttca

SEQ ID NO: 4364232 - DNA, 15 bp, Homo sapiens
tcagatgggaagaca

SEQ ID NO: 4364233 - DNA, 22 bp, Homo sapiens
tcagcagaacctgcacacagga

SEQ ID NO: 4364234 - DNA, 14 bp, Homo sapiens
tcagccccgcctgt

SEQ ID NO: 4364235 - DNA, 16 bp, Homo sapiens
tcagccccgcctgtca

SEQ ID NO: 4364236 - DNA, 20 bp, Homo sapiens
tcagccccgcctgtcacaat

SEQ ID NO: 4364237 - DNA, 19 bp, Homo sapiens
tcaggaaatatatatgtgt

SEQ ID NO: 4364238 - DNA, 20 bp, Homo sapiens
tcaggaaatatatatgtgtg

SEQ ID NO: 4364239 - DNA, 23 bp, Homo sapiens
tcaggaatggggggcgggccagg

SEQ ID NO: 4364240 - DNA, 15 bp, Homo sapiens
tcaggcataggcctg

SEQ ID NO: 4364241 - DNA, 18 bp, Homo sapiens
tcaggcataggcctgggt

SEQ ID NO: 4364242 - DNA, 20 bp, Homo sapiens
tcaggcataggcctgggtgc

SEQ ID NO: 4364243 - DNA, 22 bp, Homo sapiens
tcaggcataggcctgggtgctg

SEQ ID NO: 4364244 - DNA, 18 bp, Homo sapiens
tcagtgtacacgtctgga

SEQ ID NO: 4364245 - DNA, 17 bp, Homo sapiens
tcatagcatagccagca

SEQ ID NO: 4364246 - DNA, 22 bp, Homo sapiens
tcatcggagttgacagtgaaac

SEQ ID NO: 4364247 - DNA, 16 bp, Homo sapiens
tcatctccatcagctg

SEQ ID NO: 4364248 - DNA, 22 bp, Homo sapiens
tcatctgtaagagcttgctcca

SEQ ID NO: 4364249 - DNA, 19 bp, Homo sapiens
tcatgcccagctctctgac

SEQ ID NO: 4364250 - DNA, 20 bp, Homo sapiens
tcatgcccagctctctgacg

SEQ ID NO: 4364251 - DNA, 16 bp, Homo sapiens
tcatggtactacccca

SEQ ID NO: 4364252 - DNA, 13 bp, Homo sapiens
tcatgttcctcaa

SEQ ID NO: 4364253 - DNA, 15 bp, Homo sapiens
tccaatcctcactgg

SEQ ID NO: 4364254 - DNA, 23 bp, Homo sapiens
tccaattctaaatccgacttgaa

SEQ ID NO: 4364255 - DNA, 13 bp, Homo sapiens
tccaccctgccaa

SEQ ID NO: 4364256 - DNA, 23 bp, Homo sapiens
tccaccttttaagttaatgaaat

SEQ ID NO: 4364257 - DNA, 15 bp, Homo sapiens
tccagcagtgaatgc

SEQ ID NO: 4364258 - DNA, 22 bp, Homo sapiens
tccaggaatgcctcctccctgg

SEQ ID NO: 4364259 - DNA, 17 bp, Homo sapiens
tccaggtggtgaatttt

SEQ ID NO: 4364260 - DNA, 18 bp, Homo sapiens
tccagtcatctgtaagag

SEQ ID NO: 4364261 - DNA, 15 bp, Homo sapiens
tccagtcatggtact

SEQ ID NO: 4364262 - DNA, 19 bp, Homo sapiens
tccagtcatggtactaccc

SEQ ID NO: 4364263 - DNA, 15 bp, Homo sapiens
tccagtgaacattcc

SEQ ID NO: 4364264 - DNA, 23 bp, Homo sapiens
tccatccccttcccccatcccta

SEQ ID NO: 4364265 - DNA, 20 bp, Homo sapiens
tccatcttgtggggccagga

SEQ ID NO: 4364266 - DNA, 19 bp, Homo sapiens
tccatgccccagctctgga

SEQ ID NO: 4364267 - DNA, 21 bp, Homo sapiens
tccattgatctgccaaatcgt

SEQ ID NO: 4364268 - DNA, 23 bp, Homo sapiens
tcccaaatgaaatactgccttgg

SEQ ID NO: 4364269 - DNA, 13 bp, Homo sapiens
tcccaacatggga

SEQ ID NO: 4364270 - DNA, 20 bp, Homo sapiens
tcccaagtatgccttaagca

SEQ ID NO: 4364271 - DNA, 18 bp, Homo sapiens
tcccacattagcttgtta

SEQ ID NO: 4364272 - DNA, 22 bp, Homo sapiens
tcccacccacccgccgcctccc

SEQ ID NO: 4364273 - DNA, 16 bp, Homo sapiens
tcccagcttcaaatgc

SEQ ID NO: 4364274 - DNA, 17 bp, Homo sapiens
tcccagcttcaaatgca

SEQ ID NO: 4364275 - DNA, 13 bp, Homo sapiens
tcccataaataaa

SEQ ID NO: 4364276 - DNA, 16 bp, Homo sapiens
tcccataaataaaagt

SEQ ID NO: 4364277 - DNA, 13 bp, Homo sapiens
tccccaccccacc

SEQ ID NO: 4364278 - DNA, 19 bp, Homo sapiens
tccccgaggagctgggccc

SEQ ID NO: 4364279 - DNA, 23 bp, Homo sapiens
tccccgaggagctgggcccctgc

SEQ ID NO: 4364280 - DNA, 20 bp, Homo sapiens
tccccgatgtcccctgcggg

SEQ ID NO: 4364281 - DNA, 23 bp, Homo sapiens
tcccctctcagaacatactgatt

SEQ ID NO: 4364282 - DNA, 20 bp, Homo sapiens
tcccgatgagggaaggagcc

SEQ ID NO: 4364283 - DNA, 18 bp, Homo sapiens
tccctcaactgaaggggt

SEQ ID NO: 4364284 - DNA, 18 bp, Homo sapiens
tccctcacccatcctaga

SEQ ID NO: 4364285 - DNA, 16 bp, Homo sapiens
tccctcccctctcaga

SEQ ID NO: 4364286 - DNA, 16 bp, Homo sapiens
tccctctctcataccc

SEQ ID NO: 4364287 - DNA, 17 bp, Homo sapiens
tccctggggaccaggag

SEQ ID NO: 4364288 - DNA, 20 bp, Homo sapiens
tccctggggaccaggagcta

SEQ ID NO: 4364289 - DNA, 21 bp, Homo sapiens
tccctggggaccaggagctag

SEQ ID NO: 4364290 - DNA, 20 bp, Homo sapiens
tccggcccagtgccactgcc

SEQ ID NO: 4364291 - DNA, 23 bp, Homo sapiens
tccgtgagttgggggagggaaga

SEQ ID NO: 4364292 - DNA, 12 bp, Homo sapiens
tccgttaggaat

SEQ ID NO: 4364293 - DNA, 13 bp, Homo sapiens
tcctcactgggtg

SEQ ID NO: 4364294 - DNA, 15 bp, Homo sapiens
tcctcactgggtggg

SEQ ID NO: 4364295 - DNA, 13 bp, Homo sapiens
tcctcctgctcct

SEQ ID NO: 4364296 - DNA, 18 bp, Homo sapiens
tcctgaatatcagtcact

SEQ ID NO: 4364297 - DNA, 21 bp, Homo sapiens
tcctgaatatcagtcactgtt

SEQ ID NO: 4364298 - DNA, 19 bp, Homo sapiens
tcctgactcaacatgttac

SEQ ID NO: 4364299 - DNA, 14 bp, Homo sapiens
tcctgcaggaaata

SEQ ID NO: 4364300 - DNA, 21 bp, Homo sapiens
tcctgcaggaaatataaactt

SEQ ID NO: 4364301 - DNA, 16 bp, Homo sapiens
tcctgggtgggtgggg

SEQ ID NO: 4364302 - DNA, 13 bp, Homo sapiens
tcctggtctgtga

SEQ ID NO: 4364303 - DNA, 14 bp, Homo sapiens
tcctggtctgtgaa

SEQ ID NO: 4364304 - DNA, 16 bp, Homo sapiens
tcctgtacactgaata

SEQ ID NO: 4364305 - DNA, 15 bp, Homo sapiens
tccttaaactgtgtg

SEQ ID NO: 4364306 - DNA, 17 bp, Homo sapiens
tccttaaactgtgtgga

SEQ ID NO: 4364307 - DNA, 14 bp, Homo sapiens
tccttccatcttgt

SEQ ID NO: 4364308 - DNA, 17 bp, Homo sapiens
tccttcccctttcccca

SEQ ID NO: 4364309 - DNA, 12 bp, Homo sapiens
tccttgccttaa

SEQ ID NO: 4364310 - DNA, 14 bp, Homo sapiens
tccttgctgcagct

SEQ ID NO: 4364311 - DNA, 20 bp, Homo sapiens
tcgatgccataatcagaaca

SEQ ID NO: 4364312 - DNA, 14 bp, Homo sapiens
tcgcattaagcaca

SEQ ID NO: 4364313 - DNA, 16 bp, Homo sapiens
tcgcattaagcacaca

SEQ ID NO: 4364314 - DNA, 17 bp, Homo sapiens
tcgcattaagcacacac

SEQ ID NO: 4364315 - DNA, 22 bp, Homo sapiens
tcgggacatggttgggggaatg

SEQ ID NO: 4364316 - DNA, 19 bp, Homo sapiens
tcgttatagagagcaattt

SEQ ID NO: 4364317 - DNA, 12 bp, Homo sapiens
tcgttggagagc

SEQ ID NO: 4364318 - DNA, 18 bp, Homo sapiens
tcgttggagagcagcagg

SEQ ID NO: 4364319 - DNA, 12 bp, Homo sapiens
tctaaaagccat

SEQ ID NO: 4364320 - DNA, 23 bp, Homo sapiens
tctaaaggtaccaaacaaggaag

SEQ ID NO: 4364321 - DNA, 17 bp, Homo sapiens
tctaagtgtaaatgtta

SEQ ID NO: 4364322 - DNA, 14 bp, Homo sapiens
tctaggagtattta

SEQ ID NO: 4364323 - DNA, 21 bp, Homo sapiens
tctatatagttccttgcctta

SEQ ID NO: 4364324 - DNA, 14 bp, Homo sapiens
tctatatttgtctt

SEQ ID NO: 4364325 - DNA, 18 bp, Homo sapiens
tctatatttgtcttccga

SEQ ID NO: 4364326 - DNA, 14 bp, Homo sapiens
tctatcattccaat

SEQ ID NO: 4364327 - DNA, 17 bp, Homo sapiens
tctcaaagagattcgaa

SEQ ID NO: 4364328 - DNA, 13 bp, Homo sapiens
tctcagcctccca

SEQ ID NO: 4364329 - DNA, 14 bp, Homo sapiens
tctcagcctcccac

SEQ ID NO: 4364330 - DNA, 15 bp, Homo sapiens
tctcagcctcccaca

SEQ ID NO: 4364331 - DNA, 11 bp, Homo sapiens
tctcaggcagc

SEQ ID NO: 4364332 - DNA, 22 bp, Homo sapiens
tctcaggcagcaccacactggg

SEQ ID NO: 4364333 - DNA, 13 bp, Homo sapiens
tctcagtttcact

SEQ ID NO: 4364334 - DNA, 16 bp, Homo sapiens
tctcataccctccctc

SEQ ID NO: 4364335 - DNA, 14 bp, Homo sapiens
tctcatgaagcagg

SEQ ID NO: 4364336 - DNA, 16 bp, Homo sapiens
tctcatgaagcaggag

SEQ ID NO: 4364337 - DNA, 19 bp, Homo sapiens
tctccagtcatctgtaaga

SEQ ID NO: 4364338 - DNA, 17 bp, Homo sapiens
tctccctcaactgaagg

SEQ ID NO: 4364339 - DNA, 18 bp, Homo sapiens
tctccctcccctctcaga

SEQ ID NO: 4364340 - DNA, 24 bp, Homo sapiens
tctccctgcacgcattttctctgt

SEQ ID NO: 4364341 - DNA, 23 bp, Homo sapiens
tctcctgtgcatgggtgaaggga

SEQ ID NO: 4364342 - DNA, 18 bp, Homo sapiens
tctcgcagcctgaagcct

SEQ ID NO: 4364343 - DNA, 23 bp, Homo sapiens
tctctgacgcttgtgacagtgcc

SEQ ID NO: 4364344 - DNA, 19 bp, Homo sapiens
tctcttctgaataaagcaa

SEQ ID NO: 4364345 - DNA, 17 bp, Homo sapiens
tctgaaacacacgagca

SEQ ID NO: 4364346 - DNA, 20 bp, Homo sapiens
tctgacgcttgtgacagtgc

SEQ ID NO: 4364347 - DNA, 19 bp, Homo sapiens
tctgatattccatgaatgt

SEQ ID NO: 4364348 - DNA, 13 bp, Homo sapiens
tctgattacatgt

SEQ ID NO: 4364349 - DNA, 13 bp, Homo sapiens
tctgatttcagga

SEQ ID NO: 4364350 - DNA, 13 bp, Homo sapiens
tctgcacagatgg

SEQ ID NO: 4364351 - DNA, 15 bp, Homo sapiens
tctgcacagatggat

SEQ ID NO: 4364352 - DNA, 20 bp, Homo sapiens
tctgcagcatgacctgtgac

SEQ ID NO: 4364353 - DNA, 16 bp, Homo sapiens
accccaccccaccccc

SEQ ID NO: 4364354 - DNA, 17 bp, Homo sapiens
acccccaggcctgtcca

SEQ ID NO: 4364355 - DNA, 15 bp, Homo sapiens
acccctgtagggaaa

SEQ ID NO: 4364356 - DNA, 16 bp, Homo sapiens
acccgccgcctcccac

SEQ ID NO: 4364357 - DNA, 17 bp, Homo sapiens
acccgtggggtgctgcc

SEQ ID NO: 4364358 - DNA, 16 bp, Homo sapiens
accctaaccaagttcc

SEQ ID NO: 4364359 - DNA, 20 bp, Homo sapiens
accctcaggcataggcctgg

SEQ ID NO: 4364360 - DNA, 22 bp, Homo sapiens
accctcaggcataggcctgggt

SEQ ID NO: 4364361 - DNA, 18 bp, Homo sapiens
accctccggccagcgagt

SEQ ID NO: 4364362 - DNA, 16 bp, Homo sapiens
accctgtccggcccag

SEQ ID NO: 4364363 - DNA, 16 bp, Homo sapiens
accctttggccccact

SEQ ID NO: 4364364 - DNA, 15 bp, Homo sapiens
acctaagtcaggtaa

SEQ ID NO: 4364365 - DNA, 16 bp, Homo sapiens
acctcatgcccagctc

SEQ ID NO: 4364366 - DNA, 21 bp, Homo sapiens
acctcatgcccagctctctga

SEQ ID NO: 4364367 - DNA, 12 bp, Homo sapiens
acctccccaaag

SEQ ID NO: 4364368 - DNA, 17 bp, Homo sapiens
acctctgtgaccaactg

SEQ ID NO: 4364369 - DNA, 13 bp, Homo sapiens
acctgcacacagg

SEQ ID NO: 4364370 - DNA, 14 bp, Homo sapiens
acctgcacacagga

SEQ ID NO: 4364371 - DNA, 18 bp, Homo sapiens
acctgcacacaggacagc

SEQ ID NO: 4364372 - DNA, 19 bp, Homo sapiens
acctgcacacaggacagcg

SEQ ID NO: 4364373 - DNA, 21 bp, Homo sapiens
acctggtttacttctttagca

SEQ ID NO: 4364374 - DNA, 15 bp, Homo sapiens
accttttaagttaat

SEQ ID NO: 4364375 - DNA, 19 bp, Homo sapiens
accttttaagttaatgaaa

SEQ ID NO: 4364376 - DNA, 21 bp, Homo sapiens
accttttaagttaatgaaata

SEQ ID NO: 4364377 - DNA, 20 bp, Homo sapiens
acgacaatagctttaccctc

SEQ ID NO: 4364378 - DNA, 23 bp, Homo sapiens
acgacacctagctctaagagcaa

SEQ ID NO: 4364379 - DNA, 14 bp, Homo sapiens
acggtaagtgttct

SEQ ID NO: 4364380 - DNA, 19 bp, Homo sapiens
acggtgggcatttgtgagg

SEQ ID NO: 4364381 - DNA, 17 bp, Homo sapiens
acgtgacagtgcctggg

SEQ ID NO: 4364382 - DNA, 16 bp, Homo sapiens
acgtgattaatatgca

SEQ ID NO: 4364383 - DNA, 14 bp, Homo sapiens
acgtttttggaaaa

SEQ ID NO: 4364384 - DNA, 15 bp, Homo sapiens
actaaactaacaaga

SEQ ID NO: 4364385 - DNA, 14 bp, Homo sapiens
actaacaagattaa

SEQ ID NO: 4364386 - DNA, 19 bp, Homo sapiens
actaattgagcctgtgcct

SEQ ID NO: 4364387 - DNA, 15 bp, Homo sapiens
actagcctctccagg

SEQ ID NO: 4364388 - DNA, 17 bp, Homo sapiens
aatatttatatttcact

SEQ ID NO: 4364389 - DNA, 18 bp, Homo sapiens
aatatttatatttcacta

SEQ ID NO: 4364390 - DNA, 12 bp, Homo sapiens
aatatttcttca

SEQ ID NO: 4364391 - DNA, 22 bp, Homo sapiens
aatatttttaaatggacaatgg

SEQ ID NO: 4364392 - DNA, 16 bp, Homo sapiens
aatcaaagaacagatg

SEQ ID NO: 4364393 - DNA, 22 bp, Homo sapiens
aatcagcaacttctagcatata

SEQ ID NO: 4364394 - DNA, 12 bp, Homo sapiens
aatcaggaaaaa

SEQ ID NO: 4364395 - DNA, 20 bp, Homo sapiens
aatcctttttctttataaac

SEQ ID NO: 4364396 - DNA, 15 bp, Homo sapiens
aatctatatttgtct

SEQ ID NO: 4364397 - DNA, 12 bp, Homo sapiens
aatgaaaatcag

SEQ ID NO: 4364398 - DNA, 11 bp, Homo sapiens
aatgaaataaa

SEQ ID NO: 4364399 - DNA, 19 bp, Homo sapiens
aatgaaataaaatttgaaa

SEQ ID NO: 4364400 - DNA, 19 bp, Homo sapiens
aatgaatttgctaaataca

SEQ ID NO: 4364401 - DNA, 17 bp, Homo sapiens
aatgcacactagcctct

SEQ ID NO: 4364402 - DNA, 15 bp, Homo sapiens
aatgcctcctccctg

SEQ ID NO: 4364403 - DNA, 14 bp, Homo sapiens
aatggaaataaata

SEQ ID NO: 4364404 - DNA, 17 bp, Homo sapiens
aatggccatgcaggagg

SEQ ID NO: 4364405 - DNA, 18 bp, Homo sapiens
aatggccatgcaggaggt

SEQ ID NO: 4364406 - DNA, 21 bp, Homo sapiens
aatggccatgcaggaggtgga

SEQ ID NO: 4364407 - DNA, 23 bp, Homo sapiens
aatggcgtctgctctggtggctt

SEQ ID NO: 4364408 - DNA, 21 bp, Homo sapiens
aatgtacaattttatataatt

SEQ ID NO: 4364409 - DNA, 16 bp, Homo sapiens
aatgtacgctgctgca

SEQ ID NO: 4364410 - DNA, 12 bp, Homo sapiens
aatgtagggcct

SEQ ID NO: 4364411 - DNA, 13 bp, Homo sapiens
aatgtatcaggaa

SEQ ID NO: 4364412 - DNA, 14 bp, Homo sapiens
aatgtatcaggaaa

SEQ ID NO: 4364413 - DNA, 15 bp, Homo sapiens
aatgtatcaggaaat

SEQ ID NO: 4364414 - DNA, 22 bp, Homo sapiens
aatgtattattctgcagcatga

SEQ ID NO: 4364415 - DNA, 16 bp, Homo sapiens
aatgtattttgcctct

SEQ ID NO: 4364416 - DNA, 18 bp, Homo sapiens
aatgtgggagcagcggtt

SEQ ID NO: 4364417 - DNA, 16 bp, Homo sapiens
aatgtgtttttctata

SEQ ID NO: 4364418 - DNA, 20 bp, Homo sapiens
aatgttgccttggaaacatt

SEQ ID NO: 4364419 - DNA, 12 bp, Homo sapiens
aaaaatgaaagc

SEQ ID NO: 4364420 - DNA, 14 bp, Homo sapiens
aaaaatgctgctct

SEQ ID NO: 4364421 - DNA, 17 bp, Homo sapiens
aaaacaagtgtataact

SEQ ID NO: 4364422 - DNA, 23 bp, Homo sapiens
aaaacatgtttaaatagcctaaa

SEQ ID NO: 4364423 - DNA, 16 bp, Homo sapiens
aaaaccacagctgggc

SEQ ID NO: 4364424 - DNA, 18 bp, Homo sapiens
aaaaccacagctgggcag

SEQ ID NO: 4364425 - DNA, 14 bp, Homo sapiens
aaaactgtactgtg

SEQ ID NO: 4364426 - DNA, 17 bp, Homo sapiens
aaaagccattattatga

SEQ ID NO: 4364427 - DNA, 23 bp, Homo sapiens
aaaagtgatcaataaaatgtgat

SEQ ID NO: 4364428 - DNA, 13 bp, Homo sapiens
aaaagttggaagg

SEQ ID NO: 4364429 - DNA, 22 bp, Homo sapiens
aaaatactatattaaattctga

SEQ ID NO: 4364430 - DNA, 15 bp, Homo sapiens
aaaatcagcaacttc

SEQ ID NO: 4364431 - DNA, 22 bp, Homo sapiens
aaaatgaaagcatgtctcaata

SEQ ID NO: 4364432 - DNA, 15 bp, Homo sapiens
aaaatgtattttgcc

SEQ ID NO: 4364433 - DNA, 12 bp, Homo sapiens
aaaatgtgattt

SEQ ID NO: 4364434 - DNA, 13 bp, Homo sapiens
aaaatgtgatttt

SEQ ID NO: 4364435 - DNA, 18 bp, Homo sapiens
aaaatgtgatttttctga

SEQ ID NO: 4364436 - DNA, 22 bp, Homo sapiens
aaacaagcgtttatttgaatgt

SEQ ID NO: 4364437 - DNA, 13 bp, Homo sapiens
aaacaaggaagcc

SEQ ID NO: 4364438 - DNA, 13 bp, Homo sapiens
aaacacccctctg

SEQ ID NO: 4364439 - DNA, 16 bp, Homo sapiens
aaacagcttaaattct

SEQ ID NO: 4364440 - DNA, 17 bp, Homo sapiens
aaacagcttaaattctt

SEQ ID NO: 4364441 - DNA, 11 bp, Homo sapiens
aaacaggacca

SEQ ID NO: 4364442 - DNA, 20 bp, Homo sapiens
aaaccacagctgggcagggt

SEQ ID NO: 4364443 - DNA, 11 bp, Homo sapiens
aaaccttggag

SEQ ID NO: 4364444 - DNA, 15 bp, Homo sapiens
aaacgtctattttgt

SEQ ID NO: 4364445 - DNA, 20 bp, Homo sapiens
aaacgtctattttgtatatt

SEQ ID NO: 4364446 - DNA, 14 bp, Homo sapiens
aaactacaaagtaa

SEQ ID NO: 4364447 - DNA, 18 bp, Homo sapiens
aaactacaaagtaaaatg

SEQ ID NO: 4364448 - DNA, 20 bp, Homo sapiens
aaactacaaagtaaaatgaa

SEQ ID NO: 4364449 - DNA, 15 bp, Homo sapiens
aaactattgagcctt

SEQ ID NO: 4364450 - DNA, 15 bp, Homo sapiens
aaactgctgcatact

SEQ ID NO: 4364451 - DNA, 17 bp, Homo sapiens
aaacttaaaactttgta

SEQ ID NO: 4364452 - DNA, 15 bp, Homo sapiens
aaagacaaaaatcaa

SEQ ID NO: 4364453 - DNA, 23 bp, Homo sapiens
aaagacaaaaatcaaagaacaga

SEQ ID NO: 4364454 - DNA, 14 bp, Homo sapiens
aaagagattcgaat

SEQ ID NO: 4364455 - DNA, 15 bp, Homo sapiens
aaagatcaccttgta

SEQ ID NO: 4364456 - DNA, 18 bp, Homo sapiens
aaagatcaccttgtattc

SEQ ID NO: 4364457 - DNA, 17 bp, Homo sapiens
aaagcatccctcaccca

SEQ ID NO: 4364458 - DNA, 24 bp, Homo sapiens
aaagcatccctcacccatcctaga

SEQ ID NO: 4364459 - DNA, 16 bp, Homo sapiens
aaagcccaacctcctg

SEQ ID NO: 4364460 - DNA, 13 bp, Homo sapiens
aaaggagccttga

SEQ ID NO: 4364461 - DNA, 21 bp, Homo sapiens
aaaggcgcagtgcttctctac

SEQ ID NO: 4364462 - DNA, 16 bp, Homo sapiens
aaaggtaccaaacaag

SEQ ID NO: 4364463 - DNA, 19 bp, Homo sapiens
aaaggtaccaaacaaggaa

SEQ ID NO: 4364464 - DNA, 22 bp, Homo sapiens
aaaggtgcctcatagcatagcc

SEQ ID NO: 4364465 - DNA, 23 bp, Homo sapiens
aaagtgatcaataaaatgtgatt

SEQ ID NO: 4364466 - DNA, 18 bp, Homo sapiens
aaagttggaaggatctgc

SEQ ID NO: 4364467 - DNA, 15 bp, Homo sapiens
aaataaaatttgaaa

SEQ ID NO: 4364468 - DNA, 15 bp, Homo sapiens
aaataaatagatgta

SEQ ID NO: 4364469 - DNA, 21 bp, Homo sapiens
aaataaatcatcctcatgtcc

SEQ ID NO: 4364470 - DNA, 13 bp, Homo sapiens
aaatactatatta

SEQ ID NO: 4364471 - DNA, 15 bp, Homo sapiens
aaatactatattaaa

SEQ ID NO: 4364472 - DNA, 19 bp, Homo sapiens
aaatagacagtatatttat

SEQ ID NO: 4364473 - DNA, 23 bp, Homo sapiens
aaatagcctaaatgatggtgctt

SEQ ID NO: 4364474 - DNA, 14 bp, Homo sapiens
aaatatttccttaa

SEQ ID NO: 4364475 - DNA, 12 bp, Homo sapiens
aaatcaactttt

SEQ ID NO: 4364476 - DNA, 15 bp, Homo sapiens
aaatcagcaacttct

SEQ ID NO: 4364477 - DNA, 18 bp, Homo sapiens
aaatcatcctcatgtcct

SEQ ID NO: 4364478 - DNA, 18 bp, Homo sapiens
aaatctatatttgtcttc

SEQ ID NO: 4364479 - DNA, 15 bp, Homo sapiens
aaatgaataatttcc

SEQ ID NO: 4364480 - DNA, 22 bp, Homo sapiens
aaatgccaagggggtgactgga

SEQ ID NO: 4364481 - DNA, 12 bp, Homo sapiens
aaatgctgctct

SEQ ID NO: 4364482 - DNA, 16 bp, Homo sapiens
aaatggcgtctgctct

SEQ ID NO: 4364483 - DNA, 17 bp, Homo sapiens
aaatggcgtctgctctg

SEQ ID NO: 4364484 - DNA, 20 bp, Homo sapiens
aaatggcgtctgctctggtg

SEQ ID NO: 4364485 - DNA, 21 bp, Homo sapiens
aaatggcgtctgctctggtgg

SEQ ID NO: 4364486 - DNA, 13 bp, Homo sapiens
aaatgtgattttt

SEQ ID NO: 4364487 - DNA, 15 bp, Homo sapiens
aaatgtgatttttct

SEQ ID NO: 4364488 - DNA, 16 bp, Homo sapiens
aaatgtgatttttctg

SEQ ID NO: 4364489 - DNA, 16 bp, Homo sapiens
aaatgtgtttttctat

SEQ ID NO: 4364490 - DNA, 21 bp, Homo sapiens
aaatgtgtttttctatatagt

SEQ ID NO: 4364491 - DNA, 23 bp, Homo sapiens
aaattcaggtacagaaaacatgt

SEQ ID NO: 4364492 - DNA, 18 bp, Homo sapiens
aaattcataaccaaagag

SEQ ID NO: 4364493 - DNA, 15 bp, Homo sapiens
aaattctgaatgcaa

SEQ ID NO: 4364494 - DNA, 15 bp, Homo sapiens
aaattgccttcagcc

SEQ ID NO: 4364495 - DNA, 15 bp, Homo sapiens
aaattgctgcttgga

SEQ ID NO: 4364496 - DNA, 23 bp, Homo sapiens
aaattgtgcagtactttgtgcat

SEQ ID NO: 4364497 - DNA, 21 bp, Homo sapiens
aaatttaagttaactgttgct

SEQ ID NO: 4364498 - DNA, 20 bp, Homo sapiens
aacaaaattgttcttgggag

SEQ ID NO: 4364499 - DNA, 20 bp, Homo sapiens
aacaaagtttacattgtcct

SEQ ID NO: 4364500 - DNA, 19 bp, Homo sapiens
aacaagatctttcaggaaa

SEQ ID NO: 4364501 - DNA, 20 bp, Homo sapiens
aacaatgtctcatgatgtaa

SEQ ID NO: 4364502 - DNA, 13 bp, Homo sapiens
aacacccctctgt

SEQ ID NO: 4364503 - DNA, 11 bp, Homo sapiens
aacagctgtgt

SEQ ID NO: 4364504 - DNA, 14 bp, Homo sapiens
aacagctgtgtctg

SEQ ID NO: 4364505 - DNA, 14 bp, Homo sapiens
aacagtaaagttaa

SEQ ID NO: 4364506 - DNA, 14 bp, Homo sapiens
aacatactgattgg

SEQ ID NO: 4364507 - DNA, 19 bp, Homo sapiens
aacatagtttaagttgatt

SEQ ID NO: 4364508 - DNA, 17 bp, Homo sapiens
aacatgacccagcctga

SEQ ID NO: 4364509 - DNA, 14 bp, Homo sapiens
aacatgcactgatg

SEQ ID NO: 4364510 - DNA, 19 bp, Homo sapiens
aacatgcactgatgttgtg

SEQ ID NO: 4364511 - DNA, 16 bp, Homo sapiens
aacatgggagggatca

SEQ ID NO: 4364512 - DNA, 20 bp, Homo sapiens
aacatgggagggatcagccc

SEQ ID NO: 4364513 - DNA, 17 bp, Homo sapiens
aacatgttactgaccag

SEQ ID NO: 4364514 - DNA, 20 bp, Homo sapiens
aacatgtttaaatagcctaa

SEQ ID NO: 4364515 - DNA, 14 bp, Homo sapiens
aacattcccagccc

SEQ ID NO: 4364516 - DNA, 14 bp, Homo sapiens
aacatttatgacct

SEQ ID NO: 4364517 - DNA, 22 bp, Homo sapiens
aacatttatgacctaagtcagg

SEQ ID NO: 4364518 - DNA, 21 bp, Homo sapiens
aaccaaagagaatcccacatt

SEQ ID NO: 4364519 - DNA, 16 bp, Homo sapiens
aaccctgttttatact

SEQ ID NO: 4364520 - DNA, 20 bp, Homo sapiens
aaccctgttttatactgtac

SEQ ID NO: 4364521 - DNA, 22 bp, Homo sapiens
aacccttgtgcctctcatcttt

SEQ ID NO: 4364522 - DNA, 19 bp, Homo sapiens
aacctactgcccacatttg

SEQ ID NO: 4364523 - DNA, 19 bp, Homo sapiens
aacctgcacacaggacagc

SEQ ID NO: 4364524 - DNA, 17 bp, Homo sapiens
aaccttggagaggagag

SEQ ID NO: 4364525 - DNA, 17 bp, Homo sapiens
aactattgagccttgca

SEQ ID NO: 4364526 - DNA, 21 bp, Homo sapiens
aactattgagccttgcatgta

SEQ ID NO: 4364527 - DNA, 15 bp, Homo sapiens
aactgaactgtgaac

SEQ ID NO: 4364528 - DNA, 19 bp, Homo sapiens
aactgaaggggtgcaccca

SEQ ID NO: 4364529 - DNA, 16 bp, Homo sapiens
aacttaaaactttgta

SEQ ID NO: 4364530 - DNA, 21 bp, Homo sapiens
aacttctagcatatagactat

SEQ ID NO: 4364531 - DNA, 20 bp, Homo sapiens
aacttgtctttttctggact

SEQ ID NO: 4364532 - DNA, 22 bp, Homo sapiens
aactttagagtagcatgagaga

SEQ ID NO: 4364533 - DNA, 23 bp, Homo sapiens
aagaaagaattcctgcagcagtt

SEQ ID NO: 4364534 - DNA, 13 bp, Homo sapiens
aagaaatagcaga

SEQ ID NO: 4364535 - DNA, 17 bp, Homo sapiens
aagaaatagcagagcct

SEQ ID NO: 4364536 - DNA, 22 bp, Homo sapiens
aagaaatgattcaaattgctgc

SEQ ID NO: 4364537 - DNA, 21 bp, Homo sapiens
aagaaattcaggtacagaaaa

SEQ ID NO: 4364538 - DNA, 20 bp, Homo sapiens
aagaagaggaagaaattcag

SEQ ID NO: 4364539 - DNA, 16 bp, Homo sapiens
aagaattcctgcagca

SEQ ID NO: 4364540 - DNA, 13 bp, Homo sapiens
aagacaaaaatca

SEQ ID NO: 4364541 - DNA, 14 bp, Homo sapiens
aagacaaaaatcaa

SEQ ID NO: 4364542 - DNA, 18 bp, Homo sapiens
aagacatgaatgcacact

SEQ ID NO: 4364543 - DNA, 23 bp, Homo sapiens
aagactcagtatgctttccctga

SEQ ID NO: 4364544 - DNA, 13 bp, Homo sapiens
aagagattcgaat

SEQ ID NO: 4364545 - DNA, 21 bp, Homo sapiens
aagagattcgaatgacggtaa

SEQ ID NO: 4364546 - DNA, 14 bp, Homo sapiens
aagagcaattctgg

SEQ ID NO: 4364547 - DNA, 22 bp, Homo sapiens
aagagcccgcagggccatgcag

SEQ ID NO: 4364548 - DNA, 16 bp, Homo sapiens
aagaggaagaaattca

SEQ ID NO: 4364549 - DNA, 16 bp, Homo sapiens
aagaggggcgggctca

SEQ ID NO: 4364550 - DNA, 17 bp, Homo sapiens
aagaggggcgggctcag

SEQ ID NO: 4364551 - DNA, 21 bp, Homo sapiens
aagaggggcgggctcagagct

SEQ ID NO: 4364552 - DNA, 23 bp, Homo sapiens
aagaggggcgggctcagagcttt

SEQ ID NO: 4364553 - DNA, 14 bp, Homo sapiens
aagagtgcattttc

SEQ ID NO: 4364554 - DNA, 14 bp, Homo sapiens
aagataggctctgc

SEQ ID NO: 4364555 - DNA, 15 bp, Homo sapiens
aagataggctctgca

SEQ ID NO: 4364556 - DNA, 17 bp, Homo sapiens
aagatcaccttgtattc

SEQ ID NO: 4364557 - DNA, 18 bp, Homo sapiens
aagatcaccttgtattct

SEQ ID NO: 4364558 - DNA, 12 bp, Homo sapiens
aagatctgactg

SEQ ID NO: 4364559 - DNA, 13 bp, Homo sapiens
aagatctgactgc

SEQ ID NO: 4364560 - DNA, 16 bp, Homo sapiens
aagatctgactgccaa

SEQ ID NO: 4364561 - DNA, 16 bp, Homo sapiens
aagcaaacgtctattt

SEQ ID NO: 4364562 - DNA, 16 bp, Homo sapiens
aagcacacacatctgg

SEQ ID NO: 4364563 - DNA, 22 bp, Homo sapiens
aagcacacacatctggccctga

SEQ ID NO: 4364564 - DNA, 12 bp, Homo sapiens
aagcacccttga

SEQ ID NO: 4364565 - DNA, 15 bp, Homo sapiens
aagcactacaatcat

SEQ ID NO: 4364566 - DNA, 15 bp, Homo sapiens
aagcagaacaaatgt

SEQ ID NO: 4364567 - DNA, 20 bp, Homo sapiens
aagcagccccctgtggcggc

SEQ ID NO: 4364568 - DNA, 15 bp, Homo sapiens
aagcataaaagatca

SEQ ID NO: 4364569 - DNA, 22 bp, Homo sapiens
aagccaaagttttcaaactgct

SEQ ID NO: 4364570 - DNA, 23 bp, Homo sapiens
aagccagtggggtcccccctgag

SEQ ID NO: 4364571 - DNA, 17 bp, Homo sapiens
aagcccaacctcctgac

SEQ ID NO: 4364572 - DNA, 22 bp, Homo sapiens
aagcccaacctcctgacctgtc

SEQ ID NO: 4364573 - DNA, 14 bp, Homo sapiens
aagccccttggaga

SEQ ID NO: 4364574 - DNA, 19 bp, Homo sapiens
aagcctgctggctgcggcc

SEQ ID NO: 4364575 - DNA, 13 bp, Homo sapiens
aagcctggattcc

SEQ ID NO: 4364576 - DNA, 16 bp, Homo sapiens
aagctttttgtttgca

SEQ ID NO: 4364577 - DNA, 21 bp, Homo sapiens
aaggagctactgacattccta

SEQ ID NO: 4364578 - DNA, 13 bp, Homo sapiens
aaggatctgctga

SEQ ID NO: 4364579 - DNA, 19 bp, Homo sapiens
aaggatggatgagtcagac

SEQ ID NO: 4364580 - DNA, 19 bp, Homo sapiens
aaggcaaaaactgtactgt

SEQ ID NO: 4364581 - DNA, 16 bp, Homo sapiens
aaggcagccctcacct

SEQ ID NO: 4364582 - DNA, 16 bp, Homo sapiens
aagggcacattgccca

SEQ ID NO: 4364583 - DNA, 13 bp, Homo sapiens
aagggggtgactg

SEQ ID NO: 4364584 - DNA, 18 bp, Homo sapiens
aaggggtgcacccacctg

SEQ ID NO: 4364585 - DNA, 16 bp, Homo sapiens
aagggttctgccctgc

SEQ ID NO: 4364586 - DNA, 18 bp, Homo sapiens
aaggtaccaaacaaggaa

SEQ ID NO: 4364587 - DNA, 18 bp, Homo sapiens
aaggtgagaattaagttt

SEQ ID NO: 4364588 - DNA, 12 bp, Homo sapiens
aaggtgcctcat

SEQ ID NO: 4364589 - DNA, 22 bp, Homo sapiens
aagtatgccttaagcagaacaa

SEQ ID NO: 4364590 - DNA, 23 bp, Homo sapiens
aagtatgccttaagcagaacaaa

SEQ ID NO: 4364591 - DNA, 14 bp, Homo sapiens
aagtctccttcccc

SEQ ID NO: 4364592 - DNA, 14 bp, Homo sapiens
aagtgaacaaagtg

SEQ ID NO: 4364593 - DNA, 11 bp, Homo sapiens
aagtgagcaga

SEQ ID NO: 4364594 - DNA, 15 bp, Homo sapiens
aagtgagcagaacag

SEQ ID NO: 4364595 - DNA, 15 bp, Homo sapiens
aagtgtaacagctga

SEQ ID NO: 4364596 - DNA, 17 bp, Homo sapiens
aagtgtaacagctgagg

SEQ ID NO: 4364597 - DNA, 11 bp, Homo sapiens
aagtgtgagta

SEQ ID NO: 4364598 - DNA, 18 bp, Homo sapiens
aagtgtgagtaagagctg

SEQ ID NO: 4364599 - DNA, 20 bp, Homo sapiens
aagtgtgagtaagagctggt

SEQ ID NO: 4364600 - DNA, 12 bp, Homo sapiens
aagtgttctcat

SEQ ID NO: 4364601 - DNA, 19 bp, Homo sapiens
aagtgttctcatgaagcag

SEQ ID NO: 4364602 - DNA, 21 bp, Homo sapiens
aagttaagaattgagcagttc

SEQ ID NO: 4364603 - DNA, 12 bp, Homo sapiens
aagttaatgaaa

SEQ ID NO: 4364604 - DNA, 14 bp, Homo sapiens
aagttaatgaaata

SEQ ID NO: 4364605 - DNA, 17 bp, Homo sapiens
aagttaatgaaataaaa

SEQ ID NO: 4364606 - DNA, 22 bp, Homo sapiens
aagttaatgaaataaaatttga

SEQ ID NO: 4364607 - DNA, 21 bp, Homo sapiens
aagttatttactcctcctgct

SEQ ID NO: 4364608 - DNA, 19 bp, Homo sapiens
aagttggaaggatctgctg

SEQ ID NO: 4364609 - DNA, 14 bp, Homo sapiens
aagttgtggatatc

SEQ ID NO: 4364610 - DNA, 21 bp, Homo sapiens
aagtttacattgtcctgtagc

SEQ ID NO: 4364611 - DNA, 22 bp, Homo sapiens
aagtttacattgtcctgtagct

SEQ ID NO: 4364612 - DNA, 23 bp, Homo sapiens
aagttttcaaactgctgcatact

SEQ ID NO: 4364613 - DNA, 11 bp, Homo sapiens
aagttttcagg

SEQ ID NO: 4364614 - DNA, 11 bp, Homo sapiens
aataaagcaat

SEQ ID NO: 4364615 - DNA, 13 bp, Homo sapiens
aataaagttgctt

SEQ ID NO: 4364616 - DNA, 11 bp, Homo sapiens
aataaatatgt

SEQ ID NO: 4364617 - DNA, 15 bp, Homo sapiens
aataaatatgtaata

SEQ ID NO: 4364618 - DNA, 16 bp, Homo sapiens
aataatactttaggaa

SEQ ID NO: 4364619 - DNA, 15 bp, Homo sapiens
aatagcctaaatgat

SEQ ID NO: 4364620 - DNA, 16 bp, Homo sapiens
aatagcctaaatgatg

SEQ ID NO: 4364621 - DNA, 22 bp, Homo sapiens
aatagtaaaagataacaagatc

SEQ ID NO: 4364622 - DNA, 23 bp, Homo sapiens
aatatccagccagtacagtattt

SEQ ID NO: 4364623 - DNA, 22 bp, Homo sapiens
aatatggatcagagcatttatt

SEQ ID NO: 4364624 - DNA, 14 bp, Homo sapiens
aatatttatatttc

SEQ ID NO: 4364625 - DNA, 13 bp, Homo sapiens
aatcaggaaaaat

SEQ ID NO: 4364626 - DNA, 12 bp, Homo sapiens
aatcatcctcat

SEQ ID NO: 4364627 - DNA, 18 bp, Homo sapiens
aatcatggtcaagttccc

SEQ ID NO: 4364628 - DNA, 22 bp, Homo sapiens
aatccaaaagacaaaaatcaaa

SEQ ID NO: 4364629 - DNA, 17 bp, Homo sapiens
aatccatgttagttttt

SEQ ID NO: 4364630 - DNA, 15 bp, Homo sapiens
aatcctcactgggtg

SEQ ID NO: 4364631 - DNA, 16 bp, Homo sapiens
aatcctcactgggtgg

SEQ ID NO: 4364632 - DNA, 17 bp, Homo sapiens
aatgaaagcatgtctca

SEQ ID NO: 4364633 - DNA, 20 bp, Homo sapiens
aatgaaaggaagtataaagt

SEQ ID NO: 4364634 - DNA, 12 bp, Homo sapiens
aatgaaatactg

SEQ ID NO: 4364635 - DNA, 12 bp, Homo sapiens
aatgaacatttt

SEQ ID NO: 4364636 - DNA, 23 bp, Homo sapiens
aatgacggtaagtgttctcatga

SEQ ID NO: 4364637 - DNA, 19 bp, Homo sapiens
aatgagatgttattactgt

SEQ ID NO: 4364638 - DNA, 14 bp, Homo sapiens
aatgaggaatccaa

SEQ ID NO: 4364639 - DNA, 12 bp, Homo sapiens
aatgcaaattca

SEQ ID NO: 4364640 - DNA, 16 bp, Homo sapiens
aatgcacctccccaaa

SEQ ID NO: 4364641 - DNA, 14 bp, Homo sapiens
aatgcctcctccct

SEQ ID NO: 4364642 - DNA, 12 bp, Homo sapiens
aatggccatgca

SEQ ID NO: 4364643 - DNA, 15 bp, Homo sapiens
aatggccatgcagga

SEQ ID NO: 4364644 - DNA, 16 bp, Homo sapiens
aatggcgtctgctctg

SEQ ID NO: 4364645 - DNA, 21 bp, Homo sapiens
aatggggggcgggccagggtg

SEQ ID NO: 4364646 - DNA, 22 bp, Homo sapiens
aatggggggcgggccagggtgg

SEQ ID NO: 4364647 - DNA, 23 bp, Homo sapiens
aatggggggcgggccagggtggg

SEQ ID NO: 4364648 - DNA, 21 bp, Homo sapiens
aatgtagggcctgcatggaga

SEQ ID NO: 4364649 - DNA, 14 bp, Homo sapiens
aatgtattattctg

SEQ ID NO: 4364650 - DNA, 16 bp, Homo sapiens
aatgtattattctgca

SEQ ID NO: 4364651 - DNA, 16 bp, Homo sapiens
aatgtgatttttctga

SEQ ID NO: 4364652 - DNA, 17 bp, Homo sapiens
aatgtgtttttctatat

SEQ ID NO: 4364653 - DNA, 17 bp, Homo sapiens
aatgttgccttggaaac

SEQ ID NO: 4364654 - DNA, 17 bp, Homo sapiens
aatgtttttaatgtatt

SEQ ID NO: 4364655 - DNA, 15 bp, Homo sapiens
aattagatttaaaat

SEQ ID NO: 4364656 - DNA, 17 bp, Homo sapiens
aattccctgaaaaacta

SEQ ID NO: 4364657 - DNA, 20 bp, Homo sapiens
aattctaaatccgacttgaa

SEQ ID NO: 4364658 - DNA, 19 bp, Homo sapiens
aattgtgtattgatgcaat

SEQ ID NO: 4364659 - DNA, 11 bp, Homo sapiens
aatttaagcaa

SEQ ID NO: 4364660 - DNA, 22 bp, Homo sapiens
aatttacatcagaagtttgcat

SEQ ID NO: 4364661 - DNA, 18 bp, Homo sapiens
aattttatataattctga

SEQ ID NO: 4364662 - DNA, 17 bp, Homo sapiens
aattttccaagaacata

SEQ ID NO: 4364663 - DNA, 12 bp, Homo sapiens
acaaaatgccaa

SEQ ID NO: 4364664 - DNA, 23 bp, Homo sapiens
acaaactcactcagtaaaacata

SEQ ID NO: 4364665 - DNA, 16 bp, Homo sapiens
acaaagtttacattgt

SEQ ID NO: 4364666 - DNA, 22 bp, Homo sapiens
acaaagtttacattgtcctgta

SEQ ID NO: 4364667 - DNA, 21 bp, Homo sapiens
acaaatgtgtttttctatata

SEQ ID NO: 4364668 - DNA, 13 bp, Homo sapiens
acaagatctttca

SEQ ID NO: 4364669 - DNA, 20 bp, Homo sapiens
acaagtgtataactaaacta

SEQ ID NO: 4364670 - DNA, 22 bp, Homo sapiens
acaatcaggtaagatcataaca

SEQ ID NO: 4364671 - DNA, 12 bp, Homo sapiens
acaatggaaacc

SEQ ID NO: 4364672 - DNA, 12 bp, Homo sapiens
acaatggtttat

SEQ ID NO: 4364673 - DNA, 17 bp, Homo sapiens
acacacatctggccctg

SEQ ID NO: 4364674 - DNA, 19 bp, Homo sapiens
acacagagtggtctttctg

SEQ ID NO: 4364675 - DNA, 17 bp, Homo sapiens
acaccagagctgccgac

SEQ ID NO: 4364676 - DNA, 16 bp, Homo sapiens
acacccagcggccccc

SEQ ID NO: 4364677 - DNA, 18 bp, Homo sapiens
acacgagcaaacccagag

SEQ ID NO: 4364678 - DNA, 23 bp, Homo sapiens
acactgaatatttatatttcact

SEQ ID NO: 4364679 - DNA, 20 bp, Homo sapiens
acactgaatggaaataaata

SEQ ID NO: 4364680 - DNA, 11 bp, Homo sapiens
acactgcagcc

SEQ ID NO: 4364681 - DNA, 16 bp, Homo sapiens
acactgcagccctctc

SEQ ID NO: 4364682 - DNA, 15 bp, Homo sapiens
acactgccagaagag

SEQ ID NO: 4364683 - DNA, 17 bp, Homo sapiens
acactgccagaagagaa

SEQ ID NO: 4364684 - DNA, 14 bp, Homo sapiens
acactgtcttcccg

SEQ ID NO: 4364685 - DNA, 16 bp, Homo sapiens
acacttgtgtgtgggc

SEQ ID NO: 4364686 - DNA, 22 bp, Homo sapiens
acagaagctttttgtttgcatc

SEQ ID NO: 4364687 - DNA, 14 bp, Homo sapiens
acagaggccggggt

SEQ ID NO: 4364688 - DNA, 20 bp, Homo sapiens
acagaggccggggtccaggc

SEQ ID NO: 4364689 - DNA, 19 bp, Homo sapiens
acagagtggtctttctgga

SEQ ID NO: 4364690 - DNA, 21 bp, Homo sapiens
acagagtggtctttctggaga

SEQ ID NO: 4364691 - DNA, 16 bp, Homo sapiens
acagatggatttgcct

SEQ ID NO: 4364692 - DNA, 17 bp, Homo sapiens
acagatggatttgcctg

SEQ ID NO: 4364693 - DNA, 20 bp, Homo sapiens
acagatggggtctgtgactg

SEQ ID NO: 4364694 - DNA, 11 bp, Homo sapiens
acagccacccg

SEQ ID NO: 4364695 - DNA, 23 bp, Homo sapiens
acagccacccgtggggtgctgcc

SEQ ID NO: 4364696 - DNA, 19 bp, Homo sapiens
acagctgaagaaaatgagc

SEQ ID NO: 4364697 - DNA, 22 bp, Homo sapiens
acagctgaggtctcttgaggga

SEQ ID NO: 4364698 - DNA, 13 bp, Homo sapiens
acagctgggcagg

SEQ ID NO: 4364699 - DNA, 14 bp, Homo sapiens
acagctgtgtctgc

SEQ ID NO: 4364700 - DNA, 16 bp, Homo sapiens
acagcttgactgcttt

SEQ ID NO: 4364701 - DNA, 13 bp, Homo sapiens
acagctttctggg

SEQ ID NO: 4364702 - DNA, 16 bp, Homo sapiens
acagctttctgggatg

SEQ ID NO: 4364703 - DNA, 21 bp, Homo sapiens
acagctttctgggatgtcaca

SEQ ID NO: 4364704 - DNA, 14 bp, Homo sapiens
acaggacagcggga

SEQ ID NO: 4364705 - DNA, 14 bp, Homo sapiens
acaggagactccaa

SEQ ID NO: 4364706 - DNA, 18 bp, Homo sapiens
acaggcagttaggtgctg

SEQ ID NO: 4364707 - DNA, 13 bp, Homo sapiens
acagtgcctcttc

SEQ ID NO: 4364708 - DNA, 15 bp, Homo sapiens
acagtgcctcttcca

SEQ ID NO: 4364709 - DNA, 17 bp, Homo sapiens
acagtgcctcttccagt

SEQ ID NO: 4364710 - DNA, 19 bp, Homo sapiens
acagtgcctcttccagtga

SEQ ID NO: 4364711 - DNA, 14 bp, Homo sapiens
acagtgcctgggaa

SEQ ID NO: 4364712 - DNA, 20 bp, Homo sapiens
acataatgtatcatgaagaa

SEQ ID NO: 4364713 - DNA, 15 bp, Homo sapiens
acatatggaaatgtt

SEQ ID NO: 4364714 - DNA, 12 bp, Homo sapiens
acatatttgtct

SEQ ID NO: 4364715 - DNA, 17 bp, Homo sapiens
acatcagaagtttgcat

SEQ ID NO: 4364716 - DNA, 15 bp, Homo sapiens
acatgggagggatca

SEQ ID NO: 4364717 - DNA, 18 bp, Homo sapiens
acatgggagggatcagcc

SEQ ID NO: 4364718 - DNA, 22 bp, Homo sapiens
acatgtacatatggaaatgtta

SEQ ID NO: 4364719 - DNA, 15 bp, Homo sapiens
acatgtatgttcttg

SEQ ID NO: 4364720 - DNA, 16 bp, Homo sapiens
acatgttactgaccag

SEQ ID NO: 4364721 - DNA, 17 bp, Homo sapiens
acatgttactgaccagc

SEQ ID NO: 4364722 - DNA, 19 bp, Homo sapiens
acatgttactgaccagcaa

SEQ ID NO: 4364723 - DNA, 22 bp, Homo sapiens
acatttaccctttggccccact

SEQ ID NO: 4364724 - DNA, 12 bp, Homo sapiens
acatttatgacc

SEQ ID NO: 4364725 - DNA, 16 bp, Homo sapiens
accacaccgcagaagc

SEQ ID NO: 4364726 - DNA, 18 bp, Homo sapiens
accacactgggtgcgtct

SEQ ID NO: 4364727 - DNA, 15 bp, Homo sapiens
accagaaacacccct

SEQ ID NO: 4364728 - DNA, 18 bp, Homo sapiens
accagaattcccttgaat

SEQ ID NO: 4364729 - DNA, 23 bp, Homo sapiens
accagcaacttgtctttttctgg

SEQ ID NO: 4364730 - DNA, 22 bp, Homo sapiens
accagtttaaggaacttctgaa

SEQ ID NO: 4364731 - DNA, 16 bp, Homo sapiens
acccacctgttttctg

SEQ ID NO: 4364732 - DNA, 17 bp, Homo sapiens
acccacctgttttctga

SEQ ID NO: 4364733 - DNA, 18 bp, Homo sapiens
acccagaatgagacatcc

SEQ ID NO: 4364734 - DNA, 14 bp, Homo sapiens
accccaccccaccc

SEQ ID NO: 4364735 - DNA, 13 bp, Homo sapiens
acccccgccatgc

SEQ ID NO: 4364736 - DNA, 15 bp, Homo sapiens
acccctctggccagg

SEQ ID NO: 4364737 - DNA, 18 bp, Homo sapiens
acccctctggccaggatg

SEQ ID NO: 4364738 - DNA, 11 bp, Homo sapiens
acccctgtagg

SEQ ID NO: 4364739 - DNA, 23 bp, Homo sapiens
acccctgtagggaaaccttggag

SEQ ID NO: 4364740 - DNA, 15 bp, Homo sapiens
accctaaccaagttc

SEQ ID NO: 4364741 - DNA, 17 bp, Homo sapiens
accctaaccaagttcct

SEQ ID NO: 4364742 - DNA, 23 bp, Homo sapiens
accctcaggcataggcctgggtg

SEQ ID NO: 4364743 - DNA, 11 bp, Homo sapiens
accctccctcc

SEQ ID NO: 4364744 - DNA, 23 bp, Homo sapiens
accctccggccagcgagtggtca

SEQ ID NO: 4364745 - DNA, 15 bp, Homo sapiens
accctgtccggccca

SEQ ID NO: 4364746 - DNA, 23 bp, Homo sapiens
accctgtccggcccagtgccact

SEQ ID NO: 4364747 - DNA, 11 bp, Homo sapiens
acctccccaaa

SEQ ID NO: 4364748 - DNA, 14 bp, Homo sapiens
acctccccaaagca

SEQ ID NO: 4364749 - DNA, 20 bp, Homo sapiens
acctcggggacaccagagct

SEQ ID NO: 4364750 - DNA, 21 bp, Homo sapiens
acctcggggacaccagagctg

SEQ ID NO: 4364751 - DNA, 23 bp, Homo sapiens
acctcggggacaccagagctgcc

SEQ ID NO: 4364752 - DNA, 12 bp, Homo sapiens
acctctgaggac

SEQ ID NO: 4364753 - DNA, 20 bp, Homo sapiens
acctgcacacaggacagcgg

SEQ ID NO: 4364754 - DNA, 18 bp, Homo sapiens
acctgtcaccgtgagcag

SEQ ID NO: 4364755 - DNA, 13 bp, Homo sapiens
acctgtgaccagc

SEQ ID NO: 4364756 - DNA, 19 bp, Homo sapiens
acctgtgaccagcactgtc

SEQ ID NO: 4364757 - DNA, 23 bp, Homo sapiens
acctgtgaccagcactgtctcag

SEQ ID NO: 4364758 - DNA, 19 bp, Homo sapiens
acctgttttctgaaacaca

SEQ ID NO: 4364759 - DNA, 12 bp, Homo sapiens
accttccaccca

SEQ ID NO: 4364760 - DNA, 14 bp, Homo sapiens
accttccacccagt

SEQ ID NO: 4364761 - DNA, 17 bp, Homo sapiens
accttcctactggagct

SEQ ID NO: 4364762 - DNA, 11 bp, Homo sapiens
accttctaaaa

SEQ ID NO: 4364763 - DNA, 15 bp, Homo sapiens
accttctaaaagcca

SEQ ID NO: 4364764 - DNA, 16 bp, Homo sapiens
accttggagaggagag

SEQ ID NO: 4364765 - DNA, 14 bp, Homo sapiens
acgacttcagggca

SEQ ID NO: 4364766 - DNA, 22 bp, Homo sapiens
acgacttcagggcagggctctg

SEQ ID NO: 4364767 - DNA, 20 bp, Homo sapiens
acgagaccctacaggagagg

SEQ ID NO: 4364768 - DNA, 16 bp, Homo sapiens
acgtgacagtgcctgg

SEQ ID NO: 4364769 - DNA, 19 bp, Homo sapiens
acgtgacagtgcctgggaa

SEQ ID NO: 4364770 - DNA, 19 bp, Homo sapiens
acgtttttggaaaatgtat

SEQ ID NO: 4364771 - DNA, 22 bp, Homo sapiens
actaaataatactttaggaaat

SEQ ID NO: 4364772 - DNA, 15 bp, Homo sapiens
actattgagccttgc

SEQ ID NO: 4364773 - DNA, 19 bp, Homo sapiens
actattgctcataatgact

SEQ ID NO: 4364774 - DNA, 18 bp, Homo sapiens
actatttttatttatatt

SEQ ID NO: 4364775 - DNA, 19 bp, Homo sapiens
actcaaatgaatttgctaa

SEQ ID NO: 4364776 - DNA, 21 bp, Homo sapiens
actcaacatgttactgaccag

SEQ ID NO: 4364777 - DNA, 17 bp, Homo sapiens
actcagtaaaacataat

SEQ ID NO: 4364778 - DNA, 23 bp, Homo sapiens
actcagtatgctttccctgagga

SEQ ID NO: 4364779 - DNA, 18 bp, Homo sapiens
actccaaggagctactga

SEQ ID NO: 4364780 - DNA, 20 bp, Homo sapiens
actcctcctgctcctcaccc

SEQ ID NO: 4364781 - DNA, 21 bp, Homo sapiens
actcctggggcctcttgggtc

SEQ ID NO: 4364782 - DNA, 14 bp, Homo sapiens
actcctgggtgggt

SEQ ID NO: 4364783 - DNA, 14 bp, Homo sapiens
actctgtcagatgg

SEQ ID NO: 4364784 - DNA, 14 bp, Homo sapiens
actgaagcctgcag

SEQ ID NO: 4364785 - DNA, 18 bp, Homo sapiens
actgaatatttatatttc

SEQ ID NO: 4364786 - DNA, 22 bp, Homo sapiens
actgagtcatcttgtgagtgga

SEQ ID NO: 4364787 - DNA, 13 bp, Homo sapiens
actgattgggagg

SEQ ID NO: 4364788 - DNA, 16 bp, Homo sapiens
actgcagccctctcca

SEQ ID NO: 4364789 - DNA, 21 bp, Homo sapiens
actgcagccctctccaccctc

SEQ ID NO: 4364790 - DNA, 14 bp, Homo sapiens
actgcagtgtggag

SEQ ID NO: 4364791 - DNA, 15 bp, Homo sapiens
actgccagaagagaa

SEQ ID NO: 4364792 - DNA, 16 bp, Homo sapiens
actgcttttaaatgac

SEQ ID NO: 4364793 - DNA, 14 bp, Homo sapiens
actggatggaaact

SEQ ID NO: 4364794 - DNA, 23 bp, Homo sapiens
actgggaagataggctctgcaca

SEQ ID NO: 4364795 - DNA, 18 bp, Homo sapiens
actgggtggggtgaggac

SEQ ID NO: 4364796 - DNA, 23 bp, Homo sapiens
actggtaaaaagatccagggatg

SEQ ID NO: 4364797 - DNA, 17 bp, Homo sapiens
actgtaagagacatgaa

SEQ ID NO: 4364798 - DNA, 18 bp, Homo sapiens
actgtaagagacatgaat

SEQ ID NO: 4364799 - DNA, 13 bp, Homo sapiens
actgtacaataag

SEQ ID NO: 4364800 - DNA, 14 bp, Homo sapiens
actgtctatatata

SEQ ID NO: 4364801 - DNA, 18 bp, Homo sapiens
actgtctgactacaacat

SEQ ID NO: 4364802 - DNA, 20 bp, Homo sapiens
actgtgatgccacacagagt

SEQ ID NO: 4364803 - DNA, 22 bp, Homo sapiens
actgtgatgccacacagagtgg

SEQ ID NO: 4364804 - DNA, 18 bp, Homo sapiens
actgtggtttcagatgtg

SEQ ID NO: 4364805 - DNA, 19 bp, Homo sapiens
actgtgtggactgtgatgc

SEQ ID NO: 4364806 - DNA, 15 bp, Homo sapiens
actgttttgggcctc

SEQ ID NO: 4364807 - DNA, 22 bp, Homo sapiens
actgttttgggcctccatgccc

SEQ ID NO: 4364808 - DNA, 17 bp, Homo sapiens
acttacaaaatgccaag

SEQ ID NO: 4364809 - DNA, 15 bp, Homo sapiens
acttctagcatatag

SEQ ID NO: 4364810 - DNA, 22 bp, Homo sapiens
acttctccagacccaccacacc

SEQ ID NO: 4364811 - DNA, 12 bp, Homo sapiens
acttgaaataag

SEQ ID NO: 4364812 - DNA, 16 bp, Homo sapiens
acttgaaataagttgt

SEQ ID NO: 4364813 - DNA, 23 bp, Homo sapiens
acttgccacatggtgtctcccaa

SEQ ID NO: 4364814 - DNA, 19 bp, Homo sapiens
acttggagactcctggtct

SEQ ID NO: 4364815 - DNA, 12 bp, Homo sapiens
actttacatatt

SEQ ID NO: 4364816 - DNA, 15 bp, Homo sapiens
actttagagtagcat

SEQ ID NO: 4364817 - DNA, 19 bp, Homo sapiens
actttagagtagcatgaga

SEQ ID NO: 4364818 - DNA, 15 bp, Homo sapiens
actttaggaaatacg

SEQ ID NO: 4364819 - DNA, 13 bp, Homo sapiens
actttatgtagtt

SEQ ID NO: 4364820 - DNA, 16 bp, Homo sapiens
actttgaaaagttgga

SEQ ID NO: 4364821 - DNA, 16 bp, Homo sapiens
acttttagattaaaaa

SEQ ID NO: 4364822 - DNA, 21 bp, Homo sapiens
agaaacacccctctgtctagg

SEQ ID NO: 4364823 - DNA, 21 bp, Homo sapiens
agaaaggcagccctcacctct

SEQ ID NO: 4364824 - DNA, 16 bp, Homo sapiens
agaaatctttctccct

SEQ ID NO: 4364825 - DNA, 11 bp, Homo sapiens
agaaattcagg

SEQ ID NO: 4364826 - DNA, 17 bp, Homo sapiens
agaacaaatgtgttttt

SEQ ID NO: 4364827 - DNA, 20 bp, Homo sapiens
agaacaaatgtgtttttcta

SEQ ID NO: 4364828 - DNA, 15 bp, Homo sapiens
agaacagatggggtc

SEQ ID NO: 4364829 - DNA, 20 bp, Homo sapiens
agaacatagtttaagttgat

SEQ ID NO: 4364830 - DNA, 22 bp, Homo sapiens
agaagaggaagaaattcaggta

SEQ ID NO: 4364831 - DNA, 23 bp, Homo sapiens
agaagcgggacgagaccctacag

SEQ ID NO: 4364832 - DNA, 19 bp, Homo sapiens
agaagctttttgtttgcat

SEQ ID NO: 4364833 - DNA, 20 bp, Homo sapiens
agaagctttttgtttgcatc

SEQ ID NO: 4364834 - DNA, 21 bp, Homo sapiens
agaagggttctgccctgcctg

SEQ ID NO: 4364835 - DNA, 20 bp, Homo sapiens
agaattaagttttaaataaa

SEQ ID NO: 4364836 - DNA, 20 bp, Homo sapiens
agaattcccttgaattgtgt

SEQ ID NO: 4364837 - DNA, 21 bp, Homo sapiens
agaattcctgcagcagttatt

SEQ ID NO: 4364838 - DNA, 14 bp, Homo sapiens
agaattgagcagtt

SEQ ID NO: 4364839 - DNA, 19 bp, Homo sapiens
agaattgagcagttctgtt

SEQ ID NO: 4364840 - DNA, 18 bp, Homo sapiens
agacagtggatatgaccc

SEQ ID NO: 4364841 - DNA, 12 bp, Homo sapiens
agaccaaaattt

SEQ ID NO: 4364842 - DNA, 21 bp, Homo sapiens
agaccagaattcccttgaatt

SEQ ID NO: 4364843 - DNA, 23 bp, Homo sapiens
agaccagaattcccttgaattgt

SEQ ID NO: 4364844 - DNA, 14 bp, Homo sapiens
agacccccaggcct

SEQ ID NO: 4364845 - DNA, 17 bp, Homo sapiens
agacccctctggccagg

SEQ ID NO: 4364846 - DNA, 16 bp, Homo sapiens
agactccaaggagcta

SEQ ID NO: 4364847 - DNA, 23 bp, Homo sapiens
agactctttttttgagtgacagc

SEQ ID NO: 4364848 - DNA, 21 bp, Homo sapiens
agactgggaagataggctctg

SEQ ID NO: 4364849 - DNA, 15 bp, Homo sapiens
agagaagaaatagca

SEQ ID NO: 4364850 - DNA, 14 bp, Homo sapiens
agagaattcagtat

SEQ ID NO: 4364851 - DNA, 18 bp, Homo sapiens
agagaattcagtattttt

SEQ ID NO: 4364852 - DNA, 23 bp, Homo sapiens
agagactgggaagataggctctg

SEQ ID NO: 4364853 - DNA, 15 bp, Homo sapiens
agagagaggctgcct

SEQ ID NO: 4364854 - DNA, 13 bp, Homo sapiens
agagcagcaggtg

SEQ ID NO: 4364855 - DNA, 16 bp, Homo sapiens
agagcagcaggtgctg

SEQ ID NO: 4364856 - DNA, 13 bp, Homo sapiens
agagccagctccc

SEQ ID NO: 4364857 - DNA, 15 bp, Homo sapiens
agagccggtggtgcc

SEQ ID NO: 4364858 - DNA, 14 bp, Homo sapiens
agagcttgctccag

SEQ ID NO: 4364859 - DNA, 16 bp, Homo sapiens
agagcttgctccagat

SEQ ID NO: 4364860 - DNA, 19 bp, Homo sapiens
agagctttgtcacttgcca

SEQ ID NO: 4364861 - DNA, 20 bp, Homo sapiens
agagctttgtcacttgccac

SEQ ID NO: 4364862 - DNA, 22 bp, Homo sapiens
agagctttgtcacttgccacat

SEQ ID NO: 4364863 - DNA, 19 bp, Homo sapiens
agaggaatgtagggcctgc

SEQ ID NO: 4364864 - DNA, 21 bp, Homo sapiens
agaggaatgtagggcctgcat

SEQ ID NO: 4364865 - DNA, 15 bp, Homo sapiens
agaggctgcctcagc

SEQ ID NO: 4364866 - DNA, 17 bp, Homo sapiens
agagggaagagtgcatt

SEQ ID NO: 4364867 - DNA, 15 bp, Homo sapiens
agaggggcgggctca

SEQ ID NO: 4364868 - DNA, 17 bp, Homo sapiens
agaggggcgggctcaga

SEQ ID NO: 4364869 - DNA, 18 bp, Homo sapiens
agaggggcgggctcagag

SEQ ID NO: 4364870 - DNA, 21 bp, Homo sapiens
agaggggcgggctcagagctt

SEQ ID NO: 4364871 - DNA, 12 bp, Homo sapiens
agaggtggatgt

SEQ ID NO: 4364872 - DNA, 14 bp, Homo sapiens
agaggtggatgtta

SEQ ID NO: 4364873 - DNA, 23 bp, Homo sapiens
agaggtggatgttatgaacagct

SEQ ID NO: 4364874 - DNA, 21 bp, Homo sapiens
agagtcatctccatcagctgt

SEQ ID NO: 4364875 - DNA, 14 bp, Homo sapiens
agagtggcaggtgg

SEQ ID NO: 4364876 - DNA, 23 bp, Homo sapiens
agagtggcaggtgggctgcctgc

SEQ ID NO: 4364877 - DNA, 18 bp, Homo sapiens
agagtggtctttctggag

SEQ ID NO: 4364878 - DNA, 22 bp, Homo sapiens
agataaatttcaattagattta

SEQ ID NO: 4364879 - DNA, 18 bp, Homo sapiens
agataacaagatctttca

SEQ ID NO: 4364880 - DNA, 14 bp, Homo sapiens
agataggctctgca

SEQ ID NO: 4364881 - DNA, 15 bp, Homo sapiens
agatatatttttcac

SEQ ID NO: 4364882 - DNA, 16 bp, Homo sapiens
agatatatttttcaca

SEQ ID NO: 4364883 - DNA, 14 bp, Homo sapiens
agatattaaagatt

SEQ ID NO: 4364884 - DNA, 17 bp, Homo sapiens
agatcaccttgtattct

SEQ ID NO: 4364885 - DNA, 19 bp, Homo sapiens
agatccagggatggagatg

SEQ ID NO: 4364886 - DNA, 19 bp, Homo sapiens
agatcccgcctcttcttct

SEQ ID NO: 4364887 - DNA, 13 bp, Homo sapiens
agatctgactgcc

SEQ ID NO: 4364888 - DNA, 15 bp, Homo sapiens
agatctgactgccaa

SEQ ID NO: 4364889 - DNA, 21 bp, Homo sapiens
agatctttcaggaaagacgga

SEQ ID NO: 4364890 - DNA, 21 bp, Homo sapiens
agatgggaaggttagaaaggc

SEQ ID NO: 4364891 - DNA, 14 bp, Homo sapiens
agatggggtctgtg

SEQ ID NO: 4364892 - DNA, 22 bp, Homo sapiens
agatggggtctgtgactggatc

SEQ ID NO: 4364893 - DNA, 16 bp, Homo sapiens
agatgtaaataaaatt

SEQ ID NO: 4364894 - DNA, 21 bp, Homo sapiens
agatgtccctttcttggccag

SEQ ID NO: 4364895 - DNA, 17 bp, Homo sapiens
agatgtgcaataatttg

SEQ ID NO: 4364896 - DNA, 14 bp, Homo sapiens
agcaaacccagagg

SEQ ID NO: 4364897 - DNA, 19 bp, Homo sapiens
agcaacttctagcatatag

SEQ ID NO: 4364898 - DNA, 21 bp, Homo sapiens
agcaacttgtctttttctgga

SEQ ID NO: 4364899 - DNA, 23 bp, Homo sapiens
agcaacttgtctttttctggact

SEQ ID NO: 4364900 - DNA, 23 bp, Homo sapiens
agcaatccatgttagtttttact

SEQ ID NO: 4364901 - DNA, 20 bp, Homo sapiens
agcaattctgggagaatgaa

SEQ ID NO: 4364902 - DNA, 15 bp, Homo sapiens
agcacaagggcacat

SEQ ID NO: 4364903 - DNA, 20 bp, Homo sapiens
agcacaagggcacattgccc

SEQ ID NO: 4364904 - DNA, 23 bp, Homo sapiens
agcacacacaaacctactgccca

SEQ ID NO: 4364905 - DNA, 14 bp, Homo sapiens
agcacacacatctg

SEQ ID NO: 4364906 - DNA, 14 bp, Homo sapiens
agcactttaaactt

SEQ ID NO: 4364907 - DNA, 22 bp, Homo sapiens
agcagaacaggtagtattacac

SEQ ID NO: 4364908 - DNA, 16 bp, Homo sapiens
agcagaacctgcacac

SEQ ID NO: 4364909 - DNA, 22 bp, Homo sapiens
agcagaacctgcacacaggaca

SEQ ID NO: 4364910 - DNA, 14 bp, Homo sapiens
agcagccccctgtg

SEQ ID NO: 4364911 - DNA, 17 bp, Homo sapiens
agcaggcctctggttgc

SEQ ID NO: 4364912 - DNA, 19 bp, Homo sapiens
agcaggcctctggttgcct

SEQ ID NO: 4364913 - DNA, 18 bp, Homo sapiens
agcagtgaatgctagaca

SEQ ID NO: 4364914 - DNA, 20 bp, Homo sapiens
agcagtgaatgctagacaga

SEQ ID NO: 4364915 - DNA, 21 bp, Homo sapiens
agcataaaagatcaccttgta

SEQ ID NO: 4364916 - DNA, 16 bp, Homo sapiens
agcatagccagcattc

SEQ ID NO: 4364917 - DNA, 17 bp, Homo sapiens
agcatatagaatatatt

SEQ ID NO: 4364918 - DNA, 19 bp, Homo sapiens
agcatgagagaattgtatc

SEQ ID NO: 4364919 - DNA, 17 bp, Homo sapiens
agccaaagttttcaaac

SEQ ID NO: 4364920 - DNA, 14 bp, Homo sapiens
agccacccaagcct

SEQ ID NO: 4364921 - DNA, 18 bp, Homo sapiens
agccacccaagcctgctg

SEQ ID NO: 4364922 - DNA, 18 bp, Homo sapiens
agccagcattcagcacac

SEQ ID NO: 4364923 - DNA, 15 bp, Homo sapiens
agccagggcagagga

SEQ ID NO: 4364924 - DNA, 15 bp, Homo sapiens
agccagtggcacagg

SEQ ID NO: 4364925 - DNA, 18 bp, Homo sapiens
agccagtggcacaggaga

SEQ ID NO: 4364926 - DNA, 19 bp, Homo sapiens
agccagtggcacaggagac

SEQ ID NO: 4364927 - DNA, 22 bp, Homo sapiens
agccagtggggtcccccctgag

SEQ ID NO: 4364928 - DNA, 23 bp, Homo sapiens
agccagtggggtcccccctgagt

SEQ ID NO: 4364929 - DNA, 15 bp, Homo sapiens
agcccagcagggcct

SEQ ID NO: 4364930 - DNA, 14 bp, Homo sapiens
agcccagccccgcc

SEQ ID NO: 4364931 - DNA, 18 bp, Homo sapiens
agcccagtccctggagct

SEQ ID NO: 4364932 - DNA, 15 bp, Homo sapiens
agccccgcctgtcac

SEQ ID NO: 4364933 - DNA, 20 bp, Homo sapiens
agccccgcctgtcacaataa

SEQ ID NO: 4364934 - DNA, 15 bp, Homo sapiens
agccccttggagaga

SEQ ID NO: 4364935 - DNA, 22 bp, Homo sapiens
agccccttggagagagaggctg

SEQ ID NO: 4364936 - DNA, 21 bp, Homo sapiens
agcccgcagggccatgcagac

SEQ ID NO: 4364937 - DNA, 17 bp, Homo sapiens
agccctcacctctgagg

SEQ ID NO: 4364938 - DNA, 18 bp, Homo sapiens
agccctcacctctgagga

SEQ ID NO: 4364939 - DNA, 13 bp, Homo sapiens
agccggtggtgcc

SEQ ID NO: 4364940 - DNA, 14 bp, Homo sapiens
agccggtggtgccc

SEQ ID NO: 4364941 - DNA, 15 bp, Homo sapiens
agccggtggtgcccg

SEQ ID NO: 4364942 - DNA, 12 bp, Homo sapiens
agcctaaatgat

SEQ ID NO: 4364943 - DNA, 13 bp, Homo sapiens
agcctaaatgatg

SEQ ID NO: 4364944 - DNA, 22 bp, Homo sapiens
agcctagttcatccaatcctca

SEQ ID NO: 4364945 - DNA, 15 bp, Homo sapiens
agcctcgttggagag

SEQ ID NO: 4364946 - DNA, 12 bp, Homo sapiens
agcctctccagg

SEQ ID NO: 4364947 - DNA, 23 bp, Homo sapiens
agcctctccaggaatgcctcctc

SEQ ID NO: 4364948 - DNA, 18 bp, Homo sapiens
agcctcttgctcagagct

SEQ ID NO: 4364949 - DNA, 14 bp, Homo sapiens
agcctgaagcctgg

SEQ ID NO: 4364950 - DNA, 12 bp, Homo sapiens
agcctgctggct

SEQ ID NO: 4364951 - DNA, 15 bp, Homo sapiens
agcctgctggctgcg

SEQ ID NO: 4364952 - DNA, 18 bp, Homo sapiens
agcctgctggctgcggcc

SEQ ID NO: 4364953 - DNA, 18 bp, Homo sapiens
agcctggattccagcagt

SEQ ID NO: 4364954 - DNA, 20 bp, Homo sapiens
agcctggattccagcagtga

SEQ ID NO: 4364955 - DNA, 20 bp, Homo sapiens
agccttgataatacttgacc

SEQ ID NO: 4364956 - DNA, 22 bp, Homo sapiens
agccttgcatgtacttgaagga

SEQ ID NO: 4364957 - DNA, 10 bp, Homo sapiens
agccttgctg

SEQ ID NO: 4364958 - DNA, 17 bp, Homo sapiens
agccttgctgggccagg

SEQ ID NO: 4364959 - DNA, 18 bp, Homo sapiens
agccttgctgggccaggg

SEQ ID NO: 4364960 - DNA, 19 bp, Homo sapiens
agcggtttggggagcagag

SEQ ID NO: 4364961 - DNA, 16 bp, Homo sapiens
agctagatgcccctgc

SEQ ID NO: 4364962 - DNA, 17 bp, Homo sapiens
agctctaagagcaattc

SEQ ID NO: 4364963 - DNA, 18 bp, Homo sapiens
agctgccatccttgctgc

SEQ ID NO: 4364964 - DNA, 17 bp, Homo sapiens
agctgccgacttggaga

SEQ ID NO: 4364965 - DNA, 18 bp, Homo sapiens
agctggatagacttggga

SEQ ID NO: 4364966 - DNA, 18 bp, Homo sapiens
agctggtgtctgattgtt

SEQ ID NO: 4364967 - DNA, 17 bp, Homo sapiens
agctgtaagaagagact

SEQ ID NO: 4364968 - DNA, 15 bp, Homo sapiens
agctgtgtctgccaa

SEQ ID NO: 4364969 - DNA, 14 bp, Homo sapiens
agcttgctccagat

SEQ ID NO: 4364970 - DNA, 20 bp, Homo sapiens
agcttgctccagattctgat

SEQ ID NO: 4364971 - DNA, 23 bp, Homo sapiens
agcttgctccagattctgatgca

SEQ ID NO: 4364972 - DNA, 18 bp, Homo sapiens
agctttaaaaccacagct

SEQ ID NO: 4364973 - DNA, 13 bp, Homo sapiens
agctttaccctca

SEQ ID NO: 4364974 - DNA, 17 bp, Homo sapiens
agctttaccctcaggca

SEQ ID NO: 4364975 - DNA, 17 bp, Homo sapiens
agctttataaagcagtt

SEQ ID NO: 4364976 - DNA, 16 bp, Homo sapiens
agctttggaaacagga

SEQ ID NO: 4364977 - DNA, 13 bp, Homo sapiens
agctttgtcactt

SEQ ID NO: 4364978 - DNA, 16 bp, Homo sapiens
agctttttgtttgcat

SEQ ID NO: 4364979 - DNA, 22 bp, Homo sapiens
agctttttgtttgcatcattta

SEQ ID NO: 4364980 - DNA, 20 bp, Homo sapiens
aggaaatatatatgtgtgtg

SEQ ID NO: 4364981 - DNA, 23 bp, Homo sapiens
aggaacacccgactcctcaaaag

SEQ ID NO: 4364982 - DNA, 16 bp, Homo sapiens
aggaactgggctgggc

SEQ ID NO: 4364983 - DNA, 17 bp, Homo sapiens
aggaagaaattcaggta

SEQ ID NO: 4364984 - DNA, 21 bp, Homo sapiens
aggaatccaaaagacaaaaat

SEQ ID NO: 4364985 - DNA, 22 bp, Homo sapiens
aggaatggggggcgggccaggg

SEQ ID NO: 4364986 - DNA, 23 bp, Homo sapiens
aggaatggggggcgggccagggt

SEQ ID NO: 4364987 - DNA, 12 bp, Homo sapiens
aggacacagcac

SEQ ID NO: 4364988 - DNA, 15 bp, Homo sapiens
aggacagaggccggg

SEQ ID NO: 4364989 - DNA, 12 bp, Homo sapiens
aggaccactcct

SEQ ID NO: 4364990 - DNA, 16 bp, Homo sapiens
aggacttggtctgatt

SEQ ID NO: 4364991 - DNA, 20 bp, Homo sapiens
aggacttggtctgatttcag

SEQ ID NO: 4364992 - DNA, 23 bp, Homo sapiens
aggacttggtctgatttcaggat

SEQ ID NO: 4364993 - DNA, 19 bp, Homo sapiens
aggagactccaaggagcta

SEQ ID NO: 4364994 - DNA, 13 bp, Homo sapiens
aggagccttgctg

SEQ ID NO: 4364995 - DNA, 18 bp, Homo sapiens
aggagccttgctgggcca

SEQ ID NO: 4364996 - DNA, 20 bp, Homo sapiens
aggagccttgctgggccagg

SEQ ID NO: 4364997 - DNA, 20 bp, Homo sapiens
aggagctgggcccctgcaca

SEQ ID NO: 4364998 - DNA, 21 bp, Homo sapiens
aggaggagccttgctgggcca

SEQ ID NO: 4364999 - DNA, 17 bp, Homo sapiens
aggaggaggacacagca

SEQ ID NO: 4365000 - DNA, 20 bp, Homo sapiens
aggaggcccttgtcgtggga

SEQ ID NO: 4365001 - DNA, 14 bp, Homo sapiens
aggaggtggagaaa

SEQ ID NO: 4365002 - DNA, 20 bp, Homo sapiens
aggaggtggagaaaattgga

SEQ ID NO: 4365003 - DNA, 13 bp, Homo sapiens
aggagttgcctga

SEQ ID NO: 4365004 - DNA, 16 bp, Homo sapiens
aggagttgcctgactc

SEQ ID NO: 4365005 - DNA, 16 bp, Homo sapiens
aggatactctgtcaga

SEQ ID NO: 4365006 - DNA, 12 bp, Homo sapiens
aggatctgctga

SEQ ID NO: 4365007 - DNA, 18 bp, Homo sapiens
aggatctgctgaggccca

SEQ ID NO: 4365008 - DNA, 19 bp, Homo sapiens
aggatggaggggtggtcct

SEQ ID NO: 4365009 - DNA, 20 bp, Homo sapiens
aggcacacagggcccggcca

SEQ ID NO: 4365010 - DNA, 15 bp, Homo sapiens
aggcagccctcacct

SEQ ID NO: 4365011 - DNA, 18 bp, Homo sapiens
aggcagccctcacctctg

SEQ ID NO: 4365012 - DNA, 13 bp, Homo sapiens
aggcataggcctg

SEQ ID NO: 4365013 - DNA, 19 bp, Homo sapiens
aggcataggcctgggtgct

SEQ ID NO: 4365014 - DNA, 17 bp, Homo sapiens
aggcatgtcccacccac

SEQ ID NO: 4365015 - DNA, 19 bp, Homo sapiens
aggcccagtgcatatgcaa

SEQ ID NO: 4365016 - DNA, 18 bp, Homo sapiens
aggcccatggttgagaaa

SEQ ID NO: 4365017 - DNA, 17 bp, Homo sapiens
aggcccttgtcgtggga

SEQ ID NO: 4365018 - DNA, 19 bp, Homo sapiens
aggccggggtccaggcccg

SEQ ID NO: 4365019 - DNA, 21 bp, Homo sapiens
aggcctctggttgcctccccc

SEQ ID NO: 4365020 - DNA, 16 bp, Homo sapiens
aggcctgggtgctggc

SEQ ID NO: 4365021 - DNA, 17 bp, Homo sapiens
aggcctgggtgctggct

SEQ ID NO: 4365022 - DNA, 23 bp, Homo sapiens
aggctgcctcagccagtggcaca

SEQ ID NO: 4365023 - DNA, 13 bp, Homo sapiens
aggctggctggcc

SEQ ID NO: 4365024 - DNA, 15 bp, Homo sapiens
agggaaaccttggag

SEQ ID NO: 4365025 - DNA, 21 bp, Homo sapiens
agggaaaccttggagaggaga

SEQ ID NO: 4365026 - DNA, 14 bp, Homo sapiens
agggaagaccagaa

SEQ ID NO: 4365027 - DNA, 15 bp, Homo sapiens
agggagagccagctc

SEQ ID NO: 4365028 - DNA, 13 bp, Homo sapiens
agggcaagaaatg

SEQ ID NO: 4365029 - DNA, 22 bp, Homo sapiens
agggcacattgcccatggctgg

SEQ ID NO: 4365030 - DNA, 23 bp, Homo sapiens
agggcacattgcccatggctggg

SEQ ID NO: 4365031 - DNA, 22 bp, Homo sapiens
agggcagaggaatgtagggcct

SEQ ID NO: 4365032 - DNA, 14 bp, Homo sapiens
agggcaggcttggg

SEQ ID NO: 4365033 - DNA, 22 bp, Homo sapiens
agggcaggcttggggaaaatgg

SEQ ID NO: 4365034 - DNA, 17 bp, Homo sapiens
agggcagggcatctcct

SEQ ID NO: 4365035 - DNA, 16 bp, Homo sapiens
agggcagggctctgat

SEQ ID NO: 4365036 - DNA, 16 bp, Homo sapiens
agggcatctcctgtgc

SEQ ID NO: 4365037 - DNA, 21 bp, Homo sapiens
agggcatctcctgtgcatggg

SEQ ID NO: 4365038 - DNA, 23 bp, Homo sapiens
agggcatctcctgtgcatgggtg

SEQ ID NO: 4365039 - DNA, 14 bp, Homo sapiens
agggccatgcagac

SEQ ID NO: 4365040 - DNA, 23 bp, Homo sapiens
agggcctgcatggagaagggttc

SEQ ID NO: 4365041 - DNA, 20 bp, Homo sapiens
agggcgaacgacaatagctt

SEQ ID NO: 4365042 - DNA, 21 bp, Homo sapiens
agggctctgatattccatgaa

SEQ ID NO: 4365043 - DNA, 15 bp, Homo sapiens
aggggcgggctcaga

SEQ ID NO: 4365044 - DNA, 16 bp, Homo sapiens
aggggcgggctcagag

SEQ ID NO: 4365045 - DNA, 15 bp, Homo sapiens
agggggtgactggaa

SEQ ID NO: 4365046 - DNA, 18 bp, Homo sapiens
aggggtggtcctgactca

SEQ ID NO: 4365047 - DNA, 12 bp, Homo sapiens
agggtgggaaga

SEQ ID NO: 4365048 - DNA, 13 bp, Homo sapiens
agggttctgccct

SEQ ID NO: 4365049 - DNA, 15 bp, Homo sapiens
agggttctgccctgc

SEQ ID NO: 4365050 - DNA, 17 bp, Homo sapiens
aggtaccaaacaaggaa

SEQ ID NO: 4365051 - DNA, 22 bp, Homo sapiens
aggtaccaaacaaggaagccaa

SEQ ID NO: 4365052 - DNA, 23 bp, Homo sapiens
aggtcactccaccatccccaccc

SEQ ID NO: 4365053 - DNA, 14 bp, Homo sapiens
aggtcactcctggg

SEQ ID NO: 4365054 - DNA, 21 bp, Homo sapiens
aggtccttgcctgaactccag

SEQ ID NO: 4365055 - DNA, 22 bp, Homo sapiens
aggtccttgcctgaactccaga

SEQ ID NO: 4365056 - DNA, 15 bp, Homo sapiens
aggtctcttgaggga

SEQ ID NO: 4365057 - DNA, 16 bp, Homo sapiens
aggtctcttgagggag

SEQ ID NO: 4365058 - DNA, 21 bp, Homo sapiens
aggtgcctcatagcatagcca

SEQ ID NO: 4365059 - DNA, 22 bp, Homo sapiens
aggtgctgaatgaagctgccat

SEQ ID NO: 4365060 - DNA, 20 bp, Homo sapiens
aggtgctgtgcgccttgtag

SEQ ID NO: 4365061 - DNA, 19 bp, Homo sapiens
aggttagaaaggcagccct

SEQ ID NO: 4365062 - DNA, 17 bp, Homo sapiens
aggttataggtcactcc

SEQ ID NO: 4365063 - DNA, 19 bp, Homo sapiens
agtaagagctggtgtctga

SEQ ID NO: 4365064 - DNA, 20 bp, Homo sapiens
agtacagaacagtaaagtta

SEQ ID NO: 4365065 - DNA, 22 bp, Homo sapiens
agtacagaacagtaaagttaaa

SEQ ID NO: 4365066 - DNA, 16 bp, Homo sapiens
agtactttgtgcattc

SEQ ID NO: 4365067 - DNA, 23 bp, Homo sapiens
agtagagtcatctccatcagctg

SEQ ID NO: 4365068 - DNA, 13 bp, Homo sapiens
agtatcactctaa

SEQ ID NO: 4365069 - DNA, 19 bp, Homo sapiens
agtatcactctaatataat

SEQ ID NO: 4365070 - DNA, 17 bp, Homo sapiens
agtatgccttaagcaga

SEQ ID NO: 4365071 - DNA, 18 bp, Homo sapiens
agtatgccttaagcagaa

SEQ ID NO: 4365072 - DNA, 19 bp, Homo sapiens
agtatgctttccctgagga

SEQ ID NO: 4365073 - DNA, 22 bp, Homo sapiens
agtatgtggtactactgtaaga

SEQ ID NO: 4365074 - DNA, 19 bp, Homo sapiens
agtcactgttcgtcactca

SEQ ID NO: 4365075 - DNA, 20 bp, Homo sapiens
agtcatctgtaagagcttgc

SEQ ID NO: 4365076 - DNA, 18 bp, Homo sapiens
agtcatcttgtgagtgga

SEQ ID NO: 4365077 - DNA, 10 bp, Homo sapiens
agtcatggta

SEQ ID NO: 4365078 - DNA, 16 bp, Homo sapiens
agtccaaccagaaaca

SEQ ID NO: 4365079 - DNA, 21 bp, Homo sapiens
agtccaaccagaaacacccct

SEQ ID NO: 4365080 - DNA, 13 bp, Homo sapiens
agtccctggagct

SEQ ID NO: 4365081 - DNA, 14 bp, Homo sapiens
agtctccttcccct

SEQ ID NO: 4365082 - DNA, 14 bp, Homo sapiens
agtctgttatgcac

SEQ ID NO: 4365083 - DNA, 16 bp, Homo sapiens
agtcttggttctaaag

SEQ ID NO: 4365084 - DNA, 21 bp, Homo sapiens
agtgaacattcccagcccagc

SEQ ID NO: 4365085 - DNA, 16 bp, Homo sapiens
agtgacagctttctgg

SEQ ID NO: 4365086 - DNA, 12 bp, Homo sapiens
agtgagcagaac

SEQ ID NO: 4365087 - DNA, 16 bp, Homo sapiens
agtgagcagaacaggt

SEQ ID NO: 4365088 - DNA, 22 bp, Homo sapiens
agtgataaatcgggaaatttac

SEQ ID NO: 4365089 - DNA, 13 bp, Homo sapiens
agtggaggaggag

SEQ ID NO: 4365090 - DNA, 22 bp, Homo sapiens
agtggaggaggaggaggagcct

SEQ ID NO: 4365091 - DNA, 21 bp, Homo sapiens
agtggatatgacccacactgc

SEQ ID NO: 4365092 - DNA, 19 bp, Homo sapiens
agtggcaggtgggctgcct

SEQ ID NO: 4365093 - DNA, 20 bp, Homo sapiens
agtggcaggtgggctgcctg

SEQ ID NO: 4365094 - DNA, 21 bp, Homo sapiens
agtggcaggtgggctgcctgc

SEQ ID NO: 4365095 - DNA, 18 bp, Homo sapiens
agtgggctgggccctctg

SEQ ID NO: 4365096 - DNA, 20 bp, Homo sapiens
agtggggtcccccctgagtg

SEQ ID NO: 4365097 - DNA, 23 bp, Homo sapiens
agtggggtcccccctgagtgggc

SEQ ID NO: 4365098 - DNA, 12 bp, Homo sapiens
agtggtcaagga

SEQ ID NO: 4365099 - DNA, 16 bp, Homo sapiens
agtggtctttctggag

SEQ ID NO: 4365100 - DNA, 13 bp, Homo sapiens
agtgtaacagctg

SEQ ID NO: 4365101 - DNA, 17 bp, Homo sapiens
agtgtaacagctgaggt

SEQ ID NO: 4365102 - DNA, 17 bp, Homo sapiens
agtgtacacgtctggac

SEQ ID NO: 4365103 - DNA, 21 bp, Homo sapiens
agtgtacacgtctggaccccg

SEQ ID NO: 4365104 - DNA, 20 bp, Homo sapiens
agtgtctgctgctgcctccc

SEQ ID NO: 4365105 - DNA, 21 bp, Homo sapiens
agtgtctgctgctgcctccct

SEQ ID NO: 4365106 - DNA, 12 bp, Homo sapiens
agtgtgagtaag

SEQ ID NO: 4365107 - DNA, 16 bp, Homo sapiens
agtgtgagtaagagct

SEQ ID NO: 4365108 - DNA, 23 bp, Homo sapiens
agtgtggagttcaccttggaagg

SEQ ID NO: 4365109 - DNA, 11 bp, Homo sapiens
agtgtgtaaag

SEQ ID NO: 4365110 - DNA, 20 bp, Homo sapiens
agtgttctcatgaagcagga

SEQ ID NO: 4365111 - DNA, 22 bp, Homo sapiens
agtgttctcatgaagcaggagg

SEQ ID NO: 4365112 - DNA, 13 bp, Homo sapiens
agttaatgaaata

SEQ ID NO: 4365113 - DNA, 14 bp, Homo sapiens
agttaatgaaataa

SEQ ID NO: 4365114 - DNA, 21 bp, Homo sapiens
agttaatgaaataaaatttga

SEQ ID NO: 4365115 - DNA, 13 bp, Homo sapiens
agttacagaattc

SEQ ID NO: 4365116 - DNA, 16 bp, Homo sapiens
agttacttgaaataag

SEQ ID NO: 4365117 - DNA, 13 bp, Homo sapiens
agttcccaactga

SEQ ID NO: 4365118 - DNA, 13 bp, Homo sapiens
agttccttgcctt

SEQ ID NO: 4365119 - DNA, 16 bp, Homo sapiens
agttccttgccttaat

SEQ ID NO: 4365120 - DNA, 13 bp, Homo sapiens
agttctgctgccc

SEQ ID NO: 4365121 - DNA, 16 bp, Homo sapiens
agttctgctgccctct

SEQ ID NO: 4365122 - DNA, 19 bp, Homo sapiens
agttctgctgccctcttaa

SEQ ID NO: 4365123 - DNA, 14 bp, Homo sapiens
agttgacagtgaaa

SEQ ID NO: 4365124 - DNA, 10 bp, Homo sapiens
agttggaagg

SEQ ID NO: 4365125 - DNA, 19 bp, Homo sapiens
agttggaaggatctgctga

SEQ ID NO: 4365126 - DNA, 17 bp, Homo sapiens
agttgggggagggaaga

SEQ ID NO: 4365127 - DNA, 13 bp, Homo sapiens
agttgtggatatc

SEQ ID NO: 4365128 - DNA, 18 bp, Homo sapiens
agtttaaggaacttctga

SEQ ID NO: 4365129 - DNA, 14 bp, Homo sapiens
agtttacattgtcc

SEQ ID NO: 4365130 - DNA, 14 bp, Homo sapiens
agtttgaaaaacta

SEQ ID NO: 4365131 - DNA, 21 bp, Homo sapiens
agtttgaaaaactaattgagc

SEQ ID NO: 4365132 - DNA, 12 bp, Homo sapiens
agtttggccctg

SEQ ID NO: 4365133 - DNA, 15 bp, Homo sapiens
agtttggccctggag

SEQ ID NO: 4365134 - DNA, 17 bp, Homo sapiens
agtttggccctggagcc

SEQ ID NO: 4365135 - DNA, 13 bp, Homo sapiens
agtttgtattttg

SEQ ID NO: 4365136 - DNA, 17 bp, Homo sapiens
agttttttattatgcat

SEQ ID NO: 4365137 - DNA, 14 bp, Homo sapiens
ataaaagatcacct

SEQ ID NO: 4365138 - DNA, 18 bp, Homo sapiens
ataaaagtgatcaataaa

SEQ ID NO: 4365139 - DNA, 13 bp, Homo sapiens
ataaaatgtgatt

SEQ ID NO: 4365140 - DNA, 23 bp, Homo sapiens
ataaacattttgtccacctttta

SEQ ID NO: 4365141 - DNA, 16 bp, Homo sapiens
ataaactttacatatt

SEQ ID NO: 4365142 - DNA, 11 bp, Homo sapiens
ataaatatgta

SEQ ID NO: 4365143 - DNA, 22 bp, Homo sapiens
ataaattcagatatatttttca

SEQ ID NO: 4365144 - DNA, 20 bp, Homo sapiens
ataaatttcaattagattta

SEQ ID NO: 4365145 - DNA, 22 bp, Homo sapiens
ataaatttcaattagatttaaa

SEQ ID NO: 4365146 - DNA, 14 bp, Homo sapiens
ataacactgcagcc

SEQ ID NO: 4365147 - DNA, 12 bp, Homo sapiens
ataaccaaagag

SEQ ID NO: 4365148 - DNA, 17 bp, Homo sapiens
ataagcataaaagatca

SEQ ID NO: 4365149 - DNA, 15 bp, Homo sapiens
ataagttacttgaaa

SEQ ID NO: 4365150 - DNA, 17 bp, Homo sapiens
ataatacttgacctctg

SEQ ID NO: 4365151 - DNA, 17 bp, Homo sapiens
ataatactttaggaaat

SEQ ID NO: 4365152 - DNA, 23 bp, Homo sapiens
ataatatggatcagagcatttat

SEQ ID NO: 4365153 - DNA, 14 bp, Homo sapiens
ataatcaggaaaaa

SEQ ID NO: 4365154 - DNA, 17 bp, Homo sapiens
ataatcaggaaaaatga

SEQ ID NO: 4365155 - DNA, 22 bp, Homo sapiens
ataatgttgccttggaaacatt

SEQ ID NO: 4365156 - DNA, 21 bp, Homo sapiens
ataatttcccaattaggaagt

SEQ ID NO: 4365157 - DNA, 24 bp, Homo sapiens
ataatttgtacaatggtttattcc

SEQ ID NO: 4365158 - DNA, 17 bp, Homo sapiens
atacactgaatggaaat

SEQ ID NO: 4365159 - DNA, 12 bp, Homo sapiens
atactcaaggtg

SEQ ID NO: 4365160 - DNA, 13 bp, Homo sapiens
atactctgtcaga

SEQ ID NO: 4365161 - DNA, 14 bp, Homo sapiens
atactctgtcagat

SEQ ID NO: 4365162 - DNA, 15 bp, Homo sapiens
atactctgtcagatg

SEQ ID NO: 4365163 - DNA, 16 bp, Homo sapiens
atactgtacttaataa

SEQ ID NO: 4365164 - DNA, 17 bp, Homo sapiens
atactgtacttaataaa

SEQ ID NO: 4365165 - DNA, 13 bp, Homo sapiens
atagacttgggat

SEQ ID NO: 4365166 - DNA, 13 bp, Homo sapiens
atagagagcaatt

SEQ ID NO: 4365167 - DNA, 14 bp, Homo sapiens
atagagagcaattt

SEQ ID NO: 4365168 - DNA, 19 bp, Homo sapiens
atagatgtccctttcttgg

SEQ ID NO: 4365169 - DNA, 22 bp, Homo sapiens
atagcaatccatgttagttttt

SEQ ID NO: 4365170 - DNA, 15 bp, Homo sapiens
atagcatagccagca

SEQ ID NO: 4365171 - DNA, 15 bp, Homo sapiens
atagcctaaatgatg

SEQ ID NO: 4365172 - DNA, 18 bp, Homo sapiens
atagctttataaagcagt

SEQ ID NO: 4365173 - DNA, 20 bp, Homo sapiens
atagtgtctattatcacatt

SEQ ID NO: 4365174 - DNA, 17 bp, Homo sapiens
atagttccttgccttaa

SEQ ID NO: 4365175 - DNA, 21 bp, Homo sapiens
atagttccttgccttaataaa

SEQ ID NO: 4365176 - DNA, 23 bp, Homo sapiens
atagttccttgccttaataaata

SEQ ID NO: 4365177 - DNA, 15 bp, Homo sapiens
atataaacttaaaat

SEQ ID NO: 4365178 - DNA, 14 bp, Homo sapiens
atataaatttaagc

SEQ ID NO: 4365179 - DNA, 14 bp, Homo sapiens
atatacctggttta

SEQ ID NO: 4365180 - DNA, 13 bp, Homo sapiens
atatagaatatat

SEQ ID NO: 4365181 - DNA, 22 bp, Homo sapiens
atatagttccttgccttaataa

SEQ ID NO: 4365182 - DNA, 20 bp, Homo sapiens
atatatatgtgtgtgtatgt

SEQ ID NO: 4365183 - DNA, 18 bp, Homo sapiens
atatcagggtataaatta

SEQ ID NO: 4365184 - DNA, 19 bp, Homo sapiens
atatgcaagtgaacaaagt

SEQ ID NO: 4365185 - DNA, 15 bp, Homo sapiens
atattaaagatatca

SEQ ID NO: 4365186 - DNA, 12 bp, Homo sapiens
atattaaagatt

SEQ ID NO: 4365187 - DNA, 23 bp, Homo sapiens
atattaaattctgaatgcaattt

SEQ ID NO: 4365188 - DNA, 16 bp, Homo sapiens
atattccatgaatgta

SEQ ID NO: 4365189 - DNA, 14 bp, Homo sapiens
atatttatatttca

SEQ ID NO: 4365190 - DNA, 19 bp, Homo sapiens
atatttgtaaactacaaag

SEQ ID NO: 4365191 - DNA, 16 bp, Homo sapiens
atatttgtcttccgat

SEQ ID NO: 4365192 - DNA, 16 bp, Homo sapiens
atcaaagaacagatgg

SEQ ID NO: 4365193 - DNA, 19 bp, Homo sapiens
atcaacatttatgacctaa

SEQ ID NO: 4365194 - DNA, 18 bp, Homo sapiens
atcacattaatctcaaag

SEQ ID NO: 4365195 - DNA, 21 bp, Homo sapiens
atcacattaatctcaaagaga

SEQ ID NO: 4365196 - DNA, 12 bp, Homo sapiens
atcagaagtttg

SEQ ID NO: 4365197 - DNA, 20 bp, Homo sapiens
atcagattgacagcatatag

SEQ ID NO: 4365198 - DNA, 22 bp, Homo sapiens
atcagcaacttctagcatatag

SEQ ID NO: 4365199 - DNA, 14 bp, Homo sapiens
atcagccccgcctg

SEQ ID NO: 4365200 - DNA, 17 bp, Homo sapiens
atcagccccgcctgtca

SEQ ID NO: 4365201 - DNA, 19 bp, Homo sapiens
atcagccccgcctgtcaca

SEQ ID NO: 4365202 - DNA, 23 bp, Homo sapiens
atcagccccgcctgtcacaataa

SEQ ID NO: 4365203 - DNA, 23 bp, Homo sapiens
atcagggtataaattatatccgt

SEQ ID NO: 4365204 - DNA, 16 bp, Homo sapiens
atcatcggagttgaca

SEQ ID NO: 4365205 - DNA, 17 bp, Homo sapiens
atcatggtcaagttccc

SEQ ID NO: 4365206 - DNA, 18 bp, Homo sapiens
atcatggtcaagttccca

SEQ ID NO: 4365207 - DNA, 22 bp, Homo sapiens
atcattccaattctaaatccga

SEQ ID NO: 4365208 - DNA, 15 bp, Homo sapiens
atcatttaactgaac

SEQ ID NO: 4365209 - DNA, 13 bp, Homo sapiens
atccaaaagacaa

SEQ ID NO: 4365210 - DNA, 18 bp, Homo sapiens
atccagggatggagatgg

SEQ ID NO: 4365211 - DNA, 22 bp, Homo sapiens
atcccgcctcttcttcttcaga

SEQ ID NO: 4365212 - DNA, 14 bp, Homo sapiens
atccctaccactgt

SEQ ID NO: 4365213 - DNA, 16 bp, Homo sapiens
atccctaccactgtgg

SEQ ID NO: 4365214 - DNA, 19 bp, Homo sapiens
atccctcacccatcctaga

SEQ ID NO: 4365215 - DNA, 21 bp, Homo sapiens
atcccttccttttagcctagt

SEQ ID NO: 4365216 - DNA, 17 bp, Homo sapiens
atcctgcaggaaatata

SEQ ID NO: 4365217 - DNA, 14 bp, Homo sapiens
atccttccatcttg

SEQ ID NO: 4365218 - DNA, 23 bp, Homo sapiens
atcggagttgacagtgaaacaaa

SEQ ID NO: 4365219 - DNA, 19 bp, Homo sapiens
atctcctgtgcatgggtga

SEQ ID NO: 4365220 - DNA, 13 bp, Homo sapiens
atctgactgccaa

SEQ ID NO: 4365221 - DNA, 21 bp, Homo sapiens
atctgctgaggcccagtgcat

SEQ ID NO: 4365222 - DNA, 11 bp, Homo sapiens
atctggccctg

SEQ ID NO: 4365223 - DNA, 12 bp, Homo sapiens
atctggccctga

SEQ ID NO: 4365224 - DNA, 17 bp, Homo sapiens
atctgtaagagcttgct

SEQ ID NO: 4365225 - DNA, 18 bp, Homo sapiens
atcttctatcattccaat

SEQ ID NO: 4365226 - DNA, 18 bp, Homo sapiens
atcttgtgagtggataat

SEQ ID NO: 4365227 - DNA, 21 bp, Homo sapiens
atcttgtgagtggataatcag

SEQ ID NO: 4365228 - DNA, 17 bp, Homo sapiens
atcttgtggggccagga

SEQ ID NO: 4365229 - DNA, 18 bp, Homo sapiens
atctttatcatcggagtt

SEQ ID NO: 4365230 - DNA, 19 bp, Homo sapiens
atctttctccctcaactga

SEQ ID NO: 4365231 - DNA, 17 bp, Homo sapiens
atgaaaatcagcaactt

SEQ ID NO: 4365232 - DNA, 19 bp, Homo sapiens
atgaaaggaagtataaagt

SEQ ID NO: 4365233 - DNA, 18 bp, Homo sapiens
atgaaataaaatttgaaa

SEQ ID NO: 4365234 - DNA, 17 bp, Homo sapiens
atgaacagctgtgtctg

SEQ ID NO: 4365235 - DNA, 21 bp, Homo sapiens
atgaacagctgtgtctgccaa

SEQ ID NO: 4365236 - DNA, 18 bp, Homo sapiens
atgaacattttgtggagt

SEQ ID NO: 4365237 - DNA, 14 bp, Homo sapiens
atgaagctgccatc

SEQ ID NO: 4365238 - DNA, 22 bp, Homo sapiens
atgaagctgccatccttgctgc

SEQ ID NO: 4365239 - DNA, 15 bp, Homo sapiens
atgaataatttccca

SEQ ID NO: 4365240 - DNA, 15 bp, Homo sapiens
atgaatgtatcagga

SEQ ID NO: 4365241 - DNA, 16 bp, Homo sapiens
atgaatgtatcaggaa

SEQ ID NO: 4365242 - DNA, 12 bp, Homo sapiens
atgaccaaagat

SEQ ID NO: 4365243 - DNA, 19 bp, Homo sapiens
atgacctgtgaccagcact

SEQ ID NO: 4365244 - DNA, 20 bp, Homo sapiens
atgacggtaagtgttctcat

SEQ ID NO: 4365245 - DNA, 16 bp, Homo sapiens
atgactacatagtaag

SEQ ID NO: 4365246 - DNA, 20 bp, Homo sapiens
atgagatgttattactgttt

SEQ ID NO: 4365247 - DNA, 15 bp, Homo sapiens
atgagcgccacctct

SEQ ID NO: 4365248 - DNA, 21 bp, Homo sapiens
atgaggaatccaaaagacaaa

SEQ ID NO: 4365249 - DNA, 17 bp, Homo sapiens
atgatgttagaagaaga

SEQ ID NO: 4365250 - DNA, 12 bp, Homo sapiens
atgatttcccaa

SEQ ID NO: 4365251 - DNA, 9 bp, Homo sapiens
atgcaatat

SEQ ID NO: 4365252 - DNA, 15 bp, Homo sapiens
atgcaatataagcat

SEQ ID NO: 4365253 - DNA, 20 bp, Homo sapiens
atgcacactagcctctccag

SEQ ID NO: 4365254 - DNA, 13 bp, Homo sapiens
atgcactgtggtt

SEQ ID NO: 4365255 - DNA, 20 bp, Homo sapiens
atgcactgtggtttcagatg

SEQ ID NO: 4365256 - DNA, 15 bp, Homo sapiens
atgcagaaagcatcc

SEQ ID NO: 4365257 - DNA, 23 bp, Homo sapiens
atgcagacagtctgttatgcact

SEQ ID NO: 4365258 - DNA, 20 bp, Homo sapiens
atgcaggaggtggagaaaat

SEQ ID NO: 4365259 - DNA, 19 bp, Homo sapiens
atgccaagggggtgactgg

SEQ ID NO: 4365260 - DNA, 19 bp, Homo sapiens
atgccaccctgttttcagc

SEQ ID NO: 4365261 - DNA, 18 bp, Homo sapiens
atgccataatcagaacac

SEQ ID NO: 4365262 - DNA, 16 bp, Homo sapiens
atgcccagctctctga

SEQ ID NO: 4365263 - DNA, 14 bp, Homo sapiens
atgccccagctctg

SEQ ID NO: 4365264 - DNA, 13 bp, Homo sapiens
atgccttaagcag

SEQ ID NO: 4365265 - DNA, 17 bp, Homo sapiens
atgccttaagcagaaca

SEQ ID NO: 4365266 - DNA, 20 bp, Homo sapiens
atgccttaagcagaacaaat

SEQ ID NO: 4365267 - DNA, 16 bp, Homo sapiens
atgctacaatggaaac

SEQ ID NO: 4365268 - DNA, 20 bp, Homo sapiens
atgctttccctgaggaatga

SEQ ID NO: 4365269 - DNA, 19 bp, Homo sapiens
atggactgtacaataagtt

SEQ ID NO: 4365270 - DNA, 21 bp, Homo sapiens
atggagaagggttctgccctg

SEQ ID NO: 4365271 - DNA, 18 bp, Homo sapiens
atggaggggtggtcctga

SEQ ID NO: 4365272 - DNA, 17 bp, Homo sapiens
atggatgagtcagacac

SEQ ID NO: 4365273 - DNA, 21 bp, Homo sapiens
atggatttgcctgtgccaccc

SEQ ID NO: 4365274 - DNA, 19 bp, Homo sapiens
atggcatttggtctcaggc

SEQ ID NO: 4365275 - DNA, 21 bp, Homo sapiens
atggcatttggtctcaggcag

SEQ ID NO: 4365276 - DNA, 22 bp, Homo sapiens
atggcatttggtctcaggcagc

SEQ ID NO: 4365277 - DNA, 10 bp, Homo sapiens
atggccatgc

SEQ ID NO: 4365278 - DNA, 15 bp, Homo sapiens
atgggagggatcagc

SEQ ID NO: 4365279 - DNA, 20 bp, Homo sapiens
atggggggcgggccagggtg

SEQ ID NO: 4365280 - DNA, 20 bp, Homo sapiens
atggggtccatccccttccc

SEQ ID NO: 4365281 - DNA, 18 bp, Homo sapiens
atggtaggggagggcagg

SEQ ID NO: 4365282 - DNA, 13 bp, Homo sapiens
atggtgtctccca

SEQ ID NO: 4365283 - DNA, 19 bp, Homo sapiens
atggttgagaaatgaataa

SEQ ID NO: 4365284 - DNA, 17 bp, Homo sapiens
atggttgggggaatgca

SEQ ID NO: 4365285 - DNA, 13 bp, Homo sapiens
atgtaaaaaatat

SEQ ID NO: 4365286 - DNA, 14 bp, Homo sapiens
atgtaaaaaatatt

SEQ ID NO: 4365287 - DNA, 18 bp, Homo sapiens
atgtaaataaaattgagt

SEQ ID NO: 4365288 - DNA, 20 bp, Homo sapiens
atgtaatataaatttaagca

SEQ ID NO: 4365289 - DNA, 20 bp, Homo sapiens
atgtacaattttatataatt

SEQ ID NO: 4365290 - DNA, 16 bp, Homo sapiens
atgtacttgaaggatg

SEQ ID NO: 4365291 - DNA, 17 bp, Homo sapiens
atgtacttgaaggatgg

SEQ ID NO: 4365292 - DNA, 15 bp, Homo sapiens
atgtagtcagttgca

SEQ ID NO: 4365293 - DNA, 16 bp, Homo sapiens
atgtattattctgcag

SEQ ID NO: 4365294 - DNA, 17 bp, Homo sapiens
atgtattattctgcagc

SEQ ID NO: 4365295 - DNA, 19 bp, Homo sapiens
atgtgcaataatttgtaca

SEQ ID NO: 4365296 - DNA, 21 bp, Homo sapiens
atgtgtcatttataacttctg

SEQ ID NO: 4365297 - DNA, 19 bp, Homo sapiens
atgtgtttttctatatagt

SEQ ID NO: 4365298 - DNA, 20 bp, Homo sapiens
atgttatgaacagctgtgtc

SEQ ID NO: 4365299 - DNA, 15 bp, Homo sapiens
atgttattactgttt

SEQ ID NO: 4365300 - DNA, 21 bp, Homo sapiens
atgttattactgttttgggcc

SEQ ID NO: 4365301 - DNA, 18 bp, Homo sapiens
atgtttaaatagcctaaa

SEQ ID NO: 4365302 - DNA, 15 bp, Homo sapiens
atgtttttaatgtat

SEQ ID NO: 4365303 - DNA, 20 bp, Homo sapiens
attaaagattggaatgtgtt

SEQ ID NO: 4365304 - DNA, 16 bp, Homo sapiens
attaagttttaaataa

SEQ ID NO: 4365305 - DNA, 20 bp, Homo sapiens
attaggaagtgtaacagctg

SEQ ID NO: 4365306 - DNA, 21 bp, Homo sapiens
attaggaagtgtaacagctga

SEQ ID NO: 4365307 - DNA, 22 bp, Homo sapiens
attaggaagtgtaacagctgag

SEQ ID NO: 4365308 - DNA, 13 bp, Homo sapiens
attattctgcagc

SEQ ID NO: 4365309 - DNA, 15 bp, Homo sapiens
attcaaattgctgct

SEQ ID NO: 4365310 - DNA, 16 bp, Homo sapiens
attcaaattgctgctt

SEQ ID NO: 4365311 - DNA, 21 bp, Homo sapiens
attcaaattgctgcttggatt

SEQ ID NO: 4365312 - DNA, 14 bp, Homo sapiens
attcaggtacagaa

SEQ ID NO: 4365313 - DNA, 20 bp, Homo sapiens
attcaggtacagaaaacatg

SEQ ID NO: 4365314 - DNA, 17 bp, Homo sapiens
attcccaagtatgcctt

SEQ ID NO: 4365315 - DNA, 18 bp, Homo sapiens
attcccttgaattgtgta

SEQ ID NO: 4365316 - DNA, 18 bp, Homo sapiens
attccttttgtgtacagt

SEQ ID NO: 4365317 - DNA, 23 bp, Homo sapiens
attctaaatccgacttgaatatt

SEQ ID NO: 4365318 - DNA, 22 bp, Homo sapiens
attctgcagcatgacctgtgac

SEQ ID NO: 4365319 - DNA, 19 bp, Homo sapiens
attgatctgccaaatcgtt

SEQ ID NO: 4365320 - DNA, 13 bp, Homo sapiens
attgatgcaatat

SEQ ID NO: 4365321 - DNA, 12 bp, Homo sapiens
attgccttcagc

SEQ ID NO: 4365322 - DNA, 15 bp, Homo sapiens
attgccttcagccct

SEQ ID NO: 4365323 - DNA, 14 bp, Homo sapiens
attgctgcttggat

SEQ ID NO: 4365324 - DNA, 14 bp, Homo sapiens
attgtcctgtagct

SEQ ID NO: 4365325 - DNA, 15 bp, Homo sapiens
attgtgtattgatgc

SEQ ID NO: 4365326 - DNA, 21 bp, Homo sapiens
attgttaagtctaaatatttc

SEQ ID NO: 4365327 - DNA, 22 bp, Homo sapiens
attgttaagtctaaatatttcc

SEQ ID NO: 4365328 - DNA, 23 bp, Homo sapiens
attgttaagtctaaatatttcct

SEQ ID NO: 4365329 - DNA, 16 bp, Homo sapiens
attgttcttgggagaa

SEQ ID NO: 4365330 - DNA, 18 bp, Homo sapiens
atttaactgaactgtgaa

SEQ ID NO: 4365331 - DNA, 19 bp, Homo sapiens
atttaactgaactgtgaac

SEQ ID NO: 4365332 - DNA, 14 bp, Homo sapiens
atttacatcagaag

SEQ ID NO: 4365333 - DNA, 19 bp, Homo sapiens
atttacatcagaagtttgc

SEQ ID NO: 4365334 - DNA, 14 bp, Homo sapiens
atttaccctttggc

SEQ ID NO: 4365335 - DNA, 13 bp, Homo sapiens
atttatatttcac

SEQ ID NO: 4365336 - DNA, 22 bp, Homo sapiens
atttcaattagatttaaaataa

SEQ ID NO: 4365337 - DNA, 22 bp, Homo sapiens
atttccccgatgtcccctgcgg

SEQ ID NO: 4365338 - DNA, 14 bp, Homo sapiens
atttccctctctca

SEQ ID NO: 4365339 - DNA, 17 bp, Homo sapiens
atttgctagttctgctg

SEQ ID NO: 4365340 - DNA, 19 bp, Homo sapiens
atttggtaaaaatgctgct

SEQ ID NO: 4365341 - DNA, 23 bp, Homo sapiens
atttggtctcaggcagcaccaca

SEQ ID NO: 4365342 - DNA, 14 bp, Homo sapiens
atttgtcttccgat

SEQ ID NO: 4365343 - DNA, 16 bp, Homo sapiens
attttgtatatttgta

SEQ ID NO: 4365344 - DNA, 17 bp, Homo sapiens
atttttatgcagacagt

SEQ ID NO: 4365345 - DNA, 20 bp, Homo sapiens
attttttaaggcaaataaag

SEQ ID NO: 4365346 - DNA, 23 bp, Homo sapiens
attttttacttttcacactgtct

SEQ ID NO: 4365347 - DNA, 22 bp, Homo sapiens
caaaaatcaaagaacagatggg

SEQ ID NO: 4365348 - DNA, 19 bp, Homo sapiens
caaaaatgaaagcatgtct

SEQ ID NO: 4365349 - DNA, 15 bp, Homo sapiens
caaaagcaaatgaga

SEQ ID NO: 4365350 - DNA, 14 bp, Homo sapiens
caaaagcacccttg

SEQ ID NO: 4365351 - DNA, 16 bp, Homo sapiens
caaaatttaagttaac

SEQ ID NO: 4365352 - DNA, 19 bp, Homo sapiens
caaacacatttaccctttg

SEQ ID NO: 4365353 - DNA, 16 bp, Homo sapiens
caaacccagaggtgga

SEQ ID NO: 4365354 - DNA, 15 bp, Homo sapiens
caaacctactgccca

SEQ ID NO: 4365355 - DNA, 22 bp, Homo sapiens
caaacctactgcccacatttgg

SEQ ID NO: 4365356 - DNA, 13 bp, Homo sapiens
caaactgctgcat

SEQ ID NO: 4365357 - DNA, 16 bp, Homo sapiens
caaactgctgcatact

SEQ ID NO: 4365358 - DNA, 18 bp, Homo sapiens
caaagcagcaggcctctg

SEQ ID NO: 4365359 - DNA, 14 bp, Homo sapiens
caaaggagccttga

SEQ ID NO: 4365360 - DNA, 14 bp, Homo sapiens
caaagtaaaatgaa

SEQ ID NO: 4365361 - DNA, 20 bp, Homo sapiens
caaagtaaaatgaacatttt

SEQ ID NO: 4365362 - DNA, 17 bp, Homo sapiens
caaagttggggcaggct

SEQ ID NO: 4365363 - DNA, 15 bp, Homo sapiens
caaagtttacattgt

SEQ ID NO: 4365364 - DNA, 18 bp, Homo sapiens
caaagttttcaaactgct

SEQ ID NO: 4365365 - DNA, 21 bp, Homo sapiens
caaataaatcatcctcatgtc

SEQ ID NO: 4365366 - DNA, 18 bp, Homo sapiens
caaatctaccactgtatg

SEQ ID NO: 4365367 - DNA, 19 bp, Homo sapiens
caaatgtgtttttctatat

SEQ ID NO: 4365368 - DNA, 16 bp, Homo sapiens
caaattgccttcagcc

SEQ ID NO: 4365369 - DNA, 13 bp, Homo sapiens
caaattgctgctt

SEQ ID NO: 4365370 - DNA, 15 bp, Homo sapiens
caaattgctgcttgg

SEQ ID NO: 4365371 - DNA, 12 bp, Homo sapiens
caacatgggagg

SEQ ID NO: 4365372 - DNA, 23 bp, Homo sapiens
caacatgggagggatcagccccg

SEQ ID NO: 4365373 - DNA, 17 bp, Homo sapiens
caacatgttactgacca

SEQ ID NO: 4365374 - DNA, 18 bp, Homo sapiens
caacatgttactgaccag

SEQ ID NO: 4365375 - DNA, 14 bp, Homo sapiens
caacatttatgacc

SEQ ID NO: 4365376 - DNA, 23 bp, Homo sapiens
caaccagaaacacccctctgtct

SEQ ID NO: 4365377 - DNA, 23 bp, Homo sapiens
caacgggattgaagggtcctgcc

SEQ ID NO: 4365378 - DNA, 18 bp, Homo sapiens
caactgttggattcagaa

SEQ ID NO: 4365379 - DNA, 17 bp, Homo sapiens
caacttgtctttttctg

SEQ ID NO: 4365380 - DNA, 19 bp, Homo sapiens
caacttgtctttttctgga

SEQ ID NO: 4365381 - DNA, 21 bp, Homo sapiens
caagaaatggcgtctgctctg

SEQ ID NO: 4365382 - DNA, 11 bp, Homo sapiens
caagactcctc

SEQ ID NO: 4365383 - DNA, 18 bp, Homo sapiens
caagaggggcgggctcag

SEQ ID NO: 4365384 - DNA, 21 bp, Homo sapiens
caagatgctacaatggaaacc

SEQ ID NO: 4365385 - DNA, 15 bp, Homo sapiens
caaggaagaagaaat

SEQ ID NO: 4365386 - DNA, 23 bp, Homo sapiens
caagggcacattgcccatggctg

SEQ ID NO: 4365387 - DNA, 15 bp, Homo sapiens
caagggggtgactgg

SEQ ID NO: 4365388 - DNA, 19 bp, Homo sapiens
caagtatgccttaagcaga

SEQ ID NO: 4365389 - DNA, 20 bp, Homo sapiens
caagtatgccttaagcagaa

SEQ ID NO: 4365390 - DNA, 17 bp, Homo sapiens
caagtctccttcccctt

SEQ ID NO: 4365391 - DNA, 21 bp, Homo sapiens
caagttccttggccatgcaga

SEQ ID NO: 4365392 - DNA, 12 bp, Homo sapiens
caataagttact

SEQ ID NO: 4365393 - DNA, 21 bp, Homo sapiens
caataagttacttgaaataag

SEQ ID NO: 4365394 - DNA, 16 bp, Homo sapiens
caataatttgtacaat

SEQ ID NO: 4365395 - DNA, 14 bp, Homo sapiens
caatactaagtgac

SEQ ID NO: 4365396 - DNA, 16 bp, Homo sapiens
caatactaagtgacag

SEQ ID NO: 4365397 - DNA, 18 bp, Homo sapiens
caatagctttaccctcag

SEQ ID NO: 4365398 - DNA, 21 bp, Homo sapiens
caatagctttaccctcaggca

SEQ ID NO: 4365399 - DNA, 16 bp, Homo sapiens
caatagttaagtcaat

SEQ ID NO: 4365400 - DNA, 21 bp, Homo sapiens
caatccatgttagtttttact

SEQ ID NO: 4365401 - DNA, 16 bp, Homo sapiens
caatcctcactgggtg

SEQ ID NO: 4365402 - DNA, 13 bp, Homo sapiens
caatggtttattc

SEQ ID NO: 4365403 - DNA, 22 bp, Homo sapiens
caattaggaagtgtaacagctg

SEQ ID NO: 4365404 - DNA, 20 bp, Homo sapiens
caattctaaatccgacttga

SEQ ID NO: 4365405 - DNA, 21 bp, Homo sapiens
caatttggtaaaaatgctgct

SEQ ID NO: 4365406 - DNA, 22 bp, Homo sapiens
caatttggtaaaaatgctgctc

SEQ ID NO: 4365407 - DNA, 17 bp, Homo sapiens
cacaaccctgttttata

SEQ ID NO: 4365408 - DNA, 15 bp, Homo sapiens
cacacagagtggtct

SEQ ID NO: 4365409 - DNA, 14 bp, Homo sapiens
cacacaggacagcg

SEQ ID NO: 4365410 - DNA, 17 bp, Homo sapiens
cacactagcctctccag

SEQ ID NO: 4365411 - DNA, 18 bp, Homo sapiens
cacactagcctctccagg

SEQ ID NO: 4365412 - DNA, 19 bp, Homo sapiens
cacactagcctctccagga

SEQ ID NO: 4365413 - DNA, 17 bp, Homo sapiens
cacactgccagaagaga

SEQ ID NO: 4365414 - DNA, 21 bp, Homo sapiens
cacactgggtgcgtctccagt

SEQ ID NO: 4365415 - DNA, 14 bp, Homo sapiens
cacactgtcttccc

SEQ ID NO: 4365416 - DNA, 19 bp, Homo sapiens
cacacttgtgtgtgggctg

SEQ ID NO: 4365417 - DNA, 12 bp, Homo sapiens
cacagatggatt

SEQ ID NO: 4365418 - DNA, 15 bp, Homo sapiens
cacagccacccgtgg

SEQ ID NO: 4365419 - DNA, 14 bp, Homo sapiens
cacagctgggcagg

SEQ ID NO: 4365420 - DNA, 17 bp, Homo sapiens
cacagctgggcagggtg

SEQ ID NO: 4365421 - DNA, 13 bp, Homo sapiens
cacaggacagcgg

SEQ ID NO: 4365422 - DNA, 19 bp, Homo sapiens
cacaggagactccaaggag

SEQ ID NO: 4365423 - DNA, 17 bp, Homo sapiens
cacaggcacacagggcc

SEQ ID NO: 4365424 - DNA, 18 bp, Homo sapiens
cacagtccaaccagaaac

SEQ ID NO: 4365425 - DNA, 22 bp, Homo sapiens
cacatctggccctgacttctgg

SEQ ID NO: 4365426 - DNA, 14 bp, Homo sapiens
cacatggtgtctcc

SEQ ID NO: 4365427 - DNA, 17 bp, Homo sapiens
cacatggtgtctcccaa

SEQ ID NO: 4365428 - DNA, 19 bp, Homo sapiens
cacatgtacatatggaaat

SEQ ID NO: 4365429 - DNA, 15 bp, Homo sapiens
cacattaatctcaaa

SEQ ID NO: 4365430 - DNA, 17 bp, Homo sapiens
caccaccggccccctcc

SEQ ID NO: 4365431 - DNA, 22 bp, Homo sapiens
cacccacctgttttctgaaaca

SEQ ID NO: 4365432 - DNA, 15 bp, Homo sapiens
cacccagcggccccc

SEQ ID NO: 4365433 - DNA, 13 bp, Homo sapiens
cacccctctgtct

SEQ ID NO: 4365434 - DNA, 22 bp, Homo sapiens
cacccgccgcctcccacggcac

SEQ ID NO: 4365435 - DNA, 17 bp, Homo sapiens
cacccgtggggtgctgc

SEQ ID NO: 4365436 - DNA, 19 bp, Homo sapiens
caccctgccaagactcctc

SEQ ID NO: 4365437 - DNA, 19 bp, Homo sapiens
caccggaggtcactccacc

SEQ ID NO: 4365438 - DNA, 21 bp, Homo sapiens
cacctcggggacaccagagct

SEQ ID NO: 4365439 - DNA, 13 bp, Homo sapiens
cacctctgaggac

SEQ ID NO: 4365440 - DNA, 21 bp, Homo sapiens
cacctctgaggacagaggccg

SEQ ID NO: 4365441 - DNA, 20 bp, Homo sapiens
cacctctttaaaaactcact

SEQ ID NO: 4365442 - DNA, 21 bp, Homo sapiens
caccttttaagttaatgaaat

SEQ ID NO: 4365443 - DNA, 19 bp, Homo sapiens
cacgagcaaacccagaggt

SEQ ID NO: 4365444 - DNA, 19 bp, Homo sapiens
cactaacgacttcagggca

SEQ ID NO: 4365445 - DNA, 17 bp, Homo sapiens
cactatttttatttata

SEQ ID NO: 4365446 - DNA, 22 bp, Homo sapiens
cactatttttatttatattttt

SEQ ID NO: 4365447 - DNA, 12 bp, Homo sapiens
cactccaccatc

SEQ ID NO: 4365448 - DNA, 22 bp, Homo sapiens
cactgccagaagagaattcagt

SEQ ID NO: 4365449 - DNA, 19 bp, Homo sapiens
cactgccccccgaggctgc

SEQ ID NO: 4365450 - DNA, 20 bp, Homo sapiens
cactgccccccgaggctgct

SEQ ID NO: 4365451 - DNA, 23 bp, Homo sapiens
cactgggtggggtgaggaccact

SEQ ID NO: 4365452 - DNA, 13 bp, Homo sapiens
cacttgtgtgtgg

SEQ ID NO: 4365453 - DNA, 17 bp, Homo sapiens
cacttgtgtgtgggctg

SEQ ID NO: 4365454 - DNA, 21 bp, Homo sapiens
cacttgtgtgtgggctgtgag

SEQ ID NO: 4365455 - DNA, 17 bp, Homo sapiens
cactttcacatagatgt

SEQ ID NO: 4365456 - DNA, 14 bp, Homo sapiens
cactttgaagggca

SEQ ID NO: 4365457 - DNA, 19 bp, Homo sapiens
cagaaacacccctctgtct

SEQ ID NO: 4365458 - DNA, 23 bp, Homo sapiens
cagaaacacccctctgtctagga

SEQ ID NO: 4365459 - DNA, 19 bp, Homo sapiens
cagaaagcactacaatcat

SEQ ID NO: 4365460 - DNA, 18 bp, Homo sapiens
cagaacaaatgtgttttt

SEQ ID NO: 4365461 - DNA, 19 bp, Homo sapiens
cagaacaaatgtgtttttc

SEQ ID NO: 4365462 - DNA, 20 bp, Homo sapiens
cagaacaaatgtgtttttct

SEQ ID NO: 4365463 - DNA, 14 bp, Homo sapiens
cagaacagtaaagt

SEQ ID NO: 4365464 - DNA, 18 bp, Homo sapiens
cagaacagtaaagttaaa

SEQ ID NO: 4365465 - DNA, 21 bp, Homo sapiens
cagaacagtaaagttaaaacg

SEQ ID NO: 4365466 - DNA, 22 bp, Homo sapiens
cagaacatactgattgggaggt

SEQ ID NO: 4365467 - DNA, 19 bp, Homo sapiens
cagaacctgcacacaggac

SEQ ID NO: 4365468 - DNA, 13 bp, Homo sapiens
cagaagtttgcat

SEQ ID NO: 4365469 - DNA, 14 bp, Homo sapiens
cagaatgaaaatca

SEQ ID NO: 4365470 - DNA, 13 bp, Homo sapiens
cagaattcccttg

SEQ ID NO: 4365471 - DNA, 19 bp, Homo sapiens
cagacagcttgactgcttt

SEQ ID NO: 4365472 - DNA, 20 bp, Homo sapiens
cagacagtctgttatgcact

SEQ ID NO: 4365473 - DNA, 13 bp, Homo sapiens
cagacccctctgg

SEQ ID NO: 4365474 - DNA, 16 bp, Homo sapiens
cagacccctctggcca

SEQ ID NO: 4365475 - DNA, 15 bp, Homo sapiens
cagacttctccagac

SEQ ID NO: 4365476 - DNA, 20 bp, Homo sapiens
cagacttctccagacccacc

SEQ ID NO: 4365477 - DNA, 22 bp, Homo sapiens
cagagctgccgacttggagact

SEQ ID NO: 4365478 - DNA, 12 bp, Homo sapiens
cagagctttgtc

SEQ ID NO: 4365479 - DNA, 13 bp, Homo sapiens
cagagctttgtca

SEQ ID NO: 4365480 - DNA, 22 bp, Homo sapiens
cagagctttgtcacttgccaca

SEQ ID NO: 4365481 - DNA, 20 bp, Homo sapiens
cagaggtggatgttatgaac

SEQ ID NO: 4365482 - DNA, 23 bp, Homo sapiens
cagaggtggatgttatgaacagc

SEQ ID NO: 4365483 - DNA, 16 bp, Homo sapiens
cagatatatttttcac

SEQ ID NO: 4365484 - DNA, 19 bp, Homo sapiens
cagatgtgcaataatttgt

SEQ ID NO: 4365485 - DNA, 15 bp, Homo sapiens
cagcaacttgtcttt

SEQ ID NO: 4365486 - DNA, 18 bp, Homo sapiens
cagcaacttgtctttttc

SEQ ID NO: 4365487 - DNA, 20 bp, Homo sapiens
cagcacacacaaacctactg

SEQ ID NO: 4365488 - DNA, 14 bp, Homo sapiens
cagcaccacactgg

SEQ ID NO: 4365489 - DNA, 15 bp, Homo sapiens
cagcaccacactggg

SEQ ID NO: 4365490 - DNA, 23 bp, Homo sapiens
cagcactgtctcagtttcacttt

SEQ ID NO: 4365491 - DNA, 21 bp, Homo sapiens
cagcagaacctgcacacagga

SEQ ID NO: 4365492 - DNA, 22 bp, Homo sapiens
cagcaggcctctggttgcctcc

SEQ ID NO: 4365493 - DNA, 17 bp, Homo sapiens
cagcagggcctcaaagt

SEQ ID NO: 4365494 - DNA, 13 bp, Homo sapiens
cagcaggtgctgt

SEQ ID NO: 4365495 - DNA, 19 bp, Homo sapiens
cagcatatagaatatatta

SEQ ID NO: 4365496 - DNA, 14 bp, Homo sapiens
cagcatatttatag

SEQ ID NO: 4365497 - DNA, 16 bp, Homo sapiens
cagcattcagcacaca

SEQ ID NO: 4365498 - DNA, 17 bp, Homo sapiens
cagcattcagcacacac

SEQ ID NO: 4365499 - DNA, 14 bp, Homo sapiens
cagccacccaagcc

SEQ ID NO: 4365500 - DNA, 21 bp, Homo sapiens
cagccacccaagcctgctggc

SEQ ID NO: 4365501 - DNA, 22 bp, Homo sapiens
cagccacccaagcctgctggct

SEQ ID NO: 4365502 - DNA, 17 bp, Homo sapiens
cagccagtggcacagga

SEQ ID NO: 4365503 - DNA, 17 bp, Homo sapiens
cagccccgccccgttgt

SEQ ID NO: 4365504 - DNA, 13 bp, Homo sapiens
cagccccgcctgt

SEQ ID NO: 4365505 - DNA, 16 bp, Homo sapiens
cagccccgcctgtcac

SEQ ID NO: 4365506 - DNA, 17 bp, Homo sapiens
cagccccgcctgtcaca

SEQ ID NO: 4365507 - DNA, 21 bp, Homo sapiens
cagccccgcctgtcacaataa

SEQ ID NO: 4365508 - DNA, 14 bp, Homo sapiens
cagcccgctgagtg

SEQ ID NO: 4365509 - DNA, 12 bp, Homo sapiens
cagccctcacct

SEQ ID NO: 4365510 - DNA, 16 bp, Homo sapiens
cagcctcgttggagag

SEQ ID NO: 4365511 - DNA, 12 bp, Homo sapiens
cagcggcccccc

SEQ ID NO: 4365512 - DNA, 20 bp, Homo sapiens
cagctgggcagggtgagaag

SEQ ID NO: 4365513 - DNA, 11 bp, Homo sapiens
cagctgtgtct

SEQ ID NO: 4365514 - DNA, 15 bp, Homo sapiens
cagctgtgtctgcca

SEQ ID NO: 4365515 - DNA, 22 bp, Homo sapiens
cagctgtgtctgccaaacacat

SEQ ID NO: 4365516 - DNA, 15 bp, Homo sapiens
cagcttgactgcttt

SEQ ID NO: 4365517 - DNA, 16 bp, Homo sapiens
cagctttctgggatgt

SEQ ID NO: 4365518 - DNA, 23 bp, Homo sapiens
caggaaatatatatgtgtgtgta

SEQ ID NO: 4365519 - DNA, 17 bp, Homo sapiens
caggacagcgggaaaaa

SEQ ID NO: 4365520 - DNA, 23 bp, Homo sapiens
caggacttggtctgatttcagga

SEQ ID NO: 4365521 - DNA, 13 bp, Homo sapiens
caggaggcccttg

SEQ ID NO: 4365522 - DNA, 21 bp, Homo sapiens
caggaggcccttgtcgtggga

SEQ ID NO: 4365523 - DNA, 14 bp, Homo sapiens
caggaggtggagaa

SEQ ID NO: 4365524 - DNA, 15 bp, Homo sapiens
caggatggaggggtg

SEQ ID NO: 4365525 - DNA, 13 bp, Homo sapiens
caggcagcaccac

SEQ ID NO: 4365526 - DNA, 14 bp, Homo sapiens
caggcaggagccct

SEQ ID NO: 4365527 - DNA, 17 bp, Homo sapiens
caggcagttaggtgctg

SEQ ID NO: 4365528 - DNA, 18 bp, Homo sapiens
caggcataggcctgggtg

SEQ ID NO: 4365529 - DNA, 18 bp, Homo sapiens
caggcatctgcctctgga

SEQ ID NO: 4365530 - DNA, 18 bp, Homo sapiens
caggcattggctcagccc

SEQ ID NO: 4365531 - DNA, 21 bp, Homo sapiens
caggcattggctcagcccgct

SEQ ID NO: 4365532 - DNA, 19 bp, Homo sapiens
caggcctctggttgcctcc

SEQ ID NO: 4365533 - DNA, 20 bp, Homo sapiens
caggcctctggttgcctccc

SEQ ID NO: 4365534 - DNA, 12 bp, Homo sapiens
caggcctgtcca

SEQ ID NO: 4365535 - DNA, 21 bp, Homo sapiens
caggcctgtccaccctgccaa

SEQ ID NO: 4365536 - DNA, 14 bp, Homo sapiens
caggctgtgtactt

SEQ ID NO: 4365537 - DNA, 11 bp, Homo sapiens
caggcttgggg

SEQ ID NO: 4365538 - DNA, 18 bp, Homo sapiens
cagggatggagatgggaa

SEQ ID NO: 4365539 - DNA, 12 bp, Homo sapiens
cagggcagagga

SEQ ID NO: 4365540 - DNA, 13 bp, Homo sapiens
cagggcagaggaa

SEQ ID NO: 4365541 - DNA, 12 bp, Homo sapiens
cagggccatgca

SEQ ID NO: 4365542 - DNA, 18 bp, Homo sapiens
cagggcccggccacaccc

SEQ ID NO: 4365543 - DNA, 18 bp, Homo sapiens
cagggtgggaagagaaga

SEQ ID NO: 4365544 - DNA, 14 bp, Homo sapiens
caggtacagaaaac

SEQ ID NO: 4365545 - DNA, 21 bp, Homo sapiens
caggtacagaaaacatgttta

SEQ ID NO: 4365546 - DNA, 17 bp, Homo sapiens
cagtagagtcatctcca

SEQ ID NO: 4365547 - DNA, 21 bp, Homo sapiens
cagtatgctttccctgaggaa

SEQ ID NO: 4365548 - DNA, 16 bp, Homo sapiens
cagtccctggagctgt

SEQ ID NO: 4365549 - DNA, 15 bp, Homo sapiens
cagtctgttatgcac

SEQ ID NO: 4365550 - DNA, 16 bp, Homo sapiens
cagtctgttatgcact

SEQ ID NO: 4365551 - DNA, 22 bp, Homo sapiens
cagtctgttatgcactgtggtt

SEQ ID NO: 4365552 - DNA, 24 bp, Homo sapiens
cagtctgttatgcactgtggtttc

SEQ ID NO: 4365553 - DNA, 14 bp, Homo sapiens
cagtgaacattccc

SEQ ID NO: 4365554 - DNA, 15 bp, Homo sapiens
cagtgaacattccca

SEQ ID NO: 4365555 - DNA, 23 bp, Homo sapiens
cagtgaacattcccagcccagcc

SEQ ID NO: 4365556 - DNA, 14 bp, Homo sapiens
cagtgcctcttcca

SEQ ID NO: 4365557 - DNA, 22 bp, Homo sapiens
cagtgcctcttccagtgaacat

SEQ ID NO: 4365558 - DNA, 22 bp, Homo sapiens
cagtgtacacgtctggaccccg

SEQ ID NO: 4365559 - DNA, 16 bp, Homo sapiens
cagtttggccctggag

SEQ ID NO: 4365560 - DNA, 17 bp, Homo sapiens
cagtttggccctggagc

SEQ ID NO: 4365561 - DNA, 18 bp, Homo sapiens
cagtttggccctggagcc

SEQ ID NO: 4365562 - DNA, 20 bp, Homo sapiens
cagtttggccctggagccag

SEQ ID NO: 4365563 - DNA, 15 bp, Homo sapiens
cagttttttggaaga

SEQ ID NO: 4365564 - DNA, 16 bp, Homo sapiens
cagttttttggaagaa

SEQ ID NO: 4365565 - DNA, 19 bp, Homo sapiens
cagttttttggaagaaaat

SEQ ID NO: 4365566 - DNA, 18 bp, Homo sapiens
cataaataaaagtacagt

SEQ ID NO: 4365567 - DNA, 12 bp, Homo sapiens
cataaccaaaga

SEQ ID NO: 4365568 - DNA, 14 bp, Homo sapiens
cataatcagaacac

SEQ ID NO: 4365569 - DNA, 17 bp, Homo sapiens
catactgattgggaggt

SEQ ID NO: 4365570 - DNA, 16 bp, Homo sapiens
catagcatagccagca

SEQ ID NO: 4365571 - DNA, 13 bp, Homo sapiens
catagccagcatt

SEQ ID NO: 4365572 - DNA, 14 bp, Homo sapiens
cataggcctgggtg

SEQ ID NO: 4365573 - DNA, 15 bp, Homo sapiens
cataggcctgggtgc

SEQ ID NO: 4365574 - DNA, 15 bp, Homo sapiens
catagtaagtacaga

SEQ ID NO: 4365575 - DNA, 14 bp, Homo sapiens
catatagaatatat

SEQ ID NO: 4365576 - DNA, 20 bp, Homo sapiens
catatttattgcattgctgg

SEQ ID NO: 4365577 - DNA, 16 bp, Homo sapiens
catcatttaactgaac

SEQ ID NO: 4365578 - DNA, 14 bp, Homo sapiens
catccaatcctcac

SEQ ID NO: 4365579 - DNA, 19 bp, Homo sapiens
catccaatcctcactgggt

SEQ ID NO: 4365580 - DNA, 23 bp, Homo sapiens
catccagcagatttccagccttc

SEQ ID NO: 4365581 - DNA, 14 bp, Homo sapiens
catccccaccccac

SEQ ID NO: 4365582 - DNA, 14 bp, Homo sapiens
catccccttccccc

SEQ ID NO: 4365583 - DNA, 13 bp, Homo sapiens
catctcctgtgca

SEQ ID NO: 4365584 - DNA, 18 bp, Homo sapiens
catctgcctctggaaaac

SEQ ID NO: 4365585 - DNA, 14 bp, Homo sapiens
catctgtaagagct

SEQ ID NO: 4365586 - DNA, 16 bp, Homo sapiens
catctgtaagagcttg

SEQ ID NO: 4365587 - DNA, 22 bp, Homo sapiens
catctgtaagagcttgctccag

SEQ ID NO: 4365588 - DNA, 23 bp, Homo sapiens
catctgtaagagcttgctccaga

SEQ ID NO: 4365589 - DNA, 15 bp, Homo sapiens
catcttgtgagtgga

SEQ ID NO: 4365590 - DNA, 13 bp, Homo sapiens
catcttgtggggc

SEQ ID NO: 4365591 - DNA, 17 bp, Homo sapiens
catcttgtggggccagg

SEQ ID NO: 4365592 - DNA, 20 bp, Homo sapiens
catcttgtggggccaggacc

SEQ ID NO: 4365593 - DNA, 13 bp, Homo sapiens
catctttatcatc

SEQ ID NO: 4365594 - DNA, 15 bp, Homo sapiens
catgaagcaggaggc

SEQ ID NO: 4365595 - DNA, 14 bp, Homo sapiens
catgacctgtgacc

SEQ ID NO: 4365596 - DNA, 23 bp, Homo sapiens
catgagagaattgtatcatttga

SEQ ID NO: 4365597 - DNA, 16 bp, Homo sapiens
catgcagacctcatgc

SEQ ID NO: 4365598 - DNA, 11 bp, Homo sapiens
catgcaggagg

SEQ ID NO: 4365599 - DNA, 15 bp, Homo sapiens
catgcaggaggtgga

SEQ ID NO: 4365600 - DNA, 15 bp, Homo sapiens
catgcccagctctct

SEQ ID NO: 4365601 - DNA, 13 bp, Homo sapiens
catgctaatgacg

SEQ ID NO: 4365602 - DNA, 19 bp, Homo sapiens
catgctaatgacgacacct

SEQ ID NO: 4365603 - DNA, 20 bp, Homo sapiens
catggagaagggttctgccc

SEQ ID NO: 4365604 - DNA, 20 bp, Homo sapiens
catggccgaagccccttgga

SEQ ID NO: 4365605 - DNA, 22 bp, Homo sapiens
catggctgggaacatgacccag

SEQ ID NO: 4365606 - DNA, 16 bp, Homo sapiens
catggtactaccccag

SEQ ID NO: 4365607 - DNA, 15 bp, Homo sapiens
catggtgtctcccaa

SEQ ID NO: 4365608 - DNA, 16 bp, Homo sapiens
catggttgagaaatga

SEQ ID NO: 4365609 - DNA, 14 bp, Homo sapiens
catggttgggggaa

SEQ ID NO: 4365610 - DNA, 18 bp, Homo sapiens
catgtcccacccacccgc

SEQ ID NO: 4365611 - DNA, 19 bp, Homo sapiens
catgtggggacagggctgg

SEQ ID NO: 4365612 - DNA, 21 bp, Homo sapiens
catgtgtggtacatggtgttt

SEQ ID NO: 4365613 - DNA, 19 bp, Homo sapiens
catgttaaaaatagcagta

SEQ ID NO: 4365614 - DNA, 15 bp, Homo sapiens
catgttcccagaaag

SEQ ID NO: 4365615 - DNA, 22 bp, Homo sapiens
catgtttaaatagcctaaatga

SEQ ID NO: 4365616 - DNA, 16 bp, Homo sapiens
cattaatctcaaagag

SEQ ID NO: 4365617 - DNA, 17 bp, Homo sapiens
cattagaaatagacagt

SEQ ID NO: 4365618 - DNA, 14 bp, Homo sapiens
cattcccagcccag

SEQ ID NO: 4365619 - DNA, 19 bp, Homo sapiens
cattcctaagagtggagga

SEQ ID NO: 4365620 - DNA, 16 bp, Homo sapiens
cattgtcctgtagctt

SEQ ID NO: 4365621 - DNA, 19 bp, Homo sapiens
catttgctagttctgctgc

SEQ ID NO: 4365622 - DNA, 20 bp, Homo sapiens
catttgctagttctgctgcc

SEQ ID NO: 4365623 - DNA, 15 bp, Homo sapiens
catttggtctcaggc

SEQ ID NO: 4365624 - DNA, 21 bp, Homo sapiens
catttggtctcaggcagcacc

SEQ ID NO: 4365625 - DNA, 12 bp, Homo sapiens
cattttcccaga

SEQ ID NO: 4365626 - DNA, 18 bp, Homo sapiens
cattttggaagttttcag

SEQ ID NO: 4365627 - DNA, 20 bp, Homo sapiens
cattttggaagttttcagga

SEQ ID NO: 4365628 - DNA, 14 bp, Homo sapiens
catttttatgcaga

SEQ ID NO: 4365629 - DNA, 21 bp, Homo sapiens
ccaaacaaggaagccaaagtt

SEQ ID NO: 4365630 - DNA, 19 bp, Homo sapiens
ccaaataaatcatcctcat

SEQ ID NO: 4365631 - DNA, 15 bp, Homo sapiens
ccaacatgggaggga

SEQ ID NO: 4365632 - DNA, 17 bp, Homo sapiens
ccaacatgggagggatc

SEQ ID NO: 4365633 - DNA, 23 bp, Homo sapiens
ccaacatgggagggatcagcccc

SEQ ID NO: 4365634 - DNA, 11 bp, Homo sapiens
ccaagaacata

SEQ ID NO: 4365635 - DNA, 23 bp, Homo sapiens
ccaagaggggcgggctcagagct

SEQ ID NO: 4365636 - DNA, 17 bp, Homo sapiens
ccaagcctgctggctgc

SEQ ID NO: 4365637 - DNA, 16 bp, Homo sapiens
ccaagggggtgactgg

SEQ ID NO: 4365638 - DNA, 21 bp, Homo sapiens
ccaagtatgccttaagcagaa

SEQ ID NO: 4365639 - DNA, 17 bp, Homo sapiens
ccaattaggaagtgtaa

SEQ ID NO: 4365640 - DNA, 20 bp, Homo sapiens
ccacccaagcctgctggctg

SEQ ID NO: 4365641 - DNA, 11 bp, Homo sapiens
ccaccccaccc

SEQ ID NO: 4365642 - DNA, 14 bp, Homo sapiens
ccacccccgccatg

SEQ ID NO: 4365643 - DNA, 20 bp, Homo sapiens
ccacccgtggggtgctgccc

SEQ ID NO: 4365644 - DNA, 21 bp, Homo sapiens
ccacccgtggggtgctgccct

SEQ ID NO: 4365645 - DNA, 21 bp, Homo sapiens
ccaccctgccaagactcctca

SEQ ID NO: 4365646 - DNA, 17 bp, Homo sapiens
ccacctgttttctgaaa

SEQ ID NO: 4365647 - DNA, 18 bp, Homo sapiens
ccaccttttaagttaatg

SEQ ID NO: 4365648 - DNA, 17 bp, Homo sapiens
ccacgtgacagtgcctg

SEQ ID NO: 4365649 - DNA, 14 bp, Homo sapiens
ccactcctgtacac

SEQ ID NO: 4365650 - DNA, 15 bp, Homo sapiens
ccactcctgtacact

SEQ ID NO: 4365651 - DNA, 19 bp, Homo sapiens
ccactgccccccgaggctg

SEQ ID NO: 4365652 - DNA, 16 bp, Homo sapiens
ccactgtggccccaag

SEQ ID NO: 4365653 - DNA, 19 bp, Homo sapiens
ccagaaacacccctctgtc

SEQ ID NO: 4365654 - DNA, 15 bp, Homo sapiens
ccagaagagaattca

SEQ ID NO: 4365655 - DNA, 22 bp, Homo sapiens
ccagaagagaattcagtatttt

SEQ ID NO: 4365656 - DNA, 17 bp, Homo sapiens
ccagaattcccttgaat

SEQ ID NO: 4365657 - DNA, 22 bp, Homo sapiens
ccagacccctctggccaggatg

SEQ ID NO: 4365658 - DNA, 15 bp, Homo sapiens
ccagagctgccgact

SEQ ID NO: 4365659 - DNA, 14 bp, Homo sapiens
ccagaggtggatgt

SEQ ID NO: 4365660 - DNA, 12 bp, Homo sapiens
ccagattctgat

SEQ ID NO: 4365661 - DNA, 14 bp, Homo sapiens
ccagattctgatgc

SEQ ID NO: 4365662 - DNA, 18 bp, Homo sapiens
ccagcagatttccagcct

SEQ ID NO: 4365663 - DNA, 20 bp, Homo sapiens
ccagcagtgaatgctagaca

SEQ ID NO: 4365664 - DNA, 15 bp, Homo sapiens
ccagcattcagcaca

SEQ ID NO: 4365665 - DNA, 20 bp, Homo sapiens
ccagcctcgttggagagcag

SEQ ID NO: 4365666 - DNA, 20 bp, Homo sapiens
ccagcctcttgctcagagct

SEQ ID NO: 4365667 - DNA, 22 bp, Homo sapiens
ccagcctgaaagatacagggga

SEQ ID NO: 4365668 - DNA, 23 bp, Homo sapiens
ccagcggccccccgcacagccac

SEQ ID NO: 4365669 - DNA, 19 bp, Homo sapiens
ccaggagctagcccagtcc

SEQ ID NO: 4365670 - DNA, 20 bp, Homo sapiens
ccaggagctagcccagtccc

SEQ ID NO: 4365671 - DNA, 14 bp, Homo sapiens
ccaggatggagggg

SEQ ID NO: 4365672 - DNA, 18 bp, Homo sapiens
ccaggcattggctcagcc

SEQ ID NO: 4365673 - DNA, 16 bp, Homo sapiens
ccaggcctgtccaccc

SEQ ID NO: 4365674 - DNA, 21 bp, Homo sapiens
ccaggcctgtccaccctgcca

SEQ ID NO: 4365675 - DNA, 16 bp, Homo sapiens
ccagggcagaggaatg

SEQ ID NO: 4365676 - DNA, 13 bp, Homo sapiens
ccagtacagtatt

SEQ ID NO: 4365677 - DNA, 16 bp, Homo sapiens
ccagtcatctgtaaga

SEQ ID NO: 4365678 - DNA, 12 bp, Homo sapiens
ccagtcatggta

SEQ ID NO: 4365679 - DNA, 19 bp, Homo sapiens
ccagtcatggtactacccc

SEQ ID NO: 4365680 - DNA, 12 bp, Homo sapiens
ccagtgctgaat

SEQ ID NO: 4365681 - DNA, 12 bp, Homo sapiens
ccagtggcacag

SEQ ID NO: 4365682 - DNA, 14 bp, Homo sapiens
ccagtggcacagga

SEQ ID NO: 4365683 - DNA, 13 bp, Homo sapiens
ccagtggggtccc

SEQ ID NO: 4365684 - DNA, 23 bp, Homo sapiens
ccagtggggtcccccctgagtgg

SEQ ID NO: 4365685 - DNA, 16 bp, Homo sapiens
ccataatcagaacaca

SEQ ID NO: 4365686 - DNA, 17 bp, Homo sapiens
ccatccctaccactgtg

SEQ ID NO: 4365687 - DNA, 16 bp, Homo sapiens
ccatcttgtggggcca

SEQ ID NO: 4365688 - DNA, 18 bp, Homo sapiens
ccatgaatgtatcaggaa

SEQ ID NO: 4365689 - DNA, 15 bp, Homo sapiens
ccatgcagaaagcat

SEQ ID NO: 4365690 - DNA, 21 bp, Homo sapiens
ccatgcagacctcatgcccag

SEQ ID NO: 4365691 - DNA, 22 bp, Homo sapiens
ccatgcagacctcatgcccagc

SEQ ID NO: 4365692 - DNA, 16 bp, Homo sapiens
ccatgcaggaggtgga

SEQ ID NO: 4365693 - DNA, 18 bp, Homo sapiens
ccatgccccagctctgga

SEQ ID NO: 4365694 - DNA, 22 bp, Homo sapiens
ccatggccgaagccccttggag

SEQ ID NO: 4365695 - DNA, 23 bp, Homo sapiens
ccattgatctgccaaatcgttat

SEQ ID NO: 4365696 - DNA, 21 bp, Homo sapiens
ccatttgctagttctgctgcc

SEQ ID NO: 4365697 - DNA, 22 bp, Homo sapiens
cccaaagcagcaggcctctggt

SEQ ID NO: 4365698 - DNA, 16 bp, Homo sapiens
cccaaattgccttcag

SEQ ID NO: 4365699 - DNA, 14 bp, Homo sapiens
cccaacatgggagg

SEQ ID NO: 4365700 - DNA, 16 bp, Homo sapiens
cccaacatgggaggga

SEQ ID NO: 4365701 - DNA, 21 bp, Homo sapiens
cccaacatgggagggatcagc

SEQ ID NO: 4365702 - DNA, 23 bp, Homo sapiens
cccaactgagtcatcttgtgagt

SEQ ID NO: 4365703 - DNA, 22 bp, Homo sapiens
cccacaattaaaccgcatgtga

SEQ ID NO: 4365704 - DNA, 14 bp, Homo sapiens
cccacatttgggct

SEQ ID NO: 4365705 - DNA, 17 bp, Homo sapiens
cccacatttgggctcag

SEQ ID NO: 4365706 - DNA, 20 bp, Homo sapiens
cccacatttgggctcagggt

SEQ ID NO: 4365707 - DNA, 13 bp, Homo sapiens
cccacccgccgcc

SEQ ID NO: 4365708 - DNA, 23 bp, Homo sapiens
cccacccgccgcctcccacggca

SEQ ID NO: 4365709 - DNA, 20 bp, Homo sapiens
cccactccctggctctcaga

SEQ ID NO: 4365710 - DNA, 19 bp, Homo sapiens
cccagactctttttttgag

SEQ ID NO: 4365711 - DNA, 16 bp, Homo sapiens
cccagcctcgttggag

SEQ ID NO: 4365712 - DNA, 18 bp, Homo sapiens
cccagcctcgttggagag

SEQ ID NO: 4365713 - DNA, 14 bp, Homo sapiens
cccagctctctgac

SEQ ID NO: 4365714 - DNA, 19 bp, Homo sapiens
cccagctctggatgaaggc

SEQ ID NO: 4365715 - DNA, 13 bp, Homo sapiens
cccaggcctgtcc

SEQ ID NO: 4365716 - DNA, 21 bp, Homo sapiens
cccaggcctgtccaccctgcc

SEQ ID NO: 4365717 - DNA, 16 bp, Homo sapiens
cccagtccctggagct

SEQ ID NO: 4365718 - DNA, 17 bp, Homo sapiens
cccagtccctggagctg

SEQ ID NO: 4365719 - DNA, 17 bp, Homo sapiens
cccattgttgtcaagga

SEQ ID NO: 4365720 - DNA, 16 bp, Homo sapiens
ccccaacatgcactga

SEQ ID NO: 4365721 - DNA, 17 bp, Homo sapiens
ccccaagaggggcgggc

SEQ ID NO: 4365722 - DNA, 18 bp, Homo sapiens
ccccacccccgccatgca

SEQ ID NO: 4365723 - DNA, 19 bp, Homo sapiens
ccccacgtgacagtgcctg

SEQ ID NO: 4365724 - DNA, 21 bp, Homo sapiens
ccccaggcctgtccaccctgc

SEQ ID NO: 4365725 - DNA, 19 bp, Homo sapiens
cccccaaattgccttcagc

SEQ ID NO: 4365726 - DNA, 20 bp, Homo sapiens
cccccaaattgccttcagcc

SEQ ID NO: 4365727 - DNA, 15 bp, Homo sapiens
cccccagactctttt

SEQ ID NO: 4365728 - DNA, 12 bp, Homo sapiens
cccccctgagtg

SEQ ID NO: 4365729 - DNA, 14 bp, Homo sapiens
cccccgcacagcca

SEQ ID NO: 4365730 - DNA, 12 bp, Homo sapiens
cccccgccatgc

SEQ ID NO: 4365731 - DNA, 13 bp, Homo sapiens
cccccgcctgcca

SEQ ID NO: 4365732 - DNA, 11 bp, Homo sapiens
ccccctgtggc

SEQ ID NO: 4365733 - DNA, 14 bp, Homo sapiens
ccccgcctgccacc

SEQ ID NO: 4365734 - DNA, 17 bp, Homo sapiens
cccctccccccagactc

SEQ ID NO: 4365735 - DNA, 11 bp, Homo sapiens
cccctctcaga

SEQ ID NO: 4365736 - DNA, 21 bp, Homo sapiens
cccctgagtgggctgggccct

SEQ ID NO: 4365737 - DNA, 19 bp, Homo sapiens
cccctgcagtttggccctg

SEQ ID NO: 4365738 - DNA, 22 bp, Homo sapiens
cccctgcagtttggccctggag

SEQ ID NO: 4365739 - DNA, 13 bp, Homo sapiens
ccccttggagaga

SEQ ID NO: 4365740 - DNA, 19 bp, Homo sapiens
cccgatgtcccctgcgggc

SEQ ID NO: 4365741 - DNA, 18 bp, Homo sapiens
cccgcacagccacccgtg

SEQ ID NO: 4365742 - DNA, 12 bp, Homo sapiens
cccgcactctgc

SEQ ID NO: 4365743 - DNA, 18 bp, Homo sapiens
cccgcaggaactgggctg

SEQ ID NO: 4365744 - DNA, 21 bp, Homo sapiens
cccgcaggaactgggctgggc

SEQ ID NO: 4365745 - DNA, 15 bp, Homo sapiens
cccgcagggccatgc

SEQ ID NO: 4365746 - DNA, 18 bp, Homo sapiens
cccgcagggccatgcaga

SEQ ID NO: 4365747 - DNA, 21 bp, Homo sapiens
cccgcagggccatgcagacct

SEQ ID NO: 4365748 - DNA, 21 bp, Homo sapiens
cccgccccgttgtgagctgga

SEQ ID NO: 4365749 - DNA, 16 bp, Homo sapiens
cccgccgcctcccacg

SEQ ID NO: 4365750 - DNA, 13 bp, Homo sapiens
cccgcctgtcaca

SEQ ID NO: 4365751 - DNA, 17 bp, Homo sapiens
cccggccacacccagcg

SEQ ID NO: 4365752 - DNA, 15 bp, Homo sapiens
cccggcgccgggcac

SEQ ID NO: 4365753 - DNA, 15 bp, Homo sapiens
cccgtgcccgcagga

SEQ ID NO: 4365754 - DNA, 13 bp, Homo sapiens
ccctaccactgtg

SEQ ID NO: 4365755 - DNA, 12 bp, Homo sapiens
ccctcacctctg

SEQ ID NO: 4365756 - DNA, 15 bp, Homo sapiens
ccctcacctctgagg

SEQ ID NO: 4365757 - DNA, 18 bp, Homo sapiens
ccctcaggcataggcctg

SEQ ID NO: 4365758 - DNA, 19 bp, Homo sapiens
ccctcaggcataggcctgg

SEQ ID NO: 4365759 - DNA, 22 bp, Homo sapiens
ccctcaggcataggcctgggtg

SEQ ID NO: 4365760 - DNA, 15 bp, Homo sapiens
ccctccccccagact

SEQ ID NO: 4365761 - DNA, 15 bp, Homo sapiens
ccctccctaccctaa

SEQ ID NO: 4365762 - DNA, 11 bp, Homo sapiens
ccctctcagaa

SEQ ID NO: 4365763 - DNA, 12 bp, Homo sapiens
ccctctggccag

SEQ ID NO: 4365764 - DNA, 22 bp, Homo sapiens
ccctctgtctaggactgcagtg

SEQ ID NO: 4365765 - DNA, 16 bp, Homo sapiens
ccctcttaagatctga

SEQ ID NO: 4365766 - DNA, 22 bp, Homo sapiens
ccctcttaagatctgactgcca

SEQ ID NO: 4365767 - DNA, 24 bp, Homo sapiens
ccctgcagtttggccctggagcca

SEQ ID NO: 4365768 - DNA, 21 bp, Homo sapiens
ccctggaaaccttccacccag

SEQ ID NO: 4365769 - DNA, 13 bp, Homo sapiens
ccctggagccagg

SEQ ID NO: 4365770 - DNA, 21 bp, Homo sapiens
ccctggagccagggcagagga

SEQ ID NO: 4365771 - DNA, 20 bp, Homo sapiens
ccctggagctgtccttcatt

SEQ ID NO: 4365772 - DNA, 13 bp, Homo sapiens
ccctgtagggaaa

SEQ ID NO: 4365773 - DNA, 19 bp, Homo sapiens
ccctgtagggaaaccttgg

SEQ ID NO: 4365774 - DNA, 22 bp, Homo sapiens
cccttatgcccggcgccgggca

SEQ ID NO: 4365775 - DNA, 13 bp, Homo sapiens
cccttctataccc

SEQ ID NO: 4365776 - DNA, 19 bp, Homo sapiens
cccttctatacccacccag

SEQ ID NO: 4365777 - DNA, 17 bp, Homo sapiens
ccctttcttggccagtt

SEQ ID NO: 4365778 - DNA, 17 bp, Homo sapiens
ccgaagccccttggaga

SEQ ID NO: 4365779 - DNA, 17 bp, Homo sapiens
ccgacttggagactcct

SEQ ID NO: 4365780 - DNA, 14 bp, Homo sapiens
ccgaggctgctaga

SEQ ID NO: 4365781 - DNA, 20 bp, Homo sapiens
ccgatcaacatttatgacct

SEQ ID NO: 4365782 - DNA, 14 bp, Homo sapiens
ccgcactctgcccc

SEQ ID NO: 4365783 - DNA, 18 bp, Homo sapiens
ccgcaggaactgggctgg

SEQ ID NO: 4365784 - DNA, 20 bp, Homo sapiens
ccgcagggccatgcagacct

SEQ ID NO: 4365785 - DNA, 15 bp, Homo sapiens
ccgccgcctcccacg

SEQ ID NO: 4365786 - DNA, 18 bp, Homo sapiens
ccgccgcctcccacggca

SEQ ID NO: 4365787 - DNA, 15 bp, Homo sapiens
ccgcctcccacggca

SEQ ID NO: 4365788 - DNA, 12 bp, Homo sapiens
ccgcctgccacc

SEQ ID NO: 4365789 - DNA, 13 bp, Homo sapiens
ccgcctgccaccg

SEQ ID NO: 4365790 - DNA, 12 bp, Homo sapiens
ccgcctgtcaca

SEQ ID NO: 4365791 - DNA, 16 bp, Homo sapiens
ccggcccagtgccact

SEQ ID NO: 4365792 - DNA, 18 bp, Homo sapiens
ccggcccagtgccactgc

SEQ ID NO: 4365793 - DNA, 17 bp, Homo sapiens
ccgggtctcgcagcctg

SEQ ID NO: 4365794 - DNA, 23 bp, Homo sapiens
ccgggtctcgcagcctgaagcct

SEQ ID NO: 4365795 - DNA, 18 bp, Homo sapiens
ccggtgggaccctgtccg

SEQ ID NO: 4365796 - DNA, 17 bp, Homo sapiens
ccgtcacccctgtttct

SEQ ID NO: 4365797 - DNA, 21 bp, Homo sapiens
ccgtgcccccgcctgccaccg

SEQ ID NO: 4365798 - DNA, 14 bp, Homo sapiens
ccgtgcccgcagga

SEQ ID NO: 4365799 - DNA, 19 bp, Homo sapiens
ccgtgcccgcaggaactgg

SEQ ID NO: 4365800 - DNA, 23 bp, Homo sapiens
ccgtgcccgcaggaactgggctg

SEQ ID NO: 4365801 - DNA, 14 bp, Homo sapiens
ccgttcacatgtgt

SEQ ID NO: 4365802 - DNA, 18 bp, Homo sapiens
cctaagagtggaggagga

SEQ ID NO: 4365803 - DNA, 17 bp, Homo sapiens
cctaccactgtggcccc

SEQ ID NO: 4365804 - DNA, 20 bp, Homo sapiens
cctaccactgtggccccaag

SEQ ID NO: 4365805 - DNA, 23 bp, Homo sapiens
cctaccactgtggccccaagagg

SEQ ID NO: 4365806 - DNA, 16 bp, Homo sapiens
cctcacccctgtaggg

SEQ ID NO: 4365807 - DNA, 13 bp, Homo sapiens
cctcactgggtgg

SEQ ID NO: 4365808 - DNA, 21 bp, Homo sapiens
cctcactgggtggggtgagga

SEQ ID NO: 4365809 - DNA, 22 bp, Homo sapiens
cctcaggcataggcctgggtgc

SEQ ID NO: 4365810 - DNA, 14 bp, Homo sapiens
cctcatgcccagct

SEQ ID NO: 4365811 - DNA, 19 bp, Homo sapiens
cctcatgcccagctctctg

SEQ ID NO: 4365812 - DNA, 20 bp, Homo sapiens
cctcatgcccagctctctga

SEQ ID NO: 4365813 - DNA, 14 bp, Homo sapiens
cctccatgccccag

SEQ ID NO: 4365814 - DNA, 19 bp, Homo sapiens
cctccatgccccagctctg

SEQ ID NO: 4365815 - DNA, 20 bp, Homo sapiens
cctccatgccccagctctgg

SEQ ID NO: 4365816 - DNA, 14 bp, Homo sapiens
cctcccacggcacc

SEQ ID NO: 4365817 - DNA, 14 bp, Homo sapiens
cctccccccagact

SEQ ID NO: 4365818 - DNA, 13 bp, Homo sapiens
cctcccccgcctc

SEQ ID NO: 4365819 - DNA, 14 bp, Homo sapiens
cctcccctctcaga

SEQ ID NO: 4365820 - DNA, 15 bp, Homo sapiens
cctccctggggacca

SEQ ID NO: 4365821 - DNA, 15 bp, Homo sapiens
cctcctgctcctcac

SEQ ID NO: 4365822 - DNA, 20 bp, Homo sapiens
cctcctgctcctcacccctg

SEQ ID NO: 4365823 - DNA, 15 bp, Homo sapiens
cctcggggacaccag

SEQ ID NO: 4365824 - DNA, 12 bp, Homo sapiens
cctcgtgcgccc

SEQ ID NO: 4365825 - DNA, 21 bp, Homo sapiens
cctctgaggacagaggccggg

SEQ ID NO: 4365826 - DNA, 16 bp, Homo sapiens
cctctgtccacatgtg

SEQ ID NO: 4365827 - DNA, 21 bp, Homo sapiens
cctctgtctaggactgcagtg

SEQ ID NO: 4365828 - DNA, 22 bp, Homo sapiens
cctctgtctaggactgcagtgt

SEQ ID NO: 4365829 - DNA, 19 bp, Homo sapiens
cctcttaagatctgactgc

SEQ ID NO: 4365830 - DNA, 17 bp, Homo sapiens
cctcttccagtgaacat

SEQ ID NO: 4365831 - DNA, 15 bp, Homo sapiens
cctcttcttcttcag

SEQ ID NO: 4365832 - DNA, 16 bp, Homo sapiens
cctgaagcctggattc

SEQ ID NO: 4365833 - DNA, 13 bp, Homo sapiens
cctgacttctgga

SEQ ID NO: 4365834 - DNA, 23 bp, Homo sapiens
cctgaggaggaggacacagcaca

SEQ ID NO: 4365835 - DNA, 18 bp, Homo sapiens
cctgagtgggctgggccc

SEQ ID NO: 4365836 - DNA, 14 bp, Homo sapiens
cctgcacacaggac

SEQ ID NO: 4365837 - DNA, 17 bp, Homo sapiens
cctgcacacaggacagc

SEQ ID NO: 4365838 - DNA, 19 bp, Homo sapiens
cctgcacacaggacagcgg

SEQ ID NO: 4365839 - DNA, 15 bp, Homo sapiens
cctgcagtttggccc

SEQ ID NO: 4365840 - DNA, 23 bp, Homo sapiens
cctgcagtttggccctggagcca

SEQ ID NO: 4365841 - DNA, 24 bp, Homo sapiens
cctgcagtttggccctggagccag

SEQ ID NO: 4365842 - DNA, 15 bp, Homo sapiens
cctgccaagactcct

SEQ ID NO: 4365843 - DNA, 22 bp, Homo sapiens
cctgccaccggaggtcactcca

SEQ ID NO: 4365844 - DNA, 13 bp, Homo sapiens
cctgcctgaggag

SEQ ID NO: 4365845 - DNA, 22 bp, Homo sapiens
cctgcctgaggaggaggacaca

SEQ ID NO: 4365846 - DNA, 21 bp, Homo sapiens
cctgcgggcgcgggcagccac

SEQ ID NO: 4365847 - DNA, 11 bp, Homo sapiens
cctgctggctg

SEQ ID NO: 4365848 - DNA, 13 bp, Homo sapiens
cctgctggctgcg

SEQ ID NO: 4365849 - DNA, 19 bp, Homo sapiens
cctgctgtgttaagaggac

SEQ ID NO: 4365850 - DNA, 20 bp, Homo sapiens
cctgctgtgttaagaggact

SEQ ID NO: 4365851 - DNA, 14 bp, Homo sapiens
cctggaaaccttcc

SEQ ID NO: 4365852 - DNA, 17 bp, Homo sapiens
cctggaaaccttccacc

SEQ ID NO: 4365853 - DNA, 18 bp, Homo sapiens
cctggaaaccttccaccc

SEQ ID NO: 4365854 - DNA, 20 bp, Homo sapiens
cctggaaaccttccacccag

SEQ ID NO: 4365855 - DNA, 17 bp, Homo sapiens
cctggagccagggcaga

SEQ ID NO: 4365856 - DNA, 21 bp, Homo sapiens
cctggagccagggcagaggaa

SEQ ID NO: 4365857 - DNA, 11 bp, Homo sapiens
cctggagctgt

SEQ ID NO: 4365858 - DNA, 22 bp, Homo sapiens
cctggattccagcagtgaatgc

SEQ ID NO: 4365859 - DNA, 17 bp, Homo sapiens
cctggctagaaaacaag

SEQ ID NO: 4365860 - DNA, 14 bp, Homo sapiens
cctgggaatgtatt

SEQ ID NO: 4365861 - DNA, 16 bp, Homo sapiens
cctggggaccaggagc

SEQ ID NO: 4365862 - DNA, 17 bp, Homo sapiens
cctggggaccaggagct

SEQ ID NO: 4365863 - DNA, 12 bp, Homo sapiens
cctgtacactga

SEQ ID NO: 4365864 - DNA, 22 bp, Homo sapiens
cctgtagctttaaaaccacagc

SEQ ID NO: 4365865 - DNA, 20 bp, Homo sapiens
cctgtagggaaaccttggag

SEQ ID NO: 4365866 - DNA, 21 bp, Homo sapiens
cctgtagggaaaccttggaga

SEQ ID NO: 4365867 - DNA, 13 bp, Homo sapiens
cctgtccaccctg

SEQ ID NO: 4365868 - DNA, 16 bp, Homo sapiens
cctgtccaccctgcca

SEQ ID NO: 4365869 - DNA, 20 bp, Homo sapiens
cctgtccggcccagtgccac

SEQ ID NO: 4365870 - DNA, 17 bp, Homo sapiens
cctgtgaccagcactgt

SEQ ID NO: 4365871 - DNA, 19 bp, Homo sapiens
cctgtgccacccaccaggg

SEQ ID NO: 4365872 - DNA, 17 bp, Homo sapiens
cctgtggcggccttccg

SEQ ID NO: 4365873 - DNA, 19 bp, Homo sapiens
cctgttttatactgtactt

SEQ ID NO: 4365874 - DNA, 15 bp, Homo sapiens
ccttaaactgtgtgg

SEQ ID NO: 4365875 - DNA, 13 bp, Homo sapiens
ccttaagcagaac

SEQ ID NO: 4365876 - DNA, 14 bp, Homo sapiens
ccttaataaatatg

SEQ ID NO: 4365877 - DNA, 23 bp, Homo sapiens
ccttaataaatatgtaatataaa

SEQ ID NO: 4365878 - DNA, 22 bp, Homo sapiens
ccttatgcccggcgccgggcac

SEQ ID NO: 4365879 - DNA, 23 bp, Homo sapiens
ccttatgcccggcgccgggcacc

SEQ ID NO: 4365880 - DNA, 17 bp, Homo sapiens
ccttcattccgttagga

SEQ ID NO: 4365881 - DNA, 18 bp, Homo sapiens
ccttcattccgttaggaa

SEQ ID NO: 4365882 - DNA, 16 bp, Homo sapiens
ccttccatcttgtggg

SEQ ID NO: 4365883 - DNA, 18 bp, Homo sapiens
ccttccatcttgtggggc

SEQ ID NO: 4365884 - DNA, 15 bp, Homo sapiens
ccttcccccatccct

SEQ ID NO: 4365885 - DNA, 21 bp, Homo sapiens
ccttcccccatccctaccact

SEQ ID NO: 4365886 - DNA, 22 bp, Homo sapiens
ccttcccccatccctaccactg

SEQ ID NO: 4365887 - DNA, 21 bp, Homo sapiens
ccttccgggtctcgcagcctg

SEQ ID NO: 4365888 - DNA, 10 bp, Homo sapiens
ccttctaaaa

SEQ ID NO: 4365889 - DNA, 17 bp, Homo sapiens
ccttgataatacttgac

SEQ ID NO: 4365890 - DNA, 19 bp, Homo sapiens
ccttgataatacttgacct

SEQ ID NO: 4365891 - DNA, 18 bp, Homo sapiens
ccttgcatgtacttgaag

SEQ ID NO: 4365892 - DNA, 22 bp, Homo sapiens
ccttgcatgtacttgaaggatg

SEQ ID NO: 4365893 - DNA, 17 bp, Homo sapiens
ccttgcctgaactccag

SEQ ID NO: 4365894 - DNA, 15 bp, Homo sapiens
ccttgctgcagcttc

SEQ ID NO: 4365895 - DNA, 14 bp, Homo sapiens
ccttgctgggccag

SEQ ID NO: 4365896 - DNA, 15 bp, Homo sapiens
ccttgctgggccagg

SEQ ID NO: 4365897 - DNA, 22 bp, Homo sapiens
ccttgctgggccagggaaacaa

SEQ ID NO: 4365898 - DNA, 11 bp, Homo sapiens
ccttggaaggg

SEQ ID NO: 4365899 - DNA, 23 bp, Homo sapiens
ccttggagagagaggctgcctca

SEQ ID NO: 4365900 - DNA, 13 bp, Homo sapiens
ccttggagaggag

SEQ ID NO: 4365901 - DNA, 17 bp, Homo sapiens
cctttttcactttgaaa

SEQ ID NO: 4365902 - DNA, 22 bp, Homo sapiens
cgaatgacggtaagtgttctca

SEQ ID NO: 4365903 - DNA, 13 bp, Homo sapiens
cgatgagggaagg

SEQ ID NO: 4365904 - DNA, 20 bp, Homo sapiens
cgatgagggaaggagcccag

SEQ ID NO: 4365905 - DNA, 13 bp, Homo sapiens
cgatgtcccctgc

SEQ ID NO: 4365906 - DNA, 16 bp, Homo sapiens
cgcaaaggtgcctcat

SEQ ID NO: 4365907 - DNA, 16 bp, Homo sapiens
cgcacagccacccgtg

SEQ ID NO: 4365908 - DNA, 15 bp, Homo sapiens
cgcagcctgaagcct

SEQ ID NO: 4365909 - DNA, 19 bp, Homo sapiens
cgcagcctgaagcctggat

SEQ ID NO: 4365910 - DNA, 11 bp, Homo sapiens
cgcattaagca

SEQ ID NO: 4365911 - DNA, 18 bp, Homo sapiens
cgcattaagcacacacat

SEQ ID NO: 4365912 - DNA, 14 bp, Homo sapiens
cgcctcccacggca

SEQ ID NO: 4365913 - DNA, 20 bp, Homo sapiens
cgctgctgcaggacattaat

SEQ ID NO: 4365914 - DNA, 13 bp, Homo sapiens
cggcccagtgcca

SEQ ID NO: 4365915 - DNA, 15 bp, Homo sapiens
cggcccagtgccact

SEQ ID NO: 4365916 - DNA, 19 bp, Homo sapiens
cggcccagtgccactgccc

SEQ ID NO: 4365917 - DNA, 20 bp, Homo sapiens
cggcccagtgccactgcccc

SEQ ID NO: 4365918 - DNA, 17 bp, Homo sapiens
cggccccccgcacagcc

SEQ ID NO: 4365919 - DNA, 20 bp, Homo sapiens
cggccccccgcacagccacc

SEQ ID NO: 4365920 - DNA, 20 bp, Homo sapiens
cggccttccgggtctcgcag

SEQ ID NO: 4365921 - DNA, 14 bp, Homo sapiens
cgggcagccaccca

SEQ ID NO: 4365922 - DNA, 14 bp, Homo sapiens
cgggccagggtggg

SEQ ID NO: 4365923 - DNA, 13 bp, Homo sapiens
cgggctcagagct

SEQ ID NO: 4365924 - DNA, 18 bp, Homo sapiens
cggggtccaggcccgtgg

SEQ ID NO: 4365925 - DNA, 20 bp, Homo sapiens
cgggtctcgcagcctgaagc

SEQ ID NO: 4365926 - DNA, 14 bp, Homo sapiens
cggtggtgcccgtg

SEQ ID NO: 4365927 - DNA, 20 bp, Homo sapiens
cgtgagttgggggagggaag

SEQ ID NO: 4365928 - DNA, 19 bp, Homo sapiens
cgtgcccccgcctgccacc

SEQ ID NO: 4365929 - DNA, 18 bp, Homo sapiens
cgtgggccagtccccgag

SEQ ID NO: 4365930 - DNA, 18 bp, Homo sapiens
cgtgggcgcaaaggtgcc

SEQ ID NO: 4365931 - DNA, 19 bp, Homo sapiens
cgtgggcgcaaaggtgcct

SEQ ID NO: 4365932 - DNA, 15 bp, Homo sapiens
cgtggggtgctgccc

SEQ ID NO: 4365933 - DNA, 16 bp, Homo sapiens
cgtgttcagcagaacc

SEQ ID NO: 4365934 - DNA, 17 bp, Homo sapiens
cgtgttcagcagaacct

SEQ ID NO: 4365935 - DNA, 20 bp, Homo sapiens
cgtgttcagcagaacctgca

SEQ ID NO: 4365936 - DNA, 19 bp, Homo sapiens
cgttaggaataacactgca

SEQ ID NO: 4365937 - DNA, 21 bp, Homo sapiens
cgttaggaataacactgcagc

SEQ ID NO: 4365938 - DNA, 15 bp, Homo sapiens
ctaaatatttcctta

SEQ ID NO: 4365939 - DNA, 22 bp, Homo sapiens
ctaaatatttccttaaactgtg

SEQ ID NO: 4365940 - DNA, 12 bp, Homo sapiens
ctaaatgatggt

SEQ ID NO: 4365941 - DNA, 16 bp, Homo sapiens
ctaacaagattaaata

SEQ ID NO: 4365942 - DNA, 13 bp, Homo sapiens
ctaagagcaattc

SEQ ID NO: 4365943 - DNA, 18 bp, Homo sapiens
ctaagagtggaggaggag

SEQ ID NO: 4365944 - DNA, 13 bp, Homo sapiens
ctaagtcaggtaa

SEQ ID NO: 4365945 - DNA, 22 bp, Homo sapiens
ctaagttatttactcctcctgc

SEQ ID NO: 4365946 - DNA, 12 bp, Homo sapiens
ctaatataatat

SEQ ID NO: 4365947 - DNA, 16 bp, Homo sapiens
ctaccctaaccaagtt

SEQ ID NO: 4365948 - DNA, 12 bp, Homo sapiens
ctactaaataat

SEQ ID NO: 4365949 - DNA, 11 bp, Homo sapiens
ctactgcccac

SEQ ID NO: 4365950 - DNA, 12 bp, Homo sapiens
ctactgcccaca

SEQ ID NO: 4365951 - DNA, 21 bp, Homo sapiens
ctagacagaaaccaagccatt

SEQ ID NO: 4365952 - DNA, 21 bp, Homo sapiens
ctagcatatagactatataat

SEQ ID NO: 4365953 - DNA, 13 bp, Homo sapiens
ctagcctctccag

SEQ ID NO: 4365954 - DNA, 22 bp, Homo sapiens
ctaggcccccaaattgccttca

SEQ ID NO: 4365955 - DNA, 21 bp, Homo sapiens
ctaggcttcagcatatttata

SEQ ID NO: 4365956 - DNA, 23 bp, Homo sapiens
ctaggcttcagcatatttatagc

SEQ ID NO: 4365957 - DNA, 14 bp, Homo sapiens
ctaggtaggaagag

SEQ ID NO: 4365958 - DNA, 17 bp, Homo sapiens
ctagttctgctgccctc

SEQ ID NO: 4365959 - DNA, 21 bp, Homo sapiens
ctatatagttccttgccttaa

SEQ ID NO: 4365960 - DNA, 12 bp, Homo sapiens
ctatattaaatt

SEQ ID NO: 4365961 - DNA, 13 bp, Homo sapiens
ctatatttgtctt

SEQ ID NO: 4365962 - DNA, 16 bp, Homo sapiens
ctatatttgtcttccg

SEQ ID NO: 4365963 - DNA, 13 bp, Homo sapiens
ctatcattccaat

SEQ ID NO: 4365964 - DNA, 20 bp, Homo sapiens
ctatcctgcaggaaatataa

SEQ ID NO: 4365965 - DNA, 20 bp, Homo sapiens
ctcaaaagcacccttgacgt

SEQ ID NO: 4365966 - DNA, 16 bp, Homo sapiens
ctcaacccattgttgt

SEQ ID NO: 4365967 - DNA, 20 bp, Homo sapiens
ctcaacccattgttgtcaag

SEQ ID NO: 4365968 - DNA, 23 bp, Homo sapiens
ctcaactccgtgcttaaccaaag

SEQ ID NO: 4365969 - DNA, 16 bp, Homo sapiens
ctcaaggtgagaatta

SEQ ID NO: 4365970 - DNA, 14 bp, Homo sapiens
ctcacccatcctag

SEQ ID NO: 4365971 - DNA, 15 bp, Homo sapiens
ctcacccatcctaga

SEQ ID NO: 4365972 - DNA, 14 bp, Homo sapiens
ctcacccctgtagg

SEQ ID NO: 4365973 - DNA, 15 bp, Homo sapiens
ctcacccctgtaggg

SEQ ID NO: 4365974 - DNA, 12 bp, Homo sapiens
ctcacctctgag

SEQ ID NO: 4365975 - DNA, 17 bp, Homo sapiens
ctcacctctgaggacag

SEQ ID NO: 4365976 - DNA, 19 bp, Homo sapiens
ctcaccttgagataacaat

SEQ ID NO: 4365977 - DNA, 17 bp, Homo sapiens
ctcagaacatactgatt

SEQ ID NO: 4365978 - DNA, 13 bp, Homo sapiens
ctcagaaggtatt

SEQ ID NO: 4365979 - DNA, 19 bp, Homo sapiens
ctcagaaggtattcctttt

SEQ ID NO: 4365980 - DNA, 17 bp, Homo sapiens
ctcagagctttgtcact

SEQ ID NO: 4365981 - DNA, 18 bp, Homo sapiens
ctcagagctttgtcactt

SEQ ID NO: 4365982 - DNA, 23 bp, Homo sapiens
ctcagccagtggcacaggagact

SEQ ID NO: 4365983 - DNA, 22 bp, Homo sapiens
ctcaggcagcgtgtgggtcccg

SEQ ID NO: 4365984 - DNA, 17 bp, Homo sapiens
ctcaggcataggcctgg

SEQ ID NO: 4365985 - DNA, 20 bp, Homo sapiens
ctcaggcataggcctgggtg

SEQ ID NO: 4365986 - DNA, 21 bp, Homo sapiens
ctcaggcataggcctgggtgc

SEQ ID NO: 4365987 - DNA, 18 bp, Homo sapiens
ctcatagcatagccagca

SEQ ID NO: 4365988 - DNA, 14 bp, Homo sapiens
ctcatgaagcagga

SEQ ID NO: 4365989 - DNA, 16 bp, Homo sapiens
ctcatgcccagctctc

SEQ ID NO: 4365990 - DNA, 16 bp, Homo sapiens
ctccaccatccccacc

SEQ ID NO: 4365991 - DNA, 15 bp, Homo sapiens
ctccagattctgatg

SEQ ID NO: 4365992 - DNA, 16 bp, Homo sapiens
ctccagattctgatgc

SEQ ID NO: 4365993 - DNA, 22 bp, Homo sapiens
ctccagtcatctgtaagagctt

SEQ ID NO: 4365994 - DNA, 23 bp, Homo sapiens
ctccatgccccagctctggatga

SEQ ID NO: 4365995 - DNA, 22 bp, Homo sapiens
ctcccaacatgggagggatcag

SEQ ID NO: 4365996 - DNA, 22 bp, Homo sapiens
ctcccagcctcttgctcagagc

SEQ ID NO: 4365997 - DNA, 14 bp, Homo sapiens
ctcccctctcagaa

SEQ ID NO: 4365998 - DNA, 22 bp, Homo sapiens
ctcccctctcagaacatactga

SEQ ID NO: 4365999 - DNA, 12 bp, Homo sapiens
ctccctcaactg

SEQ ID NO: 4366000 - DNA, 19 bp, Homo sapiens
ctccctcccctctcagaac

SEQ ID NO: 4366001 - DNA, 15 bp, Homo sapiens
ctccctggctctcag

SEQ ID NO: 4366002 - DNA, 18 bp, Homo sapiens
ctccctggctctcagaag

SEQ ID NO: 4366003 - DNA, 20 bp, Homo sapiens
ctccctggggaccaggagct

SEQ ID NO: 4366004 - DNA, 18 bp, Homo sapiens
ctcctcacccctgtaggg

SEQ ID NO: 4366005 - DNA, 14 bp, Homo sapiens
ctcctggtctgtga

SEQ ID NO: 4366006 - DNA, 20 bp, Homo sapiens
ctcgcagcctgaagcctgga

SEQ ID NO: 4366007 - DNA, 15 bp, Homo sapiens
ctctcagcctcccac

SEQ ID NO: 4366008 - DNA, 16 bp, Homo sapiens
ctctccaccctccggc

SEQ ID NO: 4366009 - DNA, 15 bp, Homo sapiens
ctctcggccaggcat

SEQ ID NO: 4366010 - DNA, 15 bp, Homo sapiens
ctctgacgcttgtga

SEQ ID NO: 4366011 - DNA, 18 bp, Homo sapiens
ctctgacgcttgtgacag

SEQ ID NO: 4366012 - DNA, 20 bp, Homo sapiens
ctctgacgcttgtgacagtg

SEQ ID NO: 4366013 - DNA, 12 bp, Homo sapiens
ctctgaggacag

SEQ ID NO: 4366014 - DNA, 20 bp, Homo sapiens
ctctgatattccatgaatgt

SEQ ID NO: 4366015 - DNA, 14 bp, Homo sapiens
ctctggaaaactat

SEQ ID NO: 4366016 - DNA, 17 bp, Homo sapiens
ctctgtagttacattta

SEQ ID NO: 4366017 - DNA, 20 bp, Homo sapiens
ctctgtctaggactgcagtg

SEQ ID NO: 4366018 - DNA, 16 bp, Homo sapiens
ctctgtgaccaactgt

SEQ ID NO: 4366019 - DNA, 19 bp, Homo sapiens
ctcttctgaataaagcaat

SEQ ID NO: 4366020 - DNA, 20 bp, Homo sapiens
ctcttctgaataaagcaatt

SEQ ID NO: 4366021 - DNA, 16 bp, Homo sapiens
ctctttttttgagtga

SEQ ID NO: 4366022 - DNA, 13 bp, Homo sapiens
ctgaaacacacga

SEQ ID NO: 4366023 - DNA, 14 bp, Homo sapiens
ctgaaacacacgag

SEQ ID NO: 4366024 - DNA, 23 bp, Homo sapiens
ctgaaacacacgagcaaacccag

SEQ ID NO: 4366025 - DNA, 14 bp, Homo sapiens
ctgaaccagtccag

SEQ ID NO: 4366026 - DNA, 13 bp, Homo sapiens
ctgaactccagag

SEQ ID NO: 4366027 - DNA, 21 bp, Homo sapiens
ctgaaggggtgcacccacctg

SEQ ID NO: 4366028 - DNA, 14 bp, Homo sapiens
ctgaataaagcaat

SEQ ID NO: 4366029 - DNA, 20 bp, Homo sapiens
ctgaatatttatatttcact

SEQ ID NO: 4366030 - DNA, 21 bp, Homo sapiens
ctgaatatttatatttcacta

SEQ ID NO: 4366031 - DNA, 18 bp, Homo sapiens
ctgaatgaagctgccatc

SEQ ID NO: 4366032 - DNA, 14 bp, Homo sapiens
ctgacaaaggagcc

SEQ ID NO: 4366033 - DNA, 22 bp, Homo sapiens
ctgacattcctaagagtggagg

SEQ ID NO: 4366034 - DNA, 23 bp, Homo sapiens
ctgacgcttgtgacagtgcctct

SEQ ID NO: 4366035 - DNA, 15 bp, Homo sapiens
ctgactcctgggtgg

SEQ ID NO: 4366036 - DNA, 11 bp, Homo sapiens
ctgaggacaga

SEQ ID NO: 4366037 - DNA, 16 bp, Homo sapiens
ctgaggacagaggccg

SEQ ID NO: 4366038 - DNA, 13 bp, Homo sapiens
ctgaggcccagtg

SEQ ID NO: 4366039 - DNA, 14 bp, Homo sapiens
ctgaggcccagtgc

SEQ ID NO: 4366040 - DNA, 21 bp, Homo sapiens
ctgagtcatcttgtgagtgga

SEQ ID NO: 4366041 - DNA, 23 bp, Homo sapiens
ctgagttttacaccatactgtta

SEQ ID NO: 4366042 - DNA, 17 bp, Homo sapiens
ctgattgggaggtgcgt

SEQ ID NO: 4366043 - DNA, 12 bp, Homo sapiens
ctgatttcagga

SEQ ID NO: 4366044 - DNA, 12 bp, Homo sapiens
ctgcacacagga

SEQ ID NO: 4366045 - DNA, 20 bp, Homo sapiens
ctgcacacaggacagcggga

SEQ ID NO: 4366046 - DNA, 12 bp, Homo sapiens
ctgcacagatgg

SEQ ID NO: 4366047 - DNA, 13 bp, Homo sapiens
ctgcacagatgga

SEQ ID NO: 4366048 - DNA, 20 bp, Homo sapiens
ctgcacagatggatttgcct

SEQ ID NO: 4366049 - DNA, 17 bp, Homo sapiens
ctgcagcatgacctgtg

SEQ ID NO: 4366050 - DNA, 22 bp, Homo sapiens
ctgcagcatgacctgtgaccag

SEQ ID NO: 4366051 - DNA, 19 bp, Homo sapiens
ctgcagccctctccaccct

SEQ ID NO: 4366052 - DNA, 21 bp, Homo sapiens
ctgcagcttctaactggtaaa

SEQ ID NO: 4366053 - DNA, 16 bp, Homo sapiens
ctgcagtgtggagttc

SEQ ID NO: 4366054 - DNA, 15 bp, Homo sapiens
ctgcagtttggccct

SEQ ID NO: 4366055 - DNA, 18 bp, Homo sapiens
ctgcagtttggccctgga

SEQ ID NO: 4366056 - DNA, 23 bp, Homo sapiens
ctgcagtttggccctggagccag

SEQ ID NO: 4366057 - DNA, 20 bp, Homo sapiens
ctgcatactttgacaaggaa

SEQ ID NO: 4366058 - DNA, 12 bp, Homo sapiens
ctgccaaacaca

SEQ ID NO: 4366059 - DNA, 22 bp, Homo sapiens
ctgccaaataaatcatcctcat

SEQ ID NO: 4366060 - DNA, 18 bp, Homo sapiens
ctgccaagactcctcagg

SEQ ID NO: 4366061 - DNA, 20 bp, Homo sapiens
ctgcccacatttgggctcag

SEQ ID NO: 4366062 - DNA, 18 bp, Homo sapiens
ctgcccagacccctctgg

SEQ ID NO: 4366063 - DNA, 13 bp, Homo sapiens
ctgccccccgagg

SEQ ID NO: 4366064 - DNA, 21 bp, Homo sapiens
ctgccccccgaggctgctaga

SEQ ID NO: 4366065 - DNA, 13 bp, Homo sapiens
ctgccctgcctga

SEQ ID NO: 4366066 - DNA, 14 bp, Homo sapiens
ctgccctgcctgag

SEQ ID NO: 4366067 - DNA, 23 bp, Homo sapiens
ctgccgacttggagactcctggt

SEQ ID NO: 4366068 - DNA, 14 bp, Homo sapiens
ctgccggtgggacc

SEQ ID NO: 4366069 - DNA, 22 bp, Homo sapiens
ctgcctcagccagtggcacagg

SEQ ID NO: 4366070 - DNA, 13 bp, Homo sapiens
ctgcctccctggg

SEQ ID NO: 4366071 - DNA, 20 bp, Homo sapiens
ctgcctctggaaaactattg

SEQ ID NO: 4366072 - DNA, 11 bp, Homo sapiens
ctgcctgagga

SEQ ID NO: 4366073 - DNA, 12 bp, Homo sapiens
ctgcctgaggag

SEQ ID NO: 4366074 - DNA, 20 bp, Homo sapiens
ctgcgggcgcgggcagccac

SEQ ID NO: 4366075 - DNA, 13 bp, Homo sapiens
ctgctcccagcct

SEQ ID NO: 4366076 - DNA, 15 bp, Homo sapiens
ctgctcccagcctct

SEQ ID NO: 4366077 - DNA, 19 bp, Homo sapiens
ctgctcccagcctcttgct

SEQ ID NO: 4366078 - DNA, 13 bp, Homo sapiens
ctgctgaggccca

SEQ ID NO: 4366079 - DNA, 20 bp, Homo sapiens
ctgctgaggcccagtgcata

SEQ ID NO: 4366080 - DNA, 14 bp, Homo sapiens
ctgctggctgcggc

SEQ ID NO: 4366081 - DNA, 15 bp, Homo sapiens
ctgctggctgcggcc

SEQ ID NO: 4366082 - DNA, 22 bp, Homo sapiens
ctggaaaactattgagccttgc

SEQ ID NO: 4366083 - DNA, 16 bp, Homo sapiens
ctggaagttgtggata

SEQ ID NO: 4366084 - DNA, 19 bp, Homo sapiens
ctggaagttgtggatatca

SEQ ID NO: 4366085 - DNA, 20 bp, Homo sapiens
ctggaccccgtttcattttt

SEQ ID NO: 4366086 - DNA, 22 bp, Homo sapiens
ctggactgaagcctgcaggagt

SEQ ID NO: 4366087 - DNA, 20 bp, Homo sapiens
ctggagccagggcagaggaa

SEQ ID NO: 4366088 - DNA, 16 bp, Homo sapiens
ctggatagacttggga

SEQ ID NO: 4366089 - DNA, 21 bp, Homo sapiens
ctggatcttctatcattccaa

SEQ ID NO: 4366090 - DNA, 13 bp, Homo sapiens
ctggatggaaact

SEQ ID NO: 4366091 - DNA, 18 bp, Homo sapiens
ctggatggaaacttcctg

SEQ ID NO: 4366092 - DNA, 22 bp, Homo sapiens
ctggattccagcagtgaatgct

SEQ ID NO: 4366093 - DNA, 23 bp, Homo sapiens
ctggccaggatggaggggtggtc

SEQ ID NO: 4366094 - DNA, 22 bp, Homo sapiens
ctggcccgtcatgttcctcaaa

SEQ ID NO: 4366095 - DNA, 13 bp, Homo sapiens
ctggctagaaaac

SEQ ID NO: 4366096 - DNA, 13 bp, Homo sapiens
ctggctgcccaga

SEQ ID NO: 4366097 - DNA, 19 bp, Homo sapiens
ctgggaacatgacccagcc

SEQ ID NO: 4366098 - DNA, 18 bp, Homo sapiens
ctgggaagataggctctg

SEQ ID NO: 4366099 - DNA, 21 bp, Homo sapiens
ctgggaagataggctctgcac

SEQ ID NO: 4366100 - DNA, 18 bp, Homo sapiens
ctgggaatgtattattct

SEQ ID NO: 4366101 - DNA, 17 bp, Homo sapiens
ctgggatgtcacagtcc

SEQ ID NO: 4366102 - DNA, 12 bp, Homo sapiens
ctgggcccctgc

SEQ ID NO: 4366103 - DNA, 14 bp, Homo sapiens
ctggggaccaggag

SEQ ID NO: 4366104 - DNA, 17 bp, Homo sapiens
ctgggtgcgtctccagt

SEQ ID NO: 4366105 - DNA, 15 bp, Homo sapiens
ctgggttctttggaa

SEQ ID NO: 4366106 - DNA, 17 bp, Homo sapiens
ctgggttctttggaagc

SEQ ID NO: 4366107 - DNA, 16 bp, Homo sapiens
ctggtagagaccccca

SEQ ID NO: 4366108 - DNA, 19 bp, Homo sapiens
ctggtggcttaagtgagca

SEQ ID NO: 4366109 - DNA, 21 bp, Homo sapiens
ctggtggcttaagtgagcaga

SEQ ID NO: 4366110 - DNA, 20 bp, Homo sapiens
ctgtaactctcaattccctg

SEQ ID NO: 4366111 - DNA, 14 bp, Homo sapiens
ctgtaactgtcagt

SEQ ID NO: 4366112 - DNA, 15 bp, Homo sapiens
ctgtaactgtcagtg

SEQ ID NO: 4366113 - DNA, 20 bp, Homo sapiens
ctgtaagaagagactgggaa

SEQ ID NO: 4366114 - DNA, 23 bp, Homo sapiens
ctgtaagaagagactgggaagat

SEQ ID NO: 4366115 - DNA, 13 bp, Homo sapiens
ctgtaagagcttg

SEQ ID NO: 4366116 - DNA, 20 bp, Homo sapiens
ctgtaagagcttgctccaga

SEQ ID NO: 4366117 - DNA, 13 bp, Homo sapiens
ctgtacttaataa

SEQ ID NO: 4366118 - DNA, 16 bp, Homo sapiens
ctgtacttaataaatt

SEQ ID NO: 4366119 - DNA, 18 bp, Homo sapiens
ctgtacttaataaattca

SEQ ID NO: 4366120 - DNA, 12 bp, Homo sapiens
ctgtagctttaa

SEQ ID NO: 4366121 - DNA, 18 bp, Homo sapiens
ctgtagggaaaccttgga

SEQ ID NO: 4366122 - DNA, 20 bp, Homo sapiens
ctgtagggaaaccttggaga

SEQ ID NO: 4366123 - DNA, 13 bp, Homo sapiens
ctgtcacaataaa

SEQ ID NO: 4366124 - DNA, 14 bp, Homo sapiens
ctgtcacaataaag

SEQ ID NO: 4366125 - DNA, 13 bp, Homo sapiens
ctgtccaccctgc

SEQ ID NO: 4366126 - DNA, 23 bp, Homo sapiens
ctgtccaccctgccaagactcct

SEQ ID NO: 4366127 - DNA, 21 bp, Homo sapiens
ctgtccgttcacatgtgtggt

SEQ ID NO: 4366128 - DNA, 18 bp, Homo sapiens
ctgtctaggactgcagtg

SEQ ID NO: 4366129 - DNA, 21 bp, Homo sapiens
ctgtctaggactgcagtgtgg

SEQ ID NO: 4366130 - DNA, 14 bp, Homo sapiens
ctgtctatatatat

SEQ ID NO: 4366131 - DNA, 16 bp, Homo sapiens
ctgtctcagtttcact

SEQ ID NO: 4366132 - DNA, 17 bp, Homo sapiens
ctgtggtttcagatgtg

SEQ ID NO: 4366133 - DNA, 23 bp, Homo sapiens
ctgtggtttcagatgtgcaataa

SEQ ID NO: 4366134 - DNA, 21 bp, Homo sapiens
ctgtgtctgccaaacacattt

SEQ ID NO: 4366135 - DNA, 23 bp, Homo sapiens
ctgtgtttcgcattaagcacaca

SEQ ID NO: 4366136 - DNA, 20 bp, Homo sapiens
ctgttatgcactgtggtttc

SEQ ID NO: 4366137 - DNA, 18 bp, Homo sapiens
ctgttttgggcctccatg

SEQ ID NO: 4366138 - DNA, 19 bp, Homo sapiens
cttaagtgagcagaacagg

SEQ ID NO: 4366139 - DNA, 18 bp, Homo sapiens
cttaataaatatgtaata

SEQ ID NO: 4366140 - DNA, 14 bp, Homo sapiens
cttacaaaatgcca

SEQ ID NO: 4366141 - DNA, 15 bp, Homo sapiens
cttacaaaatgccaa

SEQ ID NO: 4366142 - DNA, 22 bp, Homo sapiens
cttaggaagcagtccctggaga

SEQ ID NO: 4366143 - DNA, 13 bp, Homo sapiens
cttcaaatgcaaa

SEQ ID NO: 4366144 - DNA, 14 bp, Homo sapiens
cttcaaatgcaaat

SEQ ID NO: 4366145 - DNA, 22 bp, Homo sapiens
cttcagccctaacatagtgtct

SEQ ID NO: 4366146 - DNA, 16 bp, Homo sapiens
cttcagggcagggctc

SEQ ID NO: 4366147 - DNA, 20 bp, Homo sapiens
cttccagtgaacattcccag

SEQ ID NO: 4366148 - DNA, 20 bp, Homo sapiens
cttccgatcaacatttatga

SEQ ID NO: 4366149 - DNA, 20 bp, Homo sapiens
cttccgggtctcgcagcctg

SEQ ID NO: 4366150 - DNA, 14 bp, Homo sapiens
cttctagcatatag

SEQ ID NO: 4366151 - DNA, 23 bp, Homo sapiens
cttctatcattccaattctaaat

SEQ ID NO: 4366152 - DNA, 13 bp, Homo sapiens
cttctctacagac

SEQ ID NO: 4366153 - DNA, 15 bp, Homo sapiens
cttctctacagactt

SEQ ID NO: 4366154 - DNA, 18 bp, Homo sapiens
cttctgaataaagcaatt

SEQ ID NO: 4366155 - DNA, 22 bp, Homo sapiens
cttctgaataaagcaattagca

SEQ ID NO: 4366156 - DNA, 22 bp, Homo sapiens
cttctgtacagtaagaccacct

SEQ ID NO: 4366157 - DNA, 20 bp, Homo sapiens
cttcttcagaagacactgca

SEQ ID NO: 4366158 - DNA, 19 bp, Homo sapiens
cttgaatattcctggactt

SEQ ID NO: 4366159 - DNA, 13 bp, Homo sapiens
cttgaattgtgta

SEQ ID NO: 4366160 - DNA, 16 bp, Homo sapiens
cttgacctctgtgacc

SEQ ID NO: 4366161 - DNA, 23 bp, Homo sapiens
cttgccacatggtgtctcccaac

SEQ ID NO: 4366162 - DNA, 19 bp, Homo sapiens
cttgcctgaactccagagg

SEQ ID NO: 4366163 - DNA, 19 bp, Homo sapiens
cttgccttaataaatatgt

SEQ ID NO: 4366164 - DNA, 20 bp, Homo sapiens
cttgccttaataaatatgta

SEQ ID NO: 4366165 - DNA, 12 bp, Homo sapiens
cttgctccagat

SEQ ID NO: 4366166 - DNA, 15 bp, Homo sapiens
cttgctccagattct

SEQ ID NO: 4366167 - DNA, 17 bp, Homo sapiens
cttgctccagattctga

SEQ ID NO: 4366168 - DNA, 21 bp, Homo sapiens
cttgctccagattctgatgca

SEQ ID NO: 4366169 - DNA, 14 bp, Homo sapiens
cttggagactcctg

SEQ ID NO: 4366170 - DNA, 16 bp, Homo sapiens
cttggagactcctggt

SEQ ID NO: 4366171 - DNA, 13 bp, Homo sapiens
cttggagagagag

SEQ ID NO: 4366172 - DNA, 23 bp, Homo sapiens
cttggagagagaggctgcctcag

SEQ ID NO: 4366173 - DNA, 14 bp, Homo sapiens
cttggagaggagag

SEQ ID NO: 4366174 - DNA, 18 bp, Homo sapiens
cttggccagttatccctt

SEQ ID NO: 4366175 - DNA, 18 bp, Homo sapiens
cttggtctttctgtgctt

SEQ ID NO: 4366176 - DNA, 13 bp, Homo sapiens
cttgtgacagtgc

SEQ ID NO: 4366177 - DNA, 14 bp, Homo sapiens
cttgtgacagtgcc

SEQ ID NO: 4366178 - DNA, 18 bp, Homo sapiens
cttgtgacagtgcctctt

SEQ ID NO: 4366179 - DNA, 20 bp, Homo sapiens
cttgtgacagtgcctcttcc

SEQ ID NO: 4366180 - DNA, 15 bp, Homo sapiens
cttgtggggccagga

SEQ ID NO: 4366181 - DNA, 16 bp, Homo sapiens
ctttaaaaccacagct

SEQ ID NO: 4366182 - DNA, 18 bp, Homo sapiens
ctttaaaaccacagctgg

SEQ ID NO: 4366183 - DNA, 19 bp, Homo sapiens
ctttaccttctaaaagcca

SEQ ID NO: 4366184 - DNA, 13 bp, Homo sapiens
ctttagagtagca

SEQ ID NO: 4366185 - DNA, 11 bp, Homo sapiens
ctttaggaaat

SEQ ID NO: 4366186 - DNA, 12 bp, Homo sapiens
ctttataaactt

SEQ ID NO: 4366187 - DNA, 19 bp, Homo sapiens
ctttatgtagtttttatat

SEQ ID NO: 4366188 - DNA, 16 bp, Homo sapiens
ctttcacatagatgtc

SEQ ID NO: 4366189 - DNA, 13 bp, Homo sapiens
ctttccctgagga

SEQ ID NO: 4366190 - DNA, 14 bp, Homo sapiens
ctttccctgaggaa

SEQ ID NO: 4366191 - DNA, 22 bp, Homo sapiens
ctttctccctcaactgaagggg

SEQ ID NO: 4366192 - DNA, 15 bp, Homo sapiens
ctttctgtgcttgga

SEQ ID NO: 4366193 - DNA, 14 bp, Homo sapiens
ctttcttggccagt

SEQ ID NO: 4366194 - DNA, 17 bp, Homo sapiens
ctttgaaaagttggaag

SEQ ID NO: 4366195 - DNA, 20 bp, Homo sapiens
ctttgaaaagttggaaggat

SEQ ID NO: 4366196 - DNA, 13 bp, Homo sapiens
ctttgaagggcaa

SEQ ID NO: 4366197 - DNA, 17 bp, Homo sapiens
ctttggccccactttga

SEQ ID NO: 4366198 - DNA, 12 bp, Homo sapiens
ctttgtcacttg

SEQ ID NO: 4366199 - DNA, 16 bp, Homo sapiens
ctttgtcacttgccac

SEQ ID NO: 4366200 - DNA, 18 bp, Homo sapiens
ctttgtcacttgccacat

SEQ ID NO: 4366201 - DNA, 13 bp, Homo sapiens
cttttaagttaat

SEQ ID NO: 4366202 - DNA, 18 bp, Homo sapiens
cttttaagttaatgaaat

SEQ ID NO: 4366203 - DNA, 13 bp, Homo sapiens
cttttcacactgt

SEQ ID NO: 4366204 - DNA, 19 bp, Homo sapiens
cttttcacactgtcttccc

SEQ ID NO: 4366205 - DNA, 18 bp, Homo sapiens
ctttttctttataaactt

SEQ ID NO: 4366206 - DNA, 20 bp, Homo sapiens
ctttttgtttgcatcattta

SEQ ID NO: 4366207 - DNA, 17 bp, Homo sapiens
gaaaaactaattgagcc

SEQ ID NO: 4366208 - DNA, 20 bp, Homo sapiens
gaaaagttggaaggatctgc

SEQ ID NO: 4366209 - DNA, 15 bp, Homo sapiens
gaaaatctatatttg

SEQ ID NO: 4366210 - DNA, 19 bp, Homo sapiens
gaaaatctatatttgtctt

SEQ ID NO: 4366211 - DNA, 22 bp, Homo sapiens
gaaaatctatatttgtcttccg

SEQ ID NO: 4366212 - DNA, 15 bp, Homo sapiens
gaaaatggccatgca

SEQ ID NO: 4366213 - DNA, 22 bp, Homo sapiens
gaaaatggccatgcaggaggtg

SEQ ID NO: 4366214 - DNA, 11 bp, Homo sapiens
gaaacacacga

SEQ ID NO: 4366215 - DNA, 22 bp, Homo sapiens
gaaacatttttgagatattaaa

SEQ ID NO: 4366216 - DNA, 14 bp, Homo sapiens
gaaaccttccaccc

SEQ ID NO: 4366217 - DNA, 15 bp, Homo sapiens
gaaaccttccaccca

SEQ ID NO: 4366218 - DNA, 18 bp, Homo sapiens
gaaaccttggagaggaga

SEQ ID NO: 4366219 - DNA, 22 bp, Homo sapiens
gaaagaattcctgcagcagtta

SEQ ID NO: 4366220 - DNA, 18 bp, Homo sapiens
gaaagcactacaatcatg

SEQ ID NO: 4366221 - DNA, 21 bp, Homo sapiens
gaaagtggccatgccaccctg

SEQ ID NO: 4366222 - DNA, 16 bp, Homo sapiens
gaaataaaatttgaaa

SEQ ID NO: 4366223 - DNA, 22 bp, Homo sapiens
gaaatacgtgattaatatgcaa

SEQ ID NO: 4366224 - DNA, 19 bp, Homo sapiens
gaaatactgccttggctag

SEQ ID NO: 4366225 - DNA, 14 bp, Homo sapiens
gaaatgaataattt

SEQ ID NO: 4366226 - DNA, 18 bp, Homo sapiens
gaaatggcgtctgctctg

SEQ ID NO: 4366227 - DNA, 24 bp, Homo sapiens
gaaatggcgtctgctctggtggct

SEQ ID NO: 4366228 - DNA, 18 bp, Homo sapiens
gaaattcaggtacagaaa

SEQ ID NO: 4366229 - DNA, 19 bp, Homo sapiens
gaacaactaggcttcagca

SEQ ID NO: 4366230 - DNA, 12 bp, Homo sapiens
gaacagctgtgt

SEQ ID NO: 4366231 - DNA, 14 bp, Homo sapiens
gaacagctgtgtct

SEQ ID NO: 4366232 - DNA, 16 bp, Homo sapiens
gaacagctgtgtctgc

SEQ ID NO: 4366233 - DNA, 13 bp, Homo sapiens
gaacattcccagc

SEQ ID NO: 4366234 - DNA, 15 bp, Homo sapiens
gaacctgcacacagg

SEQ ID NO: 4366235 - DNA, 21 bp, Homo sapiens
gaacctgcacacaggacagcg

SEQ ID NO: 4366236 - DNA, 22 bp, Homo sapiens
gaacctgcacacaggacagcgg

SEQ ID NO: 4366237 - DNA, 17 bp, Homo sapiens
gaactctactcaaccca

SEQ ID NO: 4366238 - DNA, 11 bp, Homo sapiens
gaactgggctg

SEQ ID NO: 4366239 - DNA, 14 bp, Homo sapiens
gaactgggctgggc

SEQ ID NO: 4366240 - DNA, 16 bp, Homo sapiens
gaactgggctgggcct

SEQ ID NO: 4366241 - DNA, 18 bp, Homo sapiens
gaactgggttctttggaa

SEQ ID NO: 4366242 - DNA, 22 bp, Homo sapiens
gaactgggttctttggaagcag

SEQ ID NO: 4366243 - DNA, 16 bp, Homo sapiens
gaagaaatagcagagc

SEQ ID NO: 4366244 - DNA, 23 bp, Homo sapiens
gaagaaatctttctccctcaact

SEQ ID NO: 4366245 - DNA, 13 bp, Homo sapiens
gaagaagaaatct

SEQ ID NO: 4366246 - DNA, 16 bp, Homo sapiens
gaagagccggtggtgc

SEQ ID NO: 4366247 - DNA, 13 bp, Homo sapiens
gaagataggctct

SEQ ID NO: 4366248 - DNA, 12 bp, Homo sapiens
gaagcaggaggc

SEQ ID NO: 4366249 - DNA, 22 bp, Homo sapiens
gaagccaaagttttcaaactgc

SEQ ID NO: 4366250 - DNA, 13 bp, Homo sapiens
gaagccccttgga

SEQ ID NO: 4366251 - DNA, 18 bp, Homo sapiens
gaagccccttggagagag

SEQ ID NO: 4366252 - DNA, 17 bp, Homo sapiens
gaagctagatgcccctg

SEQ ID NO: 4366253 - DNA, 23 bp, Homo sapiens
gaagctgccatccttgctgcagc

SEQ ID NO: 4366254 - DNA, 19 bp, Homo sapiens
gaagctttttgtttgcatc

SEQ ID NO: 4366255 - DNA, 19 bp, Homo sapiens
gaaggatggatgagtcaga

SEQ ID NO: 4366256 - DNA, 16 bp, Homo sapiens
gaagggagagccagct

SEQ ID NO: 4366257 - DNA, 13 bp, Homo sapiens
gaagggcaagaaa

SEQ ID NO: 4366258 - DNA, 16 bp, Homo sapiens
gaagggcgttctaggt

SEQ ID NO: 4366259 - DNA, 15 bp, Homo sapiens
gaagggtcctgccgg

SEQ ID NO: 4366260 - DNA, 16 bp, Homo sapiens
gaagggtcctgccggt

SEQ ID NO: 4366261 - DNA, 17 bp, Homo sapiens
gaagggttctgccctgc

SEQ ID NO: 4366262 - DNA, 21 bp, Homo sapiens
gaagggttctgccctgcctga

SEQ ID NO: 4366263 - DNA, 23 bp, Homo sapiens
gaaggtccttgcctgaactccag

SEQ ID NO: 4366264 - DNA, 14 bp, Homo sapiens
gaagtgtaacagct

SEQ ID NO: 4366265 - DNA, 16 bp, Homo sapiens
gaagtgtaacagctga

SEQ ID NO: 4366266 - DNA, 21 bp, Homo sapiens
gaagttgtggatatcagggta

SEQ ID NO: 4366267 - DNA, 13 bp, Homo sapiens
gaagtttgcatct

SEQ ID NO: 4366268 - DNA, 13 bp, Homo sapiens
gaataaagcaatt

SEQ ID NO: 4366269 - DNA, 13 bp, Homo sapiens
gaataacactgca

SEQ ID NO: 4366270 - DNA, 14 bp, Homo sapiens
gaataatttcccaa

SEQ ID NO: 4366271 - DNA, 19 bp, Homo sapiens
gaatatttatatttcacta

SEQ ID NO: 4366272 - DNA, 20 bp, Homo sapiens
gaatatttatatttcactat

SEQ ID NO: 4366273 - DNA, 22 bp, Homo sapiens
gaatccaaaagacaaaaatcaa

SEQ ID NO: 4366274 - DNA, 14 bp, Homo sapiens
gaatcccacattag

SEQ ID NO: 4366275 - DNA, 19 bp, Homo sapiens
gaatccccaacatgcactg

SEQ ID NO: 4366276 - DNA, 24 bp, Homo sapiens
gaatgaaaatcagcaacttctagc

SEQ ID NO: 4366277 - DNA, 20 bp, Homo sapiens
gaatgacggtaagtgttctc

SEQ ID NO: 4366278 - DNA, 20 bp, Homo sapiens
gaatgcaatttttttttgtt

SEQ ID NO: 4366279 - DNA, 20 bp, Homo sapiens
gaatgcacactagcctctcc

SEQ ID NO: 4366280 - DNA, 13 bp, Homo sapiens
gaatgcacctccc

SEQ ID NO: 4366281 - DNA, 15 bp, Homo sapiens
gaatgtatcaggaaa

SEQ ID NO: 4366282 - DNA, 18 bp, Homo sapiens
gaattgagcagttctgtt

SEQ ID NO: 4366283 - DNA, 14 bp, Homo sapiens
gaattgtatcattt

SEQ ID NO: 4366284 - DNA, 20 bp, Homo sapiens
gaattgtgtattgatgcaat

SEQ ID NO: 4366285 - DNA, 17 bp, Homo sapiens
gacaaaggagccttgat

SEQ ID NO: 4366286 - DNA, 11 bp, Homo sapiens
gacaaggaaaa

SEQ ID NO: 4366287 - DNA, 13 bp, Homo sapiens
gacacagcacaag

SEQ ID NO: 4366288 - DNA, 18 bp, Homo sapiens
gacacagcacaagggcac

SEQ ID NO: 4366289 - DNA, 19 bp, Homo sapiens
gacacagcacaagggcaca

SEQ ID NO: 4366290 - DNA, 22 bp, Homo sapiens
gacacgattgagaactgacaaa

SEQ ID NO: 4366291 - DNA, 15 bp, Homo sapiens
gacagaggccggggt

SEQ ID NO: 4366292 - DNA, 16 bp, Homo sapiens
gacagaggccggggtc

SEQ ID NO: 4366293 - DNA, 12 bp, Homo sapiens
gacagcatatag

SEQ ID NO: 4366294 - DNA, 17 bp, Homo sapiens
gacagtctgttatgcac

SEQ ID NO: 4366295 - DNA, 20 bp, Homo sapiens
gacagtctgttatgcactgt

SEQ ID NO: 4366296 - DNA, 21 bp, Homo sapiens
gacagtgcctgggaatgtatt

SEQ ID NO: 4366297 - DNA, 22 bp, Homo sapiens
gacagtgcctgggaatgtatta

SEQ ID NO: 4366298 - DNA, 14 bp, Homo sapiens
gacatgaaatgaaa

SEQ ID NO: 4366299 - DNA, 21 bp, Homo sapiens
gacattaataaagttgctttt

SEQ ID NO: 4366300 - DNA, 15 bp, Homo sapiens
gaccagaattccctt

SEQ ID NO: 4366301 - DNA, 17 bp, Homo sapiens
gaccagcactgtctcag

SEQ ID NO: 4366302 - DNA, 22 bp, Homo sapiens
gaccatggccgaagccccttgg

SEQ ID NO: 4366303 - DNA, 14 bp, Homo sapiens
gacccacactgcca

SEQ ID NO: 4366304 - DNA, 11 bp, Homo sapiens
gacccccaggc

SEQ ID NO: 4366305 - DNA, 12 bp, Homo sapiens
gacctcatgccc

SEQ ID NO: 4366306 - DNA, 16 bp, Homo sapiens
gacctcatgcccagct

SEQ ID NO: 4366307 - DNA, 22 bp, Homo sapiens
gacctcatgcccagctctctga

SEQ ID NO: 4366308 - DNA, 15 bp, Homo sapiens
gacctgtgaccagca

SEQ ID NO: 4366309 - DNA, 17 bp, Homo sapiens
gacctgtgaccagcact

SEQ ID NO: 4366310 - DNA, 19 bp, Homo sapiens
gactggaaggtccttgcct

SEQ ID NO: 4366311 - DNA, 17 bp, Homo sapiens
gactggaagttgtggat

SEQ ID NO: 4366312 - DNA, 17 bp, Homo sapiens
gactggatcttctatca

SEQ ID NO: 4366313 - DNA, 22 bp, Homo sapiens
gactgggaagataggctctgca

SEQ ID NO: 4366314 - DNA, 23 bp, Homo sapiens
gactgggaagataggctctgcac

SEQ ID NO: 4366315 - DNA, 19 bp, Homo sapiens
gactgtgatgccacacaga

SEQ ID NO: 4366316 - DNA, 19 bp, Homo sapiens
gactgtggtataattattt

SEQ ID NO: 4366317 - DNA, 14 bp, Homo sapiens
gacttacaaaatgc

SEQ ID NO: 4366318 - DNA, 17 bp, Homo sapiens
gacttacaaaatgccaa

SEQ ID NO: 4366319 - DNA, 18 bp, Homo sapiens
gacttcagggcagggctc

SEQ ID NO: 4366320 - DNA, 22 bp, Homo sapiens
gacttcagggcagggctctgat

SEQ ID NO: 4366321 - DNA, 20 bp, Homo sapiens
gacttggagactcctggtct

SEQ ID NO: 4366322 - DNA, 20 bp, Homo sapiens
gagaactgacaaaggagcct

SEQ ID NO: 4366323 - DNA, 19 bp, Homo sapiens
gagaagggttctgccctgc

SEQ ID NO: 4366324 - DNA, 20 bp, Homo sapiens
gagaagggttctgccctgcc

SEQ ID NO: 4366325 - DNA, 18 bp, Homo sapiens
gagaattaagttttaaat

SEQ ID NO: 4366326 - DNA, 11 bp, Homo sapiens
gagacatccag

SEQ ID NO: 4366327 - DNA, 17 bp, Homo sapiens
gagaccctacaggagag

SEQ ID NO: 4366328 - DNA, 13 bp, Homo sapiens
gagactccaagga

SEQ ID NO: 4366329 - DNA, 14 bp, Homo sapiens
gagactcctggtct

SEQ ID NO: 4366330 - DNA, 16 bp, Homo sapiens
gagactcctggtctgt

SEQ ID NO: 4366331 - DNA, 21 bp, Homo sapiens
gagactgggaagataggctct

SEQ ID NO: 4366332 - DNA, 15 bp, Homo sapiens
gagagaagggaattt

SEQ ID NO: 4366333 - DNA, 15 bp, Homo sapiens
gagagagaggctgcc

SEQ ID NO: 4366334 - DNA, 16 bp, Homo sapiens
gagaggctgcctcagc

SEQ ID NO: 4366335 - DNA, 19 bp, Homo sapiens
gagaggttataggtcactc

SEQ ID NO: 4366336 - DNA, 15 bp, Homo sapiens
gagagtggcaggtgg

SEQ ID NO: 4366337 - DNA, 11 bp, Homo sapiens
gagatattaaa

SEQ ID NO: 4366338 - DNA, 14 bp, Homo sapiens
gagcaaacccagag

SEQ ID NO: 4366339 - DNA, 16 bp, Homo sapiens
gagcaatttgtctgga

SEQ ID NO: 4366340 - DNA, 12 bp, Homo sapiens
gagcagaacagg

SEQ ID NO: 4366341 - DNA, 21 bp, Homo sapiens
gagcagagacactaacgactt

SEQ ID NO: 4366342 - DNA, 15 bp, Homo sapiens
gagcagcaggtgctg

SEQ ID NO: 4366343 - DNA, 13 bp, Homo sapiens
gagccagggcaga

SEQ ID NO: 4366344 - DNA, 14 bp, Homo sapiens
gagccagggcagag

SEQ ID NO: 4366345 - DNA, 17 bp, Homo sapiens
gagccagggcagaggaa

SEQ ID NO: 4366346 - DNA, 14 bp, Homo sapiens
gagcccgcagggcc

SEQ ID NO: 4366347 - DNA, 14 bp, Homo sapiens
gagccttgctgggc

SEQ ID NO: 4366348 - DNA, 22 bp, Homo sapiens
gagctggatagacttgggatgg

SEQ ID NO: 4366349 - DNA, 15 bp, Homo sapiens
gagctgggcccctgc

SEQ ID NO: 4366350 - DNA, 22 bp, Homo sapiens
gagctgggcccctgcacaggca

SEQ ID NO: 4366351 - DNA, 17 bp, Homo sapiens
gagcttagccaatgtgg

SEQ ID NO: 4366352 - DNA, 13 bp, Homo sapiens
gagctttgtcact

SEQ ID NO: 4366353 - DNA, 17 bp, Homo sapiens
gaggaatgtagggcctg

SEQ ID NO: 4366354 - DNA, 21 bp, Homo sapiens
gaggaatgtagggcctgcatg

SEQ ID NO: 4366355 - DNA, 16 bp, Homo sapiens
gaggacacagcacaag

SEQ ID NO: 4366356 - DNA, 13 bp, Homo sapiens
gaggagctgggcc

SEQ ID NO: 4366357 - DNA, 14 bp, Homo sapiens
gaggaggaggacac

SEQ ID NO: 4366358 - DNA, 24 bp, Homo sapiens
gaggctgcctcagccagtggcaca

SEQ ID NO: 4366359 - DNA, 21 bp, Homo sapiens
gagggagttttgtctgtctcc

SEQ ID NO: 4366360 - DNA, 15 bp, Homo sapiens
gagggatcagccccg

SEQ ID NO: 4366361 - DNA, 19 bp, Homo sapiens
gaggggcgggctcagagct

SEQ ID NO: 4366362 - DNA, 14 bp, Homo sapiens
gaggtctcttgagg

SEQ ID NO: 4366363 - DNA, 12 bp, Homo sapiens
gagtgacagctt

SEQ ID NO: 4366364 - DNA, 23 bp, Homo sapiens
gagtgacagctttctgggatgtc

SEQ ID NO: 4366365 - DNA, 16 bp, Homo sapiens
gagtggataatcagga

SEQ ID NO: 4366366 - DNA, 14 bp, Homo sapiens
gagtggcaggtggg

SEQ ID NO: 4366367 - DNA, 18 bp, Homo sapiens
gagtggcaggtgggctgc

SEQ ID NO: 4366368 - DNA, 22 bp, Homo sapiens
gagtgggctgggccctctgtcc

SEQ ID NO: 4366369 - DNA, 21 bp, Homo sapiens
gagtggtctttctggagaggt

SEQ ID NO: 4366370 - DNA, 14 bp, Homo sapiens
gagtgtaagtgtga

SEQ ID NO: 4366371 - DNA, 20 bp, Homo sapiens
gagtgtaagtgtgagtaaga

SEQ ID NO: 4366372 - DNA, 12 bp, Homo sapiens
gagttcaccttg

SEQ ID NO: 4366373 - DNA, 23 bp, Homo sapiens
gagttgggggagggaagaccaga

SEQ ID NO: 4366374 - DNA, 17 bp, Homo sapiens
gataatacttgacctct

SEQ ID NO: 4366375 - DNA, 17 bp, Homo sapiens
gataatctttatggttc

SEQ ID NO: 4366376 - DNA, 14 bp, Homo sapiens
gatacactgaatgg

SEQ ID NO: 4366377 - DNA, 13 bp, Homo sapiens
gataggctctgca

SEQ ID NO: 4366378 - DNA, 17 bp, Homo sapiens
gatatatttttcacagt

SEQ ID NO: 4366379 - DNA, 19 bp, Homo sapiens
gatatgacccacactgcca

SEQ ID NO: 4366380 - DNA, 23 bp, Homo sapiens
gatattaaagattggaatgtgtt

SEQ ID NO: 4366381 - DNA, 19 bp, Homo sapiens
gatattccatgaatgtatc

SEQ ID NO: 4366382 - DNA, 18 bp, Homo sapiens
gatcaataaaatgtgatt

SEQ ID NO: 4366383 - DNA, 21 bp, Homo sapiens
gatcaataaaatgtgattttt

SEQ ID NO: 4366384 - DNA, 14 bp, Homo sapiens
gatcagagcattta

SEQ ID NO: 4366385 - DNA, 15 bp, Homo sapiens
gatcagccccgcctg

SEQ ID NO: 4366386 - DNA, 22 bp, Homo sapiens
gatgcccctgcagtttggccct

SEQ ID NO: 4366387 - DNA, 22 bp, Homo sapiens
gatggaggggtggtcctgactc

SEQ ID NO: 4366388 - DNA, 24 bp, Homo sapiens
gatggcatttggtctcaggcagca

SEQ ID NO: 4366389 - DNA, 14 bp, Homo sapiens
gatgtaaataaaat

SEQ ID NO: 4366390 - DNA, 20 bp, Homo sapiens
gatgtcacagtccaaccaga

SEQ ID NO: 4366391 - DNA, 20 bp, Homo sapiens
gatgtccctttcttggccag

SEQ ID NO: 4366392 - DNA, 18 bp, Homo sapiens
gatgttatgaacagctgt

SEQ ID NO: 4366393 - DNA, 14 bp, Homo sapiens
gattaaaaaaattt

SEQ ID NO: 4366394 - DNA, 16 bp, Homo sapiens
gattaaaaatgctttt

SEQ ID NO: 4366395 - DNA, 15 bp, Homo sapiens
gattacatgtatgtt

SEQ ID NO: 4366396 - DNA, 16 bp, Homo sapiens
gattgaagggtcctgc

SEQ ID NO: 4366397 - DNA, 18 bp, Homo sapiens
gattgagaactgacaaag

SEQ ID NO: 4366398 - DNA, 22 bp, Homo sapiens
gattgggaggtgcgtgttcagc

SEQ ID NO: 4366399 - DNA, 18 bp, Homo sapiens
gcaaacaaaattgttctt

SEQ ID NO: 4366400 - DNA, 17 bp, Homo sapiens
gcaaacccagaggtgga

SEQ ID NO: 4366401 - DNA, 22 bp, Homo sapiens
gcaaacccagaggtggatgtta

SEQ ID NO: 4366402 - DNA, 14 bp, Homo sapiens
gcaaaggtgcctca

SEQ ID NO: 4366403 - DNA, 15 bp, Homo sapiens
gcaaaggtgcctcat

SEQ ID NO: 4366404 - DNA, 23 bp, Homo sapiens
gcaaaggtgcctcatagcatagc

SEQ ID NO: 4366405 - DNA, 13 bp, Homo sapiens
gcaataatttgta

SEQ ID NO: 4366406 - DNA, 19 bp, Homo sapiens
gcaataatttgtacaatgg

SEQ ID NO: 4366407 - DNA, 16 bp, Homo sapiens
gcaatataagcataaa

SEQ ID NO: 4366408 - DNA, 21 bp, Homo sapiens
gcaatccatgttagtttttac

SEQ ID NO: 4366409 - DNA, 16 bp, Homo sapiens
gcacaagggcacattg

SEQ ID NO: 4366410 - DNA, 21 bp, Homo sapiens
gcacaagggcacattgcccat

SEQ ID NO: 4366411 - DNA, 16 bp, Homo sapiens
gcacacacatctggcc

SEQ ID NO: 4366412 - DNA, 12 bp, Homo sapiens
gcacacaggaca

SEQ ID NO: 4366413 - DNA, 14 bp, Homo sapiens
gcacacaggacagc

SEQ ID NO: 4366414 - DNA, 17 bp, Homo sapiens
gcacacaggacagcggg

SEQ ID NO: 4366415 - DNA, 13 bp, Homo sapiens
gcacacagggccc

SEQ ID NO: 4366416 - DNA, 20 bp, Homo sapiens
gcacacagggcccggccaca

SEQ ID NO: 4366417 - DNA, 15 bp, Homo sapiens
gcacagatggatttg

SEQ ID NO: 4366418 - DNA, 19 bp, Homo sapiens
gcacagatggatttgcctg

SEQ ID NO: 4366419 - DNA, 22 bp, Homo sapiens
gcacagatggatttgcctgtgc

SEQ ID NO: 4366420 - DNA, 24 bp, Homo sapiens
gcacagatggatttgcctgtgcca

SEQ ID NO: 4366421 - DNA, 16 bp, Homo sapiens
gcacagccacccgtgg

SEQ ID NO: 4366422 - DNA, 23 bp, Homo sapiens
gcacagccacccgtggggtgctg

SEQ ID NO: 4366423 - DNA, 20 bp, Homo sapiens
gcacatgtacatatggaaat

SEQ ID NO: 4366424 - DNA, 15 bp, Homo sapiens
gcaccacactgggtg

SEQ ID NO: 4366425 - DNA, 23 bp, Homo sapiens
gcaccacactgggtgcgtctcca

SEQ ID NO: 4366426 - DNA, 13 bp, Homo sapiens
gcacccacctgtt

SEQ ID NO: 4366427 - DNA, 18 bp, Homo sapiens
gcacccacctgttttctg

SEQ ID NO: 4366428 - DNA, 21 bp, Homo sapiens
gcacccacctgttttctgaaa

SEQ ID NO: 4366429 - DNA, 22 bp, Homo sapiens
gcacctcggggacaccagagct

SEQ ID NO: 4366430 - DNA, 14 bp, Homo sapiens
gcactacaatcatg

SEQ ID NO: 4366431 - DNA, 14 bp, Homo sapiens
gcactctgccccca

SEQ ID NO: 4366432 - DNA, 17 bp, Homo sapiens
gcactgatgttgtgttt

SEQ ID NO: 4366433 - DNA, 17 bp, Homo sapiens
gcactgtggtttcagat

SEQ ID NO: 4366434 - DNA, 19 bp, Homo sapiens
gcactgtggtttcagatgt

SEQ ID NO: 4366435 - DNA, 19 bp, Homo sapiens
gcagaaagcatccctcacc

SEQ ID NO: 4366436 - DNA, 12 bp, Homo sapiens
gcagaacaaatg

SEQ ID NO: 4366437 - DNA, 19 bp, Homo sapiens
gcagaacctgcacacagga

SEQ ID NO: 4366438 - DNA, 14 bp, Homo sapiens
gcagacctcatgcc

SEQ ID NO: 4366439 - DNA, 21 bp, Homo sapiens
gcagacctcatgcccagctct

SEQ ID NO: 4366440 - DNA, 16 bp, Homo sapiens
gcagcaccacactggg

SEQ ID NO: 4366441 - DNA, 19 bp, Homo sapiens
gcagccacccaagcctgct

SEQ ID NO: 4366442 - DNA, 14 bp, Homo sapiens
gcagccccctgtgg

SEQ ID NO: 4366443 - DNA, 21 bp, Homo sapiens
gcagccctcacctctgaggac

SEQ ID NO: 4366444 - DNA, 12 bp, Homo sapiens
gcaggaaatata

SEQ ID NO: 4366445 - DNA, 16 bp, Homo sapiens
gcaggaactgggctgg

SEQ ID NO: 4366446 - DNA, 13 bp, Homo sapiens
gcaggacattaat

SEQ ID NO: 4366447 - DNA, 14 bp, Homo sapiens
gcaggaggtggaga

SEQ ID NO: 4366448 - DNA, 14 bp, Homo sapiens
gcaggcctctggtt

SEQ ID NO: 4366449 - DNA, 19 bp, Homo sapiens
gcaggcctctggttgcctc

SEQ ID NO: 4366450 - DNA, 12 bp, Homo sapiens
gcagggctctga

SEQ ID NO: 4366451 - DNA, 14 bp, Homo sapiens
gcaggtgggctgcc

SEQ ID NO: 4366452 - DNA, 12 bp, Homo sapiens
gcagtgtggagt

SEQ ID NO: 4366453 - DNA, 21 bp, Homo sapiens
gcagtgtggagttcaccttgg

SEQ ID NO: 4366454 - DNA, 15 bp, Homo sapiens
gcagttctgttgcat

SEQ ID NO: 4366455 - DNA, 18 bp, Homo sapiens
gcagtttggccctggagc

SEQ ID NO: 4366456 - DNA, 19 bp, Homo sapiens
gcagtttggccctggagcc

SEQ ID NO: 4366457 - DNA, 20 bp, Homo sapiens
gcagtttggccctggagcca

SEQ ID NO: 4366458 - DNA, 16 bp, Homo sapiens
gcataggcctgggtgc

SEQ ID NO: 4366459 - DNA, 21 bp, Homo sapiens
gcatccctcacccatcctaga

SEQ ID NO: 4366460 - DNA, 16 bp, Homo sapiens
gcatctcctgtgcatg

SEQ ID NO: 4366461 - DNA, 21 bp, Homo sapiens
gcatgggtgaagggagagcca

SEQ ID NO: 4366462 - DNA, 16 bp, Homo sapiens
gcatgtacttgaagga

SEQ ID NO: 4366463 - DNA, 16 bp, Homo sapiens
gcatgtcccacccacc

SEQ ID NO: 4366464 - DNA, 14 bp, Homo sapiens
gcattaagcacaca

SEQ ID NO: 4366465 - DNA, 17 bp, Homo sapiens
gcattaagcacacacat

SEQ ID NO: 4366466 - DNA, 14 bp, Homo sapiens
gcattcagcacaca

SEQ ID NO: 4366467 - DNA, 13 bp, Homo sapiens
gcatttgtgaggc

SEQ ID NO: 4366468 - DNA, 16 bp, Homo sapiens
gcattttattaaactt

SEQ ID NO: 4366469 - DNA, 16 bp, Homo sapiens
gcatttttatgcagac

SEQ ID NO: 4366470 - DNA, 19 bp, Homo sapiens
gccaaataaatcatcctca

SEQ ID NO: 4366471 - DNA, 20 bp, Homo sapiens
gccaaataaatcatcctcat

SEQ ID NO: 4366472 - DNA, 14 bp, Homo sapiens
gccaagactcctca

SEQ ID NO: 4366473 - DNA, 17 bp, Homo sapiens
gccaagggggtgactgg

SEQ ID NO: 4366474 - DNA, 18 bp, Homo sapiens
gccaagggggtgactgga

SEQ ID NO: 4366475 - DNA, 21 bp, Homo sapiens
gccacaaccctgttttatact

SEQ ID NO: 4366476 - DNA, 12 bp, Homo sapiens
gccacacccagc

SEQ ID NO: 4366477 - DNA, 17 bp, Homo sapiens
gccacacccagcggccc

SEQ ID NO: 4366478 - DNA, 17 bp, Homo sapiens
gccacccaagcctgctg

SEQ ID NO: 4366479 - DNA, 18 bp, Homo sapiens
gccacccaagcctgctgg

SEQ ID NO: 4366480 - DNA, 20 bp, Homo sapiens
gccacccaagcctgctggct

SEQ ID NO: 4366481 - DNA, 13 bp, Homo sapiens
gccactgcccccc

SEQ ID NO: 4366482 - DNA, 22 bp, Homo sapiens
gccactgccccccgaggctgct

SEQ ID NO: 4366483 - DNA, 17 bp, Homo sapiens
gccagcattcagcacac

SEQ ID NO: 4366484 - DNA, 19 bp, Homo sapiens
gccagcattcagcacacac

SEQ ID NO: 4366485 - DNA, 19 bp, Homo sapiens
gccaggcattggctcagcc

SEQ ID NO: 4366486 - DNA, 16 bp, Homo sapiens
gccagggcagaggaat

SEQ ID NO: 4366487 - DNA, 22 bp, Homo sapiens
gccagggtgggaagagaagaaa

SEQ ID NO: 4366488 - DNA, 23 bp, Homo sapiens
gccagtccccgaggagctgggcc

SEQ ID NO: 4366489 - DNA, 17 bp, Homo sapiens
gccagtggcacaggaga

SEQ ID NO: 4366490 - DNA, 22 bp, Homo sapiens
gccagtggggtcccccctgagt

SEQ ID NO: 4366491 - DNA, 15 bp, Homo sapiens
gccatgcagaaagca

SEQ ID NO: 4366492 - DNA, 23 bp, Homo sapiens
gccatgcagacctcatgcccagc

SEQ ID NO: 4366493 - DNA, 21 bp, Homo sapiens
gccatgcaggaggtggagaaa

SEQ ID NO: 4366494 - DNA, 14 bp, Homo sapiens
gccatgccaccctg

SEQ ID NO: 4366495 - DNA, 16 bp, Homo sapiens
gccatggggtccatcc

SEQ ID NO: 4366496 - DNA, 14 bp, Homo sapiens
gccattattatgat

SEQ ID NO: 4366497 - DNA, 19 bp, Homo sapiens
gccatttgctagttctgct

SEQ ID NO: 4366498 - DNA, 13 bp, Homo sapiens
gcccaacctcctg

SEQ ID NO: 4366499 - DNA, 15 bp, Homo sapiens
gcccacatttgggct

SEQ ID NO: 4366500 - DNA, 18 bp, Homo sapiens
gcccacatttgggctcag

SEQ ID NO: 4366501 - DNA, 14 bp, Homo sapiens
gcccagctctctga

SEQ ID NO: 4366502 - DNA, 16 bp, Homo sapiens
gcccagtccctggagc

SEQ ID NO: 4366503 - DNA, 17 bp, Homo sapiens
gcccagtccctggagct

SEQ ID NO: 4366504 - DNA, 17 bp, Homo sapiens
gcccagtgccactgccc

SEQ ID NO: 4366505 - DNA, 21 bp, Homo sapiens
gccccaagaggggcgggctca

SEQ ID NO: 4366506 - DNA, 22 bp, Homo sapiens
gccccaagaggggcgggctcag

SEQ ID NO: 4366507 - DNA, 23 bp, Homo sapiens
gccccaagaggggcgggctcaga

SEQ ID NO: 4366508 - DNA, 13 bp, Homo sapiens
gccccagctctgg

SEQ ID NO: 4366509 - DNA, 14 bp, Homo sapiens
gccccagctctgga

SEQ ID NO: 4366510 - DNA, 20 bp, Homo sapiens
gccccagctctggatgaagg

SEQ ID NO: 4366511 - DNA, 17 bp, Homo sapiens
gcccccaaattgccttc

SEQ ID NO: 4366512 - DNA, 23 bp, Homo sapiens
gcccccaaattgccttcagccct

SEQ ID NO: 4366513 - DNA, 15 bp, Homo sapiens
gccccctccccccag

SEQ ID NO: 4366514 - DNA, 12 bp, Homo sapiens
gccccctgtggc

SEQ ID NO: 4366515 - DNA, 23 bp, Homo sapiens
gccccgcctgtcacaataaagtt

SEQ ID NO: 4366516 - DNA, 17 bp, Homo sapiens
gcccctgcacaggcaca

SEQ ID NO: 4366517 - DNA, 15 bp, Homo sapiens
gccccttggagagag

SEQ ID NO: 4366518 - DNA, 14 bp, Homo sapiens
gcccggccacaccc

SEQ ID NO: 4366519 - DNA, 16 bp, Homo sapiens
gcccggcgccgggcac

SEQ ID NO: 4366520 - DNA, 23 bp, Homo sapiens
gcccgtggggtctgcgcttggtc

SEQ ID NO: 4366521 - DNA, 23 bp, Homo sapiens
gccctcacctctgaggacagagg

SEQ ID NO: 4366522 - DNA, 14 bp, Homo sapiens
gccctctgtccaca

SEQ ID NO: 4366523 - DNA, 17 bp, Homo sapiens
gccctcttaagatctga

SEQ ID NO: 4366524 - DNA, 19 bp, Homo sapiens
gccctgacttctggagatg

SEQ ID NO: 4366525 - DNA, 12 bp, Homo sapiens
gccctgcctgag

SEQ ID NO: 4366526 - DNA, 15 bp, Homo sapiens
gccctggagccaggg

SEQ ID NO: 4366527 - DNA, 17 bp, Homo sapiens
gccctggagccagggca

SEQ ID NO: 4366528 - DNA, 18 bp, Homo sapiens
gccctggagccagggcag

SEQ ID NO: 4366529 - DNA, 19 bp, Homo sapiens
gcccttatgcccggcgccg

SEQ ID NO: 4366530 - DNA, 20 bp, Homo sapiens
gcccttctatacccacccag

SEQ ID NO: 4366531 - DNA, 21 bp, Homo sapiens
gcccttctatacccacccaga

SEQ ID NO: 4366532 - DNA, 20 bp, Homo sapiens
gcccttgtcgtgggatggca

SEQ ID NO: 4366533 - DNA, 15 bp, Homo sapiens
gccgacttggagact

SEQ ID NO: 4366534 - DNA, 18 bp, Homo sapiens
gccgacttggagactcct

SEQ ID NO: 4366535 - DNA, 13 bp, Homo sapiens
gccgcctcccacg

SEQ ID NO: 4366536 - DNA, 15 bp, Homo sapiens
gcctcagccagtggc

SEQ ID NO: 4366537 - DNA, 16 bp, Homo sapiens
gcctcatagcatagcc

SEQ ID NO: 4366538 - DNA, 17 bp, Homo sapiens
gcctccagtcatggtac

SEQ ID NO: 4366539 - DNA, 20 bp, Homo sapiens
gcctccatgccccagctctg

SEQ ID NO: 4366540 - DNA, 21 bp, Homo sapiens
gcctccatgccccagctctgg

SEQ ID NO: 4366541 - DNA, 22 bp, Homo sapiens
gcctccatgccccagctctgga

SEQ ID NO: 4366542 - DNA, 20 bp, Homo sapiens
gcctccctggggaccaggag

SEQ ID NO: 4366543 - DNA, 19 bp, Homo sapiens
gcctcgttggagagcagca

SEQ ID NO: 4366544 - DNA, 15 bp, Homo sapiens
gcctctggttgcctc

SEQ ID NO: 4366545 - DNA, 14 bp, Homo sapiens
gcctcttccagtga

SEQ ID NO: 4366546 - DNA, 20 bp, Homo sapiens
gcctcttcttcttcagaaga

SEQ ID NO: 4366547 - DNA, 14 bp, Homo sapiens
gcctgaactccaga

SEQ ID NO: 4366548 - DNA, 13 bp, Homo sapiens
gcctgaagcctgg

SEQ ID NO: 4366549 - DNA, 18 bp, Homo sapiens
gcctgaggaggaggacac

SEQ ID NO: 4366550 - DNA, 15 bp, Homo sapiens
gcctgcatggagaag

SEQ ID NO: 4366551 - DNA, 13 bp, Homo sapiens
gcctgctggctgc

SEQ ID NO: 4366552 - DNA, 19 bp, Homo sapiens
gcctgctggctgcggcccc

SEQ ID NO: 4366553 - DNA, 23 bp, Homo sapiens
gcctggattccagcagtgaatgc

SEQ ID NO: 4366554 - DNA, 15 bp, Homo sapiens
gcctgggaatgtatt

SEQ ID NO: 4366555 - DNA, 15 bp, Homo sapiens
gcctgggtgctggct

SEQ ID NO: 4366556 - DNA, 17 bp, Homo sapiens
gcctgggtgctggctgc

SEQ ID NO: 4366557 - DNA, 20 bp, Homo sapiens
gcctgggtgctggctgccca

SEQ ID NO: 4366558 - DNA, 18 bp, Homo sapiens
gcctgtcacaataaagtt

SEQ ID NO: 4366559 - DNA, 21 bp, Homo sapiens
gccttaagcagaacaaatgtg

SEQ ID NO: 4366560 - DNA, 17 bp, Homo sapiens
gccttaataaatatgta

SEQ ID NO: 4366561 - DNA, 12 bp, Homo sapiens
gccttcagccct

SEQ ID NO: 4366562 - DNA, 22 bp, Homo sapiens
gccttccgggtctcgcagcctg

SEQ ID NO: 4366563 - DNA, 14 bp, Homo sapiens
gccttgctgggcca

SEQ ID NO: 4366564 - DNA, 16 bp, Homo sapiens
gccttgctgggccagg

SEQ ID NO: 4366565 - DNA, 18 bp, Homo sapiens
gccttgctgggccaggga

SEQ ID NO: 4366566 - DNA, 22 bp, Homo sapiens
gcgcagtgcttctctacagact

SEQ ID NO: 4366567 - DNA, 18 bp, Homo sapiens
gcggccccccgcacagcc

SEQ ID NO: 4366568 - DNA, 22 bp, Homo sapiens
gcggccccccgcacagccaccc

SEQ ID NO: 4366569 - DNA, 23 bp, Homo sapiens
gcggccttccgggtctcgcagcc

SEQ ID NO: 4366570 - DNA, 13 bp, Homo sapiens
gcgggccagggtg

SEQ ID NO: 4366571 - DNA, 14 bp, Homo sapiens
gcgggccagggtgg

SEQ ID NO: 4366572 - DNA, 13 bp, Homo sapiens
gcgtctccagtca

SEQ ID NO: 4366573 - DNA, 22 bp, Homo sapiens
gctaaaattagttttaaaatac

SEQ ID NO: 4366574 - DNA, 19 bp, Homo sapiens
gctacaatggaaaccattt

SEQ ID NO: 4366575 - DNA, 20 bp, Homo sapiens
gctagacagaaaccaagcca

SEQ ID NO: 4366576 - DNA, 18 bp, Homo sapiens
gctagttctgctgccctc

SEQ ID NO: 4366577 - DNA, 18 bp, Homo sapiens
gctataaactttacatat

SEQ ID NO: 4366578 - DNA, 16 bp, Homo sapiens
gctcagagctttgtca

SEQ ID NO: 4366579 - DNA, 18 bp, Homo sapiens
gctcagagctttgtcact

SEQ ID NO: 4366580 - DNA, 19 bp, Homo sapiens
gctcagagctttgtcactt

SEQ ID NO: 4366581 - DNA, 20 bp, Homo sapiens
gctcagagctttgtcacttg

SEQ ID NO: 4366582 - DNA, 20 bp, Homo sapiens
gctcagggttggccatttgc

SEQ ID NO: 4366583 - DNA, 16 bp, Homo sapiens
gctccagattctgatg

SEQ ID NO: 4366584 - DNA, 18 bp, Homo sapiens
gctccagattctgatgca

SEQ ID NO: 4366585 - DNA, 19 bp, Homo sapiens
gctcctcacccctgtaggg

SEQ ID NO: 4366586 - DNA, 16 bp, Homo sapiens
gctctcagcctcccac

SEQ ID NO: 4366587 - DNA, 17 bp, Homo sapiens
gctctcagcctcccaca

SEQ ID NO: 4366588 - DNA, 17 bp, Homo sapiens
gctctctgacgcttgtg

SEQ ID NO: 4366589 - DNA, 18 bp, Homo sapiens
gctctctgacgcttgtga

SEQ ID NO: 4366590 - DNA, 19 bp, Homo sapiens
gctctctgacgcttgtgac

SEQ ID NO: 4366591 - DNA, 12 bp, Homo sapiens
gctctgcacaga

SEQ ID NO: 4366592 - DNA, 18 bp, Homo sapiens
gctctgcacagatggatt

SEQ ID NO: 4366593 - DNA, 17 bp, Homo sapiens
gctgacatgaagctgtt

SEQ ID NO: 4366594 - DNA, 21 bp, Homo sapiens
gctgccatccttgctgcagct

SEQ ID NO: 4366595 - DNA, 22 bp, Homo sapiens
gctgccgacttggagactcctg

SEQ ID NO: 4366596 - DNA, 10 bp, Homo sapiens
gctgcctcag

SEQ ID NO: 4366597 - DNA, 12 bp, Homo sapiens
gctgcctcagcc

SEQ ID NO: 4366598 - DNA, 24 bp, Homo sapiens
gctgcctcagccagtggcacagga

SEQ ID NO: 4366599 - DNA, 13 bp, Homo sapiens
gctgctctcagcc

SEQ ID NO: 4366600 - DNA, 15 bp, Homo sapiens
gctgctgcctccctg

SEQ ID NO: 4366601 - DNA, 19 bp, Homo sapiens
gctgggcagggtgagaagc

SEQ ID NO: 4366602 - DNA, 21 bp, Homo sapiens
gctggtagagacccccaggcc

SEQ ID NO: 4366603 - DNA, 24 bp, Homo sapiens
gctgtaagaagagactgggaagat

SEQ ID NO: 4366604 - DNA, 13 bp, Homo sapiens
gctgtgtctgcca

SEQ ID NO: 4366605 - DNA, 14 bp, Homo sapiens
gctgtgtctgccaa

SEQ ID NO: 4366606 - DNA, 20 bp, Homo sapiens
gctgtgtctgccaaacacat

SEQ ID NO: 4366607 - DNA, 16 bp, Homo sapiens
gctgtgttaagaggac

SEQ ID NO: 4366608 - DNA, 17 bp, Homo sapiens
gctgtgttaagaggact

SEQ ID NO: 4366609 - DNA, 22 bp, Homo sapiens
gcttaaattcttcaagaaagaa

SEQ ID NO: 4366610 - DNA, 12 bp, Homo sapiens
gcttggggaaaa

SEQ ID NO: 4366611 - DNA, 16 bp, Homo sapiens
gcttgtgacagtgcct

SEQ ID NO: 4366612 - DNA, 17 bp, Homo sapiens
gctttaaaaccacagct

SEQ ID NO: 4366613 - DNA, 21 bp, Homo sapiens
gctttctgggatgtcacagtc

SEQ ID NO: 4366614 - DNA, 13 bp, Homo sapiens
gctttcttgctgg

SEQ ID NO: 4366615 - DNA, 17 bp, Homo sapiens
gctttcttgctggttgt

SEQ ID NO: 4366616 - DNA, 23 bp, Homo sapiens
gcttttaaatgaccaaagatgac

SEQ ID NO: 4366617 - DNA, 17 bp, Homo sapiens
gctttttgtttgcatca

SEQ ID NO: 4366618 - DNA, 20 bp, Homo sapiens
gcttttttaggctacagtgt

SEQ ID NO: 4366619 - DNA, 16 bp, Homo sapiens
ggaaaactattgagcc

SEQ ID NO: 4366620 - DNA, 19 bp, Homo sapiens
ggaaaactattgagccttg

SEQ ID NO: 4366621 - DNA, 17 bp, Homo sapiens
ggaaaatggccatgcag

SEQ ID NO: 4366622 - DNA, 21 bp, Homo sapiens
ggaaacaaagtttacattgtc

SEQ ID NO: 4366623 - DNA, 23 bp, Homo sapiens
ggaaacatttttgagatattaaa

SEQ ID NO: 4366624 - DNA, 17 bp, Homo sapiens
ggaaaccttccacccag

SEQ ID NO: 4366625 - DNA, 18 bp, Homo sapiens
ggaaaccttccacccagt

SEQ ID NO: 4366626 - DNA, 19 bp, Homo sapiens
ggaaaccttggagaggaga

SEQ ID NO: 4366627 - DNA, 16 bp, Homo sapiens
ggaactgggctgggcc

SEQ ID NO: 4366628 - DNA, 12 bp, Homo sapiens
ggaagaagaaat

SEQ ID NO: 4366629 - DNA, 16 bp, Homo sapiens
ggaagaccagaattcc

SEQ ID NO: 4366630 - DNA, 23 bp, Homo sapiens
ggaagaccagaattcccttgaat

SEQ ID NO: 4366631 - DNA, 16 bp, Homo sapiens
ggaagagaagaaatag

SEQ ID NO: 4366632 - DNA, 22 bp, Homo sapiens
ggaagagaagaaatagcagagc

SEQ ID NO: 4366633 - DNA, 14 bp, Homo sapiens
ggaaggatctgctg

SEQ ID NO: 4366634 - DNA, 17 bp, Homo sapiens
ggaaggatctgctgagg

SEQ ID NO: 4366635 - DNA, 20 bp, Homo sapiens
ggaaggttagaaaggcagcc

SEQ ID NO: 4366636 - DNA, 15 bp, Homo sapiens
ggaaggttgtatgtg

SEQ ID NO: 4366637 - DNA, 16 bp, Homo sapiens
ggaagttgtggatatc

SEQ ID NO: 4366638 - DNA, 13 bp, Homo sapiens
ggaataacactgc

SEQ ID NO: 4366639 - DNA, 20 bp, Homo sapiens
ggaatccaaaagacaaaaat

SEQ ID NO: 4366640 - DNA, 12 bp, Homo sapiens
ggacaccagagc

SEQ ID NO: 4366641 - DNA, 20 bp, Homo sapiens
ggaccatggccgaagcccct

SEQ ID NO: 4366642 - DNA, 12 bp, Homo sapiens
ggaccctgtccg

SEQ ID NO: 4366643 - DNA, 17 bp, Homo sapiens
ggactgaagcctgcagg

SEQ ID NO: 4366644 - DNA, 19 bp, Homo sapiens
ggactgaagcctgcaggag

SEQ ID NO: 4366645 - DNA, 16 bp, Homo sapiens
ggactgcagtgtggag

SEQ ID NO: 4366646 - DNA, 14 bp, Homo sapiens
ggacttacaaaatg

SEQ ID NO: 4366647 - DNA, 17 bp, Homo sapiens
ggagactccaaggagct

SEQ ID NO: 4366648 - DNA, 17 bp, Homo sapiens
ggagactcctggtctgt

SEQ ID NO: 4366649 - DNA, 13 bp, Homo sapiens
ggagagagaggct

SEQ ID NO: 4366650 - DNA, 14 bp, Homo sapiens
ggagagagaggctg

SEQ ID NO: 4366651 - DNA, 15 bp, Homo sapiens
ggagagagaggctgc

SEQ ID NO: 4366652 - DNA, 20 bp, Homo sapiens
ggagagagaggctgcctcag

SEQ ID NO: 4366653 - DNA, 13 bp, Homo sapiens
ggagagcagcagg

SEQ ID NO: 4366654 - DNA, 21 bp, Homo sapiens
ggagagcagcaggtgctgtgc

SEQ ID NO: 4366655 - DNA, 12 bp, Homo sapiens
ggagccagggca

SEQ ID NO: 4366656 - DNA, 13 bp, Homo sapiens
ggagccagggcag

SEQ ID NO: 4366657 - DNA, 14 bp, Homo sapiens
ggagcccagccaga

SEQ ID NO: 4366658 - DNA, 21 bp, Homo sapiens
ggagccttgctgggccaggga

SEQ ID NO: 4366659 - DNA, 22 bp, Homo sapiens
ggagctagcccagtccctggag

SEQ ID NO: 4366660 - DNA, 16 bp, Homo sapiens
ggagctgggcccctgc

SEQ ID NO: 4366661 - DNA, 11 bp, Homo sapiens
ggaggagcctt

SEQ ID NO: 4366662 - DNA, 19 bp, Homo sapiens
ggaggagccttgctgggcc

SEQ ID NO: 4366663 - DNA, 21 bp, Homo sapiens
ggaggagccttgctgggccag

SEQ ID NO: 4366664 - DNA, 13 bp, Homo sapiens
ggaggaggagcct

SEQ ID NO: 4366665 - DNA, 14 bp, Homo sapiens
ggaggaggagcctt

SEQ ID NO: 4366666 - DNA, 15 bp, Homo sapiens
ggaggaggagccttg

SEQ ID NO: 4366667 - DNA, 14 bp, Homo sapiens
ggaggaggaggagc

SEQ ID NO: 4366668 - DNA, 15 bp, Homo sapiens
ggaggtcactccacc

SEQ ID NO: 4366669 - DNA, 22 bp, Homo sapiens
ggaggtgcgtgttcagcagaac

SEQ ID NO: 4366670 - DNA, 16 bp, Homo sapiens
ggagttgacagtgaaa

SEQ ID NO: 4366671 - DNA, 18 bp, Homo sapiens
ggatactctgtcagatgg

SEQ ID NO: 4366672 - DNA, 14 bp, Homo sapiens
ggatcagccccgcc

SEQ ID NO: 4366673 - DNA, 18 bp, Homo sapiens
ggatctgctgaggcccag

SEQ ID NO: 4366674 - DNA, 17 bp, Homo sapiens
ggatggaaacttcctgc

SEQ ID NO: 4366675 - DNA, 21 bp, Homo sapiens
ggatggaggggtggtcctgac

SEQ ID NO: 4366676 - DNA, 14 bp, Homo sapiens
ggatgtcacagtcc

SEQ ID NO: 4366677 - DNA, 15 bp, Homo sapiens
ggatgttatgaacag

SEQ ID NO: 4366678 - DNA, 20 bp, Homo sapiens
ggatgttatgaacagctgtg

SEQ ID NO: 4366679 - DNA, 14 bp, Homo sapiens
ggcacattgcccat

SEQ ID NO: 4366680 - DNA, 19 bp, Homo sapiens
ggcacattgcccatggctg

SEQ ID NO: 4366681 - DNA, 22 bp, Homo sapiens
ggcacctcggggacaccagagc

SEQ ID NO: 4366682 - DNA, 21 bp, Homo sapiens
ggcagaggaatgtagggcctg

SEQ ID NO: 4366683 - DNA, 16 bp, Homo sapiens
ggcagccacccaagcc

SEQ ID NO: 4366684 - DNA, 17 bp, Homo sapiens
ggcagccacccaagcct

SEQ ID NO: 4366685 - DNA, 13 bp, Homo sapiens
ggcagccctcacc

SEQ ID NO: 4366686 - DNA, 14 bp, Homo sapiens
ggcagccctcacct

SEQ ID NO: 4366687 - DNA, 17 bp, Homo sapiens
ggcagccctcacctctg

SEQ ID NO: 4366688 - DNA, 16 bp, Homo sapiens
ggcaggctggctggcc

SEQ ID NO: 4366689 - DNA, 17 bp, Homo sapiens
ggcataggcctgggtgc

SEQ ID NO: 4366690 - DNA, 22 bp, Homo sapiens
ggcattttattaaacttaaaac

SEQ ID NO: 4366691 - DNA, 16 bp, Homo sapiens
ggccaggatggagggg

SEQ ID NO: 4366692 - DNA, 20 bp, Homo sapiens
ggccaggcaggagcccttct

SEQ ID NO: 4366693 - DNA, 19 bp, Homo sapiens
ggccagggtgggaagagaa

SEQ ID NO: 4366694 - DNA, 23 bp, Homo sapiens
ggccagtccccgaggagctgggc

SEQ ID NO: 4366695 - DNA, 14 bp, Homo sapiens
ggccatgcagacct

SEQ ID NO: 4366696 - DNA, 11 bp, Homo sapiens
ggccatgcagg

SEQ ID NO: 4366697 - DNA, 13 bp, Homo sapiens
ggccatgcaggag

SEQ ID NO: 4366698 - DNA, 18 bp, Homo sapiens
ggccatgcaggaggtgga

SEQ ID NO: 4366699 - DNA, 20 bp, Homo sapiens
ggcccccaaattgccttcag

SEQ ID NO: 4366700 - DNA, 19 bp, Homo sapiens
ggccccctccccccagact

SEQ ID NO: 4366701 - DNA, 15 bp, Homo sapiens
ggcccggccacaccc

SEQ ID NO: 4366702 - DNA, 14 bp, Homo sapiens
ggccctgacttctg

SEQ ID NO: 4366703 - DNA, 15 bp, Homo sapiens
ggccctggagccagg

SEQ ID NO: 4366704 - DNA, 16 bp, Homo sapiens
ggccctggagccaggg

SEQ ID NO: 4366705 - DNA, 19 bp, Homo sapiens
ggccctggagccagggcag

SEQ ID NO: 4366706 - DNA, 23 bp, Homo sapiens
ggccctggagccagggcagagga

SEQ ID NO: 4366707 - DNA, 12 bp, Homo sapiens
ggcctccatgcc

SEQ ID NO: 4366708 - DNA, 21 bp, Homo sapiens
ggcctccatgccccagctctg

SEQ ID NO: 4366709 - DNA, 19 bp, Homo sapiens
ggcctcttgggtcccccac

SEQ ID NO: 4366710 - DNA, 17 bp, Homo sapiens
ggcgcaaaggtgcctca

SEQ ID NO: 4366711 - DNA, 18 bp, Homo sapiens
ggcgccgggcaccaactc

SEQ ID NO: 4366712 - DNA, 15 bp, Homo sapiens
ggcgcgggcagccac

SEQ ID NO: 4366713 - DNA, 16 bp, Homo sapiens
ggcgcgggcagccacc

SEQ ID NO: 4366714 - DNA, 14 bp, Homo sapiens
ggcgggctcagagc

SEQ ID NO: 4366715 - DNA, 16 bp, Homo sapiens
ggcgggctcagagctt

SEQ ID NO: 4366716 - DNA, 18 bp, Homo sapiens
ggcgggctcagagctttg

SEQ ID NO: 4366717 - DNA, 13 bp, Homo sapiens
ggcgtctgctctg

SEQ ID NO: 4366718 - DNA, 14 bp, Homo sapiens
ggctagaaaacaag

SEQ ID NO: 4366719 - DNA, 14 bp, Homo sapiens
ggctcagagctttg

SEQ ID NO: 4366720 - DNA, 11 bp, Homo sapiens
ggctgcctcag

SEQ ID NO: 4366721 - DNA, 22 bp, Homo sapiens
ggctgggaacatgacccagcct

SEQ ID NO: 4366722 - DNA, 14 bp, Homo sapiens
gggaaaccttggag

SEQ ID NO: 4366723 - DNA, 17 bp, Homo sapiens
gggaaaccttggagagg

SEQ ID NO: 4366724 - DNA, 22 bp, Homo sapiens
gggaagaccagaattcccttga

SEQ ID NO: 4366725 - DNA, 20 bp, Homo sapiens
gggaatgtattattctgcag

SEQ ID NO: 4366726 - DNA, 17 bp, Homo sapiens
gggacaccagagctgcc

SEQ ID NO: 4366727 - DNA, 22 bp, Homo sapiens
gggaccctgtccggcccagtgc

SEQ ID NO: 4366728 - DNA, 15 bp, Homo sapiens
gggagaaaatcaact

SEQ ID NO: 4366729 - DNA, 14 bp, Homo sapiens
gggagagccagctc

SEQ ID NO: 4366730 - DNA, 13 bp, Homo sapiens
gggagcagagaca

SEQ ID NO: 4366731 - DNA, 12 bp, Homo sapiens
gggagggatcag

SEQ ID NO: 4366732 - DNA, 16 bp, Homo sapiens
gggagggatcagcccc

SEQ ID NO: 4366733 - DNA, 12 bp, Homo sapiens
gggatggggagg

SEQ ID NO: 4366734 - DNA, 18 bp, Homo sapiens
gggattgaagggtcctgc

SEQ ID NO: 4366735 - DNA, 12 bp, Homo sapiens
gggcacattgcc

SEQ ID NO: 4366736 - DNA, 20 bp, Homo sapiens
gggcacattgcccatggctg

SEQ ID NO: 4366737 - DNA, 18 bp, Homo sapiens
gggcagccacccaagcct

SEQ ID NO: 4366738 - DNA, 22 bp, Homo sapiens
gggcagccacccaagcctgctg

SEQ ID NO: 4366739 - DNA, 14 bp, Homo sapiens
gggcaggcttgggg

SEQ ID NO: 4366740 - DNA, 11 bp, Homo sapiens
gggcagggtga

SEQ ID NO: 4366741 - DNA, 12 bp, Homo sapiens
gggccagggtgg

SEQ ID NO: 4366742 - DNA, 23 bp, Homo sapiens
gggcccggccacacccagcggcc

SEQ ID NO: 4366743 - DNA, 16 bp, Homo sapiens
gggcgggccagggtgg

SEQ ID NO: 4366744 - DNA, 12 bp, Homo sapiens
gggcgggctcag

SEQ ID NO: 4366745 - DNA, 13 bp, Homo sapiens
gggcgggctcaga

SEQ ID NO: 4366746 - DNA, 17 bp, Homo sapiens
gggcgggctcagagctt

SEQ ID NO: 4366747 - DNA, 22 bp, Homo sapiens
gggcgggctcagagctttgtca

SEQ ID NO: 4366748 - DNA, 15 bp, Homo sapiens
gggctcacttctaat

SEQ ID NO: 4366749 - DNA, 21 bp, Homo sapiens
gggctcagagctttgtcactt

SEQ ID NO: 4366750 - DNA, 14 bp, Homo sapiens
ggggacaccagagc

SEQ ID NO: 4366751 - DNA, 23 bp, Homo sapiens
ggggatcatgttaaaaatagcag

SEQ ID NO: 4366752 - DNA, 16 bp, Homo sapiens
ggggcgggccagggtg

SEQ ID NO: 4366753 - DNA, 23 bp, Homo sapiens
ggggtctcttctgaataaagcaa

SEQ ID NO: 4366754 - DNA, 13 bp, Homo sapiens
ggggtgaggacca

SEQ ID NO: 4366755 - DNA, 12 bp, Homo sapiens
gggtacaggcag

SEQ ID NO: 4366756 - DNA, 13 bp, Homo sapiens
gggtccaggcccg

SEQ ID NO: 4366757 - DNA, 18 bp, Homo sapiens
gggtctgtgactggatct

SEQ ID NO: 4366758 - DNA, 19 bp, Homo sapiens
gggtctgtgactggatctt

SEQ ID NO: 4366759 - DNA, 14 bp, Homo sapiens
gggtgaagggagag

SEQ ID NO: 4366760 - DNA, 18 bp, Homo sapiens
gggtgaggaccactcctg

SEQ ID NO: 4366761 - DNA, 15 bp, Homo sapiens
gggtgggaagagaag

SEQ ID NO: 4366762 - DNA, 22 bp, Homo sapiens
gggttctgccctgcctgaggag

SEQ ID NO: 4366763 - DNA, 16 bp, Homo sapiens
ggtaaaaatgctgctc

SEQ ID NO: 4366764 - DNA, 17 bp, Homo sapiens
ggtaaaaatgctgctct

SEQ ID NO: 4366765 - DNA, 23 bp, Homo sapiens
ggtaagtgttctcatgaagcagg

SEQ ID NO: 4366766 - DNA, 17 bp, Homo sapiens
ggtaccaaacaaggaag

SEQ ID NO: 4366767 - DNA, 15 bp, Homo sapiens
ggtagagacccccag

SEQ ID NO: 4366768 - DNA, 18 bp, Homo sapiens
ggtagagacccccaggcc

SEQ ID NO: 4366769 - DNA, 14 bp, Homo sapiens
ggtaggggagggca

SEQ ID NO: 4366770 - DNA, 17 bp, Homo sapiens
ggtaggggagggcaggc

SEQ ID NO: 4366771 - DNA, 15 bp, Homo sapiens
ggtccaggcccgtgg

SEQ ID NO: 4366772 - DNA, 14 bp, Homo sapiens
ggtcgtgggccagt

SEQ ID NO: 4366773 - DNA, 23 bp, Homo sapiens
ggtctcgcagcctgaagcctgga

SEQ ID NO: 4366774 - DNA, 20 bp, Homo sapiens
ggtctcttctgaataaagca

SEQ ID NO: 4366775 - DNA, 21 bp, Homo sapiens
ggtctcttctgaataaagcaa

SEQ ID NO: 4366776 - DNA, 16 bp, Homo sapiens
ggtctgtgactggatc

SEQ ID NO: 4366777 - DNA, 15 bp, Homo sapiens
ggtgcacccacctgt

SEQ ID NO: 4366778 - DNA, 16 bp, Homo sapiens
ggtgcacccacctgtt

SEQ ID NO: 4366779 - DNA, 20 bp, Homo sapiens
ggtgcgtgttcagcagaacc

SEQ ID NO: 4366780 - DNA, 20 bp, Homo sapiens
ggtgctgaatgaagctgcca

SEQ ID NO: 4366781 - DNA, 18 bp, Homo sapiens
ggtgcttggtgagtcttg

SEQ ID NO: 4366782 - DNA, 21 bp, Homo sapiens
ggtgcttggtgagtcttggtt

SEQ ID NO: 4366783 - DNA, 21 bp, Homo sapiens
ggtggagaaaattggaactct

SEQ ID NO: 4366784 - DNA, 18 bp, Homo sapiens
ggtggatgttatgaacag

SEQ ID NO: 4366785 - DNA, 21 bp, Homo sapiens
ggtggatgttatgaacagctg

SEQ ID NO: 4366786 - DNA, 23 bp, Homo sapiens
ggtggcttaagtgagcagaacag

SEQ ID NO: 4366787 - DNA, 12 bp, Homo sapiens
ggtgtctcccaa

SEQ ID NO: 4366788 - DNA, 16 bp, Homo sapiens
ggttctaaaggtacca

SEQ ID NO: 4366789 - DNA, 19 bp, Homo sapiens
ggtttggggagcagagaca

SEQ ID NO: 4366790 - DNA, 15 bp, Homo sapiens
gtaaaaaatattaaa

SEQ ID NO: 4366791 - DNA, 17 bp, Homo sapiens
gtaaaagataacaagat

SEQ ID NO: 4366792 - DNA, 13 bp, Homo sapiens
gtaaaatgaacat

SEQ ID NO: 4366793 - DNA, 15 bp, Homo sapiens
gtaaatcctttttct

SEQ ID NO: 4366794 - DNA, 16 bp, Homo sapiens
gtaaatcctttttctt

SEQ ID NO: 4366795 - DNA, 22 bp, Homo sapiens
gtaaatcctttttctttataaa

SEQ ID NO: 4366796 - DNA, 13 bp, Homo sapiens
gtaagaagagact

SEQ ID NO: 4366797 - DNA, 15 bp, Homo sapiens
gtaagaagagactgg

SEQ ID NO: 4366798 - DNA, 16 bp, Homo sapiens
gtaagagctggtgtct

SEQ ID NO: 4366799 - DNA, 16 bp, Homo sapiens
gtaagagcttgctcca

SEQ ID NO: 4366800 - DNA, 18 bp, Homo sapiens
gtaagagcttgctccaga

SEQ ID NO: 4366801 - DNA, 13 bp, Homo sapiens
gtaaggcactgtc

SEQ ID NO: 4366802 - DNA, 20 bp, Homo sapiens
gtaagtgtgagtaagagctg

SEQ ID NO: 4366803 - DNA, 16 bp, Homo sapiens
gtaagtgttctcatga

SEQ ID NO: 4366804 - DNA, 22 bp, Homo sapiens
gtaagtgttctcatgaagcagg

SEQ ID NO: 4366805 - DNA, 19 bp, Homo sapiens
gtaatataaatttaagcaa

SEQ ID NO: 4366806 - DNA, 23 bp, Homo sapiens
gtacaataagttacttgaaataa

SEQ ID NO: 4366807 - DNA, 23 bp, Homo sapiens
gtacaatggtttattcccaagta

SEQ ID NO: 4366808 - DNA, 20 bp, Homo sapiens
gtacagaaaacatgtttaaa

SEQ ID NO: 4366809 - DNA, 18 bp, Homo sapiens
gtacagaacagtaaagtt

SEQ ID NO: 4366810 - DNA, 20 bp, Homo sapiens
gtacaggcagttaggtgctg

SEQ ID NO: 4366811 - DNA, 16 bp, Homo sapiens
gtacagtgtgtaaagt

SEQ ID NO: 4366812 - DNA, 16 bp, Homo sapiens
gtaccaaacaaggaag

SEQ ID NO: 4366813 - DNA, 21 bp, Homo sapiens
gtaccaaacaaggaagccaaa

SEQ ID NO: 4366814 - DNA, 12 bp, Homo sapiens
gtactaccccag

SEQ ID NO: 4366815 - DNA, 15 bp, Homo sapiens
gtacttaataaattc

SEQ ID NO: 4366816 - DNA, 12 bp, Homo sapiens
gtagaaagcaaa

SEQ ID NO: 4366817 - DNA, 16 bp, Homo sapiens
gtagagacccccaggc

SEQ ID NO: 4366818 - DNA, 23 bp, Homo sapiens
gtagagtcatctccatcagctgt

SEQ ID NO: 4366819 - DNA, 21 bp, Homo sapiens
gtagctttaaaaccacagctg

SEQ ID NO: 4366820 - DNA, 22 bp, Homo sapiens
gtagctttaaaaccacagctgg

SEQ ID NO: 4366821 - DNA, 16 bp, Homo sapiens
gtagggaaaccttgga

SEQ ID NO: 4366822 - DNA, 17 bp, Homo sapiens
gtagggaaaccttggag

SEQ ID NO: 4366823 - DNA, 21 bp, Homo sapiens
gtagggcctgcatggagaagg

SEQ ID NO: 4366824 - DNA, 22 bp, Homo sapiens
gtaggggagggcaggcttgggg

SEQ ID NO: 4366825 - DNA, 20 bp, Homo sapiens
gtagtttttatatgttgtaa

SEQ ID NO: 4366826 - DNA, 21 bp, Homo sapiens
gtataattattttaataatgt

SEQ ID NO: 4366827 - DNA, 21 bp, Homo sapiens
gtatagtgtctattatcacat

SEQ ID NO: 4366828 - DNA, 22 bp, Homo sapiens
gtatatttatagtcacaagagc

SEQ ID NO: 4366829 - DNA, 16 bp, Homo sapiens
gtatgccttaagcaga

SEQ ID NO: 4366830 - DNA, 16 bp, Homo sapiens
gtatgctttccctgag

SEQ ID NO: 4366831 - DNA, 22 bp, Homo sapiens
gtatgctttccctgaggaatga

SEQ ID NO: 4366832 - DNA, 16 bp, Homo sapiens
gtatgtgtcatttata

SEQ ID NO: 4366833 - DNA, 13 bp, Homo sapiens
gtatgttcttgtt

SEQ ID NO: 4366834 - DNA, 21 bp, Homo sapiens
gtatgtttgcacacttgtgtg

SEQ ID NO: 4366835 - DNA, 12 bp, Homo sapiens
gtcaaagaagac

SEQ ID NO: 4366836 - DNA, 14 bp, Homo sapiens
gtcaagttcccaac

SEQ ID NO: 4366837 - DNA, 16 bp, Homo sapiens
gtcaagttcccaactg

SEQ ID NO: 4366838 - DNA, 11 bp, Homo sapiens
gtcacaataaa

SEQ ID NO: 4366839 - DNA, 15 bp, Homo sapiens
gtcactccaccatcc

SEQ ID NO: 4366840 - DNA, 12 bp, Homo sapiens
gtcactcctggg

SEQ ID NO: 4366841 - DNA, 11 bp, Homo sapiens
gtcacttgcca

SEQ ID NO: 4366842 - DNA, 21 bp, Homo sapiens
gtcacttgccacatggtgtct

SEQ ID NO: 4366843 - DNA, 21 bp, Homo sapiens
gtcagtgtacacgtctggacc

SEQ ID NO: 4366844 - DNA, 14 bp, Homo sapiens
gtcatctgtaagag

SEQ ID NO: 4366845 - DNA, 19 bp, Homo sapiens
gtcatctgtaagagcttgc

SEQ ID NO: 4366846 - DNA, 21 bp, Homo sapiens
gtcatctgtaagagcttgctc

SEQ ID NO: 4366847 - DNA, 15 bp, Homo sapiens
gtccaaccagaaaca

SEQ ID NO: 4366848 - DNA, 22 bp, Homo sapiens
gtccacatgtggggacagggct

SEQ ID NO: 4366849 - DNA, 17 bp, Homo sapiens
gtccatccccttccccc

SEQ ID NO: 4366850 - DNA, 19 bp, Homo sapiens
gtccatccccttcccccat

SEQ ID NO: 4366851 - DNA, 12 bp, Homo sapiens
gtcccacccacc

SEQ ID NO: 4366852 - DNA, 20 bp, Homo sapiens
gtcccccctgagtgggctgg

SEQ ID NO: 4366853 - DNA, 19 bp, Homo sapiens
gtccccgaggagctgggcc

SEQ ID NO: 4366854 - DNA, 20 bp, Homo sapiens
gtccccgaggagctgggccc

SEQ ID NO: 4366855 - DNA, 20 bp, Homo sapiens
gtcccctgcgggcgcgggca

SEQ ID NO: 4366856 - DNA, 14 bp, Homo sapiens
gtcccgcactctgc

SEQ ID NO: 4366857 - DNA, 15 bp, Homo sapiens
gtccctttcttggcc

SEQ ID NO: 4366858 - DNA, 13 bp, Homo sapiens
gtcctgactcaac

SEQ ID NO: 4366859 - DNA, 13 bp, Homo sapiens
gtcctgccggtgg

SEQ ID NO: 4366860 - DNA, 20 bp, Homo sapiens
gtccttgcctgaactccaga

SEQ ID NO: 4366861 - DNA, 19 bp, Homo sapiens
gtcctttttcactttgaaa

SEQ ID NO: 4366862 - DNA, 21 bp, Homo sapiens
gtcctttttcactttgaaaag

SEQ ID NO: 4366863 - DNA, 19 bp, Homo sapiens
gtcgtgggccagtccccga

SEQ ID NO: 4366864 - DNA, 16 bp, Homo sapiens
gtctaaatatttcctt

SEQ ID NO: 4366865 - DNA, 14 bp, Homo sapiens
gtctattatcacat

SEQ ID NO: 4366866 - DNA, 18 bp, Homo sapiens
gtctattttgtatatttg

SEQ ID NO: 4366867 - DNA, 23 bp, Homo sapiens
gtctcaggcagcaccacactggg

SEQ ID NO: 4366868 - DNA, 19 bp, Homo sapiens
gtctcatgatgtaaaaaat

SEQ ID NO: 4366869 - DNA, 11 bp, Homo sapiens
gtctcccaaca

SEQ ID NO: 4366870 - DNA, 16 bp, Homo sapiens
gtctccctcccctctc

SEQ ID NO: 4366871 - DNA, 23 bp, Homo sapiens
gtctcgatgccataatcagaaca

SEQ ID NO: 4366872 - DNA, 22 bp, Homo sapiens
gtctcgcagcctgaagcctgga

SEQ ID NO: 4366873 - DNA, 21 bp, Homo sapiens
gtctcttctgaataaagcaat

SEQ ID NO: 4366874 - DNA, 22 bp, Homo sapiens
gtctcttctgaataaagcaatt

SEQ ID NO: 4366875 - DNA, 13 bp, Homo sapiens
gtctcttgaggga

SEQ ID NO: 4366876 - DNA, 18 bp, Homo sapiens
gtctgactacaacatgca

SEQ ID NO: 4366877 - DNA, 13 bp, Homo sapiens
gtctgccaaacac

SEQ ID NO: 4366878 - DNA, 16 bp, Homo sapiens
gtctgctctggtggct

SEQ ID NO: 4366879 - DNA, 16 bp, Homo sapiens
gtctgctgctgcctcc

SEQ ID NO: 4366880 - DNA, 12 bp, Homo sapiens
gtctggaccccg

SEQ ID NO: 4366881 - DNA, 17 bp, Homo sapiens
gtctggactagaaaatc

SEQ ID NO: 4366882 - DNA, 11 bp, Homo sapiens
gtctgtgactg

SEQ ID NO: 4366883 - DNA, 12 bp, Homo sapiens
gtctgtgactgg

SEQ ID NO: 4366884 - DNA, 13 bp, Homo sapiens
gtctgtgactgga

SEQ ID NO: 4366885 - DNA, 15 bp, Homo sapiens
gtctgtgactggatc

SEQ ID NO: 4366886 - DNA, 16 bp, Homo sapiens
gtcttggttctaaagg

SEQ ID NO: 4366887 - DNA, 16 bp, Homo sapiens
gtctttttctggactg

SEQ ID NO: 4366888 - DNA, 14 bp, Homo sapiens
gtgaacattcccag

SEQ ID NO: 4366889 - DNA, 13 bp, Homo sapiens
gtgacagctttct

SEQ ID NO: 4366890 - DNA, 17 bp, Homo sapiens
gtgacagtgcctgggaa

SEQ ID NO: 4366891 - DNA, 21 bp, Homo sapiens
gtgactggaagttgtggatat

SEQ ID NO: 4366892 - DNA, 14 bp, Homo sapiens
gtgactggatcttc

SEQ ID NO: 4366893 - DNA, 20 bp, Homo sapiens
gtgagctggatagacttggg

SEQ ID NO: 4366894 - DNA, 15 bp, Homo sapiens
gtgagtaagagctgg

SEQ ID NO: 4366895 - DNA, 16 bp, Homo sapiens
gtgagtaagagctggt

SEQ ID NO: 4366896 - DNA, 19 bp, Homo sapiens
gtgatgccacacagagtgg

SEQ ID NO: 4366897 - DNA, 17 bp, Homo sapiens
gtgattaccggcatttt

SEQ ID NO: 4366898 - DNA, 23 bp, Homo sapiens
gtgattaccggcattttattaaa

SEQ ID NO: 4366899 - DNA, 14 bp, Homo sapiens
gtgcacccacctgt

SEQ ID NO: 4366900 - DNA, 22 bp, Homo sapiens
gtgcacccacctgttttctgaa

SEQ ID NO: 4366901 - DNA, 13 bp, Homo sapiens
gtgcatgggtgaa

SEQ ID NO: 4366902 - DNA, 17 bp, Homo sapiens
gtgccactgccccccga

SEQ ID NO: 4366903 - DNA, 15 bp, Homo sapiens
gtgcctcttccagtg

SEQ ID NO: 4366904 - DNA, 12 bp, Homo sapiens
gtgcgcccgtgg

SEQ ID NO: 4366905 - DNA, 13 bp, Homo sapiens
gtgcgtctccagt

SEQ ID NO: 4366906 - DNA, 19 bp, Homo sapiens
gtgcgtgttcagcagaacc

SEQ ID NO: 4366907 - DNA, 11 bp, Homo sapiens
gtgcttggatt

SEQ ID NO: 4366908 - DNA, 20 bp, Homo sapiens
gtggaaattaagactttatg

SEQ ID NO: 4366909 - DNA, 12 bp, Homo sapiens
gtggagttcacc

SEQ ID NO: 4366910 - DNA, 15 bp, Homo sapiens
gtggatatcagggta

SEQ ID NO: 4366911 - DNA, 19 bp, Homo sapiens
gtggcttaagtgagcagaa

SEQ ID NO: 4366912 - DNA, 19 bp, Homo sapiens
gtgggaccctgtccggccc

SEQ ID NO: 4366913 - DNA, 19 bp, Homo sapiens
gtgggagcagcggtttggg

SEQ ID NO: 4366914 - DNA, 14 bp, Homo sapiens
gtgggcgcaaaggt

SEQ ID NO: 4366915 - DNA, 20 bp, Homo sapiens
gtgggctgggccctctgtcc

SEQ ID NO: 4366916 - DNA, 23 bp, Homo sapiens
gtggggtcccccctgagtgggct

SEQ ID NO: 4366917 - DNA, 18 bp, Homo sapiens
gtgggtcccgcactctgc

SEQ ID NO: 4366918 - DNA, 19 bp, Homo sapiens
gtgggtggggtacaggcag

SEQ ID NO: 4366919 - DNA, 12 bp, Homo sapiens
gtggtcctgact

SEQ ID NO: 4366920 - DNA, 15 bp, Homo sapiens
gtgtaacagctgagg

SEQ ID NO: 4366921 - DNA, 21 bp, Homo sapiens
gtgtaacagctgaggtctctt

SEQ ID NO: 4366922 - DNA, 22 bp, Homo sapiens
gtgtaagtgtgagtaagagctg

SEQ ID NO: 4366923 - DNA, 19 bp, Homo sapiens
gtgtacacgtctggacccc

SEQ ID NO: 4366924 - DNA, 18 bp, Homo sapiens
gtgtatgtttgcacactt

SEQ ID NO: 4366925 - DNA, 15 bp, Homo sapiens
gtgtattgatgcaat

SEQ ID NO: 4366926 - DNA, 15 bp, Homo sapiens
gtgtggactgtgatg

SEQ ID NO: 4366927 - DNA, 16 bp, Homo sapiens
gtgtggactgtgatgc

SEQ ID NO: 4366928 - DNA, 16 bp, Homo sapiens
gtgttctcatgaagca

SEQ ID NO: 4366929 - DNA, 14 bp, Homo sapiens
gtgtttttctatat

SEQ ID NO: 4366930 - DNA, 22 bp, Homo sapiens
gttaagtctaaatatttcctta

SEQ ID NO: 4366931 - DNA, 14 bp, Homo sapiens
gttacttgaaataa

SEQ ID NO: 4366932 - DNA, 15 bp, Homo sapiens
gttagaaaggcagcc

SEQ ID NO: 4366933 - DNA, 19 bp, Homo sapiens
gttaggaataacactgcag

SEQ ID NO: 4366934 - DNA, 22 bp, Homo sapiens
gttaggtgctgaatgaagctgc

SEQ ID NO: 4366935 - DNA, 14 bp, Homo sapiens
gttagtttttactt

SEQ ID NO: 4366936 - DNA, 17 bp, Homo sapiens
gttataggtcactcctg

SEQ ID NO: 4366937 - DNA, 18 bp, Homo sapiens
gttatgaacagctgtgtc

SEQ ID NO: 4366938 - DNA, 23 bp, Homo sapiens
gttatgaacagctgtgtctgcca

SEQ ID NO: 4366939 - DNA, 19 bp, Homo sapiens
gttatttactcctcctgct

SEQ ID NO: 4366940 - DNA, 12 bp, Homo sapiens
gttcccaactga

SEQ ID NO: 4366941 - DNA, 12 bp, Homo sapiens
gttctgccctgc

SEQ ID NO: 4366942 - DNA, 16 bp, Homo sapiens
gttctgccctgcctga

SEQ ID NO: 4366943 - DNA, 19 bp, Homo sapiens
gttctgccctgcctgagga

SEQ ID NO: 4366944 - DNA, 13 bp, Homo sapiens
gttggagagcagc

SEQ ID NO: 4366945 - DNA, 16 bp, Homo sapiens
gttgtcaaggaagaag

SEQ ID NO: 4366946 - DNA, 20 bp, Homo sapiens
gttgtcaaggaagaagaaat

SEQ ID NO: 4366947 - DNA, 13 bp, Homo sapiens
gttgtgagctgga

SEQ ID NO: 4366948 - DNA, 18 bp, Homo sapiens
gtttaagttgattaaaaa

SEQ ID NO: 4366949 - DNA, 20 bp, Homo sapiens
gtttacattgtcctgtagct

SEQ ID NO: 4366950 - DNA, 20 bp, Homo sapiens
gtttattcccaagtatgcct

SEQ ID NO: 4366951 - DNA, 22 bp, Homo sapiens
gtttcagatgtgcaataatttg

SEQ ID NO: 4366952 - DNA, 20 bp, Homo sapiens
gtttcgcattaagcacacac

SEQ ID NO: 4366953 - DNA, 17 bp, Homo sapiens
gtttggccctggagcca

SEQ ID NO: 4366954 - DNA, 18 bp, Homo sapiens
gtttggccctggagccag

SEQ ID NO: 4366955 - DNA, 20 bp, Homo sapiens
gtttgtcctttttcactttg

SEQ ID NO: 4366956 - DNA, 16 bp, Homo sapiens
gttttctgaaacacac

SEQ ID NO: 4366957 - DNA, 17 bp, Homo sapiens
gtttttactttctgttg

SEQ ID NO: 4366958 - DNA, 20 bp, Homo sapiens
gtttttctatatagttcctt

SEQ ID NO: 4366959 - DNA, 14 bp, Homo sapiens
taaaaatgctgctc

SEQ ID NO: 4366960 - DNA, 13 bp, Homo sapiens
taaaaatgctttt

SEQ ID NO: 4366961 - DNA, 23 bp, Homo sapiens
taaaagataacaagatctttcag

SEQ ID NO: 4366962 - DNA, 21 bp, Homo sapiens
taaaagttttttattatgcat

SEQ ID NO: 4366963 - DNA, 13 bp, Homo sapiens
taaaataaaatta

SEQ ID NO: 4366964 - DNA, 17 bp, Homo sapiens
taaaatactatattaaa

SEQ ID NO: 4366965 - DNA, 16 bp, Homo sapiens
taaaattagttttaaa

SEQ ID NO: 4366966 - DNA, 21 bp, Homo sapiens
taaaattagttttaaaatact

SEQ ID NO: 4366967 - DNA, 22 bp, Homo sapiens
taaaattagttttaaaatacta

SEQ ID NO: 4366968 - DNA, 15 bp, Homo sapiens
taaaatttgaaactg

SEQ ID NO: 4366969 - DNA, 22 bp, Homo sapiens
taaactgtgtggactgtgatgc

SEQ ID NO: 4366970 - DNA, 18 bp, Homo sapiens
taaacttaaaactttgta

SEQ ID NO: 4366971 - DNA, 18 bp, Homo sapiens
taaactttagagtagcat

SEQ ID NO: 4366972 - DNA, 20 bp, Homo sapiens
taaagtaacccataatctgc

SEQ ID NO: 4366973 - DNA, 22 bp, Homo sapiens
taaagtgtaaatcctttttctt

SEQ ID NO: 4366974 - DNA, 13 bp, Homo sapiens
taaataaaagtac

SEQ ID NO: 4366975 - DNA, 17 bp, Homo sapiens
taaataaaagtgatcaa

SEQ ID NO: 4366976 - DNA, 21 bp, Homo sapiens
taaataatactttaggaaata

SEQ ID NO: 4366977 - DNA, 17 bp, Homo sapiens
taaatatgtaatataaa

SEQ ID NO: 4366978 - DNA, 18 bp, Homo sapiens
taaatcgggaaatttaca

SEQ ID NO: 4366979 - DNA, 18 bp, Homo sapiens
taaattcagatatatttt

SEQ ID NO: 4366980 - DNA, 20 bp, Homo sapiens
taacaatcaggtaagatcat

SEQ ID NO: 4366981 - DNA, 12 bp, Homo sapiens
taacagctgagg

SEQ ID NO: 4366982 - DNA, 15 bp, Homo sapiens
taacagctgaggtct

SEQ ID NO: 4366983 - DNA, 23 bp, Homo sapiens
taacgacttcagggcagggctct

SEQ ID NO: 4366984 - DNA, 20 bp, Homo sapiens
taactaaactaacaagatta

SEQ ID NO: 4366985 - DNA, 17 bp, Homo sapiens
taagagcttgctccaga

SEQ ID NO: 4366986 - DNA, 13 bp, Homo sapiens
taagatctgactg

SEQ ID NO: 4366987 - DNA, 16 bp, Homo sapiens
taagatctgactgcca

SEQ ID NO: 4366988 - DNA, 16 bp, Homo sapiens
taagcagaacaaatgt

SEQ ID NO: 4366989 - DNA, 15 bp, Homo sapiens
taagttaatgaaata

SEQ ID NO: 4366990 - DNA, 17 bp, Homo sapiens
taagttaatgaaataaa

SEQ ID NO: 4366991 - DNA, 16 bp, Homo sapiens
taagttacttgaaata

SEQ ID NO: 4366992 - DNA, 17 bp, Homo sapiens
taagttacttgaaataa

SEQ ID NO: 4366993 - DNA, 15 bp, Homo sapiens
taataaagttgcttt

SEQ ID NO: 4366994 - DNA, 22 bp, Homo sapiens
taataatgttgccttggaaaca

SEQ ID NO: 4366995 - DNA, 19 bp, Homo sapiens
taatataaatttaagcaaa

SEQ ID NO: 4366996 - DNA, 12 bp, Homo sapiens
taatcagaacac

SEQ ID NO: 4366997 - DNA, 22 bp, Homo sapiens
taatgagatgttattactgttt

SEQ ID NO: 4366998 - DNA, 21 bp, Homo sapiens
taatgtacaattttatataat

SEQ ID NO: 4366999 - DNA, 23 bp, Homo sapiens
taatgtacgctgctgcaggacat

SEQ ID NO: 4367000 - DNA, 12 bp, Homo sapiens
taatttgtacaa

SEQ ID NO: 4367001 - DNA, 13 bp, Homo sapiens
taatttgtacaat

SEQ ID NO: 4367002 - DNA, 22 bp, Homo sapiens
tacaaagtaaaatgaacatttt

SEQ ID NO: 4367003 - DNA, 18 bp, Homo sapiens
tacaatcatggtcaagtt

SEQ ID NO: 4367004 - DNA, 16 bp, Homo sapiens
tacacgtctggacccc

SEQ ID NO: 4367005 - DNA, 15 bp, Homo sapiens
tacatatggaaatgt

SEQ ID NO: 4367006 - DNA, 16 bp, Homo sapiens
tacatatggaaatgtt

SEQ ID NO: 4367007 - DNA, 18 bp, Homo sapiens
tacatatggaaatgttac

SEQ ID NO: 4367008 - DNA, 16 bp, Homo sapiens
tacatttaggataatc

SEQ ID NO: 4367009 - DNA, 15 bp, Homo sapiens
taccaaacaaggaag

SEQ ID NO: 4367010 - DNA, 16 bp, Homo sapiens
taccaaacaaggaagc

SEQ ID NO: 4367011 - DNA, 18 bp, Homo sapiens
taccaaacaaggaagcca

SEQ ID NO: 4367012 - DNA, 20 bp, Homo sapiens
taccaaacagcttaaattct

SEQ ID NO: 4367013 - DNA, 14 bp, Homo sapiens
taccctaaccaagt

SEQ ID NO: 4367014 - DNA, 21 bp, Homo sapiens
taccctcaggcataggcctgg

SEQ ID NO: 4367015 - DNA, 23 bp, Homo sapiens
taccctcaggcataggcctgggt

SEQ ID NO: 4367016 - DNA, 12 bp, Homo sapiens
taccttctaaaa

SEQ ID NO: 4367017 - DNA, 17 bp, Homo sapiens
tacgctgctgcaggaca

SEQ ID NO: 4367018 - DNA, 13 bp, Homo sapiens
tactaaataatac

SEQ ID NO: 4367019 - DNA, 19 bp, Homo sapiens
tactgcccacatttgggct

SEQ ID NO: 4367020 - DNA, 15 bp, Homo sapiens
tactgctctcctcca

SEQ ID NO: 4367021 - DNA, 18 bp, Homo sapiens
tactgtaagagacatgaa

SEQ ID NO: 4367022 - DNA, 20 bp, Homo sapiens
tactgtctgactacaacatg

SEQ ID NO: 4367023 - DNA, 13 bp, Homo sapiens
tacttaataaatt

SEQ ID NO: 4367024 - DNA, 19 bp, Homo sapiens
tacttaataaattcagata

SEQ ID NO: 4367025 - DNA, 23 bp, Homo sapiens
tacttcccattttggaagttttc

SEQ ID NO: 4367026 - DNA, 20 bp, Homo sapiens
tacttgacctctgtgaccaa

SEQ ID NO: 4367027 - DNA, 15 bp, Homo sapiens
tactttgacaaggaa

SEQ ID NO: 4367028 - DNA, 15 bp, Homo sapiens
tacttttcacactgt

SEQ ID NO: 4367029 - DNA, 12 bp, Homo sapiens
tagaaaggcagc

SEQ ID NO: 4367030 - DNA, 11 bp, Homo sapiens
tagaagaagag

SEQ ID NO: 4367031 - DNA, 16 bp, Homo sapiens
tagaagaagaggaaga

SEQ ID NO: 4367032 - DNA, 17 bp, Homo sapiens
tagaagaagaggaagaa

SEQ ID NO: 4367033 - DNA, 19 bp, Homo sapiens
tagaagaagaggaagaaat

SEQ ID NO: 4367034 - DNA, 18 bp, Homo sapiens
tagacagaaaccaagcca

SEQ ID NO: 4367035 - DNA, 19 bp, Homo sapiens
tagacagaaaccaagccat

SEQ ID NO: 4367036 - DNA, 22 bp, Homo sapiens
tagagtcatctccatcagctgt

SEQ ID NO: 4367037 - DNA, 15 bp, Homo sapiens
tagatgtaaataaaa

SEQ ID NO: 4367038 - DNA, 21 bp, Homo sapiens
tagatgtaaataaaattgagt

SEQ ID NO: 4367039 - DNA, 22 bp, Homo sapiens
tagatgtccctttcttggccag

SEQ ID NO: 4367040 - DNA, 11 bp, Homo sapiens
tagcagagcct

SEQ ID NO: 4367041 - DNA, 12 bp, Homo sapiens
tagcagagccta

SEQ ID NO: 4367042 - DNA, 19 bp, Homo sapiens
tagcatttttatgcagaca

SEQ ID NO: 4367043 - DNA, 20 bp, Homo sapiens
tagcatttttatgcagacag

SEQ ID NO: 4367044 - DNA, 22 bp, Homo sapiens
tagcatttttatgcagacagtc

SEQ ID NO: 4367045 - DNA, 14 bp, Homo sapiens
tagccaatgtggga

SEQ ID NO: 4367046 - DNA, 20 bp, Homo sapiens
tagcccagtccctggagctg

SEQ ID NO: 4367047 - DNA, 22 bp, Homo sapiens
tagctcaccttgagataacaat

SEQ ID NO: 4367048 - DNA, 21 bp, Homo sapiens
tagctttaaaaccacagctgg

SEQ ID NO: 4367049 - DNA, 15 bp, Homo sapiens
tagctttaccctcag

SEQ ID NO: 4367050 - DNA, 15 bp, Homo sapiens
taggaataacactgc

SEQ ID NO: 4367051 - DNA, 23 bp, Homo sapiens
taggcccccaaattgccttcagc

SEQ ID NO: 4367052 - DNA, 19 bp, Homo sapiens
taggcctgggtgctggctg

SEQ ID NO: 4367053 - DNA, 21 bp, Homo sapiens
taggctctgcacagatggatt

SEQ ID NO: 4367054 - DNA, 19 bp, Homo sapiens
tagggaaaccttggagagg

SEQ ID NO: 4367055 - DNA, 15 bp, Homo sapiens
taggggagggcaggc

SEQ ID NO: 4367056 - DNA, 22 bp, Homo sapiens
taggtgttaggcatgtcccacc

SEQ ID NO: 4367057 - DNA, 20 bp, Homo sapiens
tagtgataaatcgggaaatt

SEQ ID NO: 4367058 - DNA, 17 bp, Homo sapiens
tagttacatttaggata

SEQ ID NO: 4367059 - DNA, 14 bp, Homo sapiens
tagttcatccaatc

SEQ ID NO: 4367060 - DNA, 14 bp, Homo sapiens
tagttccttgcctt

SEQ ID NO: 4367061 - DNA, 19 bp, Homo sapiens
tagttccttgccttaataa

SEQ ID NO: 4367062 - DNA, 13 bp, Homo sapiens
tagttctgctgcc

SEQ ID NO: 4367063 - DNA, 17 bp, Homo sapiens
tataaactttacatatt

SEQ ID NO: 4367064 - DNA, 22 bp, Homo sapiens
tataaactttagagtagcatga

SEQ ID NO: 4367065 - DNA, 17 bp, Homo sapiens
tataaatttaagcaaac

SEQ ID NO: 4367066 - DNA, 18 bp, Homo sapiens
tataattctgaaatgttt

SEQ ID NO: 4367067 - DNA, 22 bp, Homo sapiens
tatacccacccagaatgagaca

SEQ ID NO: 4367068 - DNA, 16 bp, Homo sapiens
tatataattctgaaat

SEQ ID NO: 4367069 - DNA, 13 bp, Homo sapiens
tatatgtgtgtgt

SEQ ID NO: 4367070 - DNA, 19 bp, Homo sapiens
tatatgtgtgtgtatgttt

SEQ ID NO: 4367071 - DNA, 15 bp, Homo sapiens
tatatttgtcttccg

SEQ ID NO: 4367072 - DNA, 15 bp, Homo sapiens
tatcaaatctaccac

SEQ ID NO: 4367073 - DNA, 22 bp, Homo sapiens
tatcacattaatctcaaagaga

SEQ ID NO: 4367074 - DNA, 18 bp, Homo sapiens
tatcactctaatataata

SEQ ID NO: 4367075 - DNA, 19 bp, Homo sapiens
tatcagggtataaattata

SEQ ID NO: 4367076 - DNA, 12 bp, Homo sapiens
tatcatcggagt

SEQ ID NO: 4367077 - DNA, 18 bp, Homo sapiens
tatcattccaattctaaa

SEQ ID NO: 4367078 - DNA, 14 bp, Homo sapiens
tatcccttcctttt

SEQ ID NO: 4367079 - DNA, 15 bp, Homo sapiens
tatgaacagctgtgt

SEQ ID NO: 4367080 - DNA, 17 bp, Homo sapiens
tatgaacagctgtgtct

SEQ ID NO: 4367081 - DNA, 16 bp, Homo sapiens
tatgacatgaaatgaa

SEQ ID NO: 4367082 - DNA, 23 bp, Homo sapiens
tatgacccacactgccagaagag

SEQ ID NO: 4367083 - DNA, 15 bp, Homo sapiens
tatgacctaagtcag

SEQ ID NO: 4367084 - DNA, 22 bp, Homo sapiens
tatgacctaagtcaggtaatat

SEQ ID NO: 4367085 - DNA, 15 bp, Homo sapiens
tatgcactgtggttt

SEQ ID NO: 4367086 - DNA, 16 bp, Homo sapiens
tatgcactgtggtttc

SEQ ID NO: 4367087 - DNA, 17 bp, Homo sapiens
tatgcagacagtctgtt

SEQ ID NO: 4367088 - DNA, 23 bp, Homo sapiens
tatgcagacagtctgttatgcac

SEQ ID NO: 4367089 - DNA, 16 bp, Homo sapiens
tatgccttaagcagaa

SEQ ID NO: 4367090 - DNA, 18 bp, Homo sapiens
tatgctttccctgaggaa

SEQ ID NO: 4367091 - DNA, 14 bp, Homo sapiens
tatggaaatgttac

SEQ ID NO: 4367092 - DNA, 21 bp, Homo sapiens
tatggaaatgttactgtctga

SEQ ID NO: 4367093 - DNA, 13 bp, Homo sapiens
tatgtaatataaa

SEQ ID NO: 4367094 - DNA, 14 bp, Homo sapiens
tatgtaatataaat

SEQ ID NO: 4367095 - DNA, 22 bp, Homo sapiens
tatgttgtaatatttcttcaaa

SEQ ID NO: 4367096 - DNA, 22 bp, Homo sapiens
tattacaccaccggccccctcc

SEQ ID NO: 4367097 - DNA, 13 bp, Homo sapiens
tattatcacatta

SEQ ID NO: 4367098 - DNA, 19 bp, Homo sapiens
tattatgatgttagaagaa

SEQ ID NO: 4367099 - DNA, 15 bp, Homo sapiens
tattattctgcagca

SEQ ID NO: 4367100 - DNA, 16 bp, Homo sapiens
tattccatgaatgtat

SEQ ID NO: 4367101 - DNA, 16 bp, Homo sapiens
tattcccaagtatgcc

SEQ ID NO: 4367102 - DNA, 19 bp, Homo sapiens
tattcccaagtatgcctta

SEQ ID NO: 4367103 - DNA, 19 bp, Homo sapiens
tattccttttgtgtacagt

SEQ ID NO: 4367104 - DNA, 18 bp, Homo sapiens
tattgagccttgcatgta

SEQ ID NO: 4367105 - DNA, 23 bp, Homo sapiens
tattgagccttgcatgtacttga

SEQ ID NO: 4367106 - DNA, 18 bp, Homo sapiens
tatttatagcaatccatg

SEQ ID NO: 4367107 - DNA, 16 bp, Homo sapiens
tatttatatttcacta

SEQ ID NO: 4367108 - DNA, 13 bp, Homo sapiens
tatttattgcatt

SEQ ID NO: 4367109 - DNA, 15 bp, Homo sapiens
tatttccttaaactg

SEQ ID NO: 4367110 - DNA, 22 bp, Homo sapiens
tatttgtcttccgatcaacatt

SEQ ID NO: 4367111 - DNA, 18 bp, Homo sapiens
tattttgtatatttgtaa

SEQ ID NO: 4367112 - DNA, 20 bp, Homo sapiens
tatttttgtaattttaaata

SEQ ID NO: 4367113 - DNA, 20 bp, Homo sapiens
tattttttacttttcacact

SEQ ID NO: 4367114 - DNA, 12 bp, Homo sapiens
tcaaagaacaga

SEQ ID NO: 4367115 - DNA, 16 bp, Homo sapiens
tcaaagaagactcagt

SEQ ID NO: 4367116 - DNA, 15 bp, Homo sapiens
tcaaatctaccactg

SEQ ID NO: 4367117 - DNA, 14 bp, Homo sapiens
tcaaattgctgctt

SEQ ID NO: 4367118 - DNA, 17 bp, Homo sapiens
tcaaattgctgcttgga

SEQ ID NO: 4367119 - DNA, 20 bp, Homo sapiens
tcaacatgttactgaccagc

SEQ ID NO: 4367120 - DNA, 21 bp, Homo sapiens
tcaactgaaggggtgcaccca

SEQ ID NO: 4367121 - DNA, 11 bp, Homo sapiens
tcaagaaatga

SEQ ID NO: 4367122 - DNA, 15 bp, Homo sapiens
tcaaggtgagaatta

SEQ ID NO: 4367123 - DNA, 18 bp, Homo sapiens
tcaaggtgagaattaagt

SEQ ID NO: 4367124 - DNA, 16 bp, Homo sapiens
tcaagttcccaactga

SEQ ID NO: 4367125 - DNA, 13 bp, Homo sapiens
tcaataaaatgtg

SEQ ID NO: 4367126 - DNA, 19 bp, Homo sapiens
tcaataaaatgtgattttt

SEQ ID NO: 4367127 - DNA, 23 bp, Homo sapiens
tcaataaaatgtgatttttctga

SEQ ID NO: 4367128 - DNA, 16 bp, Homo sapiens
tcaatcatttggatca

SEQ ID NO: 4367129 - DNA, 14 bp, Homo sapiens
tcacaataaagttt

SEQ ID NO: 4367130 - DNA, 17 bp, Homo sapiens
tcacactgtcttcccga

SEQ ID NO: 4367131 - DNA, 16 bp, Homo sapiens
tcacatagatgtccct

SEQ ID NO: 4367132 - DNA, 13 bp, Homo sapiens
tcaccttgtattc

SEQ ID NO: 4367133 - DNA, 23 bp, Homo sapiens
tcaccttgtattctctttacctt

SEQ ID NO: 4367134 - DNA, 18 bp, Homo sapiens
tcactatttttatttata

SEQ ID NO: 4367135 - DNA, 15 bp, Homo sapiens
tcactccaccatccc

SEQ ID NO: 4367136 - DNA, 15 bp, Homo sapiens
tcactctaatataat

SEQ ID NO: 4367137 - DNA, 22 bp, Homo sapiens
tcactgttcgtcactcaaatga

SEQ ID NO: 4367138 - DNA, 18 bp, Homo sapiens
tcacttacgtttgtcctt

SEQ ID NO: 4367139 - DNA, 13 bp, Homo sapiens
tcacttgccacat

SEQ ID NO: 4367140 - DNA, 20 bp, Homo sapiens
tcacttgtagtccatttaaa

SEQ ID NO: 4367141 - DNA, 10 bp, Homo sapiens
tcagaacata

SEQ ID NO: 4367142 - DNA, 16 bp, Homo sapiens
tcagaagtttgcatct

SEQ ID NO: 4367143 - DNA, 12 bp, Homo sapiens
tcagagcattta

SEQ ID NO: 4367144 - DNA, 13 bp, Homo sapiens
tcagagctaggcc

SEQ ID NO: 4367145 - DNA, 10 bp, Homo sapiens
tcagagcttt

SEQ ID NO: 4367146 - DNA, 19 bp, Homo sapiens
tcagagctttgtcacttgc

SEQ ID NO: 4367147 - DNA, 23 bp, Homo sapiens
tcagagctttgtcacttgccaca

SEQ ID NO: 4367148 - DNA, 15 bp, Homo sapiens
tcagatgtgcaataa

SEQ ID NO: 4367149 - DNA, 16 bp, Homo sapiens
tcagatgtgcaataat

SEQ ID NO: 4367150 - DNA, 20 bp, Homo sapiens
tcagattgacagcatataga

SEQ ID NO: 4367151 - DNA, 19 bp, Homo sapiens
tcagcagaacctgcacaca

SEQ ID NO: 4367152 - DNA, 20 bp, Homo sapiens
tcagcagaacctgcacacag

SEQ ID NO: 4367153 - DNA, 17 bp, Homo sapiens
tcagccccgcctgtcac

SEQ ID NO: 4367154 - DNA, 18 bp, Homo sapiens
tcagccccgcctgtcaca

SEQ ID NO: 4367155 - DNA, 18 bp, Homo sapiens
tcagctaaagcccaacct

SEQ ID NO: 4367156 - DNA, 14 bp, Homo sapiens
tcaggaaagacgga

SEQ ID NO: 4367157 - DNA, 15 bp, Homo sapiens
tcaggacttggtctg

SEQ ID NO: 4367158 - DNA, 18 bp, Homo sapiens
tcaggcagcaccacactg

SEQ ID NO: 4367159 - DNA, 23 bp, Homo sapiens
tcaggcagcaccacactgggtgc

SEQ ID NO: 4367160 - DNA, 14 bp, Homo sapiens
tcaggtaatatacc

SEQ ID NO: 4367161 - DNA, 15 bp, Homo sapiens
tcaggtaatatacct

SEQ ID NO: 4367162 - DNA, 16 bp, Homo sapiens
tcaggtaatatacctg

SEQ ID NO: 4367163 - DNA, 22 bp, Homo sapiens
tcagtatgctttccctgaggaa

SEQ ID NO: 4367164 - DNA, 22 bp, Homo sapiens
tcagtattttttacttttcaca

SEQ ID NO: 4367165 - DNA, 23 bp, Homo sapiens
tcagttgagagggtgcagtccag

SEQ ID NO: 4367166 - DNA, 22 bp, Homo sapiens
tcatcattgggctcacttctaa

SEQ ID NO: 4367167 - DNA, 20 bp, Homo sapiens
tcatccaatcctcactgggt

SEQ ID NO: 4367168 - DNA, 17 bp, Homo sapiens
tcatctccatcagctgt

SEQ ID NO: 4367169 - DNA, 23 bp, Homo sapiens
tcatcttgtgagtggataatcag

SEQ ID NO: 4367170 - DNA, 14 bp, Homo sapiens
tcatgcccagctct

SEQ ID NO: 4367171 - DNA, 16 bp, Homo sapiens
tcatgcccagctctct

SEQ ID NO: 4367172 - DNA, 17 bp, Homo sapiens
tcatggtactaccccag

SEQ ID NO: 4367173 - DNA, 18 bp, Homo sapiens
tcatggtactaccccagc

SEQ ID NO: 4367174 - DNA, 15 bp, Homo sapiens
tcattccaattctaa

SEQ ID NO: 4367175 - DNA, 14 bp, Homo sapiens
tcattccgttagga

SEQ ID NO: 4367176 - DNA, 12 bp, Homo sapiens
tcatttaactga

SEQ ID NO: 4367177 - DNA, 14 bp, Homo sapiens
tcatttaactgaac

SEQ ID NO: 4367178 - DNA, 12 bp, Homo sapiens
tccaagaacata

SEQ ID NO: 4367179 - DNA, 17 bp, Homo sapiens
tccaatcctcactgggt

SEQ ID NO: 4367180 - DNA, 13 bp, Homo sapiens
tccaattctaaat

SEQ ID NO: 4367181 - DNA, 16 bp, Homo sapiens
tccaccatccccaccc

SEQ ID NO: 4367182 - DNA, 17 bp, Homo sapiens
tccaccatccccacccc

SEQ ID NO: 4367183 - DNA, 14 bp, Homo sapiens
tccaccctgccaag

SEQ ID NO: 4367184 - DNA, 20 bp, Homo sapiens
tccaccctgccaagactcct

SEQ ID NO: 4367185 - DNA, 23 bp, Homo sapiens
tccaccctgccaagactcctcag

SEQ ID NO: 4367186 - DNA, 14 bp, Homo sapiens
tccacctcaactcc

SEQ ID NO: 4367187 - DNA, 22 bp, Homo sapiens
tccaccttttaagttaatgaaa

SEQ ID NO: 4367188 - DNA, 22 bp, Homo sapiens
tccagaggtgtcgggacatggt

SEQ ID NO: 4367189 - DNA, 16 bp, Homo sapiens
tccagattctgatgca

SEQ ID NO: 4367190 - DNA, 18 bp, Homo sapiens
tccagattctgatgcata

SEQ ID NO: 4367191 - DNA, 23 bp, Homo sapiens
tccagtcatggtactaccccagc

SEQ ID NO: 4367192 - DNA, 18 bp, Homo sapiens
tccagtgaacattcccag

SEQ ID NO: 4367193 - DNA, 12 bp, Homo sapiens
tccatgaatgta

SEQ ID NO: 4367194 - DNA, 15 bp, Homo sapiens
tccatgaatgtatca

SEQ ID NO: 4367195 - DNA, 14 bp, Homo sapiens
tccatgccccagct

SEQ ID NO: 4367196 - DNA, 18 bp, Homo sapiens
tccatgttagtttttact

SEQ ID NO: 4367197 - DNA, 13 bp, Homo sapiens
tcccaagtatgcc

SEQ ID NO: 4367198 - DNA, 15 bp, Homo sapiens
tcccaagtatgcctt

SEQ ID NO: 4367199 - DNA, 21 bp, Homo sapiens
tcccaagtatgccttaagcag

SEQ ID NO: 4367200 - DNA, 15 bp, Homo sapiens
tcccaattaggaagt

SEQ ID NO: 4367201 - DNA, 19 bp, Homo sapiens
tcccaattaggaagtgtaa

SEQ ID NO: 4367202 - DNA, 20 bp, Homo sapiens
tcccattttggaagttttca

SEQ ID NO: 4367203 - DNA, 22 bp, Homo sapiens
tccccactccctggctctcaga

SEQ ID NO: 4367204 - DNA, 15 bp, Homo sapiens
tcccccatccctacc

SEQ ID NO: 4367205 - DNA, 20 bp, Homo sapiens
tcccccatccctaccactgt

SEQ ID NO: 4367206 - DNA, 12 bp, Homo sapiens
tccccccagact

SEQ ID NO: 4367207 - DNA, 13 bp, Homo sapiens
tccccccagactc

SEQ ID NO: 4367208 - DNA, 12 bp, Homo sapiens
tcccccctgagt

SEQ ID NO: 4367209 - DNA, 13 bp, Homo sapiens
tcccccctgagtg

SEQ ID NO: 4367210 - DNA, 18 bp, Homo sapiens
tccccgaggagctgggcc

SEQ ID NO: 4367211 - DNA, 15 bp, Homo sapiens
tcccctctcagaaca

SEQ ID NO: 4367212 - DNA, 19 bp, Homo sapiens
tcccgcctcttcttcttca

SEQ ID NO: 4367213 - DNA, 13 bp, Homo sapiens
tccctcccctctc

SEQ ID NO: 4367214 - DNA, 22 bp, Homo sapiens
tccctggaaaccttccacccag

SEQ ID NO: 4367215 - DNA, 18 bp, Homo sapiens
tccctggctctcagaagg

SEQ ID NO: 4367216 - DNA, 18 bp, Homo sapiens
tccctggggaccaggagc

SEQ ID NO: 4367217 - DNA, 15 bp, Homo sapiens
tcccttgaattgtgt

SEQ ID NO: 4367218 - DNA, 17 bp, Homo sapiens
tcccttgaattgtgtat

SEQ ID NO: 4367219 - DNA, 23 bp, Homo sapiens
tcccttgagaccaaaatttaagt

SEQ ID NO: 4367220 - DNA, 13 bp, Homo sapiens
tccctttcttggc

SEQ ID NO: 4367221 - DNA, 21 bp, Homo sapiens
tccctttcttggccagttatc

SEQ ID NO: 4367222 - DNA, 14 bp, Homo sapiens
tccgggtctcgcag

SEQ ID NO: 4367223 - DNA, 18 bp, Homo sapiens
tccgggtctcgcagcctg

SEQ ID NO: 4367224 - DNA, 19 bp, Homo sapiens
tccgggtctcgcagcctga

SEQ ID NO: 4367225 - DNA, 17 bp, Homo sapiens
tccgtattctttgtgtt

SEQ ID NO: 4367226 - DNA, 14 bp, Homo sapiens
tccgtgcttaacca

SEQ ID NO: 4367227 - DNA, 21 bp, Homo sapiens
tccgttaggaataacactgca

SEQ ID NO: 4367228 - DNA, 16 bp, Homo sapiens
tccgttcacatgtgtg

SEQ ID NO: 4367229 - DNA, 16 bp, Homo sapiens
tcctcacccctgtagg

SEQ ID NO: 4367230 - DNA, 18 bp, Homo sapiens
tcctcacccctgtaggga

SEQ ID NO: 4367231 - DNA, 22 bp, Homo sapiens
tcctcactgggtggggtgagga

SEQ ID NO: 4367232 - DNA, 18 bp, Homo sapiens
tcctctactcacagctga

SEQ ID NO: 4367233 - DNA, 16 bp, Homo sapiens
tcctgccggtgggacc

SEQ ID NO: 4367234 - DNA, 23 bp, Homo sapiens
tcctgccggtgggaccctgtccg

SEQ ID NO: 4367235 - DNA, 13 bp, Homo sapiens
tcctgctcctcac

SEQ ID NO: 4367236 - DNA, 15 bp, Homo sapiens
tcctgctcctcaccc

SEQ ID NO: 4367237 - DNA, 19 bp, Homo sapiens
tcctggacttacaaaatgc

SEQ ID NO: 4367238 - DNA, 17 bp, Homo sapiens
tcctgtacactgaatat

SEQ ID NO: 4367239 - DNA, 20 bp, Homo sapiens
tcctgtgcatgggtgaaggg

SEQ ID NO: 4367240 - DNA, 19 bp, Homo sapiens
tccttcattccgttaggaa

SEQ ID NO: 4367241 - DNA, 18 bp, Homo sapiens
tccttgcctgaactccag

SEQ ID NO: 4367242 - DNA, 13 bp, Homo sapiens
tccttgccttaat

SEQ ID NO: 4367243 - DNA, 21 bp, Homo sapiens
tccttgccttaataaatatgt

SEQ ID NO: 4367244 - DNA, 15 bp, Homo sapiens
tccttttagcctagt

SEQ ID NO: 4367245 - DNA, 17 bp, Homo sapiens
tccttttgaattaaact

SEQ ID NO: 4367246 - DNA, 11 bp, Homo sapiens
tcgcagcctga

SEQ ID NO: 4367247 - DNA, 14 bp, Homo sapiens
tctaagagcaattc

SEQ ID NO: 4367248 - DNA, 15 bp, Homo sapiens
tctaatataatatgg

SEQ ID NO: 4367249 - DNA, 18 bp, Homo sapiens
tctacagacttctccaga

SEQ ID NO: 4367250 - DNA, 13 bp, Homo sapiens
tctactaaataat

SEQ ID NO: 4367251 - DNA, 20 bp, Homo sapiens
tctactcaacccattgttgt

SEQ ID NO: 4367252 - DNA, 16 bp, Homo sapiens
tctaggactgcagtgt

SEQ ID NO: 4367253 - DNA, 17 bp, Homo sapiens
tctatacccacccagaa

SEQ ID NO: 4367254 - DNA, 24 bp, Homo sapiens
tctatatatatagggagcacttta

SEQ ID NO: 4367255 - DNA, 17 bp, Homo sapiens
tctatgacatgaaatga

SEQ ID NO: 4367256 - DNA, 19 bp, Homo sapiens
tctcaggcagcaccacact

SEQ ID NO: 4367257 - DNA, 12 bp, Homo sapiens
tctcccaacatg

SEQ ID NO: 4367258 - DNA, 13 bp, Homo sapiens
tctcccaacatgg

SEQ ID NO: 4367259 - DNA, 17 bp, Homo sapiens
tctccctcccctctcag

SEQ ID NO: 4367260 - DNA, 22 bp, Homo sapiens
tctcgatgccataatcagaaca

SEQ ID NO: 4367261 - DNA, 16 bp, Homo sapiens
tctctatgacatgaaa

SEQ ID NO: 4367262 - DNA, 15 bp, Homo sapiens
tctctcataccctcc

SEQ ID NO: 4367263 - DNA, 17 bp, Homo sapiens
tctgacgcttgtgacag

SEQ ID NO: 4367264 - DNA, 18 bp, Homo sapiens
tctgacgcttgtgacagt

SEQ ID NO: 4367265 - DNA, 22 bp, Homo sapiens
tctgacgcttgtgacagtgcct

SEQ ID NO: 4367266 - DNA, 12 bp, Homo sapiens
tctgaggacaga

SEQ ID NO: 4367267 - DNA, 19 bp, Homo sapiens
tctgaggacagaggccggg

SEQ ID NO: 4367268 - DNA, 17 bp, Homo sapiens
tctgctctggtggctta

SEQ ID NO: 4367269 - DNA, 12 bp, Homo sapiens
tctgctgaggcc

SEQ ID NO: 4367270 - DNA, 19 bp, Homo sapiens
tctgcttggcaatagttaa

SEQ ID NO: 4367271 - DNA, 22 bp, Homo sapiens
tctggactagaaaatctgagtt

SEQ ID NO: 4367272 - DNA, 20 bp, Homo sapiens
tctggactgaagcctgcagg

SEQ ID NO: 4367273 - DNA, 20 bp, Homo sapiens
tctggagaggttataggtca

SEQ ID NO: 4367274 - DNA, 18 bp, Homo sapiens
tctggccctgacttctgg

SEQ ID NO: 4367275 - DNA, 13 bp, Homo sapiens
tctggttgcctcc

SEQ ID NO: 4367276 - DNA, 20 bp, Homo sapiens
tctgtccgttcacatgtgtg

SEQ ID NO: 4367277 - DNA, 22 bp, Homo sapiens
tctgtctccctcccctctcaga

SEQ ID NO: 4367278 - DNA, 14 bp, Homo sapiens
tctgtgactggatc

SEQ ID NO: 4367279 - DNA, 13 bp, Homo sapiens
tcttcagaagaca

SEQ ID NO: 4367280 - DNA, 21 bp, Homo sapiens
tcttccagtgaacattcccag

SEQ ID NO: 4367281 - DNA, 21 bp, Homo sapiens
tcttccctggaaaccttccac

SEQ ID NO: 4367282 - DNA, 16 bp, Homo sapiens
tcttctatcattccaa

SEQ ID NO: 4367283 - DNA, 15 bp, Homo sapiens
tcttcttcttcagaa

SEQ ID NO: 4367284 - DNA, 22 bp, Homo sapiens
tcttgctggttgtcatttttgc

SEQ ID NO: 4367285 - DNA, 22 bp, Homo sapiens
tcttgtgagtggataatcagga

SEQ ID NO: 4367286 - DNA, 16 bp, Homo sapiens
tctttaccttctaaaa

SEQ ID NO: 4367287 - DNA, 20 bp, Homo sapiens
tctttagcatttttatgcag

SEQ ID NO: 4367288 - DNA, 21 bp, Homo sapiens
tctttagcatttttatgcaga

SEQ ID NO: 4367289 - DNA, 17 bp, Homo sapiens
tctttatggttctactt

SEQ ID NO: 4367290 - DNA, 19 bp, Homo sapiens
tctttctgtgcttggattt

SEQ ID NO: 4367291 - DNA, 23 bp, Homo sapiens
tctttggaagcagccccctgtgg

SEQ ID NO: 4367292 - DNA, 20 bp, Homo sapiens
tctttttttgagtgacagct

SEQ ID NO: 4367293 - DNA, 15 bp, Homo sapiens
tgaaaagttggaagg

SEQ ID NO: 4367294 - DNA, 23 bp, Homo sapiens
tgaaaagttggaaggatctgctg

SEQ ID NO: 4367295 - DNA, 15 bp, Homo sapiens
tgaaataaaatttga

SEQ ID NO: 4367296 - DNA, 16 bp, Homo sapiens
tgaaataaaatttgaa

SEQ ID NO: 4367297 - DNA, 17 bp, Homo sapiens
tgaaataaaatttgaaa

SEQ ID NO: 4367298 - DNA, 14 bp, Homo sapiens
tgaaataagttgtt

SEQ ID NO: 4367299 - DNA, 18 bp, Homo sapiens
tgaaataagttgtttcag

SEQ ID NO: 4367300 - DNA, 22 bp, Homo sapiens
tgaacattttgtggagtttgta

SEQ ID NO: 4367301 - DNA, 13 bp, Homo sapiens
tgaactccagagg

SEQ ID NO: 4367302 - DNA, 12 bp, Homo sapiens
tgaactgtgaac

SEQ ID NO: 4367303 - DNA, 22 bp, Homo sapiens
tgaagagccggtggtgcccgtg

SEQ ID NO: 4367304 - DNA, 13 bp, Homo sapiens
tgaagcaggaggc

SEQ ID NO: 4367305 - DNA, 15 bp, Homo sapiens
tgaagctgttgtgtg

SEQ ID NO: 4367306 - DNA, 19 bp, Homo sapiens
tgaagctgttgtgtgaggt

SEQ ID NO: 4367307 - DNA, 16 bp, Homo sapiens
tgaagggagagccagc

SEQ ID NO: 4367308 - DNA, 17 bp, Homo sapiens
tgaagggagagccagct

SEQ ID NO: 4367309 - DNA, 15 bp, Homo sapiens
tgaagggcaagaaat

SEQ ID NO: 4367310 - DNA, 20 bp, Homo sapiens
tgaaggggtgcacccacctg

SEQ ID NO: 4367311 - DNA, 14 bp, Homo sapiens
tgaataaagcaatt

SEQ ID NO: 4367312 - DNA, 17 bp, Homo sapiens
tgaatattcctggactt

SEQ ID NO: 4367313 - DNA, 20 bp, Homo sapiens
tgaatatttatatttcacta

SEQ ID NO: 4367314 - DNA, 21 bp, Homo sapiens
tgaatgcaatttttttttgtt

SEQ ID NO: 4367315 - DNA, 22 bp, Homo sapiens
tgaattgtgtattgatgcaata

SEQ ID NO: 4367316 - DNA, 14 bp, Homo sapiens
tgacagctttctgg

SEQ ID NO: 4367317 - DNA, 17 bp, Homo sapiens
tgacagctttctgggat

SEQ ID NO: 4367318 - DNA, 16 bp, Homo sapiens
tgacagtgaaacaaat

SEQ ID NO: 4367319 - DNA, 18 bp, Homo sapiens
tgacagtgcctcttccag

SEQ ID NO: 4367320 - DNA, 21 bp, Homo sapiens
tgacagtgcctgggaatgtat

SEQ ID NO: 4367321 - DNA, 18 bp, Homo sapiens
tgaccaactgttggattc

SEQ ID NO: 4367322 - DNA, 19 bp, Homo sapiens
aaaggtttcactgttcatg

SEQ ID NO: 4367323 - DNA, 15 bp, Homo sapiens
aagatgtaagaagct

SEQ ID NO: 4367324 - DNA, 13 bp, Homo sapiens
aaggcttctccac

SEQ ID NO: 4367325 - DNA, 15 bp, Homo sapiens
aatctactagaacct

SEQ ID NO: 4367326 - DNA, 20 bp, Homo sapiens
aatgagtttccagctaagcc

SEQ ID NO: 4367327 - DNA, 14 bp, Homo sapiens
acacagtctggtgc

SEQ ID NO: 4367328 - DNA, 20 bp, Homo sapiens
accttctaatccatgtgctg

SEQ ID NO: 4367329 - DNA, 17 bp, Homo sapiens
actgtgacacagctgag

SEQ ID NO: 4367330 - DNA, 20 bp, Homo sapiens
actgtgacacagctgagctg

SEQ ID NO: 4367331 - DNA, 13 bp, Homo sapiens
acttatttccatg

SEQ ID NO: 4367332 - DNA, 13 bp, Homo sapiens
agaacagggatgc

SEQ ID NO: 4367333 - DNA, 14 bp, Homo sapiens
agaatcaagtctgt

SEQ ID NO: 4367334 - DNA, 16 bp, Homo sapiens
agaatcaagtctgtga

SEQ ID NO: 4367335 - DNA, 17 bp, Homo sapiens
agcctgatgatggaagg

SEQ ID NO: 4367336 - DNA, 13 bp, Homo sapiens
agctgagctggcc

SEQ ID NO: 4367337 - DNA, 22 bp, Homo sapiens
aggatgtggatggaggtgatga

SEQ ID NO: 4367338 - DNA, 20 bp, Homo sapiens
aggtttagaatcaagtctgt

SEQ ID NO: 4367339 - DNA, 22 bp, Homo sapiens
aggtttagaatcaagtctgtga

SEQ ID NO: 4367340 - DNA, 19 bp, Homo sapiens
aggtttcactgttcatgaa

SEQ ID NO: 4367341 - DNA, 19 bp, Homo sapiens
agtttccagctaagcctga

SEQ ID NO: 4367342 - DNA, 14 bp, Homo sapiens
atattcccatggta

SEQ ID NO: 4367343 - DNA, 22 bp, Homo sapiens
atcaggaaaggaagatgtaaga

SEQ ID NO: 4367344 - DNA, 19 bp, Homo sapiens
atctactagaaccttctaa

SEQ ID NO: 4367345 - DNA, 15 bp, Homo sapiens
atctgtttgcttcta

SEQ ID NO: 4367346 - DNA, 16 bp, Homo sapiens
atctgtttgcttctaa

SEQ ID NO: 4367347 - DNA, 17 bp, Homo sapiens
atctgtttgcttctaaa

SEQ ID NO: 4367348 - DNA, 20 bp, Homo sapiens
atgaatacgtaaactgcgta

SEQ ID NO: 4367349 - DNA, 20 bp, Homo sapiens
atgaggcacgcctgccttct

SEQ ID NO: 4367350 - DNA, 18 bp, Homo sapiens
atgctatctcgctagcca

SEQ ID NO: 4367351 - DNA, 18 bp, Homo sapiens
atggaggtgatgaaaacc

SEQ ID NO: 4367352 - DNA, 16 bp, Homo sapiens
atggtagactgtgaca

SEQ ID NO: 4367353 - DNA, 14 bp, Homo sapiens
atgtgctgctgtgg

SEQ ID NO: 4367354 - DNA, 16 bp, Homo sapiens
attaggtttagaatca

SEQ ID NO: 4367355 - DNA, 22 bp, Homo sapiens
attcccatggtagactgtgaca

SEQ ID NO: 4367356 - DNA, 21 bp, Homo sapiens
atttccatggattcccctgga

SEQ ID NO: 4367357 - DNA, 18 bp, Homo sapiens
attttggacgtgtgagga

SEQ ID NO: 4367358 - DNA, 14 bp, Homo sapiens
cacttatttccatg

SEQ ID NO: 4367359 - DNA, 17 bp, Homo sapiens
cagctaagcctgatgat

SEQ ID NO: 4367360 - DNA, 15 bp, Homo sapiens
caggaaaggaagatg

SEQ ID NO: 4367361 - DNA, 21 bp, Homo sapiens
catgaatacgtaaactgcgta

SEQ ID NO: 4367362 - DNA, 15 bp, Homo sapiens
catgtgctgctgtgg

SEQ ID NO: 4367363 - DNA, 16 bp, Homo sapiens
ccatggattcccctgg

SEQ ID NO: 4367364 - DNA, 15 bp, Homo sapiens
ccatggtagactgtg

SEQ ID NO: 4367365 - DNA, 15 bp, Homo sapiens
ccatgtgctgctgtg

SEQ ID NO: 4367366 - DNA, 23 bp, Homo sapiens
cctatcatcagttaggattaggt

SEQ ID NO: 4367367 - DNA, 19 bp, Homo sapiens
cctccagttctgatgaggc

SEQ ID NO: 4367368 - DNA, 12 bp, Homo sapiens
ccttctccacag

SEQ ID NO: 4367369 - DNA, 12 bp, Homo sapiens
ccttctcccctc

SEQ ID NO: 4367370 - DNA, 13 bp, Homo sapiens
ctgagctggccta

SEQ ID NO: 4367371 - DNA, 22 bp, Homo sapiens
ctgatatctgtttgcttctaaa

SEQ ID NO: 4367372 - DNA, 15 bp, Homo sapiens
ctgatgatggaaggg

SEQ ID NO: 4367373 - DNA, 19 bp, Homo sapiens
ctgccttctcccctccaag

SEQ ID NO: 4367374 - DNA, 18 bp, Homo sapiens
ctgcgtaggagagaacag

SEQ ID NO: 4367375 - DNA, 14 bp, Homo sapiens
ctgtatcatttctt

SEQ ID NO: 4367376 - DNA, 18 bp, Homo sapiens
ctgtgaaagtctcctgta

SEQ ID NO: 4367377 - DNA, 21 bp, Homo sapiens
ctgtgaaagtctcctgtatca

SEQ ID NO: 4367378 - DNA, 23 bp, Homo sapiens
cttctaaaggtttcactgttcat

SEQ ID NO: 4367379 - DNA, 20 bp, Homo sapiens
cttctaatccatgtgctgct

SEQ ID NO: 4367380 - DNA, 21 bp, Homo sapiens
gaaaggaagatgtaagaagct

SEQ ID NO: 4367381 - DNA, 19 bp, Homo sapiens
gatgtggatggaggtgatg

SEQ ID NO: 4367382 - DNA, 16 bp, Homo sapiens
gccacttatttccatg

SEQ ID NO: 4367383 - DNA, 19 bp, Homo sapiens
gctgtggcatcaggaaagg

SEQ ID NO: 4367384 - DNA, 21 bp, Homo sapiens
gggatgctatctcgctagcca

SEQ ID NO: 4367385 - DNA, 20 bp, Homo sapiens
gtgacacagctgagctggcc

SEQ ID NO: 4367386 - DNA, 17 bp, Homo sapiens
gtgctgctgtggcatca

SEQ ID NO: 4367387 - DNA, 22 bp, Homo sapiens
gttaggattaggtttagaatca

SEQ ID NO: 4367388 - DNA, 21 bp, Homo sapiens
gtttagaatcaagtctgtgaa

SEQ ID NO: 4367389 - DNA, 19 bp, Homo sapiens
gtttccagctaagcctgat

SEQ ID NO: 4367390 - DNA, 19 bp, Homo sapiens
gtttgcttctaaaggtttc

SEQ ID NO: 4367391 - DNA, 18 bp, Homo sapiens
tagcatatataattttat

SEQ ID NO: 4367392 - DNA, 17 bp, Homo sapiens
tatctgtttgcttctaa

SEQ ID NO: 4367393 - DNA, 23 bp, Homo sapiens
tattcccatggtagactgtgaca

SEQ ID NO: 4367394 - DNA, 18 bp, Homo sapiens
tattgctggaatctacta

SEQ ID NO: 4367395 - DNA, 22 bp, Homo sapiens
tattttctgagtagcatatata

SEQ ID NO: 4367396 - DNA, 11 bp, Homo sapiens
tcaagtctgtg

SEQ ID NO: 4367397 - DNA, 14 bp, Homo sapiens
tcaagtctgtgaaa

SEQ ID NO: 4367398 - DNA, 17 bp, Homo sapiens
tccacaacctcctcctc

SEQ ID NO: 4367399 - DNA, 19 bp, Homo sapiens
tccagctaagcctgatgat

SEQ ID NO: 4367400 - DNA, 22 bp, Homo sapiens
tccagctaagcctgatgatgga

SEQ ID NO: 4367401 - DNA, 17 bp, Homo sapiens
tccatgtgctgctgtgg

SEQ ID NO: 4367402 - DNA, 15 bp, Homo sapiens
tctcctgtatcattt

SEQ ID NO: 4367403 - DNA, 20 bp, Homo sapiens
tgaaaaatagtgtgtccatg

SEQ ID NO: 4367404 - DNA, 20 bp, Homo sapiens
tgaaagtctcctgtatcatt

SEQ ID NO: 4367405 - DNA, 22 bp, Homo sapiens
tgaatgagtttccagctaagcc

SEQ ID NO: 4367406 - DNA, 15 bp, Homo sapiens
tgagtagcatatata

SEQ ID NO: 4367407 - DNA, 17 bp, Homo sapiens
tgctatctcgctagcca

SEQ ID NO: 4367408 - DNA, 18 bp, Homo sapiens
tggaatctactagaacct

SEQ ID NO: 4367409 - DNA, 12 bp, Homo sapiens
tggaggtgatga

SEQ ID NO: 4367410 - DNA, 22 bp, Homo sapiens
tgtaagaagctaaaatgaaaaa

SEQ ID NO: 4367411 - DNA, 15 bp, Homo sapiens
tgtgctgctgtggca

SEQ ID NO: 4367412 - DNA, 17 bp, Homo sapiens
tgtggcatcaggaaagg

SEQ ID NO: 4367413 - DNA, 18 bp, Homo sapiens
ttctaaaggtttcactgt

SEQ ID NO: 4367414 - DNA, 19 bp, Homo sapiens
ttgctggaatctactagaa

SEQ ID NO: 4367415 - DNA, 20 bp, Homo sapiens
tttccagctaagcctgatga

SEQ ID NO: 4367416 - DNA, 13 bp, Homo sapiens
aaaggcttctcca

SEQ ID NO: 4367417 - DNA, 19 bp, Homo sapiens
aagaagctaaaatgaaaaa

SEQ ID NO: 4367418 - DNA, 17 bp, Homo sapiens
aagctaaaatgaaaaat

SEQ ID NO: 4367419 - DNA, 16 bp, Homo sapiens
aaggtttcactgttca

SEQ ID NO: 4367420 - DNA, 17 bp, Homo sapiens
aaggtttcactgttcat

SEQ ID NO: 4367421 - DNA, 15 bp, Homo sapiens
aagtctcctgtatca

SEQ ID NO: 4367422 - DNA, 19 bp, Homo sapiens
aatccatgtgctgctgtgg

SEQ ID NO: 4367423 - DNA, 17 bp, Homo sapiens
acactcaccgagaggaa

SEQ ID NO: 4367424 - DNA, 20 bp, Homo sapiens
acagggacacagtctggtgc

SEQ ID NO: 4367425 - DNA, 22 bp, Homo sapiens
acatattcccatggtagactgt

SEQ ID NO: 4367426 - DNA, 23 bp, Homo sapiens
accaccctatcatcagttaggat

SEQ ID NO: 4367427 - DNA, 14 bp, Homo sapiens
accctatcatcagt

SEQ ID NO: 4367428 - DNA, 21 bp, Homo sapiens
accgagaggaaaaaggcttct

SEQ ID NO: 4367429 - DNA, 23 bp, Homo sapiens
accttctaatccatgtgctgctg

SEQ ID NO: 4367430 - DNA, 13 bp, Homo sapiens
agaaccttctaat

SEQ ID NO: 4367431 - DNA, 16 bp, Homo sapiens
aggatgtggatggagg

SEQ ID NO: 4367432 - DNA, 19 bp, Homo sapiens
aggattaggtttagaatca

SEQ ID NO: 4367433 - DNA, 23 bp, Homo sapiens
agggatgctatctcgctagccat

SEQ ID NO: 4367434 - DNA, 16 bp, Homo sapiens
aggtttcactgttcat

SEQ ID NO: 4367435 - DNA, 20 bp, Homo sapiens
agtgaatgagtttccagcta

SEQ ID NO: 4367436 - DNA, 17 bp, Homo sapiens
ataattttattgctgga

SEQ ID NO: 4367437 - DNA, 17 bp, Homo sapiens
atatctgtttgcttcta

SEQ ID NO: 4367438 - DNA, 13 bp, Homo sapiens
atcaagtctgtga

SEQ ID NO: 4367439 - DNA, 14 bp, Homo sapiens
atcaagtctgtgaa

SEQ ID NO: 4367440 - DNA, 19 bp, Homo sapiens
atcattggtatctgatatc

SEQ ID NO: 4367441 - DNA, 20 bp, Homo sapiens
atcattggtatctgatatct

SEQ ID NO: 4367442 - DNA, 17 bp, Homo sapiens
atccatgtgctgctgtg

SEQ ID NO: 4367443 - DNA, 14 bp, Homo sapiens
atctgtttgcttct

SEQ ID NO: 4367444 - DNA, 21 bp, Homo sapiens
atgaaaaatagtgtgtccatg

SEQ ID NO: 4367445 - DNA, 19 bp, Homo sapiens
atggaagggccttctccac

SEQ ID NO: 4367446 - DNA, 18 bp, Homo sapiens
atggattcccctggacat

SEQ ID NO: 4367447 - DNA, 21 bp, Homo sapiens
attcccatggtagactgtgac

SEQ ID NO: 4367448 - DNA, 16 bp, Homo sapiens
attttggacgtgtgag

SEQ ID NO: 4367449 - DNA, 16 bp, Homo sapiens
caaggcctccagccac

SEQ ID NO: 4367450 - DNA, 20 bp, Homo sapiens
caagtgaatgagtttccagc

SEQ ID NO: 4367451 - DNA, 18 bp, Homo sapiens
cacaacctcctcctccag

SEQ ID NO: 4367452 - DNA, 13 bp, Homo sapiens
cacttatttccat

SEQ ID NO: 4367453 - DNA, 15 bp, Homo sapiens
cagctgagctggcct

SEQ ID NO: 4367454 - DNA, 19 bp, Homo sapiens
cagggatgctatctcgcta

SEQ ID NO: 4367455 - DNA, 15 bp, Homo sapiens
catggtagactgtga

SEQ ID NO: 4367456 - DNA, 17 bp, Homo sapiens
catgtgctgctgtggca

SEQ ID NO: 4367457 - DNA, 14 bp, Homo sapiens
ccacttatttccat

SEQ ID NO: 4367458 - DNA, 14 bp, Homo sapiens
ccagttctgatgag

SEQ ID NO: 4367459 - DNA, 16 bp, Homo sapiens
ccatggtagactgtga

SEQ ID NO: 4367460 - DNA, 15 bp, Homo sapiens
cctatcatcagttag

SEQ ID NO: 4367461 - DNA, 13 bp, Homo sapiens
ctagccatatatt

SEQ ID NO: 4367462 - DNA, 17 bp, Homo sapiens
ctagccatatattttct

SEQ ID NO: 4367463 - DNA, 14 bp, Homo sapiens
ctcaaggcctccag

SEQ ID NO: 4367464 - DNA, 23 bp, Homo sapiens
ctccacagggacacagtctggtg

SEQ ID NO: 4367465 - DNA, 13 bp, Homo sapiens
ctcccctccaagt

SEQ ID NO: 4367466 - DNA, 20 bp, Homo sapiens
ctcctccagttctgatgagg

SEQ ID NO: 4367467 - DNA, 14 bp, Homo sapiens
ctggacatattccc

SEQ ID NO: 4367468 - DNA, 22 bp, Homo sapiens
ctgtgaaagtctcctgtatcat

SEQ ID NO: 4367469 - DNA, 16 bp, Homo sapiens
gaatcaagtctgtgaa

SEQ ID NO: 4367470 - DNA, 19 bp, Homo sapiens
gacacagctgagctggcct

SEQ ID NO: 4367471 - DNA, 15 bp, Homo sapiens
gagaggaaaaaggct

SEQ ID NO: 4367472 - DNA, 21 bp, Homo sapiens
gagctggcctattttggacgt

SEQ ID NO: 4367473 - DNA, 15 bp, Homo sapiens
gcacgcctgccttct

SEQ ID NO: 4367474 - DNA, 19 bp, Homo sapiens
gccatatattttctgagta

SEQ ID NO: 4367475 - DNA, 14 bp, Homo sapiens
gccttctcccctcc

SEQ ID NO: 4367476 - DNA, 16 bp, Homo sapiens
gctaagcctgatgatg

SEQ ID NO: 4367477 - DNA, 23 bp, Homo sapiens
gcttctccacaacctcctcctcc

SEQ ID NO: 4367478 - DNA, 16 bp, Homo sapiens
ggattcccctggacat

SEQ ID NO: 4367479 - DNA, 13 bp, Homo sapiens
gtagactgtgaca

SEQ ID NO: 4367480 - DNA, 14 bp, Homo sapiens
aaaggcttctccac

SEQ ID NO: 4367481 - DNA, 22 bp, Homo sapiens
aaaggtttcactgttcatgaat

SEQ ID NO: 4367482 - DNA, 17 bp, Homo sapiens
aaagtctcctgtatcat

SEQ ID NO: 4367483 - DNA, 18 bp, Homo sapiens
aatcaagtctgtgaaagt

SEQ ID NO: 4367484 - DNA, 13 bp, Homo sapiens
aattttattgctg

SEQ ID NO: 4367485 - DNA, 21 bp, Homo sapiens
acacagctgagctggcctatt

SEQ ID NO: 4367486 - DNA, 17 bp, Homo sapiens
acagggacacagtctgg

SEQ ID NO: 4367487 - DNA, 12 bp, Homo sapiens
acgtgtgaggat

SEQ ID NO: 4367488 - DNA, 11 bp, Homo sapiens
agcatatataa

SEQ ID NO: 4367489 - DNA, 20 bp, Homo sapiens
agccatatattttctgagta

SEQ ID NO: 4367490 - DNA, 15 bp, Homo sapiens
agctaagcctgatga

SEQ ID NO: 4367491 - DNA, 17 bp, Homo sapiens
agctaagcctgatgatg

SEQ ID NO: 4367492 - DNA, 14 bp, Homo sapiens
agctgagctggcct

SEQ ID NO: 4367493 - DNA, 12 bp, Homo sapiens
aggcttctccac

SEQ ID NO: 4367494 - DNA, 14 bp, Homo sapiens
atagtgtgtccatg

SEQ ID NO: 4367495 - DNA, 19 bp, Homo sapiens
atattttctgagtagcata

SEQ ID NO: 4367496 - DNA, 22 bp, Homo sapiens
atcattggtatctgatatctgt

SEQ ID NO: 4367497 - DNA, 14 bp, Homo sapiens
atctactagaacct

SEQ ID NO: 4367498 - DNA, 19 bp, Homo sapiens
atgaaaaccaccctatcat

SEQ ID NO: 4367499 - DNA, 19 bp, Homo sapiens
atgctatctcgctagccat

SEQ ID NO: 4367500 - DNA, 21 bp, Homo sapiens
atgctatctcgctagccatat

SEQ ID NO: 4367501 - DNA, 15 bp, Homo sapiens
atggtagactgtgac

SEQ ID NO: 4367502 - DNA, 16 bp, Homo sapiens
atgtgctgctgtggca

SEQ ID NO: 4367503 - DNA, 18 bp, Homo sapiens
atgtggatggaggtgatg

SEQ ID NO: 4367504 - DNA, 18 bp, Homo sapiens
attttctgagtagcatat

SEQ ID NO: 4367505 - DNA, 17 bp, Homo sapiens
cacagctgagctggcct

SEQ ID NO: 4367506 - DNA, 15 bp, Homo sapiens
cagctaagcctgatg

SEQ ID NO: 4367507 - DNA, 19 bp, Homo sapiens
cagctaagcctgatgatgg

SEQ ID NO: 4367508 - DNA, 13 bp, Homo sapiens
cagttctgatgag

SEQ ID NO: 4367509 - DNA, 17 bp, Homo sapiens
ccacttatttccatgga

SEQ ID NO: 4367510 - DNA, 20 bp, Homo sapiens
ccatggattcccctggacat

SEQ ID NO: 4367511 - DNA, 18 bp, Homo sapiens
ccatggtagactgtgaca

SEQ ID NO: 4367512 - DNA, 17 bp, Homo sapiens
cccatggtagactgtga

SEQ ID NO: 4367513 - DNA, 20 bp, Homo sapiens
cctattttggacgtgtgagg

SEQ ID NO: 4367514 - DNA, 20 bp, Homo sapiens
cctccagccacttatttcca

SEQ ID NO: 4367515 - DNA, 22 bp, Homo sapiens
ccttctaatccatgtgctgctg

SEQ ID NO: 4367516 - DNA, 18 bp, Homo sapiens
ctaatccatgtgctgctg

SEQ ID NO: 4367517 - DNA, 13 bp, Homo sapiens
ctcctcctccagt

SEQ ID NO: 4367518 - DNA, 19 bp, Homo sapiens
ctgatatctgtttgcttct

SEQ ID NO: 4367519 - DNA, 14 bp, Homo sapiens
ctgctgtggcatca

SEQ ID NO: 4367520 - DNA, 23 bp, Homo sapiens
ctgctgtggcatcaggaaaggaa

SEQ ID NO: 4367521 - DNA, 16 bp, Homo sapiens
ctggaatctactagaa

SEQ ID NO: 4367522 - DNA, 16 bp, Homo sapiens
ctgtgacacagctgag

SEQ ID NO: 4367523 - DNA, 17 bp, Homo sapiens
ctgtgacacagctgagc

SEQ ID NO: 4367524 - DNA, 18 bp, Homo sapiens
ctgtgacacagctgagct

SEQ ID NO: 4367525 - DNA, 20 bp, Homo sapiens
gatatctgtttgcttctaaa

SEQ ID NO: 4367526 - DNA, 12 bp, Homo sapiens
gcgtaggagaga

SEQ ID NO: 4367527 - DNA, 18 bp, Homo sapiens
gctgtggcatcaggaaag

SEQ ID NO: 4367528 - DNA, 15 bp, Homo sapiens
ggcatcaggaaagga

SEQ ID NO: 4367529 - DNA, 18 bp, Homo sapiens
aaactgcgtaggagagaa

SEQ ID NO: 4367530 - DNA, 14 bp, Homo sapiens
aaagtctcctgtat

SEQ ID NO: 4367531 - DNA, 18 bp, Homo sapiens
aaatagtgtgtccatgca

SEQ ID NO: 4367532 - DNA, 14 bp, Homo sapiens
aagggccttctcca

SEQ ID NO: 4367533 - DNA, 20 bp, Homo sapiens
aatcaagtctgtgaaagtct

SEQ ID NO: 4367534 - DNA, 15 bp, Homo sapiens
aatccatgtgctgct

SEQ ID NO: 4367535 - DNA, 13 bp, Homo sapiens
actcaaggcctcc

SEQ ID NO: 4367536 - DNA, 20 bp, Homo sapiens
actgttcatgaatacgtaaa

SEQ ID NO: 4367537 - DNA, 21 bp, Homo sapiens
agactcaaggcctccagccac

SEQ ID NO: 4367538 - DNA, 17 bp, Homo sapiens
agatgtaagaagctaaa

SEQ ID NO: 4367539 - DNA, 19 bp, Homo sapiens
agccacttatttccatgga

SEQ ID NO: 4367540 - DNA, 22 bp, Homo sapiens
agggatgctatctcgctagcca

SEQ ID NO: 4367541 - DNA, 17 bp, Homo sapiens
aggtttcactgttcatg

SEQ ID NO: 4367542 - DNA, 14 bp, Homo sapiens
agtctcctgtatca

SEQ ID NO: 4367543 - DNA, 16 bp, Homo sapiens
agtctcctgtatcatt

SEQ ID NO: 4367544 - DNA, 12 bp, Homo sapiens
agttctgatgag

SEQ ID NO: 4367545 - DNA, 19 bp, Homo sapiens
atccatgtgctgctgtggc

SEQ ID NO: 4367546 - DNA, 13 bp, Homo sapiens
atctcgctagcca

SEQ ID NO: 4367547 - DNA, 20 bp, Homo sapiens
atgagtttccagctaagcct

SEQ ID NO: 4367548 - DNA, 22 bp, Homo sapiens
atgatggaagggccttctccac

SEQ ID NO: 4367549 - DNA, 20 bp, Homo sapiens
attcccatggtagactgtga

SEQ ID NO: 4367550 - DNA, 19 bp, Homo sapiens
atttcttggtatgatcatt

SEQ ID NO: 4367551 - DNA, 17 bp, Homo sapiens
attttctgagtagcata

SEQ ID NO: 4367552 - DNA, 11 bp, Homo sapiens
caagtctgtga

SEQ ID NO: 4367553 - DNA, 12 bp, Homo sapiens
caagtctgtgaa

SEQ ID NO: 4367554 - DNA, 13 bp, Homo sapiens
caagtctgtgaaa

SEQ ID NO: 4367555 - DNA, 18 bp, Homo sapiens
cacagctgagctggccta

SEQ ID NO: 4367556 - DNA, 22 bp, Homo sapiens
caccgagaggaaaaaggcttct

SEQ ID NO: 4367557 - DNA, 18 bp, Homo sapiens
cagctaagcctgatgatg

SEQ ID NO: 4367558 - DNA, 17 bp, Homo sapiens
catggtagactgtgaca

SEQ ID NO: 4367559 - DNA, 17 bp, Homo sapiens
catttcttggtatgatc

SEQ ID NO: 4367560 - DNA, 13 bp, Homo sapiens
ccagttctgatga

SEQ ID NO: 4367561 - DNA, 17 bp, Homo sapiens
ccatggtagactgtgac

SEQ ID NO: 4367562 - DNA, 12 bp, Homo sapiens
ccatgtgctgct

SEQ ID NO: 4367563 - DNA, 16 bp, Homo sapiens
cctccagttctgatga

SEQ ID NO: 4367564 - DNA, 21 bp, Homo sapiens
cctcctccagttctgatgagg

SEQ ID NO: 4367565 - DNA, 16 bp, Homo sapiens
cctggacatattccca

SEQ ID NO: 4367566 - DNA, 19 bp, Homo sapiens
ctatctcgctagccatata

SEQ ID NO: 4367567 - DNA, 18 bp, Homo sapiens
ctccagccacttatttcc

SEQ ID NO: 4367568 - DNA, 20 bp, Homo sapiens
ctgatatctgtttgcttcta

SEQ ID NO: 4367569 - DNA, 13 bp, Homo sapiens
ctgtttgcttcta

SEQ ID NO: 4367570 - DNA, 21 bp, Homo sapiens
cttctaatccatgtgctgctg

SEQ ID NO: 4367571 - DNA, 15 bp, Homo sapiens
gacatattcccatgg

SEQ ID NO: 4367572 - DNA, 15 bp, Homo sapiens
gagagaacagggatg

SEQ ID NO: 4367573 - DNA, 20 bp, Homo sapiens
gatcattggtatctgatatc

SEQ ID NO: 4367574 - DNA, 13 bp, Homo sapiens
gccttctcccctc

SEQ ID NO: 4367575 - DNA, 14 bp, Homo sapiens
gctagccatatatt

SEQ ID NO: 4367576 - DNA, 14 bp, Homo sapiens
gctgagctggccta

SEQ ID NO: 4367577 - DNA, 15 bp, Homo sapiens
gctgctgtggcatca

SEQ ID NO: 4367578 - DNA, 13 bp, Homo sapiens
ggaaaaaggcttc

SEQ ID NO: 4367579 - DNA, 12 bp, Homo sapiens
ggtatgatcatt

SEQ ID NO: 4367580 - DNA, 21 bp, Homo sapiens
ggtgcccagactcaaggcctc

SEQ ID NO: 4367581 - DNA, 23 bp, Homo sapiens
gtatctgatatctgtttgcttct

SEQ ID NO: 4367582 - DNA, 18 bp, Homo sapiens
gtctcctgtatcatttct

SEQ ID NO: 4367583 - DNA, 19 bp, Homo sapiens
gttaggattaggtttagaa

SEQ ID NO: 4367584 - DNA, 15 bp, Homo sapiens
gtttcactgttcatg

SEQ ID NO: 4367585 - DNA, 22 bp, Homo sapiens
gtttccagctaagcctgatgat

SEQ ID NO: 4367586 - DNA, 21 bp, Homo sapiens
taaaggtttcactgttcatga

SEQ ID NO: 4367587 - DNA, 16 bp, Homo sapiens
tactagaaccttctaa

SEQ ID NO: 4367588 - DNA, 13 bp, Homo sapiens
tagtgtgtccatg

SEQ ID NO: 4367589 - DNA, 17 bp, Homo sapiens
tatctcgctagccatat

SEQ ID NO: 4367590 - DNA, 19 bp, Homo sapiens
tattttggacgtgtgagga

SEQ ID NO: 4367591 - DNA, 21 bp, Homo sapiens
tccacagggacacagtctggt

SEQ ID NO: 4367592 - DNA, 14 bp, Homo sapiens
tccagttctgatga

SEQ ID NO: 4367593 - DNA, 15 bp, Homo sapiens
tccagttctgatgag

SEQ ID NO: 4367594 - DNA, 22 bp, Homo sapiens
tctaaaggtttcactgttcatg

SEQ ID NO: 4367595 - DNA, 16 bp, Homo sapiens
tctaatccatgtgctg

SEQ ID NO: 4367596 - DNA, 21 bp, Homo sapiens
tctgtgaaagtctcctgtatc

SEQ ID NO: 4367597 - DNA, 15 bp, Homo sapiens
tgatatctgtttgct

SEQ ID NO: 4367598 - DNA, 14 bp, Homo sapiens
tgatgatggaaggg

SEQ ID NO: 4367599 - DNA, 13 bp, Homo sapiens
tgctgctgtggca

SEQ ID NO: 4367600 - DNA, 14 bp, Homo sapiens
tggacgtgtgagga

SEQ ID NO: 4367601 - DNA, 22 bp, Homo sapiens
tggtgcccagactcaaggcctc

SEQ ID NO: 4367602 - DNA, 19 bp, Homo sapiens
tgtgaggatgtggatggag

SEQ ID NO: 4367603 - DNA, 23 bp, Homo sapiens
tgtggatggaggtgatgaaaacc

SEQ ID NO: 4367604 - DNA, 20 bp, Homo sapiens
ttagaatcaagtctgtgaaa

SEQ ID NO: 4367605 - DNA, 21 bp, Homo sapiens
ttccagctaagcctgatgatg

SEQ ID NO: 4367606 - DNA, 16 bp, Homo sapiens
ttctcccctccaagtg

SEQ ID NO: 4367607 - DNA, 17 bp, Homo sapiens
tttcttggtatgatcat

SEQ ID NO: 4367608 - DNA, 21 bp, Homo sapiens
gtctgtgaaagtctcctgtat

SEQ ID NO: 4367609 - DNA, 12 bp, Homo sapiens
gttcatgaatac

SEQ ID NO: 4367610 - DNA, 13 bp, Homo sapiens
gtttgcttctaaa

SEQ ID NO: 4367611 - DNA, 13 bp, Homo sapiens
taagcctgatgat

SEQ ID NO: 4367612 - DNA, 22 bp, Homo sapiens
taatccatgtgctgctgtggca

SEQ ID NO: 4367613 - DNA, 13 bp, Homo sapiens
tagaaccttctaa

SEQ ID NO: 4367614 - DNA, 15 bp, Homo sapiens
tagaatcaagtctgt

SEQ ID NO: 4367615 - DNA, 18 bp, Homo sapiens
tagaatcaagtctgtgaa

SEQ ID NO: 4367616 - DNA, 23 bp, Homo sapiens
taggtttagaatcaagtctgtga

SEQ ID NO: 4367617 - DNA, 19 bp, Homo sapiens
tataattttattgctggaa

SEQ ID NO: 4367618 - DNA, 20 bp, Homo sapiens
tatctcgctagccatatatt

SEQ ID NO: 4367619 - DNA, 11 bp, Homo sapiens
tatttccatgg

SEQ ID NO: 4367620 - DNA, 23 bp, Homo sapiens
tcaccgagaggaaaaaggcttct

SEQ ID NO: 4367621 - DNA, 22 bp, Homo sapiens
tcaggaaaggaagatgtaagaa

SEQ ID NO: 4367622 - DNA, 22 bp, Homo sapiens
tcagttaggattaggtttagaa

SEQ ID NO: 4367623 - DNA, 17 bp, Homo sapiens
tcccatggtagactgtg

SEQ ID NO: 4367624 - DNA, 23 bp, Homo sapiens
tcccatggtagactgtgacacag

SEQ ID NO: 4367625 - DNA, 22 bp, Homo sapiens
tctccacagggacacagtctgg

SEQ ID NO: 4367626 - DNA, 22 bp, Homo sapiens
tctgtgaaagtctcctgtatca

SEQ ID NO: 4367627 - DNA, 23 bp, Homo sapiens
tctgtgaaagtctcctgtatcat

SEQ ID NO: 4367628 - DNA, 12 bp, Homo sapiens
tgagtagcatat

SEQ ID NO: 4367629 - DNA, 18 bp, Homo sapiens
tgagtttccagctaagcc

SEQ ID NO: 4367630 - DNA, 19 bp, Homo sapiens
tgatatctgtttgcttcta

SEQ ID NO: 4367631 - DNA, 15 bp, Homo sapiens
tgatggaagggcctt

SEQ ID NO: 4367632 - DNA, 17 bp, Homo sapiens
tggatggaggtgatgaa

SEQ ID NO: 4367633 - DNA, 23 bp, Homo sapiens
tggcctattttggacgtgtgagg

SEQ ID NO: 4367634 - DNA, 18 bp, Homo sapiens
tgtgctgctgtggcatca

SEQ ID NO: 4367635 - DNA, 18 bp, Homo sapiens
ttagaatcaagtctgtga

SEQ ID NO: 4367636 - DNA, 19 bp, Homo sapiens
ttccagctaagcctgatga

SEQ ID NO: 4367637 - DNA, 20 bp, Homo sapiens
ttcccatggtagactgtgac

SEQ ID NO: 4367638 - DNA, 19 bp, Homo sapiens
tttagaatcaagtctgtga

SEQ ID NO: 4367639 - DNA, 21 bp, Homo sapiens
tttctgagtagcatatataat

SEQ ID NO: 4367640 - DNA, 16 bp, Homo sapiens
tttggacgtgtgagga

SEQ ID NO: 4367641 - DNA, 13 bp, Homo sapiens
gtagcatatataa

SEQ ID NO: 4367642 - DNA, 15 bp, Homo sapiens
gtctcctgtatcatt

SEQ ID NO: 4367643 - DNA, 16 bp, Homo sapiens
taatccatgtgctgct

SEQ ID NO: 4367644 - DNA, 20 bp, Homo sapiens
taatccatgtgctgctgtgg

SEQ ID NO: 4367645 - DNA, 22 bp, Homo sapiens
tactagaaccttctaatccatg

SEQ ID NO: 4367646 - DNA, 17 bp, Homo sapiens
tagaatcaagtctgtga

SEQ ID NO: 4367647 - DNA, 21 bp, Homo sapiens
taggtttagaatcaagtctgt

SEQ ID NO: 4367648 - DNA, 18 bp, Homo sapiens
tataattttattgctgga

SEQ ID NO: 4367649 - DNA, 18 bp, Homo sapiens
tatataattttattgctg

SEQ ID NO: 4367650 - DNA, 15 bp, Homo sapiens
tatctgatatctgtt

SEQ ID NO: 4367651 - DNA, 21 bp, Homo sapiens
tattcccatggtagactgtga

SEQ ID NO: 4367652 - DNA, 12 bp, Homo sapiens
tcaagtctgtga

SEQ ID NO: 4367653 - DNA, 14 bp, Homo sapiens
tcactgttcatgaa

SEQ ID NO: 4367654 - DNA, 23 bp, Homo sapiens
tccacagggacacagtctggtgc

SEQ ID NO: 4367655 - DNA, 17 bp, Homo sapiens
tccagttctgatgaggc

SEQ ID NO: 4367656 - DNA, 20 bp, Homo sapiens
tcccatggtagactgtgaca

SEQ ID NO: 4367657 - DNA, 16 bp, Homo sapiens
tctccacaacctcctc

SEQ ID NO: 4367658 - DNA, 14 bp, Homo sapiens
tctcctgtatcatt

SEQ ID NO: 4367659 - DNA, 15 bp, Homo sapiens
tcttggtatgatcat

SEQ ID NO: 4367660 - DNA, 13 bp, Homo sapiens
tgctgtggcatca

SEQ ID NO: 4367661 - DNA, 18 bp, Homo sapiens
tggaagggccttctccac

SEQ ID NO: 4367662 - DNA, 14 bp, Homo sapiens
tggattcccctgga

SEQ ID NO: 4367663 - DNA, 15 bp, Homo sapiens
tgtgaaagtctcctg

SEQ ID NO: 4367664 - DNA, 19 bp, Homo sapiens
ttcccatggtagactgtga

SEQ ID NO: 4367665 - DNA, 14 bp, Homo sapiens
ttctaatccatgtg

SEQ ID NO: 4367666 - DNA, 14 bp, Homo sapiens
ttcttggtatgatc

SEQ ID NO: 4367667 - DNA, 16 bp, Homo sapiens
ttcttggtatgatcat

SEQ ID NO: 4367668 - DNA, 22 bp, Homo sapiens
tttctgagtagcatatataatt

SEQ ID NO: 4367669 - DNA, 13 bp, Homo sapiens
ttttattgctgga

SEQ ID NO: 4367670 - DNA, 14 bp, Homo sapiens
aaaaaaaaaacact

SEQ ID NO: 4367671 - DNA, 13 bp, Homo sapiens
aaaaaaaaacaaa

SEQ ID NO: 4367672 - DNA, 13 bp, Homo sapiens
aaaaaaaacactt

SEQ ID NO: 4367673 - DNA, 12 bp, Homo sapiens
aaaaaaaataca

SEQ ID NO: 4367674 - DNA, 13 bp, Homo sapiens
aaaaaaaattgta

SEQ ID NO: 4367675 - DNA, 11 bp, Homo sapiens
aaaaaaacttt

SEQ ID NO: 4367676 - DNA, 11 bp, Homo sapiens
aaaaaaagctt

SEQ ID NO: 4367677 - DNA, 12 bp, Homo sapiens
aaaaaaatacaa

SEQ ID NO: 4367678 - DNA, 13 bp, Homo sapiens
aaaaaaatgttgt

SEQ ID NO: 4367679 - DNA, 19 bp, Homo sapiens
aaaaaacacttggcataca

SEQ ID NO: 4367680 - DNA, 11 bp, Homo sapiens
aaaaaagatga

SEQ ID NO: 4367681 - DNA, 12 bp, Homo sapiens
aaaaaagatttt

SEQ ID NO: 4367682 - DNA, 21 bp, Homo sapiens
aaaaaagcacaaagttctcag

SEQ ID NO: 4367683 - DNA, 13 bp, Homo sapiens
aaaaaagggctga

SEQ ID NO: 4367684 - DNA, 17 bp, Homo sapiens
aaaaaagtctctattta

SEQ ID NO: 4367685 - DNA, 21 bp, Homo sapiens
aaaaaagtttttaatttgatg

SEQ ID NO: 4367686 - DNA, 10 bp, Homo sapiens
aaaaaataca

SEQ ID NO: 4367687 - DNA, 16 bp, Homo sapiens
aaaaaatgtatatgca

SEQ ID NO: 4367688 - DNA, 13 bp, Homo sapiens
aaaaaatgttgtt

SEQ ID NO: 4367689 - DNA, 10 bp, Homo sapiens
aaaaaattaa

SEQ ID NO: 4367690 - DNA, 12 bp, Homo sapiens
aaaaaatttgta

SEQ ID NO: 4367691 - DNA, 12 bp, Homo sapiens
aaaaaatttgtc

SEQ ID NO: 4367692 - DNA, 12 bp, Homo sapiens
aaaaacaaagct

SEQ ID NO: 4367693 - DNA, 16 bp, Homo sapiens
aaaaacaaatgttcat

SEQ ID NO: 4367694 - DNA, 22 bp, Homo sapiens
aaaaacaataaagatacatgat

SEQ ID NO: 4367695 - DNA, 13 bp, Homo sapiens
aaaaacacagcaa

SEQ ID NO: 4367696 - DNA, 23 bp, Homo sapiens
aaaaacattctatctactgattt

SEQ ID NO: 4367697 - DNA, 15 bp, Homo sapiens
aaaaacattgccttt

SEQ ID NO: 4367698 - DNA, 11 bp, Homo sapiens
aaaaacatttt

SEQ ID NO: 4367699 - DNA, 16 bp, Homo sapiens
aaaaacattttgaagt

SEQ ID NO: 4367700 - DNA, 23 bp, Homo sapiens
aaaaaccatgttgcgttcaaaga

SEQ ID NO: 4367701 - DNA, 17 bp, Homo sapiens
aaaaactaaaaactaga

SEQ ID NO: 4367702 - DNA, 14 bp, Homo sapiens
aaaaactgtaaaag

SEQ ID NO: 4367703 - DNA, 19 bp, Homo sapiens
aaaaactgtataaggagat

SEQ ID NO: 4367704 - DNA, 22 bp, Homo sapiens
aaaaacttcatgtaattttatt

SEQ ID NO: 4367705 - DNA, 20 bp, Homo sapiens
aaaaacttttaggttgttac

SEQ ID NO: 4367706 - DNA, 18 bp, Homo sapiens
aaaaacttttataaatta

SEQ ID NO: 4367707 - DNA, 23 bp, Homo sapiens
aaaaagaaaggctgttaaataca

SEQ ID NO: 4367708 - DNA, 16 bp, Homo sapiens
aaaaagaacttttgta

SEQ ID NO: 4367709 - DNA, 15 bp, Homo sapiens
aaaaagaagccacag

SEQ ID NO: 4367710 - DNA, 14 bp, Homo sapiens
aaaaagaagtgctg

SEQ ID NO: 4367711 - DNA, 20 bp, Homo sapiens
aaaaagacagcgataagctt

SEQ ID NO: 4367712 - DNA, 16 bp, Homo sapiens
aaaaagcaaaaacaat

SEQ ID NO: 4367713 - DNA, 23 bp, Homo sapiens
aaaaagcacaaagttctcagagc

SEQ ID NO: 4367714 - DNA, 17 bp, Homo sapiens
aaaaagcatatataact

SEQ ID NO: 4367715 - DNA, 17 bp, Homo sapiens
aaaaagctaatgtgcag

SEQ ID NO: 4367716 - DNA, 20 bp, Homo sapiens
aaaaagcttaaaactttgaa

SEQ ID NO: 4367717 - DNA, 19 bp, Homo sapiens
aaaaagctttatgattttc

SEQ ID NO: 4367718 - DNA, 15 bp, Homo sapiens
aaaaaggcaaatatt

SEQ ID NO: 4367719 - DNA, 15 bp, Homo sapiens
aaaaagggaggggga

SEQ ID NO: 4367720 - DNA, 16 bp, Homo sapiens
aaaaagggagtttttg

SEQ ID NO: 4367721 - DNA, 23 bp, Homo sapiens
aaaaagggtcaatgctatttttg

SEQ ID NO: 4367722 - DNA, 20 bp, Homo sapiens
aaaaagtcaatgtacttgtt

SEQ ID NO: 4367723 - DNA, 14 bp, Homo sapiens
aaaaagtcagatgt

SEQ ID NO: 4367724 - DNA, 16 bp, Homo sapiens
aaaaagtccaatttta

SEQ ID NO: 4367725 - DNA, 18 bp, Homo sapiens
aaaaagtctaccaaagga

SEQ ID NO: 4367726 - DNA, 18 bp, Homo sapiens
aaaaagtctctatttaaa

SEQ ID NO: 4367727 - DNA, 23 bp, Homo sapiens
aaaaagtctctatttaaattctt

SEQ ID NO: 4367728 - DNA, 16 bp, Homo sapiens
aaaaagtgattgtgaa

SEQ ID NO: 4367729 - DNA, 17 bp, Homo sapiens
aaaaagtgattgtgaag

SEQ ID NO: 4367730 - DNA, 22 bp, Homo sapiens
aaaaagtggggcagagcctccc

SEQ ID NO: 4367731 - DNA, 15 bp, Homo sapiens
aaaaagttgaaccat

SEQ ID NO: 4367732 - DNA, 21 bp, Homo sapiens
aaaaagttgaaccattatact

SEQ ID NO: 4367733 - DNA, 13 bp, Homo sapiens
aaaaagtttgttt

SEQ ID NO: 4367734 - DNA, 15 bp, Homo sapiens
aaaaataactgagat

SEQ ID NO: 4367735 - DNA, 22 bp, Homo sapiens
aaaaataagaagaatgcttaat

SEQ ID NO: 4367736 - DNA, 21 bp, Homo sapiens
aaaaataagtcaacagtaaac

SEQ ID NO: 4367737 - DNA, 13 bp, Homo sapiens
aaaaatacaaaaa

SEQ ID NO: 4367738 - DNA, 18 bp, Homo sapiens
aaaaatagatgtctttta

SEQ ID NO: 4367739 - DNA, 21 bp, Homo sapiens
aaaaatagctaaatacctcaa

SEQ ID NO: 4367740 - DNA, 12 bp, Homo sapiens
aaaaatatgtat

SEQ ID NO: 4367741 - DNA, 11 bp, Homo sapiens
aaaaatattgt

SEQ ID NO: 4367742 - DNA, 12 bp, Homo sapiens
aaaaatattgtt

SEQ ID NO: 4367743 - DNA, 23 bp, Homo sapiens
aaaaatattgtttctgcattcat

SEQ ID NO: 4367744 - DNA, 23 bp, Homo sapiens
aaaaatcaactttttattgcctt

SEQ ID NO: 4367745 - DNA, 20 bp, Homo sapiens
aaaaatcctgcccaaaatgt

SEQ ID NO: 4367746 - DNA, 23 bp, Homo sapiens
aaaaatcctgcccaaaatgtgaa

SEQ ID NO: 4367747 - DNA, 10 bp, Homo sapiens
aaaaatctca

SEQ ID NO: 4367748 - DNA, 19 bp, Homo sapiens
aaaaatctcaattgaaagc

SEQ ID NO: 4367749 - DNA, 20 bp, Homo sapiens
aaaaatctcattatttcaaa

SEQ ID NO: 4367750 - DNA, 23 bp, Homo sapiens
aaaaatctcattatttcaaaatg

SEQ ID NO: 4367751 - DNA, 15 bp, Homo sapiens
aaaaatgagatttct

SEQ ID NO: 4367752 - DNA, 16 bp, Homo sapiens
aaaaatgagatttctt

SEQ ID NO: 4367753 - DNA, 18 bp, Homo sapiens
aaaaatgccatcaaatga

SEQ ID NO: 4367754 - DNA, 18 bp, Homo sapiens
aaaaatgggtcttttata

SEQ ID NO: 4367755 - DNA, 17 bp, Homo sapiens
aaaaatggtttaaatgg

SEQ ID NO: 4367756 - DNA, 18 bp, Homo sapiens
aaaaatgtggtttgtaca

SEQ ID NO: 4367757 - DNA, 11 bp, Homo sapiens
aaaaattaaaa

SEQ ID NO: 4367758 - DNA, 14 bp, Homo sapiens
aaaaattaaatatt

SEQ ID NO: 4367759 - DNA, 22 bp, Homo sapiens
aaaaattacatatataaaacta

SEQ ID NO: 4367760 - DNA, 15 bp, Homo sapiens
aaaaattatcaaaaa

SEQ ID NO: 4367761 - DNA, 19 bp, Homo sapiens
aaaaattatctatagctaa

SEQ ID NO: 4367762 - DNA, 20 bp, Homo sapiens
aaaaattcagcaaagtggtt

SEQ ID NO: 4367763 - DNA, 13 bp, Homo sapiens
aaaaattgaaata

SEQ ID NO: 4367764 - DNA, 19 bp, Homo sapiens
aaaaattgctctgtgtata

SEQ ID NO: 4367765 - DNA, 11 bp, Homo sapiens
aaaaatttaaa

SEQ ID NO: 4367766 - DNA, 22 bp, Homo sapiens
aaaaatttattatatatttaca

SEQ ID NO: 4367767 - DNA, 23 bp, Homo sapiens
aaaaatttattatatatttacag

SEQ ID NO: 4367768 - DNA, 15 bp, Homo sapiens
aaaaatttgtataag

SEQ ID NO: 4367769 - DNA, 14 bp, Homo sapiens
aaaaattttgaatg

SEQ ID NO: 4367770 - DNA, 16 bp, Homo sapiens
aaaaattttgactttt

SEQ ID NO: 4367771 - DNA, 15 bp, Homo sapiens
aaaacaaaaagatgt

SEQ ID NO: 4367772 - DNA, 11 bp, Homo sapiens
aaaacaaaaga

SEQ ID NO: 4367773 - DNA, 12 bp, Homo sapiens
aaaacaaaagag

SEQ ID NO: 4367774 - DNA, 18 bp, Homo sapiens
aaaacaaatatttcactt

SEQ ID NO: 4367775 - DNA, 15 bp, Homo sapiens
aaaacaataatgcaa

SEQ ID NO: 4367776 - DNA, 21 bp, Homo sapiens
aaaacaatattactttgtctt

SEQ ID NO: 4367777 - DNA, 13 bp, Homo sapiens
aaaacaatctatt

SEQ ID NO: 4367778 - DNA, 22 bp, Homo sapiens
aaaacaatgtattgctgataat

SEQ ID NO: 4367779 - DNA, 13 bp, Homo sapiens
aaaacacagcaag

SEQ ID NO: 4367780 - DNA, 14 bp, Homo sapiens
aaaacacatgatac

SEQ ID NO: 4367781 - DNA, 15 bp, Homo sapiens
aaaacactgccctct

SEQ ID NO: 4367782 - DNA, 19 bp, Homo sapiens
aaaacacttggcatacaaa

SEQ ID NO: 4367783 - DNA, 18 bp, Homo sapiens
aaaacaggcaaagtttta

SEQ ID NO: 4367784 - DNA, 23 bp, Homo sapiens
aaaacagggccacatagatgctg

SEQ ID NO: 4367785 - DNA, 17 bp, Homo sapiens
aaaacaggtagaattat

SEQ ID NO: 4367786 - DNA, 17 bp, Homo sapiens
aaaacataatcttctgc

SEQ ID NO: 4367787 - DNA, 18 bp, Homo sapiens
aaaacataatcttctgcc

SEQ ID NO: 4367788 - DNA, 16 bp, Homo sapiens
aaaacatctagcccaa

SEQ ID NO: 4367789 - DNA, 15 bp, Homo sapiens
aaaacatgtttattt

SEQ ID NO: 4367790 - DNA, 12 bp, Homo sapiens
aaaacattctat

SEQ ID NO: 4367791 - DNA, 22 bp, Homo sapiens
aaaacattgcctttgaatgtta

SEQ ID NO: 4367792 - DNA, 17 bp, Homo sapiens
aaaacatttactgacca

SEQ ID NO: 4367793 - DNA, 12 bp, Homo sapiens
aaaacatttatt

SEQ ID NO: 4367794 - DNA, 16 bp, Homo sapiens
aaaacatttattttga

SEQ ID NO: 4367795 - DNA, 18 bp, Homo sapiens
aaaacatttgattaataa

SEQ ID NO: 4367796 - DNA, 18 bp, Homo sapiens
aaaacattttttatacat

SEQ ID NO: 4367797 - DNA, 13 bp, Homo sapiens
aaaaccaaaatga

SEQ ID NO: 4367798 - DNA, 22 bp, Homo sapiens
aaaaccaaagagggcttcctct

SEQ ID NO: 4367799 - DNA, 12 bp, Homo sapiens
aaaacccagaga

SEQ ID NO: 4367800 - DNA, 19 bp, Homo sapiens
aaaacctgattggccactg

SEQ ID NO: 4367801 - DNA, 23 bp, Homo sapiens
aaaacgggcagtctgctctgctg

SEQ ID NO: 4367802 - DNA, 17 bp, Homo sapiens
aaaacgtcttccttctt

SEQ ID NO: 4367803 - DNA, 15 bp, Homo sapiens
aaaactagcaactct

SEQ ID NO: 4367804 - DNA, 17 bp, Homo sapiens
aaaactaggctcaaaat

SEQ ID NO: 4367805 - DNA, 23 bp, Homo sapiens
aaaactatgtgttcaatgaaata

SEQ ID NO: 4367806 - DNA, 19 bp, Homo sapiens
aaaactcactcactgttta

SEQ ID NO: 4367807 - DNA, 12 bp, Homo sapiens
aaaactcagcct

SEQ ID NO: 4367808 - DNA, 18 bp, Homo sapiens
aaaactcatcacataaag

SEQ ID NO: 4367809 - DNA, 19 bp, Homo sapiens
aaaactcatcacataaaga

SEQ ID NO: 4367810 - DNA, 21 bp, Homo sapiens
aaaactcatcacataaagaaa

SEQ ID NO: 4367811 - DNA, 20 bp, Homo sapiens
aaaactcccaatacaaagat

SEQ ID NO: 4367812 - DNA, 17 bp, Homo sapiens
aaaactctggtgataaa

SEQ ID NO: 4367813 - DNA, 12 bp, Homo sapiens
aaaactctttga

SEQ ID NO: 4367814 - DNA, 16 bp, Homo sapiens
aaaactgacttaatgc

SEQ ID NO: 4367815 - DNA, 13 bp, Homo sapiens
aaaactgctttat

SEQ ID NO: 4367816 - DNA, 12 bp, Homo sapiens
aaaactgggata

SEQ ID NO: 4367817 - DNA, 21 bp, Homo sapiens
aaaactgggataactgatttc

SEQ ID NO: 4367818 - DNA, 22 bp, Homo sapiens
aaaactgggataactgatttct

SEQ ID NO: 4367819 - DNA, 23 bp, Homo sapiens
aaaactgggataactgatttcta

SEQ ID NO: 4367820 - DNA, 12 bp, Homo sapiens
aaaactgtgttg

SEQ ID NO: 4367821 - DNA, 20 bp, Homo sapiens
aaaactgtttgacttctcaa

SEQ ID NO: 4367822 - DNA, 17 bp, Homo sapiens
aaaacttaaaaattaat

SEQ ID NO: 4367823 - DNA, 19 bp, Homo sapiens
aaaacttaaaaattaatat

SEQ ID NO: 4367824 - DNA, 21 bp, Homo sapiens
aaaacttcagtttcacagaaa

SEQ ID NO: 4367825 - DNA, 17 bp, Homo sapiens
aaaacttcatgtaattt

SEQ ID NO: 4367826 - DNA, 20 bp, Homo sapiens
aaaacttggacccttggaaa

SEQ ID NO: 4367827 - DNA, 22 bp, Homo sapiens
aaaacttgtgtgaaattttctt

SEQ ID NO: 4367828 - DNA, 19 bp, Homo sapiens
aaaactttaaagataagtc

SEQ ID NO: 4367829 - DNA, 15 bp, Homo sapiens
aaaacttttataaat

SEQ ID NO: 4367830 - DNA, 22 bp, Homo sapiens
aaaacttttataaattaaatat

SEQ ID NO: 4367831 - DNA, 22 bp, Homo sapiens
aaaagaaaatctttataaatgt

SEQ ID NO: 4367832 - DNA, 23 bp, Homo sapiens
aaaagaaatatacagtttgactt

SEQ ID NO: 4367833 - DNA, 14 bp, Homo sapiens
aaaagaaatcaata

SEQ ID NO: 4367834 - DNA, 19 bp, Homo sapiens
aaaagaaatcatgtccata

SEQ ID NO: 4367835 - DNA, 22 bp, Homo sapiens
aaaagaacatgcagtttgaaat

SEQ ID NO: 4367836 - DNA, 11 bp, Homo sapiens
aaaagaagtaa

SEQ ID NO: 4367837 - DNA, 13 bp, Homo sapiens
aaaagaataagac

SEQ ID NO: 4367838 - DNA, 13 bp, Homo sapiens
aaaagaatttgtt

SEQ ID NO: 4367839 - DNA, 23 bp, Homo sapiens
aaaagacaattttttttcaaatg

SEQ ID NO: 4367840 - DNA, 11 bp, Homo sapiens
aaaagacattt

SEQ ID NO: 4367841 - DNA, 13 bp, Homo sapiens
aaaagacattttt

SEQ ID NO: 4367842 - DNA, 16 bp, Homo sapiens
aaaagaccaaatctca

SEQ ID NO: 4367843 - DNA, 23 bp, Homo sapiens
aaaagactattttctattttccc

SEQ ID NO: 4367844 - DNA, 22 bp, Homo sapiens
aaaagagcatggatgcatttca

SEQ ID NO: 4367845 - DNA, 23 bp, Homo sapiens
aaaagagcgatacacaaagcttt

SEQ ID NO: 4367846 - DNA, 22 bp, Homo sapiens
aaaagataaagaccagaaattc

SEQ ID NO: 4367847 - DNA, 14 bp, Homo sapiens
aaaagataaagagt

SEQ ID NO: 4367848 - DNA, 16 bp, Homo sapiens
aaaagatccttcattt

SEQ ID NO: 4367849 - DNA, 17 bp, Homo sapiens
aaaagatccttcatttt

SEQ ID NO: 4367850 - DNA, 21 bp, Homo sapiens
aaaagatccttcattttagat

SEQ ID NO: 4367851 - DNA, 15 bp, Homo sapiens
aaaagatgtaataat

SEQ ID NO: 4367852 - DNA, 21 bp, Homo sapiens
aaaagattgctgaaattttat

SEQ ID NO: 4367853 - DNA, 17 bp, Homo sapiens
aaaagattgtattgctg

SEQ ID NO: 4367854 - DNA, 21 bp, Homo sapiens
aaaagcaaaataaaaactatt

SEQ ID NO: 4367855 - DNA, 18 bp, Homo sapiens
aaaagcaattatattgtc

SEQ ID NO: 4367856 - DNA, 18 bp, Homo sapiens
aaaagcaattctgactgt

SEQ ID NO: 4367857 - DNA, 18 bp, Homo sapiens
aaaagcacacacaataaa

SEQ ID NO: 4367858 - DNA, 10 bp, Homo sapiens
aaaagcattt

SEQ ID NO: 4367859 - DNA, 17 bp, Homo sapiens
aaaagcgcgttgtgtat

SEQ ID NO: 4367860 - DNA, 15 bp, Homo sapiens
aaaagctcatttcat

SEQ ID NO: 4367861 - DNA, 22 bp, Homo sapiens
aaaagctccatgtgcctctttg

SEQ ID NO: 4367862 - DNA, 14 bp, Homo sapiens
aaaagctcttttaa

SEQ ID NO: 4367863 - DNA, 15 bp, Homo sapiens
aaaagctcttttaat

SEQ ID NO: 4367864 - DNA, 15 bp, Homo sapiens
aaaagcttacaaata

SEQ ID NO: 4367865 - DNA, 11 bp, Homo sapiens
aaaagctttat

SEQ ID NO: 4367866 - DNA, 20 bp, Homo sapiens
aaaagctttatgattttcat

SEQ ID NO: 4367867 - DNA, 14 bp, Homo sapiens
aaaagctttttatt

SEQ ID NO: 4367868 - DNA, 14 bp, Homo sapiens
aaaaggaaagtttg

SEQ ID NO: 4367869 - DNA, 19 bp, Homo sapiens
aaaaggagccttttgctct

SEQ ID NO: 4367870 - DNA, 17 bp, Homo sapiens
aaaaggatagtattttt

SEQ ID NO: 4367871 - DNA, 15 bp, Homo sapiens
aaaaggcctcttgta

SEQ ID NO: 4367872 - DNA, 21 bp, Homo sapiens
aaaaggcctcttgtaaagact

SEQ ID NO: 4367873 - DNA, 17 bp, Homo sapiens
aaaaggctgagaaggaa

SEQ ID NO: 4367874 - DNA, 19 bp, Homo sapiens
aaaagggagtttaaaaatg

SEQ ID NO: 4367875 - DNA, 22 bp, Homo sapiens
aaaagggcttcggccacaggca

SEQ ID NO: 4367876 - DNA, 15 bp, Homo sapiens
aaaagggtgtatagt

SEQ ID NO: 4367877 - DNA, 14 bp, Homo sapiens
aaaaggtcctgtaa

SEQ ID NO: 4367878 - DNA, 16 bp, Homo sapiens
aaaaggtcctgtaaga

SEQ ID NO: 4367879 - DNA, 22 bp, Homo sapiens
aaaaggtgcctgtgaggcaggg

SEQ ID NO: 4367880 - DNA, 15 bp, Homo sapiens
aaaaggttgaataat

SEQ ID NO: 4367881 - DNA, 14 bp, Homo sapiens
aaaagtaatgaaga

SEQ ID NO: 4367882 - DNA, 16 bp, Homo sapiens
aaaagtacattgctta

SEQ ID NO: 4367883 - DNA, 17 bp, Homo sapiens
aaaagtatattaaacaa

SEQ ID NO: 4367884 - DNA, 22 bp, Homo sapiens
aaaagtatattaaacaaagttt

SEQ ID NO: 4367885 - DNA, 13 bp, Homo sapiens
aaaagtccaattt

SEQ ID NO: 4367886 - DNA, 22 bp, Homo sapiens
aaaagtccaattttaatttagt

SEQ ID NO: 4367887 - DNA, 16 bp, Homo sapiens
aaaagtccctccctgc

SEQ ID NO: 4367888 - DNA, 16 bp, Homo sapiens
aaaagtcgttttccaa

SEQ ID NO: 4367889 - DNA, 21 bp, Homo sapiens
aaaagtgcaatgcgtgttgta

SEQ ID NO: 4367890 - DNA, 13 bp, Homo sapiens
aaaagtggggcag

SEQ ID NO: 4367891 - DNA, 14 bp, Homo sapiens
aaaagtggggcaga

SEQ ID NO: 4367892 - DNA, 13 bp, Homo sapiens
aaaagttcatgtt

SEQ ID NO: 4367893 - DNA, 18 bp, Homo sapiens
aaaagtttgaaaagcaat

SEQ ID NO: 4367894 - DNA, 19 bp, Homo sapiens
aaaagttttgaaggaaacc

SEQ ID NO: 4367895 - DNA, 19 bp, Homo sapiens
aaaataaaaaatctgaaga

SEQ ID NO: 4367896 - DNA, 12 bp, Homo sapiens
aaaataaaactg

SEQ ID NO: 4367897 - DNA, 14 bp, Homo sapiens
aaaataaaactgtc

SEQ ID NO: 4367898 - DNA, 13 bp, Homo sapiens
aaaataaaatgaa

SEQ ID NO: 4367899 - DNA, 22 bp, Homo sapiens
aaaataaacagacaaaaacaag

SEQ ID NO: 4367900 - DNA, 12 bp, Homo sapiens
aaaataaagaca

SEQ ID NO: 4367901 - DNA, 20 bp, Homo sapiens
aaaataaagcttacatagtt

SEQ ID NO: 4367902 - DNA, 14 bp, Homo sapiens
aaaataaatttata

SEQ ID NO: 4367903 - DNA, 20 bp, Homo sapiens
aaaataaatttatatgaaaa

SEQ ID NO: 4367904 - DNA, 19 bp, Homo sapiens
aaaataacaactatttttg

SEQ ID NO: 4367905 - DNA, 14 bp, Homo sapiens
aaaataagtcaaca

SEQ ID NO: 4367906 - DNA, 12 bp, Homo sapiens
aaaataatacaa

SEQ ID NO: 4367907 - DNA, 21 bp, Homo sapiens
aaaataatctatattaaatga

SEQ ID NO: 4367908 - DNA, 23 bp, Homo sapiens
aaaataatgtactgaattcttta

SEQ ID NO: 4367909 - DNA, 19 bp, Homo sapiens
aaaataattatttattaca

SEQ ID NO: 4367910 - DNA, 10 bp, Homo sapiens
aaaatacatg

SEQ ID NO: 4367911 - DNA, 15 bp, Homo sapiens
aaaataccagagcct

SEQ ID NO: 4367912 - DNA, 19 bp, Homo sapiens
aaaataccagagccttcaa

SEQ ID NO: 4367913 - DNA, 18 bp, Homo sapiens
aaaatacctcaggaaaga

SEQ ID NO: 4367914 - DNA, 24 bp, Homo sapiens
aaaatacctcaggaaagaatagaa

SEQ ID NO: 4367915 - DNA, 19 bp, Homo sapiens
aaaatactttttctaatga

SEQ ID NO: 4367916 - DNA, 17 bp, Homo sapiens
aaaatagaaaaagtgga

SEQ ID NO: 4367917 - DNA, 21 bp, Homo sapiens
aaaatagaaattttgtaagaa

SEQ ID NO: 4367918 - DNA, 13 bp, Homo sapiens
aaaatagacactc

SEQ ID NO: 4367919 - DNA, 17 bp, Homo sapiens
aaaatagagcaaaatca

SEQ ID NO: 4367920 - DNA, 18 bp, Homo sapiens
aaaatagagcaaaatcaa

SEQ ID NO: 4367921 - DNA, 14 bp, Homo sapiens
aaaatagatgtctt

SEQ ID NO: 4367922 - DNA, 21 bp, Homo sapiens
aaaatagcaataactgaaaat

SEQ ID NO: 4367923 - DNA, 16 bp, Homo sapiens
aaaataggctttttaa

SEQ ID NO: 4367924 - DNA, 17 bp, Homo sapiens
aaaataggctttttaat

SEQ ID NO: 4367925 - DNA, 21 bp, Homo sapiens
aaaataggctttttaatcatg

SEQ ID NO: 4367926 - DNA, 22 bp, Homo sapiens
aaaatagggactatctatctta

SEQ ID NO: 4367927 - DNA, 19 bp, Homo sapiens
aaaatagtgtaagaactgt

SEQ ID NO: 4367928 - DNA, 20 bp, Homo sapiens
aaaatagtgtaagaactgta

SEQ ID NO: 4367929 - DNA, 16 bp, Homo sapiens
aaaatagtttggatat

SEQ ID NO: 4367930 - DNA, 16 bp, Homo sapiens
aaaatataaattgtac

SEQ ID NO: 4367931 - DNA, 19 bp, Homo sapiens
aaaatataaattgtacatt

SEQ ID NO: 4367932 - DNA, 13 bp, Homo sapiens
aaaatatacaaaa

SEQ ID NO: 4367933 - DNA, 15 bp, Homo sapiens
aaaatatagagacag

SEQ ID NO: 4367934 - DNA, 13 bp, Homo sapiens
aaaatatatacta

SEQ ID NO: 4367935 - DNA, 17 bp, Homo sapiens
aaaatatatactaaaca

SEQ ID NO: 4367936 - DNA, 17 bp, Homo sapiens
aaaatatatgaagacaa

SEQ ID NO: 4367937 - DNA, 16 bp, Homo sapiens
aaaatattgtttctgc

SEQ ID NO: 4367938 - DNA, 23 bp, Homo sapiens
aaaatattgtttctgcattcatt

SEQ ID NO: 4367939 - DNA, 20 bp, Homo sapiens
aaaatatttaaaaatgtctt

SEQ ID NO: 4367940 - DNA, 14 bp, Homo sapiens
aaaatatttaagtg

SEQ ID NO: 4367941 - DNA, 18 bp, Homo sapiens
aaaatatttaatatcaaa

SEQ ID NO: 4367942 - DNA, 13 bp, Homo sapiens
aaaatattttctc

SEQ ID NO: 4367943 - DNA, 23 bp, Homo sapiens
aaaatattttctctgtacttttc

SEQ ID NO: 4367944 - DNA, 19 bp, Homo sapiens
aaaatatttttttaagaaa

SEQ ID NO: 4367945 - DNA, 13 bp, Homo sapiens
aaaatcaactttt

SEQ ID NO: 4367946 - DNA, 21 bp, Homo sapiens
aaaatcaactttttattgcct

SEQ ID NO: 4367947 - DNA, 22 bp, Homo sapiens
aaaatcaactttttattgcctt

SEQ ID NO: 4367948 - DNA, 14 bp, Homo sapiens
aaaatcacaatttt

SEQ ID NO: 4367949 - DNA, 20 bp, Homo sapiens
aaaatcatattctaacttat

SEQ ID NO: 4367950 - DNA, 15 bp, Homo sapiens
aaaatcatcagaaag

SEQ ID NO: 4367951 - DNA, 18 bp, Homo sapiens
aaaatcatgccagtattt

SEQ ID NO: 4367952 - DNA, 15 bp, Homo sapiens
aaaatcatgtttatt

SEQ ID NO: 4367953 - DNA, 15 bp, Homo sapiens
aaaatccaaaaagct

SEQ ID NO: 4367954 - DNA, 22 bp, Homo sapiens
aaaatcctgaactttctccctc

SEQ ID NO: 4367955 - DNA, 21 bp, Homo sapiens
aaaatcctgcccaaaatgtga

SEQ ID NO: 4367956 - DNA, 19 bp, Homo sapiens
aaaatctcccattttggaa

SEQ ID NO: 4367957 - DNA, 21 bp, Homo sapiens
aaaatctcccattttggaatt

SEQ ID NO: 4367958 - DNA, 23 bp, Homo sapiens
aaaatctgaagaggcttctcctg

SEQ ID NO: 4367959 - DNA, 13 bp, Homo sapiens
aaaatctgcctgg

SEQ ID NO: 4367960 - DNA, 15 bp, Homo sapiens
aaaatctgctgttaa

SEQ ID NO: 4367961 - DNA, 11 bp, Homo sapiens
aaaatctgtga

SEQ ID NO: 4367962 - DNA, 12 bp, Homo sapiens
aaaatgaaagaa

SEQ ID NO: 4367963 - DNA, 19 bp, Homo sapiens
aaaatgaaagctactcata

SEQ ID NO: 4367964 - DNA, 20 bp, Homo sapiens
aaaatgaacctgcaagcctt

SEQ ID NO: 4367965 - DNA, 22 bp, Homo sapiens
aaaatgaattgaaaaacaattt

SEQ ID NO: 4367966 - DNA, 16 bp, Homo sapiens
aaaatgacatcttttt

SEQ ID NO: 4367967 - DNA, 18 bp, Homo sapiens
aaaatgagcatacatctt

SEQ ID NO: 4367968 - DNA, 15 bp, Homo sapiens
aaaatgagccctggc

SEQ ID NO: 4367969 - DNA, 23 bp, Homo sapiens
aaaatgagctcgcatttgtcaat

SEQ ID NO: 4367970 - DNA, 16 bp, Homo sapiens
aaaatgagcttgatta

SEQ ID NO: 4367971 - DNA, 18 bp, Homo sapiens
aaaatgatagacatatac

SEQ ID NO: 4367972 - DNA, 12 bp, Homo sapiens
aaaatgcaatat

SEQ ID NO: 4367973 - DNA, 15 bp, Homo sapiens
aaaatgcaatatttg

SEQ ID NO: 4367974 - DNA, 20 bp, Homo sapiens
aaaatgcacccatcagcact

SEQ ID NO: 4367975 - DNA, 18 bp, Homo sapiens
aaaatgcacttctattta

SEQ ID NO: 4367976 - DNA, 16 bp, Homo sapiens
aaaatgctcaatttca

SEQ ID NO: 4367977 - DNA, 18 bp, Homo sapiens
aaaatgctccccacagcg

SEQ ID NO: 4367978 - DNA, 14 bp, Homo sapiens
aaaatgcttcaaag

SEQ ID NO: 4367979 - DNA, 19 bp, Homo sapiens
aaaatgctttttatttctg

SEQ ID NO: 4367980 - DNA, 13 bp, Homo sapiens
aaaatggatacat

SEQ ID NO: 4367981 - DNA, 14 bp, Homo sapiens
aaaatggatacata

SEQ ID NO: 4367982 - DNA, 21 bp, Homo sapiens
aaaatggatgccttgaataat

SEQ ID NO: 4367983 - DNA, 21 bp, Homo sapiens
aaaatggcagggggtggaatt

SEQ ID NO: 4367984 - DNA, 19 bp, Homo sapiens
aaaatggcgaacatgtgtt

SEQ ID NO: 4367985 - DNA, 17 bp, Homo sapiens
aaaatgggtcttttata

SEQ ID NO: 4367986 - DNA, 18 bp, Homo sapiens
aaaatggtttaaatggtc

SEQ ID NO: 4367987 - DNA, 16 bp, Homo sapiens
aaaatgtaataacttt

SEQ ID NO: 4367988 - DNA, 14 bp, Homo sapiens
aaaatgtacttaaa

SEQ ID NO: 4367989 - DNA, 20 bp, Homo sapiens
aaaatgtataaaaattatca

SEQ ID NO: 4367990 - DNA, 14 bp, Homo sapiens
aaaatgtattcctt

SEQ ID NO: 4367991 - DNA, 18 bp, Homo sapiens
aaaatgtattcctttaaa

SEQ ID NO: 4367992 - DNA, 20 bp, Homo sapiens
aaaatgtattcctttaaaat

SEQ ID NO: 4367993 - DNA, 21 bp, Homo sapiens
aaaatgtattcctttaaaata

SEQ ID NO: 4367994 - DNA, 23 bp, Homo sapiens
aaaatgtattcctttaaaatatt

SEQ ID NO: 4367995 - DNA, 18 bp, Homo sapiens
aaaatgtcttgtgttacc

SEQ ID NO: 4367996 - DNA, 21 bp, Homo sapiens
aaaatgtctttccaaattatt

SEQ ID NO: 4367997 - DNA, 13 bp, Homo sapiens
aaaatgtgaaaaa

SEQ ID NO: 4367998 - DNA, 15 bp, Homo sapiens
aaaatgtgaaatgct

SEQ ID NO: 4367999 - DNA, 11 bp, Homo sapiens
aaaatgtgaag

SEQ ID NO: 4368000 - DNA, 18 bp, Homo sapiens
aaaatgtgaggcaataag

SEQ ID NO: 4368001 - DNA, 20 bp, Homo sapiens
aaaatgtgctatactgcata

SEQ ID NO: 4368002 - DNA, 11 bp, Homo sapiens
aaaatgtgtgg

SEQ ID NO: 4368003 - DNA, 14 bp, Homo sapiens
aaaatgtgtttcag

SEQ ID NO: 4368004 - DNA, 20 bp, Homo sapiens
aaaatgttaaacccttacca

SEQ ID NO: 4368005 - DNA, 20 bp, Homo sapiens
aaaatgttcccttgaccatt

SEQ ID NO: 4368006 - DNA, 15 bp, Homo sapiens
aaaatgttctgtttg

SEQ ID NO: 4368007 - DNA, 13 bp, Homo sapiens
aaaatgttgaaat

SEQ ID NO: 4368008 - DNA, 21 bp, Homo sapiens
aaaatgttggtcattttatgt

SEQ ID NO: 4368009 - DNA, 22 bp, Homo sapiens
aaaatgtttttggtcttttata

SEQ ID NO: 4368010 - DNA, 15 bp, Homo sapiens
aaaatgttttttgat

SEQ ID NO: 4368011 - DNA, 18 bp, Homo sapiens
aaaattaaatctagacat

SEQ ID NO: 4368012 - DNA, 18 bp, Homo sapiens
aaaattaagtgtgtataa

SEQ ID NO: 4368013 - DNA, 20 bp, Homo sapiens
aaaattaatatggtgtattt

SEQ ID NO: 4368014 - DNA, 15 bp, Homo sapiens
aaaattaatgtaata

SEQ ID NO: 4368015 - DNA, 18 bp, Homo sapiens
aaaattaatgtaataaag

SEQ ID NO: 4368016 - DNA, 17 bp, Homo sapiens
aaaattaattaggaatt

SEQ ID NO: 4368017 - DNA, 14 bp, Homo sapiens
aaaattagaaagga

SEQ ID NO: 4368018 - DNA, 13 bp, Homo sapiens
aaaattagtcttt

SEQ ID NO: 4368019 - DNA, 13 bp, Homo sapiens
aaaattatactgt

SEQ ID NO: 4368020 - DNA, 23 bp, Homo sapiens
aaaattatgataaaatgctttaa

SEQ ID NO: 4368021 - DNA, 22 bp, Homo sapiens
aaaattatggaatatcatctgt

SEQ ID NO: 4368022 - DNA, 23 bp, Homo sapiens
aaaattatgtgttgccaaaacca

SEQ ID NO: 4368023 - DNA, 19 bp, Homo sapiens
aaaattatgttactgtatt

SEQ ID NO: 4368024 - DNA, 15 bp, Homo sapiens
aaaattattttgaca

SEQ ID NO: 4368025 - DNA, 12 bp, Homo sapiens
aaaattcatttt

SEQ ID NO: 4368026 - DNA, 13 bp, Homo sapiens
aaaattctgaatt

SEQ ID NO: 4368027 - DNA, 14 bp, Homo sapiens
aaaattctgtgcct

SEQ ID NO: 4368028 - DNA, 23 bp, Homo sapiens
aaaattctgtgccttgttttttg

SEQ ID NO: 4368029 - DNA, 20 bp, Homo sapiens
aaaattgaatgtggctgaag

SEQ ID NO: 4368030 - DNA, 23 bp, Homo sapiens
aaaattgagttcttcctgtaatc

SEQ ID NO: 4368031 - DNA, 17 bp, Homo sapiens
aaaattgatattatatt

SEQ ID NO: 4368032 - DNA, 23 bp, Homo sapiens
aaaattgatattatattaaacat

SEQ ID NO: 4368033 - DNA, 15 bp, Homo sapiens
aaaattgcaaatctt

SEQ ID NO: 4368034 - DNA, 23 bp, Homo sapiens
aaaattgctctgtgtatatctct

SEQ ID NO: 4368035 - DNA, 21 bp, Homo sapiens
aaaattgtataaattactttg

SEQ ID NO: 4368036 - DNA, 16 bp, Homo sapiens
aaaattgtgatgtgtc

SEQ ID NO: 4368037 - DNA, 13 bp, Homo sapiens
aaaattgtgcata

SEQ ID NO: 4368038 - DNA, 15 bp, Homo sapiens
aaaatttattctcag

SEQ ID NO: 4368039 - DNA, 13 bp, Homo sapiens
aaaatttatttca

SEQ ID NO: 4368040 - DNA, 20 bp, Homo sapiens
aaaatttcataattctgaaa

SEQ ID NO: 4368041 - DNA, 21 bp, Homo sapiens
aaaatttcataattctgaaac

SEQ ID NO: 4368042 - DNA, 18 bp, Homo sapiens
aaaatttcccattaaaga

SEQ ID NO: 4368043 - DNA, 15 bp, Homo sapiens
aaaatttctattaaa

SEQ ID NO: 4368044 - DNA, 19 bp, Homo sapiens
aaaatttgactaattttac

SEQ ID NO: 4368045 - DNA, 19 bp, Homo sapiens
aaaatttgttcttgtattt

SEQ ID NO: 4368046 - DNA, 14 bp, Homo sapiens
aaaatttgttgcat

SEQ ID NO: 4368047 - DNA, 22 bp, Homo sapiens
aaaattttaagaagaaagattt

SEQ ID NO: 4368048 - DNA, 21 bp, Homo sapiens
aaaattttggaatatttgctt

SEQ ID NO: 4368049 - DNA, 12 bp, Homo sapiens
aaacaaaaacat

SEQ ID NO: 4368050 - DNA, 16 bp, Homo sapiens
aaacaaaaagatgtct

SEQ ID NO: 4368051 - DNA, 13 bp, Homo sapiens
aaacaaaacaaaa

SEQ ID NO: 4368052 - DNA, 21 bp, Homo sapiens
aaacaaaacccctaagagact

SEQ ID NO: 4368053 - DNA, 10 bp, Homo sapiens
aaacaaaaga

SEQ ID NO: 4368054 - DNA, 21 bp, Homo sapiens
aaacaaaagggtgtatagtgt

SEQ ID NO: 4368055 - DNA, 18 bp, Homo sapiens
aaacaaagagttcaagaa

SEQ ID NO: 4368056 - DNA, 23 bp, Homo sapiens
aaacaaagtttcagagtatattg

SEQ ID NO: 4368057 - DNA, 17 bp, Homo sapiens
aaacaaatatttcactt

SEQ ID NO: 4368058 - DNA, 15 bp, Homo sapiens
aaacaaatgttagac

SEQ ID NO: 4368059 - DNA, 22 bp, Homo sapiens
aaacaacaatttctactttgaa

SEQ ID NO: 4368060 - DNA, 20 bp, Homo sapiens
aaacaacagctcgatccaaa

SEQ ID NO: 4368061 - DNA, 19 bp, Homo sapiens
aaacaacagtcttcatttt

SEQ ID NO: 4368062 - DNA, 17 bp, Homo sapiens
aaacaactctttgagaa

SEQ ID NO: 4368063 - DNA, 15 bp, Homo sapiens
aaacaagtatataat

SEQ ID NO: 4368064 - DNA, 22 bp, Homo sapiens
aaacaagtatataatttacttt

SEQ ID NO: 4368065 - DNA, 12 bp, Homo sapiens
aaacaagtattt

SEQ ID NO: 4368066 - DNA, 22 bp, Homo sapiens
aaacaagtatttgttaatttag

SEQ ID NO: 4368067 - DNA, 16 bp, Homo sapiens
aaacaatctatttaaa

SEQ ID NO: 4368068 - DNA, 12 bp, Homo sapiens
aaacaatctctt

SEQ ID NO: 4368069 - DNA, 15 bp, Homo sapiens
aaacaatctcttaaa

SEQ ID NO: 4368070 - DNA, 14 bp, Homo sapiens
aaacaatgtttaaa

SEQ ID NO: 4368071 - DNA, 13 bp, Homo sapiens
aaacaatttattt

SEQ ID NO: 4368072 - DNA, 16 bp, Homo sapiens
aaacaatttattttat

SEQ ID NO: 4368073 - DNA, 11 bp, Homo sapiens
aaacacagcaa

SEQ ID NO: 4368074 - DNA, 12 bp, Homo sapiens
aaacacagcaag

SEQ ID NO: 4368075 - DNA, 18 bp, Homo sapiens
aaacacataatttctgtt

SEQ ID NO: 4368076 - DNA, 14 bp, Homo sapiens
aaacacatagattc

SEQ ID NO: 4368077 - DNA, 18 bp, Homo sapiens
aaacacatagattcacct

SEQ ID NO: 4368078 - DNA, 22 bp, Homo sapiens
aaacacatagattcacctgtaa

SEQ ID NO: 4368079 - DNA, 15 bp, Homo sapiens
aaacaccaacataaa

SEQ ID NO: 4368080 - DNA, 12 bp, Homo sapiens
aaacaccattca

SEQ ID NO: 4368081 - DNA, 11 bp, Homo sapiens
aaacacccaga

SEQ ID NO: 4368082 - DNA, 18 bp, Homo sapiens
aaacactccacattcttc

SEQ ID NO: 4368083 - DNA, 14 bp, Homo sapiens
aaacactctttgag

SEQ ID NO: 4368084 - DNA, 16 bp, Homo sapiens
aaacactgaaaagaag

SEQ ID NO: 4368085 - DNA, 13 bp, Homo sapiens
aaacactgcaaat

SEQ ID NO: 4368086 - DNA, 18 bp, Homo sapiens
aaacacttatcttctgga

SEQ ID NO: 4368087 - DNA, 21 bp, Homo sapiens
aaacacttatcttctggatta

SEQ ID NO: 4368088 - DNA, 21 bp, Homo sapiens
aaacacttcgttcgcagagct

SEQ ID NO: 4368089 - DNA, 19 bp, Homo sapiens
aaacacttggcatacaaaa

SEQ ID NO: 4368090 - DNA, 21 bp, Homo sapiens
aaacacttggcatacaaaata

SEQ ID NO: 4368091 - DNA, 21 bp, Homo sapiens
gagcttgggtctctctcggcc

SEQ ID NO: 4368092 - DNA, 22 bp, Homo sapiens
gagcttgggtctctctcggccc

SEQ ID NO: 4368093 - DNA, 21 bp, Homo sapiens
gagctttatggtcctaaaagc

SEQ ID NO: 4368094 - DNA, 13 bp, Homo sapiens
gagctttgtcact

SEQ ID NO: 4368095 - DNA, 14 bp, Homo sapiens
gaggaaaagtgcaa

SEQ ID NO: 4368096 - DNA, 20 bp, Homo sapiens
gaggaaaagtgcaatgcgtg

SEQ ID NO: 4368097 - DNA, 15 bp, Homo sapiens
gaggaaactgagtca

SEQ ID NO: 4368098 - DNA, 15 bp, Homo sapiens
gaggaaatgtggaaa

SEQ ID NO: 4368099 - DNA, 18 bp, Homo sapiens
gaggaacctctgatttat

SEQ ID NO: 4368100 - DNA, 17 bp, Homo sapiens
gaggaagagccacctgc

SEQ ID NO: 4368101 - DNA, 14 bp, Homo sapiens
gaggaaggaggcca

SEQ ID NO: 4368102 - DNA, 16 bp, Homo sapiens
gaggaaggaggccacg

SEQ ID NO: 4368103 - DNA, 21 bp, Homo sapiens
gaggaaggcaagagggggtgg

SEQ ID NO: 4368104 - DNA, 15 bp, Homo sapiens
gaggaagggctgggc

SEQ ID NO: 4368105 - DNA, 16 bp, Homo sapiens
gaggaagggctgggcc

SEQ ID NO: 4368106 - DNA, 22 bp, Homo sapiens
gaggaagggctgggccaccagg

SEQ ID NO: 4368107 - DNA, 16 bp, Homo sapiens
gaggaagtgagcagtc

SEQ ID NO: 4368108 - DNA, 22 bp, Homo sapiens
gaggaatctgtgggtctgggag

SEQ ID NO: 4368109 - DNA, 21 bp, Homo sapiens
gaggaatctgtttctctgctg

SEQ ID NO: 4368110 - DNA, 22 bp, Homo sapiens
gaggaatctgtttctctgctgt

SEQ ID NO: 4368111 - DNA, 14 bp, Homo sapiens
gaggaatttcacct

SEQ ID NO: 4368112 - DNA, 15 bp, Homo sapiens
gaggacagcttgagc

SEQ ID NO: 4368113 - DNA, 13 bp, Homo sapiens
gaggacaggcagg

SEQ ID NO: 4368114 - DNA, 15 bp, Homo sapiens
gaggacaggcaggcc

SEQ ID NO: 4368115 - DNA, 16 bp, Homo sapiens
gaggacagtctggaga

SEQ ID NO: 4368116 - DNA, 20 bp, Homo sapiens
gaggacagtctggagaaggt

SEQ ID NO: 4368117 - DNA, 14 bp, Homo sapiens
gaggacatggggag

SEQ ID NO: 4368118 - DNA, 14 bp, Homo sapiens
gaggaccagaggag

SEQ ID NO: 4368119 - DNA, 16 bp, Homo sapiens
gaggaccagaggagca

SEQ ID NO: 4368120 - DNA, 14 bp, Homo sapiens
gaggacccagaccc

SEQ ID NO: 4368121 - DNA, 20 bp, Homo sapiens
gaggacccaggaaaggcagg

SEQ ID NO: 4368122 - DNA, 22 bp, Homo sapiens
gaggaccgaggctacagctcca

SEQ ID NO: 4368123 - DNA, 16 bp, Homo sapiens
gaggacctgtatttaa

SEQ ID NO: 4368124 - DNA, 17 bp, Homo sapiens
gaggacctgtatttaag

SEQ ID NO: 4368125 - DNA, 20 bp, Homo sapiens
gaggacggtgcaacccaagg

SEQ ID NO: 4368126 - DNA, 23 bp, Homo sapiens
gaggacgtcatcggaggctgggc

SEQ ID NO: 4368127 - DNA, 11 bp, Homo sapiens
gaggactgaga

SEQ ID NO: 4368128 - DNA, 17 bp, Homo sapiens
gaggactgagcccccac

SEQ ID NO: 4368129 - DNA, 19 bp, Homo sapiens
gaggactgagcccccaccg

SEQ ID NO: 4368130 - DNA, 20 bp, Homo sapiens
gaggagaaatgcaataactc

SEQ ID NO: 4368131 - DNA, 12 bp, Homo sapiens
gaggagaagaat

SEQ ID NO: 4368132 - DNA, 16 bp, Homo sapiens
gaggagccaccagttc

SEQ ID NO: 4368133 - DNA, 12 bp, Homo sapiens
gaggagctgctg

SEQ ID NO: 4368134 - DNA, 18 bp, Homo sapiens
gaggagctggcctgcggt

SEQ ID NO: 4368135 - DNA, 17 bp, Homo sapiens
gaggaggagctggcctg

SEQ ID NO: 4368136 - DNA, 21 bp, Homo sapiens
gaggaggcctgggggcaggga

SEQ ID NO: 4368137 - DNA, 16 bp, Homo sapiens
gaggaggcctgtccca

SEQ ID NO: 4368138 - DNA, 11 bp, Homo sapiens
gaggagggaga

SEQ ID NO: 4368139 - DNA, 12 bp, Homo sapiens
gaggagggcaga

SEQ ID NO: 4368140 - DNA, 13 bp, Homo sapiens
gaggagggcagag

SEQ ID NO: 4368141 - DNA, 13 bp, Homo sapiens
gaggagggcaggc

SEQ ID NO: 4368142 - DNA, 14 bp, Homo sapiens
gaggagggctttga

SEQ ID NO: 4368143 - DNA, 14 bp, Homo sapiens
gaggagtaaaattc

SEQ ID NO: 4368144 - DNA, 21 bp, Homo sapiens
gaggagtaaaattcagttttt

SEQ ID NO: 4368145 - DNA, 21 bp, Homo sapiens
gaggagtgcagccttctccat

SEQ ID NO: 4368146 - DNA, 12 bp, Homo sapiens
gaggagtttcct

SEQ ID NO: 4368147 - DNA, 20 bp, Homo sapiens
gaggagtttcctaaaagttc

SEQ ID NO: 4368148 - DNA, 14 bp, Homo sapiens
gaggatacagagga

SEQ ID NO: 4368149 - DNA, 22 bp, Homo sapiens
gaggatgatttcagaaggagaa

SEQ ID NO: 4368150 - DNA, 23 bp, Homo sapiens
gaggatgcttagtcttaaaataa

SEQ ID NO: 4368151 - DNA, 22 bp, Homo sapiens
gaggcaacagggccatgtgctg

SEQ ID NO: 4368152 - DNA, 14 bp, Homo sapiens
gaggcaagagactg

SEQ ID NO: 4368153 - DNA, 16 bp, Homo sapiens
gaggcaagcgtgttct

SEQ ID NO: 4368154 - DNA, 17 bp, Homo sapiens
gaggcaagctgaaattt

SEQ ID NO: 4368155 - DNA, 21 bp, Homo sapiens
gaggcaattagacactttgga

SEQ ID NO: 4368156 - DNA, 15 bp, Homo sapiens
gaggcaccagtccag

SEQ ID NO: 4368157 - DNA, 22 bp, Homo sapiens
gaggcactcagtgagcctcctg

SEQ ID NO: 4368158 - DNA, 19 bp, Homo sapiens
gaggcagacgtctgtcagg

SEQ ID NO: 4368159 - DNA, 20 bp, Homo sapiens
gaggcagacgtctgtcaggg

SEQ ID NO: 4368160 - DNA, 21 bp, Homo sapiens
gaggcagcagtgtgaggccag

SEQ ID NO: 4368161 - DNA, 18 bp, Homo sapiens
gaggcagcgccccaccac

SEQ ID NO: 4368162 - DNA, 14 bp, Homo sapiens
gaggcagctcagga

SEQ ID NO: 4368163 - DNA, 15 bp, Homo sapiens
gaggcagctcaggat

SEQ ID NO: 4368164 - DNA, 18 bp, Homo sapiens
gaggcagggccttgccca

SEQ ID NO: 4368165 - DNA, 22 bp, Homo sapiens
gaggcagggccttgcccagaga

SEQ ID NO: 4368166 - DNA, 16 bp, Homo sapiens
gaggcagggctctccc

SEQ ID NO: 4368167 - DNA, 14 bp, Homo sapiens
gaggcaggggcgga

SEQ ID NO: 4368168 - DNA, 15 bp, Homo sapiens
gaggcaggggcggag

SEQ ID NO: 4368169 - DNA, 18 bp, Homo sapiens
gaggcatacacacagcag

SEQ ID NO: 4368170 - DNA, 14 bp, Homo sapiens
gaggcatcttttct

SEQ ID NO: 4368171 - DNA, 23 bp, Homo sapiens
gaggcatcttttctagagacaca

SEQ ID NO: 4368172 - DNA, 12 bp, Homo sapiens
gaggccacccca

SEQ ID NO: 4368173 - DNA, 14 bp, Homo sapiens
gaggccaccccaaa

SEQ ID NO: 4368174 - DNA, 21 bp, Homo sapiens
gaggccaccccaaaccccagc

SEQ ID NO: 4368175 - DNA, 22 bp, Homo sapiens
gaggccaccccaaaccccagcc

SEQ ID NO: 4368176 - DNA, 22 bp, Homo sapiens
gaggccagccccacccaggagg

SEQ ID NO: 4368177 - DNA, 15 bp, Homo sapiens
gaggccatctcagga

SEQ ID NO: 4368178 - DNA, 18 bp, Homo sapiens
gaggccatctcaggagat

SEQ ID NO: 4368179 - DNA, 19 bp, Homo sapiens
gaggccattgtgtgagcct

SEQ ID NO: 4368180 - DNA, 22 bp, Homo sapiens
gaggccccacctgaagggtgga

SEQ ID NO: 4368181 - DNA, 22 bp, Homo sapiens
gaggccctcaatccaccttcag

SEQ ID NO: 4368182 - DNA, 23 bp, Homo sapiens
gaggccctcaatccaccttcagg

SEQ ID NO: 4368183 - DNA, 16 bp, Homo sapiens
gaggccctcgggccca

SEQ ID NO: 4368184 - DNA, 13 bp, Homo sapiens
gaggccctggagg

SEQ ID NO: 4368185 - DNA, 22 bp, Homo sapiens
gaggccctggagggaaggacag

SEQ ID NO: 4368186 - DNA, 22 bp, Homo sapiens
gaggcctctcattccagaggaa

SEQ ID NO: 4368187 - DNA, 13 bp, Homo sapiens
gaggcctgcccgg

SEQ ID NO: 4368188 - DNA, 20 bp, Homo sapiens
gaggcctgctgccagtgcag

SEQ ID NO: 4368189 - DNA, 18 bp, Homo sapiens
gaggcctggggaggccct

SEQ ID NO: 4368190 - DNA, 18 bp, Homo sapiens
gaggccttgggtgttcca

SEQ ID NO: 4368191 - DNA, 20 bp, Homo sapiens
gaggcgaagcgttgtcctca

SEQ ID NO: 4368192 - DNA, 13 bp, Homo sapiens
gaggcgaataaat

SEQ ID NO: 4368193 - DNA, 21 bp, Homo sapiens
gaggcgcacagtgtgagcccg

SEQ ID NO: 4368194 - DNA, 14 bp, Homo sapiens
gaggcgcgggggcc

SEQ ID NO: 4368195 - DNA, 19 bp, Homo sapiens
gaggcggaggctgtgctcc

SEQ ID NO: 4368196 - DNA, 19 bp, Homo sapiens
gaggcggtggtagagagag

SEQ ID NO: 4368197 - DNA, 14 bp, Homo sapiens
gaggcgtgcccccc

SEQ ID NO: 4368198 - DNA, 20 bp, Homo sapiens
gaggcgtgcccccctcctcc

SEQ ID NO: 4368199 - DNA, 16 bp, Homo sapiens
gaggctacagctccac

SEQ ID NO: 4368200 - DNA, 21 bp, Homo sapiens
gaggctacagctccacacgcc

SEQ ID NO: 4368201 - DNA, 18 bp, Homo sapiens
gaggctacccgctgtggc

SEQ ID NO: 4368202 - DNA, 20 bp, Homo sapiens
gaggctacccgctgtggccg

SEQ ID NO: 4368203 - DNA, 19 bp, Homo sapiens
gaggctccagctctggcac

SEQ ID NO: 4368204 - DNA, 22 bp, Homo sapiens
gaggctccccgcctccactcta

SEQ ID NO: 4368205 - DNA, 18 bp, Homo sapiens
gaggctcccggggcctgg

SEQ ID NO: 4368206 - DNA, 21 bp, Homo sapiens
gaggctctggacagcagaagc

SEQ ID NO: 4368207 - DNA, 22 bp, Homo sapiens
gaggctctggacagcagaagcc

SEQ ID NO: 4368208 - DNA, 23 bp, Homo sapiens
gaggctctggacagcagaagcct

SEQ ID NO: 4368209 - DNA, 13 bp, Homo sapiens
gaggctgagacag

SEQ ID NO: 4368210 - DNA, 13 bp, Homo sapiens
gaggctgaggcag

SEQ ID NO: 4368211 - DNA, 14 bp, Homo sapiens
gaggctgaggcaga

SEQ ID NO: 4368212 - DNA, 19 bp, Homo sapiens
gaggctgcaatgagccatg

SEQ ID NO: 4368213 - DNA, 20 bp, Homo sapiens
gaggctgcccccggccccct

SEQ ID NO: 4368214 - DNA, 22 bp, Homo sapiens
gaggctgcccccggccccctgg

SEQ ID NO: 4368215 - DNA, 14 bp, Homo sapiens
gaggctgcccctct

SEQ ID NO: 4368216 - DNA, 19 bp, Homo sapiens
gaggctgcccctctcacca

SEQ ID NO: 4368217 - DNA, 21 bp, Homo sapiens
gaggctggcattgaggctaac

SEQ ID NO: 4368218 - DNA, 16 bp, Homo sapiens
gaggctgggcccctgg

SEQ ID NO: 4368219 - DNA, 17 bp, Homo sapiens
gaggctgggcccctggg

SEQ ID NO: 4368220 - DNA, 13 bp, Homo sapiens
gaggctgtgctcc

SEQ ID NO: 4368221 - DNA, 20 bp, Homo sapiens
gaggcttctccgccagcctc

SEQ ID NO: 4368222 - DNA, 22 bp, Homo sapiens
gaggcttcttcagatcagtgct

SEQ ID NO: 4368223 - DNA, 16 bp, Homo sapiens
gaggctttggatttga

SEQ ID NO: 4368224 - DNA, 23 bp, Homo sapiens
gaggctttggggtcctagcccag

SEQ ID NO: 4368225 - DNA, 15 bp, Homo sapiens
gagggaaaagggaag

SEQ ID NO: 4368226 - DNA, 14 bp, Homo sapiens
gagggaaatgtaca

SEQ ID NO: 4368227 - DNA, 18 bp, Homo sapiens
gagggaaatgtacacttt

SEQ ID NO: 4368228 - DNA, 19 bp, Homo sapiens
gagggaaattgtaaatcct

SEQ ID NO: 4368229 - DNA, 15 bp, Homo sapiens
gagggaaggggaatg

SEQ ID NO: 4368230 - DNA, 20 bp, Homo sapiens
gagggaagggtttctctatt

SEQ ID NO: 4368231 - DNA, 20 bp, Homo sapiens
gagggaccaaattgcttcta

SEQ ID NO: 4368232 - DNA, 14 bp, Homo sapiens
gagggacgcctggg

SEQ ID NO: 4368233 - DNA, 20 bp, Homo sapiens
gagggactctgaagcctctg

SEQ ID NO: 4368234 - DNA, 22 bp, Homo sapiens
gagggagaatccaagggttgag

SEQ ID NO: 4368235 - DNA, 16 bp, Homo sapiens
gagggagactcagcct

SEQ ID NO: 4368236 - DNA, 12 bp, Homo sapiens
gagggaggggaa

SEQ ID NO: 4368237 - DNA, 21 bp, Homo sapiens
gagggaggggaaaagcatttt

SEQ ID NO: 4368238 - DNA, 20 bp, Homo sapiens
gagggagtgagccagcagct

SEQ ID NO: 4368239 - DNA, 21 bp, Homo sapiens
gagggatggagaggcggcctc

SEQ ID NO: 4368240 - DNA, 22 bp, Homo sapiens
gagggcaagccctgcccacaga

SEQ ID NO: 4368241 - DNA, 15 bp, Homo sapiens
gagggcaagcctcta

SEQ ID NO: 4368242 - DNA, 15 bp, Homo sapiens
gagggcactcagaag

SEQ ID NO: 4368243 - DNA, 17 bp, Homo sapiens
gagggcagaaaggttct

SEQ ID NO: 4368244 - DNA, 22 bp, Homo sapiens
gagggcagaaaggttctgcccg

SEQ ID NO: 4368245 - DNA, 15 bp, Homo sapiens
gagggcagagggaga

SEQ ID NO: 4368246 - DNA, 22 bp, Homo sapiens
gagggcagcagaagggggtggt

SEQ ID NO: 4368247 - DNA, 16 bp, Homo sapiens
gagggcccagcccaga

SEQ ID NO: 4368248 - DNA, 19 bp, Homo sapiens
gagggcccagcccagagcc

SEQ ID NO: 4368249 - DNA, 19 bp, Homo sapiens
gagggcccctgcgtggggg

SEQ ID NO: 4368250 - DNA, 21 bp, Homo sapiens
gagggctaaaaaggtcctgta

SEQ ID NO: 4368251 - DNA, 19 bp, Homo sapiens
gagggctagaacctggaga

SEQ ID NO: 4368252 - DNA, 18 bp, Homo sapiens
gagggctagaactggaga

SEQ ID NO: 4368253 - DNA, 20 bp, Homo sapiens
gagggctctgtttgtgggac

SEQ ID NO: 4368254 - DNA, 23 bp, Homo sapiens
gagggctgatggattccaaacca

SEQ ID NO: 4368255 - DNA, 9 bp, Homo sapiens
gagggctgc

SEQ ID NO: 4368256 - DNA, 16 bp, Homo sapiens
gagggctgcctttgga

SEQ ID NO: 4368257 - DNA, 23 bp, Homo sapiens
gagggctgcgacgcttgctctgt

SEQ ID NO: 4368258 - DNA, 13 bp, Homo sapiens
gagggctggaatc

SEQ ID NO: 4368259 - DNA, 10 bp, Homo sapiens
gagggctggc

SEQ ID NO: 4368260 - DNA, 12 bp, Homo sapiens
gagggctggccg

SEQ ID NO: 4368261 - DNA, 13 bp, Homo sapiens
gagggctggctgg

SEQ ID NO: 4368262 - DNA, 16 bp, Homo sapiens
gagggctggctggcct

SEQ ID NO: 4368263 - DNA, 21 bp, Homo sapiens
gaggggaccaattctggacag

SEQ ID NO: 4368264 - DNA, 17 bp, Homo sapiens
gaggggcatctgcccct

SEQ ID NO: 4368265 - DNA, 16 bp, Homo sapiens
gaggggcccagggaag

SEQ ID NO: 4368266 - DNA, 13 bp, Homo sapiens
gaggggccctggc

SEQ ID NO: 4368267 - DNA, 18 bp, Homo sapiens
gaggggcgcaccccacag

SEQ ID NO: 4368268 - DNA, 18 bp, Homo sapiens
gaggggcgggctcagagc

SEQ ID NO: 4368269 - DNA, 14 bp, Homo sapiens
gagggggagtagcc

SEQ ID NO: 4368270 - DNA, 15 bp, Homo sapiens
gagggggagtagcca

SEQ ID NO: 4368271 - DNA, 21 bp, Homo sapiens
gagggggccgggcgcggtggc

SEQ ID NO: 4368272 - DNA, 19 bp, Homo sapiens
gaggggggggtgggtgaga

SEQ ID NO: 4368273 - DNA, 14 bp, Homo sapiens
gagggggtggaggg

SEQ ID NO: 4368274 - DNA, 23 bp, Homo sapiens
gaggggtctcggatgacaccctg

SEQ ID NO: 4368275 - DNA, 21 bp, Homo sapiens
gaggggtgagagacctgctca

SEQ ID NO: 4368276 - DNA, 14 bp, Homo sapiens
gaggggtggaggct

SEQ ID NO: 4368277 - DNA, 18 bp, Homo sapiens
gaggggtggcccagagcc

SEQ ID NO: 4368278 - DNA, 21 bp, Homo sapiens
gaggggtggcccagagccata

SEQ ID NO: 4368279 - DNA, 21 bp, Homo sapiens
gagggtaggagggtgggaagg

SEQ ID NO: 4368280 - DNA, 17 bp, Homo sapiens
gagggtcaccctggcct

SEQ ID NO: 4368281 - DNA, 24 bp, Homo sapiens
gagggtctggagaagcagtgagcc

SEQ ID NO: 4368282 - DNA, 23 bp, Homo sapiens
gagggtgacttttcctgctgcct

SEQ ID NO: 4368283 - DNA, 13 bp, Homo sapiens
gagggtgtttcct

SEQ ID NO: 4368284 - DNA, 18 bp, Homo sapiens
gagggttcacacagccca

SEQ ID NO: 4368285 - DNA, 19 bp, Homo sapiens
gagggttcacacagcccag

SEQ ID NO: 4368286 - DNA, 18 bp, Homo sapiens
gaggtaactatcaatatt

SEQ ID NO: 4368287 - DNA, 21 bp, Homo sapiens
gaggtaggtggatcacctgag

SEQ ID NO: 4368288 - DNA, 16 bp, Homo sapiens
gaggtcaacagagaag

SEQ ID NO: 4368289 - DNA, 21 bp, Homo sapiens
gaggtcactccaccatcccca

SEQ ID NO: 4368290 - DNA, 18 bp, Homo sapiens
gaggtcactggaaagggg

SEQ ID NO: 4368291 - DNA, 21 bp, Homo sapiens
gaggtcactggaaaggggaga

SEQ ID NO: 4368292 - DNA, 23 bp, Homo sapiens
gaggtcagcatgtctattcagct

SEQ ID NO: 4368293 - DNA, 17 bp, Homo sapiens
gaggtcaggacggctcc

SEQ ID NO: 4368294 - DNA, 21 bp, Homo sapiens
gaggtcaggacggctcctcag

SEQ ID NO: 4368295 - DNA, 19 bp, Homo sapiens
gaggtccttaggcctctga

SEQ ID NO: 4368296 - DNA, 17 bp, Homo sapiens
gaggtctcatctcccag

SEQ ID NO: 4368297 - DNA, 20 bp, Homo sapiens
gaggtctcatctcccaggcc

SEQ ID NO: 4368298 - DNA, 14 bp, Homo sapiens
gaggtctgagccct

SEQ ID NO: 4368299 - DNA, 12 bp, Homo sapiens
gaggtctgttta

SEQ ID NO: 4368300 - DNA, 16 bp, Homo sapiens
gaggtgaaagggagct

SEQ ID NO: 4368301 - DNA, 18 bp, Homo sapiens
gaggtgaacattaaaata

SEQ ID NO: 4368302 - DNA, 16 bp, Homo sapiens
gaggtgctaaattgtc

SEQ ID NO: 4368303 - DNA, 19 bp, Homo sapiens
gaggtgctgtccccactgc

SEQ ID NO: 4368304 - DNA, 15 bp, Homo sapiens
gaggtggaagaaggg

SEQ ID NO: 4368305 - DNA, 18 bp, Homo sapiens
gaggtggaagcagaggcc

SEQ ID NO: 4368306 - DNA, 15 bp, Homo sapiens
gaggtggaagccctc

SEQ ID NO: 4368307 - DNA, 20 bp, Homo sapiens
gaggtggaagccctccttcc

SEQ ID NO: 4368308 - DNA, 23 bp, Homo sapiens
gaggtggaggaagatagcgcata

SEQ ID NO: 4368309 - DNA, 20 bp, Homo sapiens
gaggtggatcacagaggctt

SEQ ID NO: 4368310 - DNA, 13 bp, Homo sapiens
gaggtgggagggc

SEQ ID NO: 4368311 - DNA, 16 bp, Homo sapiens
gaggtgtccaactggc

SEQ ID NO: 4368312 - DNA, 16 bp, Homo sapiens
gaggtgtgggtgcctt

SEQ ID NO: 4368313 - DNA, 16 bp, Homo sapiens
gaggttcctctgcctg

SEQ ID NO: 4368314 - DNA, 15 bp, Homo sapiens
gaggttgcagtgagc

SEQ ID NO: 4368315 - DNA, 23 bp, Homo sapiens
gaggttgcagtgagccaaaatca

SEQ ID NO: 4368316 - DNA, 19 bp, Homo sapiens
gaggttgcagtgagctgag

SEQ ID NO: 4368317 - DNA, 16 bp, Homo sapiens
gaggttgggaattctt

SEQ ID NO: 4368318 - DNA, 23 bp, Homo sapiens
gaggttttattctgacttcctct

SEQ ID NO: 4368319 - DNA, 22 bp, Homo sapiens
gaggtttttaaatatatatttt

SEQ ID NO: 4368320 - DNA, 20 bp, Homo sapiens
gagtaaaaagacatttttta

SEQ ID NO: 4368321 - DNA, 19 bp, Homo sapiens
gagtaaacggcccaggcca

SEQ ID NO: 4368322 - DNA, 13 bp, Homo sapiens
gagtaacagggca

SEQ ID NO: 4368323 - DNA, 14 bp, Homo sapiens
gagtaatttcattt

SEQ ID NO: 4368324 - DNA, 17 bp, Homo sapiens
gagtaattttggatttt

SEQ ID NO: 4368325 - DNA, 15 bp, Homo sapiens
gagtacactcagcca

SEQ ID NO: 4368326 - DNA, 17 bp, Homo sapiens
gagtacactcagccact

SEQ ID NO: 4368327 - DNA, 17 bp, Homo sapiens
gagtactgtgggcaatt

SEQ ID NO: 4368328 - DNA, 18 bp, Homo sapiens
gagtactgtgggcaattt

SEQ ID NO: 4368329 - DNA, 15 bp, Homo sapiens
gagtagacacattta

SEQ ID NO: 4368330 - DNA, 18 bp, Homo sapiens
gagtagacacatttaagg

SEQ ID NO: 4368331 - DNA, 18 bp, Homo sapiens
gagtataccatgagatga

SEQ ID NO: 4368332 - DNA, 19 bp, Homo sapiens
gagtcaaaactacaaatca

SEQ ID NO: 4368333 - DNA, 14 bp, Homo sapiens
gagtcaaagctgac

SEQ ID NO: 4368334 - DNA, 21 bp, Homo sapiens
gagtcaaagctgaccatggat

SEQ ID NO: 4368335 - DNA, 20 bp, Homo sapiens
gagtcaatcccctcattcag

SEQ ID NO: 4368336 - DNA, 12 bp, Homo sapiens
gagtcacacagt

SEQ ID NO: 4368337 - DNA, 19 bp, Homo sapiens
gagtcacagatgaggcccc

SEQ ID NO: 4368338 - DNA, 20 bp, Homo sapiens
gagtcacagatgaggccccc

SEQ ID NO: 4368339 - DNA, 14 bp, Homo sapiens
gagtcaccttttct

SEQ ID NO: 4368340 - DNA, 21 bp, Homo sapiens
gagtcaccttttctgtggctg

SEQ ID NO: 4368341 - DNA, 17 bp, Homo sapiens
gagtcactcacattgag

SEQ ID NO: 4368342 - DNA, 13 bp, Homo sapiens
gagtcagaggaga

SEQ ID NO: 4368343 - DNA, 22 bp, Homo sapiens
gagtcagggacctgctgctcag

SEQ ID NO: 4368344 - DNA, 22 bp, Homo sapiens
gagtcaggtgaggcatctttac

SEQ ID NO: 4368345 - DNA, 20 bp, Homo sapiens
gagtcagtgaagtctagaat

SEQ ID NO: 4368346 - DNA, 23 bp, Homo sapiens
gagtcagtgaagtctagaatcat

SEQ ID NO: 4368347 - DNA, 19 bp, Homo sapiens
gagtcatgatctccctgcc

SEQ ID NO: 4368348 - DNA, 16 bp, Homo sapiens
gagtcattgacttcat

SEQ ID NO: 4368349 - DNA, 22 bp, Homo sapiens
gagtcattgacttcattttata

SEQ ID NO: 4368350 - DNA, 20 bp, Homo sapiens
gagtcatttaaatgtgtaca

SEQ ID NO: 4368351 - DNA, 20 bp, Homo sapiens
gagtcattttcacttttaaa

SEQ ID NO: 4368352 - DNA, 14 bp, Homo sapiens
gagtccaaggccag

SEQ ID NO: 4368353 - DNA, 17 bp, Homo sapiens
gagtccagaccccccag

SEQ ID NO: 4368354 - DNA, 22 bp, Homo sapiens
gagtccagaccccccagcccct

SEQ ID NO: 4368355 - DNA, 15 bp, Homo sapiens
gagtccagcccctcc

SEQ ID NO: 4368356 - DNA, 23 bp, Homo sapiens
gagtccagcccctcctccctcag

SEQ ID NO: 4368357 - DNA, 16 bp, Homo sapiens
gagtccaggcccccag

SEQ ID NO: 4368358 - DNA, 19 bp, Homo sapiens
gagtccagggtttctctgc

SEQ ID NO: 4368359 - DNA, 20 bp, Homo sapiens
gagtccagggtttctctgca

SEQ ID NO: 4368360 - DNA, 23 bp, Homo sapiens
gagtccagggtttctctgcagat

SEQ ID NO: 4368361 - DNA, 15 bp, Homo sapiens
gagtccagtgctctg

SEQ ID NO: 4368362 - DNA, 19 bp, Homo sapiens
gagtccagtgctctgcctc

SEQ ID NO: 4368363 - DNA, 15 bp, Homo sapiens
gagtccatcagcctc

SEQ ID NO: 4368364 - DNA, 17 bp, Homo sapiens
gagtccattctcccagg

SEQ ID NO: 4368365 - DNA, 18 bp, Homo sapiens
gagtccattctcccaggt

SEQ ID NO: 4368366 - DNA, 20 bp, Homo sapiens
gagtccattctcccaggtac

SEQ ID NO: 4368367 - DNA, 20 bp, Homo sapiens
gagtccctacctgcttcacg

SEQ ID NO: 4368368 - DNA, 19 bp, Homo sapiens
gagtccctgcctggaccag

SEQ ID NO: 4368369 - DNA, 17 bp, Homo sapiens
gagtcctaggacttaaa

SEQ ID NO: 4368370 - DNA, 18 bp, Homo sapiens
gagtcctgtctctgcctg

SEQ ID NO: 4368371 - DNA, 22 bp, Homo sapiens
gagtcgtacagaaagctgcctg

SEQ ID NO: 4368372 - DNA, 19 bp, Homo sapiens
gagtctaatagtctttgcc

SEQ ID NO: 4368373 - DNA, 23 bp, Homo sapiens
gagtctccagggccccccaactg

SEQ ID NO: 4368374 - DNA, 23 bp, Homo sapiens
gagtctcgctctgtcgcccaggc

SEQ ID NO: 4368375 - DNA, 14 bp, Homo sapiens
gagtctgagtcctg

SEQ ID NO: 4368376 - DNA, 18 bp, Homo sapiens
gagtctgagtcctgtctc

SEQ ID NO: 4368377 - DNA, 15 bp, Homo sapiens
gagtctggggacctg

SEQ ID NO: 4368378 - DNA, 18 bp, Homo sapiens
gagtcttaactgtatttc

SEQ ID NO: 4368379 - DNA, 13 bp, Homo sapiens
gagtcttgtgaaa

SEQ ID NO: 4368380 - DNA, 17 bp, Homo sapiens
gagtcttgtgaaagtgt

SEQ ID NO: 4368381 - DNA, 19 bp, Homo sapiens
gagtctttcattcggtgtg

SEQ ID NO: 4368382 - DNA, 12 bp, Homo sapiens
gagtgaaatact

SEQ ID NO: 4368383 - DNA, 15 bp, Homo sapiens
gagtgaatgtggcag

SEQ ID NO: 4368384 - DNA, 20 bp, Homo sapiens
gagtgagggagacaggaacg

SEQ ID NO: 4368385 - DNA, 16 bp, Homo sapiens
gagtgagggaggaggg

SEQ ID NO: 4368386 - DNA, 17 bp, Homo sapiens
gagtgcactgctccctg

SEQ ID NO: 4368387 - DNA, 16 bp, Homo sapiens
gagtgcagagaaagaa

SEQ ID NO: 4368388 - DNA, 12 bp, Homo sapiens
gagtgcagcctt

SEQ ID NO: 4368389 - DNA, 17 bp, Homo sapiens
gagtgcaggcctgctca

SEQ ID NO: 4368390 - DNA, 17 bp, Homo sapiens
gagtgcagtcctgatca

SEQ ID NO: 4368391 - DNA, 18 bp, Homo sapiens
gagtgcagtcctgatcag

SEQ ID NO: 4368392 - DNA, 14 bp, Homo sapiens
gagtgcgggctgag

SEQ ID NO: 4368393 - DNA, 19 bp, Homo sapiens
gagtgctgataagaatgaa

SEQ ID NO: 4368394 - DNA, 18 bp, Homo sapiens
gagtggaggaggcctggg

SEQ ID NO: 4368395 - DNA, 10 bp, Homo sapiens
gagtggccca

SEQ ID NO: 4368396 - DNA, 11 bp, Homo sapiens
gagtggcccac

SEQ ID NO: 4368397 - DNA, 11 bp, Homo sapiens
gagtggcctcc

SEQ ID NO: 4368398 - DNA, 14 bp, Homo sapiens
gagtggcctccctg

SEQ ID NO: 4368399 - DNA, 15 bp, Homo sapiens
gagtggcctccctgc

SEQ ID NO: 4368400 - DNA, 18 bp, Homo sapiens
gagtggcctggccaggag

SEQ ID NO: 4368401 - DNA, 19 bp, Homo sapiens
gagtggcctggccaggagc

SEQ ID NO: 4368402 - DNA, 23 bp, Homo sapiens
gagtggggcctttgccagcagag

SEQ ID NO: 4368403 - DNA, 14 bp, Homo sapiens
gagtggggggacag

SEQ ID NO: 4368404 - DNA, 16 bp, Homo sapiens
gagtggttaggcagca

SEQ ID NO: 4368405 - DNA, 22 bp, Homo sapiens
gagtgtctttccacggagccac

SEQ ID NO: 4368406 - DNA, 22 bp, Homo sapiens
gagtgtgaatataaatgtgtgt

SEQ ID NO: 4368407 - DNA, 18 bp, Homo sapiens
gagtgtgagccacctaag

SEQ ID NO: 4368408 - DNA, 16 bp, Homo sapiens
gagtgtggctgaggag

SEQ ID NO: 4368409 - DNA, 18 bp, Homo sapiens
gagtgtgggaagggagag

SEQ ID NO: 4368410 - DNA, 21 bp, Homo sapiens
gagtgtgtaatttaaaattgt

SEQ ID NO: 4368411 - DNA, 20 bp, Homo sapiens
gagttaactgtgaaatacca

SEQ ID NO: 4368412 - DNA, 14 bp, Homo sapiens
gagttacagttctg

SEQ ID NO: 4368413 - DNA, 15 bp, Homo sapiens
gagttacagttctgt

SEQ ID NO: 4368414 - DNA, 17 bp, Homo sapiens
gagttacagttctgtgg

SEQ ID NO: 4368415 - DNA, 19 bp, Homo sapiens
gagttagaaccacagcaga

SEQ ID NO: 4368416 - DNA, 23 bp, Homo sapiens
gagttatcttctttattattcct

SEQ ID NO: 4368417 - DNA, 17 bp, Homo sapiens
gagttattcaaatgaag

SEQ ID NO: 4368418 - DNA, 15 bp, Homo sapiens
gagttcaaatacttt

SEQ ID NO: 4368419 - DNA, 16 bp, Homo sapiens
gagttccagaaagtaa

SEQ ID NO: 4368420 - DNA, 23 bp, Homo sapiens
gagttccttatccctctcttccc

SEQ ID NO: 4368421 - DNA, 23 bp, Homo sapiens
gagttctgggtttctagaggtca

SEQ ID NO: 4368422 - DNA, 22 bp, Homo sapiens
gagttcttagctatccttggct

SEQ ID NO: 4368423 - DNA, 20 bp, Homo sapiens
gagttgaagacagcttccca

SEQ ID NO: 4368424 - DNA, 14 bp, Homo sapiens
gagttgatgtctcc

SEQ ID NO: 4368425 - DNA, 18 bp, Homo sapiens
gagttgctgcaaacctga

SEQ ID NO: 4368426 - DNA, 17 bp, Homo sapiens
gagttgggcagccagga

SEQ ID NO: 4368427 - DNA, 23 bp, Homo sapiens
gagttgtgtgaataccccaagac

SEQ ID NO: 4368428 - DNA, 14 bp, Homo sapiens
gagtttaaaaatca

SEQ ID NO: 4368429 - DNA, 20 bp, Homo sapiens
gagtttaaaatcatcagaaa

SEQ ID NO: 4368430 - DNA, 15 bp, Homo sapiens
gagtttagggtgggg

SEQ ID NO: 4368431 - DNA, 13 bp, Homo sapiens
gagtttattacaa

SEQ ID NO: 4368432 - DNA, 22 bp, Homo sapiens
gagtttattacaatgtatcttt

SEQ ID NO: 4368433 - DNA, 22 bp, Homo sapiens
gagtttccccactaataaagtg

SEQ ID NO: 4368434 - DNA, 13 bp, Homo sapiens
gagtttctatgga

SEQ ID NO: 4368435 - DNA, 18 bp, Homo sapiens
gagtttctctagaagctc

SEQ ID NO: 4368436 - DNA, 12 bp, Homo sapiens
gagtttggtccc

SEQ ID NO: 4368437 - DNA, 23 bp, Homo sapiens
gagtttgtaggtaaaatgtattt

SEQ ID NO: 4368438 - DNA, 13 bp, Homo sapiens
gagttttgtgttt

SEQ ID NO: 4368439 - DNA, 22 bp, Homo sapiens
gagttttgtgtttgttgtagat

SEQ ID NO: 4368440 - DNA, 18 bp, Homo sapiens
gagttttgtttcactttg

SEQ ID NO: 4368441 - DNA, 12 bp, Homo sapiens
gagtttttcctc

SEQ ID NO: 4368442 - DNA, 13 bp, Homo sapiens
gagtttttcctcc

SEQ ID NO: 4368443 - DNA, 16 bp, Homo sapiens
gataaaagatggccat

SEQ ID NO: 4368444 - DNA, 18 bp, Homo sapiens
gataaacaacaaggtggt

SEQ ID NO: 4368445 - DNA, 17 bp, Homo sapiens
gataaaccaaaaacatt

SEQ ID NO: 4368446 - DNA, 19 bp, Homo sapiens
gataaaccaaaaacatttg

SEQ ID NO: 4368447 - DNA, 20 bp, Homo sapiens
gataaagacttttatgtgag

SEQ ID NO: 4368448 - DNA, 21 bp, Homo sapiens
gataaagacttttatgtgaga

SEQ ID NO: 4368449 - DNA, 22 bp, Homo sapiens
gataaagatgcaaggaccagga

SEQ ID NO: 4368450 - DNA, 16 bp, Homo sapiens
gataaataactttttt

SEQ ID NO: 4368451 - DNA, 15 bp, Homo sapiens
gataaccaattttca

SEQ ID NO: 4368452 - DNA, 16 bp, Homo sapiens
gataaccagtaaggaa

SEQ ID NO: 4368453 - DNA, 19 bp, Homo sapiens
gataaccagtaaggaaata

SEQ ID NO: 4368454 - DNA, 21 bp, Homo sapiens
gataactgaaaattatttaaa

SEQ ID NO: 4368455 - DNA, 22 bp, Homo sapiens
gataactgatttctatggcttt

SEQ ID NO: 4368456 - DNA, 15 bp, Homo sapiens
gataacttctttagg

SEQ ID NO: 4368457 - DNA, 22 bp, Homo sapiens
gataacttttttgagtcattga

SEQ ID NO: 4368458 - DNA, 17 bp, Homo sapiens
gataagcaccagtggga

SEQ ID NO: 4368459 - DNA, 20 bp, Homo sapiens
gataaggctgttctttaaat

SEQ ID NO: 4368460 - DNA, 14 bp, Homo sapiens
gataatattgtctg

SEQ ID NO: 4368461 - DNA, 20 bp, Homo sapiens
gataatattgtctgtctcta

SEQ ID NO: 4368462 - DNA, 16 bp, Homo sapiens
gataatctcagtgctt

SEQ ID NO: 4368463 - DNA, 19 bp, Homo sapiens
gataatgctgttgcctcat

SEQ ID NO: 4368464 - DNA, 16 bp, Homo sapiens
gataatttaaaatcca

SEQ ID NO: 4368465 - DNA, 22 bp, Homo sapiens
gataattttttttttttaggaa

SEQ ID NO: 4368466 - DNA, 14 bp, Homo sapiens
gatacaaatttggc

SEQ ID NO: 4368467 - DNA, 15 bp, Homo sapiens
gatacaataaaacaa

SEQ ID NO: 4368468 - DNA, 23 bp, Homo sapiens
gatacaccattatgtttaagata

SEQ ID NO: 4368469 - DNA, 23 bp, Homo sapiens
gatacactcaagcatgaagataa

SEQ ID NO: 4368470 - DNA, 16 bp, Homo sapiens
gatacactgcactttg

SEQ ID NO: 4368471 - DNA, 19 bp, Homo sapiens
gatacactgcactttgttt

SEQ ID NO: 4368472 - DNA, 19 bp, Homo sapiens
gatacagtacggatttgtc

SEQ ID NO: 4368473 - DNA, 12 bp, Homo sapiens
gatacagttttg

SEQ ID NO: 4368474 - DNA, 12 bp, Homo sapiens
gatacatttaat

SEQ ID NO: 4368475 - DNA, 18 bp, Homo sapiens
gataccttcttatttaat

SEQ ID NO: 4368476 - DNA, 16 bp, Homo sapiens
gatactaaaaaggcca

SEQ ID NO: 4368477 - DNA, 13 bp, Homo sapiens
gatactaaggacg

SEQ ID NO: 4368478 - DNA, 18 bp, Homo sapiens
gatactgattatgaaatg

SEQ ID NO: 4368479 - DNA, 17 bp, Homo sapiens
gatacttcagctttgtg

SEQ ID NO: 4368480 - DNA, 17 bp, Homo sapiens
gatactttagccatcat

SEQ ID NO: 4368481 - DNA, 20 bp, Homo sapiens
gatagaggggctgcagggcc

SEQ ID NO: 4368482 - DNA, 13 bp, Homo sapiens
gatagatgtgtgg

SEQ ID NO: 4368483 - DNA, 17 bp, Homo sapiens
gatagcgtgcagtagag

SEQ ID NO: 4368484 - DNA, 19 bp, Homo sapiens
gatagctaactgtaaatca

SEQ ID NO: 4368485 - DNA, 13 bp, Homo sapiens
gatagctgtgact

SEQ ID NO: 4368486 - DNA, 22 bp, Homo sapiens
gatagcttctcttctttctgaa

SEQ ID NO: 4368487 - DNA, 17 bp, Homo sapiens
gataggagcctgctggt

SEQ ID NO: 4368488 - DNA, 13 bp, Homo sapiens
gataggtaaattt

SEQ ID NO: 4368489 - DNA, 18 bp, Homo sapiens
gatataaaagactgacca

SEQ ID NO: 4368490 - DNA, 17 bp, Homo sapiens
gatataacactttccag

SEQ ID NO: 4368491 - DNA, 15 bp, Homo sapiens
gatataactgtcttg

SEQ ID NO: 4368492 - DNA, 16 bp, Homo sapiens
gatataactttagaaa

SEQ ID NO: 4368493 - DNA, 18 bp, Homo sapiens
gatataagagggcttttt

SEQ ID NO: 4368494 - DNA, 19 bp, Homo sapiens
gatataatatcagatttca

SEQ ID NO: 4368495 - DNA, 18 bp, Homo sapiens
gatatacacggatgactt

SEQ ID NO: 4368496 - DNA, 22 bp, Homo sapiens
gatatactttgtggaccaatta

SEQ ID NO: 4368497 - DNA, 12 bp, Homo sapiens
gatatagaaaat

SEQ ID NO: 4368498 - DNA, 23 bp, Homo sapiens
gatatatattataaatatatata

SEQ ID NO: 4368499 - DNA, 16 bp, Homo sapiens
gatatatgtgtataca

SEQ ID NO: 4368500 - DNA, 14 bp, Homo sapiens
gatatattttacaa

SEQ ID NO: 4368501 - DNA, 17 bp, Homo sapiens
gatatcagaatttgtgt

SEQ ID NO: 4368502 - DNA, 18 bp, Homo sapiens
gatatcagagctgggaaa

SEQ ID NO: 4368503 - DNA, 20 bp, Homo sapiens
gatatcgtgaaatcctcagc

SEQ ID NO: 4368504 - DNA, 15 bp, Homo sapiens
gatatgaaagctgat

SEQ ID NO: 4368505 - DNA, 23 bp, Homo sapiens
gatatgaatatatggcatttgca

SEQ ID NO: 4368506 - DNA, 23 bp, Homo sapiens
gatatgcatgtagcatataaatg

SEQ ID NO: 4368507 - DNA, 14 bp, Homo sapiens
gatatgcttactaa

SEQ ID NO: 4368508 - DNA, 13 bp, Homo sapiens
gatatggagaatt

SEQ ID NO: 4368509 - DNA, 18 bp, Homo sapiens
gatatggcttaggaatga

SEQ ID NO: 4368510 - DNA, 18 bp, Homo sapiens
gatatgtaaaacatttat

SEQ ID NO: 4368511 - DNA, 20 bp, Homo sapiens
gatatgtacctaacgaagta

SEQ ID NO: 4368512 - DNA, 12 bp, Homo sapiens
gatattatagaa

SEQ ID NO: 4368513 - DNA, 14 bp, Homo sapiens
gatattatagaaaa

SEQ ID NO: 4368514 - DNA, 18 bp, Homo sapiens
gatattattaatttttat

SEQ ID NO: 4368515 - DNA, 16 bp, Homo sapiens
gatattattttaaatt

SEQ ID NO: 4368516 - DNA, 20 bp, Homo sapiens
gatattattttaaatttctt

SEQ ID NO: 4368517 - DNA, 18 bp, Homo sapiens
gatattcaaggctttaaa

SEQ ID NO: 4368518 - DNA, 22 bp, Homo sapiens
gatattcctattgtgcaatgta

SEQ ID NO: 4368519 - DNA, 18 bp, Homo sapiens
gatattctccctgacctt

SEQ ID NO: 4368520 - DNA, 16 bp, Homo sapiens
gatattctgttgcttt

SEQ ID NO: 4368521 - DNA, 11 bp, Homo sapiens
gatattgcctt

SEQ ID NO: 4368522 - DNA, 12 bp, Homo sapiens
gatattgcctta

SEQ ID NO: 4368523 - DNA, 17 bp, Homo sapiens
gatattgctactataat

SEQ ID NO: 4368524 - DNA, 21 bp, Homo sapiens
gatattgttataaataaaatt

SEQ ID NO: 4368525 - DNA, 15 bp, Homo sapiens
gatattgtttgctgt

SEQ ID NO: 4368526 - DNA, 13 bp, Homo sapiens
gatatttaattat

SEQ ID NO: 4368527 - DNA, 19 bp, Homo sapiens
gatatttcgaccctggggc

SEQ ID NO: 4368528 - DNA, 12 bp, Homo sapiens
gatatttgaaat

SEQ ID NO: 4368529 - DNA, 15 bp, Homo sapiens
gatattttctgtgcc

SEQ ID NO: 4368530 - DNA, 21 bp, Homo sapiens
gatattttctgtgcctgaata

SEQ ID NO: 4368531 - DNA, 14 bp, Homo sapiens
gatcaaaaggccca

SEQ ID NO: 4368532 - DNA, 16 bp, Homo sapiens
gatcaacatcttttct

SEQ ID NO: 4368533 - DNA, 20 bp, Homo sapiens
gatcaacatcttttcttgcc

SEQ ID NO: 4368534 - DNA, 16 bp, Homo sapiens
gatcaagttgttgact

SEQ ID NO: 4368535 - DNA, 21 bp, Homo sapiens
gatcaagttgttgactgtgat

SEQ ID NO: 4368536 - DNA, 15 bp, Homo sapiens
gatcaatcctttatt

SEQ ID NO: 4368537 - DNA, 13 bp, Homo sapiens
gatcacagaccac

SEQ ID NO: 4368538 - DNA, 16 bp, Homo sapiens
gatcacagaccacagg

SEQ ID NO: 4368539 - DNA, 15 bp, Homo sapiens
gatcacagagcagca

SEQ ID NO: 4368540 - DNA, 15 bp, Homo sapiens
gatcaccattatatt

SEQ ID NO: 4368541 - DNA, 14 bp, Homo sapiens
gatcacctgaggtc

SEQ ID NO: 4368542 - DNA, 21 bp, Homo sapiens
gatcacgccattgtactccag

SEQ ID NO: 4368543 - DNA, 14 bp, Homo sapiens
gatcagaagaacat

SEQ ID NO: 4368544 - DNA, 16 bp, Homo sapiens
gatcagagccgtggtc

SEQ ID NO: 4368545 - DNA, 15 bp, Homo sapiens
gatcagaggagtaaa

SEQ ID NO: 4368546 - DNA, 15 bp, Homo sapiens
gatcagatgctgaat

SEQ ID NO: 4368547 - DNA, 20 bp, Homo sapiens
gatcagatgctgaattgaga

SEQ ID NO: 4368548 - DNA, 15 bp, Homo sapiens
gatcagccccgcctg

SEQ ID NO: 4368549 - DNA, 17 bp, Homo sapiens
gatcaggagagcaaggt

SEQ ID NO: 4368550 - DNA, 14 bp, Homo sapiens
gatcaggaggaagt

SEQ ID NO: 4368551 - DNA, 14 bp, Homo sapiens
gatcagtaaaatta

SEQ ID NO: 4368552 - DNA, 13 bp, Homo sapiens
gatcatcatgcag

SEQ ID NO: 4368553 - DNA, 13 bp, Homo sapiens
gatcatgtacttt

SEQ ID NO: 4368554 - DNA, 21 bp, Homo sapiens
gatcatttttaactgattctt

SEQ ID NO: 4368555 - DNA, 20 bp, Homo sapiens
gatccaactaatgccttact

SEQ ID NO: 4368556 - DNA, 19 bp, Homo sapiens
gatccagtaacctcggaga

SEQ ID NO: 4368557 - DNA, 15 bp, Homo sapiens
gatccatcttgagcc

SEQ ID NO: 4368558 - DNA, 19 bp, Homo sapiens
gatccatgtagcaggactg

SEQ ID NO: 4368559 - DNA, 16 bp, Homo sapiens
gatcccaacactgcca

SEQ ID NO: 4368560 - DNA, 15 bp, Homo sapiens
gatcccaccccctcc

SEQ ID NO: 4368561 - DNA, 15 bp, Homo sapiens
gatcccaggcccctg

SEQ ID NO: 4368562 - DNA, 18 bp, Homo sapiens
gatcccaggcccctggag

SEQ ID NO: 4368563 - DNA, 17 bp, Homo sapiens
gatcccatgagctcctt

SEQ ID NO: 4368564 - DNA, 16 bp, Homo sapiens
gatccccaactgctcc

SEQ ID NO: 4368565 - DNA, 17 bp, Homo sapiens
gatccccaactgctcca

SEQ ID NO: 4368566 - DNA, 16 bp, Homo sapiens
gatccccagcccctcc

SEQ ID NO: 4368567 - DNA, 20 bp, Homo sapiens
gatccccagcccctcctccc

SEQ ID NO: 4368568 - DNA, 21 bp, Homo sapiens
gatccccagcccctcctccct

SEQ ID NO: 4368569 - DNA, 14 bp, Homo sapiens
gatcccctcaggac

SEQ ID NO: 4368570 - DNA, 20 bp, Homo sapiens
gatccctaatgtgtttcttt

SEQ ID NO: 4368571 - DNA, 12 bp, Homo sapiens
gatccctcatct

SEQ ID NO: 4368572 - DNA, 23 bp, Homo sapiens
gatccctctacagagcttccctg

SEQ ID NO: 4368573 - DNA, 20 bp, Homo sapiens
gatccgcctacctcagcctc

SEQ ID NO: 4368574 - DNA, 21 bp, Homo sapiens
gatccgcctacctcagcctcc

SEQ ID NO: 4368575 - DNA, 14 bp, Homo sapiens
gatccggaaagaag

SEQ ID NO: 4368576 - DNA, 20 bp, Homo sapiens
gatcctaaactctctagctt

SEQ ID NO: 4368577 - DNA, 12 bp, Homo sapiens
gatcctaaatat

SEQ ID NO: 4368578 - DNA, 22 bp, Homo sapiens
gatcctaagaatttttcattct

SEQ ID NO: 4368579 - DNA, 23 bp, Homo sapiens
gatcctcatatggcccagtgtca

SEQ ID NO: 4368580 - DNA, 14 bp, Homo sapiens
gatcctccacagag

SEQ ID NO: 4368581 - DNA, 15 bp, Homo sapiens
gatcctccacagaga

SEQ ID NO: 4368582 - DNA, 17 bp, Homo sapiens
gatcctccacagagagg

SEQ ID NO: 4368583 - DNA, 15 bp, Homo sapiens
gatcctcccacctca

SEQ ID NO: 4368584 - DNA, 15 bp, Homo sapiens
gatcctctcacctca

SEQ ID NO: 4368585 - DNA, 21 bp, Homo sapiens
gatcctctcctttgaaacctg

SEQ ID NO: 4368586 - DNA, 12 bp, Homo sapiens
gatcctctctgg

SEQ ID NO: 4368587 - DNA, 18 bp, Homo sapiens
gatcctgctgctttgggc

SEQ ID NO: 4368588 - DNA, 22 bp, Homo sapiens
gatcctgggtcaaaaaaaagaa

SEQ ID NO: 4368589 - DNA, 21 bp, Homo sapiens
gatccttcaaagtctcaatga

SEQ ID NO: 4368590 - DNA, 17 bp, Homo sapiens
gatcgagaccatcctgg

SEQ ID NO: 4368591 - DNA, 18 bp, Homo sapiens
gatcgagaccatcctggc

SEQ ID NO: 4368592 - DNA, 18 bp, Homo sapiens
gatcgcaccactgcactc

SEQ ID NO: 4368593 - DNA, 22 bp, Homo sapiens
gatcgcaccactgcactccagc

SEQ ID NO: 4368594 - DNA, 22 bp, Homo sapiens
gatcgctgcacatggcctgagc

SEQ ID NO: 4368595 - DNA, 23 bp, Homo sapiens
gatcgtgccgttactctccaacc

SEQ ID NO: 4368596 - DNA, 23 bp, Homo sapiens
gatctaaacagttatttctgttt

SEQ ID NO: 4368597 - DNA, 15 bp, Homo sapiens
gatctacacatgttg

SEQ ID NO: 4368598 - DNA, 21 bp, Homo sapiens
gatctacacatgttgccttgc

SEQ ID NO: 4368599 - DNA, 18 bp, Homo sapiens
gatctaccagcataaata

SEQ ID NO: 4368600 - DNA, 14 bp, Homo sapiens
gatctatgggaaga

SEQ ID NO: 4368601 - DNA, 20 bp, Homo sapiens
gatctccctgccgcctcaat

SEQ ID NO: 4368602 - DNA, 14 bp, Homo sapiens
gatctctgctccct

SEQ ID NO: 4368603 - DNA, 22 bp, Homo sapiens
gatctctgctccctgcaagctc

SEQ ID NO: 4368604 - DNA, 16 bp, Homo sapiens
gatctgaattaaataa

SEQ ID NO: 4368605 - DNA, 15 bp, Homo sapiens
gatctgcacagtcag

SEQ ID NO: 4368606 - DNA, 20 bp, Homo sapiens
gatctgcacagtcagaagga

SEQ ID NO: 4368607 - DNA, 19 bp, Homo sapiens
gatctgctgggctctgcct

SEQ ID NO: 4368608 - DNA, 23 bp, Homo sapiens
gatctgggcattttcctcctctg

SEQ ID NO: 4368609 - DNA, 21 bp, Homo sapiens
gatctggggactgagtgtggg

SEQ ID NO: 4368610 - DNA, 18 bp, Homo sapiens
gatctgtgctttccagct

SEQ ID NO: 4368611 - DNA, 19 bp, Homo sapiens
gatctgtgctttccagctc

SEQ ID NO: 4368612 - DNA, 23 bp, Homo sapiens
gatctgtgctttccagctcaccc

SEQ ID NO: 4368613 - DNA, 19 bp, Homo sapiens
gatctgttttgaaggcaaa

SEQ ID NO: 4368614 - DNA, 20 bp, Homo sapiens
gatctgttttgaaggcaaaa

SEQ ID NO: 4368615 - DNA, 22 bp, Homo sapiens
gatctgttttgtggtttggaat

SEQ ID NO: 4368616 - DNA, 10 bp, Homo sapiens
gatcttaaaa

SEQ ID NO: 4368617 - DNA, 12 bp, Homo sapiens
gatcttaaaata

SEQ ID NO: 4368618 - DNA, 23 bp, Homo sapiens
gatcttcccacaggagggccagc

SEQ ID NO: 4368619 - DNA, 16 bp, Homo sapiens
gatcttgcaaaacagg

SEQ ID NO: 4368620 - DNA, 15 bp, Homo sapiens
gatctttgactgaaa

SEQ ID NO: 4368621 - DNA, 16 bp, Homo sapiens
gatctttgagcccatt

SEQ ID NO: 4368622 - DNA, 21 bp, Homo sapiens
gatctttgagcccattcttct

SEQ ID NO: 4368623 - DNA, 23 bp, Homo sapiens
gatctttgagcccattcttctgg

SEQ ID NO: 4368624 - DNA, 13 bp, Homo sapiens
gatctttgtttaa

SEQ ID NO: 4368625 - DNA, 17 bp, Homo sapiens
gatctttgtttaaatgc

SEQ ID NO: 4368626 - DNA, 16 bp, Homo sapiens
gatgaacaatgtatac

SEQ ID NO: 4368627 - DNA, 17 bp, Homo sapiens
gatgaacatattcatga

SEQ ID NO: 4368628 - DNA, 22 bp, Homo sapiens
gatgaagttttacattgttgag

SEQ ID NO: 4368629 - DNA, 19 bp, Homo sapiens
gatgacaggcgcctgccat

SEQ ID NO: 4368630 - DNA, 17 bp, Homo sapiens
gatgacaggtcagcagt

SEQ ID NO: 4368631 - DNA, 22 bp, Homo sapiens
gatgaccagggatgctgggctg

SEQ ID NO: 4368632 - DNA, 15 bp, Homo sapiens
gatgacgggatgctc

SEQ ID NO: 4368633 - DNA, 20 bp, Homo sapiens
gatgacgggatgctctttaa

SEQ ID NO: 4368634 - DNA, 23 bp, Homo sapiens
gatgacttagcgtcaagacattt

SEQ ID NO: 4368635 - DNA, 16 bp, Homo sapiens
gatgagatttttaaaa

SEQ ID NO: 4368636 - DNA, 23 bp, Homo sapiens
gatgagccaaaccagcagggagt

SEQ ID NO: 4368637 - DNA, 14 bp, Homo sapiens
gatgagcccaccct

SEQ ID NO: 4368638 - DNA, 16 bp, Homo sapiens
gatgagccgggtccgg

SEQ ID NO: 4368639 - DNA, 13 bp, Homo sapiens
gatgaggacagag

SEQ ID NO: 4368640 - DNA, 13 bp, Homo sapiens
gatgaggcagagg

SEQ ID NO: 4368641 - DNA, 19 bp, Homo sapiens
gatgatcaatcctttatta

SEQ ID NO: 4368642 - DNA, 16 bp, Homo sapiens
gatgatctttaaaata

SEQ ID NO: 4368643 - DNA, 14 bp, Homo sapiens
gatgatgatgaaaa

SEQ ID NO: 4368644 - DNA, 14 bp, Homo sapiens
gatgatgctgccag

SEQ ID NO: 4368645 - DNA, 13 bp, Homo sapiens
gatgattaaattt

SEQ ID NO: 4368646 - DNA, 20 bp, Homo sapiens
gatgattgcttgagctcagg

SEQ ID NO: 4368647 - DNA, 12 bp, Homo sapiens
gatgatttaagt

SEQ ID NO: 4368648 - DNA, 18 bp, Homo sapiens
gatgatttcagaaggaga

SEQ ID NO: 4368649 - DNA, 19 bp, Homo sapiens
gatgatttcagaaggagaa

SEQ ID NO: 4368650 - DNA, 21 bp, Homo sapiens
gatgcaaagtacaatgtgttt

SEQ ID NO: 4368651 - DNA, 17 bp, Homo sapiens
gatgcaaggaccaggac

SEQ ID NO: 4368652 - DNA, 18 bp, Homo sapiens
gatgcaaggaccaggact

SEQ ID NO: 4368653 - DNA, 18 bp, Homo sapiens
gatgcaattgctcccatc

SEQ ID NO: 4368654 - DNA, 19 bp, Homo sapiens
gatgcacgtggggcccact

SEQ ID NO: 4368655 - DNA, 21 bp, Homo sapiens
gatgcacgtggggcccactgc

SEQ ID NO: 4368656 - DNA, 18 bp, Homo sapiens
gatgcagataaaatattt

SEQ ID NO: 4368657 - DNA, 12 bp, Homo sapiens
gatgcagcattt

SEQ ID NO: 4368658 - DNA, 12 bp, Homo sapiens
gatgcagctact

SEQ ID NO: 4368659 - DNA, 14 bp, Homo sapiens
gatgcagggctgca

SEQ ID NO: 4368660 - DNA, 24 bp, Homo sapiens
gatgcatcacactcaaggacagga

SEQ ID NO: 4368661 - DNA, 16 bp, Homo sapiens
gatgcatgtcttttaa

SEQ ID NO: 4368662 - DNA, 11 bp, Homo sapiens
gatgcatttca

SEQ ID NO: 4368663 - DNA, 14 bp, Homo sapiens
gatgcatttcaaat

SEQ ID NO: 4368664 - DNA, 15 bp, Homo sapiens
gatgcatttccattt

SEQ ID NO: 4368665 - DNA, 19 bp, Homo sapiens
gatgccaatattaaatctg

SEQ ID NO: 4368666 - DNA, 15 bp, Homo sapiens
gatgccaccggcctg

SEQ ID NO: 4368667 - DNA, 16 bp, Homo sapiens
gatgccagctgtctcc

SEQ ID NO: 4368668 - DNA, 15 bp, Homo sapiens
gatgccatcctcttt

SEQ ID NO: 4368669 - DNA, 16 bp, Homo sapiens
gatgcctccaccgctg

SEQ ID NO: 4368670 - DNA, 15 bp, Homo sapiens
gatgcctggtgagca

SEQ ID NO: 4368671 - DNA, 23 bp, Homo sapiens
gatgcctgttaatttataatgta

SEQ ID NO: 4368672 - DNA, 23 bp, Homo sapiens
gatgcgcattctaacctggaggt

SEQ ID NO: 4368673 - DNA, 15 bp, Homo sapiens
gatgctccctcccct

SEQ ID NO: 4368674 - DNA, 21 bp, Homo sapiens
gatgctccctcccctgccctg

SEQ ID NO: 4368675 - DNA, 13 bp, Homo sapiens
gatgctccttggg

SEQ ID NO: 4368676 - DNA, 14 bp, Homo sapiens
gatgctccttgggc

SEQ ID NO: 4368677 - DNA, 16 bp, Homo sapiens
gatgctccttgggccc

SEQ ID NO: 4368678 - DNA, 13 bp, Homo sapiens
gatgctgggaccc

SEQ ID NO: 4368679 - DNA, 12 bp, Homo sapiens
gatgctgggctg

SEQ ID NO: 4368680 - DNA, 19 bp, Homo sapiens
gatgctggtggaggaaggg

SEQ ID NO: 4368681 - DNA, 23 bp, Homo sapiens
gatgctggtggaggaagggctgg

SEQ ID NO: 4368682 - DNA, 18 bp, Homo sapiens
gatgctgtagacatctgt

SEQ ID NO: 4368683 - DNA, 20 bp, Homo sapiens
gatgcttgcggcaaaaggaa

SEQ ID NO: 4368684 - DNA, 23 bp, Homo sapiens
gatgcttgcggcaaaaggaaagc

SEQ ID NO: 4368685 - DNA, 19 bp, Homo sapiens
gatgcttggagcaatcaga

SEQ ID NO: 4368686 - DNA, 16 bp, Homo sapiens
gatggaaaaataacaa

SEQ ID NO: 4368687 - DNA, 17 bp, Homo sapiens
gatggaaaattcatttt

SEQ ID NO: 4368688 - DNA, 17 bp, Homo sapiens
gatggaaactgccaaac

SEQ ID NO: 4368689 - DNA, 23 bp, Homo sapiens
gatggaaactgccaaacctcctg

SEQ ID NO: 4368690 - DNA, 14 bp, Homo sapiens
gatggaaatacagt

SEQ ID NO: 4368691 - DNA, 15 bp, Homo sapiens
gatggaacatcagtg

SEQ ID NO: 4368692 - DNA, 19 bp, Homo sapiens
gatggaacatcagtggatg

SEQ ID NO: 4368693 - DNA, 16 bp, Homo sapiens
gatggaactgtgtatt

SEQ ID NO: 4368694 - DNA, 18 bp, Homo sapiens
gatggaactgtgtattta

SEQ ID NO: 4368695 - DNA, 13 bp, Homo sapiens
gatggaatgatgg

SEQ ID NO: 4368696 - DNA, 16 bp, Homo sapiens
gatggacacgagccac

SEQ ID NO: 4368697 - DNA, 17 bp, Homo sapiens
gatggacacgagccaca

SEQ ID NO: 4368698 - DNA, 23 bp, Homo sapiens
gatggacacgagccacaagctgc

SEQ ID NO: 4368699 - DNA, 13 bp, Homo sapiens
gatggaccccagc

SEQ ID NO: 4368700 - DNA, 14 bp, Homo sapiens
gatggacctcagca

SEQ ID NO: 4368701 - DNA, 15 bp, Homo sapiens
gatggagaggacaga

SEQ ID NO: 4368702 - DNA, 14 bp, Homo sapiens
gatggaggagaaga

SEQ ID NO: 4368703 - DNA, 15 bp, Homo sapiens
gatggagggcttggc

SEQ ID NO: 4368704 - DNA, 18 bp, Homo sapiens
gatggagggcttggccca

SEQ ID NO: 4368705 - DNA, 15 bp, Homo sapiens
gatggagggggctgg

SEQ ID NO: 4368706 - DNA, 17 bp, Homo sapiens
gatggagggggctgggg

SEQ ID NO: 4368707 - DNA, 17 bp, Homo sapiens
gatggatgcatcacact

SEQ ID NO: 4368708 - DNA, 17 bp, Homo sapiens
gatggcaacattggaca

SEQ ID NO: 4368709 - DNA, 19 bp, Homo sapiens
gatggcaacattggacaga

SEQ ID NO: 4368710 - DNA, 21 bp, Homo sapiens
gatggcacttataaccaaagc

SEQ ID NO: 4368711 - DNA, 14 bp, Homo sapiens
gatggccagcccct

SEQ ID NO: 4368712 - DNA, 13 bp, Homo sapiens
gatggccatgctc

SEQ ID NO: 4368713 - DNA, 16 bp, Homo sapiens
gatggcctttccttcc

SEQ ID NO: 4368714 - DNA, 24 bp, Homo sapiens
gatggcctttggacccagggcctg

SEQ ID NO: 4368715 - DNA, 22 bp, Homo sapiens
gatggctatgtagacataaaga

SEQ ID NO: 4368716 - DNA, 20 bp, Homo sapiens
gatggcttccgtgagacaca

SEQ ID NO: 4368717 - DNA, 21 bp, Homo sapiens
gatggcttccgtgagacacaa

SEQ ID NO: 4368718 - DNA, 14 bp, Homo sapiens
gatgggaccaggga

SEQ ID NO: 4368719 - DNA, 20 bp, Homo sapiens
gatgggaccagggatggggg

SEQ ID NO: 4368720 - DNA, 18 bp, Homo sapiens
gatgggaggtggaagcag

SEQ ID NO: 4368721 - DNA, 22 bp, Homo sapiens
gatgggaggtggaagcagaggc

SEQ ID NO: 4368722 - DNA, 23 bp, Homo sapiens
gatgggaggtggaagcagaggcc

SEQ ID NO: 4368723 - DNA, 12 bp, Homo sapiens
gatgggccaggg

SEQ ID NO: 4368724 - DNA, 21 bp, Homo sapiens
gatggggctcccagctccttt

SEQ ID NO: 4368725 - DNA, 16 bp, Homo sapiens
gatgggggaactgtga

SEQ ID NO: 4368726 - DNA, 20 bp, Homo sapiens
gatgggtcaggtagggggga

SEQ ID NO: 4368727 - DNA, 21 bp, Homo sapiens
gatgggtcagttgtatcagca

SEQ ID NO: 4368728 - DNA, 16 bp, Homo sapiens
gatgggtgctggtcct

SEQ ID NO: 4368729 - DNA, 21 bp, Homo sapiens
gatggtcttacagcaggcagt

SEQ ID NO: 4368730 - DNA, 15 bp, Homo sapiens
gatggtgactcctga

SEQ ID NO: 4368731 - DNA, 21 bp, Homo sapiens
gatggtgcatgcctgtagtct

SEQ ID NO: 4368732 - DNA, 14 bp, Homo sapiens
gatggtggagggcc

SEQ ID NO: 4368733 - DNA, 17 bp, Homo sapiens
gatggtgtcctgaggcc

SEQ ID NO: 4368734 - DNA, 18 bp, Homo sapiens
gatgtaaaagactttttt

SEQ ID NO: 4368735 - DNA, 15 bp, Homo sapiens
gatgtaaaatgagtt

SEQ ID NO: 4368736 - DNA, 16 bp, Homo sapiens
gatgtaaacagtgcct

SEQ ID NO: 4368737 - DNA, 19 bp, Homo sapiens
gatgtaaacagtgcctgct

SEQ ID NO: 4368738 - DNA, 20 bp, Homo sapiens
gatgtaaacagtgcctgctg

SEQ ID NO: 4368739 - DNA, 17 bp, Homo sapiens
gatgtacagtctgtcat

SEQ ID NO: 4368740 - DNA, 13 bp, Homo sapiens
gatgtagaaagtt

SEQ ID NO: 4368741 - DNA, 20 bp, Homo sapiens
gatgtagggtaaggtgcctt

SEQ ID NO: 4368742 - DNA, 19 bp, Homo sapiens
gatgtagtgattaaatata

SEQ ID NO: 4368743 - DNA, 15 bp, Homo sapiens
gatgtattttcatag

SEQ ID NO: 4368744 - DNA, 23 bp, Homo sapiens
gatgtcaaaggtcgggacagctg

SEQ ID NO: 4368745 - DNA, 18 bp, Homo sapiens
gatgtcccagtgctcacc

SEQ ID NO: 4368746 - DNA, 18 bp, Homo sapiens
gatgtcttctgcctgtta

SEQ ID NO: 4368747 - DNA, 13 bp, Homo sapiens
gatgtcttttata

SEQ ID NO: 4368748 - DNA, 23 bp, Homo sapiens
gatgtgaataggttatatgcaag

SEQ ID NO: 4368749 - DNA, 20 bp, Homo sapiens
gatgtgaattattgacactg

SEQ ID NO: 4368750 - DNA, 22 bp, Homo sapiens
gatgtgaattattgacactgaa

SEQ ID NO: 4368751 - DNA, 21 bp, Homo sapiens
gatgtgagccaccgtgcctgg

SEQ ID NO: 4368752 - DNA, 15 bp, Homo sapiens
gatgtgattgtggaa

SEQ ID NO: 4368753 - DNA, 18 bp, Homo sapiens
gatgtgattgtggaatgg

SEQ ID NO: 4368754 - DNA, 21 bp, Homo sapiens
gatgtgcggagcgggaggcgg

SEQ ID NO: 4368755 - DNA, 14 bp, Homo sapiens
gatgtgctggaggg

SEQ ID NO: 4368756 - DNA, 22 bp, Homo sapiens
gatgtgctggaggggtggccca

SEQ ID NO: 4368757 - DNA, 14 bp, Homo sapiens
gatgtggaggaaga

SEQ ID NO: 4368758 - DNA, 18 bp, Homo sapiens
gatgtggaggaagagcca

SEQ ID NO: 4368759 - DNA, 23 bp, Homo sapiens
gatgtggaggaagagccacctgc

SEQ ID NO: 4368760 - DNA, 13 bp, Homo sapiens
gatgtggatgaaa

SEQ ID NO: 4368761 - DNA, 22 bp, Homo sapiens
gatgtggccaggggtgctcctg

SEQ ID NO: 4368762 - DNA, 21 bp, Homo sapiens
gatgtggccctggcctgctgg

SEQ ID NO: 4368763 - DNA, 20 bp, Homo sapiens
gatgtggtaggtgataaaga

SEQ ID NO: 4368764 - DNA, 16 bp, Homo sapiens
gatgtggtcacagctg

SEQ ID NO: 4368765 - DNA, 17 bp, Homo sapiens
gatgtggtcacagctgt

SEQ ID NO: 4368766 - DNA, 18 bp, Homo sapiens
gatgtggtcacagctgta

SEQ ID NO: 4368767 - DNA, 16 bp, Homo sapiens
gatgtgtaaacaggta

SEQ ID NO: 4368768 - DNA, 17 bp, Homo sapiens
gatgtgtaaacaggtat

SEQ ID NO: 4368769 - DNA, 14 bp, Homo sapiens
gatgtgttcttatt

SEQ ID NO: 4368770 - DNA, 17 bp, Homo sapiens
gatgttaaaataaatgg

SEQ ID NO: 4368771 - DNA, 18 bp, Homo sapiens
gatgttccacctgccaca

SEQ ID NO: 4368772 - DNA, 19 bp, Homo sapiens
gatgttctaagtctttcca

SEQ ID NO: 4368773 - DNA, 16 bp, Homo sapiens
gatgttctttccatga

SEQ ID NO: 4368774 - DNA, 19 bp, Homo sapiens
gatgttgaactttttttaa

SEQ ID NO: 4368775 - DNA, 19 bp, Homo sapiens
gatgtttcattttactgta

SEQ ID NO: 4368776 - DNA, 16 bp, Homo sapiens
gatgttttttctgtaa

SEQ ID NO: 4368777 - DNA, 21 bp, Homo sapiens
gatgttttttctgtaatgtaa

SEQ ID NO: 4368778 - DNA, 21 bp, Homo sapiens
gattaaaaataccttctatgt

SEQ ID NO: 4368779 - DNA, 19 bp, Homo sapiens
gattaaaatgtttgagcac

SEQ ID NO: 4368780 - DNA, 12 bp, Homo sapiens
gattaaaccttt

SEQ ID NO: 4368781 - DNA, 19 bp, Homo sapiens
gattaaacctttttataaa

SEQ ID NO: 4368782 - DNA, 13 bp, Homo sapiens
gattaaattacag

SEQ ID NO: 4368783 - DNA, 17 bp, Homo sapiens
gattaaattacagcttt

SEQ ID NO: 4368784 - DNA, 21 bp, Homo sapiens
gattaaattttagtacatttt

SEQ ID NO: 4368785 - DNA, 11 bp, Homo sapiens
gattaagaaac

SEQ ID NO: 4368786 - DNA, 16 bp, Homo sapiens
gattaagcttttcatt

SEQ ID NO: 4368787 - DNA, 16 bp, Homo sapiens
gattacaaatcagaag

SEQ ID NO: 4368788 - DNA, 17 bp, Homo sapiens
gattacaggaatgaaga

SEQ ID NO: 4368789 - DNA, 19 bp, Homo sapiens
gattacaggaatgaagaac

SEQ ID NO: 4368790 - DNA, 23 bp, Homo sapiens
gattacatccgtaggacaagttt

SEQ ID NO: 4368791 - DNA, 16 bp, Homo sapiens
gattacatctgcctta

SEQ ID NO: 4368792 - DNA, 16 bp, Homo sapiens
gattaccagtctgatt

SEQ ID NO: 4368793 - DNA, 19 bp, Homo sapiens
gattaccagtctgattata

SEQ ID NO: 4368794 - DNA, 13 bp, Homo sapiens
gattacctcctga

SEQ ID NO: 4368795 - DNA, 19 bp, Homo sapiens
gattacgatgtaaattttt

SEQ ID NO: 4368796 - DNA, 19 bp, Homo sapiens
gattactctttgctttgta

SEQ ID NO: 4368797 - DNA, 16 bp, Homo sapiens
gattactgatgtgata

SEQ ID NO: 4368798 - DNA, 18 bp, Homo sapiens
gattacttctctataaaa

SEQ ID NO: 4368799 - DNA, 23 bp, Homo sapiens
gattagcaggccaaggtctgagc

SEQ ID NO: 4368800 - DNA, 16 bp, Homo sapiens
gattagggaaaatgga

SEQ ID NO: 4368801 - DNA, 22 bp, Homo sapiens
gattagtattcaggcactgaga

SEQ ID NO: 4368802 - DNA, 21 bp, Homo sapiens
gattatacaaaagagcatgga

SEQ ID NO: 4368803 - DNA, 17 bp, Homo sapiens
gattatagtaactataa

SEQ ID NO: 4368804 - DNA, 17 bp, Homo sapiens
gattatggaaaaataaa

SEQ ID NO: 4368805 - DNA, 15 bp, Homo sapiens
gattattcagtgtca

SEQ ID NO: 4368806 - DNA, 23 bp, Homo sapiens
gattattgtgacttcactgtata

SEQ ID NO: 4368807 - DNA, 13 bp, Homo sapiens
gattatttacaag

SEQ ID NO: 4368808 - DNA, 20 bp, Homo sapiens
gattatttttcttttaaaga

SEQ ID NO: 4368809 - DNA, 22 bp, Homo sapiens
gattatttttcttttaaagatt

SEQ ID NO: 4368810 - DNA, 14 bp, Homo sapiens
gattcaaatgtttt

SEQ ID NO: 4368811 - DNA, 13 bp, Homo sapiens
gattcaaattgct

SEQ ID NO: 4368812 - DNA, 17 bp, Homo sapiens
gattcaaattgctgctt

SEQ ID NO: 4368813 - DNA, 22 bp, Homo sapiens
gattcaagactcaatgtggaaa

SEQ ID NO: 4368814 - DNA, 14 bp, Homo sapiens
gattcaaggctcag

SEQ ID NO: 4368815 - DNA, 12 bp, Homo sapiens
gattcagcaaaa

SEQ ID NO: 4368816 - DNA, 16 bp, Homo sapiens
gattcaggctgcttgg

SEQ ID NO: 4368817 - DNA, 20 bp, Homo sapiens
gattcagtgttaaatgtgat

SEQ ID NO: 4368818 - DNA, 19 bp, Homo sapiens
gattcagtttctaaaattg

SEQ ID NO: 4368819 - DNA, 15 bp, Homo sapiens
gattcagttttcatt

SEQ ID NO: 4368820 - DNA, 16 bp, Homo sapiens
gattcatagtaacttc

SEQ ID NO: 4368821 - DNA, 18 bp, Homo sapiens
gattcatgtagagagaca

SEQ ID NO: 4368822 - DNA, 20 bp, Homo sapiens
gattcattctcataattcct

SEQ ID NO: 4368823 - DNA, 18 bp, Homo sapiens
gattccaaaaagcacata

SEQ ID NO: 4368824 - DNA, 18 bp, Homo sapiens
gattccaaagagtagaat

SEQ ID NO: 4368825 - DNA, 23 bp, Homo sapiens
gattccaaagagtagaattgcat

SEQ ID NO: 4368826 - DNA, 17 bp, Homo sapiens
gattccactacacctgg

SEQ ID NO: 4368827 - DNA, 21 bp, Homo sapiens
gattcccagagacaggaaaat

SEQ ID NO: 4368828 - DNA, 23 bp, Homo sapiens
gattcctagattacatctgcctt

SEQ ID NO: 4368829 - DNA, 13 bp, Homo sapiens
gattcctttccct

SEQ ID NO: 4368830 - DNA, 20 bp, Homo sapiens
gattcctttccctttagcac

SEQ ID NO: 4368831 - DNA, 20 bp, Homo sapiens
gattctatttatatgtacat

SEQ ID NO: 4368832 - DNA, 11 bp, Homo sapiens
gattctccttc

SEQ ID NO: 4368833 - DNA, 13 bp, Homo sapiens
gattctccttcag

SEQ ID NO: 4368834 - DNA, 17 bp, Homo sapiens
gattctccttcagccct

SEQ ID NO: 4368835 - DNA, 18 bp, Homo sapiens
gattctccttcagccctc

SEQ ID NO: 4368836 - DNA, 21 bp, Homo sapiens
gattctcgccccttccctctc

SEQ ID NO: 4368837 - DNA, 16 bp, Homo sapiens
gattctctctttaacc

SEQ ID NO: 4368838 - DNA, 22 bp, Homo sapiens
gattctgagcaaaggccctggg

SEQ ID NO: 4368839 - DNA, 18 bp, Homo sapiens
gattctgcagtaaatctt

SEQ ID NO: 4368840 - DNA, 19 bp, Homo sapiens
gattctgcagtaaatcttt

SEQ ID NO: 4368841 - DNA, 21 bp, Homo sapiens
gattctgcagtaaatctttta

SEQ ID NO: 4368842 - DNA, 15 bp, Homo sapiens
gattctgcctctctg

SEQ ID NO: 4368843 - DNA, 16 bp, Homo sapiens
gattctgcctctctgg

SEQ ID NO: 4368844 - DNA, 18 bp, Homo sapiens
gattctgtgtcagagccc

SEQ ID NO: 4368845 - DNA, 13 bp, Homo sapiens
gattcttgtaaat

SEQ ID NO: 4368846 - DNA, 16 bp, Homo sapiens
gattcttgtaaatctt

SEQ ID NO: 4368847 - DNA, 14 bp, Homo sapiens
gattctttccccag

SEQ ID NO: 4368848 - DNA, 19 bp, Homo sapiens
gattcttttaaattagaaa

SEQ ID NO: 4368849 - DNA, 22 bp, Homo sapiens
gattcttttcccatcaccagaa

SEQ ID NO: 4368850 - DNA, 20 bp, Homo sapiens
gattctttttttctgtcagt

SEQ ID NO: 4368851 - DNA, 21 bp, Homo sapiens
gattctttttttctgtcagta

SEQ ID NO: 4368852 - DNA, 18 bp, Homo sapiens
gattgaaaatgtccagga

SEQ ID NO: 4368853 - DNA, 20 bp, Homo sapiens
gattgaaaatgtccaggaaa

SEQ ID NO: 4368854 - DNA, 18 bp, Homo sapiens
gattgaaaccaagttgaa

SEQ ID NO: 4368855 - DNA, 12 bp, Homo sapiens
gattgagaagcc

SEQ ID NO: 4368856 - DNA, 14 bp, Homo sapiens
gattgagaagccat

SEQ ID NO: 4368857 - DNA, 20 bp, Homo sapiens
gattgaggggccctggccag

SEQ ID NO: 4368858 - DNA, 16 bp, Homo sapiens
gattgagtctgtgcca

SEQ ID NO: 4368859 - DNA, 17 bp, Homo sapiens
gattgatcacacagtgt

SEQ ID NO: 4368860 - DNA, 21 bp, Homo sapiens
gattgatcacacagtgttagt

SEQ ID NO: 4368861 - DNA, 23 bp, Homo sapiens
gattgcccctggctttgcctctt

SEQ ID NO: 4368862 - DNA, 18 bp, Homo sapiens
gattgcttaaaagcattt

SEQ ID NO: 4368863 - DNA, 20 bp, Homo sapiens
gattggctcacactgagaat

SEQ ID NO: 4368864 - DNA, 16 bp, Homo sapiens
gattggttaaaatgtg

SEQ ID NO: 4368865 - DNA, 14 bp, Homo sapiens
gattgtatgttgag

SEQ ID NO: 4368866 - DNA, 16 bp, Homo sapiens
gattgtatgttgagga

SEQ ID NO: 4368867 - DNA, 21 bp, Homo sapiens
gattgtcaccatgatcactta

SEQ ID NO: 4368868 - DNA, 13 bp, Homo sapiens
gattgtgcccctg

SEQ ID NO: 4368869 - DNA, 16 bp, Homo sapiens
gattgtggaatgttgg

SEQ ID NO: 4368870 - DNA, 16 bp, Homo sapiens
gatttaaaagcctgct

SEQ ID NO: 4368871 - DNA, 17 bp, Homo sapiens
gatttaaactccagcat

SEQ ID NO: 4368872 - DNA, 18 bp, Homo sapiens
gatttaacattatctagt

SEQ ID NO: 4368873 - DNA, 18 bp, Homo sapiens
gatttaacctgttatttc

SEQ ID NO: 4368874 - DNA, 19 bp, Homo sapiens
gatttaagtgaatacatta

SEQ ID NO: 4368875 - DNA, 13 bp, Homo sapiens
gatttacattcaa

SEQ ID NO: 4368876 - DNA, 22 bp, Homo sapiens
gatttacccagaatgtcagatt

SEQ ID NO: 4368877 - DNA, 20 bp, Homo sapiens
gatttagaggtaaaagtaca

SEQ ID NO: 4368878 - DNA, 15 bp, Homo sapiens
gatttaggagcagaa

SEQ ID NO: 4368879 - DNA, 16 bp, Homo sapiens
gatttaggagcagaaa

SEQ ID NO: 4368880 - DNA, 15 bp, Homo sapiens
gatttatgtcagcac

SEQ ID NO: 4368881 - DNA, 15 bp, Homo sapiens
gatttattgtaagca

SEQ ID NO: 4368882 - DNA, 11 bp, Homo sapiens
gatttatttgc

SEQ ID NO: 4368883 - DNA, 15 bp, Homo sapiens
gatttatttgcttct

SEQ ID NO: 4368884 - DNA, 17 bp, Homo sapiens
gatttatttgcttcttc

SEQ ID NO: 4368885 - DNA, 13 bp, Homo sapiens
gatttcatatcta

SEQ ID NO: 4368886 - DNA, 15 bp, Homo sapiens
gatttcatattgatc

SEQ ID NO: 4368887 - DNA, 22 bp, Homo sapiens
gatttcatattgatctttttat

SEQ ID NO: 4368888 - DNA, 14 bp, Homo sapiens
gatttccaagcctc

SEQ ID NO: 4368889 - DNA, 15 bp, Homo sapiens
gatttccagccttct

SEQ ID NO: 4368890 - DNA, 19 bp, Homo sapiens
gatttcccactgcactcca

SEQ ID NO: 4368891 - DNA, 18 bp, Homo sapiens
gatttccctgcagacctc

SEQ ID NO: 4368892 - DNA, 23 bp, Homo sapiens
gatttccctgcagacctcaagcc

SEQ ID NO: 4368893 - DNA, 13 bp, Homo sapiens
gatttccttgaat

SEQ ID NO: 4368894 - DNA, 22 bp, Homo sapiens
gatttccttgaatgtggcttga

SEQ ID NO: 4368895 - DNA, 15 bp, Homo sapiens
gatttccttgtgcaa

SEQ ID NO: 4368896 - DNA, 14 bp, Homo sapiens
gatttcgtgtgccg

SEQ ID NO: 4368897 - DNA, 17 bp, Homo sapiens
gatttcgtgtgccgctg

SEQ ID NO: 4368898 - DNA, 18 bp, Homo sapiens
gatttcgtgtgccgctgc

SEQ ID NO: 4368899 - DNA, 23 bp, Homo sapiens
gatttctatggctttcaaagcta

SEQ ID NO: 4368900 - DNA, 22 bp, Homo sapiens
gatttctttctttgcaccaaag

SEQ ID NO: 4368901 - DNA, 13 bp, Homo sapiens
gatttgaaaaact

SEQ ID NO: 4368902 - DNA, 18 bp, Homo sapiens
gatttgaaaaacttttag

SEQ ID NO: 4368903 - DNA, 12 bp, Homo sapiens
gatttgaaaaga

SEQ ID NO: 4368904 - DNA, 18 bp, Homo sapiens
gatttgaaaagaatttgt

SEQ ID NO: 4368905 - DNA, 16 bp, Homo sapiens
gatttgaactcagatc

SEQ ID NO: 4368906 - DNA, 22 bp, Homo sapiens
gatttgaactcagatctgtctg

SEQ ID NO: 4368907 - DNA, 22 bp, Homo sapiens
gatttgatctttgtttaaatgc

SEQ ID NO: 4368908 - DNA, 19 bp, Homo sapiens
gatttgatgagttaactgt

SEQ ID NO: 4368909 - DNA, 21 bp, Homo sapiens
gatttgatgagttaactgtga

SEQ ID NO: 4368910 - DNA, 21 bp, Homo sapiens
gatttgcattgaacacaaact

SEQ ID NO: 4368911 - DNA, 22 bp, Homo sapiens
gatttgccattgtccaggaaag

SEQ ID NO: 4368912 - DNA, 20 bp, Homo sapiens
gatttggccacactggggct

SEQ ID NO: 4368913 - DNA, 19 bp, Homo sapiens
gatttgggctgaatgtatg

SEQ ID NO: 4368914 - DNA, 18 bp, Homo sapiens
gatttgtgtttttctttt

SEQ ID NO: 4368915 - DNA, 23 bp, Homo sapiens
gattttaatggattgttaatttc

SEQ ID NO: 4368916 - DNA, 16 bp, Homo sapiens
cccccacagtgctgtc

SEQ ID NO: 4368917 - DNA, 12 bp, Homo sapiens
cccccaccccct

SEQ ID NO: 4368918 - DNA, 13 bp, Homo sapiens
cccccaccctcca

SEQ ID NO: 4368919 - DNA, 21 bp, Homo sapiens
cccccactctcattccccagg

SEQ ID NO: 4368920 - DNA, 14 bp, Homo sapiens
cccccactgcaccc

SEQ ID NO: 4368921 - DNA, 15 bp, Homo sapiens
cccccagaaagcctc

SEQ ID NO: 4368922 - DNA, 19 bp, Homo sapiens
cccccagaaagcctcctgc

SEQ ID NO: 4368923 - DNA, 19 bp, Homo sapiens
cccccagattccaacattt

SEQ ID NO: 4368924 - DNA, 23 bp, Homo sapiens
cccccagcactaaggccgtgtct

SEQ ID NO: 4368925 - DNA, 15 bp, Homo sapiens
cccccagcagaggca

SEQ ID NO: 4368926 - DNA, 22 bp, Homo sapiens
cccccagcagaggcaggctggg

SEQ ID NO: 4368927 - DNA, 13 bp, Homo sapiens
cccccagccccgg

SEQ ID NO: 4368928 - DNA, 11 bp, Homo sapiens
cccccaggact

SEQ ID NO: 4368929 - DNA, 15 bp, Homo sapiens
cccccaggactgggc

SEQ ID NO: 4368930 - DNA, 17 bp, Homo sapiens
cccccaggactgggcca

SEQ ID NO: 4368931 - DNA, 22 bp, Homo sapiens
cccccaggcctgtccaccctgc

SEQ ID NO: 4368932 - DNA, 20 bp, Homo sapiens
cccccagtccccacccctgc

SEQ ID NO: 4368933 - DNA, 11 bp, Homo sapiens
cccccatgctg

SEQ ID NO: 4368934 - DNA, 12 bp, Homo sapiens
ccccccagcact

SEQ ID NO: 4368935 - DNA, 13 bp, Homo sapiens
cccccgagccctg

SEQ ID NO: 4368936 - DNA, 14 bp, Homo sapiens
cccccgagccctga

SEQ ID NO: 4368937 - DNA, 23 bp, Homo sapiens
cccccgagccctgactcctggac

SEQ ID NO: 4368938 - DNA, 15 bp, Homo sapiens
cccccgaggctgcta

SEQ ID NO: 4368939 - DNA, 14 bp, Homo sapiens
cccccgcacagcca

SEQ ID NO: 4368940 - DNA, 21 bp, Homo sapiens
cccccgcacagccacccgtgg

SEQ ID NO: 4368941 - DNA, 19 bp, Homo sapiens
cccccgcgctcgcccagca

SEQ ID NO: 4368942 - DNA, 20 bp, Homo sapiens
cccccgcgctcgcccagcag

SEQ ID NO: 4368943 - DNA, 14 bp, Homo sapiens
cccccggccccctg

SEQ ID NO: 4368944 - DNA, 17 bp, Homo sapiens
cccccgtggtgcctgca

SEQ ID NO: 4368945 - DNA, 19 bp, Homo sapiens
cccccgtttctccttttcc

SEQ ID NO: 4368946 - DNA, 22 bp, Homo sapiens
ccccctagcaatacagggaggc

SEQ ID NO: 4368947 - DNA, 14 bp, Homo sapiens
ccccctcatctgca

SEQ ID NO: 4368948 - DNA, 13 bp, Homo sapiens
ccccctcctccag

SEQ ID NO: 4368949 - DNA, 14 bp, Homo sapiens
ccccctcctccagt

SEQ ID NO: 4368950 - DNA, 12 bp, Homo sapiens
ccccctctgtcc

SEQ ID NO: 4368951 - DNA, 20 bp, Homo sapiens
ccccctgcaacttccgctga

SEQ ID NO: 4368952 - DNA, 12 bp, Homo sapiens
ccccctgccctg

SEQ ID NO: 4368953 - DNA, 14 bp, Homo sapiens
ccccctgccctgca

SEQ ID NO: 4368954 - DNA, 18 bp, Homo sapiens
ccccctgctccaccagca

SEQ ID NO: 4368955 - DNA, 20 bp, Homo sapiens
ccccctgctggctcttctgc

SEQ ID NO: 4368956 - DNA, 16 bp, Homo sapiens
ccccctggtctctggt

SEQ ID NO: 4368957 - DNA, 17 bp, Homo sapiens
ccccctgtcccattcta

SEQ ID NO: 4368958 - DNA, 19 bp, Homo sapiens
ccccctgtcccattctaga

SEQ ID NO: 4368959 - DNA, 12 bp, Homo sapiens
cccccttcccat

SEQ ID NO: 4368960 - DNA, 15 bp, Homo sapiens
ccccctttcacactg

SEQ ID NO: 4368961 - DNA, 18 bp, Homo sapiens
ccccctttcacactggat

SEQ ID NO: 4368962 - DNA, 22 bp, Homo sapiens
ccccctttcagatgtcttctgc

SEQ ID NO: 4368963 - DNA, 20 bp, Homo sapiens
ccccctttgactctggggtg

SEQ ID NO: 4368964 - DNA, 14 bp, Homo sapiens
ccccgactccagcc

SEQ ID NO: 4368965 - DNA, 17 bp, Homo sapiens
ccccgactccagccagc

SEQ ID NO: 4368966 - DNA, 18 bp, Homo sapiens
ccccgactccagccagcg

SEQ ID NO: 4368967 - DNA, 14 bp, Homo sapiens
ccccgacttttgtt

SEQ ID NO: 4368968 - DNA, 12 bp, Homo sapiens
ccccgagccctg

SEQ ID NO: 4368969 - DNA, 17 bp, Homo sapiens
ccccgaggagctgggcc

SEQ ID NO: 4368970 - DNA, 13 bp, Homo sapiens
ccccgaggctgct

SEQ ID NO: 4368971 - DNA, 17 bp, Homo sapiens
ccccgaggtaggggtgg

SEQ ID NO: 4368972 - DNA, 14 bp, Homo sapiens
ccccgagtctccgg

SEQ ID NO: 4368973 - DNA, 13 bp, Homo sapiens
ccccgcacagcca

SEQ ID NO: 4368974 - DNA, 15 bp, Homo sapiens
ccccgcacagccacc

SEQ ID NO: 4368975 - DNA, 19 bp, Homo sapiens
ccccgcacagccacccgtg

SEQ ID NO: 4368976 - DNA, 22 bp, Homo sapiens
ccccgcagacggtctgtgtgct

SEQ ID NO: 4368977 - DNA, 23 bp, Homo sapiens
ccccgcagacggtctgtgtgctg

SEQ ID NO: 4368978 - DNA, 13 bp, Homo sapiens
ccccgcagcccgc

SEQ ID NO: 4368979 - DNA, 12 bp, Homo sapiens
ccccgcccccag

SEQ ID NO: 4368980 - DNA, 14 bp, Homo sapiens
ccccgcctgccacc

SEQ ID NO: 4368981 - DNA, 21 bp, Homo sapiens
ccccgcgctcgcccagcagga

SEQ ID NO: 4368982 - DNA, 17 bp, Homo sapiens
ccccgcgggttctagac

SEQ ID NO: 4368983 - DNA, 22 bp, Homo sapiens
ccccgctctgcatgcggcccag

SEQ ID NO: 4368984 - DNA, 17 bp, Homo sapiens
ccccgcttgtccagcgc

SEQ ID NO: 4368985 - DNA, 13 bp, Homo sapiens
ccccggcaagcca

SEQ ID NO: 4368986 - DNA, 18 bp, Homo sapiens
ccccggccaaggacccag

SEQ ID NO: 4368987 - DNA, 23 bp, Homo sapiens
ccccggccaaggacccaggcgct

SEQ ID NO: 4368988 - DNA, 21 bp, Homo sapiens
ccccgggctgggcccctccag

SEQ ID NO: 4368989 - DNA, 16 bp, Homo sapiens
ccccggggaccctgtg

SEQ ID NO: 4368990 - DNA, 17 bp, Homo sapiens
ccccggtcccccagagc

SEQ ID NO: 4368991 - DNA, 19 bp, Homo sapiens
ccccggtcccccagagcat

SEQ ID NO: 4368992 - DNA, 15 bp, Homo sapiens
ccccgtcggactgcc

SEQ ID NO: 4368993 - DNA, 18 bp, Homo sapiens
ccccgtctctcttggacc

SEQ ID NO: 4368994 - DNA, 22 bp, Homo sapiens
ccccgtctctcttggacccacc

SEQ ID NO: 4368995 - DNA, 20 bp, Homo sapiens
ccccgtggccatccctgtga

SEQ ID NO: 4368996 - DNA, 15 bp, Homo sapiens
ccccgtttcttgcaa

SEQ ID NO: 4368997 - DNA, 12 bp, Homo sapiens
cccctagatcca

SEQ ID NO: 4368998 - DNA, 13 bp, Homo sapiens
cccctagatccag

SEQ ID NO: 4368999 - DNA, 14 bp, Homo sapiens
cccctatccaccca

SEQ ID NO: 4369000 - DNA, 21 bp, Homo sapiens
cccctatccacccagcccatt

SEQ ID NO: 4369001 - DNA, 12 bp, Homo sapiens
cccctatcctct

SEQ ID NO: 4369002 - DNA, 21 bp, Homo sapiens
cccctcagatgatctctccac

SEQ ID NO: 4369003 - DNA, 23 bp, Homo sapiens
cccctcagatgatctctccacgg

SEQ ID NO: 4369004 - DNA, 11 bp, Homo sapiens
cccctcatctg

SEQ ID NO: 4369005 - DNA, 13 bp, Homo sapiens
cccctcccaccgc

SEQ ID NO: 4369006 - DNA, 15 bp, Homo sapiens
cccctcccagacagg

SEQ ID NO: 4369007 - DNA, 19 bp, Homo sapiens
cccctcccagacaggccct

SEQ ID NO: 4369008 - DNA, 20 bp, Homo sapiens
cccctcccagacaggccctc

SEQ ID NO: 4369009 - DNA, 13 bp, Homo sapiens
cccctccccagcc

SEQ ID NO: 4369010 - DNA, 18 bp, Homo sapiens
cccctccccagccagccc

SEQ ID NO: 4369011 - DNA, 16 bp, Homo sapiens
cccctcccctggggac

SEQ ID NO: 4369012 - DNA, 19 bp, Homo sapiens
cccctcccctggggacgcc

SEQ ID NO: 4369013 - DNA, 15 bp, Homo sapiens
cccctccctacctca

SEQ ID NO: 4369014 - DNA, 17 bp, Homo sapiens
cccctccctacctcaac

SEQ ID NO: 4369015 - DNA, 15 bp, Homo sapiens
cccctccctgcctgc

SEQ ID NO: 4369016 - DNA, 12 bp, Homo sapiens
cccctccctttc

SEQ ID NO: 4369017 - DNA, 18 bp, Homo sapiens
cccctccggccccgtctc

SEQ ID NO: 4369018 - DNA, 13 bp, Homo sapiens
cccctcctcagcc

SEQ ID NO: 4369019 - DNA, 12 bp, Homo sapiens
cccctcctccac

SEQ ID NO: 4369020 - DNA, 12 bp, Homo sapiens
cccctcctccct

SEQ ID NO: 4369021 - DNA, 14 bp, Homo sapiens
cccctcctccctca

SEQ ID NO: 4369022 - DNA, 15 bp, Homo sapiens
cccctcctccctcag

SEQ ID NO: 4369023 - DNA, 16 bp, Homo sapiens
cccctcctccctcaga

SEQ ID NO: 4369024 - DNA, 19 bp, Homo sapiens
cccctcctccctcagaccc

SEQ ID NO: 4369025 - DNA, 21 bp, Homo sapiens
cccctcctccctcagacccag

SEQ ID NO: 4369026 - DNA, 21 bp, Homo sapiens
cccctcctccctcagactcag

SEQ ID NO: 4369027 - DNA, 13 bp, Homo sapiens
cccctcctctgcc

SEQ ID NO: 4369028 - DNA, 16 bp, Homo sapiens
cccctccttccccaga

SEQ ID NO: 4369029 - DNA, 21 bp, Homo sapiens
cccctccttccccagacccag

SEQ ID NO: 4369030 - DNA, 13 bp, Homo sapiens
cccctctctttct

SEQ ID NO: 4369031 - DNA, 17 bp, Homo sapiens
cccctctgcacccagaa

SEQ ID NO: 4369032 - DNA, 18 bp, Homo sapiens
cccctctgcccctgcagc

SEQ ID NO: 4369033 - DNA, 22 bp, Homo sapiens
cccctctgccggtcgggcagcc

SEQ ID NO: 4369034 - DNA, 12 bp, Homo sapiens
cccctctgcctt

SEQ ID NO: 4369035 - DNA, 13 bp, Homo sapiens
cccctctgccttg

SEQ ID NO: 4369036 - DNA, 19 bp, Homo sapiens
cccgtgggtgggcctggcc

SEQ ID NO: 4369037 - DNA, 14 bp, Homo sapiens
cccgtgtcctctcc

SEQ ID NO: 4369038 - DNA, 20 bp, Homo sapiens
cccgtgtcctctccctgcca

SEQ ID NO: 4369039 - DNA, 15 bp, Homo sapiens
cccgttgccccactc

SEQ ID NO: 4369040 - DNA, 13 bp, Homo sapiens
cccgttttgtcac

SEQ ID NO: 4369041 - DNA, 15 bp, Homo sapiens
ccctacacctccctc

SEQ ID NO: 4369042 - DNA, 14 bp, Homo sapiens
ccctaccccaccac

SEQ ID NO: 4369043 - DNA, 15 bp, Homo sapiens
ccctacctcaacctg

SEQ ID NO: 4369044 - DNA, 19 bp, Homo sapiens
ccctacctcaacctgtaaa

SEQ ID NO: 4369045 - DNA, 16 bp, Homo sapiens
ccctacctcaggcagg

SEQ ID NO: 4369046 - DNA, 23 bp, Homo sapiens
ccctacctgattggtgcaaccct

SEQ ID NO: 4369047 - DNA, 14 bp, Homo sapiens
ccctacctgcttca

SEQ ID NO: 4369048 - DNA, 16 bp, Homo sapiens
ccctactcccctgggc

SEQ ID NO: 4369049 - DNA, 18 bp, Homo sapiens
ccctactgaaccctgcct

SEQ ID NO: 4369050 - DNA, 20 bp, Homo sapiens
ccctactgaaccctgcctct

SEQ ID NO: 4369051 - DNA, 22 bp, Homo sapiens
ccctactgaaccctgcctcttg

SEQ ID NO: 4369052 - DNA, 16 bp, Homo sapiens
ccctacttccaggatg

SEQ ID NO: 4369053 - DNA, 15 bp, Homo sapiens
ccctagagcctgcct

SEQ ID NO: 4369054 - DNA, 12 bp, Homo sapiens
ccctagatccag

SEQ ID NO: 4369055 - DNA, 16 bp, Homo sapiens
ccctagatccagaaat

SEQ ID NO: 4369056 - DNA, 21 bp, Homo sapiens
ccctagctttagaccctgggt

SEQ ID NO: 4369057 - DNA, 11 bp, Homo sapiens
ccctataaatc

SEQ ID NO: 4369058 - DNA, 18 bp, Homo sapiens
ccctatagcactgagctc

SEQ ID NO: 4369059 - DNA, 13 bp, Homo sapiens
ccctatcagttga

SEQ ID NO: 4369060 - DNA, 14 bp, Homo sapiens
ccctatccacccag

SEQ ID NO: 4369061 - DNA, 18 bp, Homo sapiens
ccctatccacccagccca

SEQ ID NO: 4369062 - DNA, 19 bp, Homo sapiens
ccctatccacccagcccat

SEQ ID NO: 4369063 - DNA, 17 bp, Homo sapiens
ccctatctaaccctccc

SEQ ID NO: 4369064 - DNA, 14 bp, Homo sapiens
ccctatctgtgatt

SEQ ID NO: 4369065 - DNA, 20 bp, Homo sapiens
ccctatttagatgataaaga

SEQ ID NO: 4369066 - DNA, 16 bp, Homo sapiens
ccctatttccccaccc

SEQ ID NO: 4369067 - DNA, 21 bp, Homo sapiens
ccctcaaaccaagggtacaga

SEQ ID NO: 4369068 - DNA, 16 bp, Homo sapiens
ccctcaaagaggcctt

SEQ ID NO: 4369069 - DNA, 19 bp, Homo sapiens
ccctcaatccaccttcagg

SEQ ID NO: 4369070 - DNA, 11 bp, Homo sapiens
ccctcacccat

SEQ ID NO: 4369071 - DNA, 17 bp, Homo sapiens
ccctcacccatcctaga

SEQ ID NO: 4369072 - DNA, 17 bp, Homo sapiens
ccctcaccccctccttc

SEQ ID NO: 4369073 - DNA, 17 bp, Homo sapiens
ccctcactctgtcagcc

SEQ ID NO: 4369074 - DNA, 16 bp, Homo sapiens
ccctcagacccaggag

SEQ ID NO: 4369075 - DNA, 20 bp, Homo sapiens
ccctcagacccaggagtcca

SEQ ID NO: 4369076 - DNA, 23 bp, Homo sapiens
ccctcagacccaggagtccagac

SEQ ID NO: 4369077 - DNA, 23 bp, Homo sapiens
ccctcagacccaggggtccaggc

SEQ ID NO: 4369078 - DNA, 22 bp, Homo sapiens
ccctcagatgatctctccacgg

SEQ ID NO: 4369079 - DNA, 13 bp, Homo sapiens
ccctcagcagctc

SEQ ID NO: 4369080 - DNA, 12 bp, Homo sapiens
ccctcaggccca

SEQ ID NO: 4369081 - DNA, 18 bp, Homo sapiens
ccctcaggcccaggagtc

SEQ ID NO: 4369082 - DNA, 14 bp, Homo sapiens
ccctcagggagcct

SEQ ID NO: 4369083 - DNA, 17 bp, Homo sapiens
ccctcatcccgagcacc

SEQ ID NO: 4369084 - DNA, 15 bp, Homo sapiens
ccctcatggctctgg

SEQ ID NO: 4369085 - DNA, 15 bp, Homo sapiens
ccctcattcaggaaa

SEQ ID NO: 4369086 - DNA, 11 bp, Homo sapiens
ccctccaaaga

SEQ ID NO: 4369087 - DNA, 15 bp, Homo sapiens
ccctccaccccacag

SEQ ID NO: 4369088 - DNA, 14 bp, Homo sapiens
ccctccaccccagg

SEQ ID NO: 4369089 - DNA, 15 bp, Homo sapiens
ccctccaccccagga

SEQ ID NO: 4369090 - DNA, 17 bp, Homo sapiens
ccctccacgcctcctgg

SEQ ID NO: 4369091 - DNA, 21 bp, Homo sapiens
ccctccacgcctcctggccag

SEQ ID NO: 4369092 - DNA, 13 bp, Homo sapiens
ccctccagagccc

SEQ ID NO: 4369093 - DNA, 23 bp, Homo sapiens
ccctccattgggcacagtccaga

SEQ ID NO: 4369094 - DNA, 16 bp, Homo sapiens
ccctcccaccagaacg

SEQ ID NO: 4369095 - DNA, 21 bp, Homo sapiens
ccctcccaccagaacgcaccc

SEQ ID NO: 4369096 - DNA, 16 bp, Homo sapiens
ccctcccacccccagc

SEQ ID NO: 4369097 - DNA, 20 bp, Homo sapiens
ccctcccagacaggccctcc

SEQ ID NO: 4369098 - DNA, 19 bp, Homo sapiens
ccctccccacacctcccta

SEQ ID NO: 4369099 - DNA, 21 bp, Homo sapiens
ccctccccacacctccctact

SEQ ID NO: 4369100 - DNA, 18 bp, Homo sapiens
ccctccccagactctcag

SEQ ID NO: 4369101 - DNA, 12 bp, Homo sapiens
ccctccccagcc

SEQ ID NO: 4369102 - DNA, 15 bp, Homo sapiens
ccctccccaggctgg

SEQ ID NO: 4369103 - DNA, 12 bp, Homo sapiens
ccctccccaggg

SEQ ID NO: 4369104 - DNA, 18 bp, Homo sapiens
ccctcccccattccctcc

SEQ ID NO: 4369105 - DNA, 13 bp, Homo sapiens
ccctccccctgag

SEQ ID NO: 4369106 - DNA, 13 bp, Homo sapiens
ccctcccctgcag

SEQ ID NO: 4369107 - DNA, 14 bp, Homo sapiens
ccctcccctgcaga

SEQ ID NO: 4369108 - DNA, 13 bp, Homo sapiens
ccctcccctgccc

SEQ ID NO: 4369109 - DNA, 12 bp, Homo sapiens
ccctcccctggg

SEQ ID NO: 4369110 - DNA, 23 bp, Homo sapiens
ccctcccgccccttcccactcac

SEQ ID NO: 4369111 - DNA, 16 bp, Homo sapiens
ccctccctaccctaac

SEQ ID NO: 4369112 - DNA, 20 bp, Homo sapiens
ccctccctacctcaacctgt

SEQ ID NO: 4369113 - DNA, 20 bp, Homo sapiens
ccctccctgactccctgtgg

SEQ ID NO: 4369114 - DNA, 21 bp, Homo sapiens
ccctccctgactccctgtggg

SEQ ID NO: 4369115 - DNA, 21 bp, Homo sapiens
ccctccctgcctgagggcagt

SEQ ID NO: 4369116 - DNA, 16 bp, Homo sapiens
ccctccctgcctgctc

SEQ ID NO: 4369117 - DNA, 12 bp, Homo sapiens
ccctccctgcta

SEQ ID NO: 4369118 - DNA, 22 bp, Homo sapiens
ccctccctgctagcacagaggc

SEQ ID NO: 4369119 - DNA, 14 bp, Homo sapiens
ccctccctggagtg

SEQ ID NO: 4369120 - DNA, 19 bp, Homo sapiens
ccctccctggctcccatga

SEQ ID NO: 4369121 - DNA, 11 bp, Homo sapiens
ccctccctgtc

SEQ ID NO: 4369122 - DNA, 17 bp, Homo sapiens
ccctcctcagccagcct

SEQ ID NO: 4369123 - DNA, 15 bp, Homo sapiens
ccctcctccaggcct

SEQ ID NO: 4369124 - DNA, 10 bp, Homo sapiens
ccctcctccc

SEQ ID NO: 4369125 - DNA, 16 bp, Homo sapiens
ccctcctccccagagc

SEQ ID NO: 4369126 - DNA, 12 bp, Homo sapiens
ccctcctccctc

SEQ ID NO: 4369127 - DNA, 16 bp, Homo sapiens
ccctcctccctcagac

SEQ ID NO: 4369128 - DNA, 17 bp, Homo sapiens
ccctcctccctcagacc

SEQ ID NO: 4369129 - DNA, 17 bp, Homo sapiens
ccctcctccctcagact

SEQ ID NO: 4369130 - DNA, 19 bp, Homo sapiens
ccctcctctgaaacagctg

SEQ ID NO: 4369131 - DNA, 20 bp, Homo sapiens
ccctcctctgaaacagctgc

SEQ ID NO: 4369132 - DNA, 13 bp, Homo sapiens
ccctcctcttgga

SEQ ID NO: 4369133 - DNA, 14 bp, Homo sapiens
ccctcctcttggaa

SEQ ID NO: 4369134 - DNA, 21 bp, Homo sapiens
ccctcctgctgcctaataaag

SEQ ID NO: 4369135 - DNA, 13 bp, Homo sapiens
ccctcctgggccc

SEQ ID NO: 4369136 - DNA, 17 bp, Homo sapiens
ccctccttccccagacc

SEQ ID NO: 4369137 - DNA, 19 bp, Homo sapiens
ccctccttccccagaccca

SEQ ID NO: 4369138 - DNA, 18 bp, Homo sapiens
ccctccttgtgccttctt

SEQ ID NO: 4369139 - DNA, 16 bp, Homo sapiens
ccctcgaccctgtgca

SEQ ID NO: 4369140 - DNA, 13 bp, Homo sapiens
ccctcggagaaga

SEQ ID NO: 4369141 - DNA, 15 bp, Homo sapiens
ccctcgggcccagcc

SEQ ID NO: 4369142 - DNA, 19 bp, Homo sapiens
ccctcgggcccagccccca

SEQ ID NO: 4369143 - DNA, 17 bp, Homo sapiens
ccctctagtgccttctt

SEQ ID NO: 4369144 - DNA, 13 bp, Homo sapiens
ccctctcaccaaa

SEQ ID NO: 4369145 - DNA, 17 bp, Homo sapiens
ccctctcagaggcctgc

SEQ ID NO: 4369146 - DNA, 19 bp, Homo sapiens
ccctctcagaggcctgctg

SEQ ID NO: 4369147 - DNA, 17 bp, Homo sapiens
ccctctccctgtgttct

SEQ ID NO: 4369148 - DNA, 21 bp, Homo sapiens
ccctctccctgtgttctgggc

SEQ ID NO: 4369149 - DNA, 11 bp, Homo sapiens
ccctctcctgc

SEQ ID NO: 4369150 - DNA, 15 bp, Homo sapiens
ccctctcgccccatc

SEQ ID NO: 4369151 - DNA, 16 bp, Homo sapiens
ccctctcgccccatcc

SEQ ID NO: 4369152 - DNA, 21 bp, Homo sapiens
ccctctcgccccatccctgct

SEQ ID NO: 4369153 - DNA, 16 bp, Homo sapiens
ccctctcggccaggca

SEQ ID NO: 4369154 - DNA, 17 bp, Homo sapiens
ccctctctagggacccc

SEQ ID NO: 4369155 - DNA, 18 bp, Homo sapiens
ccctctctcataccctcc

SEQ ID NO: 4369156 - DNA, 16 bp, Homo sapiens
ccctggcactggcaaa

SEQ ID NO: 4369157 - DNA, 23 bp, Homo sapiens
ccctggcatcgtgtattccatat

SEQ ID NO: 4369158 - DNA, 13 bp, Homo sapiens
ccctggcccaggt

SEQ ID NO: 4369159 - DNA, 14 bp, Homo sapiens
ccctggcccaggtg

SEQ ID NO: 4369160 - DNA, 17 bp, Homo sapiens
ccctggcccccatcagc

SEQ ID NO: 4369161 - DNA, 21 bp, Homo sapiens
ccctggcccccatcagccctg

SEQ ID NO: 4369162 - DNA, 14 bp, Homo sapiens
ccctggccccgccg

SEQ ID NO: 4369163 - DNA, 20 bp, Homo sapiens
ccctggcctccggcgtcagc

SEQ ID NO: 4369164 - DNA, 14 bp, Homo sapiens
ccctggcctgaact

SEQ ID NO: 4369165 - DNA, 21 bp, Homo sapiens
ccctggcctgaactgaggaga

SEQ ID NO: 4369166 - DNA, 13 bp, Homo sapiens
ccctggcctgctg

SEQ ID NO: 4369167 - DNA, 22 bp, Homo sapiens
ccctggcctgctgggctctcca

SEQ ID NO: 4369168 - DNA, 14 bp, Homo sapiens
ccctggctcccatg

SEQ ID NO: 4369169 - DNA, 13 bp, Homo sapiens
ccctggctccctc

SEQ ID NO: 4369170 - DNA, 18 bp, Homo sapiens
ccctggctccctcctcca

SEQ ID NO: 4369171 - DNA, 18 bp, Homo sapiens
ccctggctgctgccccca

SEQ ID NO: 4369172 - DNA, 20 bp, Homo sapiens
ccctggcttgtaactccacc

SEQ ID NO: 4369173 - DNA, 18 bp, Homo sapiens
ccctggctttgcctcttc

SEQ ID NO: 4369174 - DNA, 19 bp, Homo sapiens
ccctggctttgcctcttct

SEQ ID NO: 4369175 - DNA, 21 bp, Homo sapiens
ccctgggaaggcctcttggag

SEQ ID NO: 4369176 - DNA, 18 bp, Homo sapiens
ccctgggacacagaccca

SEQ ID NO: 4369177 - DNA, 19 bp, Homo sapiens
ccctgggccacgccggcca

SEQ ID NO: 4369178 - DNA, 14 bp, Homo sapiens
ccctgggcccctcc

SEQ ID NO: 4369179 - DNA, 16 bp, Homo sapiens
ccctgggcccctccac

SEQ ID NO: 4369180 - DNA, 18 bp, Homo sapiens
ccctgggcccctccacgc

SEQ ID NO: 4369181 - DNA, 17 bp, Homo sapiens
ccctgggctattgctgc

SEQ ID NO: 4369182 - DNA, 21 bp, Homo sapiens
ccctgggctgccaccagcccc

SEQ ID NO: 4369183 - DNA, 20 bp, Homo sapiens
ccctgggctgtctgtcacca

SEQ ID NO: 4369184 - DNA, 20 bp, Homo sapiens
ccctgggcttggcctgctgt

SEQ ID NO: 4369185 - DNA, 21 bp, Homo sapiens
ccctgggcttggcctgctgtg

SEQ ID NO: 4369186 - DNA, 21 bp, Homo sapiens
ccctggggacttcaactgccc

SEQ ID NO: 4369187 - DNA, 21 bp, Homo sapiens
ccctggggatcttcccacagg

SEQ ID NO: 4369188 - DNA, 17 bp, Homo sapiens
ccctggggcgtgcagca

SEQ ID NO: 4369189 - DNA, 19 bp, Homo sapiens
ccctggggcgtgcagcagg

SEQ ID NO: 4369190 - DNA, 16 bp, Homo sapiens
ccctggggctgagtct

SEQ ID NO: 4369191 - DNA, 18 bp, Homo sapiens
ccctgggggaagccctgg

SEQ ID NO: 4369192 - DNA, 16 bp, Homo sapiens
ccctggtaatagctgt

SEQ ID NO: 4369193 - DNA, 14 bp, Homo sapiens
ccctggtctctggt

SEQ ID NO: 4369194 - DNA, 11 bp, Homo sapiens
ccctggtgctt

SEQ ID NO: 4369195 - DNA, 19 bp, Homo sapiens
ccctggttatattctcacg

SEQ ID NO: 4369196 - DNA, 16 bp, Homo sapiens
ccctggttctcatctt

SEQ ID NO: 4369197 - DNA, 20 bp, Homo sapiens
ccctggttgggtggcaattc

SEQ ID NO: 4369198 - DNA, 14 bp, Homo sapiens
ccctgtcacctctt

SEQ ID NO: 4369199 - DNA, 15 bp, Homo sapiens
ccctgtcccaggccg

SEQ ID NO: 4369200 - DNA, 16 bp, Homo sapiens
ccctgtcccaggccgg

SEQ ID NO: 4369201 - DNA, 17 bp, Homo sapiens
ccctgtcccattctaga

SEQ ID NO: 4369202 - DNA, 18 bp, Homo sapiens
ccctgtcccattctagat

SEQ ID NO: 4369203 - DNA, 22 bp, Homo sapiens
ccctgtccctctagtgccttct

SEQ ID NO: 4369204 - DNA, 15 bp, Homo sapiens
ccctgtccggcccag

SEQ ID NO: 4369205 - DNA, 12 bp, Homo sapiens
ccctgtcctgca

SEQ ID NO: 4369206 - DNA, 18 bp, Homo sapiens
ccctgtccttccctgttc

SEQ ID NO: 4369207 - DNA, 15 bp, Homo sapiens
ccctgtctccagggc

SEQ ID NO: 4369208 - DNA, 23 bp, Homo sapiens
ccctgtctccagggcccccaccg

SEQ ID NO: 4369209 - DNA, 21 bp, Homo sapiens
ccctgtctgtagagggccctg

SEQ ID NO: 4369210 - DNA, 13 bp, Homo sapiens
ccctgtggacagg

SEQ ID NO: 4369211 - DNA, 19 bp, Homo sapiens
ccctgtgggagccgcagag

SEQ ID NO: 4369212 - DNA, 19 bp, Homo sapiens
ccctgtgggggtggccatc

SEQ ID NO: 4369213 - DNA, 19 bp, Homo sapiens
ccctgtgttctgggctggg

SEQ ID NO: 4369214 - DNA, 14 bp, Homo sapiens
ccctgttcctggag

SEQ ID NO: 4369215 - DNA, 14 bp, Homo sapiens
ccctgttctccctt

SEQ ID NO: 4369216 - DNA, 17 bp, Homo sapiens
ccctgtttactggttct

SEQ ID NO: 4369217 - DNA, 14 bp, Homo sapiens
cccttaactgacat

SEQ ID NO: 4369218 - DNA, 19 bp, Homo sapiens
cccttaattacttaaaaaa

SEQ ID NO: 4369219 - DNA, 17 bp, Homo sapiens
cccttaccccttagcct

SEQ ID NO: 4369220 - DNA, 16 bp, Homo sapiens
cccttagcaccttcag

SEQ ID NO: 4369221 - DNA, 21 bp, Homo sapiens
cccttaggatggggctcccag

SEQ ID NO: 4369222 - DNA, 22 bp, Homo sapiens
cccttatgcccggcgccgggca

SEQ ID NO: 4369223 - DNA, 19 bp, Homo sapiens
cccttcagaacagaggcat

SEQ ID NO: 4369224 - DNA, 13 bp, Homo sapiens
cccttcagtgccc

SEQ ID NO: 4369225 - DNA, 13 bp, Homo sapiens
cccttccactgag

SEQ ID NO: 4369226 - DNA, 14 bp, Homo sapiens
cccttcccacagga

SEQ ID NO: 4369227 - DNA, 22 bp, Homo sapiens
cccttcccagggcacccaggca

SEQ ID NO: 4369228 - DNA, 21 bp, Homo sapiens
cccttcccccatccctaccac

SEQ ID NO: 4369229 - DNA, 16 bp, Homo sapiens
cccttcccctccctgg

SEQ ID NO: 4369230 - DNA, 22 bp, Homo sapiens
cccttcccctccctggctccca

SEQ ID NO: 4369231 - DNA, 14 bp, Homo sapiens
cccttcccctgctg

SEQ ID NO: 4369232 - DNA, 19 bp, Homo sapiens
cccttcccctgctgacctt

SEQ ID NO: 4369233 - DNA, 16 bp, Homo sapiens
cccttccctctgggca

SEQ ID NO: 4369234 - DNA, 15 bp, Homo sapiens
cccttccgacaggag

SEQ ID NO: 4369235 - DNA, 22 bp, Homo sapiens
cccttcctattccaagcttcca

SEQ ID NO: 4369236 - DNA, 12 bp, Homo sapiens
cccttcctggca

SEQ ID NO: 4369237 - DNA, 14 bp, Homo sapiens
cccttcctggcaca

SEQ ID NO: 4369238 - DNA, 22 bp, Homo sapiens
cccttcctgtttctcgttgtca

SEQ ID NO: 4369239 - DNA, 22 bp, Homo sapiens
cccttccttttccctgcttcca

SEQ ID NO: 4369240 - DNA, 15 bp, Homo sapiens
cccttctacactctc

SEQ ID NO: 4369241 - DNA, 17 bp, Homo sapiens
cccttctacactctcct

SEQ ID NO: 4369242 - DNA, 23 bp, Homo sapiens
cccttctacactctcctgggccc

SEQ ID NO: 4369243 - DNA, 17 bp, Homo sapiens
cccttctcatctcccca

SEQ ID NO: 4369244 - DNA, 23 bp, Homo sapiens
cccttctccatccacatgggagc

SEQ ID NO: 4369245 - DNA, 15 bp, Homo sapiens
cccttctctcatctc

SEQ ID NO: 4369246 - DNA, 23 bp, Homo sapiens
cccttctctgctccaccacatcc

SEQ ID NO: 4369247 - DNA, 14 bp, Homo sapiens
cccttctgggtcca

SEQ ID NO: 4369248 - DNA, 18 bp, Homo sapiens
cccttctgggtccaggga

SEQ ID NO: 4369249 - DNA, 19 bp, Homo sapiens
cccttgaaatttagatcaa

SEQ ID NO: 4369250 - DNA, 19 bp, Homo sapiens
cccttgactttgctcctca

SEQ ID NO: 4369251 - DNA, 13 bp, Homo sapiens
cccttgagacctc

SEQ ID NO: 4369252 - DNA, 16 bp, Homo sapiens
cccttgagacctcagc

SEQ ID NO: 4369253 - DNA, 18 bp, Homo sapiens
cccttgagacctcagcca

SEQ ID NO: 4369254 - DNA, 22 bp, Homo sapiens
cccttgcaggggtcccccctca

SEQ ID NO: 4369255 - DNA, 14 bp, Homo sapiens
cccttgcagggtgg

SEQ ID NO: 4369256 - DNA, 13 bp, Homo sapiens
cccttgccacccc

SEQ ID NO: 4369257 - DNA, 23 bp, Homo sapiens
cccttgcctccccatttcccatc

SEQ ID NO: 4369258 - DNA, 13 bp, Homo sapiens
cccttgcctctgc

SEQ ID NO: 4369259 - DNA, 13 bp, Homo sapiens
cccttgccttcct

SEQ ID NO: 4369260 - DNA, 22 bp, Homo sapiens
cccttgccttcctcagctgcct

SEQ ID NO: 4369261 - DNA, 17 bp, Homo sapiens
cccttgctttcctgggc

SEQ ID NO: 4369262 - DNA, 22 bp, Homo sapiens
cccttgctttcctgggcctttg

SEQ ID NO: 4369263 - DNA, 12 bp, Homo sapiens
cccttggcctca

SEQ ID NO: 4369264 - DNA, 14 bp, Homo sapiens
cccttggcctcaga

SEQ ID NO: 4369265 - DNA, 16 bp, Homo sapiens
cccttggcctgtctca

SEQ ID NO: 4369266 - DNA, 22 bp, Homo sapiens
cccttggggtaagccagagcct

SEQ ID NO: 4369267 - DNA, 19 bp, Homo sapiens
cccttggtcccaagcctga

SEQ ID NO: 4369268 - DNA, 13 bp, Homo sapiens
cccttggtcctgg

SEQ ID NO: 4369269 - DNA, 16 bp, Homo sapiens
cccttggtcctggcag

SEQ ID NO: 4369270 - DNA, 23 bp, Homo sapiens
cccttggtctgtacaaataatag

SEQ ID NO: 4369271 - DNA, 19 bp, Homo sapiens
cccttgtcggccccaccag

SEQ ID NO: 4369272 - DNA, 20 bp, Homo sapiens
ccctttcagatgtcttctgc

SEQ ID NO: 4369273 - DNA, 18 bp, Homo sapiens
ccctttcccctagatcca

SEQ ID NO: 4369274 - DNA, 15 bp, Homo sapiens
ccgctgttcacccac

SEQ ID NO: 4369275 - DNA, 21 bp, Homo sapiens
ccgctgttcacccacagggct

SEQ ID NO: 4369276 - DNA, 17 bp, Homo sapiens
ccgcttgctcgcttgct

SEQ ID NO: 4369277 - DNA, 18 bp, Homo sapiens
ccgcttggagcagagggg

SEQ ID NO: 4369278 - DNA, 17 bp, Homo sapiens
ccgcttgtccagcgcct

SEQ ID NO: 4369279 - DNA, 11 bp, Homo sapiens
ccggaaagaag

SEQ ID NO: 4369280 - DNA, 16 bp, Homo sapiens
ccggacactcctagag

SEQ ID NO: 4369281 - DNA, 17 bp, Homo sapiens
ccggagattggacggcc

SEQ ID NO: 4369282 - DNA, 19 bp, Homo sapiens
ccggagattggacggcctg

SEQ ID NO: 4369283 - DNA, 17 bp, Homo sapiens
ccggaggactgagcccc

SEQ ID NO: 4369284 - DNA, 19 bp, Homo sapiens
ccggaggactgagccccca

SEQ ID NO: 4369285 - DNA, 20 bp, Homo sapiens
ccggaggactgagcccccac

SEQ ID NO: 4369286 - DNA, 21 bp, Homo sapiens
ccggaggactgagcccccacc

SEQ ID NO: 4369287 - DNA, 16 bp, Homo sapiens
ccggatctgagggaga

SEQ ID NO: 4369288 - DNA, 19 bp, Homo sapiens
ccggcacagatgctccagg

SEQ ID NO: 4369289 - DNA, 14 bp, Homo sapiens
ccggcagggccccc

SEQ ID NO: 4369290 - DNA, 23 bp, Homo sapiens
ccggcagggcgggcagagggctg

SEQ ID NO: 4369291 - DNA, 15 bp, Homo sapiens
ccggccaaggaccca

SEQ ID NO: 4369292 - DNA, 17 bp, Homo sapiens
ccggccaaggacccagg

SEQ ID NO: 4369293 - DNA, 14 bp, Homo sapiens
ccggccacacccag

SEQ ID NO: 4369294 - DNA, 16 bp, Homo sapiens
ccggccatactgcctt

SEQ ID NO: 4369295 - DNA, 12 bp, Homo sapiens
ccggcccagatg

SEQ ID NO: 4369296 - DNA, 20 bp, Homo sapiens
ccggccccctggtctctggt

SEQ ID NO: 4369297 - DNA, 14 bp, Homo sapiens
ccggccccgtctct

SEQ ID NO: 4369298 - DNA, 17 bp, Homo sapiens
ccggcccctccccctga

SEQ ID NO: 4369299 - DNA, 16 bp, Homo sapiens
ccggcccggctgagcc

SEQ ID NO: 4369300 - DNA, 17 bp, Homo sapiens
ccggcccggctgagccc

SEQ ID NO: 4369301 - DNA, 19 bp, Homo sapiens
ccggccctgggctcggagg

SEQ ID NO: 4369302 - DNA, 18 bp, Homo sapiens
ccggcctctccctgcctg

SEQ ID NO: 4369303 - DNA, 23 bp, Homo sapiens
ccggcctctccctgcctgtggcc

SEQ ID NO: 4369304 - DNA, 19 bp, Homo sapiens
ccggcgctgattcctcgtg

SEQ ID NO: 4369305 - DNA, 21 bp, Homo sapiens
ccggcgctgattcctcgtgtc

SEQ ID NO: 4369306 - DNA, 20 bp, Homo sapiens
ccggcggaaagcctctgtcc

SEQ ID NO: 4369307 - DNA, 19 bp, Homo sapiens
ccggcgggtgacagctccg

SEQ ID NO: 4369308 - DNA, 22 bp, Homo sapiens
ccggcgggtgacagctccggga

SEQ ID NO: 4369309 - DNA, 19 bp, Homo sapiens
ccggctcccaccgaggcgc

SEQ ID NO: 4369310 - DNA, 12 bp, Homo sapiens
ccggctctgtgg

SEQ ID NO: 4369311 - DNA, 15 bp, Homo sapiens
ccggctgagccctgc

SEQ ID NO: 4369312 - DNA, 15 bp, Homo sapiens
ccggctgtgctggga

SEQ ID NO: 4369313 - DNA, 17 bp, Homo sapiens
ccggctgtgctgggaga

SEQ ID NO: 4369314 - DNA, 19 bp, Homo sapiens
ccggctttgtggcactggg

SEQ ID NO: 4369315 - DNA, 20 bp, Homo sapiens
ccgggaccaccctgagccgg

SEQ ID NO: 4369316 - DNA, 16 bp, Homo sapiens
ccgggactgctgctct

SEQ ID NO: 4369317 - DNA, 15 bp, Homo sapiens
ccgggagctcaggaa

SEQ ID NO: 4369318 - DNA, 17 bp, Homo sapiens
ccgggagctgggccctg

SEQ ID NO: 4369319 - DNA, 18 bp, Homo sapiens
ccgggagctgggccctgc

SEQ ID NO: 4369320 - DNA, 19 bp, Homo sapiens
ccgggagctgggccctgcc

SEQ ID NO: 4369321 - DNA, 22 bp, Homo sapiens
ccgggaggaaaaggcccctgca

SEQ ID NO: 4369322 - DNA, 23 bp, Homo sapiens
ccgggaggaaaaggcccctgcaa

SEQ ID NO: 4369323 - DNA, 18 bp, Homo sapiens
ccgggaggcagccacagg

SEQ ID NO: 4369324 - DNA, 22 bp, Homo sapiens
ccgggaggcagccacagggaag

SEQ ID NO: 4369325 - DNA, 16 bp, Homo sapiens
ccgggcaccaggggcc

SEQ ID NO: 4369326 - DNA, 16 bp, Homo sapiens
ccgggcaggtcctgcc

SEQ ID NO: 4369327 - DNA, 22 bp, Homo sapiens
ccgggcatggtggcgcaagcct

SEQ ID NO: 4369328 - DNA, 16 bp, Homo sapiens
ccgggcccctgggctt

SEQ ID NO: 4369329 - DNA, 21 bp, Homo sapiens
ccgggcccctgggcttggcct

SEQ ID NO: 4369330 - DNA, 20 bp, Homo sapiens
ccgggcgtgtgaagaacacc

SEQ ID NO: 4369331 - DNA, 23 bp, Homo sapiens
ccgggctctcatggtacttcctc

SEQ ID NO: 4369332 - DNA, 13 bp, Homo sapiens
ccgggctctctgc

SEQ ID NO: 4369333 - DNA, 14 bp, Homo sapiens
ccgggctctctgct

SEQ ID NO: 4369334 - DNA, 16 bp, Homo sapiens
ccgggctctctgctgt

SEQ ID NO: 4369335 - DNA, 15 bp, Homo sapiens
ccggggacagaggcc

SEQ ID NO: 4369336 - DNA, 16 bp, Homo sapiens
ccgggggacagaggtt

SEQ ID NO: 4369337 - DNA, 13 bp, Homo sapiens
ccgggtccggcct

SEQ ID NO: 4369338 - DNA, 19 bp, Homo sapiens
ccgggtccggcctctccct

SEQ ID NO: 4369339 - DNA, 14 bp, Homo sapiens
ccgggtgtggcctc

SEQ ID NO: 4369340 - DNA, 15 bp, Homo sapiens
ccgggtgtggcctca

SEQ ID NO: 4369341 - DNA, 20 bp, Homo sapiens
ccgggtgtggcctcagccct

SEQ ID NO: 4369342 - DNA, 22 bp, Homo sapiens
ccgggttcacgccattctcctg

SEQ ID NO: 4369343 - DNA, 13 bp, Homo sapiens
ccggtcagccaag

SEQ ID NO: 4369344 - DNA, 14 bp, Homo sapiens
ccggtcagccaagt

SEQ ID NO: 4369345 - DNA, 15 bp, Homo sapiens
ccggtcccccagagc

SEQ ID NO: 4369346 - DNA, 16 bp, Homo sapiens
ccggtcccccagagca

SEQ ID NO: 4369347 - DNA, 18 bp, Homo sapiens
ccggtcccttgagacctc

SEQ ID NO: 4369348 - DNA, 16 bp, Homo sapiens
ccggtgccagctgccc

SEQ ID NO: 4369349 - DNA, 17 bp, Homo sapiens
ccggtgccagctgccct

SEQ ID NO: 4369350 - DNA, 13 bp, Homo sapiens
ccggtgctgcagg

SEQ ID NO: 4369351 - DNA, 14 bp, Homo sapiens
ccggtgctgcagga

SEQ ID NO: 4369352 - DNA, 16 bp, Homo sapiens
ccggtgctgcaggagt

SEQ ID NO: 4369353 - DNA, 13 bp, Homo sapiens
ccggtggtgcccg

SEQ ID NO: 4369354 - DNA, 11 bp, Homo sapiens
ccggtgtcctt

SEQ ID NO: 4369355 - DNA, 22 bp, Homo sapiens
ccgtagtatcagagatgtccat

SEQ ID NO: 4369356 - DNA, 15 bp, Homo sapiens
ccgtagttccctgaa

SEQ ID NO: 4369357 - DNA, 22 bp, Homo sapiens
ccgtagttccctgaaaacccag

SEQ ID NO: 4369358 - DNA, 16 bp, Homo sapiens
ccgtatcacagtgttt

SEQ ID NO: 4369359 - DNA, 13 bp, Homo sapiens
ccgtatctgccct

SEQ ID NO: 4369360 - DNA, 19 bp, Homo sapiens
ccgtcaccacgactggcca

SEQ ID NO: 4369361 - DNA, 17 bp, Homo sapiens
ccgtcagcttctcccaa

SEQ ID NO: 4369362 - DNA, 22 bp, Homo sapiens
ccgtccagccgccattgccacc

SEQ ID NO: 4369363 - DNA, 15 bp, Homo sapiens
ccgtctcccttggcc

SEQ ID NO: 4369364 - DNA, 19 bp, Homo sapiens
ccgtctctctcccatggag

SEQ ID NO: 4369365 - DNA, 17 bp, Homo sapiens
ccgtctctctgcccact

SEQ ID NO: 4369366 - DNA, 17 bp, Homo sapiens
ccgtctggacctgggga

SEQ ID NO: 4369367 - DNA, 17 bp, Homo sapiens
ccgtctggggttcagcc

SEQ ID NO: 4369368 - DNA, 18 bp, Homo sapiens
ccgtgaaccagagggtgt

SEQ ID NO: 4369369 - DNA, 14 bp, Homo sapiens
ccgtgacgaggctc

SEQ ID NO: 4369370 - DNA, 13 bp, Homo sapiens
ccgtgagcatgca

SEQ ID NO: 4369371 - DNA, 14 bp, Homo sapiens
ccgtgcatcccccc

SEQ ID NO: 4369372 - DNA, 20 bp, Homo sapiens
ccgtgcatcccccctgctca

SEQ ID NO: 4369373 - DNA, 21 bp, Homo sapiens
ccgtgcatcccccctgctcag

SEQ ID NO: 4369374 - DNA, 14 bp, Homo sapiens
ccgtgcccgcagga

SEQ ID NO: 4369375 - DNA, 16 bp, Homo sapiens
ccgtgcccgcaggaac

SEQ ID NO: 4369376 - DNA, 23 bp, Homo sapiens
ccgtgccggcggcagccccactt

SEQ ID NO: 4369377 - DNA, 15 bp, Homo sapiens
ccgtgcctggccaga

SEQ ID NO: 4369378 - DNA, 11 bp, Homo sapiens
ccgtgcctggg

SEQ ID NO: 4369379 - DNA, 14 bp, Homo sapiens
ccgtgcctgggaga

SEQ ID NO: 4369380 - DNA, 23 bp, Homo sapiens
ccgtggaccaggaggattgcctt

SEQ ID NO: 4369381 - DNA, 22 bp, Homo sapiens
ccgtggaggaggaaggcaagag

SEQ ID NO: 4369382 - DNA, 20 bp, Homo sapiens
ccgtgggaccctcagcagct

SEQ ID NO: 4369383 - DNA, 12 bp, Homo sapiens
ccgtgggcgggg

SEQ ID NO: 4369384 - DNA, 14 bp, Homo sapiens
ccgtgggctccctg

SEQ ID NO: 4369385 - DNA, 16 bp, Homo sapiens
ccgtggggtgctgccc

SEQ ID NO: 4369386 - DNA, 19 bp, Homo sapiens
ccgtgggtgggcctggccc

SEQ ID NO: 4369387 - DNA, 22 bp, Homo sapiens
ccgtggtggcggtggctgcccc

SEQ ID NO: 4369388 - DNA, 23 bp, Homo sapiens
ccgtggtttgaacacgaaagaaa

SEQ ID NO: 4369389 - DNA, 17 bp, Homo sapiens
ccgtgtctcagcctctg

SEQ ID NO: 4369390 - DNA, 19 bp, Homo sapiens
ccgtgtctcagcctctgcc

SEQ ID NO: 4369391 - DNA, 21 bp, Homo sapiens
ccgtgttgcaggttcatggat

SEQ ID NO: 4369392 - DNA, 15 bp, Homo sapiens
ttcccaggagaccat

SEQ ID NO: 4369393 - DNA, 16 bp, Homo sapiens
ttcccaggagaccatt

SEQ ID NO: 4369394 - DNA, 10 bp, Homo sapiens
ttcccagggt

SEQ ID NO: 4369395 - DNA, 18 bp, Homo sapiens
ttcccaggtaatttaaat

SEQ ID NO: 4369396 - DNA, 21 bp, Homo sapiens
ttcccatgacctaaaacactg

SEQ ID NO: 4369397 - DNA, 16 bp, Homo sapiens
ttcccatgtatttgtt

SEQ ID NO: 4369398 - DNA, 14 bp, Homo sapiens
ttcccattaaaaat

SEQ ID NO: 4369399 - DNA, 19 bp, Homo sapiens
ttcccattaaaaatgagat

SEQ ID NO: 4369400 - DNA, 17 bp, Homo sapiens
ttcccattgtggctcct

SEQ ID NO: 4369401 - DNA, 15 bp, Homo sapiens
ttcccatttcagctg

SEQ ID NO: 4369402 - DNA, 14 bp, Homo sapiens
ttccccaaatacaa

SEQ ID NO: 4369403 - DNA, 16 bp, Homo sapiens
ttccccaataaagcct

SEQ ID NO: 4369404 - DNA, 23 bp, Homo sapiens
ttccccaattacagggtgactca

SEQ ID NO: 4369405 - DNA, 12 bp, Homo sapiens
ttccccagaccc

SEQ ID NO: 4369406 - DNA, 14 bp, Homo sapiens
ttccccagacccag

SEQ ID NO: 4369407 - DNA, 15 bp, Homo sapiens
ttccccagacccaga

SEQ ID NO: 4369408 - DNA, 20 bp, Homo sapiens
ttccccagaggctcccaatc

SEQ ID NO: 4369409 - DNA, 16 bp, Homo sapiens
ttccccagcaactctg

SEQ ID NO: 4369410 - DNA, 12 bp, Homo sapiens
ttccccatggga

SEQ ID NO: 4369411 - DNA, 13 bp, Homo sapiens
ttcccccatccct

SEQ ID NO: 4369412 - DNA, 16 bp, Homo sapiens
ttcccccatccctacc

SEQ ID NO: 4369413 - DNA, 18 bp, Homo sapiens
ttccccccactctcccca

SEQ ID NO: 4369414 - DNA, 19 bp, Homo sapiens
ttccccccactctccccac

SEQ ID NO: 4369415 - DNA, 16 bp, Homo sapiens
ttcccccttcccattt

SEQ ID NO: 4369416 - DNA, 18 bp, Homo sapiens
ttcccctagatccagaaa

SEQ ID NO: 4369417 - DNA, 17 bp, Homo sapiens
ttcccctccctggctcc

SEQ ID NO: 4369418 - DNA, 15 bp, Homo sapiens
ttcccctcctccact

SEQ ID NO: 4369419 - DNA, 19 bp, Homo sapiens
ttcccctgctgaccttgga

SEQ ID NO: 4369420 - DNA, 22 bp, Homo sapiens
ttcccggcccccggccaaggac

SEQ ID NO: 4369421 - DNA, 13 bp, Homo sapiens
ttcccgggagctg

SEQ ID NO: 4369422 - DNA, 20 bp, Homo sapiens
ttcccgggagctgggccctg

SEQ ID NO: 4369423 - DNA, 13 bp, Homo sapiens
ttccctacctcag

SEQ ID NO: 4369424 - DNA, 14 bp, Homo sapiens
ttccctacctcagg

SEQ ID NO: 4369425 - DNA, 22 bp, Homo sapiens
ttccctactgaaccctgcctct

SEQ ID NO: 4369426 - DNA, 14 bp, Homo sapiens
ttccctacttgcag

SEQ ID NO: 4369427 - DNA, 22 bp, Homo sapiens
ttccctagaaacttccaaatcc

SEQ ID NO: 4369428 - DNA, 14 bp, Homo sapiens
ttccctcaccccct

SEQ ID NO: 4369429 - DNA, 19 bp, Homo sapiens
ttccctcaccccctcccac

SEQ ID NO: 4369430 - DNA, 22 bp, Homo sapiens
ttccctcaccccctcccacccc

SEQ ID NO: 4369431 - DNA, 12 bp, Homo sapiens
ttccctcagcct

SEQ ID NO: 4369432 - DNA, 15 bp, Homo sapiens
ttccctcccaacaga

SEQ ID NO: 4369433 - DNA, 22 bp, Homo sapiens
ttccctcccaacagagctgggc

SEQ ID NO: 4369434 - DNA, 15 bp, Homo sapiens
ttccctccccctcct

SEQ ID NO: 4369435 - DNA, 14 bp, Homo sapiens
ttccctccttttaa

SEQ ID NO: 4369436 - DNA, 15 bp, Homo sapiens
ttccctctctccctg

SEQ ID NO: 4369437 - DNA, 18 bp, Homo sapiens
ttccctctctccctgcct

SEQ ID NO: 4369438 - DNA, 20 bp, Homo sapiens
ttccctctctgatgtcccag

SEQ ID NO: 4369439 - DNA, 12 bp, Homo sapiens
ttccctctgctg

SEQ ID NO: 4369440 - DNA, 14 bp, Homo sapiens
ttccctctgctgct

SEQ ID NO: 4369441 - DNA, 24 bp, Homo sapiens
ttccctctgggcacgcctgctggc

SEQ ID NO: 4369442 - DNA, 19 bp, Homo sapiens
ttccctgagtcaccaggaa

SEQ ID NO: 4369443 - DNA, 19 bp, Homo sapiens
ttccctgatggcctttgga

SEQ ID NO: 4369444 - DNA, 15 bp, Homo sapiens
ttccctgcacacaca

SEQ ID NO: 4369445 - DNA, 22 bp, Homo sapiens
ttccctgcccaaacccttaact

SEQ ID NO: 4369446 - DNA, 12 bp, Homo sapiens
ttccctgcctgt

SEQ ID NO: 4369447 - DNA, 13 bp, Homo sapiens
ttccctgcttcca

SEQ ID NO: 4369448 - DNA, 20 bp, Homo sapiens
ttccctggaaaccttccacc

SEQ ID NO: 4369449 - DNA, 22 bp, Homo sapiens
ttccctggaaaccttccaccca

SEQ ID NO: 4369450 - DNA, 21 bp, Homo sapiens
ttccctggaactcctggcctt

SEQ ID NO: 4369451 - DNA, 12 bp, Homo sapiens
ttccctggcctc

SEQ ID NO: 4369452 - DNA, 13 bp, Homo sapiens
ttccctgggctgc

SEQ ID NO: 4369453 - DNA, 20 bp, Homo sapiens
ttccctggggaaaacttgca

SEQ ID NO: 4369454 - DNA, 14 bp, Homo sapiens
ttcccttgaccatt

SEQ ID NO: 4369455 - DNA, 12 bp, Homo sapiens
ttcccttggcct

SEQ ID NO: 4369456 - DNA, 15 bp, Homo sapiens
ttcccttggcctcag

SEQ ID NO: 4369457 - DNA, 16 bp, Homo sapiens
ttcccttggcctcaga

SEQ ID NO: 4369458 - DNA, 15 bp, Homo sapiens
ttccctttccttcca

SEQ ID NO: 4369459 - DNA, 22 bp, Homo sapiens
ttccctttgtgagtcaatacat

SEQ ID NO: 4369460 - DNA, 14 bp, Homo sapiens
ttcccttttctgtt

SEQ ID NO: 4369461 - DNA, 16 bp, Homo sapiens
ttccctttttcataat

SEQ ID NO: 4369462 - DNA, 18 bp, Homo sapiens
ttccgcccactcctggga

SEQ ID NO: 4369463 - DNA, 21 bp, Homo sapiens
ttccgtcaccacgactggcca

SEQ ID NO: 4369464 - DNA, 16 bp, Homo sapiens
ttccgtgaactctggt

SEQ ID NO: 4369465 - DNA, 17 bp, Homo sapiens
ttccgtgagacacaaga

SEQ ID NO: 4369466 - DNA, 19 bp, Homo sapiens
ttccgtgggaccctcagca

SEQ ID NO: 4369467 - DNA, 20 bp, Homo sapiens
ttccgtgggaccctcagcag

SEQ ID NO: 4369468 - DNA, 21 bp, Homo sapiens
ttccgtggtcagagtgccact

SEQ ID NO: 4369469 - DNA, 13 bp, Homo sapiens
ttccgtgtgttta

SEQ ID NO: 4369470 - DNA, 19 bp, Homo sapiens
ttcctaaagtctctgctgc

SEQ ID NO: 4369471 - DNA, 20 bp, Homo sapiens
ttcctaaagtctctgctgct

SEQ ID NO: 4369472 - DNA, 14 bp, Homo sapiens
ttcctaagacattt

SEQ ID NO: 4369473 - DNA, 15 bp, Homo sapiens
ttcctaagacatttt

SEQ ID NO: 4369474 - DNA, 17 bp, Homo sapiens
ttcctaagacatttttc

SEQ ID NO: 4369475 - DNA, 19 bp, Homo sapiens
ttcctaagacatttttcat

SEQ ID NO: 4369476 - DNA, 21 bp, Homo sapiens
ttcctaagacatttttcattc

SEQ ID NO: 4369477 - DNA, 22 bp, Homo sapiens
ttcctaagacatttttcattca

SEQ ID NO: 4369478 - DNA, 22 bp, Homo sapiens
ttcctaataaagttctgtactc

SEQ ID NO: 4369479 - DNA, 21 bp, Homo sapiens
ttcctaatggctatttttgaa

SEQ ID NO: 4369480 - DNA, 20 bp, Homo sapiens
ttcctacagcactactgggt

SEQ ID NO: 4369481 - DNA, 21 bp, Homo sapiens
ttcctacagcactactgggtg

SEQ ID NO: 4369482 - DNA, 14 bp, Homo sapiens
ttcctacccccgtc

SEQ ID NO: 4369483 - DNA, 16 bp, Homo sapiens
ttcctagaaattgaac

SEQ ID NO: 4369484 - DNA, 20 bp, Homo sapiens
ttcctagattacatctgcct

SEQ ID NO: 4369485 - DNA, 23 bp, Homo sapiens
ttcctagcactgccccacatgca

SEQ ID NO: 4369486 - DNA, 18 bp, Homo sapiens
ttcctagctgtgtgaata

SEQ ID NO: 4369487 - DNA, 17 bp, Homo sapiens
ttcctagtctttccagt

SEQ ID NO: 4369488 - DNA, 11 bp, Homo sapiens
ttcctataagg

SEQ ID NO: 4369489 - DNA, 15 bp, Homo sapiens
ttcctcaaaaagcag

SEQ ID NO: 4369490 - DNA, 19 bp, Homo sapiens
ttcctcaaaataaagaagt

SEQ ID NO: 4369491 - DNA, 18 bp, Homo sapiens
ttcctcaaatacatgcac

SEQ ID NO: 4369492 - DNA, 14 bp, Homo sapiens
ttcctcaaatcaaa

SEQ ID NO: 4369493 - DNA, 13 bp, Homo sapiens
ttcctcagctcta

SEQ ID NO: 4369494 - DNA, 17 bp, Homo sapiens
ttcctcagctctaggct

SEQ ID NO: 4369495 - DNA, 16 bp, Homo sapiens
ttcctcagctgcctcc

SEQ ID NO: 4369496 - DNA, 17 bp, Homo sapiens
ttcctcagctgtacaaa

SEQ ID NO: 4369497 - DNA, 16 bp, Homo sapiens
ttcctccagcctcccc

SEQ ID NO: 4369498 - DNA, 18 bp, Homo sapiens
ttcctccagcctcccctc

SEQ ID NO: 4369499 - DNA, 18 bp, Homo sapiens
ttcctccagtgcatactg

SEQ ID NO: 4369500 - DNA, 20 bp, Homo sapiens
ttcctcccaagtggtgccta

SEQ ID NO: 4369501 - DNA, 19 bp, Homo sapiens
ttcctcccagtgagactgc

SEQ ID NO: 4369502 - DNA, 14 bp, Homo sapiens
ttcctccccctgca

SEQ ID NO: 4369503 - DNA, 15 bp, Homo sapiens
ttcctccccctgcaa

SEQ ID NO: 4369504 - DNA, 15 bp, Homo sapiens
ttcctcctctgccta

SEQ ID NO: 4369505 - DNA, 15 bp, Homo sapiens
ttcctcctgcagaca

SEQ ID NO: 4369506 - DNA, 21 bp, Homo sapiens
ttcctccttcactgtttcatc

SEQ ID NO: 4369507 - DNA, 18 bp, Homo sapiens
ttcctcctttacctttca

SEQ ID NO: 4369508 - DNA, 14 bp, Homo sapiens
ttcctcgccctggg

SEQ ID NO: 4369509 - DNA, 17 bp, Homo sapiens
ttcctctagaagccaag

SEQ ID NO: 4369510 - DNA, 19 bp, Homo sapiens
ttcctctcaaattcagctc

SEQ ID NO: 4369511 - DNA, 13 bp, Homo sapiens
ttctgtaccagtt

SEQ ID NO: 4369512 - DNA, 15 bp, Homo sapiens
ttctgtatatacttt

SEQ ID NO: 4369513 - DNA, 15 bp, Homo sapiens
ttctgtattaaatat

SEQ ID NO: 4369514 - DNA, 22 bp, Homo sapiens
ttctgtcattcccctcttttgt

SEQ ID NO: 4369515 - DNA, 17 bp, Homo sapiens
ttctgtcctagcaagta

SEQ ID NO: 4369516 - DNA, 20 bp, Homo sapiens
ttctgtctaggttaaagcta

SEQ ID NO: 4369517 - DNA, 21 bp, Homo sapiens
ttctgtctaggttaaagctaa

SEQ ID NO: 4369518 - DNA, 17 bp, Homo sapiens
ttctgtcttcacaacag

SEQ ID NO: 4369519 - DNA, 15 bp, Homo sapiens
ttctgtgaaagaagt

SEQ ID NO: 4369520 - DNA, 18 bp, Homo sapiens
ttctgtgaaagaagtatt

SEQ ID NO: 4369521 - DNA, 15 bp, Homo sapiens
ttctgtgacccatct

SEQ ID NO: 4369522 - DNA, 16 bp, Homo sapiens
ttctgtgacccatctg

SEQ ID NO: 4369523 - DNA, 19 bp, Homo sapiens
ttctgtgagacccccacac

SEQ ID NO: 4369524 - DNA, 12 bp, Homo sapiens
ttctgtgcctcc

SEQ ID NO: 4369525 - DNA, 15 bp, Homo sapiens
ttctgtgcctccccc

SEQ ID NO: 4369526 - DNA, 17 bp, Homo sapiens
ttctgtgcctgaatatt

SEQ ID NO: 4369527 - DNA, 16 bp, Homo sapiens
ttctgtgcttggattt

SEQ ID NO: 4369528 - DNA, 20 bp, Homo sapiens
ttctgtggggcccctcacct

SEQ ID NO: 4369529 - DNA, 17 bp, Homo sapiens
ttctgtggttcctctgc

SEQ ID NO: 4369530 - DNA, 20 bp, Homo sapiens
ttctgtggttcctctgctca

SEQ ID NO: 4369531 - DNA, 22 bp, Homo sapiens
ttctgtggtttcatgttagtta

SEQ ID NO: 4369532 - DNA, 19 bp, Homo sapiens
ttctgtgtcagagcccagc

SEQ ID NO: 4369533 - DNA, 22 bp, Homo sapiens
ttctgttaggggccaataaaat

SEQ ID NO: 4369534 - DNA, 19 bp, Homo sapiens
ttctgttatttttaagctt

SEQ ID NO: 4369535 - DNA, 13 bp, Homo sapiens
ttctgttccaaat

SEQ ID NO: 4369536 - DNA, 17 bp, Homo sapiens
ttctgttccagtcacat

SEQ ID NO: 4369537 - DNA, 13 bp, Homo sapiens
ttctgttccccag

SEQ ID NO: 4369538 - DNA, 21 bp, Homo sapiens
ttctgttctagttttttactt

SEQ ID NO: 4369539 - DNA, 14 bp, Homo sapiens
ttctgtttgattct

SEQ ID NO: 4369540 - DNA, 19 bp, Homo sapiens
ttctgtttgcgtacttgta

SEQ ID NO: 4369541 - DNA, 13 bp, Homo sapiens
ttctgtttgctgt

SEQ ID NO: 4369542 - DNA, 14 bp, Homo sapiens
ttcttaaaaaggaa

SEQ ID NO: 4369543 - DNA, 12 bp, Homo sapiens
ttcttaaaacac

SEQ ID NO: 4369544 - DNA, 18 bp, Homo sapiens
ttcttaaaacacatgata

SEQ ID NO: 4369545 - DNA, 19 bp, Homo sapiens
ttcttaaaactataacatt

SEQ ID NO: 4369546 - DNA, 13 bp, Homo sapiens
ttcttaaaagaaa

SEQ ID NO: 4369547 - DNA, 23 bp, Homo sapiens
ttcttaaaagaaatcttgcttca

SEQ ID NO: 4369548 - DNA, 16 bp, Homo sapiens
ttcttaaaatgcaata

SEQ ID NO: 4369549 - DNA, 13 bp, Homo sapiens
ttcttaacagttt

SEQ ID NO: 4369550 - DNA, 13 bp, Homo sapiens
ttcttaacttctt

SEQ ID NO: 4369551 - DNA, 17 bp, Homo sapiens
ttcttaagtataaacct

SEQ ID NO: 4369552 - DNA, 19 bp, Homo sapiens
ttcttaagtataaacctta

SEQ ID NO: 4369553 - DNA, 22 bp, Homo sapiens
ttcttaagtatgttattttctg

SEQ ID NO: 4369554 - DNA, 14 bp, Homo sapiens
ttcttaataaaact

SEQ ID NO: 4369555 - DNA, 21 bp, Homo sapiens
ttcttaattattataaaaata

SEQ ID NO: 4369556 - DNA, 22 bp, Homo sapiens
ttcttaattattataaaaatat

SEQ ID NO: 4369557 - DNA, 20 bp, Homo sapiens
ttcttacaagcttaaagctt

SEQ ID NO: 4369558 - DNA, 23 bp, Homo sapiens
ttcttagggcacatgaaaaattt

SEQ ID NO: 4369559 - DNA, 23 bp, Homo sapiens
ttcttagttgctgtatgtctcgt

SEQ ID NO: 4369560 - DNA, 18 bp, Homo sapiens
ttcttatgaggaggggag

SEQ ID NO: 4369561 - DNA, 19 bp, Homo sapiens
ttcttatgtgacattaaca

SEQ ID NO: 4369562 - DNA, 20 bp, Homo sapiens
ttcttatgtgacattaacaa

SEQ ID NO: 4369563 - DNA, 21 bp, Homo sapiens
ttcttatttaatcttttctta

SEQ ID NO: 4369564 - DNA, 15 bp, Homo sapiens
ttcttatttcatttc

SEQ ID NO: 4369565 - DNA, 15 bp, Homo sapiens
ttcttattttagtat

SEQ ID NO: 4369566 - DNA, 18 bp, Homo sapiens
ttcttcacatgtttaact

SEQ ID NO: 4369567 - DNA, 18 bp, Homo sapiens
ttcttcaccaagtgcaat

SEQ ID NO: 4369568 - DNA, 14 bp, Homo sapiens
ttcttcagcattta

SEQ ID NO: 4369569 - DNA, 20 bp, Homo sapiens
ttcttcaggtaacactacag

SEQ ID NO: 4369570 - DNA, 22 bp, Homo sapiens
ttcttcatccatagacacagta

SEQ ID NO: 4369571 - DNA, 17 bp, Homo sapiens
ttcttcatgaaatgtgt

SEQ ID NO: 4369572 - DNA, 16 bp, Homo sapiens
ttcttcatgtcatcaa

SEQ ID NO: 4369573 - DNA, 24 bp, Homo sapiens
ttcttcatgtcatcaaaatctgca

SEQ ID NO: 4369574 - DNA, 14 bp, Homo sapiens
ttcttcatttacaa

SEQ ID NO: 4369575 - DNA, 13 bp, Homo sapiens
ttcttccctgctt

SEQ ID NO: 4369576 - DNA, 15 bp, Homo sapiens
ttcttcctcttcttt

SEQ ID NO: 4369577 - DNA, 14 bp, Homo sapiens
ttcttcgaaaatct

SEQ ID NO: 4369578 - DNA, 17 bp, Homo sapiens
ttcttcgaaaatctaga

SEQ ID NO: 4369579 - DNA, 21 bp, Homo sapiens
ttcttcgctggactattgtgc

SEQ ID NO: 4369580 - DNA, 20 bp, Homo sapiens
ttcttcggggaactcctgga

SEQ ID NO: 4369581 - DNA, 18 bp, Homo sapiens
ttcttcgttctttttaag

SEQ ID NO: 4369582 - DNA, 14 bp, Homo sapiens
ttcttctaagaaga

SEQ ID NO: 4369583 - DNA, 18 bp, Homo sapiens
ttcttctaagaagacatt

SEQ ID NO: 4369584 - DNA, 20 bp, Homo sapiens
ttcttctaagaagacatttt

SEQ ID NO: 4369585 - DNA, 20 bp, Homo sapiens
ttcttctgaactcaaactga

SEQ ID NO: 4369586 - DNA, 20 bp, Homo sapiens
ttcttctgcaacatttgaca

SEQ ID NO: 4369587 - DNA, 13 bp, Homo sapiens
ttcttctgtattt

SEQ ID NO: 4369588 - DNA, 13 bp, Homo sapiens
ttcttctttcatt

SEQ ID NO: 4369589 - DNA, 20 bp, Homo sapiens
ttcttgaaagccaagtgttt

SEQ ID NO: 4369590 - DNA, 15 bp, Homo sapiens
ttcttgacttatatt

SEQ ID NO: 4369591 - DNA, 16 bp, Homo sapiens
ttcttgccatcactgg

SEQ ID NO: 4369592 - DNA, 15 bp, Homo sapiens
ttcttgccttttgtt

SEQ ID NO: 4369593 - DNA, 13 bp, Homo sapiens
ttcttgcttgtgt

SEQ ID NO: 4369594 - DNA, 18 bp, Homo sapiens
ttcttgctttctctctca

SEQ ID NO: 4369595 - DNA, 19 bp, Homo sapiens
ttcttggaactgtcccagc

SEQ ID NO: 4369596 - DNA, 20 bp, Homo sapiens
ttcttggaactgtcccagct

SEQ ID NO: 4369597 - DNA, 21 bp, Homo sapiens
ttcttggagtgccaagtttgc

SEQ ID NO: 4369598 - DNA, 15 bp, Homo sapiens
ttcttggttgttaat

SEQ ID NO: 4369599 - DNA, 18 bp, Homo sapiens
ttcttgtaaatctttttg

SEQ ID NO: 4369600 - DNA, 20 bp, Homo sapiens
ttcttgtatcaaattcaata

SEQ ID NO: 4369601 - DNA, 20 bp, Homo sapiens
ttcttgtgtagatttgaaaa

SEQ ID NO: 4369602 - DNA, 17 bp, Homo sapiens
ttctttaaaagaatgac

SEQ ID NO: 4369603 - DNA, 22 bp, Homo sapiens
ttctttagaaaacccaagtttt

SEQ ID NO: 4369604 - DNA, 14 bp, Homo sapiens
ttctttataattga

SEQ ID NO: 4369605 - DNA, 19 bp, Homo sapiens
ttctttatagtgaagtgtt

SEQ ID NO: 4369606 - DNA, 22 bp, Homo sapiens
ttctttcaacctatacaaccta

SEQ ID NO: 4369607 - DNA, 19 bp, Homo sapiens
ttctttccaaaacatttct

SEQ ID NO: 4369608 - DNA, 16 bp, Homo sapiens
ttctttccaagtcatt

SEQ ID NO: 4369609 - DNA, 13 bp, Homo sapiens
ttctttcccagtg

SEQ ID NO: 4369610 - DNA, 13 bp, Homo sapiens
ttctttcctttaa

SEQ ID NO: 4369611 - DNA, 13 bp, Homo sapiens
ttctttctagttt

SEQ ID NO: 4369612 - DNA, 14 bp, Homo sapiens
ttctttctgaagat

SEQ ID NO: 4369613 - DNA, 11 bp, Homo sapiens
ttctttcttcc

SEQ ID NO: 4369614 - DNA, 13 bp, Homo sapiens
ttctttgattctc

SEQ ID NO: 4369615 - DNA, 23 bp, Homo sapiens
ttctttgattctccttttatgtg

SEQ ID NO: 4369616 - DNA, 13 bp, Homo sapiens
ttctttgcctctg

SEQ ID NO: 4369617 - DNA, 14 bp, Homo sapiens
ttctttgctgcccc

SEQ ID NO: 4369618 - DNA, 17 bp, Homo sapiens
ttctttgctgcccctgt

SEQ ID NO: 4369619 - DNA, 16 bp, Homo sapiens
ttctttgcttgaacac

SEQ ID NO: 4369620 - DNA, 22 bp, Homo sapiens
ttctttgcttgaacacagtatt

SEQ ID NO: 4369621 - DNA, 15 bp, Homo sapiens
ttctttgtgcctttg

SEQ ID NO: 4369622 - DNA, 18 bp, Homo sapiens
ttcttttaaattagaaaa

SEQ ID NO: 4369623 - DNA, 13 bp, Homo sapiens
ttcttttagagag

SEQ ID NO: 4369624 - DNA, 21 bp, Homo sapiens
ttcttttcacattaggctgtt

SEQ ID NO: 4369625 - DNA, 15 bp, Homo sapiens
ttcttttctaacttt

SEQ ID NO: 4369626 - DNA, 14 bp, Homo sapiens
ttcttttctttgta

SEQ ID NO: 4369627 - DNA, 12 bp, Homo sapiens
ttcttttgaatt

SEQ ID NO: 4369628 - DNA, 23 bp, Homo sapiens
ttcttttggtaaagactggcttt

SEQ ID NO: 4369629 - DNA, 15 bp, Homo sapiens
cactacacctggctg

SEQ ID NO: 4369630 - DNA, 23 bp, Homo sapiens
cactacatgcagcccatgcccac

SEQ ID NO: 4369631 - DNA, 14 bp, Homo sapiens
cactaccagccagc

SEQ ID NO: 4369632 - DNA, 22 bp, Homo sapiens
cactaccctgagatctgcacag

SEQ ID NO: 4369633 - DNA, 21 bp, Homo sapiens
cactacgcactggacagcatc

SEQ ID NO: 4369634 - DNA, 14 bp, Homo sapiens
cactactctgtgcc

SEQ ID NO: 4369635 - DNA, 16 bp, Homo sapiens
cactactgcatttata

SEQ ID NO: 4369636 - DNA, 21 bp, Homo sapiens
cactactgggtgtcatttcat

SEQ ID NO: 4369637 - DNA, 17 bp, Homo sapiens
cactagaaattgggcag

SEQ ID NO: 4369638 - DNA, 20 bp, Homo sapiens
cactaggcacccagctgcca

SEQ ID NO: 4369639 - DNA, 20 bp, Homo sapiens
cactagggcagggacaggat

SEQ ID NO: 4369640 - DNA, 21 bp, Homo sapiens
cactagtaagtaattatgcac

SEQ ID NO: 4369641 - DNA, 21 bp, Homo sapiens
cactagtgcaattccaagaaa

SEQ ID NO: 4369642 - DNA, 17 bp, Homo sapiens
cactatatatatttcta

SEQ ID NO: 4369643 - DNA, 12 bp, Homo sapiens
cactatatcttc

SEQ ID NO: 4369644 - DNA, 17 bp, Homo sapiens
cactatatcttcccatt

SEQ ID NO: 4369645 - DNA, 17 bp, Homo sapiens
cactatgaagctacctc

SEQ ID NO: 4369646 - DNA, 15 bp, Homo sapiens
cactatgctttcctt

SEQ ID NO: 4369647 - DNA, 19 bp, Homo sapiens
cactatggtatgctggcca

SEQ ID NO: 4369648 - DNA, 18 bp, Homo sapiens
cactatggtttgttgcct

SEQ ID NO: 4369649 - DNA, 17 bp, Homo sapiens
cactattataagtgctt

SEQ ID NO: 4369650 - DNA, 23 bp, Homo sapiens
cactattgtgaatatttggaatt

SEQ ID NO: 4369651 - DNA, 20 bp, Homo sapiens
cactcaaggacaggagcctg

SEQ ID NO: 4369652 - DNA, 12 bp, Homo sapiens
cactcacctgca

SEQ ID NO: 4369653 - DNA, 12 bp, Homo sapiens
cactcagccaca

SEQ ID NO: 4369654 - DNA, 13 bp, Homo sapiens
cactcagccacaa

SEQ ID NO: 4369655 - DNA, 18 bp, Homo sapiens
cactcagccacaaagccc

SEQ ID NO: 4369656 - DNA, 20 bp, Homo sapiens
cactcagccacaaagccccc

SEQ ID NO: 4369657 - DNA, 19 bp, Homo sapiens
cactcagccactgtcacag

SEQ ID NO: 4369658 - DNA, 12 bp, Homo sapiens
cactcagccccg

SEQ ID NO: 4369659 - DNA, 19 bp, Homo sapiens
cactcagcttcctacccac

SEQ ID NO: 4369660 - DNA, 18 bp, Homo sapiens
cactcagtctctcttctc

SEQ ID NO: 4369661 - DNA, 21 bp, Homo sapiens
cactcagtgagcctcctgtgc

SEQ ID NO: 4369662 - DNA, 20 bp, Homo sapiens
cactcatgcaaactgcttta

SEQ ID NO: 4369663 - DNA, 22 bp, Homo sapiens
cactcatgtgactctttccaac

SEQ ID NO: 4369664 - DNA, 18 bp, Homo sapiens
cactcattctgaattaat

SEQ ID NO: 4369665 - DNA, 16 bp, Homo sapiens
cactcatttcatctca

SEQ ID NO: 4369666 - DNA, 18 bp, Homo sapiens
cactccacattcttcagt

SEQ ID NO: 4369667 - DNA, 10 bp, Homo sapiens
cactccacca

SEQ ID NO: 4369668 - DNA, 11 bp, Homo sapiens
cactccaccac

SEQ ID NO: 4369669 - DNA, 13 bp, Homo sapiens
cactccagcctga

SEQ ID NO: 4369670 - DNA, 22 bp, Homo sapiens
cactcccacctgacacaccagg

SEQ ID NO: 4369671 - DNA, 16 bp, Homo sapiens
cactccccagccccag

SEQ ID NO: 4369672 - DNA, 11 bp, Homo sapiens
cactccctggg

SEQ ID NO: 4369673 - DNA, 17 bp, Homo sapiens
cactcccttctacctgc

SEQ ID NO: 4369674 - DNA, 21 bp, Homo sapiens
cactccgcgccgatgccaccg

SEQ ID NO: 4369675 - DNA, 21 bp, Homo sapiens
cactccggccctccagagccc

SEQ ID NO: 4369676 - DNA, 21 bp, Homo sapiens
cactcctagagaacgcagccc

SEQ ID NO: 4369677 - DNA, 22 bp, Homo sapiens
cactcctagagaacgcagccct

SEQ ID NO: 4369678 - DNA, 17 bp, Homo sapiens
cactcctatggtcacag

SEQ ID NO: 4369679 - DNA, 15 bp, Homo sapiens
cactcctccaaagga

SEQ ID NO: 4369680 - DNA, 15 bp, Homo sapiens
cactcctccgtgagc

SEQ ID NO: 4369681 - DNA, 16 bp, Homo sapiens
cactcctccgtgagca

SEQ ID NO: 4369682 - DNA, 17 bp, Homo sapiens
cactcctctatcatgca

SEQ ID NO: 4369683 - DNA, 18 bp, Homo sapiens
cactcctctcccacagag

SEQ ID NO: 4369684 - DNA, 13 bp, Homo sapiens
cactcctctgact

SEQ ID NO: 4369685 - DNA, 23 bp, Homo sapiens
cactcctctgactcagggctcct

SEQ ID NO: 4369686 - DNA, 22 bp, Homo sapiens
cactccttccatctcttccttc

SEQ ID NO: 4369687 - DNA, 12 bp, Homo sapiens
cactccttcctt

SEQ ID NO: 4369688 - DNA, 14 bp, Homo sapiens
cactccttgtcaac

SEQ ID NO: 4369689 - DNA, 21 bp, Homo sapiens
cactcgacccagaatggagcc

SEQ ID NO: 4369690 - DNA, 22 bp, Homo sapiens
cactcgacccagaatggagcct

SEQ ID NO: 4369691 - DNA, 17 bp, Homo sapiens
cactcgaggcctgcaaa

SEQ ID NO: 4369692 - DNA, 22 bp, Homo sapiens
cactcggcggcagcatggagct

SEQ ID NO: 4369693 - DNA, 14 bp, Homo sapiens
cactctagttctag

SEQ ID NO: 4369694 - DNA, 18 bp, Homo sapiens
cactctagttctagatga

SEQ ID NO: 4369695 - DNA, 17 bp, Homo sapiens
cactctatatgtagtgc

SEQ ID NO: 4369696 - DNA, 13 bp, Homo sapiens
cactctatgagtt

SEQ ID NO: 4369697 - DNA, 18 bp, Homo sapiens
cactctcattccccaggt

SEQ ID NO: 4369698 - DNA, 12 bp, Homo sapiens
cactctcctggg

SEQ ID NO: 4369699 - DNA, 13 bp, Homo sapiens
cactctcctgggc

SEQ ID NO: 4369700 - DNA, 16 bp, Homo sapiens
cactctcctgggcccc

SEQ ID NO: 4369701 - DNA, 23 bp, Homo sapiens
cactctcctgggcccctccctac

SEQ ID NO: 4369702 - DNA, 21 bp, Homo sapiens
cactctctgccattctgtgca

SEQ ID NO: 4369703 - DNA, 14 bp, Homo sapiens
cactctctgggact

SEQ ID NO: 4369704 - DNA, 15 bp, Homo sapiens
cactctctgggactc

SEQ ID NO: 4369705 - DNA, 13 bp, Homo sapiens
cactctgccccca

SEQ ID NO: 4369706 - DNA, 15 bp, Homo sapiens
cactctgcccccatt

SEQ ID NO: 4369707 - DNA, 12 bp, Homo sapiens
cactctgctgtt

SEQ ID NO: 4369708 - DNA, 18 bp, Homo sapiens
cactctggatgatggatt

SEQ ID NO: 4369709 - DNA, 16 bp, Homo sapiens
cactctgtcagccagc

SEQ ID NO: 4369710 - DNA, 21 bp, Homo sapiens
cactctgtcagccagccgccc

SEQ ID NO: 4369711 - DNA, 18 bp, Homo sapiens
cactctgtccctgtcctt

SEQ ID NO: 4369712 - DNA, 17 bp, Homo sapiens
cactcttctcttgagca

SEQ ID NO: 4369713 - DNA, 14 bp, Homo sapiens
cactcttctgtctt

SEQ ID NO: 4369714 - DNA, 15 bp, Homo sapiens
cactctttaccttta

SEQ ID NO: 4369715 - DNA, 16 bp, Homo sapiens
cactctttatagtgca

SEQ ID NO: 4369716 - DNA, 23 bp, Homo sapiens
cactcttttgctttattccagaa

SEQ ID NO: 4369717 - DNA, 16 bp, Homo sapiens
cactgaaaaaatatat

SEQ ID NO: 4369718 - DNA, 20 bp, Homo sapiens
cactgaaagttttgtaaaag

SEQ ID NO: 4369719 - DNA, 14 bp, Homo sapiens
cactgaactgcttt

SEQ ID NO: 4369720 - DNA, 15 bp, Homo sapiens
cactgaactgctttt

SEQ ID NO: 4369721 - DNA, 16 bp, Homo sapiens
cactgaagagctcttg

SEQ ID NO: 4369722 - DNA, 19 bp, Homo sapiens
cactgaagagctcttggcc

SEQ ID NO: 4369723 - DNA, 13 bp, Homo sapiens
cactgaagtgctt

SEQ ID NO: 4369724 - DNA, 21 bp, Homo sapiens
cactgaatatcaactctgaaa

SEQ ID NO: 4369725 - DNA, 16 bp, Homo sapiens
cactgaccatccactc

SEQ ID NO: 4369726 - DNA, 14 bp, Homo sapiens
cactgacttctaag

SEQ ID NO: 4369727 - DNA, 16 bp, Homo sapiens
cactgagaatgtaaga

SEQ ID NO: 4369728 - DNA, 18 bp, Homo sapiens
cactgagaatgtaagaac

SEQ ID NO: 4369729 - DNA, 21 bp, Homo sapiens
cactgagcatcactagtgaca

SEQ ID NO: 4369730 - DNA, 12 bp, Homo sapiens
cactgagccagt

SEQ ID NO: 4369731 - DNA, 16 bp, Homo sapiens
cactgagccagtcttt

SEQ ID NO: 4369732 - DNA, 15 bp, Homo sapiens
cactgaggaagaacg

SEQ ID NO: 4369733 - DNA, 13 bp, Homo sapiens
cactgaggggcca

SEQ ID NO: 4369734 - DNA, 15 bp, Homo sapiens
cactgaggggccagg

SEQ ID NO: 4369735 - DNA, 20 bp, Homo sapiens
cactgaggggccagggagga

SEQ ID NO: 4369736 - DNA, 19 bp, Homo sapiens
cactgagtgcctactcttt

SEQ ID NO: 4369737 - DNA, 21 bp, Homo sapiens
cactgagttttgtttcacttt

SEQ ID NO: 4369738 - DNA, 17 bp, Homo sapiens
cactgataatcacactg

SEQ ID NO: 4369739 - DNA, 13 bp, Homo sapiens
cactgatagtcct

SEQ ID NO: 4369740 - DNA, 14 bp, Homo sapiens
cactgatagtcctt

SEQ ID NO: 4369741 - DNA, 17 bp, Homo sapiens
cactgatatcatgggga

SEQ ID NO: 4369742 - DNA, 17 bp, Homo sapiens
cactgatctttgcaaag

SEQ ID NO: 4369743 - DNA, 16 bp, Homo sapiens
cactgatgcttagatg

SEQ ID NO: 4369744 - DNA, 15 bp, Homo sapiens
cactgatgggaataa

SEQ ID NO: 4369745 - DNA, 16 bp, Homo sapiens
cactgatgtgtgaagt

SEQ ID NO: 4369746 - DNA, 17 bp, Homo sapiens
cacttctagatctcagc

SEQ ID NO: 4369747 - DNA, 12 bp, Homo sapiens
cacttctattta

SEQ ID NO: 4369748 - DNA, 16 bp, Homo sapiens
cacttctatttagcca

SEQ ID NO: 4369749 - DNA, 17 bp, Homo sapiens
cacttctatttatttat

SEQ ID NO: 4369750 - DNA, 13 bp, Homo sapiens
cacttctccccgc

SEQ ID NO: 4369751 - DNA, 13 bp, Homo sapiens
cacttctgctgca

SEQ ID NO: 4369752 - DNA, 17 bp, Homo sapiens
cacttctgctgcatcgc

SEQ ID NO: 4369753 - DNA, 18 bp, Homo sapiens
cacttctgggtggggcag

SEQ ID NO: 4369754 - DNA, 22 bp, Homo sapiens
cacttctgtgagacccccacac

SEQ ID NO: 4369755 - DNA, 19 bp, Homo sapiens
cacttctttgcagagcctt

SEQ ID NO: 4369756 - DNA, 19 bp, Homo sapiens
cacttgaagcctaaatttg

SEQ ID NO: 4369757 - DNA, 15 bp, Homo sapiens
cacttgaatttattg

SEQ ID NO: 4369758 - DNA, 16 bp, Homo sapiens
cacttgaatttattga

SEQ ID NO: 4369759 - DNA, 20 bp, Homo sapiens
cacttgagaaccagtctcct

SEQ ID NO: 4369760 - DNA, 15 bp, Homo sapiens
cacttgagatgattt

SEQ ID NO: 4369761 - DNA, 20 bp, Homo sapiens
cacttgccattccaaaatat

SEQ ID NO: 4369762 - DNA, 20 bp, Homo sapiens
cacttgctgcactcttgcac

SEQ ID NO: 4369763 - DNA, 15 bp, Homo sapiens
cacttggcatacaaa

SEQ ID NO: 4369764 - DNA, 20 bp, Homo sapiens
cacttggcatacaaaatatt

SEQ ID NO: 4369765 - DNA, 21 bp, Homo sapiens
cacttggcatacaaaatattt

SEQ ID NO: 4369766 - DNA, 19 bp, Homo sapiens
cacttgtctcattttaatg

SEQ ID NO: 4369767 - DNA, 22 bp, Homo sapiens
cacttgtgtgtgtacctgtggc

SEQ ID NO: 4369768 - DNA, 23 bp, Homo sapiens
cacttgtgtgtgtacctgtggct

SEQ ID NO: 4369769 - DNA, 13 bp, Homo sapiens
cacttgttccagc

SEQ ID NO: 4369770 - DNA, 15 bp, Homo sapiens
cacttgttccagctc

SEQ ID NO: 4369771 - DNA, 17 bp, Homo sapiens
cacttgttccagctctt

SEQ ID NO: 4369772 - DNA, 14 bp, Homo sapiens
cactttactttcaa

SEQ ID NO: 4369773 - DNA, 15 bp, Homo sapiens
cactttatttacttc

SEQ ID NO: 4369774 - DNA, 23 bp, Homo sapiens
cactttcattgccagtgtctttc

SEQ ID NO: 4369775 - DNA, 21 bp, Homo sapiens
cactttccaatgccacagaca

SEQ ID NO: 4369776 - DNA, 18 bp, Homo sapiens
cactttcccttgtgtcaa

SEQ ID NO: 4369777 - DNA, 20 bp, Homo sapiens
cactttctatcctctgtaaa

SEQ ID NO: 4369778 - DNA, 19 bp, Homo sapiens
cactttctcagttttcata

SEQ ID NO: 4369779 - DNA, 17 bp, Homo sapiens
cactttcttcaaagcca

SEQ ID NO: 4369780 - DNA, 15 bp, Homo sapiens
cactttgacacccag

SEQ ID NO: 4369781 - DNA, 16 bp, Homo sapiens
cactttgcctcctgtg

SEQ ID NO: 4369782 - DNA, 17 bp, Homo sapiens
cactttgcctcctgtgt

SEQ ID NO: 4369783 - DNA, 13 bp, Homo sapiens
cactttgtaaatt

SEQ ID NO: 4369784 - DNA, 15 bp, Homo sapiens
cactttgtatgattt

SEQ ID NO: 4369785 - DNA, 14 bp, Homo sapiens
cactttgttgcaag

SEQ ID NO: 4369786 - DNA, 16 bp, Homo sapiens
cactttgtttagaaaa

SEQ ID NO: 4369787 - DNA, 13 bp, Homo sapiens
cacttttaaacta

SEQ ID NO: 4369788 - DNA, 19 bp, Homo sapiens
cactttttaagtttgaaga

SEQ ID NO: 4369789 - DNA, 20 bp, Homo sapiens
cactttttacagcagcaata

SEQ ID NO: 4369790 - DNA, 14 bp, Homo sapiens
cactttttgtgaat

SEQ ID NO: 4369791 - DNA, 17 bp, Homo sapiens
cactttttttctttttc

SEQ ID NO: 4369792 - DNA, 20 bp, Homo sapiens
cagaaaaaaaaaatgcattt

SEQ ID NO: 4369793 - DNA, 22 bp, Homo sapiens
cagaaaaacaatggtaacattt

SEQ ID NO: 4369794 - DNA, 19 bp, Homo sapiens
cagaaaaattgaactacag

SEQ ID NO: 4369795 - DNA, 9 bp, Homo sapiens
cagaaaacc

SEQ ID NO: 4369796 - DNA, 17 bp, Homo sapiens
cagaaaacctaagcaaa

SEQ ID NO: 4369797 - DNA, 17 bp, Homo sapiens
cagaaaagaagtgaagt

SEQ ID NO: 4369798 - DNA, 16 bp, Homo sapiens
cagaaaagcacctgcc

SEQ ID NO: 4369799 - DNA, 21 bp, Homo sapiens
cagaaaataaggcacccatct

SEQ ID NO: 4369800 - DNA, 18 bp, Homo sapiens
cagaaaatgttgagaatc

SEQ ID NO: 4369801 - DNA, 13 bp, Homo sapiens
cagaaaattaaac

SEQ ID NO: 4369802 - DNA, 23 bp, Homo sapiens
cagaaaattaaactacagaatat

SEQ ID NO: 4369803 - DNA, 17 bp, Homo sapiens
cagaaaattctgtgcct

SEQ ID NO: 4369804 - DNA, 23 bp, Homo sapiens
cagaaaattctgtgccttgtttt

SEQ ID NO: 4369805 - DNA, 14 bp, Homo sapiens
cagaaaatttaact

SEQ ID NO: 4369806 - DNA, 14 bp, Homo sapiens
cagaaacagcatat

SEQ ID NO: 4369807 - DNA, 21 bp, Homo sapiens
cagaaaccaaactaggagatg

SEQ ID NO: 4369808 - DNA, 15 bp, Homo sapiens
cagaaaccattctag

SEQ ID NO: 4369809 - DNA, 22 bp, Homo sapiens
cagaaaccctcattgtgtttct

SEQ ID NO: 4369810 - DNA, 15 bp, Homo sapiens
cagaaagagggacaa

SEQ ID NO: 4369811 - DNA, 21 bp, Homo sapiens
cagaaagagggacaagagggt

SEQ ID NO: 4369812 - DNA, 17 bp, Homo sapiens
aagggggtcaaaggaag

SEQ ID NO: 4369813 - DNA, 18 bp, Homo sapiens
aagggggtcaaaggaaga

SEQ ID NO: 4369814 - DNA, 19 bp, Homo sapiens
aaggggttcctcaaatttt

SEQ ID NO: 4369815 - DNA, 12 bp, Homo sapiens
aagggtcaggcc

SEQ ID NO: 4369816 - DNA, 21 bp, Homo sapiens
aagttatttccaagtttgtgt

SEQ ID NO: 4369817 - DNA, 23 bp, Homo sapiens
aagttattttgtacatttttcag

SEQ ID NO: 4369818 - DNA, 18 bp, Homo sapiens
gaagcctccaagcacaga

SEQ ID NO: 4369819 - DNA, 23 bp, Homo sapiens
gaagcctccaagcacagagcctg

SEQ ID NO: 4369820 - DNA, 21 bp, Homo sapiens
gaagcctccaagcctgcctcc

SEQ ID NO: 4369821 - DNA, 22 bp, Homo sapiens
gaagcctccaagcctgcctccc

SEQ ID NO: 4369822 - DNA, 19 bp, Homo sapiens
gaagccttatgaaaattat

SEQ ID NO: 4369823 - DNA, 18 bp, Homo sapiens
gaagcctttgggaagggg

SEQ ID NO: 4369824 - DNA, 19 bp, Homo sapiens
gaagcgttgtcctcagccc

SEQ ID NO: 4369825 - DNA, 14 bp, Homo sapiens
gaagctaatttgca

SEQ ID NO: 4369826 - DNA, 17 bp, Homo sapiens
gaagctaatttgcatta

SEQ ID NO: 4369827 - DNA, 20 bp, Homo sapiens
gaagctgaagatccccaact

SEQ ID NO: 4369828 - DNA, 17 bp, Homo sapiens
gaagctgacaatttatg

SEQ ID NO: 4369829 - DNA, 16 bp, Homo sapiens
gaagctgctgtgtcct

SEQ ID NO: 4369830 - DNA, 21 bp, Homo sapiens
gaagctggagcccagcgtcag

SEQ ID NO: 4369831 - DNA, 14 bp, Homo sapiens
gaagctggcctgag

SEQ ID NO: 4369832 - DNA, 19 bp, Homo sapiens
gaagctggcctgagagggg

SEQ ID NO: 4369833 - DNA, 22 bp, Homo sapiens
gaagctggcctgagaggggaag

SEQ ID NO: 4369834 - DNA, 12 bp, Homo sapiens
gaagctgtgtcc

SEQ ID NO: 4369835 - DNA, 17 bp, Homo sapiens
gaagctgtgtccttgca

SEQ ID NO: 4369836 - DNA, 24 bp, Homo sapiens
gaagctgtgtccttgcacctgcat

SEQ ID NO: 4369837 - DNA, 15 bp, Homo sapiens
gaagctgtttggaaa

SEQ ID NO: 4369838 - DNA, 18 bp, Homo sapiens
gaagctgtttggaaaaga

SEQ ID NO: 4369839 - DNA, 17 bp, Homo sapiens
gaagcttccacaaaatt

SEQ ID NO: 4369840 - DNA, 15 bp, Homo sapiens
gaaggaacaaagaca

SEQ ID NO: 4369841 - DNA, 20 bp, Homo sapiens
gaaggaacatggagctgtca

SEQ ID NO: 4369842 - DNA, 16 bp, Homo sapiens
gaaggaagagaagaca

SEQ ID NO: 4369843 - DNA, 23 bp, Homo sapiens
gaaggaaggagactcacctctgc

SEQ ID NO: 4369844 - DNA, 18 bp, Homo sapiens
gaaggacagtccctgctg

SEQ ID NO: 4369845 - DNA, 19 bp, Homo sapiens
gaaggacagtccctgctgg

SEQ ID NO: 4369846 - DNA, 23 bp, Homo sapiens
gaaggacagtccctgctggggaa

SEQ ID NO: 4369847 - DNA, 21 bp, Homo sapiens
gaaggactatgaaaagctaga

SEQ ID NO: 4369848 - DNA, 20 bp, Homo sapiens
gaaggagactcacctctgcc

SEQ ID NO: 4369849 - DNA, 23 bp, Homo sapiens
gaaggagactcacctctgcctca

SEQ ID NO: 4369850 - DNA, 15 bp, Homo sapiens
gaaggagagcctgct

SEQ ID NO: 4369851 - DNA, 20 bp, Homo sapiens
gaaggagatgagtgggcttc

SEQ ID NO: 4369852 - DNA, 16 bp, Homo sapiens
gaaggagattttaagg

SEQ ID NO: 4369853 - DNA, 11 bp, Homo sapiens
gaaggaggcct

SEQ ID NO: 4369854 - DNA, 21 bp, Homo sapiens
gaaggaggggagagacaggca

SEQ ID NO: 4369855 - DNA, 22 bp, Homo sapiens
gaaggaggggagagacaggcag

SEQ ID NO: 4369856 - DNA, 18 bp, Homo sapiens
gaaggagttacagggaag

SEQ ID NO: 4369857 - DNA, 22 bp, Homo sapiens
gaaggcaagagggggtggaggg

SEQ ID NO: 4369858 - DNA, 23 bp, Homo sapiens
gaaggcaagagggggtggagggg

SEQ ID NO: 4369859 - DNA, 13 bp, Homo sapiens
gaaggcagagaaa

SEQ ID NO: 4369860 - DNA, 18 bp, Homo sapiens
gaaggcagagaaatctaa

SEQ ID NO: 4369861 - DNA, 14 bp, Homo sapiens
gaaggcagcattcc

SEQ ID NO: 4369862 - DNA, 19 bp, Homo sapiens
gaaggcatttgcagggtcc

SEQ ID NO: 4369863 - DNA, 19 bp, Homo sapiens
gaaggccaaaatcaagagt

SEQ ID NO: 4369864 - DNA, 16 bp, Homo sapiens
gaaggccagcaacatt

SEQ ID NO: 4369865 - DNA, 17 bp, Homo sapiens
gaaggcccaactggttc

SEQ ID NO: 4369866 - DNA, 21 bp, Homo sapiens
gaaggccccagagagaccctg

SEQ ID NO: 4369867 - DNA, 13 bp, Homo sapiens
gaaggcctgactt

SEQ ID NO: 4369868 - DNA, 14 bp, Homo sapiens
gaaggcctgagccc

SEQ ID NO: 4369869 - DNA, 15 bp, Homo sapiens
gaaggcgggctgagg

SEQ ID NO: 4369870 - DNA, 17 bp, Homo sapiens
gaaggcgggctgaggag

SEQ ID NO: 4369871 - DNA, 17 bp, Homo sapiens
gaaggctaaaaagcaac

SEQ ID NO: 4369872 - DNA, 23 bp, Homo sapiens
gaaggctgtgtgtcttctgcccc

SEQ ID NO: 4369873 - DNA, 21 bp, Homo sapiens
gaaggcttgggatttgctgtg

SEQ ID NO: 4369874 - DNA, 18 bp, Homo sapiens
gaagggaaagcgggcagc

SEQ ID NO: 4369875 - DNA, 16 bp, Homo sapiens
gaagggcattctttcc

SEQ ID NO: 4369876 - DNA, 14 bp, Homo sapiens
gaagggccagtcct

SEQ ID NO: 4369877 - DNA, 16 bp, Homo sapiens
gaagggccagtcctgc

SEQ ID NO: 4369878 - DNA, 22 bp, Homo sapiens
gaagggctagaacctggagagc

SEQ ID NO: 4369879 - DNA, 22 bp, Homo sapiens
gaagggctgggccaccagggat

SEQ ID NO: 4369880 - DNA, 15 bp, Homo sapiens
tcagtatgtcactct

SEQ ID NO: 4369881 - DNA, 17 bp, Homo sapiens
tcagtatgtcactctgg

SEQ ID NO: 4369882 - DNA, 19 bp, Homo sapiens
tcagtattctgacatgtaa

SEQ ID NO: 4369883 - DNA, 13 bp, Homo sapiens
tcagtattttcca

SEQ ID NO: 4369884 - DNA, 19 bp, Homo sapiens
tcagtattttccagcctta

SEQ ID NO: 4369885 - DNA, 14 bp, Homo sapiens
tcagtcaaaacttt

SEQ ID NO: 4369886 - DNA, 16 bp, Homo sapiens
tcagtcaatattttta

SEQ ID NO: 4369887 - DNA, 20 bp, Homo sapiens
tcagtcactaaaaggaagac

SEQ ID NO: 4369888 - DNA, 18 bp, Homo sapiens
tcagtcattgctgttgta

SEQ ID NO: 4369889 - DNA, 18 bp, Homo sapiens
tcagtccatgaagatgta

SEQ ID NO: 4369890 - DNA, 20 bp, Homo sapiens
tcagtctctcttctctccag

SEQ ID NO: 4369891 - DNA, 13 bp, Homo sapiens
tcagtctggtggg

SEQ ID NO: 4369892 - DNA, 17 bp, Homo sapiens
tcagtctggtgggagga

SEQ ID NO: 4369893 - DNA, 13 bp, Homo sapiens
tcagtgaactgtt

SEQ ID NO: 4369894 - DNA, 16 bp, Homo sapiens
tcagtgaagtctagaa

SEQ ID NO: 4369895 - DNA, 17 bp, Homo sapiens
tcagtgagcccctcccc

SEQ ID NO: 4369896 - DNA, 20 bp, Homo sapiens
tcagtgagcccctccccagc

SEQ ID NO: 4369897 - DNA, 23 bp, Homo sapiens
tcagtgagcccctccccagccag

SEQ ID NO: 4369898 - DNA, 19 bp, Homo sapiens
tcagtgataatgttcattt

SEQ ID NO: 4369899 - DNA, 23 bp, Homo sapiens
tcagtgataattggtttgactgt

SEQ ID NO: 4369900 - DNA, 16 bp, Homo sapiens
tcagtgccacctatgc

SEQ ID NO: 4369901 - DNA, 9 bp, Homo sapiens
tcagtgccc

SEQ ID NO: 4369902 - DNA, 13 bp, Homo sapiens
tcagtgctcctgg

SEQ ID NO: 4369903 - DNA, 15 bp, Homo sapiens
tcagtggccaggtgc

SEQ ID NO: 4369904 - DNA, 17 bp, Homo sapiens
tcagtggcttcatctgt

SEQ ID NO: 4369905 - DNA, 12 bp, Homo sapiens
tcagtggcttct

SEQ ID NO: 4369906 - DNA, 13 bp, Homo sapiens
tcagtgggagaaa

SEQ ID NO: 4369907 - DNA, 17 bp, Homo sapiens
tcagtggggcagcctct

SEQ ID NO: 4369908 - DNA, 14 bp, Homo sapiens
tcagtggggcagtc

SEQ ID NO: 4369909 - DNA, 15 bp, Homo sapiens
tcagtggtgaaatct

SEQ ID NO: 4369910 - DNA, 14 bp, Homo sapiens
tcagtgtaaagtgt

SEQ ID NO: 4369911 - DNA, 22 bp, Homo sapiens
tcagtgtagaacctaattcaat

SEQ ID NO: 4369912 - DNA, 15 bp, Homo sapiens
tcagtgtcaaataaa

SEQ ID NO: 4369913 - DNA, 17 bp, Homo sapiens
tcagtgtcaaataaaca

SEQ ID NO: 4369914 - DNA, 21 bp, Homo sapiens
tcagtgtcaaataaacactgt

SEQ ID NO: 4369915 - DNA, 14 bp, Homo sapiens
tcagtgtgatgaat

SEQ ID NO: 4369916 - DNA, 18 bp, Homo sapiens
aatacaggaaacagttgc

SEQ ID NO: 4369917 - DNA, 23 bp, Homo sapiens
aatacaggaaacagttgcatgta

SEQ ID NO: 4369918 - DNA, 12 bp, Homo sapiens
aatacatactaa

SEQ ID NO: 4369919 - DNA, 13 bp, Homo sapiens
aatacatactaat

SEQ ID NO: 4369920 - DNA, 20 bp, Homo sapiens
aatacatactaatgaagtat

SEQ ID NO: 4369921 - DNA, 20 bp, Homo sapiens
catctataatgtcagcttat

SEQ ID NO: 4369922 - DNA, 15 bp, Homo sapiens
catctatctcaatcc

SEQ ID NO: 4369923 - DNA, 20 bp, Homo sapiens
catctatctcatctatctca

SEQ ID NO: 4369924 - DNA, 19 bp, Homo sapiens
catctatggttctaaatat

SEQ ID NO: 4369925 - DNA, 21 bp, Homo sapiens
catctatggttctaaatattg

SEQ ID NO: 4369926 - DNA, 11 bp, Homo sapiens
catctatttta

SEQ ID NO: 4369927 - DNA, 22 bp, Homo sapiens
catctattttattttattgaat

SEQ ID NO: 4369928 - DNA, 21 bp, Homo sapiens
catctattttgatgcagcatt

SEQ ID NO: 4369929 - DNA, 14 bp, Homo sapiens
catctattttggat

SEQ ID NO: 4369930 - DNA, 16 bp, Homo sapiens
catctcagaccctgct

SEQ ID NO: 4369931 - DNA, 13 bp, Homo sapiens
catctcagatgcc

SEQ ID NO: 4369932 - DNA, 13 bp, Homo sapiens
catctcaggagat

SEQ ID NO: 4369933 - DNA, 17 bp, Homo sapiens
catctcaggagatggag

SEQ ID NO: 4369934 - DNA, 23 bp, Homo sapiens
catctcaggagatggagggcttg

SEQ ID NO: 4369935 - DNA, 18 bp, Homo sapiens
catctcatcatgtctatt

SEQ ID NO: 4369936 - DNA, 23 bp, Homo sapiens
catctcatgtatcatctggatag

SEQ ID NO: 4369937 - DNA, 23 bp, Homo sapiens
catctcatttaagggaaaaatat

SEQ ID NO: 4369938 - DNA, 18 bp, Homo sapiens
catctcccagataatgtg

SEQ ID NO: 4369939 - DNA, 18 bp, Homo sapiens
catctcccaggccccagg

SEQ ID NO: 4369940 - DNA, 21 bp, Homo sapiens
catctcccaggccccagggga

SEQ ID NO: 4369941 - DNA, 13 bp, Homo sapiens
catctccctgcct

SEQ ID NO: 4369942 - DNA, 14 bp, Homo sapiens
catctccctgcctg

SEQ ID NO: 4369943 - DNA, 17 bp, Homo sapiens
catctccctgcctggcc

SEQ ID NO: 4369944 - DNA, 18 bp, Homo sapiens
catctccctgcctggccc

SEQ ID NO: 4369945 - DNA, 19 bp, Homo sapiens
catctccctgcctggcccc

SEQ ID NO: 4369946 - DNA, 19 bp, Homo sapiens
catctcctcccgcccttcc

SEQ ID NO: 4369947 - DNA, 21 bp, Homo sapiens
catctccttgatcatgtcttc

SEQ ID NO: 4369948 - DNA, 16 bp, Homo sapiens
catctctctgccctct

SEQ ID NO: 4369949 - DNA, 23 bp, Homo sapiens
catctctctgccctctccctgtg

SEQ ID NO: 4369950 - DNA, 20 bp, Homo sapiens
catctctctggggccctggg

SEQ ID NO: 4369951 - DNA, 22 bp, Homo sapiens
catctctgaactggtagaaaaa

SEQ ID NO: 4369952 - DNA, 14 bp, Homo sapiens
catctctgactttc

SEQ ID NO: 4369953 - DNA, 23 bp, Homo sapiens
catctctgttcttttcccgcctc

SEQ ID NO: 4369954 - DNA, 21 bp, Homo sapiens
catctcttagctcccctccaa

SEQ ID NO: 4369955 - DNA, 23 bp, Homo sapiens
catctcttagctcccctccaacc

SEQ ID NO: 4369956 - DNA, 12 bp, Homo sapiens
catctcttcccc

SEQ ID NO: 4369957 - DNA, 16 bp, Homo sapiens
catctcttccccagag

SEQ ID NO: 4369958 - DNA, 21 bp, Homo sapiens
catctcttcctccgaggccag

SEQ ID NO: 4369959 - DNA, 17 bp, Homo sapiens
catctctttaaaaacaa

SEQ ID NO: 4369960 - DNA, 13 bp, Homo sapiens
catctgaaagcca

SEQ ID NO: 4369961 - DNA, 16 bp, Homo sapiens
catctgaaagccacgt

SEQ ID NO: 4369962 - DNA, 21 bp, Homo sapiens
catctgaacacaaccagaggt

SEQ ID NO: 4369963 - DNA, 19 bp, Homo sapiens
catctgaaggggcaaattc

SEQ ID NO: 4369964 - DNA, 22 bp, Homo sapiens
catctgaaggggcaaattcttt

SEQ ID NO: 4369965 - DNA, 21 bp, Homo sapiens
catctgaggttttatttcatt

SEQ ID NO: 4369966 - DNA, 12 bp, Homo sapiens
catctgcaaaag

SEQ ID NO: 4369967 - DNA, 20 bp, Homo sapiens
catctgcaaaaggcctcttg

SEQ ID NO: 4369968 - DNA, 17 bp, Homo sapiens
catctgcacccctgagt

SEQ ID NO: 4369969 - DNA, 23 bp, Homo sapiens
catctgcaccccttctctcctcc

SEQ ID NO: 4369970 - DNA, 15 bp, Homo sapiens
catctgccccaggta

SEQ ID NO: 4369971 - DNA, 11 bp, Homo sapiens
catctgcccct

SEQ ID NO: 4369972 - DNA, 18 bp, Homo sapiens
catctgccttaaaaccaa

SEQ ID NO: 4369973 - DNA, 14 bp, Homo sapiens
catctgctctcctt

SEQ ID NO: 4369974 - DNA, 18 bp, Homo sapiens
catctgcttggttggctg

SEQ ID NO: 4369975 - DNA, 19 bp, Homo sapiens
catctggaaagttttctcc

SEQ ID NO: 4369976 - DNA, 20 bp, Homo sapiens
catctggataggagcctgct

SEQ ID NO: 4369977 - DNA, 20 bp, Homo sapiens
catctgtcattatattctaa

SEQ ID NO: 4369978 - DNA, 23 bp, Homo sapiens
catctgtcattatattctaatta

SEQ ID NO: 4369979 - DNA, 14 bp, Homo sapiens
catctgtccagctg

SEQ ID NO: 4369980 - DNA, 20 bp, Homo sapiens
catctgtccagctggggcca

SEQ ID NO: 4369981 - DNA, 16 bp, Homo sapiens
catctgtccctccggg

SEQ ID NO: 4369982 - DNA, 17 bp, Homo sapiens
catctgtccctccggga

SEQ ID NO: 4369983 - DNA, 20 bp, Homo sapiens
catctgtccctccgggacct

SEQ ID NO: 4369984 - DNA, 16 bp, Homo sapiens
catctgtgggatgctg

SEQ ID NO: 4369985 - DNA, 14 bp, Homo sapiens
catctgtgtcttgt

SEQ ID NO: 4369986 - DNA, 20 bp, Homo sapiens
catcttaaactaatacgtgc

SEQ ID NO: 4369987 - DNA, 21 bp, Homo sapiens
catcttatttattttagcaaa

SEQ ID NO: 4369988 - DNA, 16 bp, Homo sapiens
catcttcactgcaatt

SEQ ID NO: 4369989 - DNA, 17 bp, Homo sapiens
catcttctccatctggc

SEQ ID NO: 4369990 - DNA, 17 bp, Homo sapiens
catcttctggcttgact

SEQ ID NO: 4369991 - DNA, 19 bp, Homo sapiens
catcttcttcaccatttgg

SEQ ID NO: 4369992 - DNA, 22 bp, Homo sapiens
catcttgaatactctgccctct

SEQ ID NO: 4369993 - DNA, 12 bp, Homo sapiens
catcttgctttt

SEQ ID NO: 4369994 - DNA, 22 bp, Homo sapiens
catctttacaaaactacatgag

SEQ ID NO: 4369995 - DNA, 14 bp, Homo sapiens
gtagaattgcattg

SEQ ID NO: 4369996 - DNA, 15 bp, Homo sapiens
gtagaattgcattga

SEQ ID NO: 4369997 - DNA, 14 bp, Homo sapiens
gtagacataaagaa

SEQ ID NO: 4369998 - DNA, 15 bp, Homo sapiens
gtagacatttataac

SEQ ID NO: 4369999 - DNA, 15 bp, Homo sapiens
gtagagacagggttt

SEQ ID NO: 4370000 - DNA, 18 bp, Homo sapiens
gtagagagcaaagatggc

SEQ ID NO: 4370001 - DNA, 21 bp, Homo sapiens
gtagagctagaacatggagag

SEQ ID NO: 4370002 - DNA, 22 bp, Homo sapiens
gtagaggggtctcatgtctccc

SEQ ID NO: 4370003 - DNA, 21 bp, Homo sapiens
gtagagtaacgagaagtgctt

SEQ ID NO: 4370004 - DNA, 14 bp, Homo sapiens
gtagatgacaaata

SEQ ID NO: 4370005 - DNA, 16 bp, Homo sapiens
gtagatgcttgattgt

SEQ ID NO: 4370006 - DNA, 22 bp, Homo sapiens
gtagatgttagggtataagttg

SEQ ID NO: 4370007 - DNA, 17 bp, Homo sapiens
gtagatttgaaaattgt

SEQ ID NO: 4370008 - DNA, 14 bp, Homo sapiens
gtagattttgttat

SEQ ID NO: 4370009 - DNA, 16 bp, Homo sapiens
gtagcaaatgtttact

SEQ ID NO: 4370010 - DNA, 22 bp, Homo sapiens
gtagcacagattttgaatctgt

SEQ ID NO: 4370011 - DNA, 18 bp, Homo sapiens
gtagcagctatatatttc

SEQ ID NO: 4370012 - DNA, 17 bp, Homo sapiens
gtagcaggtaccactga

SEQ ID NO: 4370013 - DNA, 12 bp, Homo sapiens
gtagccacagct

SEQ ID NO: 4370014 - DNA, 15 bp, Homo sapiens
gtagccacagctgct

SEQ ID NO: 4370015 - DNA, 13 bp, Homo sapiens
gtagcctcctcct

SEQ ID NO: 4370016 - DNA, 23 bp, Homo sapiens
gtagcctgaattgctttctgctc

SEQ ID NO: 4370017 - DNA, 18 bp, Homo sapiens
gtagcgttttttaaatgt

SEQ ID NO: 4370018 - DNA, 21 bp, Homo sapiens
gtagctaacagttgccacatc

SEQ ID NO: 4370019 - DNA, 22 bp, Homo sapiens
gtagctacctacatgctgaaaa

SEQ ID NO: 4370020 - DNA, 15 bp, Homo sapiens
gtagctcccctggct

SEQ ID NO: 4370021 - DNA, 17 bp, Homo sapiens
gtagctcccctggctgg

SEQ ID NO: 4370022 - DNA, 20 bp, Homo sapiens
gtagctcccctggctggctc

SEQ ID NO: 4370023 - DNA, 21 bp, Homo sapiens
gtagctcccctggctggctcc

SEQ ID NO: 4370024 - DNA, 14 bp, Homo sapiens
gtagctctgcctcc

SEQ ID NO: 4370025 - DNA, 18 bp, Homo sapiens
gtagctctgcctccctct

SEQ ID NO: 4370026 - DNA, 22 bp, Homo sapiens
gtagctgggaaagcataaagct

SEQ ID NO: 4370027 - DNA, 18 bp, Homo sapiens
gtagctgggattacaggc

SEQ ID NO: 4370028 - DNA, 18 bp, Homo sapiens
gtagctgtggtgaggtgg

SEQ ID NO: 4370029 - DNA, 16 bp, Homo sapiens
gtagcttatctgcccc

SEQ ID NO: 4370030 - DNA, 22 bp, Homo sapiens
gtagcttatctgcccctccccc

SEQ ID NO: 4370031 - DNA, 14 bp, Homo sapiens
gtagcttcagtcat

SEQ ID NO: 4370032 - DNA, 16 bp, Homo sapiens
gtagcttcagtcatta

SEQ ID NO: 4370033 - DNA, 13 bp, Homo sapiens
gtaggacaagttt

SEQ ID NO: 4370034 - DNA, 14 bp, Homo sapiens
gtaggacaagtttt

SEQ ID NO: 4370035 - DNA, 21 bp, Homo sapiens
gtaggatagctactaaatata

SEQ ID NO: 4370036 - DNA, 16 bp, Homo sapiens
gtaggatcacctgagg

SEQ ID NO: 4370037 - DNA, 18 bp, Homo sapiens
gtaggatgacaggctctc

SEQ ID NO: 4370038 - DNA, 12 bp, Homo sapiens
gtagggctgact

SEQ ID NO: 4370039 - DNA, 22 bp, Homo sapiens
gtagggtaattagtaacatgtg

SEQ ID NO: 4370040 - DNA, 14 bp, Homo sapiens
gtaggtaaaatgta

SEQ ID NO: 4370041 - DNA, 18 bp, Homo sapiens
gtaggtaaaatgtatttt

SEQ ID NO: 4370042 - DNA, 15 bp, Homo sapiens
gtaggtaccatttgt

SEQ ID NO: 4370043 - DNA, 22 bp, Homo sapiens
gtaggtcacaacaactcatttt

SEQ ID NO: 4370044 - DNA, 24 bp, Homo sapiens
gtaggtggaagctagacacatgaa

SEQ ID NO: 4370045 - DNA, 15 bp, Homo sapiens
gtagtaacactaata

SEQ ID NO: 4370046 - DNA, 15 bp, Homo sapiens
gtagtaattgacatg

SEQ ID NO: 4370047 - DNA, 24 bp, Homo sapiens
gtagtaatttattgtctgtctaca

SEQ ID NO: 4370048 - DNA, 12 bp, Homo sapiens
aataaaacaaat

SEQ ID NO: 4370049 - DNA, 15 bp, Homo sapiens
aataaaacacacctc

SEQ ID NO: 4370050 - DNA, 13 bp, Homo sapiens
aataaaacatggc

SEQ ID NO: 4370051 - DNA, 13 bp, Homo sapiens
aataaaactcact

SEQ ID NO: 4370052 - DNA, 22 bp, Homo sapiens
aataaaactgcgaggacatcaa

SEQ ID NO: 4370053 - DNA, 13 bp, Homo sapiens
aataaaagtatta

SEQ ID NO: 4370054 - DNA, 14 bp, Homo sapiens
aataaaatgaaaat

SEQ ID NO: 4370055 - DNA, 19 bp, Homo sapiens
aataaaatgaaaattgtat

SEQ ID NO: 4370056 - DNA, 13 bp, Homo sapiens
aataaaatgtatc

SEQ ID NO: 4370057 - DNA, 17 bp, Homo sapiens
catggacaaggagctgt

SEQ ID NO: 4370058 - DNA, 19 bp, Homo sapiens
catggacctggtgcccctg

SEQ ID NO: 4370059 - DNA, 20 bp, Homo sapiens
catggagaaaccctgtctct

SEQ ID NO: 4370060 - DNA, 14 bp, Homo sapiens
catggagccccagc

SEQ ID NO: 4370061 - DNA, 15 bp, Homo sapiens
catggagctgggcta

SEQ ID NO: 4370062 - DNA, 12 bp, Homo sapiens
catggagctgtc

SEQ ID NO: 4370063 - DNA, 14 bp, Homo sapiens
catggagctgtcat

SEQ ID NO: 4370064 - DNA, 15 bp, Homo sapiens
catggagctgtcatc

SEQ ID NO: 4370065 - DNA, 22 bp, Homo sapiens
catggatatgttatactgaacc

SEQ ID NO: 4370066 - DNA, 23 bp, Homo sapiens
catggatatgttatactgaacca

SEQ ID NO: 4370067 - DNA, 16 bp, Homo sapiens
catggatgattctttt

SEQ ID NO: 4370068 - DNA, 22 bp, Homo sapiens
catggatgcatttcaaatgtta

SEQ ID NO: 4370069 - DNA, 22 bp, Homo sapiens
catggcacagagattctgaact

SEQ ID NO: 4370070 - DNA, 22 bp, Homo sapiens
catggcaccttcagactttgct

SEQ ID NO: 4370071 - DNA, 17 bp, Homo sapiens
catggcaggacagctcc

SEQ ID NO: 4370072 - DNA, 15 bp, Homo sapiens
catggcatattttaa

SEQ ID NO: 4370073 - DNA, 15 bp, Homo sapiens
catggccagcaaata

SEQ ID NO: 4370074 - DNA, 15 bp, Homo sapiens
catggcccccaataa

SEQ ID NO: 4370075 - DNA, 21 bp, Homo sapiens
catggcccccaataaaggcag

SEQ ID NO: 4370076 - DNA, 24 bp, Homo sapiens
catggcccccaataaaggcagctg

SEQ ID NO: 4370077 - DNA, 19 bp, Homo sapiens
catggccctgtcccaggcc

SEQ ID NO: 4370078 - DNA, 17 bp, Homo sapiens
catggcctcagccctgc

SEQ ID NO: 4370079 - DNA, 23 bp, Homo sapiens
catggcctcagccctgctccctg

SEQ ID NO: 4370080 - DNA, 14 bp, Homo sapiens
catggcctgagcat

SEQ ID NO: 4370081 - DNA, 23 bp, Homo sapiens
catggctgggaactgcagacctg

SEQ ID NO: 4370082 - DNA, 20 bp, Homo sapiens
catgggaaatagcggccctg

SEQ ID NO: 4370083 - DNA, 21 bp, Homo sapiens
catgggaaatagcggccctgg

SEQ ID NO: 4370084 - DNA, 23 bp, Homo sapiens
catgggaaatagcggccctggag

SEQ ID NO: 4370085 - DNA, 14 bp, Homo sapiens
catgggagggatca

SEQ ID NO: 4370086 - DNA, 20 bp, Homo sapiens
catgggagggatcagccccg

SEQ ID NO: 4370087 - DNA, 12 bp, Homo sapiens
catgggaggggg

SEQ ID NO: 4370088 - DNA, 18 bp, Homo sapiens
catgggatgtctgaaatc

SEQ ID NO: 4370089 - DNA, 15 bp, Homo sapiens
catgggcagagccca

SEQ ID NO: 4370090 - DNA, 21 bp, Homo sapiens
catggggaaaaaaatcatcta

SEQ ID NO: 4370091 - DNA, 19 bp, Homo sapiens
catggggctgattgtattt

SEQ ID NO: 4370092 - DNA, 18 bp, Homo sapiens
catgggtgagacctgacc

SEQ ID NO: 4370093 - DNA, 21 bp, Homo sapiens
cattaattcaggcatatttta

SEQ ID NO: 4370094 - DNA, 19 bp, Homo sapiens
cattaattgctaacaattg

SEQ ID NO: 4370095 - DNA, 18 bp, Homo sapiens
cattaatttaaatgattt

SEQ ID NO: 4370096 - DNA, 22 bp, Homo sapiens
cattacaactgaccaagtttct

SEQ ID NO: 4370097 - DNA, 23 bp, Homo sapiens
cattacagattaaagaagaaaag

SEQ ID NO: 4370098 - DNA, 15 bp, Homo sapiens
cattacattattaaa

SEQ ID NO: 4370099 - DNA, 16 bp, Homo sapiens
cattacattattaaac

SEQ ID NO: 4370100 - DNA, 11 bp, Homo sapiens
cattaccaaaa

SEQ ID NO: 4370101 - DNA, 12 bp, Homo sapiens
cattaccactca

SEQ ID NO: 4370102 - DNA, 13 bp, Homo sapiens
cattaccactcag

SEQ ID NO: 4370103 - DNA, 14 bp, Homo sapiens
cattaccactcagg

SEQ ID NO: 4370104 - DNA, 19 bp, Homo sapiens
cattacctgggaatttata

SEQ ID NO: 4370105 - DNA, 11 bp, Homo sapiens
cattacttgaa

SEQ ID NO: 4370106 - DNA, 12 bp, Homo sapiens
cattacttgaat

SEQ ID NO: 4370107 - DNA, 14 bp, Homo sapiens
cattacttgaatgt

SEQ ID NO: 4370108 - DNA, 12 bp, Homo sapiens
cattagaaaaaa

SEQ ID NO: 4370109 - DNA, 14 bp, Homo sapiens
cattagaaatattt

SEQ ID NO: 4370110 - DNA, 15 bp, Homo sapiens
cattagaaatatttt

SEQ ID NO: 4370111 - DNA, 19 bp, Homo sapiens
cattagccagatttgtctt

SEQ ID NO: 4370112 - DNA, 20 bp, Homo sapiens
cattataacaactatttact

SEQ ID NO: 4370113 - DNA, 20 bp, Homo sapiens
cattataactgaaggagaag

SEQ ID NO: 4370114 - DNA, 14 bp, Homo sapiens
cattataataaaat

SEQ ID NO: 4370115 - DNA, 15 bp, Homo sapiens
cattataataaaatt

SEQ ID NO: 4370116 - DNA, 16 bp, Homo sapiens
cattataataaaattt

SEQ ID NO: 4370117 - DNA, 17 bp, Homo sapiens
cattataataaaatttc

SEQ ID NO: 4370118 - DNA, 18 bp, Homo sapiens
cattataataaaatttct

SEQ ID NO: 4370119 - DNA, 16 bp, Homo sapiens
cattatataacaaaaa

SEQ ID NO: 4370120 - DNA, 17 bp, Homo sapiens
cattatataacaaaaaa

SEQ ID NO: 4370121 - DNA, 13 bp, Homo sapiens
cattatattctaa

SEQ ID NO: 4370122 - DNA, 13 bp, Homo sapiens
cattatattgcaa

SEQ ID NO: 4370123 - DNA, 13 bp, Homo sapiens
cattatccctgaa

SEQ ID NO: 4370124 - DNA, 23 bp, Homo sapiens
cattatccttttatctcacaaat

SEQ ID NO: 4370125 - DNA, 16 bp, Homo sapiens
cattatctttgctgtt

SEQ ID NO: 4370126 - DNA, 17 bp, Homo sapiens
cattatctttgctgtta

SEQ ID NO: 4370127 - DNA, 20 bp, Homo sapiens
cattatgatcaaaaactgcc

SEQ ID NO: 4370128 - DNA, 14 bp, Homo sapiens
cattatgctttgaa

SEQ ID NO: 4370129 - DNA, 16 bp, Homo sapiens
cattatgctttgaact

SEQ ID NO: 4370130 - DNA, 17 bp, Homo sapiens
cattatgctttgaactt

SEQ ID NO: 4370131 - DNA, 14 bp, Homo sapiens
cattatgttaatat

SEQ ID NO: 4370132 - DNA, 15 bp, Homo sapiens
cattatgttaatatt

SEQ ID NO: 4370133 - DNA, 20 bp, Homo sapiens
cattatgtttcctaactgtg

SEQ ID NO: 4370134 - DNA, 23 bp, Homo sapiens
cattattacttttcctcttagaa

SEQ ID NO: 4370135 - DNA, 19 bp, Homo sapiens
cattattatctagctaagc

SEQ ID NO: 4370136 - DNA, 14 bp, Homo sapiens
cattattcataaaa

SEQ ID NO: 4370137 - DNA, 16 bp, Homo sapiens
cattattcataaaaaa

SEQ ID NO: 4370138 - DNA, 22 bp, Homo sapiens
cattattctctgctatatataa

SEQ ID NO: 4370139 - DNA, 20 bp, Homo sapiens
cattattgtagtttgaaagt

SEQ ID NO: 4370140 - DNA, 12 bp, Homo sapiens
cattatttcaaa

SEQ ID NO: 4370141 - DNA, 13 bp, Homo sapiens
cattatttcaaaa

SEQ ID NO: 4370142 - DNA, 19 bp, Homo sapiens
cattatttcaaaatgatag

SEQ ID NO: 4370143 - DNA, 15 bp, Homo sapiens
cattatttgtcaaat

SEQ ID NO: 4370144 - DNA, 20 bp, Homo sapiens
cattatttttgttagcaaag

SEQ ID NO: 4370145 - DNA, 17 bp, Homo sapiens
cattattttttatttct

SEQ ID NO: 4370146 - DNA, 16 bp, Homo sapiens
cattattttttgttga

SEQ ID NO: 4370147 - DNA, 17 bp, Homo sapiens
cattcaaaaaactctct

SEQ ID NO: 4370148 - DNA, 24 bp, Homo sapiens
cattcaaaaagacagcagacaaaa

SEQ ID NO: 4370149 - DNA, 13 bp, Homo sapiens
cattcaaaaattt

SEQ ID NO: 4370150 - DNA, 12 bp, Homo sapiens
cattcaacaaga

SEQ ID NO: 4370151 - DNA, 22 bp, Homo sapiens
cattcaactttagtatttttac

SEQ ID NO: 4370152 - DNA, 23 bp, Homo sapiens
cattcaagtgtaaaatattttga

SEQ ID NO: 4370153 - DNA, 13 bp, Homo sapiens
cattcacaagcct

SEQ ID NO: 4370154 - DNA, 17 bp, Homo sapiens
cattcacaagcctcctg

SEQ ID NO: 4370155 - DNA, 13 bp, Homo sapiens
cattcacttctct

SEQ ID NO: 4370156 - DNA, 14 bp, Homo sapiens
cattcacttttgtt

SEQ ID NO: 4370157 - DNA, 19 bp, Homo sapiens
cattcagcagcaaattttc

SEQ ID NO: 4370158 - DNA, 20 bp, Homo sapiens
cattcaggaaaactgacaga

SEQ ID NO: 4370159 - DNA, 15 bp, Homo sapiens
cattcagtggcaact

SEQ ID NO: 4370160 - DNA, 19 bp, Homo sapiens
cattcataaaccttgtcta

SEQ ID NO: 4370161 - DNA, 22 bp, Homo sapiens
cattcatacttaaaaatttatt

SEQ ID NO: 4370162 - DNA, 18 bp, Homo sapiens
cattcatgaatattttca

SEQ ID NO: 4370163 - DNA, 19 bp, Homo sapiens
cattcatgaatattttcaa

SEQ ID NO: 4370164 - DNA, 20 bp, Homo sapiens
cattcatttagctaaacgga

SEQ ID NO: 4370165 - DNA, 12 bp, Homo sapiens
cattccaaagtt

SEQ ID NO: 4370166 - DNA, 13 bp, Homo sapiens
cattccagaggaa

SEQ ID NO: 4370167 - DNA, 13 bp, Homo sapiens
cattccagctctg

SEQ ID NO: 4370168 - DNA, 13 bp, Homo sapiens
cattccattgcct

SEQ ID NO: 4370169 - DNA, 21 bp, Homo sapiens
cattccattgcctagctcttt

SEQ ID NO: 4370170 - DNA, 13 bp, Homo sapiens
cattcccagggac

SEQ ID NO: 4370171 - DNA, 15 bp, Homo sapiens
cattcccagggacct

SEQ ID NO: 4370172 - DNA, 11 bp, Homo sapiens
cattccctgag

SEQ ID NO: 4370173 - DNA, 21 bp, Homo sapiens
cattccctgagtcaccaggaa

SEQ ID NO: 4370174 - DNA, 14 bp, Homo sapiens
cattcctaaaatgc

SEQ ID NO: 4370175 - DNA, 16 bp, Homo sapiens
cattcctaaaatgctt

SEQ ID NO: 4370176 - DNA, 22 bp, Homo sapiens
cattcctaaagaaaaatatctt

SEQ ID NO: 4370177 - DNA, 14 bp, Homo sapiens
cattcctccagcct

SEQ ID NO: 4370178 - DNA, 17 bp, Homo sapiens
cattcctccagcctccc

SEQ ID NO: 4370179 - DNA, 18 bp, Homo sapiens
cattcctccagcctcccc

SEQ ID NO: 4370180 - DNA, 17 bp, Homo sapiens
cattcctgtgccctaga

SEQ ID NO: 4370181 - DNA, 17 bp, Homo sapiens
cattccttgcgcctcag

SEQ ID NO: 4370182 - DNA, 18 bp, Homo sapiens
cattccttttcgtttaga

SEQ ID NO: 4370183 - DNA, 12 bp, Homo sapiens
aaaaaaaaatca

SEQ ID NO: 4370184 - DNA, 14 bp, Homo sapiens
aaaaaaaaatgttc

SEQ ID NO: 4370185 - DNA, 12 bp, Homo sapiens
aaaaaaaacagt

SEQ ID NO: 4370186 - DNA, 11 bp, Homo sapiens
aaaaaaaagat

SEQ ID NO: 4370187 - DNA, 13 bp, Homo sapiens
aaaaaaaattccc

SEQ ID NO: 4370188 - DNA, 12 bp, Homo sapiens
aaaaaaagatga

SEQ ID NO: 4370189 - DNA, 12 bp, Homo sapiens
aaaaaaagcttt

SEQ ID NO: 4370190 - DNA, 11 bp, Homo sapiens
aaaaaaaggaa

SEQ ID NO: 4370191 - DNA, 11 bp, Homo sapiens
aaaaaacactt

SEQ ID NO: 4370192 - DNA, 11 bp, Homo sapiens
aaaaaagaaaa

SEQ ID NO: 4370193 - DNA, 14 bp, Homo sapiens
aaaaaagcacaaag

SEQ ID NO: 4370194 - DNA, 11 bp, Homo sapiens
aaaaaagctca

SEQ ID NO: 4370195 - DNA, 13 bp, Homo sapiens
aaaaaagctgaat

SEQ ID NO: 4370196 - DNA, 12 bp, Homo sapiens
aaaaaaggaagg

SEQ ID NO: 4370197 - DNA, 12 bp, Homo sapiens
aaaaaataatta

SEQ ID NO: 4370198 - DNA, 11 bp, Homo sapiens
aaaaaatatgt

SEQ ID NO: 4370199 - DNA, 13 bp, Homo sapiens
aaaaaatattgaa

SEQ ID NO: 4370200 - DNA, 12 bp, Homo sapiens
aaaaaatgtaat

SEQ ID NO: 4370201 - DNA, 13 bp, Homo sapiens
aaaaaatttatac

SEQ ID NO: 4370202 - DNA, 21 bp, Homo sapiens
aaaaaatttgttttcaacaat

SEQ ID NO: 4370203 - DNA, 13 bp, Homo sapiens
aaaaacaaagctg

SEQ ID NO: 4370204 - DNA, 14 bp, Homo sapiens
aaaaacaaatgtta

SEQ ID NO: 4370205 - DNA, 23 bp, Homo sapiens
aaaaacaagtcatttttgtattt

SEQ ID NO: 4370206 - DNA, 12 bp, Homo sapiens
aaaaacacagca

SEQ ID NO: 4370207 - DNA, 19 bp, Homo sapiens
aaaaacagcctcacagaag

SEQ ID NO: 4370208 - DNA, 19 bp, Homo sapiens
aaaaacattctatctactg

SEQ ID NO: 4370209 - DNA, 20 bp, Homo sapiens
aaaaacattttttatacatt

SEQ ID NO: 4370210 - DNA, 15 bp, Homo sapiens
aaaaactctctccca

SEQ ID NO: 4370211 - DNA, 18 bp, Homo sapiens
aaaaactctctcccagga

SEQ ID NO: 4370212 - DNA, 18 bp, Homo sapiens
aaaaactggccttttgat

SEQ ID NO: 4370213 - DNA, 23 bp, Homo sapiens
aaaaacttcatgtaattttattt

SEQ ID NO: 4370214 - DNA, 12 bp, Homo sapiens
aaaaacttttat

SEQ ID NO: 4370215 - DNA, 23 bp, Homo sapiens
aaaaacttttataaattaaatat

SEQ ID NO: 4370216 - DNA, 20 bp, Homo sapiens
aaaaagaaaaatctcattat

SEQ ID NO: 4370217 - DNA, 15 bp, Homo sapiens
aaaaagaaaatgtct

SEQ ID NO: 4370218 - DNA, 19 bp, Homo sapiens
aaaaagaaaggctgttaaa

SEQ ID NO: 4370219 - DNA, 14 bp, Homo sapiens
aaaaagaagaatct

SEQ ID NO: 4370220 - DNA, 13 bp, Homo sapiens
aaaaagaccagac

SEQ ID NO: 4370221 - DNA, 12 bp, Homo sapiens
aaaaagcttaaa

SEQ ID NO: 4370222 - DNA, 17 bp, Homo sapiens
aaaaagcttaaaacttt

SEQ ID NO: 4370223 - DNA, 11 bp, Homo sapiens
aaaaaggaagg

SEQ ID NO: 4370224 - DNA, 16 bp, Homo sapiens
aaaaaggacatcagca

SEQ ID NO: 4370225 - DNA, 14 bp, Homo sapiens
aaaaaggcaaatat

SEQ ID NO: 4370226 - DNA, 22 bp, Homo sapiens
aaaaaggctgctcacaagttct

SEQ ID NO: 4370227 - DNA, 12 bp, Homo sapiens
aaaaagggaaaa

SEQ ID NO: 4370228 - DNA, 20 bp, Homo sapiens
aaaaagggaaaacaaatatt

SEQ ID NO: 4370229 - DNA, 19 bp, Homo sapiens
aaaaagggtcaatgctatt

SEQ ID NO: 4370230 - DNA, 21 bp, Homo sapiens
aaaaagggtcaatgctatttt

SEQ ID NO: 4370231 - DNA, 23 bp, Homo sapiens
aaaaagtaatgacttagaaactg

SEQ ID NO: 4370232 - DNA, 20 bp, Homo sapiens
aaaaagtagcaaatgtttac

SEQ ID NO: 4370233 - DNA, 21 bp, Homo sapiens
aaaaagtagcaaatgtttact

SEQ ID NO: 4370234 - DNA, 16 bp, Homo sapiens
aaaaagtcagatgttt

SEQ ID NO: 4370235 - DNA, 15 bp, Homo sapiens
aaaaagtctctattt

SEQ ID NO: 4370236 - DNA, 22 bp, Homo sapiens
aaaaagtctctatttaaattct

SEQ ID NO: 4370237 - DNA, 13 bp, Homo sapiens
aaaaagtgtcttt

SEQ ID NO: 4370238 - DNA, 18 bp, Homo sapiens
aaaaagtttgtcttagtt

SEQ ID NO: 4370239 - DNA, 14 bp, Homo sapiens
aaaaataaaactgt

SEQ ID NO: 4370240 - DNA, 12 bp, Homo sapiens
aaaaataaagga

SEQ ID NO: 4370241 - DNA, 15 bp, Homo sapiens
aaaaataaaggaaaa

SEQ ID NO: 4370242 - DNA, 24 bp, Homo sapiens
aaaaataaatatatctaccccaga

SEQ ID NO: 4370243 - DNA, 16 bp, Homo sapiens
aaaaataagaagaatg

SEQ ID NO: 4370244 - DNA, 18 bp, Homo sapiens
aaaaataagtcaacagta

SEQ ID NO: 4370245 - DNA, 13 bp, Homo sapiens
aaaaataatacaa

SEQ ID NO: 4370246 - DNA, 14 bp, Homo sapiens
aaaaataatgaatg

SEQ ID NO: 4370247 - DNA, 18 bp, Homo sapiens
aaaaatactttttctaat

SEQ ID NO: 4370248 - DNA, 23 bp, Homo sapiens
aaaaatagtttggatatgtaaaa

SEQ ID NO: 4370249 - DNA, 15 bp, Homo sapiens
aaaaatatatactaa

SEQ ID NO: 4370250 - DNA, 20 bp, Homo sapiens
aaaaatcacaatttttaatg

SEQ ID NO: 4370251 - DNA, 20 bp, Homo sapiens
aaaaatcatcttataattag

SEQ ID NO: 4370252 - DNA, 16 bp, Homo sapiens
aaaaatcctgcccaaa

SEQ ID NO: 4370253 - DNA, 11 bp, Homo sapiens
aaaaatctcat

SEQ ID NO: 4370254 - DNA, 16 bp, Homo sapiens
aaaaatctcattattt

SEQ ID NO: 4370255 - DNA, 20 bp, Homo sapiens
aaaaatctcattatttctgg

SEQ ID NO: 4370256 - DNA, 20 bp, Homo sapiens
aaaaatgagagctgtaactg

SEQ ID NO: 4370257 - DNA, 14 bp, Homo sapiens
aaaaatgatctaaa

SEQ ID NO: 4370258 - DNA, 12 bp, Homo sapiens
aaaaatgctgct

SEQ ID NO: 4370259 - DNA, 22 bp, Homo sapiens
aaaaatggaacataaaatacaa

SEQ ID NO: 4370260 - DNA, 22 bp, Homo sapiens
aaaaatgggagacagcctctta

SEQ ID NO: 4370261 - DNA, 19 bp, Homo sapiens
aaaaatggtatcaaaatta

SEQ ID NO: 4370262 - DNA, 21 bp, Homo sapiens
aaaaatgtcttgctgttgaca

SEQ ID NO: 4370263 - DNA, 20 bp, Homo sapiens
aaaaatgtgaaatgctttta

SEQ ID NO: 4370264 - DNA, 23 bp, Homo sapiens
aaaaatgtgaaatgcttttatat

SEQ ID NO: 4370265 - DNA, 21 bp, Homo sapiens
aaaaatgttcccttgaccatt

SEQ ID NO: 4370266 - DNA, 19 bp, Homo sapiens
aaaaatgttttccaatatt

SEQ ID NO: 4370267 - DNA, 23 bp, Homo sapiens
aaaaatgtttttggtcttttata

SEQ ID NO: 4370268 - DNA, 13 bp, Homo sapiens
aaaaattaaatat

SEQ ID NO: 4370269 - DNA, 16 bp, Homo sapiens
aaaaattaaatattta

SEQ ID NO: 4370270 - DNA, 17 bp, Homo sapiens
aaaaattaaatatttat

SEQ ID NO: 4370271 - DNA, 15 bp, Homo sapiens
aaaatcctgcccaaa

SEQ ID NO: 4370272 - DNA, 18 bp, Homo sapiens
aaaatcctttttgtattt

SEQ ID NO: 4370273 - DNA, 14 bp, Homo sapiens
aaaatctaaaatgt

SEQ ID NO: 4370274 - DNA, 24 bp, Homo sapiens
aaaatctaaaatttcataattctg

SEQ ID NO: 4370275 - DNA, 21 bp, Homo sapiens
aaaatctacactccagtgaga

SEQ ID NO: 4370276 - DNA, 18 bp, Homo sapiens
aaaatctagaagagtcta

SEQ ID NO: 4370277 - DNA, 13 bp, Homo sapiens
aaaatctcattat

SEQ ID NO: 4370278 - DNA, 19 bp, Homo sapiens
aaaatctcattatttcaaa

SEQ ID NO: 4370279 - DNA, 23 bp, Homo sapiens
aaaatctcattatttcaaaatga

SEQ ID NO: 4370280 - DNA, 17 bp, Homo sapiens
aaaatctcattatttct

SEQ ID NO: 4370281 - DNA, 11 bp, Homo sapiens
aaaatctccta

SEQ ID NO: 4370282 - DNA, 12 bp, Homo sapiens
aaaatctgaaga

SEQ ID NO: 4370283 - DNA, 12 bp, Homo sapiens
aaaatctgtcca

SEQ ID NO: 4370284 - DNA, 13 bp, Homo sapiens
aaaatgaattgaa

SEQ ID NO: 4370285 - DNA, 17 bp, Homo sapiens
aaaatgacatcttttta

SEQ ID NO: 4370286 - DNA, 15 bp, Homo sapiens
aaaatgagagctgta

SEQ ID NO: 4370287 - DNA, 14 bp, Homo sapiens
aaaatgagatttct

SEQ ID NO: 4370288 - DNA, 19 bp, Homo sapiens
aaaatgagatttcttattt

SEQ ID NO: 4370289 - DNA, 11 bp, Homo sapiens
aaaatgagccc

SEQ ID NO: 4370290 - DNA, 12 bp, Homo sapiens
aaaatgagccct

SEQ ID NO: 4370291 - DNA, 18 bp, Homo sapiens
aaaatgagtcatttgttt

SEQ ID NO: 4370292 - DNA, 15 bp, Homo sapiens
aaaatgagtttgtat

SEQ ID NO: 4370293 - DNA, 16 bp, Homo sapiens
aaaatgatagacatat

SEQ ID NO: 4370294 - DNA, 23 bp, Homo sapiens
aaaatgattcctggacatcacca

SEQ ID NO: 4370295 - DNA, 20 bp, Homo sapiens
aaaatgcacaaacaatgcaa

SEQ ID NO: 4370296 - DNA, 17 bp, Homo sapiens
aaaatgcacttctattt

SEQ ID NO: 4370297 - DNA, 16 bp, Homo sapiens
aaaatgccacttaaca

SEQ ID NO: 4370298 - DNA, 19 bp, Homo sapiens
aaaatgccacttaacagga

SEQ ID NO: 4370299 - DNA, 19 bp, Homo sapiens
aaaatgctcaatttcagca

SEQ ID NO: 4370300 - DNA, 23 bp, Homo sapiens
aaaatgcttaaaaaataatacaa

SEQ ID NO: 4370301 - DNA, 21 bp, Homo sapiens
aaaatgcttcatgaatttctc

SEQ ID NO: 4370302 - DNA, 22 bp, Homo sapiens
aaaatgcttcatgaatttctcc

SEQ ID NO: 4370303 - DNA, 13 bp, Homo sapiens
aaaatgcttttta

SEQ ID NO: 4370304 - DNA, 17 bp, Homo sapiens
aaaatggcgaacatgtg

SEQ ID NO: 4370305 - DNA, 17 bp, Homo sapiens
aaaatgggatgaattct

SEQ ID NO: 4370306 - DNA, 24 bp, Homo sapiens
aaaatggtatcaaaattacatata

SEQ ID NO: 4370307 - DNA, 16 bp, Homo sapiens
aaaatggttatgtgca

SEQ ID NO: 4370308 - DNA, 16 bp, Homo sapiens
aaaatggtttaaatgg

SEQ ID NO: 4370309 - DNA, 19 bp, Homo sapiens
aaaatgtaaaggagtcaaa

SEQ ID NO: 4370310 - DNA, 16 bp, Homo sapiens
aaaatgtagaatattc

SEQ ID NO: 4370311 - DNA, 14 bp, Homo sapiens
aaaatgtataatga

SEQ ID NO: 4370312 - DNA, 17 bp, Homo sapiens
aaaatgtatatgcactt

SEQ ID NO: 4370313 - DNA, 13 bp, Homo sapiens
aaaatgtatctaa

SEQ ID NO: 4370314 - DNA, 15 bp, Homo sapiens
aaaatgtattccttt

SEQ ID NO: 4370315 - DNA, 12 bp, Homo sapiens
aaaatgtatttt

SEQ ID NO: 4370316 - DNA, 16 bp, Homo sapiens
aaaatgtgaaaaacta

SEQ ID NO: 4370317 - DNA, 12 bp, Homo sapiens
aaaatgttcttt

SEQ ID NO: 4370318 - DNA, 17 bp, Homo sapiens
aaaatgttgaaatatga

SEQ ID NO: 4370319 - DNA, 16 bp, Homo sapiens
aaaatgtttccactgg

SEQ ID NO: 4370320 - DNA, 14 bp, Homo sapiens
aaaatgtttgagca

SEQ ID NO: 4370321 - DNA, 16 bp, Homo sapiens
aaaatgttttatgaca

SEQ ID NO: 4370322 - DNA, 19 bp, Homo sapiens
aaaatgttttatgacattt

SEQ ID NO: 4370323 - DNA, 12 bp, Homo sapiens
aaaattaaaatg

SEQ ID NO: 4370324 - DNA, 13 bp, Homo sapiens
aaaattaaatatt

SEQ ID NO: 4370325 - DNA, 16 bp, Homo sapiens
aaaattaaatttgatg

SEQ ID NO: 4370326 - DNA, 17 bp, Homo sapiens
aaaattaacttagtttt

SEQ ID NO: 4370327 - DNA, 13 bp, Homo sapiens
aaaattaagtgtg

SEQ ID NO: 4370328 - DNA, 17 bp, Homo sapiens
aaaattaatgtaataaa

SEQ ID NO: 4370329 - DNA, 21 bp, Homo sapiens
aaaattaatgtaataaagtga

SEQ ID NO: 4370330 - DNA, 14 bp, Homo sapiens
aaaattaattagga

SEQ ID NO: 4370331 - DNA, 17 bp, Homo sapiens
aaaattagaaaggacaa

SEQ ID NO: 4370332 - DNA, 20 bp, Homo sapiens
aaaattagaaaggacaacag

SEQ ID NO: 4370333 - DNA, 23 bp, Homo sapiens
aaaattagactgtgattcagaaa

SEQ ID NO: 4370334 - DNA, 15 bp, Homo sapiens
aaaattagccgggca

SEQ ID NO: 4370335 - DNA, 23 bp, Homo sapiens
aaaattagtgaccattattcaca

SEQ ID NO: 4370336 - DNA, 15 bp, Homo sapiens
aaaattatggaatat

SEQ ID NO: 4370337 - DNA, 22 bp, Homo sapiens
aaaattatgttactgtattttt

SEQ ID NO: 4370338 - DNA, 12 bp, Homo sapiens
aaaattattaga

SEQ ID NO: 4370339 - DNA, 13 bp, Homo sapiens
aaaattatttaaa

SEQ ID NO: 4370340 - DNA, 14 bp, Homo sapiens
aaaattatttgcag

SEQ ID NO: 4370341 - DNA, 13 bp, Homo sapiens
aaaattatttgta

SEQ ID NO: 4370342 - DNA, 14 bp, Homo sapiens
aaaattattttgac

SEQ ID NO: 4370343 - DNA, 16 bp, Homo sapiens
aaaattcagagtcctt

SEQ ID NO: 4370344 - DNA, 13 bp, Homo sapiens
aaaattcagcaaa

SEQ ID NO: 4370345 - DNA, 15 bp, Homo sapiens
aaaattcatttctaa

SEQ ID NO: 4370346 - DNA, 17 bp, Homo sapiens
aaaattccaaattcatg

SEQ ID NO: 4370347 - DNA, 14 bp, Homo sapiens
aaaattccactcaa

SEQ ID NO: 4370348 - DNA, 20 bp, Homo sapiens
aaaattcgcccgagctgttt

SEQ ID NO: 4370349 - DNA, 22 bp, Homo sapiens
aaaattcgcccgagctgtttat

SEQ ID NO: 4370350 - DNA, 21 bp, Homo sapiens
aaaattctgaattttggggat

SEQ ID NO: 4370351 - DNA, 14 bp, Homo sapiens
aaaattctgtaatt

SEQ ID NO: 4370352 - DNA, 23 bp, Homo sapiens
aaaattgaatagtttatttctgt

SEQ ID NO: 4370353 - DNA, 12 bp, Homo sapiens
aaaattgaatgc

SEQ ID NO: 4370354 - DNA, 14 bp, Homo sapiens
aaaattgaatgcaa

SEQ ID NO: 4370355 - DNA, 21 bp, Homo sapiens
aaaattgaatgcaaaccatag

SEQ ID NO: 4370356 - DNA, 22 bp, Homo sapiens
aaaattgagttcttcctgtaat

SEQ ID NO: 4370357 - DNA, 19 bp, Homo sapiens
aaaattgatattatattaa

SEQ ID NO: 4370358 - DNA, 19 bp, Homo sapiens
aaaattgcagtttcatgta

SEQ ID NO: 4370359 - DNA, 17 bp, Homo sapiens
aaaattggtatatttga

SEQ ID NO: 4370360 - DNA, 18 bp, Homo sapiens
aaaattgtataccaatgt

SEQ ID NO: 4370361 - DNA, 20 bp, Homo sapiens
aaaattgtctaaaatgtcag

SEQ ID NO: 4370362 - DNA, 15 bp, Homo sapiens
aaaattgtctttcct

SEQ ID NO: 4370363 - DNA, 20 bp, Homo sapiens
aaaatttacacatcttaaaa

SEQ ID NO: 4370364 - DNA, 17 bp, Homo sapiens
aaaatttagcttatgct

SEQ ID NO: 4370365 - DNA, 20 bp, Homo sapiens
aaaatttattatatatttac

SEQ ID NO: 4370366 - DNA, 21 bp, Homo sapiens
aaaatttattatatatttaca

SEQ ID NO: 4370367 - DNA, 22 bp, Homo sapiens
aaaatttattatatatttacag

SEQ ID NO: 4370368 - DNA, 12 bp, Homo sapiens
aaaatttattct

SEQ ID NO: 4370369 - DNA, 14 bp, Homo sapiens
aaaatttatttcat

SEQ ID NO: 4370370 - DNA, 14 bp, Homo sapiens
aaaatttatttgca

SEQ ID NO: 4370371 - DNA, 19 bp, Homo sapiens
aaaatttgatggactaatt

SEQ ID NO: 4370372 - DNA, 22 bp, Homo sapiens
aaaatttgtctgaaacatttca

SEQ ID NO: 4370373 - DNA, 20 bp, Homo sapiens
aaaatttgttcttgtattta

SEQ ID NO: 4370374 - DNA, 13 bp, Homo sapiens
aaaattttaagaa

SEQ ID NO: 4370375 - DNA, 12 bp, Homo sapiens
aaaattttagct

SEQ ID NO: 4370376 - DNA, 14 bp, Homo sapiens
aaaattttatttta

SEQ ID NO: 4370377 - DNA, 13 bp, Homo sapiens
aaaattttgaatg

SEQ ID NO: 4370378 - DNA, 14 bp, Homo sapiens
aaaattttgaatgt

SEQ ID NO: 4370379 - DNA, 18 bp, Homo sapiens
aaaattttggaatatttg

SEQ ID NO: 4370380 - DNA, 16 bp, Homo sapiens
aaaattttgtgacatt

SEQ ID NO: 4370381 - DNA, 19 bp, Homo sapiens
aaaattttgtgacattcct

SEQ ID NO: 4370382 - DNA, 19 bp, Homo sapiens
aaacaaaaattaaaatcct

SEQ ID NO: 4370383 - DNA, 16 bp, Homo sapiens
aaacaaaacaaaacaa

SEQ ID NO: 4370384 - DNA, 15 bp, Homo sapiens
aaacaaaacaaaact

SEQ ID NO: 4370385 - DNA, 16 bp, Homo sapiens
aaacaaaacaaaacta

SEQ ID NO: 4370386 - DNA, 18 bp, Homo sapiens
aaacaaaagggtgtatag

SEQ ID NO: 4370387 - DNA, 19 bp, Homo sapiens
aaacaaaagggtgtatagt

SEQ ID NO: 4370388 - DNA, 20 bp, Homo sapiens
aaacaaaagggtgtatagtg

SEQ ID NO: 4370389 - DNA, 23 bp, Homo sapiens
aaacaaaagggtgtatagtgttc

SEQ ID NO: 4370390 - DNA, 17 bp, Homo sapiens
aaacaaaagttttaatt

SEQ ID NO: 4370391 - DNA, 16 bp, Homo sapiens
aaacaaaatgaaacaa

SEQ ID NO: 4370392 - DNA, 18 bp, Homo sapiens
aaacaaaatttcacagtt

SEQ ID NO: 4370393 - DNA, 14 bp, Homo sapiens
aaacaaaatttcta

SEQ ID NO: 4370394 - DNA, 17 bp, Homo sapiens
aaacaaaatttgactaa

SEQ ID NO: 4370395 - DNA, 20 bp, Homo sapiens
aaacaaactcgttttttaca

SEQ ID NO: 4370396 - DNA, 12 bp, Homo sapiens
aaacaaagatgt

SEQ ID NO: 4370397 - DNA, 20 bp, Homo sapiens
aaacaaagatttgtggtaac

SEQ ID NO: 4370398 - DNA, 15 bp, Homo sapiens
aaacaaagctgatag

SEQ ID NO: 4370399 - DNA, 15 bp, Homo sapiens
aaacaaagtttcaga

SEQ ID NO: 4370400 - DNA, 19 bp, Homo sapiens
aaacaaagtttcagagtat

SEQ ID NO: 4370401 - DNA, 21 bp, Homo sapiens
aaacaaatgttagacttgtgt

SEQ ID NO: 4370402 - DNA, 12 bp, Homo sapiens
aaacaacattta

SEQ ID NO: 4370403 - DNA, 15 bp, Homo sapiens
aaacaaccatgtcat

SEQ ID NO: 4370404 - DNA, 23 bp, Homo sapiens
aaacaagccaagaaagatgtata

SEQ ID NO: 4370405 - DNA, 16 bp, Homo sapiens
aaacaagtaaatatat

SEQ ID NO: 4370406 - DNA, 13 bp, Homo sapiens
aaacaagtatttg

SEQ ID NO: 4370407 - DNA, 20 bp, Homo sapiens
aaacaatctttcatgtcttg

SEQ ID NO: 4370408 - DNA, 22 bp, Homo sapiens
aaacaatggggctggttttgct

SEQ ID NO: 4370409 - DNA, 16 bp, Homo sapiens
aaacaattactaatga

SEQ ID NO: 4370410 - DNA, 11 bp, Homo sapiens
aaacacacatt

SEQ ID NO: 4370411 - DNA, 17 bp, Homo sapiens
aaacacataatttctgt

SEQ ID NO: 4370412 - DNA, 19 bp, Homo sapiens
aaacacatagattcacctg

SEQ ID NO: 4370413 - DNA, 12 bp, Homo sapiens
aaacacatgata

SEQ ID NO: 4370414 - DNA, 15 bp, Homo sapiens
aaacacattataaag

SEQ ID NO: 4370415 - DNA, 17 bp, Homo sapiens
aaacactacacatttga

SEQ ID NO: 4370416 - DNA, 17 bp, Homo sapiens
aaacacttccagtctgg

SEQ ID NO: 4370417 - DNA, 23 bp, Homo sapiens
aaacacttggcatacaaaatatt

SEQ ID NO: 4370418 - DNA, 17 bp, Homo sapiens
aaacactttgcctcctg

SEQ ID NO: 4370419 - DNA, 11 bp, Homo sapiens
aaacagaaaaa

SEQ ID NO: 4370420 - DNA, 14 bp, Homo sapiens
aaacagaagcaaat

SEQ ID NO: 4370421 - DNA, 12 bp, Homo sapiens
aaacagacactg

SEQ ID NO: 4370422 - DNA, 21 bp, Homo sapiens
aaacagattcaggccagccca

SEQ ID NO: 4370423 - DNA, 22 bp, Homo sapiens
aaacagattcaggccagcccag

SEQ ID NO: 4370424 - DNA, 20 bp, Homo sapiens
aaacagcaccaccatttaat

SEQ ID NO: 4370425 - DNA, 13 bp, Homo sapiens
aaacagctgcctt

SEQ ID NO: 4370426 - DNA, 15 bp, Homo sapiens
aaacagctgccttag

SEQ ID NO: 4370427 - DNA, 17 bp, Homo sapiens
aaacagctgccttagct

SEQ ID NO: 4370428 - DNA, 12 bp, Homo sapiens
aaacaggatcag

SEQ ID NO: 4370429 - DNA, 15 bp, Homo sapiens
aaacagggctgcctt

SEQ ID NO: 4370430 - DNA, 21 bp, Homo sapiens
aaacaggtatttttttaaatc

SEQ ID NO: 4370431 - DNA, 22 bp, Homo sapiens
aaacaggtatttttttaaatca

SEQ ID NO: 4370432 - DNA, 23 bp, Homo sapiens
aaacaggtatttttttaaatcaa

SEQ ID NO: 4370433 - DNA, 18 bp, Homo sapiens
aaacaggttgggatggga

SEQ ID NO: 4370434 - DNA, 13 bp, Homo sapiens
aaacagtatttct

SEQ ID NO: 4370435 - DNA, 15 bp, Homo sapiens
aaacagtctcaggaa

SEQ ID NO: 4370436 - DNA, 23 bp, Homo sapiens
aaacagtgaacttgtctggcttt

SEQ ID NO: 4370437 - DNA, 14 bp, Homo sapiens
aaacagttatttct

SEQ ID NO: 4370438 - DNA, 20 bp, Homo sapiens
aaacagttgcatgtagtaac

SEQ ID NO: 4370439 - DNA, 21 bp, Homo sapiens
aaacatagaaatggaaatttt

SEQ ID NO: 4370440 - DNA, 19 bp, Homo sapiens
aaacatatttttatacttt

SEQ ID NO: 4370441 - DNA, 23 bp, Homo sapiens
aaacatatttttatactttattg

SEQ ID NO: 4370442 - DNA, 16 bp, Homo sapiens
aaacatctagcccaaa

SEQ ID NO: 4370443 - DNA, 18 bp, Homo sapiens
aaacatctcatcatgtct

SEQ ID NO: 4370444 - DNA, 19 bp, Homo sapiens
aaacatgaccctaaatctt

SEQ ID NO: 4370445 - DNA, 22 bp, Homo sapiens
aaacatgcagctcttcaacatg

SEQ ID NO: 4370446 - DNA, 13 bp, Homo sapiens
aaacatggagaaa

SEQ ID NO: 4370447 - DNA, 13 bp, Homo sapiens
aaacatgtattta

SEQ ID NO: 4370448 - DNA, 12 bp, Homo sapiens
aaacatgtttaa

SEQ ID NO: 4370449 - DNA, 21 bp, Homo sapiens
aaacatgtttatttttcttgt

SEQ ID NO: 4370450 - DNA, 12 bp, Homo sapiens
aaacatgtttcc

SEQ ID NO: 4370451 - DNA, 18 bp, Homo sapiens
aaacattatatgtataca

SEQ ID NO: 4370452 - DNA, 19 bp, Homo sapiens
aaacattctatctactgat

SEQ ID NO: 4370453 - DNA, 20 bp, Homo sapiens
aaacattgaagtaatgaatt

SEQ ID NO: 4370454 - DNA, 19 bp, Homo sapiens
aaacattgcctttgaatgt

SEQ ID NO: 4370455 - DNA, 16 bp, Homo sapiens
aaacatttactgacca

SEQ ID NO: 4370456 - DNA, 18 bp, Homo sapiens
aaacatttattttgacat

SEQ ID NO: 4370457 - DNA, 21 bp, Homo sapiens
aaacatttgattaataaaata

SEQ ID NO: 4370458 - DNA, 17 bp, Homo sapiens
aaacattttaaatgaaa

SEQ ID NO: 4370459 - DNA, 16 bp, Homo sapiens
aaacattttctggcca

SEQ ID NO: 4370460 - DNA, 19 bp, Homo sapiens
aaacattttttatacattt

SEQ ID NO: 4370461 - DNA, 20 bp, Homo sapiens
aaacattttttatacatttg

SEQ ID NO: 4370462 - DNA, 15 bp, Homo sapiens
aaaccaaaaacattt

SEQ ID NO: 4370463 - DNA, 13 bp, Homo sapiens
aaaccaaaatgac

SEQ ID NO: 4370464 - DNA, 23 bp, Homo sapiens
aaaccaaaatgacatctttttaa

SEQ ID NO: 4370465 - DNA, 20 bp, Homo sapiens
aaaccaaactgggtcttcag

SEQ ID NO: 4370466 - DNA, 22 bp, Homo sapiens
aaaccaaactgggtcttcagct

SEQ ID NO: 4370467 - DNA, 17 bp, Homo sapiens
aaaccaaagagggcttc

SEQ ID NO: 4370468 - DNA, 19 bp, Homo sapiens
aaaccaaagagggcttcct

SEQ ID NO: 4370469 - DNA, 15 bp, Homo sapiens
aaaccacaagcatct

SEQ ID NO: 4370470 - DNA, 16 bp, Homo sapiens
aaaccacagcagttga

SEQ ID NO: 4370471 - DNA, 12 bp, Homo sapiens
aaaccactgaaa

SEQ ID NO: 4370472 - DNA, 12 bp, Homo sapiens
aaaccagtgtga

SEQ ID NO: 4370473 - DNA, 15 bp, Homo sapiens
aaaccagtgtgaacc

SEQ ID NO: 4370474 - DNA, 21 bp, Homo sapiens
aaaccatgttgcgttcaaaga

SEQ ID NO: 4370475 - DNA, 14 bp, Homo sapiens
aaacccaagtgctg

SEQ ID NO: 4370476 - DNA, 14 bp, Homo sapiens
aaacccaagttttt

SEQ ID NO: 4370477 - DNA, 11 bp, Homo sapiens
aaacccagaga

SEQ ID NO: 4370478 - DNA, 13 bp, Homo sapiens
aaacccatacaat

SEQ ID NO: 4370479 - DNA, 15 bp, Homo sapiens
aaacccatacaatgt

SEQ ID NO: 4370480 - DNA, 19 bp, Homo sapiens
aaacccatacaatgtatgt

SEQ ID NO: 4370481 - DNA, 22 bp, Homo sapiens
aaacccatattgtaaaacaggt

SEQ ID NO: 4370482 - DNA, 12 bp, Homo sapiens
aaaccccagccc

SEQ ID NO: 4370483 - DNA, 13 bp, Homo sapiens
aaacccccatctc

SEQ ID NO: 4370484 - DNA, 15 bp, Homo sapiens
aaaccctataaacct

SEQ ID NO: 4370485 - DNA, 17 bp, Homo sapiens
aaaccctatctgtgatt

SEQ ID NO: 4370486 - DNA, 21 bp, Homo sapiens
aaaccctgtctctactaaaaa

SEQ ID NO: 4370487 - DNA, 16 bp, Homo sapiens
aaacccttaactgaca

SEQ ID NO: 4370488 - DNA, 14 bp, Homo sapiens
aaaccgctaaaaga

SEQ ID NO: 4370489 - DNA, 15 bp, Homo sapiens
aaaccgctaaaagaa

SEQ ID NO: 4370490 - DNA, 21 bp, Homo sapiens
aaaccgctaaaagaaactttc

SEQ ID NO: 4370491 - DNA, 20 bp, Homo sapiens
aaacctcagggctgtcccag

SEQ ID NO: 4370492 - DNA, 23 bp, Homo sapiens
aaacctcagggctgtcccagccc

SEQ ID NO: 4370493 - DNA, 14 bp, Homo sapiens
aaacctcctgtcag

SEQ ID NO: 4370494 - DNA, 13 bp, Homo sapiens
aaacctgaatggt

SEQ ID NO: 4370495 - DNA, 18 bp, Homo sapiens
aaacctgacccctgctca

SEQ ID NO: 4370496 - DNA, 22 bp, Homo sapiens
aaacctgactcaattatttgca

SEQ ID NO: 4370497 - DNA, 21 bp, Homo sapiens
aaacctgcagtttttaatttg

SEQ ID NO: 4370498 - DNA, 22 bp, Homo sapiens
aaacctggttcatatttatact

SEQ ID NO: 4370499 - DNA, 16 bp, Homo sapiens
aaacctgtagaatcaa

SEQ ID NO: 4370500 - DNA, 15 bp, Homo sapiens
aaaccttaatatttc

SEQ ID NO: 4370501 - DNA, 16 bp, Homo sapiens
aaaccttccacccagt

SEQ ID NO: 4370502 - DNA, 16 bp, Homo sapiens
aaaccttgccttgaaa

SEQ ID NO: 4370503 - DNA, 17 bp, Homo sapiens
aaaccttgctctcctca

SEQ ID NO: 4370504 - DNA, 21 bp, Homo sapiens
aaaccttgtggataagtggct

SEQ ID NO: 4370505 - DNA, 22 bp, Homo sapiens
aaacctttaaaaaaaaaatgct

SEQ ID NO: 4370506 - DNA, 13 bp, Homo sapiens
aaacctttccatt

SEQ ID NO: 4370507 - DNA, 12 bp, Homo sapiens
aaacctttcccc

SEQ ID NO: 4370508 - DNA, 17 bp, Homo sapiens
aaacctttcttcaccaa

SEQ ID NO: 4370509 - DNA, 14 bp, Homo sapiens
aaagctgtgtttat

SEQ ID NO: 4370510 - DNA, 14 bp, Homo sapiens
aaagcttaaaactt

SEQ ID NO: 4370511 - DNA, 16 bp, Homo sapiens
aaagcttaaaactttg

SEQ ID NO: 4370512 - DNA, 19 bp, Homo sapiens
aaagcttaaaactttgaag

SEQ ID NO: 4370513 - DNA, 23 bp, Homo sapiens
aaagcttatccataaaaaaaaat

SEQ ID NO: 4370514 - DNA, 17 bp, Homo sapiens
aaagcttccatgattct

SEQ ID NO: 4370515 - DNA, 18 bp, Homo sapiens
aaagcttccatgattcta

SEQ ID NO: 4370516 - DNA, 20 bp, Homo sapiens
aaagcttccatgattctatt

SEQ ID NO: 4370517 - DNA, 12 bp, Homo sapiens
aaagctttatga

SEQ ID NO: 4370518 - DNA, 12 bp, Homo sapiens
aaagctttctgc

SEQ ID NO: 4370519 - DNA, 21 bp, Homo sapiens
aaagctttgcttatggtaata

SEQ ID NO: 4370520 - DNA, 15 bp, Homo sapiens
aaagctttgttttgt

SEQ ID NO: 4370521 - DNA, 14 bp, Homo sapiens
aaagcttttaaaat

SEQ ID NO: 4370522 - DNA, 17 bp, Homo sapiens
aaagcttttattccttt

SEQ ID NO: 4370523 - DNA, 15 bp, Homo sapiens
aaaggaaaaagctcc

SEQ ID NO: 4370524 - DNA, 18 bp, Homo sapiens
aaaggaaagctgtgttta

SEQ ID NO: 4370525 - DNA, 17 bp, Homo sapiens
aaaggaaatcaaatgaa

SEQ ID NO: 4370526 - DNA, 23 bp, Homo sapiens
aaaggaacttgccctgagcactc

SEQ ID NO: 4370527 - DNA, 20 bp, Homo sapiens
aaaggaagcattgtaaaata

SEQ ID NO: 4370528 - DNA, 22 bp, Homo sapiens
aaaggaagcattgtaaaataat

SEQ ID NO: 4370529 - DNA, 22 bp, Homo sapiens
aaaggacaaatctaaaatgcaa

SEQ ID NO: 4370530 - DNA, 16 bp, Homo sapiens
aaaggacatcagcaaa

SEQ ID NO: 4370531 - DNA, 22 bp, Homo sapiens
aaaggaccgttttgtattgctt

SEQ ID NO: 4370532 - DNA, 14 bp, Homo sapiens
aaaggagagtactt

SEQ ID NO: 4370533 - DNA, 21 bp, Homo sapiens
aaaggagccttttgctctctg

SEQ ID NO: 4370534 - DNA, 13 bp, Homo sapiens
aaaggaggctggc

SEQ ID NO: 4370535 - DNA, 22 bp, Homo sapiens
aaaggattttggaaactcaagg

SEQ ID NO: 4370536 - DNA, 23 bp, Homo sapiens
aaaggcaaatattgaagttgttt

SEQ ID NO: 4370537 - DNA, 14 bp, Homo sapiens
aaaggcaagcactt

SEQ ID NO: 4370538 - DNA, 11 bp, Homo sapiens
aaaggcagctg

SEQ ID NO: 4370539 - DNA, 18 bp, Homo sapiens
aaaggcagctgcctctgc

SEQ ID NO: 4370540 - DNA, 22 bp, Homo sapiens
aaaggcaggtttcatttcttat

SEQ ID NO: 4370541 - DNA, 17 bp, Homo sapiens
aaaggccaatataccta

SEQ ID NO: 4370542 - DNA, 21 bp, Homo sapiens
aaaggccgttggctgtgctgt

SEQ ID NO: 4370543 - DNA, 13 bp, Homo sapiens
aaaggcctcttgt

SEQ ID NO: 4370544 - DNA, 19 bp, Homo sapiens
aaaggctcatttaaaacag

SEQ ID NO: 4370545 - DNA, 21 bp, Homo sapiens
aaaggctcatttaaaacaggc

SEQ ID NO: 4370546 - DNA, 24 bp, Homo sapiens
aaaggctcatttaaaacaggcaaa

SEQ ID NO: 4370547 - DNA, 21 bp, Homo sapiens
aaaggctgacattcactgagt

SEQ ID NO: 4370548 - DNA, 13 bp, Homo sapiens
aaaggctgagaag

SEQ ID NO: 4370549 - DNA, 19 bp, Homo sapiens
aaaggctgttaaatacagg

SEQ ID NO: 4370550 - DNA, 13 bp, Homo sapiens
aaaggcttccagg

SEQ ID NO: 4370551 - DNA, 19 bp, Homo sapiens
aaagggaacaagatgctga

SEQ ID NO: 4370552 - DNA, 18 bp, Homo sapiens
aaagggaatgggtctgca

SEQ ID NO: 4370553 - DNA, 16 bp, Homo sapiens
aaagggagaatggtgc

SEQ ID NO: 4370554 - DNA, 15 bp, Homo sapiens
aaagggagtttttga

SEQ ID NO: 4370555 - DNA, 13 bp, Homo sapiens
aaagggctgagag

SEQ ID NO: 4370556 - DNA, 23 bp, Homo sapiens
aaagggctggctccccctcccca

SEQ ID NO: 4370557 - DNA, 14 bp, Homo sapiens
aaagggcttcattt

SEQ ID NO: 4370558 - DNA, 16 bp, Homo sapiens
aaaggggagagcctgc

SEQ ID NO: 4370559 - DNA, 15 bp, Homo sapiens
aaaggggtgctttta

SEQ ID NO: 4370560 - DNA, 15 bp, Homo sapiens
aaagggtcaggcccg

SEQ ID NO: 4370561 - DNA, 19 bp, Homo sapiens
aaagggtgtatagtgttca

SEQ ID NO: 4370562 - DNA, 18 bp, Homo sapiens
aaaggtcgggacagctgt

SEQ ID NO: 4370563 - DNA, 20 bp, Homo sapiens
aaaggtgagtttgagctgcc

SEQ ID NO: 4370564 - DNA, 22 bp, Homo sapiens
aaaggtgagtttgagctgcctt

SEQ ID NO: 4370565 - DNA, 23 bp, Homo sapiens
aaaggtgagtttgagctgccttc

SEQ ID NO: 4370566 - DNA, 13 bp, Homo sapiens
aaaggtgccatgg

SEQ ID NO: 4370567 - DNA, 16 bp, Homo sapiens
aaaggttgaataatat

SEQ ID NO: 4370568 - DNA, 14 bp, Homo sapiens
aaaggttggcctta

SEQ ID NO: 4370569 - DNA, 23 bp, Homo sapiens
aaaggtttttgaaatccaggaat

SEQ ID NO: 4370570 - DNA, 12 bp, Homo sapiens
aaagtaaaacaa

SEQ ID NO: 4370571 - DNA, 16 bp, Homo sapiens
aaagtaaaattgaagc

SEQ ID NO: 4370572 - DNA, 19 bp, Homo sapiens
aaagtaaattttacggaaa

SEQ ID NO: 4370573 - DNA, 12 bp, Homo sapiens
aaagtaacattt

SEQ ID NO: 4370574 - DNA, 21 bp, Homo sapiens
aaagtaaggtgcttggagttt

SEQ ID NO: 4370575 - DNA, 20 bp, Homo sapiens
aaagtaatcagcatatgtgt

SEQ ID NO: 4370576 - DNA, 16 bp, Homo sapiens
aaagtacaatgtgttt

SEQ ID NO: 4370577 - DNA, 17 bp, Homo sapiens
aaagtacaatgtgtttt

SEQ ID NO: 4370578 - DNA, 14 bp, Homo sapiens
aaagtacagaattt

SEQ ID NO: 4370579 - DNA, 21 bp, Homo sapiens
aaagtacagaatttgaattat

SEQ ID NO: 4370580 - DNA, 16 bp, Homo sapiens
aaagtacatgttaaac

SEQ ID NO: 4370581 - DNA, 19 bp, Homo sapiens
aaagtactaatagaacttg

SEQ ID NO: 4370582 - DNA, 11 bp, Homo sapiens
aaagtactgta

SEQ ID NO: 4370583 - DNA, 19 bp, Homo sapiens
aaagtagcaaatgtttact

SEQ ID NO: 4370584 - DNA, 20 bp, Homo sapiens
aaagtaggaactcttaagca

SEQ ID NO: 4370585 - DNA, 19 bp, Homo sapiens
aaagtagtacttcttctgt

SEQ ID NO: 4370586 - DNA, 20 bp, Homo sapiens
aaagtagtacttcttctgta

SEQ ID NO: 4370587 - DNA, 21 bp, Homo sapiens
aaagtagtacttcttctgtaa

SEQ ID NO: 4370588 - DNA, 15 bp, Homo sapiens
aaagtagttatttta

SEQ ID NO: 4370589 - DNA, 20 bp, Homo sapiens
aaagtataatgtttattaaa

SEQ ID NO: 4370590 - DNA, 22 bp, Homo sapiens
aaagtataatgtttattaaatg

SEQ ID NO: 4370591 - DNA, 20 bp, Homo sapiens
aaagtatgcattattaaatt

SEQ ID NO: 4370592 - DNA, 19 bp, Homo sapiens
aaagtatgtattatttaca

SEQ ID NO: 4370593 - DNA, 18 bp, Homo sapiens
aaagtattccaccttaaa

SEQ ID NO: 4370594 - DNA, 16 bp, Homo sapiens
aaagtattggcattca

SEQ ID NO: 4370595 - DNA, 13 bp, Homo sapiens
aaagtattgtaaa

SEQ ID NO: 4370596 - DNA, 20 bp, Homo sapiens
aaagtattgtaaattatatt

SEQ ID NO: 4370597 - DNA, 21 bp, Homo sapiens
aaagtattgtaaattatattt

SEQ ID NO: 4370598 - DNA, 20 bp, Homo sapiens
aaagtattgtaatgagtgaa

SEQ ID NO: 4370599 - DNA, 21 bp, Homo sapiens
aaagtatttactttttaaaaa

SEQ ID NO: 4370600 - DNA, 21 bp, Homo sapiens
aaagtatttataaaaatataa

SEQ ID NO: 4370601 - DNA, 20 bp, Homo sapiens
aaagtatttgatgtacatta

SEQ ID NO: 4370602 - DNA, 16 bp, Homo sapiens
aaagtattttaatttt

SEQ ID NO: 4370603 - DNA, 21 bp, Homo sapiens
aaagtattttaattttaaaga

SEQ ID NO: 4370604 - DNA, 17 bp, Homo sapiens
aaagtcaccaaatagtg

SEQ ID NO: 4370605 - DNA, 14 bp, Homo sapiens
aaagtcagatgttt

SEQ ID NO: 4370606 - DNA, 23 bp, Homo sapiens
aaagtcagttgctcaaaaagaaa

SEQ ID NO: 4370607 - DNA, 15 bp, Homo sapiens
aaagtcattattcct

SEQ ID NO: 4370608 - DNA, 20 bp, Homo sapiens
aaagtccaattttaatttag

SEQ ID NO: 4370609 - DNA, 18 bp, Homo sapiens
aaagtccccctcctcagc

SEQ ID NO: 4370610 - DNA, 23 bp, Homo sapiens
aaagtccctccctgcctgagggc

SEQ ID NO: 4370611 - DNA, 15 bp, Homo sapiens
aaagtcgttttccaa

SEQ ID NO: 4370612 - DNA, 16 bp, Homo sapiens
aaagtcgttttccaaa

SEQ ID NO: 4370613 - DNA, 15 bp, Homo sapiens
aaagtctctatttaa

SEQ ID NO: 4370614 - DNA, 20 bp, Homo sapiens
aaagtctctatttaaattct

SEQ ID NO: 4370615 - DNA, 21 bp, Homo sapiens
aaagtctctatttaaattctt

SEQ ID NO: 4370616 - DNA, 21 bp, Homo sapiens
aaagtgaaacgtaattgtaca

SEQ ID NO: 4370617 - DNA, 15 bp, Homo sapiens
aaagtgaactttgtt

SEQ ID NO: 4370618 - DNA, 21 bp, Homo sapiens
aaagtgatcttgagaaccttt

SEQ ID NO: 4370619 - DNA, 11 bp, Homo sapiens
aaagtgccagc

SEQ ID NO: 4370620 - DNA, 19 bp, Homo sapiens
aaagtgccagcattccaga

SEQ ID NO: 4370621 - DNA, 20 bp, Homo sapiens
aaagtggaaaacaaggaagt

SEQ ID NO: 4370622 - DNA, 13 bp, Homo sapiens
aaagtggaacgaa

SEQ ID NO: 4370623 - DNA, 19 bp, Homo sapiens
aaagtggtaaatactgtga

SEQ ID NO: 4370624 - DNA, 14 bp, Homo sapiens
aaagtggtacttga

SEQ ID NO: 4370625 - DNA, 23 bp, Homo sapiens
aaagtggtacttgatcattttta

SEQ ID NO: 4370626 - DNA, 19 bp, Homo sapiens
aaatgaattgaaaaacaat

SEQ ID NO: 4370627 - DNA, 22 bp, Homo sapiens
aaatgacaccatcttttattct

SEQ ID NO: 4370628 - DNA, 14 bp, Homo sapiens
aaatgacagaccta

SEQ ID NO: 4370629 - DNA, 14 bp, Homo sapiens
aaatgacatctttt

SEQ ID NO: 4370630 - DNA, 15 bp, Homo sapiens
aaatgacatcttttt

SEQ ID NO: 4370631 - DNA, 21 bp, Homo sapiens
aaatgacatctttttaaagct

SEQ ID NO: 4370632 - DNA, 22 bp, Homo sapiens
aaatgacatctttttaaagctt

SEQ ID NO: 4370633 - DNA, 13 bp, Homo sapiens
aaatgacatttca

SEQ ID NO: 4370634 - DNA, 14 bp, Homo sapiens
aaatgacatttcac

SEQ ID NO: 4370635 - DNA, 15 bp, Homo sapiens
aaatgacatttcact

SEQ ID NO: 4370636 - DNA, 15 bp, Homo sapiens
aaatgactggctcct

SEQ ID NO: 4370637 - DNA, 20 bp, Homo sapiens
aaatgagaatgacagccttt

SEQ ID NO: 4370638 - DNA, 15 bp, Homo sapiens
aaatgagagcagaaa

SEQ ID NO: 4370639 - DNA, 12 bp, Homo sapiens
aaatgagccctg

SEQ ID NO: 4370640 - DNA, 23 bp, Homo sapiens
aaatgagctcgcatttgtcaatg

SEQ ID NO: 4370641 - DNA, 20 bp, Homo sapiens
aaatgaggccggacagaggg

SEQ ID NO: 4370642 - DNA, 19 bp, Homo sapiens
aaatgagggaagaacatta

SEQ ID NO: 4370643 - DNA, 16 bp, Homo sapiens
aaatgagggtttctga

SEQ ID NO: 4370644 - DNA, 16 bp, Homo sapiens
aaatgaggtctgttta

SEQ ID NO: 4370645 - DNA, 18 bp, Homo sapiens
aaatgagtcatttgttta

SEQ ID NO: 4370646 - DNA, 18 bp, Homo sapiens
aaatgagttacttagaat

SEQ ID NO: 4370647 - DNA, 14 bp, Homo sapiens
aaatgataaagact

SEQ ID NO: 4370648 - DNA, 23 bp, Homo sapiens
aaatgatccccagctgtttatgc

SEQ ID NO: 4370649 - DNA, 18 bp, Homo sapiens
aaatgatcctcccacctc

SEQ ID NO: 4370650 - DNA, 22 bp, Homo sapiens
aaatgatgatgtggaagaactt

SEQ ID NO: 4370651 - DNA, 18 bp, Homo sapiens
aaatgattatattcacag

SEQ ID NO: 4370652 - DNA, 20 bp, Homo sapiens
aaatgattcaaattgctgct

SEQ ID NO: 4370653 - DNA, 15 bp, Homo sapiens
aaatgatttcacagt

SEQ ID NO: 4370654 - DNA, 14 bp, Homo sapiens
aaatgatttcatat

SEQ ID NO: 4370655 - DNA, 14 bp, Homo sapiens
aaatgcaaatttct

SEQ ID NO: 4370656 - DNA, 14 bp, Homo sapiens
aaatgcaagatttt

SEQ ID NO: 4370657 - DNA, 15 bp, Homo sapiens
aaatgcaataactct

SEQ ID NO: 4370658 - DNA, 14 bp, Homo sapiens
aaatgcacaaacaa

SEQ ID NO: 4370659 - DNA, 14 bp, Homo sapiens
aaatgcacttctat

SEQ ID NO: 4370660 - DNA, 20 bp, Homo sapiens
aaatgcacttctatttagcc

SEQ ID NO: 4370661 - DNA, 14 bp, Homo sapiens
aaatgcagtatatt

SEQ ID NO: 4370662 - DNA, 16 bp, Homo sapiens
aaatgcatattaaata

SEQ ID NO: 4370663 - DNA, 18 bp, Homo sapiens
aaatgccaaaatgtactt

SEQ ID NO: 4370664 - DNA, 21 bp, Homo sapiens
aaatgccaaaatgtacttaaa

SEQ ID NO: 4370665 - DNA, 16 bp, Homo sapiens
aaatgccacttaacag

SEQ ID NO: 4370666 - DNA, 14 bp, Homo sapiens
aaatgccatgaaaa

SEQ ID NO: 4370667 - DNA, 17 bp, Homo sapiens
aaatgcccatttttgct

SEQ ID NO: 4370668 - DNA, 22 bp, Homo sapiens
aaatgcctcttaaattatatat

SEQ ID NO: 4370669 - DNA, 16 bp, Homo sapiens
aaatgccttttcccaa

SEQ ID NO: 4370670 - DNA, 13 bp, Homo sapiens
aaatgctccccac

SEQ ID NO: 4370671 - DNA, 12 bp, Homo sapiens
aaatgctgctct

SEQ ID NO: 4370672 - DNA, 13 bp, Homo sapiens
aaatgctgctctc

SEQ ID NO: 4370673 - DNA, 22 bp, Homo sapiens
aaatgctggtttttcagttttc

SEQ ID NO: 4370674 - DNA, 14 bp, Homo sapiens
aaatgctgtatttt

SEQ ID NO: 4370675 - DNA, 20 bp, Homo sapiens
aaatgctgtatttttacagc

SEQ ID NO: 4370676 - DNA, 13 bp, Homo sapiens
aaatgcttaaaaa

SEQ ID NO: 4370677 - DNA, 22 bp, Homo sapiens
aaatgcttaaatttcagaatta

SEQ ID NO: 4370678 - DNA, 19 bp, Homo sapiens
aaatgcttcactgtacgta

SEQ ID NO: 4370679 - DNA, 16 bp, Homo sapiens
aaatgcttcatttgta

SEQ ID NO: 4370680 - DNA, 19 bp, Homo sapiens
aaatgcttcatttgtatgt

SEQ ID NO: 4370681 - DNA, 22 bp, Homo sapiens
aaatgcttccactgcaagtctg

SEQ ID NO: 4370682 - DNA, 15 bp, Homo sapiens
aaatgcttttatatt

SEQ ID NO: 4370683 - DNA, 18 bp, Homo sapiens
aaatgcttttatattcta

SEQ ID NO: 4370684 - DNA, 20 bp, Homo sapiens
aaatgcttttatattctaat

SEQ ID NO: 4370685 - DNA, 20 bp, Homo sapiens
aaatgctttttatttctgca

SEQ ID NO: 4370686 - DNA, 16 bp, Homo sapiens
aaatggaaaagagaga

SEQ ID NO: 4370687 - DNA, 20 bp, Homo sapiens
aaatggaataacatatcaaa

SEQ ID NO: 4370688 - DNA, 23 bp, Homo sapiens
aaatggactggagctcatctgca

SEQ ID NO: 4370689 - DNA, 18 bp, Homo sapiens
aaatggagctcagtaaca

SEQ ID NO: 4370690 - DNA, 16 bp, Homo sapiens
aaatggatacataaag

SEQ ID NO: 4370691 - DNA, 13 bp, Homo sapiens
aaatggatactgg

SEQ ID NO: 4370692 - DNA, 14 bp, Homo sapiens
aaatggatatagaa

SEQ ID NO: 4370693 - DNA, 21 bp, Homo sapiens
aaatggcacttttgatgaaat

SEQ ID NO: 4370694 - DNA, 14 bp, Homo sapiens
aaatggcgaacatg

SEQ ID NO: 4370695 - DNA, 21 bp, Homo sapiens
aaatggcgtctggaagtccaa

SEQ ID NO: 4370696 - DNA, 15 bp, Homo sapiens
aaatggctttctcag

SEQ ID NO: 4370697 - DNA, 21 bp, Homo sapiens
aaatgggaaaaaacttaaaaa

SEQ ID NO: 4370698 - DNA, 18 bp, Homo sapiens
aaatgggatgaattcttt

SEQ ID NO: 4370699 - DNA, 22 bp, Homo sapiens
aaatgggcattttacaagaagt

SEQ ID NO: 4370700 - DNA, 13 bp, Homo sapiens
aaatgggtctttt

SEQ ID NO: 4370701 - DNA, 17 bp, Homo sapiens
aaatgggtcttttatag

SEQ ID NO: 4370702 - DNA, 21 bp, Homo sapiens
aaatggtatcaaaattacata

SEQ ID NO: 4370703 - DNA, 14 bp, Homo sapiens
aaatggtccaggag

SEQ ID NO: 4370704 - DNA, 16 bp, Homo sapiens
aaatggtctcttccct

SEQ ID NO: 4370705 - DNA, 20 bp, Homo sapiens
aaatggtttggtgcttttta

SEQ ID NO: 4370706 - DNA, 16 bp, Homo sapiens
aaatgtaaaaatgaag

SEQ ID NO: 4370707 - DNA, 18 bp, Homo sapiens
aaatgtaaaaatgaagga

SEQ ID NO: 4370708 - DNA, 22 bp, Homo sapiens
aaatgtaaagatatttttatct

SEQ ID NO: 4370709 - DNA, 18 bp, Homo sapiens
aaatgtaatataatgtat

SEQ ID NO: 4370710 - DNA, 19 bp, Homo sapiens
aaatgtaattatgttctaa

SEQ ID NO: 4370711 - DNA, 15 bp, Homo sapiens
aaatgtacacttttt

SEQ ID NO: 4370712 - DNA, 22 bp, Homo sapiens
aaatgtacactttttacagcag

SEQ ID NO: 4370713 - DNA, 13 bp, Homo sapiens
aaatgtacatcag

SEQ ID NO: 4370714 - DNA, 17 bp, Homo sapiens
aaatgtaccttctttca

SEQ ID NO: 4370715 - DNA, 15 bp, Homo sapiens
aaatgtacttaaatg

SEQ ID NO: 4370716 - DNA, 16 bp, Homo sapiens
aaatgtacttaaatga

SEQ ID NO: 4370717 - DNA, 16 bp, Homo sapiens
aaatgtagaatattca

SEQ ID NO: 4370718 - DNA, 20 bp, Homo sapiens
aaatgtatctaagaataata

SEQ ID NO: 4370719 - DNA, 14 bp, Homo sapiens
aaatgtattttaca

SEQ ID NO: 4370720 - DNA, 12 bp, Homo sapiens
aaatgtattttt

SEQ ID NO: 4370721 - DNA, 18 bp, Homo sapiens
aaatgtcattgtctactc

SEQ ID NO: 4370722 - DNA, 23 bp, Homo sapiens
aaatgtcttgctgttgacatatt

SEQ ID NO: 4370723 - DNA, 13 bp, Homo sapiens
aaatgtcttgtgt

SEQ ID NO: 4370724 - DNA, 14 bp, Homo sapiens
aaatgtgaaaaact

SEQ ID NO: 4370725 - DNA, 14 bp, Homo sapiens
aaatgtgaaatgct

SEQ ID NO: 4370726 - DNA, 13 bp, Homo sapiens
aaatgtgactcag

SEQ ID NO: 4370727 - DNA, 17 bp, Homo sapiens
aaatgtgaggcaataag

SEQ ID NO: 4370728 - DNA, 16 bp, Homo sapiens
aaatgtgagtgttttt

SEQ ID NO: 4370729 - DNA, 13 bp, Homo sapiens
aaatgtgatgaat

SEQ ID NO: 4370730 - DNA, 21 bp, Homo sapiens
aaatgtgatgaatactgtatt

SEQ ID NO: 4370731 - DNA, 14 bp, Homo sapiens
aaatgtgcattttg

SEQ ID NO: 4370732 - DNA, 20 bp, Homo sapiens
aaatgtggattttgtagatg

SEQ ID NO: 4370733 - DNA, 16 bp, Homo sapiens
aaatgtggctgtaaaa

SEQ ID NO: 4370734 - DNA, 19 bp, Homo sapiens
aaatgtggttgcttaattc

SEQ ID NO: 4370735 - DNA, 22 bp, Homo sapiens
aaatgtgtatttcttaagaatt

SEQ ID NO: 4370736 - DNA, 21 bp, Homo sapiens
aaatgtgttagcactgatagt

SEQ ID NO: 4370737 - DNA, 13 bp, Homo sapiens
aaatgttaacaat

SEQ ID NO: 4370738 - DNA, 11 bp, Homo sapiens
aaatgttaact

SEQ ID NO: 4370739 - DNA, 16 bp, Homo sapiens
aaatgttacttctgat

SEQ ID NO: 4370740 - DNA, 21 bp, Homo sapiens
aaatgttacttctgatacttt

SEQ ID NO: 4370741 - DNA, 13 bp, Homo sapiens
aaatgttagactt

SEQ ID NO: 4370742 - DNA, 17 bp, Homo sapiens
aaatgttagacttgtgt

SEQ ID NO: 4370743 - DNA, 20 bp, Homo sapiens
aaatgttagacttgtgtgca

SEQ ID NO: 4370744 - DNA, 21 bp, Homo sapiens
aaatgttagacttgtgtgcat

SEQ ID NO: 4370745 - DNA, 21 bp, Homo sapiens
aacagaaattgtatattgtaa

SEQ ID NO: 4370746 - DNA, 15 bp, Homo sapiens
aacagaacccacagt

SEQ ID NO: 4370747 - DNA, 21 bp, Homo sapiens
aacagaagtgacttctggaga

SEQ ID NO: 4370748 - DNA, 18 bp, Homo sapiens
aacagagaggaccaacat

SEQ ID NO: 4370749 - DNA, 19 bp, Homo sapiens
aacagagtggcctccctgc

SEQ ID NO: 4370750 - DNA, 16 bp, Homo sapiens
aacagataaatagttt

SEQ ID NO: 4370751 - DNA, 15 bp, Homo sapiens
aacagatgtgaaaat

SEQ ID NO: 4370752 - DNA, 17 bp, Homo sapiens
aacagatgtttgttttc

SEQ ID NO: 4370753 - DNA, 17 bp, Homo sapiens
aacagattcaggccagc

SEQ ID NO: 4370754 - DNA, 17 bp, Homo sapiens
aacagcacacaggcagc

SEQ ID NO: 4370755 - DNA, 18 bp, Homo sapiens
aacagcacacaggcagcc

SEQ ID NO: 4370756 - DNA, 21 bp, Homo sapiens
aacagcacagggaagcaaata

SEQ ID NO: 4370757 - DNA, 23 bp, Homo sapiens
aacagcaccaccatttaatttca

SEQ ID NO: 4370758 - DNA, 15 bp, Homo sapiens
aacagccccggggcc

SEQ ID NO: 4370759 - DNA, 14 bp, Homo sapiens
aacagccctctctc

SEQ ID NO: 4370760 - DNA, 17 bp, Homo sapiens
aacagcgtcttccttct

SEQ ID NO: 4370761 - DNA, 19 bp, Homo sapiens
aacagcgttcctagagaag

SEQ ID NO: 4370762 - DNA, 21 bp, Homo sapiens
aacagctacaaacttttaaga

SEQ ID NO: 4370763 - DNA, 19 bp, Homo sapiens
aacagctcgatccaaattg

SEQ ID NO: 4370764 - DNA, 13 bp, Homo sapiens
aacagctgcctta

SEQ ID NO: 4370765 - DNA, 18 bp, Homo sapiens
aacagctgccttagcttc

SEQ ID NO: 4370766 - DNA, 23 bp, Homo sapiens
aacagctggaggaatacatttta

SEQ ID NO: 4370767 - DNA, 14 bp, Homo sapiens
aacagctgtattta

SEQ ID NO: 4370768 - DNA, 21 bp, Homo sapiens
aacagcttttcccaggagacc

SEQ ID NO: 4370769 - DNA, 20 bp, Homo sapiens
aacaggaaactcctgtgacc

SEQ ID NO: 4370770 - DNA, 19 bp, Homo sapiens
aacaggaactagtaaacat

SEQ ID NO: 4370771 - DNA, 20 bp, Homo sapiens
aacagggactacgtattttt

SEQ ID NO: 4370772 - DNA, 16 bp, Homo sapiens
aacagggccacataga

SEQ ID NO: 4370773 - DNA, 21 bp, Homo sapiens
aacagggctgccttctggcct

SEQ ID NO: 4370774 - DNA, 22 bp, Homo sapiens
aacaggttcttaaaaaggaaca

SEQ ID NO: 4370775 - DNA, 17 bp, Homo sapiens
aacaggttgggatggga

SEQ ID NO: 4370776 - DNA, 18 bp, Homo sapiens
aacagtaaaccactgaaa

SEQ ID NO: 4370777 - DNA, 23 bp, Homo sapiens
aacagtaaaccactgaaaaaata

SEQ ID NO: 4370778 - DNA, 20 bp, Homo sapiens
aacagtacagaaggcaaagt

SEQ ID NO: 4370779 - DNA, 17 bp, Homo sapiens
aacagtcactggaaaga

SEQ ID NO: 4370780 - DNA, 23 bp, Homo sapiens
aacagtccccgtggccatccctg

SEQ ID NO: 4370781 - DNA, 22 bp, Homo sapiens
aacagtgattaccagggactga

SEQ ID NO: 4370782 - DNA, 16 bp, Homo sapiens
aacagtgcaagatttt

SEQ ID NO: 4370783 - DNA, 20 bp, Homo sapiens
aacagtgcagggcaaaatat

SEQ ID NO: 4370784 - DNA, 13 bp, Homo sapiens
aacagtgcatgtg

SEQ ID NO: 4370785 - DNA, 18 bp, Homo sapiens
aacagtgccattgtcttt

SEQ ID NO: 4370786 - DNA, 15 bp, Homo sapiens
aacagtgcctgctga

SEQ ID NO: 4370787 - DNA, 15 bp, Homo sapiens
aacagtggaatataa

SEQ ID NO: 4370788 - DNA, 14 bp, Homo sapiens
aacagtggatcaca

SEQ ID NO: 4370789 - DNA, 15 bp, Homo sapiens
aacagtgtaaagtta

SEQ ID NO: 4370790 - DNA, 17 bp, Homo sapiens
aacagtgtctttctagc

SEQ ID NO: 4370791 - DNA, 14 bp, Homo sapiens
aacagttgcatgta

SEQ ID NO: 4370792 - DNA, 22 bp, Homo sapiens
aacagttggtaacttttgtgaa

SEQ ID NO: 4370793 - DNA, 15 bp, Homo sapiens
aacagttttgagtaa

SEQ ID NO: 4370794 - DNA, 17 bp, Homo sapiens
aacataaaaactgattt

SEQ ID NO: 4370795 - DNA, 15 bp, Homo sapiens
aacataaaaaggaca

SEQ ID NO: 4370796 - DNA, 22 bp, Homo sapiens
aacataaaaaggacatcagcaa

SEQ ID NO: 4370797 - DNA, 13 bp, Homo sapiens
aacataaaaatga

SEQ ID NO: 4370798 - DNA, 14 bp, Homo sapiens
aacataaagagcaa

SEQ ID NO: 4370799 - DNA, 22 bp, Homo sapiens
aacataatcttctgccttctca

SEQ ID NO: 4370800 - DNA, 19 bp, Homo sapiens
aacatacgggaagtttatt

SEQ ID NO: 4370801 - DNA, 11 bp, Homo sapiens
aacatactgta

SEQ ID NO: 4370802 - DNA, 15 bp, Homo sapiens
aacataggtttttaa

SEQ ID NO: 4370803 - DNA, 22 bp, Homo sapiens
aacatatgagtgttttgaaaat

SEQ ID NO: 4370804 - DNA, 14 bp, Homo sapiens
aacatattgttgaa

SEQ ID NO: 4370805 - DNA, 16 bp, Homo sapiens
aacatatttttatact

SEQ ID NO: 4370806 - DNA, 18 bp, Homo sapiens
aacatcacacctgcccta

SEQ ID NO: 4370807 - DNA, 19 bp, Homo sapiens
aacatcacctatttaatgt

SEQ ID NO: 4370808 - DNA, 17 bp, Homo sapiens
aacatcactatcaattt

SEQ ID NO: 4370809 - DNA, 20 bp, Homo sapiens
aacatcactatcaattttaa

SEQ ID NO: 4370810 - DNA, 13 bp, Homo sapiens
aacatcagtggat

SEQ ID NO: 4370811 - DNA, 11 bp, Homo sapiens
aacatccaaaa

SEQ ID NO: 4370812 - DNA, 15 bp, Homo sapiens
aacatccaagtcttt

SEQ ID NO: 4370813 - DNA, 22 bp, Homo sapiens
aacatcccaagattttttcatt

SEQ ID NO: 4370814 - DNA, 18 bp, Homo sapiens
aacatcccattgccctgg

SEQ ID NO: 4370815 - DNA, 18 bp, Homo sapiens
aacatcgtggatgtagtg

SEQ ID NO: 4370816 - DNA, 15 bp, Homo sapiens
aacatctgccattta

SEQ ID NO: 4370817 - DNA, 22 bp, Homo sapiens
aacatctgtcctgtgaaagact

SEQ ID NO: 4370818 - DNA, 18 bp, Homo sapiens
aacatcttcatgttttag

SEQ ID NO: 4370819 - DNA, 11 bp, Homo sapiens
aacatcttttc

SEQ ID NO: 4370820 - DNA, 20 bp, Homo sapiens
aacatgaccctaaatcttga

SEQ ID NO: 4370821 - DNA, 24 bp, Homo sapiens
aacatgacttccttatttctgaac

SEQ ID NO: 4370822 - DNA, 12 bp, Homo sapiens
aacatgcaataa

SEQ ID NO: 4370823 - DNA, 14 bp, Homo sapiens
aacatgcactgatg

SEQ ID NO: 4370824 - DNA, 22 bp, Homo sapiens
aacatgcagtttgaaattctga

SEQ ID NO: 4370825 - DNA, 20 bp, Homo sapiens
aacatggagaaaccctgtct

SEQ ID NO: 4370826 - DNA, 16 bp, Homo sapiens
aacatggagctgtcat

SEQ ID NO: 4370827 - DNA, 15 bp, Homo sapiens
aacatggaggatggt

SEQ ID NO: 4370828 - DNA, 23 bp, Homo sapiens
aacatgggagggatcagccccgc

SEQ ID NO: 4370829 - DNA, 16 bp, Homo sapiens
aacatgtatttatgta

SEQ ID NO: 4370830 - DNA, 19 bp, Homo sapiens
aacatgtcacaatacagta

SEQ ID NO: 4370831 - DNA, 20 bp, Homo sapiens
aacatgtcctgcctattatc

SEQ ID NO: 4370832 - DNA, 23 bp, Homo sapiens
aacattaagaaaaacaataaaga

SEQ ID NO: 4370833 - DNA, 18 bp, Homo sapiens
aacattacttatttaact

SEQ ID NO: 4370834 - DNA, 14 bp, Homo sapiens
aacattatataaca

SEQ ID NO: 4370835 - DNA, 15 bp, Homo sapiens
aacattatattgcaa

SEQ ID NO: 4370836 - DNA, 15 bp, Homo sapiens
aacattattttttat

SEQ ID NO: 4370837 - DNA, 22 bp, Homo sapiens
aacattcacttttgttaacagt

SEQ ID NO: 4370838 - DNA, 20 bp, Homo sapiens
aacattccaaggagttggaa

SEQ ID NO: 4370839 - DNA, 21 bp, Homo sapiens
aacattccagggatgagccaa

SEQ ID NO: 4370840 - DNA, 21 bp, Homo sapiens
aacattcctccagcctcccct

SEQ ID NO: 4370841 - DNA, 19 bp, Homo sapiens
aacattctatctactgatt

SEQ ID NO: 4370842 - DNA, 18 bp, Homo sapiens
aacattctcctgtggaag

SEQ ID NO: 4370843 - DNA, 14 bp, Homo sapiens
aacattctgccctc

SEQ ID NO: 4370844 - DNA, 16 bp, Homo sapiens
aacattgaagtaatga

SEQ ID NO: 4370845 - DNA, 21 bp, Homo sapiens
aacattgatccagtcatttta

SEQ ID NO: 4370846 - DNA, 18 bp, Homo sapiens
aacattgcctttgaatgt

SEQ ID NO: 4370847 - DNA, 12 bp, Homo sapiens
aacattggacag

SEQ ID NO: 4370848 - DNA, 22 bp, Homo sapiens
aacatttaaactttttaaaata

SEQ ID NO: 4370849 - DNA, 12 bp, Homo sapiens
aacatttaaatt

SEQ ID NO: 4370850 - DNA, 17 bp, Homo sapiens
aacatttactacagttt

SEQ ID NO: 4370851 - DNA, 19 bp, Homo sapiens
aacatttactacagttttt

SEQ ID NO: 4370852 - DNA, 22 bp, Homo sapiens
aacatttatgtgaggtaattat

SEQ ID NO: 4370853 - DNA, 15 bp, Homo sapiens
aacatttattttgac

SEQ ID NO: 4370854 - DNA, 19 bp, Homo sapiens
aacatttcatgtagtaaga

SEQ ID NO: 4370855 - DNA, 20 bp, Homo sapiens
aacatttgattaataaaata

SEQ ID NO: 4370856 - DNA, 23 bp, Homo sapiens
aacatttgtttcccccacagttt

SEQ ID NO: 4370857 - DNA, 15 bp, Homo sapiens
aacattttgaagtgt

SEQ ID NO: 4370858 - DNA, 20 bp, Homo sapiens
aacatttttttttctccata

SEQ ID NO: 4370859 - DNA, 12 bp, Homo sapiens
aaccaaaaacat

SEQ ID NO: 4370860 - DNA, 15 bp, Homo sapiens
aaccaaaaacatttg

SEQ ID NO: 4370861 - DNA, 16 bp, Homo sapiens
aaccaaaaacatttga

SEQ ID NO: 4370862 - DNA, 20 bp, Homo sapiens
aaccaaaaacatttgattaa

SEQ ID NO: 4370863 - DNA, 13 bp, Homo sapiens
aactcctgtgacc

SEQ ID NO: 4370864 - DNA, 15 bp, Homo sapiens
aactcgaatctgtgt

SEQ ID NO: 4370865 - DNA, 16 bp, Homo sapiens
aactcgaatctgtgtg

SEQ ID NO: 4370866 - DNA, 20 bp, Homo sapiens
aactcgcgagtgtaactttc

SEQ ID NO: 4370867 - DNA, 16 bp, Homo sapiens
aactctaatattgctt

SEQ ID NO: 4370868 - DNA, 18 bp, Homo sapiens
aactctacccctgctccc

SEQ ID NO: 4370869 - DNA, 13 bp, Homo sapiens
aactctctagctt

SEQ ID NO: 4370870 - DNA, 15 bp, Homo sapiens
aactctctcccagga

SEQ ID NO: 4370871 - DNA, 19 bp, Homo sapiens
aactctgaattttaaagca

SEQ ID NO: 4370872 - DNA, 19 bp, Homo sapiens
aactctgcatagacaaagg

SEQ ID NO: 4370873 - DNA, 16 bp, Homo sapiens
aactctggacactcta

SEQ ID NO: 4370874 - DNA, 19 bp, Homo sapiens
aactctggtgataaaaata

SEQ ID NO: 4370875 - DNA, 23 bp, Homo sapiens
aactctggtgataaaaataaagc

SEQ ID NO: 4370876 - DNA, 12 bp, Homo sapiens
aactctggtggc

SEQ ID NO: 4370877 - DNA, 18 bp, Homo sapiens
aactctgttcccccaccc

SEQ ID NO: 4370878 - DNA, 18 bp, Homo sapiens
aactcttatttctttcct

SEQ ID NO: 4370879 - DNA, 20 bp, Homo sapiens
aactcttatttctttccttt

SEQ ID NO: 4370880 - DNA, 16 bp, Homo sapiens
aactcttctttgctgc

SEQ ID NO: 4370881 - DNA, 11 bp, Homo sapiens
aactcttgatt

SEQ ID NO: 4370882 - DNA, 14 bp, Homo sapiens
aactcttggaagaa

SEQ ID NO: 4370883 - DNA, 23 bp, Homo sapiens
aactctttgctgctgcccatgtt

SEQ ID NO: 4370884 - DNA, 12 bp, Homo sapiens
aactgaaaatta

SEQ ID NO: 4370885 - DNA, 17 bp, Homo sapiens
aactgaaaattatttaa

SEQ ID NO: 4370886 - DNA, 19 bp, Homo sapiens
aactgaaagctttaatgtt

SEQ ID NO: 4370887 - DNA, 23 bp, Homo sapiens
aactgaacaccattgaaggctta

SEQ ID NO: 4370888 - DNA, 11 bp, Homo sapiens
aactgaagcat

SEQ ID NO: 4370889 - DNA, 15 bp, Homo sapiens
aactgaaggagaagg

SEQ ID NO: 4370890 - DNA, 21 bp, Homo sapiens
aactgaaggctaaaaagcaac

SEQ ID NO: 4370891 - DNA, 16 bp, Homo sapiens
aactgaattttgggac

SEQ ID NO: 4370892 - DNA, 16 bp, Homo sapiens
aactgacaagccatct

SEQ ID NO: 4370893 - DNA, 17 bp, Homo sapiens
aactgacaagccatctt

SEQ ID NO: 4370894 - DNA, 17 bp, Homo sapiens
aactgagaaatgaatgc

SEQ ID NO: 4370895 - DNA, 13 bp, Homo sapiens
aactgagagaaag

SEQ ID NO: 4370896 - DNA, 14 bp, Homo sapiens
aactgagagaaaga

SEQ ID NO: 4370897 - DNA, 20 bp, Homo sapiens
aactgagctgggcaggaagg

SEQ ID NO: 4370898 - DNA, 20 bp, Homo sapiens
aactgaggagatgaccaggg

SEQ ID NO: 4370899 - DNA, 19 bp, Homo sapiens
aactgagggctctgtttgt

SEQ ID NO: 4370900 - DNA, 18 bp, Homo sapiens
aactgagtcactcacatt

SEQ ID NO: 4370901 - DNA, 22 bp, Homo sapiens
aactgagtcactcacattgaga

SEQ ID NO: 4370902 - DNA, 23 bp, Homo sapiens
aactgatgatgacaggtcagcag

SEQ ID NO: 4370903 - DNA, 18 bp, Homo sapiens
aactgattaaaaatacct

SEQ ID NO: 4370904 - DNA, 15 bp, Homo sapiens
aactgatttaacact

SEQ ID NO: 4370905 - DNA, 11 bp, Homo sapiens
aactgatttct

SEQ ID NO: 4370906 - DNA, 12 bp, Homo sapiens
aactgatttcta

SEQ ID NO: 4370907 - DNA, 22 bp, Homo sapiens
aactgatttctatggctttcaa

SEQ ID NO: 4370908 - DNA, 14 bp, Homo sapiens
aactgatttctcac

SEQ ID NO: 4370909 - DNA, 19 bp, Homo sapiens
aactgcactgtcaagatga

SEQ ID NO: 4370910 - DNA, 19 bp, Homo sapiens
aactgcattggttttccat

SEQ ID NO: 4370911 - DNA, 17 bp, Homo sapiens
aactgccaggctgcctc

SEQ ID NO: 4370912 - DNA, 13 bp, Homo sapiens
aactgccccaggg

SEQ ID NO: 4370913 - DNA, 16 bp, Homo sapiens
aactgcccttgctgcc

SEQ ID NO: 4370914 - DNA, 16 bp, Homo sapiens
aactgccgtaatttaa

SEQ ID NO: 4370915 - DNA, 16 bp, Homo sapiens
aactgcctactccaaa

SEQ ID NO: 4370916 - DNA, 20 bp, Homo sapiens
aactgcctcgaaacacagaa

SEQ ID NO: 4370917 - DNA, 20 bp, Homo sapiens
aactgctccagcctctgccg

SEQ ID NO: 4370918 - DNA, 22 bp, Homo sapiens
aactgctccagcctctgccgct

SEQ ID NO: 4370919 - DNA, 13 bp, Homo sapiens
aactgctgcagat

SEQ ID NO: 4370920 - DNA, 17 bp, Homo sapiens
aactgctttctgttcca

SEQ ID NO: 4370921 - DNA, 17 bp, Homo sapiens
aactggaaacaaaacag

SEQ ID NO: 4370922 - DNA, 14 bp, Homo sapiens
aactggaattaaaa

SEQ ID NO: 4370923 - DNA, 20 bp, Homo sapiens
aactggaattaaaaggatag

SEQ ID NO: 4370924 - DNA, 19 bp, Homo sapiens
aactggcaaaagtgtgtgt

SEQ ID NO: 4370925 - DNA, 20 bp, Homo sapiens
aactggcatgtcatttgcac

SEQ ID NO: 4370926 - DNA, 21 bp, Homo sapiens
aactggcatgtcatttgcaca

SEQ ID NO: 4370927 - DNA, 13 bp, Homo sapiens
aactggcttcccc

SEQ ID NO: 4370928 - DNA, 11 bp, Homo sapiens
aactgggctgg

SEQ ID NO: 4370929 - DNA, 22 bp, Homo sapiens
aactgggctggcgcttggatct

SEQ ID NO: 4370930 - DNA, 15 bp, Homo sapiens
aactgggctgggcct

SEQ ID NO: 4370931 - DNA, 16 bp, Homo sapiens
aactgggtcttcagct

SEQ ID NO: 4370932 - DNA, 21 bp, Homo sapiens
aactgggtttctcattaaagt

SEQ ID NO: 4370933 - DNA, 18 bp, Homo sapiens
aactggtgcactttgtaa

SEQ ID NO: 4370934 - DNA, 23 bp, Homo sapiens
aactggttaaaaaacaaatgttc

SEQ ID NO: 4370935 - DNA, 15 bp, Homo sapiens
aactgtaaaagtgta

SEQ ID NO: 4370936 - DNA, 11 bp, Homo sapiens
aactgtaaatc

SEQ ID NO: 4370937 - DNA, 23 bp, Homo sapiens
aactgtactagtctgtgtgggac

SEQ ID NO: 4370938 - DNA, 15 bp, Homo sapiens
aactgtagaaatgat

SEQ ID NO: 4370939 - DNA, 19 bp, Homo sapiens
aactgtagaaatgatgatg

SEQ ID NO: 4370940 - DNA, 18 bp, Homo sapiens
aactgtatcatctttgcc

SEQ ID NO: 4370941 - DNA, 14 bp, Homo sapiens
aactgtatttcagt

SEQ ID NO: 4370942 - DNA, 19 bp, Homo sapiens
aactgtatttttgaagact

SEQ ID NO: 4370943 - DNA, 14 bp, Homo sapiens
aactgtcttagact

SEQ ID NO: 4370944 - DNA, 15 bp, Homo sapiens
aactgtcttgtttca

SEQ ID NO: 4370945 - DNA, 20 bp, Homo sapiens
aactgtcttgtttcagtgag

SEQ ID NO: 4370946 - DNA, 20 bp, Homo sapiens
aactgtgaaaatagtgtaag

SEQ ID NO: 4370947 - DNA, 19 bp, Homo sapiens
aactgtgaaataccacaag

SEQ ID NO: 4370948 - DNA, 13 bp, Homo sapiens
aactgtggatatt

SEQ ID NO: 4370949 - DNA, 20 bp, Homo sapiens
aactgtgtacataactgaaa

SEQ ID NO: 4370950 - DNA, 21 bp, Homo sapiens
aactgtgtacataactgaaaa

SEQ ID NO: 4370951 - DNA, 13 bp, Homo sapiens
aactgtgtattta

SEQ ID NO: 4370952 - DNA, 19 bp, Homo sapiens
aactgttgcctaattggaa

SEQ ID NO: 4370953 - DNA, 13 bp, Homo sapiens
aactgtttagatg

SEQ ID NO: 4370954 - DNA, 16 bp, Homo sapiens
aactgtttcaaagcca

SEQ ID NO: 4370955 - DNA, 21 bp, Homo sapiens
aactgtttcaagccctcctcc

SEQ ID NO: 4370956 - DNA, 14 bp, Homo sapiens
aacttaaataataa

SEQ ID NO: 4370957 - DNA, 19 bp, Homo sapiens
aacttaaatgttattatct

SEQ ID NO: 4370958 - DNA, 23 bp, Homo sapiens
aacttaatttgggaatttgttgt

SEQ ID NO: 4370959 - DNA, 18 bp, Homo sapiens
aacttacaaaaacacttc

SEQ ID NO: 4370960 - DNA, 21 bp, Homo sapiens
aacttaccaggcaccaaaaga

SEQ ID NO: 4370961 - DNA, 16 bp, Homo sapiens
aacttataatgattaa

SEQ ID NO: 4370962 - DNA, 21 bp, Homo sapiens
aacttatggactgttttgata

SEQ ID NO: 4370963 - DNA, 14 bp, Homo sapiens
aacttattaaattt

SEQ ID NO: 4370964 - DNA, 21 bp, Homo sapiens
aacttattccaggtattaaag

SEQ ID NO: 4370965 - DNA, 23 bp, Homo sapiens
aacttattgtattcctcatgtca

SEQ ID NO: 4370966 - DNA, 23 bp, Homo sapiens
aacttcaccaccccctgtcccat

SEQ ID NO: 4370967 - DNA, 11 bp, Homo sapiens
aacttcagcaa

SEQ ID NO: 4370968 - DNA, 14 bp, Homo sapiens
aacttcatgtaatt

SEQ ID NO: 4370969 - DNA, 12 bp, Homo sapiens
aacttcattctc

SEQ ID NO: 4370970 - DNA, 14 bp, Homo sapiens
aacttcattggtaa

SEQ ID NO: 4370971 - DNA, 13 bp, Homo sapiens
aacttccaaagaa

SEQ ID NO: 4370972 - DNA, 14 bp, Homo sapiens
aacttccaaagaaa

SEQ ID NO: 4370973 - DNA, 16 bp, Homo sapiens
aacttcccattaaaaa

SEQ ID NO: 4370974 - DNA, 14 bp, Homo sapiens
aacttccgctgagg

SEQ ID NO: 4370975 - DNA, 17 bp, Homo sapiens
aacttcctgtgcctttc

SEQ ID NO: 4370976 - DNA, 17 bp, Homo sapiens
aacttcctgtggcctga

SEQ ID NO: 4370977 - DNA, 22 bp, Homo sapiens
aacttccttggactcattttaa

SEQ ID NO: 4370978 - DNA, 19 bp, Homo sapiens
aacttctcttgctttctat

SEQ ID NO: 4370979 - DNA, 19 bp, Homo sapiens
aacttcttgcttctttcta

SEQ ID NO: 4370980 - DNA, 20 bp, Homo sapiens
aacttcttgcttctttctag

SEQ ID NO: 4370981 - DNA, 19 bp, Homo sapiens
aagaggaaaagtgcaatgc

SEQ ID NO: 4370982 - DNA, 15 bp, Homo sapiens
aagaggactgagact

SEQ ID NO: 4370983 - DNA, 16 bp, Homo sapiens
aagaggattgtaaaat

SEQ ID NO: 4370984 - DNA, 23 bp, Homo sapiens
aagaggccagacatggtgtctca

SEQ ID NO: 4370985 - DNA, 15 bp, Homo sapiens
aagaggctacagggc

SEQ ID NO: 4370986 - DNA, 16 bp, Homo sapiens
aagaggctctggacag

SEQ ID NO: 4370987 - DNA, 21 bp, Homo sapiens
aagaggctgcccctctcacca

SEQ ID NO: 4370988 - DNA, 16 bp, Homo sapiens
aagaggcttctcctgt

SEQ ID NO: 4370989 - DNA, 16 bp, Homo sapiens
aagagggacgcctggg

SEQ ID NO: 4370990 - DNA, 21 bp, Homo sapiens
aagagggcccagcccagagcc

SEQ ID NO: 4370991 - DNA, 16 bp, Homo sapiens
aagaggggcgggctca

SEQ ID NO: 4370992 - DNA, 16 bp, Homo sapiens
aagagggggtggaggg

SEQ ID NO: 4370993 - DNA, 21 bp, Homo sapiens
aagagggttcacacagcccag

SEQ ID NO: 4370994 - DNA, 18 bp, Homo sapiens
aagaggtctgagccctgg

SEQ ID NO: 4370995 - DNA, 15 bp, Homo sapiens
aagaggtgggagggc

SEQ ID NO: 4370996 - DNA, 13 bp, Homo sapiens
aagagtagaaact

SEQ ID NO: 4370997 - DNA, 13 bp, Homo sapiens
aagagtcattttc

SEQ ID NO: 4370998 - DNA, 22 bp, Homo sapiens
aagagtcattttcacttttaaa

SEQ ID NO: 4370999 - DNA, 14 bp, Homo sapiens
aagagtcttccaat

SEQ ID NO: 4371000 - DNA, 19 bp, Homo sapiens
aagagttattcaaatgaag

SEQ ID NO: 4371001 - DNA, 20 bp, Homo sapiens
aagagttctatggagacttt

SEQ ID NO: 4371002 - DNA, 18 bp, Homo sapiens
aagataaaataaaatttt

SEQ ID NO: 4371003 - DNA, 18 bp, Homo sapiens
aagataatcctagagtct

SEQ ID NO: 4371004 - DNA, 21 bp, Homo sapiens
aagataatcgaagcaaaagta

SEQ ID NO: 4371005 - DNA, 16 bp, Homo sapiens
aagatacactgcactt

SEQ ID NO: 4371006 - DNA, 22 bp, Homo sapiens
aagatacagaactctttcaaaa

SEQ ID NO: 4371007 - DNA, 13 bp, Homo sapiens
aagatacatgatt

SEQ ID NO: 4371008 - DNA, 17 bp, Homo sapiens
aagatacttaagtgctg

SEQ ID NO: 4371009 - DNA, 14 bp, Homo sapiens
aagatagcagggca

SEQ ID NO: 4371010 - DNA, 17 bp, Homo sapiens
aagatagcgcatatatt

SEQ ID NO: 4371011 - DNA, 14 bp, Homo sapiens
aagatagctgtgac

SEQ ID NO: 4371012 - DNA, 20 bp, Homo sapiens
aagatatatgtgtatacata

SEQ ID NO: 4371013 - DNA, 17 bp, Homo sapiens
aagatatggagaattgc

SEQ ID NO: 4371014 - DNA, 20 bp, Homo sapiens
aagatatttgcagtttttca

SEQ ID NO: 4371015 - DNA, 17 bp, Homo sapiens
aagatatttttatcttt

SEQ ID NO: 4371016 - DNA, 19 bp, Homo sapiens
aagatatttttatctttat

SEQ ID NO: 4371017 - DNA, 14 bp, Homo sapiens
aagatcaatttctc

SEQ ID NO: 4371018 - DNA, 17 bp, Homo sapiens
aagatcactttctcagt

SEQ ID NO: 4371019 - DNA, 12 bp, Homo sapiens
aagatccagaaa

SEQ ID NO: 4371020 - DNA, 17 bp, Homo sapiens
aagatcctaaactctct

SEQ ID NO: 4371021 - DNA, 21 bp, Homo sapiens
aagatcctaaactctctagct

SEQ ID NO: 4371022 - DNA, 12 bp, Homo sapiens
aagatccttcat

SEQ ID NO: 4371023 - DNA, 20 bp, Homo sapiens
aagatctgttttgaaggcaa

SEQ ID NO: 4371024 - DNA, 13 bp, Homo sapiens
aagatgaaaatat

SEQ ID NO: 4371025 - DNA, 16 bp, Homo sapiens
aagatgaaagagcagt

SEQ ID NO: 4371026 - DNA, 13 bp, Homo sapiens
aagatgaaatata

SEQ ID NO: 4371027 - DNA, 18 bp, Homo sapiens
aagatgagctgtgcgctg

SEQ ID NO: 4371028 - DNA, 20 bp, Homo sapiens
aagatgatttaatgttgatt

SEQ ID NO: 4371029 - DNA, 20 bp, Homo sapiens
aagatgcaaggaccaggact

SEQ ID NO: 4371030 - DNA, 12 bp, Homo sapiens
aagatgcttggt

SEQ ID NO: 4371031 - DNA, 18 bp, Homo sapiens
aagatggagggggctggg

SEQ ID NO: 4371032 - DNA, 20 bp, Homo sapiens
aagatggagggggctggggt

SEQ ID NO: 4371033 - DNA, 23 bp, Homo sapiens
aagatggcacttataaccaaagc

SEQ ID NO: 4371034 - DNA, 19 bp, Homo sapiens
aagatggcataacctgtct

SEQ ID NO: 4371035 - DNA, 15 bp, Homo sapiens
aagatggcttttcct

SEQ ID NO: 4371036 - DNA, 13 bp, Homo sapiens
aagatgggacagc

SEQ ID NO: 4371037 - DNA, 12 bp, Homo sapiens
aagatgtacatt

SEQ ID NO: 4371038 - DNA, 14 bp, Homo sapiens
aagatgtacattta

SEQ ID NO: 4371039 - DNA, 15 bp, Homo sapiens
aagatgtacatttaa

SEQ ID NO: 4371040 - DNA, 19 bp, Homo sapiens
aagatgtacatttaataat

SEQ ID NO: 4371041 - DNA, 22 bp, Homo sapiens
aagatgtagaggagaaactgga

SEQ ID NO: 4371042 - DNA, 21 bp, Homo sapiens
aagatgtagcgctttgaatat

SEQ ID NO: 4371043 - DNA, 11 bp, Homo sapiens
aagatgtgaat

SEQ ID NO: 4371044 - DNA, 18 bp, Homo sapiens
aagatgtgtaaacaggta

SEQ ID NO: 4371045 - DNA, 15 bp, Homo sapiens
aagatgtgttcttat

SEQ ID NO: 4371046 - DNA, 19 bp, Homo sapiens
aagatgtttcattttactg

SEQ ID NO: 4371047 - DNA, 21 bp, Homo sapiens
aagatgtttgtttacataaga

SEQ ID NO: 4371048 - DNA, 21 bp, Homo sapiens
aagattaataagatttttcaa

SEQ ID NO: 4371049 - DNA, 22 bp, Homo sapiens
aagattaataagatttttcaaa

SEQ ID NO: 4371050 - DNA, 20 bp, Homo sapiens
aagattacaaatcagaagtc

SEQ ID NO: 4371051 - DNA, 14 bp, Homo sapiens
aagattcccagaga

SEQ ID NO: 4371052 - DNA, 18 bp, Homo sapiens
aagattcccagagacagg

SEQ ID NO: 4371053 - DNA, 17 bp, Homo sapiens
aagattctctgcccagc

SEQ ID NO: 4371054 - DNA, 23 bp, Homo sapiens
aagattctgtgtcagagcccagc

SEQ ID NO: 4371055 - DNA, 17 bp, Homo sapiens
aagattcttttaaatta

SEQ ID NO: 4371056 - DNA, 15 bp, Homo sapiens
aagattgagaagcca

SEQ ID NO: 4371057 - DNA, 12 bp, Homo sapiens
aagattgctgaa

SEQ ID NO: 4371058 - DNA, 15 bp, Homo sapiens
aagattgctgaaatt

SEQ ID NO: 4371059 - DNA, 20 bp, Homo sapiens
aagattggttgcctctgcct

SEQ ID NO: 4371060 - DNA, 21 bp, Homo sapiens
aagattgtccttttctcccat

SEQ ID NO: 4371061 - DNA, 19 bp, Homo sapiens
aagatttaaaattaaattt

SEQ ID NO: 4371062 - DNA, 15 bp, Homo sapiens
aagatttcatatcta

SEQ ID NO: 4371063 - DNA, 16 bp, Homo sapiens
aagatttcatatctaa

SEQ ID NO: 4371064 - DNA, 17 bp, Homo sapiens
aagatttggaagctctt

SEQ ID NO: 4371065 - DNA, 16 bp, Homo sapiens
aagatttgtgaactgg

SEQ ID NO: 4371066 - DNA, 20 bp, Homo sapiens
aagatttgtgaactggaaga

SEQ ID NO: 4371067 - DNA, 12 bp, Homo sapiens
aagatttttaaa

SEQ ID NO: 4371068 - DNA, 17 bp, Homo sapiens
aagatttttcaaaatcg

SEQ ID NO: 4371069 - DNA, 16 bp, Homo sapiens
aagattttttaataat

SEQ ID NO: 4371070 - DNA, 17 bp, Homo sapiens
aagattttttaataatt

SEQ ID NO: 4371071 - DNA, 15 bp, Homo sapiens
aagcaaaaaagaaaa

SEQ ID NO: 4371072 - DNA, 14 bp, Homo sapiens
aagcaaaaggctga

SEQ ID NO: 4371073 - DNA, 14 bp, Homo sapiens
aagcaaaagtaatc

SEQ ID NO: 4371074 - DNA, 16 bp, Homo sapiens
aagcaaaataaaaact

SEQ ID NO: 4371075 - DNA, 13 bp, Homo sapiens
aagcaaaatgtga

SEQ ID NO: 4371076 - DNA, 21 bp, Homo sapiens
aagcaaagcacccatttcaat

SEQ ID NO: 4371077 - DNA, 13 bp, Homo sapiens
aagcaaatactta

SEQ ID NO: 4371078 - DNA, 14 bp, Homo sapiens
aagcaaatcatttg

SEQ ID NO: 4371079 - DNA, 18 bp, Homo sapiens
aagcaaatcgaatgaaat

SEQ ID NO: 4371080 - DNA, 22 bp, Homo sapiens
aagcaacaaccttaaaggccgt

SEQ ID NO: 4371081 - DNA, 15 bp, Homo sapiens
aagcaacctcagtaa

SEQ ID NO: 4371082 - DNA, 21 bp, Homo sapiens
aagcaacctcagtaatttaga

SEQ ID NO: 4371083 - DNA, 22 bp, Homo sapiens
aagcaacctcagtaatttagaa

SEQ ID NO: 4371084 - DNA, 14 bp, Homo sapiens
aagcaacctttccc

SEQ ID NO: 4371085 - DNA, 17 bp, Homo sapiens
aagcaacctttcccttc

SEQ ID NO: 4371086 - DNA, 16 bp, Homo sapiens
aagcaacttgcttcta

SEQ ID NO: 4371087 - DNA, 18 bp, Homo sapiens
aagcaacttgcttctaaa

SEQ ID NO: 4371088 - DNA, 22 bp, Homo sapiens
aagcaacttgcttctaaatgcc

SEQ ID NO: 4371089 - DNA, 23 bp, Homo sapiens
aagcaagaatcagagaaggaaca

SEQ ID NO: 4371090 - DNA, 12 bp, Homo sapiens
aagcaagccaga

SEQ ID NO: 4371091 - DNA, 13 bp, Homo sapiens
aagcaagcttaat

SEQ ID NO: 4371092 - DNA, 15 bp, Homo sapiens
aagcaagtatattta

SEQ ID NO: 4371093 - DNA, 19 bp, Homo sapiens
aagcaatatgcatttaaat

SEQ ID NO: 4371094 - DNA, 14 bp, Homo sapiens
aagcaatcatttta

SEQ ID NO: 4371095 - DNA, 16 bp, Homo sapiens
aagcaatcctcctgcc

SEQ ID NO: 4371096 - DNA, 16 bp, Homo sapiens
aagcaatctttgaaat

SEQ ID NO: 4371097 - DNA, 18 bp, Homo sapiens
aagcaatctttgaaataa

SEQ ID NO: 4371098 - DNA, 13 bp, Homo sapiens
aagcaattatatt

SEQ ID NO: 4371099 - DNA, 16 bp, Homo sapiens
aagcaattccaacctt

SEQ ID NO: 4371100 - DNA, 20 bp, Homo sapiens
aaggattcagttttgcttat

SEQ ID NO: 4371101 - DNA, 20 bp, Homo sapiens
aaggattctgaagttttatt

SEQ ID NO: 4371102 - DNA, 22 bp, Homo sapiens
aaggattctgttctgcaactcc

SEQ ID NO: 4371103 - DNA, 18 bp, Homo sapiens
aaggattttaccaaagca

SEQ ID NO: 4371104 - DNA, 20 bp, Homo sapiens
aaggattttaccaaagcatc

SEQ ID NO: 4371105 - DNA, 13 bp, Homo sapiens
aaggcaaaaatag

SEQ ID NO: 4371106 - DNA, 15 bp, Homo sapiens
aaggcaaaaatgtaa

SEQ ID NO: 4371107 - DNA, 17 bp, Homo sapiens
aaggcaaagtttacaga

SEQ ID NO: 4371108 - DNA, 19 bp, Homo sapiens
aaggcacccatctgtctgc

SEQ ID NO: 4371109 - DNA, 12 bp, Homo sapiens
aaggcaccttct

SEQ ID NO: 4371110 - DNA, 15 bp, Homo sapiens
aaggcagagaaatct

SEQ ID NO: 4371111 - DNA, 14 bp, Homo sapiens
aaggcagcattcca

SEQ ID NO: 4371112 - DNA, 16 bp, Homo sapiens
aaggcagccacagaca

SEQ ID NO: 4371113 - DNA, 11 bp, Homo sapiens
aaggcagctgc

SEQ ID NO: 4371114 - DNA, 17 bp, Homo sapiens
aaggcagctgcctctgc

SEQ ID NO: 4371115 - DNA, 16 bp, Homo sapiens
aaggcaggaatgtgtg

SEQ ID NO: 4371116 - DNA, 20 bp, Homo sapiens
aaggcaggggaatgtatgtg

SEQ ID NO: 4371117 - DNA, 13 bp, Homo sapiens
aaggcaggtttca

SEQ ID NO: 4371118 - DNA, 19 bp, Homo sapiens
aaggcaggtttcatttctt

SEQ ID NO: 4371119 - DNA, 21 bp, Homo sapiens
aaggcatacgagagcagaggt

SEQ ID NO: 4371120 - DNA, 22 bp, Homo sapiens
aaggcatacgagagcagaggtc

SEQ ID NO: 4371121 - DNA, 13 bp, Homo sapiens
aaggcatgtttta

SEQ ID NO: 4371122 - DNA, 15 bp, Homo sapiens
aaggccaaggtgctg

SEQ ID NO: 4371123 - DNA, 21 bp, Homo sapiens
aaggccaattcctatacgcag

SEQ ID NO: 4371124 - DNA, 20 bp, Homo sapiens
aaggccacaaaagttccctc

SEQ ID NO: 4371125 - DNA, 23 bp, Homo sapiens
aaggccacaaaagttccctctca

SEQ ID NO: 4371126 - DNA, 19 bp, Homo sapiens
aaggccagagtggcctggc

SEQ ID NO: 4371127 - DNA, 20 bp, Homo sapiens
aaggccagagtggcctggcc

SEQ ID NO: 4371128 - DNA, 23 bp, Homo sapiens
aaggccagagtggcctggccagg

SEQ ID NO: 4371129 - DNA, 21 bp, Homo sapiens
aaggccagtccccatttctgc

SEQ ID NO: 4371130 - DNA, 18 bp, Homo sapiens
aaggccataaaacaggta

SEQ ID NO: 4371131 - DNA, 24 bp, Homo sapiens
aaggccataaaacaggtaatataa

SEQ ID NO: 4371132 - DNA, 14 bp, Homo sapiens
aaggcccagaagcc

SEQ ID NO: 4371133 - DNA, 18 bp, Homo sapiens
aaggccccaaggtttaca

SEQ ID NO: 4371134 - DNA, 17 bp, Homo sapiens
aaggccccagagagacc

SEQ ID NO: 4371135 - DNA, 14 bp, Homo sapiens
aaggccccctacgc

SEQ ID NO: 4371136 - DNA, 16 bp, Homo sapiens
aaggccgtgtctctga

SEQ ID NO: 4371137 - DNA, 13 bp, Homo sapiens
aaggcctcttgta

SEQ ID NO: 4371138 - DNA, 14 bp, Homo sapiens
aaggcctgagcccc

SEQ ID NO: 4371139 - DNA, 21 bp, Homo sapiens
aaggccttttatgtaatttct

SEQ ID NO: 4371140 - DNA, 16 bp, Homo sapiens
aaggcgggctgaggag

SEQ ID NO: 4371141 - DNA, 16 bp, Homo sapiens
aaggctaaaaagcaac

SEQ ID NO: 4371142 - DNA, 15 bp, Homo sapiens
aaggctcatttaaaa

SEQ ID NO: 4371143 - DNA, 17 bp, Homo sapiens
aaggctcatttaaaaca

SEQ ID NO: 4371144 - DNA, 14 bp, Homo sapiens
aaggctctcacccc

SEQ ID NO: 4371145 - DNA, 15 bp, Homo sapiens
aaggctctctctgtc

SEQ ID NO: 4371146 - DNA, 17 bp, Homo sapiens
aaggctctctctgtccc

SEQ ID NO: 4371147 - DNA, 22 bp, Homo sapiens
aaggctgagacagtgaatttgg

SEQ ID NO: 4371148 - DNA, 23 bp, Homo sapiens
aaggctgctcacaagttctattt

SEQ ID NO: 4371149 - DNA, 20 bp, Homo sapiens
aaggctggtaagagaagtga

SEQ ID NO: 4371150 - DNA, 23 bp, Homo sapiens
aaggctgttctttaaatgtctga

SEQ ID NO: 4371151 - DNA, 15 bp, Homo sapiens
aagggaaaaatatat

SEQ ID NO: 4371152 - DNA, 18 bp, Homo sapiens
aagggaaaaatcaagttt

SEQ ID NO: 4371153 - DNA, 23 bp, Homo sapiens
aagggaaaacaaatatttcactt

SEQ ID NO: 4371154 - DNA, 17 bp, Homo sapiens
aagggaaactgccagca

SEQ ID NO: 4371155 - DNA, 15 bp, Homo sapiens
aagggaaactggctg

SEQ ID NO: 4371156 - DNA, 17 bp, Homo sapiens
aagggaaagcgggcagc

SEQ ID NO: 4371157 - DNA, 19 bp, Homo sapiens
aagggaaagcgggcagccc

SEQ ID NO: 4371158 - DNA, 17 bp, Homo sapiens
aagggaagagcctttat

SEQ ID NO: 4371159 - DNA, 16 bp, Homo sapiens
aagggaataaaatctg

SEQ ID NO: 4371160 - DNA, 19 bp, Homo sapiens
aagggaccagcccttcatg

SEQ ID NO: 4371161 - DNA, 13 bp, Homo sapiens
aagggagaaatgc

SEQ ID NO: 4371162 - DNA, 15 bp, Homo sapiens
aagggagaaatgcca

SEQ ID NO: 4371163 - DNA, 12 bp, Homo sapiens
aagggagaagaa

SEQ ID NO: 4371164 - DNA, 23 bp, Homo sapiens
aagggagaagacaacagaaagag

SEQ ID NO: 4371165 - DNA, 16 bp, Homo sapiens
aagggatcctgcctgc

SEQ ID NO: 4371166 - DNA, 16 bp, Homo sapiens
aagggatgtatttgta

SEQ ID NO: 4371167 - DNA, 20 bp, Homo sapiens
aagggcaacagatcagtaaa

SEQ ID NO: 4371168 - DNA, 19 bp, Homo sapiens
aagggcagaacactaacct

SEQ ID NO: 4371169 - DNA, 21 bp, Homo sapiens
aagggcaggaaggagagcctg

SEQ ID NO: 4371170 - DNA, 22 bp, Homo sapiens
aagggcaggaaggagagcctgc

SEQ ID NO: 4371171 - DNA, 14 bp, Homo sapiens
aagggcattttaaa

SEQ ID NO: 4371172 - DNA, 16 bp, Homo sapiens
aagggccagtcctgcc

SEQ ID NO: 4371173 - DNA, 19 bp, Homo sapiens
aagggctagaacctggagg

SEQ ID NO: 4371174 - DNA, 19 bp, Homo sapiens
aagggctgagaggaagcaa

SEQ ID NO: 4371175 - DNA, 13 bp, Homo sapiens
aagggctggctcc

SEQ ID NO: 4371176 - DNA, 23 bp, Homo sapiens
aagggctggctccccctccccag

SEQ ID NO: 4371177 - DNA, 12 bp, Homo sapiens
aagggctgggcc

SEQ ID NO: 4371178 - DNA, 14 bp, Homo sapiens
aaggggactaaagt

SEQ ID NO: 4371179 - DNA, 19 bp, Homo sapiens
aaggggagagcctgctggc

SEQ ID NO: 4371180 - DNA, 21 bp, Homo sapiens
aagggggtgacctcttgcctc

SEQ ID NO: 4371181 - DNA, 17 bp, Homo sapiens
aagggggtggtgtctcc

SEQ ID NO: 4371182 - DNA, 17 bp, Homo sapiens
aaggggtcaaaatttgc

SEQ ID NO: 4371183 - DNA, 18 bp, Homo sapiens
aaggggttcctcaaattt

SEQ ID NO: 4371184 - DNA, 22 bp, Homo sapiens
aagggtcactggcctctcccca

SEQ ID NO: 4371185 - DNA, 22 bp, Homo sapiens
aagggtcagaggacctgtattt

SEQ ID NO: 4371186 - DNA, 22 bp, Homo sapiens
aagggtctagggagagaccctt

SEQ ID NO: 4371187 - DNA, 19 bp, Homo sapiens
aagggtggatgtgctggag

SEQ ID NO: 4371188 - DNA, 22 bp, Homo sapiens
aagggtggatgtgctggagggg

SEQ ID NO: 4371189 - DNA, 21 bp, Homo sapiens
aagggtgttgggagggtggtt

SEQ ID NO: 4371190 - DNA, 15 bp, Homo sapiens
aagggttgagagcca

SEQ ID NO: 4371191 - DNA, 18 bp, Homo sapiens
aagggttgagagccagtg

SEQ ID NO: 4371192 - DNA, 14 bp, Homo sapiens
aagggtttctctat

SEQ ID NO: 4371193 - DNA, 15 bp, Homo sapiens
aagggtttgtaatac

SEQ ID NO: 4371194 - DNA, 20 bp, Homo sapiens
aagggtttgtaatactttac

SEQ ID NO: 4371195 - DNA, 20 bp, Homo sapiens
aagggtttgtggctgggggc

SEQ ID NO: 4371196 - DNA, 17 bp, Homo sapiens
aaggtaaatcccacatc

SEQ ID NO: 4371197 - DNA, 18 bp, Homo sapiens
aaggtaagctcaggatat

SEQ ID NO: 4371198 - DNA, 19 bp, Homo sapiens
aaggtacaagaagcatttt

SEQ ID NO: 4371199 - DNA, 13 bp, Homo sapiens
aaggtagatttta

SEQ ID NO: 4371200 - DNA, 18 bp, Homo sapiens
aaggtagcattctttgga

SEQ ID NO: 4371201 - DNA, 19 bp, Homo sapiens
aaggtcaccagcaccaaca

SEQ ID NO: 4371202 - DNA, 13 bp, Homo sapiens
aaggtcagaacag

SEQ ID NO: 4371203 - DNA, 14 bp, Homo sapiens
aaggtcctctcagt

SEQ ID NO: 4371204 - DNA, 14 bp, Homo sapiens
aaggtcctcttgaa

SEQ ID NO: 4371205 - DNA, 20 bp, Homo sapiens
aaggtcctcttgaaatgtta

SEQ ID NO: 4371206 - DNA, 24 bp, Homo sapiens
aaggtcctgctcaactctacccct

SEQ ID NO: 4371207 - DNA, 13 bp, Homo sapiens
aaggtctgagcca

SEQ ID NO: 4371208 - DNA, 18 bp, Homo sapiens
aaggtctttcagtacttt

SEQ ID NO: 4371209 - DNA, 12 bp, Homo sapiens
aaggtcttttga

SEQ ID NO: 4371210 - DNA, 18 bp, Homo sapiens
aaggtcttttgagggcta

SEQ ID NO: 4371211 - DNA, 20 bp, Homo sapiens
aaggtgacatcggaaaaata

SEQ ID NO: 4371212 - DNA, 17 bp, Homo sapiens
aaggtgagcataaatca

SEQ ID NO: 4371213 - DNA, 19 bp, Homo sapiens
aaggtgataagggaaaaga

SEQ ID NO: 4371214 - DNA, 13 bp, Homo sapiens
aaggtgatgttgt

SEQ ID NO: 4371215 - DNA, 11 bp, Homo sapiens
aaggtgcctgt

SEQ ID NO: 4371216 - DNA, 20 bp, Homo sapiens
aaggtgcctgtgaggcaggg

SEQ ID NO: 4371217 - DNA, 14 bp, Homo sapiens
aaggtgctaacata

SEQ ID NO: 4371218 - DNA, 14 bp, Homo sapiens
aagtgattgtgaag

SEQ ID NO: 4371219 - DNA, 20 bp, Homo sapiens
aagtgcaatgcgtgttgtac

SEQ ID NO: 4371220 - DNA, 14 bp, Homo sapiens
aagtgccaaacaga

SEQ ID NO: 4371221 - DNA, 16 bp, Homo sapiens
aagtgccagcattcca

SEQ ID NO: 4371222 - DNA, 22 bp, Homo sapiens
aagtgccataaccatgagcact

SEQ ID NO: 4371223 - DNA, 15 bp, Homo sapiens
aagtgccgcaaattg

SEQ ID NO: 4371224 - DNA, 16 bp, Homo sapiens
aagtgccgcaaattgt

SEQ ID NO: 4371225 - DNA, 23 bp, Homo sapiens
aagtgcctcacatttttttctac

SEQ ID NO: 4371226 - DNA, 14 bp, Homo sapiens
aagtgctgaaaatg

SEQ ID NO: 4371227 - DNA, 14 bp, Homo sapiens
aagtgctgcactca

SEQ ID NO: 4371228 - DNA, 17 bp, Homo sapiens
aagtgctgtttattaat

SEQ ID NO: 4371229 - DNA, 23 bp, Homo sapiens
aagtgcttgcagatcatctgggg

SEQ ID NO: 4371230 - DNA, 14 bp, Homo sapiens
aagtggaaatttat

SEQ ID NO: 4371231 - DNA, 22 bp, Homo sapiens
aagtggcaatctcagatgcagt

SEQ ID NO: 4371232 - DNA, 14 bp, Homo sapiens
aagtggctgctgac

SEQ ID NO: 4371233 - DNA, 21 bp, Homo sapiens
aagtgggccaggacaggcccg

SEQ ID NO: 4371234 - DNA, 12 bp, Homo sapiens
aagtgggcttga

SEQ ID NO: 4371235 - DNA, 18 bp, Homo sapiens
aagtggggagagagccct

SEQ ID NO: 4371236 - DNA, 17 bp, Homo sapiens
aagtggggctaaatgaa

SEQ ID NO: 4371237 - DNA, 15 bp, Homo sapiens
aagtgggggtggagg

SEQ ID NO: 4371238 - DNA, 16 bp, Homo sapiens
aagtgggggtggagga

SEQ ID NO: 4371239 - DNA, 23 bp, Homo sapiens
aagtgggggtggaggaccgaggc

SEQ ID NO: 4371240 - DNA, 16 bp, Homo sapiens
aagtggtaaatactgt

SEQ ID NO: 4371241 - DNA, 18 bp, Homo sapiens
aagtggtaaatactgtga

SEQ ID NO: 4371242 - DNA, 15 bp, Homo sapiens
aagtgtaaatgaagt

SEQ ID NO: 4371243 - DNA, 21 bp, Homo sapiens
aagtgtaaatgaagtacagta

SEQ ID NO: 4371244 - DNA, 11 bp, Homo sapiens
aagtgtacaga

SEQ ID NO: 4371245 - DNA, 19 bp, Homo sapiens
aagtgtacagactcttcac

SEQ ID NO: 4371246 - DNA, 14 bp, Homo sapiens
aagtgtatctcctt

SEQ ID NO: 4371247 - DNA, 17 bp, Homo sapiens
aagtgtcaactctttgt

SEQ ID NO: 4371248 - DNA, 15 bp, Homo sapiens
aagtgtcttaaattt

SEQ ID NO: 4371249 - DNA, 15 bp, Homo sapiens
aagtgtcttttaaac

SEQ ID NO: 4371250 - DNA, 12 bp, Homo sapiens
aagtgtggctgg

SEQ ID NO: 4371251 - DNA, 10 bp, Homo sapiens
aagtgtgggt

SEQ ID NO: 4371252 - DNA, 12 bp, Homo sapiens
aagtgtgtttgc

SEQ ID NO: 4371253 - DNA, 17 bp, Homo sapiens
aagtgttaatacatcac

SEQ ID NO: 4371254 - DNA, 23 bp, Homo sapiens
aagtgttgagccatgctacagtt

SEQ ID NO: 4371255 - DNA, 13 bp, Homo sapiens
aagtgttttcaga

SEQ ID NO: 4371256 - DNA, 15 bp, Homo sapiens
aagtgttttcagagc

SEQ ID NO: 4371257 - DNA, 19 bp, Homo sapiens
aagtgttttgtattttata

SEQ ID NO: 4371258 - DNA, 23 bp, Homo sapiens
aagtgttttgtattttatagtga

SEQ ID NO: 4371259 - DNA, 22 bp, Homo sapiens
aagttaatcagaaagaaaaaat

SEQ ID NO: 4371260 - DNA, 22 bp, Homo sapiens
aagttaatgtatataaaaatgg

SEQ ID NO: 4371261 - DNA, 22 bp, Homo sapiens
aagttagaactagccaaaccag

SEQ ID NO: 4371262 - DNA, 19 bp, Homo sapiens
aagttagtatcttttgata

SEQ ID NO: 4371263 - DNA, 19 bp, Homo sapiens
aagttagtggaaatctgaa

SEQ ID NO: 4371264 - DNA, 12 bp, Homo sapiens
aagttatatttc

SEQ ID NO: 4371265 - DNA, 14 bp, Homo sapiens
aagttatatttcag

SEQ ID NO: 4371266 - DNA, 17 bp, Homo sapiens
aagttatatttcagatg

SEQ ID NO: 4371267 - DNA, 14 bp, Homo sapiens
aagttatgtattta

SEQ ID NO: 4371268 - DNA, 17 bp, Homo sapiens
aagttattgcagtttat

SEQ ID NO: 4371269 - DNA, 23 bp, Homo sapiens
aagttattgcagtttatcattca

SEQ ID NO: 4371270 - DNA, 14 bp, Homo sapiens
aagttattttacct

SEQ ID NO: 4371271 - DNA, 14 bp, Homo sapiens
aagttattttctac

SEQ ID NO: 4371272 - DNA, 15 bp, Homo sapiens
aagttcagatgtttc

SEQ ID NO: 4371273 - DNA, 15 bp, Homo sapiens
aagttccattatgaa

SEQ ID NO: 4371274 - DNA, 16 bp, Homo sapiens
aagttccattatgaaa

SEQ ID NO: 4371275 - DNA, 14 bp, Homo sapiens
aagttctataacta

SEQ ID NO: 4371276 - DNA, 19 bp, Homo sapiens
aagttctatttcttgaaga

SEQ ID NO: 4371277 - DNA, 17 bp, Homo sapiens
aagttctgcaaaataca

SEQ ID NO: 4371278 - DNA, 15 bp, Homo sapiens
aagttctttcaacct

SEQ ID NO: 4371279 - DNA, 18 bp, Homo sapiens
aagttgaatattatatat

SEQ ID NO: 4371280 - DNA, 20 bp, Homo sapiens
aagttgacctttatttatta

SEQ ID NO: 4371281 - DNA, 13 bp, Homo sapiens
aagttgagcgtgc

SEQ ID NO: 4371282 - DNA, 19 bp, Homo sapiens
aagttgagtatcccttatc

SEQ ID NO: 4371283 - DNA, 21 bp, Homo sapiens
aagttgattaagaaaggaagt

SEQ ID NO: 4371284 - DNA, 14 bp, Homo sapiens
aagttgattagaaa

SEQ ID NO: 4371285 - DNA, 17 bp, Homo sapiens
aagttgctgcttgtgat

SEQ ID NO: 4371286 - DNA, 17 bp, Homo sapiens
aagttgctgtaaaattt

SEQ ID NO: 4371287 - DNA, 18 bp, Homo sapiens
aagttgctgtaaaatttg

SEQ ID NO: 4371288 - DNA, 21 bp, Homo sapiens
aagttgctgtaaaatttgtgt

SEQ ID NO: 4371289 - DNA, 20 bp, Homo sapiens
aagttggtatcgaaatttgt

SEQ ID NO: 4371290 - DNA, 20 bp, Homo sapiens
aagttggtattaataaaaag

SEQ ID NO: 4371291 - DNA, 17 bp, Homo sapiens
aagttgtaaagtatgta

SEQ ID NO: 4371292 - DNA, 13 bp, Homo sapiens
aagttgtacatga

SEQ ID NO: 4371293 - DNA, 21 bp, Homo sapiens
aagttgtacatgataagacat

SEQ ID NO: 4371294 - DNA, 21 bp, Homo sapiens
aagttgtataggctaaatgtt

SEQ ID NO: 4371295 - DNA, 17 bp, Homo sapiens
aagttgtcaaagaagct

SEQ ID NO: 4371296 - DNA, 21 bp, Homo sapiens
aagttgtcaaagaagcttcca

SEQ ID NO: 4371297 - DNA, 18 bp, Homo sapiens
aagttgtctgtctgaatg

SEQ ID NO: 4371298 - DNA, 17 bp, Homo sapiens
aagttgtgacagtcact

SEQ ID NO: 4371299 - DNA, 15 bp, Homo sapiens
aagttgtgcttgttt

SEQ ID NO: 4371300 - DNA, 22 bp, Homo sapiens
aagttgttctagtaacaataca

SEQ ID NO: 4371301 - DNA, 18 bp, Homo sapiens
aagttgtttatcaacttc

SEQ ID NO: 4371302 - DNA, 12 bp, Homo sapiens
aagtttaaatgt

SEQ ID NO: 4371303 - DNA, 20 bp, Homo sapiens
aagtttaaatgtattttaca

SEQ ID NO: 4371304 - DNA, 14 bp, Homo sapiens
aagtttaataaatt

SEQ ID NO: 4371305 - DNA, 17 bp, Homo sapiens
aagtttaataaatttat

SEQ ID NO: 4371306 - DNA, 18 bp, Homo sapiens
aagtttacaatcaaagga

SEQ ID NO: 4371307 - DNA, 11 bp, Homo sapiens
aagtttagaga

SEQ ID NO: 4371308 - DNA, 15 bp, Homo sapiens
aagtttattgtttga

SEQ ID NO: 4371309 - DNA, 15 bp, Homo sapiens
aagtttcatcatttt

SEQ ID NO: 4371310 - DNA, 17 bp, Homo sapiens
aagtttcgaggggtcct

SEQ ID NO: 4371311 - DNA, 14 bp, Homo sapiens
aagtttctattctg

SEQ ID NO: 4371312 - DNA, 17 bp, Homo sapiens
aagtttctattctgtca

SEQ ID NO: 4371313 - DNA, 13 bp, Homo sapiens
aagtttctcttct

SEQ ID NO: 4371314 - DNA, 17 bp, Homo sapiens
aagtttctggtgccatt

SEQ ID NO: 4371315 - DNA, 20 bp, Homo sapiens
aagtttctggtgccatttct

SEQ ID NO: 4371316 - DNA, 16 bp, Homo sapiens
aagtttctttgcttca

SEQ ID NO: 4371317 - DNA, 14 bp, Homo sapiens
aagttttaacttta

SEQ ID NO: 4371318 - DNA, 17 bp, Homo sapiens
aagttttaactttaata

SEQ ID NO: 4371319 - DNA, 17 bp, Homo sapiens
aagttttagttaaaact

SEQ ID NO: 4371320 - DNA, 23 bp, Homo sapiens
aagttttcagaacctcttcccca

SEQ ID NO: 4371321 - DNA, 17 bp, Homo sapiens
aagttttgcacttttgt

SEQ ID NO: 4371322 - DNA, 16 bp, Homo sapiens
aagttttgtaaaagaa

SEQ ID NO: 4371323 - DNA, 19 bp, Homo sapiens
aagttttgtaaaagaaatc

SEQ ID NO: 4371324 - DNA, 17 bp, Homo sapiens
aagtttttatagttatt

SEQ ID NO: 4371325 - DNA, 18 bp, Homo sapiens
aagtttttcatactgtac

SEQ ID NO: 4371326 - DNA, 22 bp, Homo sapiens
aagtttttcatactgtacacat

SEQ ID NO: 4371327 - DNA, 13 bp, Homo sapiens
aagtttttctctt

SEQ ID NO: 4371328 - DNA, 23 bp, Homo sapiens
aataaaaaagaacttttgtatct

SEQ ID NO: 4371329 - DNA, 15 bp, Homo sapiens
aataaaaaagtctct

SEQ ID NO: 4371330 - DNA, 16 bp, Homo sapiens
aataaaaaatggctga

SEQ ID NO: 4371331 - DNA, 14 bp, Homo sapiens
aataaaaacaaagt

SEQ ID NO: 4371332 - DNA, 19 bp, Homo sapiens
aataaaaactattcgaatg

SEQ ID NO: 4371333 - DNA, 17 bp, Homo sapiens
aataaaaagatcacttt

SEQ ID NO: 4371334 - DNA, 12 bp, Homo sapiens
aataaaaaggaa

SEQ ID NO: 4371335 - DNA, 13 bp, Homo sapiens
aataaaaatggat

SEQ ID NO: 4371336 - DNA, 14 bp, Homo sapiens
aataaaaatgtggt

SEQ ID NO: 4371337 - DNA, 20 bp, Homo sapiens
aatattttttgaaggtttca

SEQ ID NO: 4371338 - DNA, 14 bp, Homo sapiens
aatcaaactctggt

SEQ ID NO: 4371339 - DNA, 16 bp, Homo sapiens
aatcaaatatgcaaag

SEQ ID NO: 4371340 - DNA, 21 bp, Homo sapiens
aatcaaatgaatgattaaatt

SEQ ID NO: 4371341 - DNA, 17 bp, Homo sapiens
aatcaaatgatttcata

SEQ ID NO: 4371342 - DNA, 20 bp, Homo sapiens
aatcaaatgatttcatattg

SEQ ID NO: 4371343 - DNA, 21 bp, Homo sapiens
aatcaaatgatttcatattga

SEQ ID NO: 4371344 - DNA, 16 bp, Homo sapiens
aatcaacatgactggt

SEQ ID NO: 4371345 - DNA, 20 bp, Homo sapiens
aatcaactttttattgcctt

SEQ ID NO: 4371346 - DNA, 10 bp, Homo sapiens
aatcaagaga

SEQ ID NO: 4371347 - DNA, 15 bp, Homo sapiens
aatcaagagaaactt

SEQ ID NO: 4371348 - DNA, 14 bp, Homo sapiens
aatcaagagctgcc

SEQ ID NO: 4371349 - DNA, 16 bp, Homo sapiens
aatcaagagctgccct

SEQ ID NO: 4371350 - DNA, 12 bp, Homo sapiens
aatcaaggaaag

SEQ ID NO: 4371351 - DNA, 22 bp, Homo sapiens
aatcaaggaaaggctcatttaa

SEQ ID NO: 4371352 - DNA, 17 bp, Homo sapiens
aatcaaggttataattt

SEQ ID NO: 4371353 - DNA, 14 bp, Homo sapiens
aatcaatacactag

SEQ ID NO: 4371354 - DNA, 18 bp, Homo sapiens
aatcaatacactagttgt

SEQ ID NO: 4371355 - DNA, 16 bp, Homo sapiens
aatcaatctggcttct

SEQ ID NO: 4371356 - DNA, 21 bp, Homo sapiens
aatcaatctggcttctgcatt

SEQ ID NO: 4371357 - DNA, 18 bp, Homo sapiens
aatcacaaactgaatgac

SEQ ID NO: 4371358 - DNA, 19 bp, Homo sapiens
aatcacaattttcctgtgg

SEQ ID NO: 4371359 - DNA, 17 bp, Homo sapiens
aatcacacgactgtcat

SEQ ID NO: 4371360 - DNA, 15 bp, Homo sapiens
aatcacagaaaattt

SEQ ID NO: 4371361 - DNA, 17 bp, Homo sapiens
aatcacagaaaatttaa

SEQ ID NO: 4371362 - DNA, 23 bp, Homo sapiens
aatcacatattttaaaatttgtt

SEQ ID NO: 4371363 - DNA, 14 bp, Homo sapiens
aatcaccaattaaa

SEQ ID NO: 4371364 - DNA, 17 bp, Homo sapiens
aatcaccaattaaaaac

SEQ ID NO: 4371365 - DNA, 18 bp, Homo sapiens
aatcaccaattaaaaacc

SEQ ID NO: 4371366 - DNA, 15 bp, Homo sapiens
aatcaccatgtaagc

SEQ ID NO: 4371367 - DNA, 23 bp, Homo sapiens
aatcaccatgtaagcactctgga

SEQ ID NO: 4371368 - DNA, 16 bp, Homo sapiens
aatcacccctctgccc

SEQ ID NO: 4371369 - DNA, 21 bp, Homo sapiens
aatcacccctctgcccctgca

SEQ ID NO: 4371370 - DNA, 16 bp, Homo sapiens
aatcaccctaccaact

SEQ ID NO: 4371371 - DNA, 22 bp, Homo sapiens
aatcacctgaaccccagaggca

SEQ ID NO: 4371372 - DNA, 20 bp, Homo sapiens
aatcacgctttttgaaaaag

SEQ ID NO: 4371373 - DNA, 15 bp, Homo sapiens
aatcacgtaaagcta

SEQ ID NO: 4371374 - DNA, 16 bp, Homo sapiens
aatcactaacattata

SEQ ID NO: 4371375 - DNA, 13 bp, Homo sapiens
aatcactgctcca

SEQ ID NO: 4371376 - DNA, 16 bp, Homo sapiens
aatcactgctccaggc

SEQ ID NO: 4371377 - DNA, 18 bp, Homo sapiens
aatcactgttgctttgaa

SEQ ID NO: 4371378 - DNA, 19 bp, Homo sapiens
aatcacttaacattcctaa

SEQ ID NO: 4371379 - DNA, 18 bp, Homo sapiens
aatcagaaagaaaaaatt

SEQ ID NO: 4371380 - DNA, 19 bp, Homo sapiens
aatcagaaagaaaaaattt

SEQ ID NO: 4371381 - DNA, 22 bp, Homo sapiens
aatcagaaagaaaaaattttat

SEQ ID NO: 4371382 - DNA, 24 bp, Homo sapiens
aatcagaagtcatcttgctaccag

SEQ ID NO: 4371383 - DNA, 11 bp, Homo sapiens
aatcagaataa

SEQ ID NO: 4371384 - DNA, 20 bp, Homo sapiens
aatcagaccctaccccacca

SEQ ID NO: 4371385 - DNA, 14 bp, Homo sapiens
aatcagatagatat

SEQ ID NO: 4371386 - DNA, 17 bp, Homo sapiens
aatcagatggtgtcatt

SEQ ID NO: 4371387 - DNA, 19 bp, Homo sapiens
aatcagcatatgtgtaaag

SEQ ID NO: 4371388 - DNA, 15 bp, Homo sapiens
aatcagcgctctgta

SEQ ID NO: 4371389 - DNA, 17 bp, Homo sapiens
aatcagctattttgtga

SEQ ID NO: 4371390 - DNA, 20 bp, Homo sapiens
aatcagctccttcctggaga

SEQ ID NO: 4371391 - DNA, 22 bp, Homo sapiens
aatcagctgcaatccatttatt

SEQ ID NO: 4371392 - DNA, 20 bp, Homo sapiens
aatcagcttttgttctagac

SEQ ID NO: 4371393 - DNA, 16 bp, Homo sapiens
aatcaggtggcttttg

SEQ ID NO: 4371394 - DNA, 16 bp, Homo sapiens
aatcagtagaaagcta

SEQ ID NO: 4371395 - DNA, 22 bp, Homo sapiens
aatcagtatattttctgtattt

SEQ ID NO: 4371396 - DNA, 13 bp, Homo sapiens
aatcagtgataat

SEQ ID NO: 4371397 - DNA, 19 bp, Homo sapiens
aatcagttcattagaaata

SEQ ID NO: 4371398 - DNA, 23 bp, Homo sapiens
aatcagttcattagaaatatttt

SEQ ID NO: 4371399 - DNA, 21 bp, Homo sapiens
aatcatacaaactctcaccat

SEQ ID NO: 4371400 - DNA, 15 bp, Homo sapiens
aatcatacttaacat

SEQ ID NO: 4371401 - DNA, 19 bp, Homo sapiens
aatcatagattattataaa

SEQ ID NO: 4371402 - DNA, 20 bp, Homo sapiens
aatcatccatccttgccaat

SEQ ID NO: 4371403 - DNA, 19 bp, Homo sapiens
aatcatccctccttgccta

SEQ ID NO: 4371404 - DNA, 12 bp, Homo sapiens
aatcatctattt

SEQ ID NO: 4371405 - DNA, 13 bp, Homo sapiens
aatcatctatttt

SEQ ID NO: 4371406 - DNA, 15 bp, Homo sapiens
aatcatctattttga

SEQ ID NO: 4371407 - DNA, 23 bp, Homo sapiens
aatcatctattttgatgcagcat

SEQ ID NO: 4371408 - DNA, 16 bp, Homo sapiens
aatcatcttataatta

SEQ ID NO: 4371409 - DNA, 17 bp, Homo sapiens
aatcatcttataattag

SEQ ID NO: 4371410 - DNA, 18 bp, Homo sapiens
aatcatgaagtaaattga

SEQ ID NO: 4371411 - DNA, 20 bp, Homo sapiens
aatcatgaagtaaattgaaa

SEQ ID NO: 4371412 - DNA, 23 bp, Homo sapiens
aatcatgacttatcccattttca

SEQ ID NO: 4371413 - DNA, 12 bp, Homo sapiens
aatcatgctcat

SEQ ID NO: 4371414 - DNA, 19 bp, Homo sapiens
aatcatgtccatacacttt

SEQ ID NO: 4371415 - DNA, 12 bp, Homo sapiens
aatcatgtttta

SEQ ID NO: 4371416 - DNA, 20 bp, Homo sapiens
aatcattatttattaaattt

SEQ ID NO: 4371417 - DNA, 12 bp, Homo sapiens
aatcattatttg

SEQ ID NO: 4371418 - DNA, 13 bp, Homo sapiens
aatcattccttcc

SEQ ID NO: 4371419 - DNA, 19 bp, Homo sapiens
aatcattgttttgaatatt

SEQ ID NO: 4371420 - DNA, 13 bp, Homo sapiens
aatcatttattca

SEQ ID NO: 4371421 - DNA, 12 bp, Homo sapiens
aatcatttctat

SEQ ID NO: 4371422 - DNA, 19 bp, Homo sapiens
aatcatttctatttctcct

SEQ ID NO: 4371423 - DNA, 22 bp, Homo sapiens
aatcatttctgcatcagctgct

SEQ ID NO: 4371424 - DNA, 14 bp, Homo sapiens
aatcatttggttaa

SEQ ID NO: 4371425 - DNA, 11 bp, Homo sapiens
aatcattttaa

SEQ ID NO: 4371426 - DNA, 15 bp, Homo sapiens
aatcattttaaattc

SEQ ID NO: 4371427 - DNA, 14 bp, Homo sapiens
aatcattttagaat

SEQ ID NO: 4371428 - DNA, 18 bp, Homo sapiens
aatcattttagaattaaa

SEQ ID NO: 4371429 - DNA, 21 bp, Homo sapiens
aatcattttagaattaaaatt

SEQ ID NO: 4371430 - DNA, 14 bp, Homo sapiens
aatcattttatgct

SEQ ID NO: 4371431 - DNA, 22 bp, Homo sapiens
aatccaagggttgagagccagt

SEQ ID NO: 4371432 - DNA, 23 bp, Homo sapiens
aatccaagggttgagagccagtg

SEQ ID NO: 4371433 - DNA, 22 bp, Homo sapiens
aatccaataaaaacattttgaa

SEQ ID NO: 4371434 - DNA, 18 bp, Homo sapiens
aatccaccttcaggcccc

SEQ ID NO: 4371435 - DNA, 14 bp, Homo sapiens
aatccactaacact

SEQ ID NO: 4371436 - DNA, 15 bp, Homo sapiens
aatccactaacactt

SEQ ID NO: 4371437 - DNA, 13 bp, Homo sapiens
aatccaggctgtt

SEQ ID NO: 4371438 - DNA, 14 bp, Homo sapiens
aatccatcttgctt

SEQ ID NO: 4371439 - DNA, 19 bp, Homo sapiens
aatccatcttgctttttcc

SEQ ID NO: 4371440 - DNA, 21 bp, Homo sapiens
aatccattcacaagcctcctg

SEQ ID NO: 4371441 - DNA, 22 bp, Homo sapiens
aatcccaaatcctatttaaaga

SEQ ID NO: 4371442 - DNA, 16 bp, Homo sapiens
aatcccaccttcccac

SEQ ID NO: 4371443 - DNA, 11 bp, Homo sapiens
aatcccagcta

SEQ ID NO: 4371444 - DNA, 18 bp, Homo sapiens
aatcccagctactcagga

SEQ ID NO: 4371445 - DNA, 15 bp, Homo sapiens
aatcccccttgccac

SEQ ID NO: 4371446 - DNA, 14 bp, Homo sapiens
aatcccctcattca

SEQ ID NO: 4371447 - DNA, 19 bp, Homo sapiens
aatcccctcattcaggaaa

SEQ ID NO: 4371448 - DNA, 13 bp, Homo sapiens
aatccctgctttt

SEQ ID NO: 4371449 - DNA, 22 bp, Homo sapiens
aatccctgctttttgtgttttt

SEQ ID NO: 4371450 - DNA, 18 bp, Homo sapiens
aatcccttaacagttgta

SEQ ID NO: 4371451 - DNA, 21 bp, Homo sapiens
aatcccttaatatcctaaaca

SEQ ID NO: 4371452 - DNA, 17 bp, Homo sapiens
aatcccttttatctatt

SEQ ID NO: 4371453 - DNA, 19 bp, Homo sapiens
aatccgtattgaatttgtg

SEQ ID NO: 4371454 - DNA, 24 bp, Homo sapiens
aatcctaatttctcctcccttcct

SEQ ID NO: 4371455 - DNA, 20 bp, Homo sapiens
aatggagattcagttttcat

SEQ ID NO: 4371456 - DNA, 22 bp, Homo sapiens
aatggagctcagtaacataact

SEQ ID NO: 4371457 - DNA, 13 bp, Homo sapiens
aatggaggcagag

SEQ ID NO: 4371458 - DNA, 17 bp, Homo sapiens
aatggaggccattgtgt

SEQ ID NO: 4371459 - DNA, 17 bp, Homo sapiens
aatggatacataaagac

SEQ ID NO: 4371460 - DNA, 22 bp, Homo sapiens
aatggatgccttgaataataag

SEQ ID NO: 4371461 - DNA, 18 bp, Homo sapiens
aatggattgttaatttca

SEQ ID NO: 4371462 - DNA, 19 bp, Homo sapiens
aatggattgttaatttcag

SEQ ID NO: 4371463 - DNA, 13 bp, Homo sapiens
aatggatttttct

SEQ ID NO: 4371464 - DNA, 17 bp, Homo sapiens
aatggatttttctttaa

SEQ ID NO: 4371465 - DNA, 18 bp, Homo sapiens
aatggccagagcctctgg

SEQ ID NO: 4371466 - DNA, 19 bp, Homo sapiens
aatggccagagcctctggc

SEQ ID NO: 4371467 - DNA, 17 bp, Homo sapiens
aatggccttcatatcat

SEQ ID NO: 4371468 - DNA, 22 bp, Homo sapiens
aatggcgcgatctcagctcacc

SEQ ID NO: 4371469 - DNA, 20 bp, Homo sapiens
aatggcgtctggaagtccaa

SEQ ID NO: 4371470 - DNA, 16 bp, Homo sapiens
aatggctatgaacaga

SEQ ID NO: 4371471 - DNA, 16 bp, Homo sapiens
aatggctatgttttta

SEQ ID NO: 4371472 - DNA, 15 bp, Homo sapiens
aatggctgataattt

SEQ ID NO: 4371473 - DNA, 18 bp, Homo sapiens
aatggcttgtctttgcta

SEQ ID NO: 4371474 - DNA, 23 bp, Homo sapiens
aatgggagaaaacgccagtgtgt

SEQ ID NO: 4371475 - DNA, 14 bp, Homo sapiens
aatgggctcaaact

SEQ ID NO: 4371476 - DNA, 15 bp, Homo sapiens
aatgggtcatgacaa

SEQ ID NO: 4371477 - DNA, 15 bp, Homo sapiens
aatgggtcttttata

SEQ ID NO: 4371478 - DNA, 23 bp, Homo sapiens
aatgggtcttttataggaaaaaa

SEQ ID NO: 4371479 - DNA, 13 bp, Homo sapiens
aatgggtgatatg

SEQ ID NO: 4371480 - DNA, 22 bp, Homo sapiens
aatggtaaaataaaatgcctca

SEQ ID NO: 4371481 - DNA, 20 bp, Homo sapiens
aatggtaacatttttcaata

SEQ ID NO: 4371482 - DNA, 20 bp, Homo sapiens
aatggtaggtcaagtaataa

SEQ ID NO: 4371483 - DNA, 23 bp, Homo sapiens
aatggtcacgtttggtgcttctc

SEQ ID NO: 4371484 - DNA, 19 bp, Homo sapiens
aatggtccaggagaaggcc

SEQ ID NO: 4371485 - DNA, 15 bp, Homo sapiens
aatggtggcttcttt

SEQ ID NO: 4371486 - DNA, 14 bp, Homo sapiens
aatggttgtacata

SEQ ID NO: 4371487 - DNA, 22 bp, Homo sapiens
aatggtttctcattaaactcta

SEQ ID NO: 4371488 - DNA, 18 bp, Homo sapiens
aatggtttttatttctcg

SEQ ID NO: 4371489 - DNA, 22 bp, Homo sapiens
aatgtaaaaatccttttgaatg

SEQ ID NO: 4371490 - DNA, 17 bp, Homo sapiens
aatgtaaaaatgaagga

SEQ ID NO: 4371491 - DNA, 20 bp, Homo sapiens
aatgtaaaggagtcaaaact

SEQ ID NO: 4371492 - DNA, 17 bp, Homo sapiens
aatgtaaagttatgtat

SEQ ID NO: 4371493 - DNA, 15 bp, Homo sapiens
aatgtaaataaaaca

SEQ ID NO: 4371494 - DNA, 14 bp, Homo sapiens
aatgtaaataaact

SEQ ID NO: 4371495 - DNA, 19 bp, Homo sapiens
aatgtaaataaactattta

SEQ ID NO: 4371496 - DNA, 22 bp, Homo sapiens
aatgtaaataaactatttatat

SEQ ID NO: 4371497 - DNA, 16 bp, Homo sapiens
aatgtaaatattttaa

SEQ ID NO: 4371498 - DNA, 21 bp, Homo sapiens
aatgtaaatattttaaagaat

SEQ ID NO: 4371499 - DNA, 20 bp, Homo sapiens
aatgtaactgtccgtagtat

SEQ ID NO: 4371500 - DNA, 14 bp, Homo sapiens
aatgtaataaagtg

SEQ ID NO: 4371501 - DNA, 23 bp, Homo sapiens
aatgtaataaagtgaactttgtt

SEQ ID NO: 4371502 - DNA, 15 bp, Homo sapiens
aatgtaatataatgt

SEQ ID NO: 4371503 - DNA, 18 bp, Homo sapiens
aatgtaattaaactgtta

SEQ ID NO: 4371504 - DNA, 19 bp, Homo sapiens
aatgtaattaaactgttaa

SEQ ID NO: 4371505 - DNA, 18 bp, Homo sapiens
aatgtaatttcagttcta

SEQ ID NO: 4371506 - DNA, 16 bp, Homo sapiens
aatgtaatttgtgtaa

SEQ ID NO: 4371507 - DNA, 17 bp, Homo sapiens
aatgtaatttgtgtaat

SEQ ID NO: 4371508 - DNA, 14 bp, Homo sapiens
aatgtacaattatg

SEQ ID NO: 4371509 - DNA, 15 bp, Homo sapiens
aatgtacaattatgt

SEQ ID NO: 4371510 - DNA, 16 bp, Homo sapiens
aatgtacagacatatt

SEQ ID NO: 4371511 - DNA, 21 bp, Homo sapiens
aatgtacagacatatttaact

SEQ ID NO: 4371512 - DNA, 17 bp, Homo sapiens
aatgtactgatttcagt

SEQ ID NO: 4371513 - DNA, 13 bp, Homo sapiens
aatgtacttgttt

SEQ ID NO: 4371514 - DNA, 17 bp, Homo sapiens
aatgtacttgtttgaat

SEQ ID NO: 4371515 - DNA, 15 bp, Homo sapiens
aatgtagaaataaat

SEQ ID NO: 4371516 - DNA, 19 bp, Homo sapiens
aatgtagaatattcagaca

SEQ ID NO: 4371517 - DNA, 22 bp, Homo sapiens
aatgtaggcacttttattttca

SEQ ID NO: 4371518 - DNA, 16 bp, Homo sapiens
aatgtataatgtgcag

SEQ ID NO: 4371519 - DNA, 19 bp, Homo sapiens
aatgtatactatagtacca

SEQ ID NO: 4371520 - DNA, 12 bp, Homo sapiens
aatgtatataaa

SEQ ID NO: 4371521 - DNA, 14 bp, Homo sapiens
aatgtatataaaaa

SEQ ID NO: 4371522 - DNA, 13 bp, Homo sapiens
aatgtatatgcac

SEQ ID NO: 4371523 - DNA, 17 bp, Homo sapiens
aatgtatctatttgtac

SEQ ID NO: 4371524 - DNA, 18 bp, Homo sapiens
aatgtatctatttgtaca

SEQ ID NO: 4371525 - DNA, 19 bp, Homo sapiens
aatgtatctatttgtacaa

SEQ ID NO: 4371526 - DNA, 15 bp, Homo sapiens
aatgtatctgcatat

SEQ ID NO: 4371527 - DNA, 20 bp, Homo sapiens
aatgtatctttattaaaaca

SEQ ID NO: 4371528 - DNA, 15 bp, Homo sapiens
aatgtatgtaaatag

SEQ ID NO: 4371529 - DNA, 14 bp, Homo sapiens
aatgtatgtacaat

SEQ ID NO: 4371530 - DNA, 13 bp, Homo sapiens
aatgtatgtctgg

SEQ ID NO: 4371531 - DNA, 13 bp, Homo sapiens
aatgtatgttacc

SEQ ID NO: 4371532 - DNA, 21 bp, Homo sapiens
aatgtatgttaccaaaaataa

SEQ ID NO: 4371533 - DNA, 22 bp, Homo sapiens
aatgtattatgtcctgtgagat

SEQ ID NO: 4371534 - DNA, 14 bp, Homo sapiens
aatgtattgattca

SEQ ID NO: 4371535 - DNA, 19 bp, Homo sapiens
aatgtattgattcaacagg

SEQ ID NO: 4371536 - DNA, 13 bp, Homo sapiens
aatgtattttaca

SEQ ID NO: 4371537 - DNA, 17 bp, Homo sapiens
aatgtcaaggaagactt

SEQ ID NO: 4371538 - DNA, 23 bp, Homo sapiens
aatgtcacaacatggtgctactt

SEQ ID NO: 4371539 - DNA, 15 bp, Homo sapiens
aatgtcaccaccttc

SEQ ID NO: 4371540 - DNA, 16 bp, Homo sapiens
aatgtcagattccttt

SEQ ID NO: 4371541 - DNA, 20 bp, Homo sapiens
aatgtcagattcctttccct

SEQ ID NO: 4371542 - DNA, 15 bp, Homo sapiens
aatgtcagtatgtgg

SEQ ID NO: 4371543 - DNA, 23 bp, Homo sapiens
aatgtcataaagtgagaaaactg

SEQ ID NO: 4371544 - DNA, 15 bp, Homo sapiens
aatgtcattgtctac

SEQ ID NO: 4371545 - DNA, 16 bp, Homo sapiens
aatgtcattgtctact

SEQ ID NO: 4371546 - DNA, 14 bp, Homo sapiens
aatgtcattttggt

SEQ ID NO: 4371547 - DNA, 19 bp, Homo sapiens
aatgtcccccatcatgtgg

SEQ ID NO: 4371548 - DNA, 23 bp, Homo sapiens
aatgtcccccatcatgtggccca

SEQ ID NO: 4371549 - DNA, 22 bp, Homo sapiens
aatgtcccctcaaactcattgc

SEQ ID NO: 4371550 - DNA, 18 bp, Homo sapiens
aatgtcctccagaagcct

SEQ ID NO: 4371551 - DNA, 21 bp, Homo sapiens
aatgtcctccagaagcctctg

SEQ ID NO: 4371552 - DNA, 16 bp, Homo sapiens
aatgtcctttctcaga

SEQ ID NO: 4371553 - DNA, 17 bp, Homo sapiens
aatgtcgaactcttctt

SEQ ID NO: 4371554 - DNA, 21 bp, Homo sapiens
aatgtctcactttactttcaa

SEQ ID NO: 4371555 - DNA, 22 bp, Homo sapiens
aatgtctcactttactttcaag

SEQ ID NO: 4371556 - DNA, 20 bp, Homo sapiens
aatgtctcagcgaggtgtaa

SEQ ID NO: 4371557 - DNA, 15 bp, Homo sapiens
aatgtctgaaatgga

SEQ ID NO: 4371558 - DNA, 21 bp, Homo sapiens
aatgtctgaagtacaaacatg

SEQ ID NO: 4371559 - DNA, 23 bp, Homo sapiens
aatgtcttgctgttgacatattt

SEQ ID NO: 4371560 - DNA, 11 bp, Homo sapiens
aatgtcttgtg

SEQ ID NO: 4371561 - DNA, 13 bp, Homo sapiens
aatgtcttgtgtt

SEQ ID NO: 4371562 - DNA, 23 bp, Homo sapiens
aatgtctttccaaattatttctt

SEQ ID NO: 4371563 - DNA, 14 bp, Homo sapiens
aatgtgaaaaagga

SEQ ID NO: 4371564 - DNA, 15 bp, Homo sapiens
aatgtgaaaaaggaa

SEQ ID NO: 4371565 - DNA, 22 bp, Homo sapiens
aatgtgaaacatccgttttcat

SEQ ID NO: 4371566 - DNA, 17 bp, Homo sapiens
aatgtgagtgtgtttgt

SEQ ID NO: 4371567 - DNA, 15 bp, Homo sapiens
aatgtgatcatatga

SEQ ID NO: 4371568 - DNA, 16 bp, Homo sapiens
aatgtgcagaaaatat

SEQ ID NO: 4371569 - DNA, 23 bp, Homo sapiens
aatgtgccacagaggccccacct

SEQ ID NO: 4371570 - DNA, 15 bp, Homo sapiens
aatgtgccttgattg

SEQ ID NO: 4371571 - DNA, 18 bp, Homo sapiens
aatgtgctatactgcata

SEQ ID NO: 4371572 - DNA, 18 bp, Homo sapiens
aatgtgctcaaattacta

SEQ ID NO: 4371573 - DNA, 15 bp, Homo sapiens
aattgcgctcagggg

SEQ ID NO: 4371574 - DNA, 16 bp, Homo sapiens
aattgcgctcaggggc

SEQ ID NO: 4371575 - DNA, 20 bp, Homo sapiens
aattgcgctcaggggctcca

SEQ ID NO: 4371576 - DNA, 15 bp, Homo sapiens
aattgctaacaattg

SEQ ID NO: 4371577 - DNA, 23 bp, Homo sapiens
aattgctcctgcatgcaactaat

SEQ ID NO: 4371578 - DNA, 15 bp, Homo sapiens
aattgctctgtgtat

SEQ ID NO: 4371579 - DNA, 19 bp, Homo sapiens
aattgctctgtgtatatct

SEQ ID NO: 4371580 - DNA, 23 bp, Homo sapiens
aattgctgaagggcattctttcc

SEQ ID NO: 4371581 - DNA, 16 bp, Homo sapiens
aattgctttgccaaaa

SEQ ID NO: 4371582 - DNA, 21 bp, Homo sapiens
aattgctttgccaaaatacca

SEQ ID NO: 4371583 - DNA, 23 bp, Homo sapiens
aattgctttgccaaaataccaga

SEQ ID NO: 4371584 - DNA, 20 bp, Homo sapiens
aattgcttttgaaaaacaac

SEQ ID NO: 4371585 - DNA, 16 bp, Homo sapiens
aattggaacaaagtga

SEQ ID NO: 4371586 - DNA, 17 bp, Homo sapiens
aattggagaagatttat

SEQ ID NO: 4371587 - DNA, 17 bp, Homo sapiens
aattggatttcctaata

SEQ ID NO: 4371588 - DNA, 18 bp, Homo sapiens
aattggctaaaagacatg

SEQ ID NO: 4371589 - DNA, 19 bp, Homo sapiens
aattgggctggattgtgct

SEQ ID NO: 4371590 - DNA, 19 bp, Homo sapiens
aattgggttcatgatgcag

SEQ ID NO: 4371591 - DNA, 20 bp, Homo sapiens
aattggttattaaactgaat

SEQ ID NO: 4371592 - DNA, 14 bp, Homo sapiens
aattgtaaactgta

SEQ ID NO: 4371593 - DNA, 15 bp, Homo sapiens
aattgtaaactgtac

SEQ ID NO: 4371594 - DNA, 14 bp, Homo sapiens
aattgtaactgttc

SEQ ID NO: 4371595 - DNA, 16 bp, Homo sapiens
aattgtaactgttctt

SEQ ID NO: 4371596 - DNA, 18 bp, Homo sapiens
aattgtatggtgataaaa

SEQ ID NO: 4371597 - DNA, 19 bp, Homo sapiens
aattgtctaaaatgtcagt

SEQ ID NO: 4371598 - DNA, 12 bp, Homo sapiens
aattgtgaaaaa

SEQ ID NO: 4371599 - DNA, 15 bp, Homo sapiens
aattgtgatgtgtcc

SEQ ID NO: 4371600 - DNA, 18 bp, Homo sapiens
aattgtgcataatgcttt

SEQ ID NO: 4371601 - DNA, 21 bp, Homo sapiens
aattgtgcttctccccagaat

SEQ ID NO: 4371602 - DNA, 18 bp, Homo sapiens
aattgtgctttcaccaga

SEQ ID NO: 4371603 - DNA, 15 bp, Homo sapiens
aatttaaaagtaaaa

SEQ ID NO: 4371604 - DNA, 16 bp, Homo sapiens
aatttaaaagtaaaat

SEQ ID NO: 4371605 - DNA, 22 bp, Homo sapiens
aatttaaactataagcaagaag

SEQ ID NO: 4371606 - DNA, 23 bp, Homo sapiens
aatttaaatctgattaatccatt

SEQ ID NO: 4371607 - DNA, 18 bp, Homo sapiens
aatttaaatgatttaaat

SEQ ID NO: 4371608 - DNA, 11 bp, Homo sapiens
aatttaaattg

SEQ ID NO: 4371609 - DNA, 15 bp, Homo sapiens
aatttaagaaaacaa

SEQ ID NO: 4371610 - DNA, 19 bp, Homo sapiens
aatttaagaaaacaagtat

SEQ ID NO: 4371611 - DNA, 21 bp, Homo sapiens
aatttaagaaaacaagtatat

SEQ ID NO: 4371612 - DNA, 17 bp, Homo sapiens
aatttaagttctattca

SEQ ID NO: 4371613 - DNA, 19 bp, Homo sapiens
aatttaatccttctttgta

SEQ ID NO: 4371614 - DNA, 13 bp, Homo sapiens
aatttaattaaag

SEQ ID NO: 4371615 - DNA, 22 bp, Homo sapiens
aatttacaagatattattaatt

SEQ ID NO: 4371616 - DNA, 22 bp, Homo sapiens
aatttacacagtgagactgtac

SEQ ID NO: 4371617 - DNA, 23 bp, Homo sapiens
aatttacacagtgagactgtaca

SEQ ID NO: 4371618 - DNA, 20 bp, Homo sapiens
aatttacacatcttaaaagt

SEQ ID NO: 4371619 - DNA, 18 bp, Homo sapiens
aatttacagagacagaaa

SEQ ID NO: 4371620 - DNA, 22 bp, Homo sapiens
aatttaccctcttgaatataat

SEQ ID NO: 4371621 - DNA, 14 bp, Homo sapiens
aatttacctaagat

SEQ ID NO: 4371622 - DNA, 17 bp, Homo sapiens
aatttacctaagattac

SEQ ID NO: 4371623 - DNA, 20 bp, Homo sapiens
aatttacctttaaaataata

SEQ ID NO: 4371624 - DNA, 19 bp, Homo sapiens
aatttactggacaaagaat

SEQ ID NO: 4371625 - DNA, 16 bp, Homo sapiens
aatttacttaagtgtt

SEQ ID NO: 4371626 - DNA, 17 bp, Homo sapiens
aatttacttaagtgttc

SEQ ID NO: 4371627 - DNA, 18 bp, Homo sapiens
aatttactttcttcacca

SEQ ID NO: 4371628 - DNA, 15 bp, Homo sapiens
aatttagaaaaagaa

SEQ ID NO: 4371629 - DNA, 18 bp, Homo sapiens
aatttagaaactaattga

SEQ ID NO: 4371630 - DNA, 19 bp, Homo sapiens
aatttagaaactaattgac

SEQ ID NO: 4371631 - DNA, 17 bp, Homo sapiens
aatttagaaatcatttt

SEQ ID NO: 4371632 - DNA, 12 bp, Homo sapiens
aatttagatctt

SEQ ID NO: 4371633 - DNA, 14 bp, Homo sapiens
aatttagatcttat

SEQ ID NO: 4371634 - DNA, 16 bp, Homo sapiens
aatttagtgtatccat

SEQ ID NO: 4371635 - DNA, 22 bp, Homo sapiens
aatttagtttcatataaagtat

SEQ ID NO: 4371636 - DNA, 15 bp, Homo sapiens
aatttagtttgttaa

SEQ ID NO: 4371637 - DNA, 23 bp, Homo sapiens
aatttagtttgttaaagcctgtt

SEQ ID NO: 4371638 - DNA, 16 bp, Homo sapiens
aatttataaaaaggtg

SEQ ID NO: 4371639 - DNA, 22 bp, Homo sapiens
aatttataaaaaggtgttttga

SEQ ID NO: 4371640 - DNA, 15 bp, Homo sapiens
aatttataaaggtct

SEQ ID NO: 4371641 - DNA, 14 bp, Homo sapiens
aatttataatgtat

SEQ ID NO: 4371642 - DNA, 19 bp, Homo sapiens
aatttatacttaaaaaatc

SEQ ID NO: 4371643 - DNA, 18 bp, Homo sapiens
aatttatagtaatgagtt

SEQ ID NO: 4371644 - DNA, 17 bp, Homo sapiens
aatttatcacacttctg

SEQ ID NO: 4371645 - DNA, 17 bp, Homo sapiens
aatttatcagtacctaa

SEQ ID NO: 4371646 - DNA, 12 bp, Homo sapiens
aatttatcttta

SEQ ID NO: 4371647 - DNA, 14 bp, Homo sapiens
aatttatctttacc

SEQ ID NO: 4371648 - DNA, 15 bp, Homo sapiens
aatttatctttacca

SEQ ID NO: 4371649 - DNA, 15 bp, Homo sapiens
aatttatgtgaaatg

SEQ ID NO: 4371650 - DNA, 22 bp, Homo sapiens
aatttattatatatttacagaa

SEQ ID NO: 4371651 - DNA, 18 bp, Homo sapiens
aatttattggggtgacct

SEQ ID NO: 4371652 - DNA, 20 bp, Homo sapiens
aatttattgtctgtctacat

SEQ ID NO: 4371653 - DNA, 17 bp, Homo sapiens
aatttatttagttttta

SEQ ID NO: 4371654 - DNA, 19 bp, Homo sapiens
aatttatttcaataaatct

SEQ ID NO: 4371655 - DNA, 17 bp, Homo sapiens
aatttatttcatccagt

SEQ ID NO: 4371656 - DNA, 17 bp, Homo sapiens
aatttatttcttaacct

SEQ ID NO: 4371657 - DNA, 18 bp, Homo sapiens
aatttatttcttaacctt

SEQ ID NO: 4371658 - DNA, 20 bp, Homo sapiens
aatttatttcttaacctttg

SEQ ID NO: 4371659 - DNA, 16 bp, Homo sapiens
aatttcaaaatttaaa

SEQ ID NO: 4371660 - DNA, 17 bp, Homo sapiens
aatttcaaacttttgaa

SEQ ID NO: 4371661 - DNA, 20 bp, Homo sapiens
aatttcaaacttttgaaaga

SEQ ID NO: 4371662 - DNA, 14 bp, Homo sapiens
aatttcacagttct

SEQ ID NO: 4371663 - DNA, 18 bp, Homo sapiens
aatttcacagttctgtaa

SEQ ID NO: 4371664 - DNA, 13 bp, Homo sapiens
aatttcagtgtaa

SEQ ID NO: 4371665 - DNA, 19 bp, Homo sapiens
aatttcagtgtaaagtgtg

SEQ ID NO: 4371666 - DNA, 21 bp, Homo sapiens
aatttcatagctgtacttctt

SEQ ID NO: 4371667 - DNA, 15 bp, Homo sapiens
aatttcatttaaata

SEQ ID NO: 4371668 - DNA, 19 bp, Homo sapiens
aatttcatttcacattttt

SEQ ID NO: 4371669 - DNA, 20 bp, Homo sapiens
aatttcatttccagcatttt

SEQ ID NO: 4371670 - DNA, 22 bp, Homo sapiens
aatttcatttccagcattttta

SEQ ID NO: 4371671 - DNA, 21 bp, Homo sapiens
aatttcattttagtattttag

SEQ ID NO: 4371672 - DNA, 18 bp, Homo sapiens
aatttccaaaataatcta

SEQ ID NO: 4371673 - DNA, 19 bp, Homo sapiens
aatttcccagttaaagatt

SEQ ID NO: 4371674 - DNA, 19 bp, Homo sapiens
aatttccccctaaaccaac

SEQ ID NO: 4371675 - DNA, 18 bp, Homo sapiens
aatttccccctgttctta

SEQ ID NO: 4371676 - DNA, 14 bp, Homo sapiens
aatttcctgtaata

SEQ ID NO: 4371677 - DNA, 15 bp, Homo sapiens
aatttcctgtaatat

SEQ ID NO: 4371678 - DNA, 16 bp, Homo sapiens
aatttcctgtttgaaa

SEQ ID NO: 4371679 - DNA, 15 bp, Homo sapiens
aatttcctttttgac

SEQ ID NO: 4371680 - DNA, 21 bp, Homo sapiens
aatttcctttttgacactgaa

SEQ ID NO: 4371681 - DNA, 13 bp, Homo sapiens
aatttcgccttaa

SEQ ID NO: 4371682 - DNA, 14 bp, Homo sapiens
aatttcgccttaaa

SEQ ID NO: 4371683 - DNA, 15 bp, Homo sapiens
aatttcgccttaaac

SEQ ID NO: 4371684 - DNA, 18 bp, Homo sapiens
aatttcggattttttcca

SEQ ID NO: 4371685 - DNA, 17 bp, Homo sapiens
aatttctaatgtttact

SEQ ID NO: 4371686 - DNA, 14 bp, Homo sapiens
aatttctactgagc

SEQ ID NO: 4371687 - DNA, 17 bp, Homo sapiens
aatttctactttgaagt

SEQ ID NO: 4371688 - DNA, 18 bp, Homo sapiens
aatttctataaatttaag

SEQ ID NO: 4371689 - DNA, 19 bp, Homo sapiens
aatttctcccagtcattta

SEQ ID NO: 4371690 - DNA, 20 bp, Homo sapiens
aatttctcccagtcatttaa

SEQ ID NO: 4371691 - DNA, 14 bp, Homo sapiens
acaaaactatactt

SEQ ID NO: 4371692 - DNA, 21 bp, Homo sapiens
acaaaagaataacattttcta

SEQ ID NO: 4371693 - DNA, 21 bp, Homo sapiens
acaaaagaataagacaagaga

SEQ ID NO: 4371694 - DNA, 22 bp, Homo sapiens
acaaaagagcatggatgcattt

SEQ ID NO: 4371695 - DNA, 12 bp, Homo sapiens
acaaaagattta

SEQ ID NO: 4371696 - DNA, 21 bp, Homo sapiens
acaaaagcccgcttgctcgct

SEQ ID NO: 4371697 - DNA, 11 bp, Homo sapiens
acaaaaggaat

SEQ ID NO: 4371698 - DNA, 14 bp, Homo sapiens
acaaaagggtcaga

SEQ ID NO: 4371699 - DNA, 20 bp, Homo sapiens
acaaaagggtgtatagtgtt

SEQ ID NO: 4371700 - DNA, 17 bp, Homo sapiens
acaaaagtacattgctt

SEQ ID NO: 4371701 - DNA, 18 bp, Homo sapiens
acaaaagtacattgctta

SEQ ID NO: 4371702 - DNA, 15 bp, Homo sapiens
acaaaagtctgtctt

SEQ ID NO: 4371703 - DNA, 16 bp, Homo sapiens
acaaaagttcaacctc

SEQ ID NO: 4371704 - DNA, 23 bp, Homo sapiens
acaaaatacacattcttgcttgt

SEQ ID NO: 4371705 - DNA, 19 bp, Homo sapiens
acaaaatccattccaggta

SEQ ID NO: 4371706 - DNA, 11 bp, Homo sapiens
acaaaatgaaa

SEQ ID NO: 4371707 - DNA, 21 bp, Homo sapiens
acaaaatgggcccttgcctct

SEQ ID NO: 4371708 - DNA, 19 bp, Homo sapiens
acaaaatgtagaatattca

SEQ ID NO: 4371709 - DNA, 14 bp, Homo sapiens
acaaaatttctatt

SEQ ID NO: 4371710 - DNA, 16 bp, Homo sapiens
acaaacaaaatttcta

SEQ ID NO: 4371711 - DNA, 11 bp, Homo sapiens
acaaacacatt

SEQ ID NO: 4371712 - DNA, 16 bp, Homo sapiens
acaaacacattataaa

SEQ ID NO: 4371713 - DNA, 18 bp, Homo sapiens
acaaacacattataaagt

SEQ ID NO: 4371714 - DNA, 12 bp, Homo sapiens
acaaacatgaaa

SEQ ID NO: 4371715 - DNA, 14 bp, Homo sapiens
acaaacatgaccct

SEQ ID NO: 4371716 - DNA, 21 bp, Homo sapiens
acaaaccaccaggactgaaag

SEQ ID NO: 4371717 - DNA, 18 bp, Homo sapiens
acaaacgtaatttgttat

SEQ ID NO: 4371718 - DNA, 21 bp, Homo sapiens
acaaactcgttttttacaaag

SEQ ID NO: 4371719 - DNA, 16 bp, Homo sapiens
acaaactgtgaaaata

SEQ ID NO: 4371720 - DNA, 20 bp, Homo sapiens
acaaactgtgaaaatagtgt

SEQ ID NO: 4371721 - DNA, 21 bp, Homo sapiens
acaaactgtgaaaatagtgta

SEQ ID NO: 4371722 - DNA, 13 bp, Homo sapiens
acaaacttttata

SEQ ID NO: 4371723 - DNA, 18 bp, Homo sapiens
acaaagacgcaaggtgtg

SEQ ID NO: 4371724 - DNA, 16 bp, Homo sapiens
acaaagagttcaagaa

SEQ ID NO: 4371725 - DNA, 19 bp, Homo sapiens
acaaagagttcaagaaata

SEQ ID NO: 4371726 - DNA, 14 bp, Homo sapiens
acaaagattgagaa

SEQ ID NO: 4371727 - DNA, 15 bp, Homo sapiens
acaaagcccttttat

SEQ ID NO: 4371728 - DNA, 15 bp, Homo sapiens
acaaagcgtgcacaa

SEQ ID NO: 4371729 - DNA, 23 bp, Homo sapiens
acaaagctaggatggttctgtga

SEQ ID NO: 4371730 - DNA, 13 bp, Homo sapiens
acaaagctgctaa

SEQ ID NO: 4371731 - DNA, 19 bp, Homo sapiens
acaaagctttcttttctaa

SEQ ID NO: 4371732 - DNA, 11 bp, Homo sapiens
acaaaggcaag

SEQ ID NO: 4371733 - DNA, 13 bp, Homo sapiens
acaaaggccacag

SEQ ID NO: 4371734 - DNA, 16 bp, Homo sapiens
acaaagtcacagtcgt

SEQ ID NO: 4371735 - DNA, 14 bp, Homo sapiens
acaaagttctcaga

SEQ ID NO: 4371736 - DNA, 15 bp, Homo sapiens
acaaagttctcagag

SEQ ID NO: 4371737 - DNA, 14 bp, Homo sapiens
acaaagtttcagag

SEQ ID NO: 4371738 - DNA, 17 bp, Homo sapiens
acaaataagattaataa

SEQ ID NO: 4371739 - DNA, 21 bp, Homo sapiens
acaaatattatttgtgtttcc

SEQ ID NO: 4371740 - DNA, 14 bp, Homo sapiens
acaaatattcagaa

SEQ ID NO: 4371741 - DNA, 22 bp, Homo sapiens
acaaatattgtcatctttttct

SEQ ID NO: 4371742 - DNA, 13 bp, Homo sapiens
acaaatatttcac

SEQ ID NO: 4371743 - DNA, 20 bp, Homo sapiens
acaaatatttcacttaaact

SEQ ID NO: 4371744 - DNA, 23 bp, Homo sapiens
acaaatcagaagtcatcttgcta

SEQ ID NO: 4371745 - DNA, 15 bp, Homo sapiens
acaaatcagtaattt

SEQ ID NO: 4371746 - DNA, 16 bp, Homo sapiens
acaaatcagtaatttt

SEQ ID NO: 4371747 - DNA, 23 bp, Homo sapiens
acaaatgactgtatctaggcatt

SEQ ID NO: 4371748 - DNA, 15 bp, Homo sapiens
acaaatgtcattgtc

SEQ ID NO: 4371749 - DNA, 16 bp, Homo sapiens
acaaatgtcattgtct

SEQ ID NO: 4371750 - DNA, 18 bp, Homo sapiens
acaaatgtcattgtctac

SEQ ID NO: 4371751 - DNA, 19 bp, Homo sapiens
acaaatgttagacttgtgt

SEQ ID NO: 4371752 - DNA, 14 bp, Homo sapiens
acaaattatttttg

SEQ ID NO: 4371753 - DNA, 15 bp, Homo sapiens
acaaattcagtctct

SEQ ID NO: 4371754 - DNA, 23 bp, Homo sapiens
acaaattccgattagacctttat

SEQ ID NO: 4371755 - DNA, 19 bp, Homo sapiens
acaaattgtttcattttgt

SEQ ID NO: 4371756 - DNA, 21 bp, Homo sapiens
acaaatttggccttaagaact

SEQ ID NO: 4371757 - DNA, 12 bp, Homo sapiens
acaacaaagaca

SEQ ID NO: 4371758 - DNA, 23 bp, Homo sapiens
acaacaaagacatgctttccatt

SEQ ID NO: 4371759 - DNA, 15 bp, Homo sapiens
acaacaataactttt

SEQ ID NO: 4371760 - DNA, 15 bp, Homo sapiens
acaacactacttccc

SEQ ID NO: 4371761 - DNA, 13 bp, Homo sapiens
acaacagaaagag

SEQ ID NO: 4371762 - DNA, 14 bp, Homo sapiens
acaacagcacacag

SEQ ID NO: 4371763 - DNA, 20 bp, Homo sapiens
acaaccactgggatcagctg

SEQ ID NO: 4371764 - DNA, 14 bp, Homo sapiens
acaaccatgtcatt

SEQ ID NO: 4371765 - DNA, 16 bp, Homo sapiens
acaacctcaactgcct

SEQ ID NO: 4371766 - DNA, 14 bp, Homo sapiens
acaaccttttcctc

SEQ ID NO: 4371767 - DNA, 14 bp, Homo sapiens
acaacgaatgaatg

SEQ ID NO: 4371768 - DNA, 14 bp, Homo sapiens
acaacgattatagt

SEQ ID NO: 4371769 - DNA, 19 bp, Homo sapiens
acaactgcataacctttac

SEQ ID NO: 4371770 - DNA, 21 bp, Homo sapiens
acaactgcctcgaaacacaga

SEQ ID NO: 4371771 - DNA, 17 bp, Homo sapiens
acaacttcaagtgcatg

SEQ ID NO: 4371772 - DNA, 18 bp, Homo sapiens
acaacttgtagcagctat

SEQ ID NO: 4371773 - DNA, 19 bp, Homo sapiens
acaagaaaacaatggggct

SEQ ID NO: 4371774 - DNA, 13 bp, Homo sapiens
acaagaaaatcag

SEQ ID NO: 4371775 - DNA, 11 bp, Homo sapiens
acaagaaatgg

SEQ ID NO: 4371776 - DNA, 18 bp, Homo sapiens
acaagaagcattttgtaa

SEQ ID NO: 4371777 - DNA, 19 bp, Homo sapiens
acaagagatctacacatgt

SEQ ID NO: 4371778 - DNA, 15 bp, Homo sapiens
acaagagcactacat

SEQ ID NO: 4371779 - DNA, 19 bp, Homo sapiens
acaagagcagcctgtggca

SEQ ID NO: 4371780 - DNA, 20 bp, Homo sapiens
acaagagggttcacacagcc

SEQ ID NO: 4371781 - DNA, 22 bp, Homo sapiens
acaagagtatgtggcaaaacat

SEQ ID NO: 4371782 - DNA, 13 bp, Homo sapiens
acaagatgggaca

SEQ ID NO: 4371783 - DNA, 14 bp, Homo sapiens
acaagatgggacag

SEQ ID NO: 4371784 - DNA, 16 bp, Homo sapiens
acaagattcccagaga

SEQ ID NO: 4371785 - DNA, 18 bp, Homo sapiens
acaagatttccttgtgca

SEQ ID NO: 4371786 - DNA, 14 bp, Homo sapiens
acaagcaagcaaaa

SEQ ID NO: 4371787 - DNA, 22 bp, Homo sapiens
acaagcaaggatatcagagctg

SEQ ID NO: 4371788 - DNA, 20 bp, Homo sapiens
acaagccaaaagtccctccc

SEQ ID NO: 4371789 - DNA, 22 bp, Homo sapiens
acaagccaaaagtccctccctg

SEQ ID NO: 4371790 - DNA, 23 bp, Homo sapiens
acaagccaaagagcctcccacca

SEQ ID NO: 4371791 - DNA, 14 bp, Homo sapiens
acaagcctcctgta

SEQ ID NO: 4371792 - DNA, 17 bp, Homo sapiens
acaagcctcctgtacct

SEQ ID NO: 4371793 - DNA, 13 bp, Homo sapiens
acaagcctgagaa

SEQ ID NO: 4371794 - DNA, 14 bp, Homo sapiens
acaagcctgagaac

SEQ ID NO: 4371795 - DNA, 17 bp, Homo sapiens
acaagccttactcacct

SEQ ID NO: 4371796 - DNA, 16 bp, Homo sapiens
acaagctcatccctgg

SEQ ID NO: 4371797 - DNA, 19 bp, Homo sapiens
acaagctgcactgtgaacc

SEQ ID NO: 4371798 - DNA, 19 bp, Homo sapiens
acaagcttaaagcttgatt

SEQ ID NO: 4371799 - DNA, 21 bp, Homo sapiens
acaaggaagtcaaagcaagga

SEQ ID NO: 4371800 - DNA, 23 bp, Homo sapiens
acaaggaataaatgagagggaat

SEQ ID NO: 4371801 - DNA, 21 bp, Homo sapiens
acaaggaatagtcgcgcaagc

SEQ ID NO: 4371802 - DNA, 15 bp, Homo sapiens
acaaggattgaaaat

SEQ ID NO: 4371803 - DNA, 17 bp, Homo sapiens
acaaggattgaaaattc

SEQ ID NO: 4371804 - DNA, 19 bp, Homo sapiens
acaagggagaagacaacag

SEQ ID NO: 4371805 - DNA, 18 bp, Homo sapiens
acaagggtctagggagag

SEQ ID NO: 4371806 - DNA, 19 bp, Homo sapiens
acaagggtctagggagaga

SEQ ID NO: 4371807 - DNA, 20 bp, Homo sapiens
acaagggtctagggagagac

SEQ ID NO: 4371808 - DNA, 19 bp, Homo sapiens
acaaggtaaacttcattgg

SEQ ID NO: 4371809 - DNA, 12 bp, Homo sapiens
acaaggtgctaa

SEQ ID NO: 4371810 - DNA, 16 bp, Homo sapiens
acacttatcttctgga

SEQ ID NO: 4371811 - DNA, 19 bp, Homo sapiens
acacttatcttctggatta

SEQ ID NO: 4371812 - DNA, 21 bp, Homo sapiens
acacttatggaatttttaagt

SEQ ID NO: 4371813 - DNA, 20 bp, Homo sapiens
acacttattggaactctgct

SEQ ID NO: 4371814 - DNA, 23 bp, Homo sapiens
acacttccaaagactccctccat

SEQ ID NO: 4371815 - DNA, 14 bp, Homo sapiens
acacttccagtctg

SEQ ID NO: 4371816 - DNA, 15 bp, Homo sapiens
acacttccagtctgg

SEQ ID NO: 4371817 - DNA, 21 bp, Homo sapiens
acacttcctattagtgacttt

SEQ ID NO: 4371818 - DNA, 16 bp, Homo sapiens
acacttcgttcgcaga

SEQ ID NO: 4371819 - DNA, 16 bp, Homo sapiens
acacttctccttatct

SEQ ID NO: 4371820 - DNA, 16 bp, Homo sapiens
acacttgagatgattt

SEQ ID NO: 4371821 - DNA, 22 bp, Homo sapiens
acacttggcatacaaaatattt

SEQ ID NO: 4371822 - DNA, 20 bp, Homo sapiens
acacttgttccagctctttg

SEQ ID NO: 4371823 - DNA, 20 bp, Homo sapiens
acactttagttatattcact

SEQ ID NO: 4371824 - DNA, 20 bp, Homo sapiens
acactttgccaaggctctcc

SEQ ID NO: 4371825 - DNA, 20 bp, Homo sapiens
acactttgcctcctgtgtac

SEQ ID NO: 4371826 - DNA, 17 bp, Homo sapiens
acactttggcccagggt

SEQ ID NO: 4371827 - DNA, 23 bp, Homo sapiens
acactttgttgcaagatgtgaat

SEQ ID NO: 4371828 - DNA, 18 bp, Homo sapiens
acacttttcatatcattt

SEQ ID NO: 4371829 - DNA, 18 bp, Homo sapiens
acactttttacagcagca

SEQ ID NO: 4371830 - DNA, 22 bp, Homo sapiens
acactttttacagcagcaatat

SEQ ID NO: 4371831 - DNA, 13 bp, Homo sapiens
acagaaaatgcaa

SEQ ID NO: 4371832 - DNA, 16 bp, Homo sapiens
acagaaaccagaaaag

SEQ ID NO: 4371833 - DNA, 19 bp, Homo sapiens
acagaaagcagaacagtga

SEQ ID NO: 4371834 - DNA, 15 bp, Homo sapiens
acagaaatgtttaaa

SEQ ID NO: 4371835 - DNA, 14 bp, Homo sapiens
acagaaattgtata

SEQ ID NO: 4371836 - DNA, 19 bp, Homo sapiens
acagaaattgtatattgta

SEQ ID NO: 4371837 - DNA, 15 bp, Homo sapiens
acagaacccacagta

SEQ ID NO: 4371838 - DNA, 21 bp, Homo sapiens
acagaaccttcaacccagtgg

SEQ ID NO: 4371839 - DNA, 16 bp, Homo sapiens
acagaacctttgtcaa

SEQ ID NO: 4371840 - DNA, 12 bp, Homo sapiens
acagaactaaaa

SEQ ID NO: 4371841 - DNA, 16 bp, Homo sapiens
acagaactttccccaa

SEQ ID NO: 4371842 - DNA, 11 bp, Homo sapiens
acagaagctat

SEQ ID NO: 4371843 - DNA, 24 bp, Homo sapiens
acagaaggcaaagtttacagatgt

SEQ ID NO: 4371844 - DNA, 17 bp, Homo sapiens
acagaatagtttacaca

SEQ ID NO: 4371845 - DNA, 16 bp, Homo sapiens
acagaatattaaatat

SEQ ID NO: 4371846 - DNA, 15 bp, Homo sapiens
acagaatatttttat

SEQ ID NO: 4371847 - DNA, 18 bp, Homo sapiens
acagaatcttgttttgaa

SEQ ID NO: 4371848 - DNA, 13 bp, Homo sapiens
acagaatttgaat

SEQ ID NO: 4371849 - DNA, 19 bp, Homo sapiens
acagacaaaaacagcctca

SEQ ID NO: 4371850 - DNA, 20 bp, Homo sapiens
acagacaaaaacagcctcac

SEQ ID NO: 4371851 - DNA, 20 bp, Homo sapiens
acagacacgagccacctcac

SEQ ID NO: 4371852 - DNA, 13 bp, Homo sapiens
acagacaggaatt

SEQ ID NO: 4371853 - DNA, 21 bp, Homo sapiens
acagacaggagaaatgcatcc

SEQ ID NO: 4371854 - DNA, 14 bp, Homo sapiens
acagaccacttgcc

SEQ ID NO: 4371855 - DNA, 21 bp, Homo sapiens
acagacccacccccagccttg

SEQ ID NO: 4371856 - DNA, 15 bp, Homo sapiens
acagaccccagctgg

SEQ ID NO: 4371857 - DNA, 22 bp, Homo sapiens
acagactatttgctaatgtata

SEQ ID NO: 4371858 - DNA, 13 bp, Homo sapiens
acagactgaaagg

SEQ ID NO: 4371859 - DNA, 22 bp, Homo sapiens
acagactgaaaggtgtgaacag

SEQ ID NO: 4371860 - DNA, 18 bp, Homo sapiens
acagagaaatacaaaata

SEQ ID NO: 4371861 - DNA, 19 bp, Homo sapiens
acagagaaatacaaaataa

SEQ ID NO: 4371862 - DNA, 22 bp, Homo sapiens
acagagaaatacaaaataaaga

SEQ ID NO: 4371863 - DNA, 14 bp, Homo sapiens
acagagaaggcagg

SEQ ID NO: 4371864 - DNA, 16 bp, Homo sapiens
acagagaatttctaaa

SEQ ID NO: 4371865 - DNA, 15 bp, Homo sapiens
acagagacacctgca

SEQ ID NO: 4371866 - DNA, 16 bp, Homo sapiens
acagagacacctgcac

SEQ ID NO: 4371867 - DNA, 11 bp, Homo sapiens
acagagactca

SEQ ID NO: 4371868 - DNA, 20 bp, Homo sapiens
acagagactgaatagatatg

SEQ ID NO: 4371869 - DNA, 19 bp, Homo sapiens
acagagaggatacatttaa

SEQ ID NO: 4371870 - DNA, 22 bp, Homo sapiens
acagagaggatacatttaataa

SEQ ID NO: 4371871 - DNA, 16 bp, Homo sapiens
acagagattctgaact

SEQ ID NO: 4371872 - DNA, 18 bp, Homo sapiens
acagagcaagtcctcact

SEQ ID NO: 4371873 - DNA, 12 bp, Homo sapiens
acagagcagcaa

SEQ ID NO: 4371874 - DNA, 14 bp, Homo sapiens
acagagcaggactg

SEQ ID NO: 4371875 - DNA, 13 bp, Homo sapiens
acagagcctggcc

SEQ ID NO: 4371876 - DNA, 14 bp, Homo sapiens
acagagcctggccc

SEQ ID NO: 4371877 - DNA, 12 bp, Homo sapiens
acagaggaaagg

SEQ ID NO: 4371878 - DNA, 17 bp, Homo sapiens
acagaggaaagggctgg

SEQ ID NO: 4371879 - DNA, 20 bp, Homo sapiens
acagaggaaagggctggctc

SEQ ID NO: 4371880 - DNA, 15 bp, Homo sapiens
acagaggagtgcagc

SEQ ID NO: 4371881 - DNA, 14 bp, Homo sapiens
acagaggccccacc

SEQ ID NO: 4371882 - DNA, 22 bp, Homo sapiens
acagaggccccacctgaagggt

SEQ ID NO: 4371883 - DNA, 12 bp, Homo sapiens
acagaggcctgc

SEQ ID NO: 4371884 - DNA, 13 bp, Homo sapiens
acagaggcctgcc

SEQ ID NO: 4371885 - DNA, 24 bp, Homo sapiens
acagaggctgcacccctgggccag

SEQ ID NO: 4371886 - DNA, 20 bp, Homo sapiens
acagagggaagccagtcagg

SEQ ID NO: 4371887 - DNA, 16 bp, Homo sapiens
acagagggagacaggg

SEQ ID NO: 4371888 - DNA, 14 bp, Homo sapiens
acagagggagttta

SEQ ID NO: 4371889 - DNA, 13 bp, Homo sapiens
acagagggcacat

SEQ ID NO: 4371890 - DNA, 13 bp, Homo sapiens
acagaggtaacta

SEQ ID NO: 4371891 - DNA, 20 bp, Homo sapiens
acagagtgagactccatctc

SEQ ID NO: 4371892 - DNA, 14 bp, Homo sapiens
acagagtggccgtc

SEQ ID NO: 4371893 - DNA, 14 bp, Homo sapiens
acagataactgaaa

SEQ ID NO: 4371894 - DNA, 23 bp, Homo sapiens
acagatcaggaattctaaataaa

SEQ ID NO: 4371895 - DNA, 18 bp, Homo sapiens
acagatccccagcccctc

SEQ ID NO: 4371896 - DNA, 21 bp, Homo sapiens
acagatccccagcccctcctc

SEQ ID NO: 4371897 - DNA, 23 bp, Homo sapiens
acagatcgaaccgttttgaagct

SEQ ID NO: 4371898 - DNA, 19 bp, Homo sapiens
acagatcttttttttttcc

SEQ ID NO: 4371899 - DNA, 14 bp, Homo sapiens
acagatgagcagga

SEQ ID NO: 4371900 - DNA, 16 bp, Homo sapiens
acagatgaggcccccg

SEQ ID NO: 4371901 - DNA, 19 bp, Homo sapiens
acagatgccccagagctgt

SEQ ID NO: 4371902 - DNA, 22 bp, Homo sapiens
acagatgccccagagctgttta

SEQ ID NO: 4371903 - DNA, 20 bp, Homo sapiens
acagatgcctggtgagcagg

SEQ ID NO: 4371904 - DNA, 14 bp, Homo sapiens
acagatgctccagg

SEQ ID NO: 4371905 - DNA, 20 bp, Homo sapiens
acagatgtaaaagacttttt

SEQ ID NO: 4371906 - DNA, 19 bp, Homo sapiens
acagatgtttgttttcaaa

SEQ ID NO: 4371907 - DNA, 15 bp, Homo sapiens
acagattcaggccag

SEQ ID NO: 4371908 - DNA, 17 bp, Homo sapiens
acagattcaggccagcc

SEQ ID NO: 4371909 - DNA, 20 bp, Homo sapiens
acagattcaggccagcccag

SEQ ID NO: 4371910 - DNA, 16 bp, Homo sapiens
acagcaaatgcaaaaa

SEQ ID NO: 4371911 - DNA, 17 bp, Homo sapiens
acagcaacaatttatga

SEQ ID NO: 4371912 - DNA, 14 bp, Homo sapiens
acagcacacaggca

SEQ ID NO: 4371913 - DNA, 23 bp, Homo sapiens
acagcaccaccatttaatttcat

SEQ ID NO: 4371914 - DNA, 17 bp, Homo sapiens
acagcacctccccgctg

SEQ ID NO: 4371915 - DNA, 12 bp, Homo sapiens
acagcactactc

SEQ ID NO: 4371916 - DNA, 20 bp, Homo sapiens
acagcactactctgtgccag

SEQ ID NO: 4371917 - DNA, 21 bp, Homo sapiens
acagcagacaccattcattcc

SEQ ID NO: 4371918 - DNA, 12 bp, Homo sapiens
acagcagcaata

SEQ ID NO: 4371919 - DNA, 16 bp, Homo sapiens
acagcagcaatatttt

SEQ ID NO: 4371920 - DNA, 22 bp, Homo sapiens
acagcagcatttttatttcaga

SEQ ID NO: 4371921 - DNA, 18 bp, Homo sapiens
acagcaggctgccagtgc

SEQ ID NO: 4371922 - DNA, 18 bp, Homo sapiens
acagcagttgaaaagact

SEQ ID NO: 4371923 - DNA, 21 bp, Homo sapiens
acagcagttgaaaagactcca

SEQ ID NO: 4371924 - DNA, 23 bp, Homo sapiens
acagcagttgaaaagactccaaa

SEQ ID NO: 4371925 - DNA, 14 bp, Homo sapiens
acagcatcagctca

SEQ ID NO: 4371926 - DNA, 19 bp, Homo sapiens
acagcatcccttcccacat

SEQ ID NO: 4371927 - DNA, 22 bp, Homo sapiens
acagcatcgggagcacccagag

SEQ ID NO: 4371928 - DNA, 17 bp, Homo sapiens
acatagacagaagaaac

SEQ ID NO: 4371929 - DNA, 16 bp, Homo sapiens
acatagactagagaaa

SEQ ID NO: 4371930 - DNA, 18 bp, Homo sapiens
acatagagctttttaata

SEQ ID NO: 4371931 - DNA, 22 bp, Homo sapiens
acatagagctttttaatagcac

SEQ ID NO: 4371932 - DNA, 14 bp, Homo sapiens
acatagaggtatat

SEQ ID NO: 4371933 - DNA, 18 bp, Homo sapiens
acatagaggtatattgga

SEQ ID NO: 4371934 - DNA, 17 bp, Homo sapiens
acatagattcacctgta

SEQ ID NO: 4371935 - DNA, 22 bp, Homo sapiens
acatagattcacctgtaaaact

SEQ ID NO: 4371936 - DNA, 22 bp, Homo sapiens
acataggcagtagcctcctcct

SEQ ID NO: 4371937 - DNA, 16 bp, Homo sapiens
acataggcttctatta

SEQ ID NO: 4371938 - DNA, 19 bp, Homo sapiens
acataggcttctattacct

SEQ ID NO: 4371939 - DNA, 16 bp, Homo sapiens
acatagtattatgtca

SEQ ID NO: 4371940 - DNA, 19 bp, Homo sapiens
acatagttatttttctctt

SEQ ID NO: 4371941 - DNA, 21 bp, Homo sapiens
acatagttctgtaataaaact

SEQ ID NO: 4371942 - DNA, 22 bp, Homo sapiens
acatagttttcttcctttgaaa

SEQ ID NO: 4371943 - DNA, 15 bp, Homo sapiens
acatataaaactgtt

SEQ ID NO: 4371944 - DNA, 15 bp, Homo sapiens
acatatacatatgag

SEQ ID NO: 4371945 - DNA, 15 bp, Homo sapiens
acatataccaaaaac

SEQ ID NO: 4371946 - DNA, 20 bp, Homo sapiens
acatataccacccatagtgc

SEQ ID NO: 4371947 - DNA, 14 bp, Homo sapiens
acatatcaaatgaa

SEQ ID NO: 4371948 - DNA, 18 bp, Homo sapiens
acatatccaaaataatga

SEQ ID NO: 4371949 - DNA, 16 bp, Homo sapiens
acatatgatactgatg

SEQ ID NO: 4371950 - DNA, 16 bp, Homo sapiens
acatatgatctgtctg

SEQ ID NO: 4371951 - DNA, 17 bp, Homo sapiens
acatatgatctgtctgt

SEQ ID NO: 4371952 - DNA, 23 bp, Homo sapiens
acatatgggaactatgaggagcc

SEQ ID NO: 4371953 - DNA, 20 bp, Homo sapiens
acatatgtcacgaacttgaa

SEQ ID NO: 4371954 - DNA, 20 bp, Homo sapiens
acatattagtgcagccaagt

SEQ ID NO: 4371955 - DNA, 21 bp, Homo sapiens
acatattagtgcagccaagta

SEQ ID NO: 4371956 - DNA, 14 bp, Homo sapiens
acatattcatgaaa

SEQ ID NO: 4371957 - DNA, 13 bp, Homo sapiens
acatatttaactg

SEQ ID NO: 4371958 - DNA, 13 bp, Homo sapiens
acatatttaatgt

SEQ ID NO: 4371959 - DNA, 15 bp, Homo sapiens
acatatttaatgttt

SEQ ID NO: 4371960 - DNA, 20 bp, Homo sapiens
acatatttaatgttttaaat

SEQ ID NO: 4371961 - DNA, 19 bp, Homo sapiens
acatatttatttttacctg

SEQ ID NO: 4371962 - DNA, 23 bp, Homo sapiens
acatatttatttttacctgcttt

SEQ ID NO: 4371963 - DNA, 21 bp, Homo sapiens
acatatttgtatgtttttctg

SEQ ID NO: 4371964 - DNA, 14 bp, Homo sapiens
acatattttaaaat

SEQ ID NO: 4371965 - DNA, 13 bp, Homo sapiens
acatatttttaaa

SEQ ID NO: 4371966 - DNA, 19 bp, Homo sapiens
acatatttttatactttat

SEQ ID NO: 4371967 - DNA, 19 bp, Homo sapiens
acatattttttatatctgg

SEQ ID NO: 4371968 - DNA, 19 bp, Homo sapiens
acatcaacaagaagaaact

SEQ ID NO: 4371969 - DNA, 20 bp, Homo sapiens
acatcaacattccagggatg

SEQ ID NO: 4371970 - DNA, 21 bp, Homo sapiens
acatcaacattccagggatga

SEQ ID NO: 4371971 - DNA, 18 bp, Homo sapiens
acatcaagactatctaca

SEQ ID NO: 4371972 - DNA, 19 bp, Homo sapiens
acatcaagtccatctgaca

SEQ ID NO: 4371973 - DNA, 18 bp, Homo sapiens
acatcaatggctttgtac

SEQ ID NO: 4371974 - DNA, 21 bp, Homo sapiens
acatcaattaattaaatgaac

SEQ ID NO: 4371975 - DNA, 14 bp, Homo sapiens
acatcacaagacta

SEQ ID NO: 4371976 - DNA, 13 bp, Homo sapiens
acatcacatctta

SEQ ID NO: 4371977 - DNA, 18 bp, Homo sapiens
acatcacatcttatttat

SEQ ID NO: 4371978 - DNA, 21 bp, Homo sapiens
acatcacatcttatttatttt

SEQ ID NO: 4371979 - DNA, 18 bp, Homo sapiens
acatcactatcaatttta

SEQ ID NO: 4371980 - DNA, 19 bp, Homo sapiens
acatcactatcaattttaa

SEQ ID NO: 4371981 - DNA, 20 bp, Homo sapiens
acatcactatcaattttaag

SEQ ID NO: 4371982 - DNA, 12 bp, Homo sapiens
acatcagccttc

SEQ ID NO: 4371983 - DNA, 16 bp, Homo sapiens
acatcaggaaagagag

SEQ ID NO: 4371984 - DNA, 23 bp, Homo sapiens
acatcagggcggcctcccaggtc

SEQ ID NO: 4371985 - DNA, 16 bp, Homo sapiens
acatcagtacttttct

SEQ ID NO: 4371986 - DNA, 19 bp, Homo sapiens
acatcagtagcatttttct

SEQ ID NO: 4371987 - DNA, 23 bp, Homo sapiens
acatcagtatagtgttttattat

SEQ ID NO: 4371988 - DNA, 13 bp, Homo sapiens
acatcattattgt

SEQ ID NO: 4371989 - DNA, 14 bp, Homo sapiens
acatcattattgta

SEQ ID NO: 4371990 - DNA, 22 bp, Homo sapiens
acatcatttcaatcgtaaaatt

SEQ ID NO: 4371991 - DNA, 21 bp, Homo sapiens
acatccaaaatagttaagaca

SEQ ID NO: 4371992 - DNA, 12 bp, Homo sapiens
acatccagcaga

SEQ ID NO: 4371993 - DNA, 12 bp, Homo sapiens
acatcccatgtt

SEQ ID NO: 4371994 - DNA, 15 bp, Homo sapiens
acatcccatgttgaa

SEQ ID NO: 4371995 - DNA, 14 bp, Homo sapiens
acatccctgtaaat

SEQ ID NO: 4371996 - DNA, 17 bp, Homo sapiens
acatccgtcccacatca

SEQ ID NO: 4371997 - DNA, 14 bp, Homo sapiens
acatcctccgtcca

SEQ ID NO: 4371998 - DNA, 22 bp, Homo sapiens
acatcgcaatagttttttactt

SEQ ID NO: 4371999 - DNA, 13 bp, Homo sapiens
acatctaaagctt

SEQ ID NO: 4372000 - DNA, 15 bp, Homo sapiens
acatctaaagcttta

SEQ ID NO: 4372001 - DNA, 22 bp, Homo sapiens
acatctaaagctttatctttgt

SEQ ID NO: 4372002 - DNA, 17 bp, Homo sapiens
acatctaacctcatctt

SEQ ID NO: 4372003 - DNA, 18 bp, Homo sapiens
acatctacctaaaggact

SEQ ID NO: 4372004 - DNA, 23 bp, Homo sapiens
acatctattttggattgtatatt

SEQ ID NO: 4372005 - DNA, 15 bp, Homo sapiens
acatctctgactttc

SEQ ID NO: 4372006 - DNA, 16 bp, Homo sapiens
acatctctgactttct

SEQ ID NO: 4372007 - DNA, 23 bp, Homo sapiens
acatctgaggttttatttcattt

SEQ ID NO: 4372008 - DNA, 20 bp, Homo sapiens
acatctgcaatatgaattca

SEQ ID NO: 4372009 - DNA, 20 bp, Homo sapiens
acatctgccatttatttcct

SEQ ID NO: 4372010 - DNA, 23 bp, Homo sapiens
acatctgcctgtaattaaactag

SEQ ID NO: 4372011 - DNA, 23 bp, Homo sapiens
acatctggaaagttttctccact

SEQ ID NO: 4372012 - DNA, 19 bp, Homo sapiens
acatctgtaaatctacaca

SEQ ID NO: 4372013 - DNA, 16 bp, Homo sapiens
acatctgtgtcttgtt

SEQ ID NO: 4372014 - DNA, 16 bp, Homo sapiens
acatctgttatcaaac

SEQ ID NO: 4372015 - DNA, 12 bp, Homo sapiens
acatcttattta

SEQ ID NO: 4372016 - DNA, 16 bp, Homo sapiens
acatcttatttatttt

SEQ ID NO: 4372017 - DNA, 16 bp, Homo sapiens
acatcttgcattcaaa

SEQ ID NO: 4372018 - DNA, 16 bp, Homo sapiens
acatctttattgaaat

SEQ ID NO: 4372019 - DNA, 18 bp, Homo sapiens
acatctttattgaaattc

SEQ ID NO: 4372020 - DNA, 19 bp, Homo sapiens
acatctttattgaaattct

SEQ ID NO: 4372021 - DNA, 18 bp, Homo sapiens
acatctttccctaaagaa

SEQ ID NO: 4372022 - DNA, 15 bp, Homo sapiens
acatcttttaactgc

SEQ ID NO: 4372023 - DNA, 15 bp, Homo sapiens
acatgaacagcttgc

SEQ ID NO: 4372024 - DNA, 18 bp, Homo sapiens
acatgaagacaccatctc

SEQ ID NO: 4372025 - DNA, 15 bp, Homo sapiens
acatgaagattcttt

SEQ ID NO: 4372026 - DNA, 23 bp, Homo sapiens
acatgaagcaattagtctgaaac

SEQ ID NO: 4372027 - DNA, 13 bp, Homo sapiens
acatgaaggtaaa

SEQ ID NO: 4372028 - DNA, 15 bp, Homo sapiens
acatgacatccagag

SEQ ID NO: 4372029 - DNA, 19 bp, Homo sapiens
acatgaccctaaatcttga

SEQ ID NO: 4372030 - DNA, 21 bp, Homo sapiens
acatgaccctaaatcttgact

SEQ ID NO: 4372031 - DNA, 15 bp, Homo sapiens
acatgactctttatt

SEQ ID NO: 4372032 - DNA, 20 bp, Homo sapiens
acatgactctttattgtctg

SEQ ID NO: 4372033 - DNA, 12 bp, Homo sapiens
acatgagaaaga

SEQ ID NO: 4372034 - DNA, 19 bp, Homo sapiens
acatgaggccatctcagga

SEQ ID NO: 4372035 - DNA, 23 bp, Homo sapiens
acatgaggtactgagagtgaaca

SEQ ID NO: 4372036 - DNA, 17 bp, Homo sapiens
acatgatttccttgaat

SEQ ID NO: 4372037 - DNA, 21 bp, Homo sapiens
acatgatttccttgaatgtgg

SEQ ID NO: 4372038 - DNA, 23 bp, Homo sapiens
acatgatttccttgaatgtggct

SEQ ID NO: 4372039 - DNA, 12 bp, Homo sapiens
acatgcaacaga

SEQ ID NO: 4372040 - DNA, 11 bp, Homo sapiens
acatgcacagt

SEQ ID NO: 4372041 - DNA, 20 bp, Homo sapiens
acatgcagaataatcctgtt

SEQ ID NO: 4372042 - DNA, 17 bp, Homo sapiens
acatgcagcccatgccc

SEQ ID NO: 4372043 - DNA, 20 bp, Homo sapiens
acatgcagcccatgcccacc

SEQ ID NO: 4372044 - DNA, 12 bp, Homo sapiens
acatgcagtttg

SEQ ID NO: 4372045 - DNA, 13 bp, Homo sapiens
acatgcagtttga

SEQ ID NO: 4372046 - DNA, 22 bp, Homo sapiens
accactcttctttaagccatag

SEQ ID NO: 4372047 - DNA, 14 bp, Homo sapiens
accactgttctgtt

SEQ ID NO: 4372048 - DNA, 15 bp, Homo sapiens
accacttcagggctt

SEQ ID NO: 4372049 - DNA, 23 bp, Homo sapiens
accacttccaggggaacctgcca

SEQ ID NO: 4372050 - DNA, 15 bp, Homo sapiens
accacttcgcacaca

SEQ ID NO: 4372051 - DNA, 16 bp, Homo sapiens
accacttcgcacacac

SEQ ID NO: 4372052 - DNA, 13 bp, Homo sapiens
accagaaaagcaa

SEQ ID NO: 4372053 - DNA, 14 bp, Homo sapiens
accagaaaagcaat

SEQ ID NO: 4372054 - DNA, 16 bp, Homo sapiens
accagaacgcacccca

SEQ ID NO: 4372055 - DNA, 21 bp, Homo sapiens
accagaacgtggtttgcctga

SEQ ID NO: 4372056 - DNA, 17 bp, Homo sapiens
accagacgtcaggccct

SEQ ID NO: 4372057 - DNA, 14 bp, Homo sapiens
accagagccgggag

SEQ ID NO: 4372058 - DNA, 17 bp, Homo sapiens
accagagccttcaagtg

SEQ ID NO: 4372059 - DNA, 20 bp, Homo sapiens
accagagccttcaagtgcca

SEQ ID NO: 4372060 - DNA, 21 bp, Homo sapiens
accagagccttcaagtgccaa

SEQ ID NO: 4372061 - DNA, 15 bp, Homo sapiens
accagaggtggcagg

SEQ ID NO: 4372062 - DNA, 22 bp, Homo sapiens
accagagtcttaagggtcactg

SEQ ID NO: 4372063 - DNA, 20 bp, Homo sapiens
accagatcaggagagcaagg

SEQ ID NO: 4372064 - DNA, 13 bp, Homo sapiens
accagatgagaat

SEQ ID NO: 4372065 - DNA, 17 bp, Homo sapiens
accagcaatatatctga

SEQ ID NO: 4372066 - DNA, 20 bp, Homo sapiens
accagcagcaactgaaaatg

SEQ ID NO: 4372067 - DNA, 15 bp, Homo sapiens
accagccagatcctc

SEQ ID NO: 4372068 - DNA, 19 bp, Homo sapiens
accagccaggctctgtgct

SEQ ID NO: 4372069 - DNA, 20 bp, Homo sapiens
accagccaggctctgtgctg

SEQ ID NO: 4372070 - DNA, 22 bp, Homo sapiens
accagccatacttatctctctg

SEQ ID NO: 4372071 - DNA, 20 bp, Homo sapiens
accagcccattggccgagct

SEQ ID NO: 4372072 - DNA, 16 bp, Homo sapiens
accagccccatcagaa

SEQ ID NO: 4372073 - DNA, 18 bp, Homo sapiens
accagccccccgcgcgcc

SEQ ID NO: 4372074 - DNA, 20 bp, Homo sapiens
accagcccccgccccagagt

SEQ ID NO: 4372075 - DNA, 14 bp, Homo sapiens
accagccctgcagc

SEQ ID NO: 4372076 - DNA, 21 bp, Homo sapiens
accagcctagcctggctctgc

SEQ ID NO: 4372077 - DNA, 14 bp, Homo sapiens
accagcctggtcaa

SEQ ID NO: 4372078 - DNA, 20 bp, Homo sapiens
accagcctgtccaacatggt

SEQ ID NO: 4372079 - DNA, 17 bp, Homo sapiens
accagccttgctctctt

SEQ ID NO: 4372080 - DNA, 16 bp, Homo sapiens
accagctaccctgtgt

SEQ ID NO: 4372081 - DNA, 17 bp, Homo sapiens
accagctatctgtcatc

SEQ ID NO: 4372082 - DNA, 14 bp, Homo sapiens
accagctgcaaagt

SEQ ID NO: 4372083 - DNA, 20 bp, Homo sapiens
accagctgcaaagtgttttg

SEQ ID NO: 4372084 - DNA, 22 bp, Homo sapiens
accagctgcaaagtgttttgta

SEQ ID NO: 4372085 - DNA, 20 bp, Homo sapiens
accagctgcgcttgcttttc

SEQ ID NO: 4372086 - DNA, 18 bp, Homo sapiens
accagcttgcgaataaca

SEQ ID NO: 4372087 - DNA, 20 bp, Homo sapiens
accaggaatgttaaagtcag

SEQ ID NO: 4372088 - DNA, 17 bp, Homo sapiens
accaggacaggaccaga

SEQ ID NO: 4372089 - DNA, 14 bp, Homo sapiens
accaggactccctc

SEQ ID NO: 4372090 - DNA, 16 bp, Homo sapiens
accaggactccctcct

SEQ ID NO: 4372091 - DNA, 17 bp, Homo sapiens
accaggactccctcctc

SEQ ID NO: 4372092 - DNA, 18 bp, Homo sapiens
accaggactccctcctca

SEQ ID NO: 4372093 - DNA, 20 bp, Homo sapiens
accaggcacgaacccacctg

SEQ ID NO: 4372094 - DNA, 17 bp, Homo sapiens
accaggccagctcagga

SEQ ID NO: 4372095 - DNA, 18 bp, Homo sapiens
accaggccagctcaggaa

SEQ ID NO: 4372096 - DNA, 17 bp, Homo sapiens
accaggccccagcctcc

SEQ ID NO: 4372097 - DNA, 17 bp, Homo sapiens
accaggctgcctccctt

SEQ ID NO: 4372098 - DNA, 13 bp, Homo sapiens
accaggctgggca

SEQ ID NO: 4372099 - DNA, 14 bp, Homo sapiens
accagggactgagg

SEQ ID NO: 4372100 - DNA, 20 bp, Homo sapiens
accagggatcacagaccaca

SEQ ID NO: 4372101 - DNA, 22 bp, Homo sapiens
accagggatgctgggctgggcc

SEQ ID NO: 4372102 - DNA, 16 bp, Homo sapiens
accagggcgcaagcct

SEQ ID NO: 4372103 - DNA, 20 bp, Homo sapiens
accaggggccaacctcaggc

SEQ ID NO: 4372104 - DNA, 17 bp, Homo sapiens
accaggggtgcacaata

SEQ ID NO: 4372105 - DNA, 20 bp, Homo sapiens
accaggggtgcacaataaag

SEQ ID NO: 4372106 - DNA, 15 bp, Homo sapiens
accagggtggccaca

SEQ ID NO: 4372107 - DNA, 23 bp, Homo sapiens
accaggtgcctttcaaatttaga

SEQ ID NO: 4372108 - DNA, 15 bp, Homo sapiens
accagtatttaagct

SEQ ID NO: 4372109 - DNA, 21 bp, Homo sapiens
accagtatttttgctgcttct

SEQ ID NO: 4372110 - DNA, 13 bp, Homo sapiens
accagtcagatgg

SEQ ID NO: 4372111 - DNA, 21 bp, Homo sapiens
accagtgaatttttgcaataa

SEQ ID NO: 4372112 - DNA, 22 bp, Homo sapiens
accagtgcctctccctgctgct

SEQ ID NO: 4372113 - DNA, 19 bp, Homo sapiens
accagtgggactgtggtga

SEQ ID NO: 4372114 - DNA, 12 bp, Homo sapiens
accagtgtgaac

SEQ ID NO: 4372115 - DNA, 13 bp, Homo sapiens
accagtgtgaacc

SEQ ID NO: 4372116 - DNA, 22 bp, Homo sapiens
accagtgttagggaagggcctg

SEQ ID NO: 4372117 - DNA, 15 bp, Homo sapiens
accagtgttcctgaa

SEQ ID NO: 4372118 - DNA, 19 bp, Homo sapiens
accagtgttgggttttttt

SEQ ID NO: 4372119 - DNA, 12 bp, Homo sapiens
accagttaattt

SEQ ID NO: 4372120 - DNA, 16 bp, Homo sapiens
accagttaatttttcc

SEQ ID NO: 4372121 - DNA, 16 bp, Homo sapiens
accataagctactgcc

SEQ ID NO: 4372122 - DNA, 18 bp, Homo sapiens
accataagctactgccat

SEQ ID NO: 4372123 - DNA, 12 bp, Homo sapiens
accatactcaga

SEQ ID NO: 4372124 - DNA, 15 bp, Homo sapiens
accatactgagggac

SEQ ID NO: 4372125 - DNA, 12 bp, Homo sapiens
accatagaaaaa

SEQ ID NO: 4372126 - DNA, 15 bp, Homo sapiens
accatagaaaaatgt

SEQ ID NO: 4372127 - DNA, 20 bp, Homo sapiens
accatagaaaaatgtataaa

SEQ ID NO: 4372128 - DNA, 17 bp, Homo sapiens
accatagggcatgatta

SEQ ID NO: 4372129 - DNA, 17 bp, Homo sapiens
accatatgtccactgtt

SEQ ID NO: 4372130 - DNA, 16 bp, Homo sapiens
accatattttttatga

SEQ ID NO: 4372131 - DNA, 19 bp, Homo sapiens
accatcaaaggaatataag

SEQ ID NO: 4372132 - DNA, 15 bp, Homo sapiens
accatcaagaaccta

SEQ ID NO: 4372133 - DNA, 22 bp, Homo sapiens
accatcactgagagtcaggagt

SEQ ID NO: 4372134 - DNA, 23 bp, Homo sapiens
accatccactctaccctcccacc

SEQ ID NO: 4372135 - DNA, 21 bp, Homo sapiens
accatccattctcctcagtgg

SEQ ID NO: 4372136 - DNA, 14 bp, Homo sapiens
accatccccaactc

SEQ ID NO: 4372137 - DNA, 23 bp, Homo sapiens
accatctacctgcttggtctttc

SEQ ID NO: 4372138 - DNA, 18 bp, Homo sapiens
accatctatgtgaatatt

SEQ ID NO: 4372139 - DNA, 18 bp, Homo sapiens
accatgagatgagatgac

SEQ ID NO: 4372140 - DNA, 18 bp, Homo sapiens
accatgcaaattgtgaaa

SEQ ID NO: 4372141 - DNA, 14 bp, Homo sapiens
accatgcactgtaa

SEQ ID NO: 4372142 - DNA, 19 bp, Homo sapiens
accatgccaggctaatttt

SEQ ID NO: 4372143 - DNA, 22 bp, Homo sapiens
accatgctcaatgaaaaggtga

SEQ ID NO: 4372144 - DNA, 15 bp, Homo sapiens
accatgctctctcac

SEQ ID NO: 4372145 - DNA, 16 bp, Homo sapiens
accatgctctctcacc

SEQ ID NO: 4372146 - DNA, 22 bp, Homo sapiens
accatgctctctcacctgctcc

SEQ ID NO: 4372147 - DNA, 22 bp, Homo sapiens
accatggccaattcagtttcac

SEQ ID NO: 4372148 - DNA, 17 bp, Homo sapiens
accatgtagaaaatttg

SEQ ID NO: 4372149 - DNA, 17 bp, Homo sapiens
accatgttatattgctt

SEQ ID NO: 4372150 - DNA, 14 bp, Homo sapiens
accatgttgcactg

SEQ ID NO: 4372151 - DNA, 15 bp, Homo sapiens
accatgttgcactgt

SEQ ID NO: 4372152 - DNA, 14 bp, Homo sapiens
accatgttgcgttc

SEQ ID NO: 4372153 - DNA, 19 bp, Homo sapiens
accatgttggccaggatgg

SEQ ID NO: 4372154 - DNA, 13 bp, Homo sapiens
accatgtttcaaa

SEQ ID NO: 4372155 - DNA, 19 bp, Homo sapiens
accatgtttgagctcagac

SEQ ID NO: 4372156 - DNA, 14 bp, Homo sapiens
accattaccaaaat

SEQ ID NO: 4372157 - DNA, 20 bp, Homo sapiens
accattatgatcaaaaactg

SEQ ID NO: 4372158 - DNA, 20 bp, Homo sapiens
accattcacaataaaagctt

SEQ ID NO: 4372159 - DNA, 23 bp, Homo sapiens
accattctaggtgtttcaacaga

SEQ ID NO: 4372160 - DNA, 16 bp, Homo sapiens
accattgaaggcttaa

SEQ ID NO: 4372161 - DNA, 18 bp, Homo sapiens
accattgatttaatgtaa

SEQ ID NO: 4372162 - DNA, 21 bp, Homo sapiens
accattgctcttagtcccaag

SEQ ID NO: 4372163 - DNA, 16 bp, Homo sapiens
accattggggctccca

SEQ ID NO: 4372164 - DNA, 14 bp, Homo sapiens
acctctgcctcaat

SEQ ID NO: 4372165 - DNA, 23 bp, Homo sapiens
acctctggactggctagagtcct

SEQ ID NO: 4372166 - DNA, 23 bp, Homo sapiens
acctcttccccagaaaggagact

SEQ ID NO: 4372167 - DNA, 18 bp, Homo sapiens
acctcttcctaggccacg

SEQ ID NO: 4372168 - DNA, 20 bp, Homo sapiens
acctcttctaccctcatcat

SEQ ID NO: 4372169 - DNA, 12 bp, Homo sapiens
acctcttgcctc

SEQ ID NO: 4372170 - DNA, 20 bp, Homo sapiens
acctcttgtgcaaggtggcc

SEQ ID NO: 4372171 - DNA, 17 bp, Homo sapiens
acctctttttcctcctg

SEQ ID NO: 4372172 - DNA, 21 bp, Homo sapiens
acctgaaataatatatttctt

SEQ ID NO: 4372173 - DNA, 16 bp, Homo sapiens
acctgaaccccagagg

SEQ ID NO: 4372174 - DNA, 16 bp, Homo sapiens
acctgaactgaacacc

SEQ ID NO: 4372175 - DNA, 19 bp, Homo sapiens
acctgacactcccttgggc

SEQ ID NO: 4372176 - DNA, 23 bp, Homo sapiens
acctgacccctgctcagtaaagc

SEQ ID NO: 4372177 - DNA, 20 bp, Homo sapiens
acctgagaccctgggagaga

SEQ ID NO: 4372178 - DNA, 18 bp, Homo sapiens
acctgagcattcaggcag

SEQ ID NO: 4372179 - DNA, 12 bp, Homo sapiens
acctgagcccca

SEQ ID NO: 4372180 - DNA, 19 bp, Homo sapiens
acctgagcgggagtcaggg

SEQ ID NO: 4372181 - DNA, 22 bp, Homo sapiens
acctgagcgggagtcagggacc

SEQ ID NO: 4372182 - DNA, 21 bp, Homo sapiens
acctgagctattttcctctgg

SEQ ID NO: 4372183 - DNA, 23 bp, Homo sapiens
acctgagggcagaaaggttctgc

SEQ ID NO: 4372184 - DNA, 23 bp, Homo sapiens
acctgagttcccgggagctgggc

SEQ ID NO: 4372185 - DNA, 15 bp, Homo sapiens
acctgattggccact

SEQ ID NO: 4372186 - DNA, 16 bp, Homo sapiens
acctgattgtattttt

SEQ ID NO: 4372187 - DNA, 11 bp, Homo sapiens
acctgattttt

SEQ ID NO: 4372188 - DNA, 20 bp, Homo sapiens
acctgattttttttcctttt

SEQ ID NO: 4372189 - DNA, 13 bp, Homo sapiens
acctgcaagcctt

SEQ ID NO: 4372190 - DNA, 19 bp, Homo sapiens
acctgcaagttgctctgac

SEQ ID NO: 4372191 - DNA, 20 bp, Homo sapiens
acctgcaagttgctctgacc

SEQ ID NO: 4372192 - DNA, 21 bp, Homo sapiens
acctgcacattgggtggggct

SEQ ID NO: 4372193 - DNA, 16 bp, Homo sapiens
acctgcacctcccccc

SEQ ID NO: 4372194 - DNA, 19 bp, Homo sapiens
acctgcacctccccccact

SEQ ID NO: 4372195 - DNA, 21 bp, Homo sapiens
acctgcacctccccccactgc

SEQ ID NO: 4372196 - DNA, 17 bp, Homo sapiens
acctgcactaacagagt

SEQ ID NO: 4372197 - DNA, 18 bp, Homo sapiens
acctgcactaacagagtg

SEQ ID NO: 4372198 - DNA, 13 bp, Homo sapiens
acctgccactcac

SEQ ID NO: 4372199 - DNA, 22 bp, Homo sapiens
acctgccactcacacagccagg

SEQ ID NO: 4372200 - DNA, 13 bp, Homo sapiens
acctgccaggcag

SEQ ID NO: 4372201 - DNA, 15 bp, Homo sapiens
acctgccaggcaggg

SEQ ID NO: 4372202 - DNA, 19 bp, Homo sapiens
acctgccatgccaggaacc

SEQ ID NO: 4372203 - DNA, 16 bp, Homo sapiens
acctgcccccaatcca

SEQ ID NO: 4372204 - DNA, 17 bp, Homo sapiens
acctgccctaaaccctg

SEQ ID NO: 4372205 - DNA, 21 bp, Homo sapiens
acctgcctcggcctcccaaag

SEQ ID NO: 4372206 - DNA, 22 bp, Homo sapiens
acctgccttggcctcccaaagt

SEQ ID NO: 4372207 - DNA, 16 bp, Homo sapiens
acctgctcacgtcaaa

SEQ ID NO: 4372208 - DNA, 20 bp, Homo sapiens
acctgctcacgtcaaatgca

SEQ ID NO: 4372209 - DNA, 18 bp, Homo sapiens
acctgctcccagtcctgc

SEQ ID NO: 4372210 - DNA, 22 bp, Homo sapiens
acctgctcccagtcctgcctga

SEQ ID NO: 4372211 - DNA, 13 bp, Homo sapiens
acctgctgctcag

SEQ ID NO: 4372212 - DNA, 14 bp, Homo sapiens
acctgctgctcagt

SEQ ID NO: 4372213 - DNA, 15 bp, Homo sapiens
acctgctgcttctcc

SEQ ID NO: 4372214 - DNA, 20 bp, Homo sapiens
acctggaatctacaagccaa

SEQ ID NO: 4372215 - DNA, 23 bp, Homo sapiens
acctggagaactagaacctggag

SEQ ID NO: 4372216 - DNA, 13 bp, Homo sapiens
acctggagagcta

SEQ ID NO: 4372217 - DNA, 22 bp, Homo sapiens
acctggagagctagaacctgga

SEQ ID NO: 4372218 - DNA, 18 bp, Homo sapiens
acctggagcagaggaggg

SEQ ID NO: 4372219 - DNA, 13 bp, Homo sapiens
acctggagggcta

SEQ ID NO: 4372220 - DNA, 22 bp, Homo sapiens
acctggagggctagaacctgga

SEQ ID NO: 4372221 - DNA, 23 bp, Homo sapiens
acctggagggctagaacctggag

SEQ ID NO: 4372222 - DNA, 22 bp, Homo sapiens
acctggagggctagaacctggc

SEQ ID NO: 4372223 - DNA, 15 bp, Homo sapiens
acctggagggctgga

SEQ ID NO: 4372224 - DNA, 20 bp, Homo sapiens
acctggcaagctagaacctg

SEQ ID NO: 4372225 - DNA, 22 bp, Homo sapiens
acctggcaagctagaacctgga

SEQ ID NO: 4372226 - DNA, 23 bp, Homo sapiens
acctggcaagctagaacctggag

SEQ ID NO: 4372227 - DNA, 14 bp, Homo sapiens
acctggcactggga

SEQ ID NO: 4372228 - DNA, 21 bp, Homo sapiens
acctggccccatgtctctcag

SEQ ID NO: 4372229 - DNA, 17 bp, Homo sapiens
acctggcgtgctcagac

SEQ ID NO: 4372230 - DNA, 23 bp, Homo sapiens
acctggctctgtggcgagccatt

SEQ ID NO: 4372231 - DNA, 19 bp, Homo sapiens
acctggctgaggttcctct

SEQ ID NO: 4372232 - DNA, 17 bp, Homo sapiens
acctggcttatttaata

SEQ ID NO: 4372233 - DNA, 14 bp, Homo sapiens
acctgggaatttat

SEQ ID NO: 4372234 - DNA, 15 bp, Homo sapiens
acctgggatcctgac

SEQ ID NO: 4372235 - DNA, 22 bp, Homo sapiens
acctggggggcagtggtgtgga

SEQ ID NO: 4372236 - DNA, 15 bp, Homo sapiens
acctgtaaaacttta

SEQ ID NO: 4372237 - DNA, 21 bp, Homo sapiens
acctgtaaaactttattttat

SEQ ID NO: 4372238 - DNA, 14 bp, Homo sapiens
acctgtagtcccag

SEQ ID NO: 4372239 - DNA, 19 bp, Homo sapiens
acctgtatatttcttttaa

SEQ ID NO: 4372240 - DNA, 12 bp, Homo sapiens
acctgtatttaa

SEQ ID NO: 4372241 - DNA, 21 bp, Homo sapiens
acctgtatttaagcaaatact

SEQ ID NO: 4372242 - DNA, 19 bp, Homo sapiens
acctgtcaaaaattttgaa

SEQ ID NO: 4372243 - DNA, 21 bp, Homo sapiens
acctgtcaaaaattttgaatg

SEQ ID NO: 4372244 - DNA, 23 bp, Homo sapiens
acctgtcaaaaattttgaatgta

SEQ ID NO: 4372245 - DNA, 18 bp, Homo sapiens
acctgtctatactacagt

SEQ ID NO: 4372246 - DNA, 10 bp, Homo sapiens
acctgtggat

SEQ ID NO: 4372247 - DNA, 19 bp, Homo sapiens
acctgtggccaagttctta

SEQ ID NO: 4372248 - DNA, 24 bp, Homo sapiens
acctgtgtgagattttattttgac

SEQ ID NO: 4372249 - DNA, 19 bp, Homo sapiens
acctgttaatttttatact

SEQ ID NO: 4372250 - DNA, 13 bp, Homo sapiens
acctgttatttct

SEQ ID NO: 4372251 - DNA, 18 bp, Homo sapiens
acctgtttctggaagact

SEQ ID NO: 4372252 - DNA, 13 bp, Homo sapiens
acctgtttgaagg

SEQ ID NO: 4372253 - DNA, 22 bp, Homo sapiens
accttaaaggccgtcatttcat

SEQ ID NO: 4372254 - DNA, 14 bp, Homo sapiens
accttaaattaaac

SEQ ID NO: 4372255 - DNA, 16 bp, Homo sapiens
accttaaattaaacaa

SEQ ID NO: 4372256 - DNA, 17 bp, Homo sapiens
accttaaattaaacaat

SEQ ID NO: 4372257 - DNA, 19 bp, Homo sapiens
accttaaggcagtagttct

SEQ ID NO: 4372258 - DNA, 18 bp, Homo sapiens
accttaatgacaacactt

SEQ ID NO: 4372259 - DNA, 19 bp, Homo sapiens
accttaatgacaacactta

SEQ ID NO: 4372260 - DNA, 20 bp, Homo sapiens
accttacaacgccgagtgca

SEQ ID NO: 4372261 - DNA, 17 bp, Homo sapiens
accttagcgttctggac

SEQ ID NO: 4372262 - DNA, 16 bp, Homo sapiens
accttaggctttgtat

SEQ ID NO: 4372263 - DNA, 20 bp, Homo sapiens
accttaggctttgtatgaca

SEQ ID NO: 4372264 - DNA, 16 bp, Homo sapiens
accttaggttctttct

SEQ ID NO: 4372265 - DNA, 12 bp, Homo sapiens
accttatagtta

SEQ ID NO: 4372266 - DNA, 22 bp, Homo sapiens
accttatagttactgtgtaatt

SEQ ID NO: 4372267 - DNA, 23 bp, Homo sapiens
accttatagttactgtgtaatta

SEQ ID NO: 4372268 - DNA, 16 bp, Homo sapiens
accttcatgcccttct

SEQ ID NO: 4372269 - DNA, 12 bp, Homo sapiens
accttccaccca

SEQ ID NO: 4372270 - DNA, 22 bp, Homo sapiens
accttccatacacagaggagtg

SEQ ID NO: 4372271 - DNA, 12 bp, Homo sapiens
accttcccagct

SEQ ID NO: 4372272 - DNA, 18 bp, Homo sapiens
accttcctcctgcagaca

SEQ ID NO: 4372273 - DNA, 11 bp, Homo sapiens
accttcctggg

SEQ ID NO: 4372274 - DNA, 18 bp, Homo sapiens
accttcctgtccctgagg

SEQ ID NO: 4372275 - DNA, 16 bp, Homo sapiens
accttgaaaaaaaaca

SEQ ID NO: 4372276 - DNA, 20 bp, Homo sapiens
accttgaaaataagaataga

SEQ ID NO: 4372277 - DNA, 12 bp, Homo sapiens
accttgaaatgg

SEQ ID NO: 4372278 - DNA, 22 bp, Homo sapiens
accttgaataaggcccactgta

SEQ ID NO: 4372279 - DNA, 23 bp, Homo sapiens
accttgaataaggcccactgtaa

SEQ ID NO: 4372280 - DNA, 14 bp, Homo sapiens
accttgccttgaaa

SEQ ID NO: 4372281 - DNA, 20 bp, Homo sapiens
actacagaatattaaatatt

SEQ ID NO: 4372282 - DNA, 20 bp, Homo sapiens
actacagtcaagatagaaag

SEQ ID NO: 4372283 - DNA, 11 bp, Homo sapiens
actacatctgg

SEQ ID NO: 4372284 - DNA, 13 bp, Homo sapiens
actacatctggga

SEQ ID NO: 4372285 - DNA, 15 bp, Homo sapiens
actacatctgggact

SEQ ID NO: 4372286 - DNA, 13 bp, Homo sapiens
actacattcattt

SEQ ID NO: 4372287 - DNA, 15 bp, Homo sapiens
actacattttaaaaa

SEQ ID NO: 4372288 - DNA, 19 bp, Homo sapiens
actactaatagaataaagg

SEQ ID NO: 4372289 - DNA, 14 bp, Homo sapiens
actactcctctgca

SEQ ID NO: 4372290 - DNA, 14 bp, Homo sapiens
actactctttgatt

SEQ ID NO: 4372291 - DNA, 15 bp, Homo sapiens
actactgcatttata

SEQ ID NO: 4372292 - DNA, 21 bp, Homo sapiens
actactgcctttagaaaatat

SEQ ID NO: 4372293 - DNA, 12 bp, Homo sapiens
actactgggtgt

SEQ ID NO: 4372294 - DNA, 13 bp, Homo sapiens
actactgggtgtc

SEQ ID NO: 4372295 - DNA, 14 bp, Homo sapiens
actactgggtgtca

SEQ ID NO: 4372296 - DNA, 23 bp, Homo sapiens
actactgggtgtcatttcattcc

SEQ ID NO: 4372297 - DNA, 22 bp, Homo sapiens
actactttgttaggattttcac

SEQ ID NO: 4372298 - DNA, 14 bp, Homo sapiens
actacttttctaaa

SEQ ID NO: 4372299 - DNA, 16 bp, Homo sapiens
actacttttctaaaat

SEQ ID NO: 4372300 - DNA, 22 bp, Homo sapiens
actagaatcaccgcatttcagt

SEQ ID NO: 4372301 - DNA, 14 bp, Homo sapiens
actagactttatgt

SEQ ID NO: 4372302 - DNA, 11 bp, Homo sapiens
actagagaaac

SEQ ID NO: 4372303 - DNA, 12 bp, Homo sapiens
actagagaaacc

SEQ ID NO: 4372304 - DNA, 16 bp, Homo sapiens
actagagatattttgt

SEQ ID NO: 4372305 - DNA, 18 bp, Homo sapiens
actagagatattttgtaa

SEQ ID NO: 4372306 - DNA, 19 bp, Homo sapiens
actagagatattttgtaaa

SEQ ID NO: 4372307 - DNA, 21 bp, Homo sapiens
actagagatattttgtaaaat

SEQ ID NO: 4372308 - DNA, 13 bp, Homo sapiens
actagagcaaaat

SEQ ID NO: 4372309 - DNA, 19 bp, Homo sapiens
actagagcaaaataatgca

SEQ ID NO: 4372310 - DNA, 13 bp, Homo sapiens
actagatgatgga

SEQ ID NO: 4372311 - DNA, 23 bp, Homo sapiens
actagcaccattttaagtccctg

SEQ ID NO: 4372312 - DNA, 17 bp, Homo sapiens
actagcattacattatt

SEQ ID NO: 4372313 - DNA, 14 bp, Homo sapiens
actagccaaaccag

SEQ ID NO: 4372314 - DNA, 18 bp, Homo sapiens
actagccaaaccaggacc

SEQ ID NO: 4372315 - DNA, 15 bp, Homo sapiens
actagccactcctgc

SEQ ID NO: 4372316 - DNA, 17 bp, Homo sapiens
actagcccaatgaaatg

SEQ ID NO: 4372317 - DNA, 16 bp, Homo sapiens
actagcctggccaaca

SEQ ID NO: 4372318 - DNA, 19 bp, Homo sapiens
actaggagatgaaactggt

SEQ ID NO: 4372319 - DNA, 20 bp, Homo sapiens
actaggcctgaaatgacatt

SEQ ID NO: 4372320 - DNA, 23 bp, Homo sapiens
actaggcctgaaatgacatttca

SEQ ID NO: 4372321 - DNA, 22 bp, Homo sapiens
actaggctcttatgtgtgcctt

SEQ ID NO: 4372322 - DNA, 14 bp, Homo sapiens
actaggctgagcaa

SEQ ID NO: 4372323 - DNA, 21 bp, Homo sapiens
actagggactatcaggtaata

SEQ ID NO: 4372324 - DNA, 18 bp, Homo sapiens
actagggatccctcatct

SEQ ID NO: 4372325 - DNA, 19 bp, Homo sapiens
actagggatccctcatctg

SEQ ID NO: 4372326 - DNA, 16 bp, Homo sapiens
actaggtgtccccaac

SEQ ID NO: 4372327 - DNA, 19 bp, Homo sapiens
actaggtgtccccaacgtc

SEQ ID NO: 4372328 - DNA, 19 bp, Homo sapiens
actagtaagtaattatgca

SEQ ID NO: 4372329 - DNA, 17 bp, Homo sapiens
actagtgcaattccaag

SEQ ID NO: 4372330 - DNA, 20 bp, Homo sapiens
actagtgtttaagtcatttt

SEQ ID NO: 4372331 - DNA, 21 bp, Homo sapiens
actagtttttcctatcatgtt

SEQ ID NO: 4372332 - DNA, 18 bp, Homo sapiens
actataaacttaagggca

SEQ ID NO: 4372333 - DNA, 20 bp, Homo sapiens
actataaacttaagggcaag

SEQ ID NO: 4372334 - DNA, 20 bp, Homo sapiens
actataacattatataacaa

SEQ ID NO: 4372335 - DNA, 12 bp, Homo sapiens
actataatcaaa

SEQ ID NO: 4372336 - DNA, 16 bp, Homo sapiens
actataatcaaatgat

SEQ ID NO: 4372337 - DNA, 18 bp, Homo sapiens
actataatcaaatgattt

SEQ ID NO: 4372338 - DNA, 19 bp, Homo sapiens
actataatcaaatgatttc

SEQ ID NO: 4372339 - DNA, 21 bp, Homo sapiens
actataatgtgaaatgtaact

SEQ ID NO: 4372340 - DNA, 23 bp, Homo sapiens
actatacttgaacaaaagggtca

SEQ ID NO: 4372341 - DNA, 16 bp, Homo sapiens
actatagcaaagtagt

SEQ ID NO: 4372342 - DNA, 20 bp, Homo sapiens
actatagcaaagtagtactt

SEQ ID NO: 4372343 - DNA, 19 bp, Homo sapiens
actatataatttatttcca

SEQ ID NO: 4372344 - DNA, 22 bp, Homo sapiens
actatatacatcacgttaaagt

SEQ ID NO: 4372345 - DNA, 16 bp, Homo sapiens
actatatatatttcta

SEQ ID NO: 4372346 - DNA, 17 bp, Homo sapiens
actatatatatttctag

SEQ ID NO: 4372347 - DNA, 23 bp, Homo sapiens
actatatgtgaaacattttttct

SEQ ID NO: 4372348 - DNA, 19 bp, Homo sapiens
actatcctgtaaatatatc

SEQ ID NO: 4372349 - DNA, 19 bp, Homo sapiens
actatgaaaagctagaatt

SEQ ID NO: 4372350 - DNA, 18 bp, Homo sapiens
actatgaggagcctctga

SEQ ID NO: 4372351 - DNA, 19 bp, Homo sapiens
actatgatgagaggccagc

SEQ ID NO: 4372352 - DNA, 19 bp, Homo sapiens
actatggagtcttgtgaaa

SEQ ID NO: 4372353 - DNA, 14 bp, Homo sapiens
actatgtaaactac

SEQ ID NO: 4372354 - DNA, 14 bp, Homo sapiens
actatgtaacatgt

SEQ ID NO: 4372355 - DNA, 15 bp, Homo sapiens
actatgtctgaacat

SEQ ID NO: 4372356 - DNA, 16 bp, Homo sapiens
actattcaaacagtct

SEQ ID NO: 4372357 - DNA, 18 bp, Homo sapiens
actattcaaacagtctca

SEQ ID NO: 4372358 - DNA, 19 bp, Homo sapiens
actattcgaatgaaaagac

SEQ ID NO: 4372359 - DNA, 21 bp, Homo sapiens
actattgtgaatatttggaat

SEQ ID NO: 4372360 - DNA, 21 bp, Homo sapiens
actattgtgccaactgccagg

SEQ ID NO: 4372361 - DNA, 14 bp, Homo sapiens
actattgttacatt

SEQ ID NO: 4372362 - DNA, 20 bp, Homo sapiens
actatttatatcacacaata

SEQ ID NO: 4372363 - DNA, 11 bp, Homo sapiens
actatttctgt

SEQ ID NO: 4372364 - DNA, 15 bp, Homo sapiens
actatttctttttat

SEQ ID NO: 4372365 - DNA, 14 bp, Homo sapiens
actatttgaccccc

SEQ ID NO: 4372366 - DNA, 18 bp, Homo sapiens
actatttgctaatgtata

SEQ ID NO: 4372367 - DNA, 15 bp, Homo sapiens
actattttaaataaa

SEQ ID NO: 4372368 - DNA, 15 bp, Homo sapiens
actattttaaatatc

SEQ ID NO: 4372369 - DNA, 13 bp, Homo sapiens
actattttcagaa

SEQ ID NO: 4372370 - DNA, 17 bp, Homo sapiens
actattttcagaatctg

SEQ ID NO: 4372371 - DNA, 15 bp, Homo sapiens
actatttttctatga

SEQ ID NO: 4372372 - DNA, 17 bp, Homo sapiens
actatttttctttccaa

SEQ ID NO: 4372373 - DNA, 14 bp, Homo sapiens
actcaaactgagga

SEQ ID NO: 4372374 - DNA, 21 bp, Homo sapiens
actcaaactgaggaatttcac

SEQ ID NO: 4372375 - DNA, 20 bp, Homo sapiens
actcaaatgtgagtgttttt

SEQ ID NO: 4372376 - DNA, 23 bp, Homo sapiens
actcaaattttggcgaatctcaa

SEQ ID NO: 4372377 - DNA, 14 bp, Homo sapiens
actcaaattttgta

SEQ ID NO: 4372378 - DNA, 16 bp, Homo sapiens
actcaaattttgtacc

SEQ ID NO: 4372379 - DNA, 22 bp, Homo sapiens
actcaacaaaaaaccgaggccc

SEQ ID NO: 4372380 - DNA, 21 bp, Homo sapiens
actcaagaggaatctgtttct

SEQ ID NO: 4372381 - DNA, 15 bp, Homo sapiens
actcaagcagatctc

SEQ ID NO: 4372382 - DNA, 17 bp, Homo sapiens
actcaagggttttccag

SEQ ID NO: 4372383 - DNA, 18 bp, Homo sapiens
actcaagggttttccagg

SEQ ID NO: 4372384 - DNA, 22 bp, Homo sapiens
actcaagggttttccaggtgta

SEQ ID NO: 4372385 - DNA, 22 bp, Homo sapiens
actcaatgtggaaaaaatattt

SEQ ID NO: 4372386 - DNA, 22 bp, Homo sapiens
actcacagccgcattggtgact

SEQ ID NO: 4372387 - DNA, 16 bp, Homo sapiens
actcacagtgctttta

SEQ ID NO: 4372388 - DNA, 20 bp, Homo sapiens
actcacattgttcaactccc

SEQ ID NO: 4372389 - DNA, 19 bp, Homo sapiens
actcaccccggcagacgcc

SEQ ID NO: 4372390 - DNA, 15 bp, Homo sapiens
actcacctctctcta

SEQ ID NO: 4372391 - DNA, 23 bp, Homo sapiens
actcacgataaataatcggccca

SEQ ID NO: 4372392 - DNA, 20 bp, Homo sapiens
actcactcctgagacccctg

SEQ ID NO: 4372393 - DNA, 21 bp, Homo sapiens
actcactcctgagacccctgg

SEQ ID NO: 4372394 - DNA, 19 bp, Homo sapiens
actcactgtttataaatgt

SEQ ID NO: 4372395 - DNA, 23 bp, Homo sapiens
actcacttcaatgtgtcatttcc

SEQ ID NO: 4372396 - DNA, 13 bp, Homo sapiens
actcagaaagcca

SEQ ID NO: 4372397 - DNA, 17 bp, Homo sapiens
actcagaggtccaggcc

SEQ ID NO: 4372398 - DNA, 17 bp, Homo sapiens
actcagatgaggacaga

SEQ ID NO: 4372399 - DNA, 16 bp, Homo sapiens
actcctttcagccaca

SEQ ID NO: 4372400 - DNA, 17 bp, Homo sapiens
actcctttccaatagaa

SEQ ID NO: 4372401 - DNA, 15 bp, Homo sapiens
actcgaatctgtgtg

SEQ ID NO: 4372402 - DNA, 17 bp, Homo sapiens
actcgactctgctgctc

SEQ ID NO: 4372403 - DNA, 13 bp, Homo sapiens
actcgaggcctgc

SEQ ID NO: 4372404 - DNA, 16 bp, Homo sapiens
actcgaggcctgcaaa

SEQ ID NO: 4372405 - DNA, 20 bp, Homo sapiens
actcgatttaaactccagca

SEQ ID NO: 4372406 - DNA, 22 bp, Homo sapiens
actcgatttaaactccagcatt

SEQ ID NO: 4372407 - DNA, 23 bp, Homo sapiens
actcgctcctagtgtttctttgt

SEQ ID NO: 4372408 - DNA, 21 bp, Homo sapiens
actcggcctcccaaagtgctg

SEQ ID NO: 4372409 - DNA, 17 bp, Homo sapiens
actcgtcaccccagccc

SEQ ID NO: 4372410 - DNA, 23 bp, Homo sapiens
actcgtgtctggcacagcctggc

SEQ ID NO: 4372411 - DNA, 22 bp, Homo sapiens
actcgttcacctccaagcattt

SEQ ID NO: 4372412 - DNA, 20 bp, Homo sapiens
actctaaagcttctataaaa

SEQ ID NO: 4372413 - DNA, 19 bp, Homo sapiens
actctaatatgattataca

SEQ ID NO: 4372414 - DNA, 15 bp, Homo sapiens
actctaatattgctt

SEQ ID NO: 4372415 - DNA, 14 bp, Homo sapiens
actctacccctgct

SEQ ID NO: 4372416 - DNA, 19 bp, Homo sapiens
actctaccctcccaccccc

SEQ ID NO: 4372417 - DNA, 14 bp, Homo sapiens
actctactgtgtaa

SEQ ID NO: 4372418 - DNA, 18 bp, Homo sapiens
actctagaaaaaagggct

SEQ ID NO: 4372419 - DNA, 21 bp, Homo sapiens
actctagatgaagttttacat

SEQ ID NO: 4372420 - DNA, 12 bp, Homo sapiens
actctagatggc

SEQ ID NO: 4372421 - DNA, 22 bp, Homo sapiens
actctaggatgtatattttata

SEQ ID NO: 4372422 - DNA, 22 bp, Homo sapiens
actctataagcaaattgctttt

SEQ ID NO: 4372423 - DNA, 20 bp, Homo sapiens
actctatatgtagtgcattt

SEQ ID NO: 4372424 - DNA, 17 bp, Homo sapiens
actctatgttctaagaa

SEQ ID NO: 4372425 - DNA, 21 bp, Homo sapiens
actctcaccatgatgtgaaga

SEQ ID NO: 4372426 - DNA, 22 bp, Homo sapiens
actctcagcccagaagaaaatt

SEQ ID NO: 4372427 - DNA, 18 bp, Homo sapiens
actctcagtctctgagca

SEQ ID NO: 4372428 - DNA, 13 bp, Homo sapiens
actctccatatcc

SEQ ID NO: 4372429 - DNA, 19 bp, Homo sapiens
actctcccaaagggcacac

SEQ ID NO: 4372430 - DNA, 10 bp, Homo sapiens
actctcccca

SEQ ID NO: 4372431 - DNA, 11 bp, Homo sapiens
actctccccac

SEQ ID NO: 4372432 - DNA, 12 bp, Homo sapiens
actctccccaca

SEQ ID NO: 4372433 - DNA, 22 bp, Homo sapiens
actctccccacgagggctggct

SEQ ID NO: 4372434 - DNA, 18 bp, Homo sapiens
actctccccagtgcctgc

SEQ ID NO: 4372435 - DNA, 19 bp, Homo sapiens
actctccccagtgcctgcc

SEQ ID NO: 4372436 - DNA, 19 bp, Homo sapiens
actctcctcctcccctcct

SEQ ID NO: 4372437 - DNA, 14 bp, Homo sapiens
actctcctctgcct

SEQ ID NO: 4372438 - DNA, 11 bp, Homo sapiens
actctcctggg

SEQ ID NO: 4372439 - DNA, 14 bp, Homo sapiens
actctcctgggccc

SEQ ID NO: 4372440 - DNA, 12 bp, Homo sapiens
actctctcccag

SEQ ID NO: 4372441 - DNA, 17 bp, Homo sapiens
actctctgggactctcc

SEQ ID NO: 4372442 - DNA, 21 bp, Homo sapiens
actctctgggactctcctcct

SEQ ID NO: 4372443 - DNA, 16 bp, Homo sapiens
actctctgtggtccct

SEQ ID NO: 4372444 - DNA, 14 bp, Homo sapiens
actctcttctcttt

SEQ ID NO: 4372445 - DNA, 17 bp, Homo sapiens
actctcttcttctcata

SEQ ID NO: 4372446 - DNA, 16 bp, Homo sapiens
actctgaaatgaagat

SEQ ID NO: 4372447 - DNA, 14 bp, Homo sapiens
actctgaagcctct

SEQ ID NO: 4372448 - DNA, 23 bp, Homo sapiens
actctgcactactcctctgcagt

SEQ ID NO: 4372449 - DNA, 12 bp, Homo sapiens
actctgccccct

SEQ ID NO: 4372450 - DNA, 15 bp, Homo sapiens
actctgccccctgct

SEQ ID NO: 4372451 - DNA, 18 bp, Homo sapiens
actctgccccctgctggc

SEQ ID NO: 4372452 - DNA, 22 bp, Homo sapiens
actctgcccctggacctgggaa

SEQ ID NO: 4372453 - DNA, 20 bp, Homo sapiens
actctgcgggaggctggggc

SEQ ID NO: 4372454 - DNA, 23 bp, Homo sapiens
actctgggagtaatactttttaa

SEQ ID NO: 4372455 - DNA, 15 bp, Homo sapiens
actctgtataataga

SEQ ID NO: 4372456 - DNA, 18 bp, Homo sapiens
actctgtataatagagat

SEQ ID NO: 4372457 - DNA, 21 bp, Homo sapiens
actctgtataatagagataag

SEQ ID NO: 4372458 - DNA, 15 bp, Homo sapiens
actctgtcagccagc

SEQ ID NO: 4372459 - DNA, 21 bp, Homo sapiens
actctgtcagccagccgccct

SEQ ID NO: 4372460 - DNA, 15 bp, Homo sapiens
actctgttcccccac

SEQ ID NO: 4372461 - DNA, 22 bp, Homo sapiens
actctgttgcccaggctggagt

SEQ ID NO: 4372462 - DNA, 16 bp, Homo sapiens
actcttaaatcatttg

SEQ ID NO: 4372463 - DNA, 22 bp, Homo sapiens
actcttaccatatgtttggtaa

SEQ ID NO: 4372464 - DNA, 14 bp, Homo sapiens
actcttatttcttt

SEQ ID NO: 4372465 - DNA, 22 bp, Homo sapiens
actcttatttctttcctttaaa

SEQ ID NO: 4372466 - DNA, 17 bp, Homo sapiens
actcttctgactgcccc

SEQ ID NO: 4372467 - DNA, 15 bp, Homo sapiens
actcttctgtcttgt

SEQ ID NO: 4372468 - DNA, 16 bp, Homo sapiens
actcttcttgaaattt

SEQ ID NO: 4372469 - DNA, 12 bp, Homo sapiens
actcttgagaat

SEQ ID NO: 4372470 - DNA, 15 bp, Homo sapiens
actcttgcggcaagc

SEQ ID NO: 4372471 - DNA, 21 bp, Homo sapiens
actcttggttcgatacctgga

SEQ ID NO: 4372472 - DNA, 19 bp, Homo sapiens
actctttattgtctgtaaa

SEQ ID NO: 4372473 - DNA, 11 bp, Homo sapiens
actctttcaaa

SEQ ID NO: 4372474 - DNA, 20 bp, Homo sapiens
actctttccgactgcccaga

SEQ ID NO: 4372475 - DNA, 15 bp, Homo sapiens
actctttctgagtgc

SEQ ID NO: 4372476 - DNA, 21 bp, Homo sapiens
actctttctgagtgccttctg

SEQ ID NO: 4372477 - DNA, 16 bp, Homo sapiens
actctttgagaaacaa

SEQ ID NO: 4372478 - DNA, 12 bp, Homo sapiens
actctttgagag

SEQ ID NO: 4372479 - DNA, 18 bp, Homo sapiens
actctttgctttgtagtt

SEQ ID NO: 4372480 - DNA, 14 bp, Homo sapiens
actcttttgcttta

SEQ ID NO: 4372481 - DNA, 18 bp, Homo sapiens
actgaaaaaaaaaaagaa

SEQ ID NO: 4372482 - DNA, 15 bp, Homo sapiens
actgaaaaaatatat

SEQ ID NO: 4372483 - DNA, 19 bp, Homo sapiens
actgaaaagaaggaaagat

SEQ ID NO: 4372484 - DNA, 14 bp, Homo sapiens
actgaaaatgaatg

SEQ ID NO: 4372485 - DNA, 20 bp, Homo sapiens
actgaaagaagaaaacagta

SEQ ID NO: 4372486 - DNA, 21 bp, Homo sapiens
actgaaagaagaaaacagtac

SEQ ID NO: 4372487 - DNA, 13 bp, Homo sapiens
actgaaagcttta

SEQ ID NO: 4372488 - DNA, 19 bp, Homo sapiens
actgaaaggtagactttta

SEQ ID NO: 4372489 - DNA, 16 bp, Homo sapiens
actgaaagttttgtaa

SEQ ID NO: 4372490 - DNA, 23 bp, Homo sapiens
actgaaagttttgtaaaagaaat

SEQ ID NO: 4372491 - DNA, 15 bp, Homo sapiens
actgaaccaggccag

SEQ ID NO: 4372492 - DNA, 16 bp, Homo sapiens
actgaactacatgcat

SEQ ID NO: 4372493 - DNA, 14 bp, Homo sapiens
actgaactgctttt

SEQ ID NO: 4372494 - DNA, 17 bp, Homo sapiens
actgaactgcttttaaa

SEQ ID NO: 4372495 - DNA, 14 bp, Homo sapiens
actgaacttgaagc

SEQ ID NO: 4372496 - DNA, 16 bp, Homo sapiens
actgaagagctcttgg

SEQ ID NO: 4372497 - DNA, 19 bp, Homo sapiens
actgaagatgaaatatata

SEQ ID NO: 4372498 - DNA, 22 bp, Homo sapiens
actgaaggaaaaacacaagcaa

SEQ ID NO: 4372499 - DNA, 23 bp, Homo sapiens
actgaaggaaaaacacaagcaaa

SEQ ID NO: 4372500 - DNA, 16 bp, Homo sapiens
actgaaggcatatgca

SEQ ID NO: 4372501 - DNA, 19 bp, Homo sapiens
actgaaggctaaaaagcaa

SEQ ID NO: 4372502 - DNA, 14 bp, Homo sapiens
actgaatagttcag

SEQ ID NO: 4372503 - DNA, 23 bp, Homo sapiens
actgaatagttcaggagacttta

SEQ ID NO: 4372504 - DNA, 16 bp, Homo sapiens
actgaatatcaactct

SEQ ID NO: 4372505 - DNA, 21 bp, Homo sapiens
actgaatgcataatgtttaaa

SEQ ID NO: 4372506 - DNA, 14 bp, Homo sapiens
actgaatgtcattg

SEQ ID NO: 4372507 - DNA, 17 bp, Homo sapiens
actgaattgtccccagt

SEQ ID NO: 4372508 - DNA, 19 bp, Homo sapiens
actgaattttgggacttct

SEQ ID NO: 4372509 - DNA, 16 bp, Homo sapiens
actgaatttttttgta

SEQ ID NO: 4372510 - DNA, 17 bp, Homo sapiens
actgaatttttttgtaa

SEQ ID NO: 4372511 - DNA, 19 bp, Homo sapiens
actgacaatgaagggaaat

SEQ ID NO: 4372512 - DNA, 22 bp, Homo sapiens
actgaccaatattgtacagttt

SEQ ID NO: 4372513 - DNA, 13 bp, Homo sapiens
actgaccactggg

SEQ ID NO: 4372514 - DNA, 19 bp, Homo sapiens
actgacccactcggatgga

SEQ ID NO: 4372515 - DNA, 14 bp, Homo sapiens
actgaccttaaaac

SEQ ID NO: 4372516 - DNA, 16 bp, Homo sapiens
actgacggactcatga

SEQ ID NO: 4372517 - DNA, 13 bp, Homo sapiens
actgtcttcctca

SEQ ID NO: 4372518 - DNA, 18 bp, Homo sapiens
actgtcttcctcaaaata

SEQ ID NO: 4372519 - DNA, 23 bp, Homo sapiens
actgtgaaaatagtgtaagaact

SEQ ID NO: 4372520 - DNA, 12 bp, Homo sapiens
actgtgaaatac

SEQ ID NO: 4372521 - DNA, 22 bp, Homo sapiens
actgtgaacctgggcactccgc

SEQ ID NO: 4372522 - DNA, 13 bp, Homo sapiens
actgtgaacttga

SEQ ID NO: 4372523 - DNA, 21 bp, Homo sapiens
actgtgaacttgactgggtga

SEQ ID NO: 4372524 - DNA, 16 bp, Homo sapiens
actgtgaccaagtata

SEQ ID NO: 4372525 - DNA, 15 bp, Homo sapiens
actgtgagactgtat

SEQ ID NO: 4372526 - DNA, 16 bp, Homo sapiens
actgtgattactcttt

SEQ ID NO: 4372527 - DNA, 17 bp, Homo sapiens
actgtgcaactttttaa

SEQ ID NO: 4372528 - DNA, 18 bp, Homo sapiens
actgtgcaactttttaaa

SEQ ID NO: 4372529 - DNA, 20 bp, Homo sapiens
actgtgcaactttttaaagt

SEQ ID NO: 4372530 - DNA, 19 bp, Homo sapiens
actgtgcacatctgtgtct

SEQ ID NO: 4372531 - DNA, 20 bp, Homo sapiens
actgtgcaggcctgtccctg

SEQ ID NO: 4372532 - DNA, 23 bp, Homo sapiens
actgtgcaggcctgtccctggga

SEQ ID NO: 4372533 - DNA, 21 bp, Homo sapiens
actgtgcaggtgctattgtta

SEQ ID NO: 4372534 - DNA, 14 bp, Homo sapiens
actgtgccagaggc

SEQ ID NO: 4372535 - DNA, 19 bp, Homo sapiens
actgtgcccggcctgtgta

SEQ ID NO: 4372536 - DNA, 14 bp, Homo sapiens
actgtgcctggctc

SEQ ID NO: 4372537 - DNA, 18 bp, Homo sapiens
actgtgcctggctccctg

SEQ ID NO: 4372538 - DNA, 22 bp, Homo sapiens
actgtgcgtcttggtgtaattt

SEQ ID NO: 4372539 - DNA, 13 bp, Homo sapiens
actgtgctttcta

SEQ ID NO: 4372540 - DNA, 22 bp, Homo sapiens
actgtgctttctattgtacaga

SEQ ID NO: 4372541 - DNA, 15 bp, Homo sapiens
actgtgggcaattta

SEQ ID NO: 4372542 - DNA, 19 bp, Homo sapiens
actgtgggcaatttagaaa

SEQ ID NO: 4372543 - DNA, 16 bp, Homo sapiens
actgtgtacataactg

SEQ ID NO: 4372544 - DNA, 19 bp, Homo sapiens
actgtgtactggagcctgc

SEQ ID NO: 4372545 - DNA, 19 bp, Homo sapiens
actgtgtataggaatttgt

SEQ ID NO: 4372546 - DNA, 21 bp, Homo sapiens
actgtgtattccaagacatgt

SEQ ID NO: 4372547 - DNA, 22 bp, Homo sapiens
actgtgtatttatttaaaactc

SEQ ID NO: 4372548 - DNA, 18 bp, Homo sapiens
actgtgtcataaacagat

SEQ ID NO: 4372549 - DNA, 19 bp, Homo sapiens
actgtgtctggcgttctca

SEQ ID NO: 4372550 - DNA, 15 bp, Homo sapiens
actgtgtgtgtgaat

SEQ ID NO: 4372551 - DNA, 18 bp, Homo sapiens
actgtgtgtgtgaatgaa

SEQ ID NO: 4372552 - DNA, 16 bp, Homo sapiens
actgttaacttattca

SEQ ID NO: 4372553 - DNA, 23 bp, Homo sapiens
actgttacaacttgtatttccaa

SEQ ID NO: 4372554 - DNA, 17 bp, Homo sapiens
actgttacagactgaaa

SEQ ID NO: 4372555 - DNA, 12 bp, Homo sapiens
actgttacagta

SEQ ID NO: 4372556 - DNA, 13 bp, Homo sapiens
actgttactttgg

SEQ ID NO: 4372557 - DNA, 14 bp, Homo sapiens
actgttagaacact

SEQ ID NO: 4372558 - DNA, 15 bp, Homo sapiens
actgttagaacacta

SEQ ID NO: 4372559 - DNA, 20 bp, Homo sapiens
actgttccaggccctccagt

SEQ ID NO: 4372560 - DNA, 21 bp, Homo sapiens
actgttcctcatgttgctgaa

SEQ ID NO: 4372561 - DNA, 13 bp, Homo sapiens
actgttctgttca

SEQ ID NO: 4372562 - DNA, 15 bp, Homo sapiens
actgttctgttctca

SEQ ID NO: 4372563 - DNA, 13 bp, Homo sapiens
actgttcttgaat

SEQ ID NO: 4372564 - DNA, 18 bp, Homo sapiens
actgttgcctaattggaa

SEQ ID NO: 4372565 - DNA, 19 bp, Homo sapiens
actgttgctttgaaaaatc

SEQ ID NO: 4372566 - DNA, 14 bp, Homo sapiens
actgtttagatgaa

SEQ ID NO: 4372567 - DNA, 17 bp, Homo sapiens
actgtttatatgtgttg

SEQ ID NO: 4372568 - DNA, 13 bp, Homo sapiens
actgtttccttca

SEQ ID NO: 4372569 - DNA, 15 bp, Homo sapiens
actgtttgcacttac

SEQ ID NO: 4372570 - DNA, 19 bp, Homo sapiens
actgtttgcccattttcat

SEQ ID NO: 4372571 - DNA, 21 bp, Homo sapiens
actgtttgtttttatttaaat

SEQ ID NO: 4372572 - DNA, 18 bp, Homo sapiens
actgttttagaaattggt

SEQ ID NO: 4372573 - DNA, 21 bp, Homo sapiens
acttaaaaaaaaaaaaaagct

SEQ ID NO: 4372574 - DNA, 22 bp, Homo sapiens
acttaaaaaaaaaaaaaagctt

SEQ ID NO: 4372575 - DNA, 13 bp, Homo sapiens
acttaaaaatggt

SEQ ID NO: 4372576 - DNA, 21 bp, Homo sapiens
acttaaaaatggtttaaatgg

SEQ ID NO: 4372577 - DNA, 22 bp, Homo sapiens
acttaaaaatggtttaaatggt

SEQ ID NO: 4372578 - DNA, 16 bp, Homo sapiens
acttaaaaatttatta

SEQ ID NO: 4372579 - DNA, 16 bp, Homo sapiens
acttaaactttgtcac

SEQ ID NO: 4372580 - DNA, 21 bp, Homo sapiens
acttaaactttgtcacttctg

SEQ ID NO: 4372581 - DNA, 19 bp, Homo sapiens
acttaaagggcccaatgaa

SEQ ID NO: 4372582 - DNA, 21 bp, Homo sapiens
acttaaagggcccaatgaatt

SEQ ID NO: 4372583 - DNA, 15 bp, Homo sapiens
acttaacattcctaa

SEQ ID NO: 4372584 - DNA, 17 bp, Homo sapiens
acttaacatttcattgt

SEQ ID NO: 4372585 - DNA, 23 bp, Homo sapiens
acttaacgttctataaatgaatg

SEQ ID NO: 4372586 - DNA, 17 bp, Homo sapiens
acttaagggttgcttgc

SEQ ID NO: 4372587 - DNA, 14 bp, Homo sapiens
acttaagtgttcat

SEQ ID NO: 4372588 - DNA, 23 bp, Homo sapiens
acttaagtgttcattttaagtaa

SEQ ID NO: 4372589 - DNA, 15 bp, Homo sapiens
acttaatagcaacag

SEQ ID NO: 4372590 - DNA, 16 bp, Homo sapiens
acttaatgtatgttac

SEQ ID NO: 4372591 - DNA, 17 bp, Homo sapiens
acttaatgtttcttaga

SEQ ID NO: 4372592 - DNA, 15 bp, Homo sapiens
acttaatttacttaa

SEQ ID NO: 4372593 - DNA, 20 bp, Homo sapiens
acttaatttacttaagtgtt

SEQ ID NO: 4372594 - DNA, 12 bp, Homo sapiens
acttaatttcaa

SEQ ID NO: 4372595 - DNA, 15 bp, Homo sapiens
acttacatcatgtgt

SEQ ID NO: 4372596 - DNA, 22 bp, Homo sapiens
acttaccaggcaccaaaagaag

SEQ ID NO: 4372597 - DNA, 14 bp, Homo sapiens
acttaccatttgct

SEQ ID NO: 4372598 - DNA, 15 bp, Homo sapiens
acttagacctgccag

SEQ ID NO: 4372599 - DNA, 21 bp, Homo sapiens
acttagacctgccagccactg

SEQ ID NO: 4372600 - DNA, 15 bp, Homo sapiens
acttagagtttctgt

SEQ ID NO: 4372601 - DNA, 20 bp, Homo sapiens
acttagagtttctgtttgat

SEQ ID NO: 4372602 - DNA, 21 bp, Homo sapiens
acttagagtttctgtttgatt

SEQ ID NO: 4372603 - DNA, 18 bp, Homo sapiens
acttagatctctcctgca

SEQ ID NO: 4372604 - DNA, 19 bp, Homo sapiens
acttagatgggcatggtgg

SEQ ID NO: 4372605 - DNA, 13 bp, Homo sapiens
acttagcaaaaag

SEQ ID NO: 4372606 - DNA, 17 bp, Homo sapiens
acttagcaaaaagtggg

SEQ ID NO: 4372607 - DNA, 23 bp, Homo sapiens
acttagccatttttcaaagcaat

SEQ ID NO: 4372608 - DNA, 13 bp, Homo sapiens
acttagcccaaga

SEQ ID NO: 4372609 - DNA, 15 bp, Homo sapiens
acttagcccaagagg

SEQ ID NO: 4372610 - DNA, 21 bp, Homo sapiens
acttagcccaagaggtctgag

SEQ ID NO: 4372611 - DNA, 12 bp, Homo sapiens
acttagcctgag

SEQ ID NO: 4372612 - DNA, 19 bp, Homo sapiens
acttagcgtcaagacattt

SEQ ID NO: 4372613 - DNA, 18 bp, Homo sapiens
acttagcttttgatgtct

SEQ ID NO: 4372614 - DNA, 21 bp, Homo sapiens
acttagcttttgatgtctcca

SEQ ID NO: 4372615 - DNA, 21 bp, Homo sapiens
acttagtttttaaaatttatt

SEQ ID NO: 4372616 - DNA, 15 bp, Homo sapiens
acttatactcttgag

SEQ ID NO: 4372617 - DNA, 17 bp, Homo sapiens
acttatagtacatgata

SEQ ID NO: 4372618 - DNA, 18 bp, Homo sapiens
acttatagtacatgataa

SEQ ID NO: 4372619 - DNA, 22 bp, Homo sapiens
acttatattttataatcagaat

SEQ ID NO: 4372620 - DNA, 19 bp, Homo sapiens
acttatctctcaaaacaat

SEQ ID NO: 4372621 - DNA, 14 bp, Homo sapiens
acttatcttatgcc

SEQ ID NO: 4372622 - DNA, 15 bp, Homo sapiens
acttattacctcagg

SEQ ID NO: 4372623 - DNA, 16 bp, Homo sapiens
acttattacctcaggt

SEQ ID NO: 4372624 - DNA, 17 bp, Homo sapiens
acttattcaaagagaaa

SEQ ID NO: 4372625 - DNA, 19 bp, Homo sapiens
acttattcattcctcacaa

SEQ ID NO: 4372626 - DNA, 13 bp, Homo sapiens
acttatttctgct

SEQ ID NO: 4372627 - DNA, 13 bp, Homo sapiens
acttatttttctg

SEQ ID NO: 4372628 - DNA, 17 bp, Homo sapiens
acttcaaatatagagat

SEQ ID NO: 4372629 - DNA, 17 bp, Homo sapiens
acttcaactgcccagca

SEQ ID NO: 4372630 - DNA, 15 bp, Homo sapiens
acttcacactgcaag

SEQ ID NO: 4372631 - DNA, 14 bp, Homo sapiens
acttcaccaccccc

SEQ ID NO: 4372632 - DNA, 15 bp, Homo sapiens
acttcacccgagttc

SEQ ID NO: 4372633 - DNA, 15 bp, Homo sapiens
acttcactgtatata

SEQ ID NO: 4372634 - DNA, 16 bp, Homo sapiens
acttcactttcttcaa

SEQ ID NO: 4372635 - DNA, 16 bp, Homo sapiens
acttttgttaacagta

SEQ ID NO: 4372636 - DNA, 13 bp, Homo sapiens
actttttaaaata

SEQ ID NO: 4372637 - DNA, 13 bp, Homo sapiens
actttttaaagta

SEQ ID NO: 4372638 - DNA, 19 bp, Homo sapiens
actttttacagcagcaata

SEQ ID NO: 4372639 - DNA, 15 bp, Homo sapiens
actttttagtaattt

SEQ ID NO: 4372640 - DNA, 11 bp, Homo sapiens
actttttgatg

SEQ ID NO: 4372641 - DNA, 23 bp, Homo sapiens
actttttgatggaattaaatgtg

SEQ ID NO: 4372642 - DNA, 22 bp, Homo sapiens
actttttggaattcagcagttt

SEQ ID NO: 4372643 - DNA, 17 bp, Homo sapiens
actttttggtggatgta

SEQ ID NO: 4372644 - DNA, 19 bp, Homo sapiens
actttttgtttttatttct

SEQ ID NO: 4372645 - DNA, 16 bp, Homo sapiens
acttttttaaatattt

SEQ ID NO: 4372646 - DNA, 18 bp, Homo sapiens
acttttttgtttgaatgt

SEQ ID NO: 4372647 - DNA, 13 bp, Homo sapiens
actttttttcttt

SEQ ID NO: 4372648 - DNA, 17 bp, Homo sapiens
actttttttctttttct

SEQ ID NO: 4372649 - DNA, 14 bp, Homo sapiens
actttttttgtatg

SEQ ID NO: 4372650 - DNA, 17 bp, Homo sapiens
actttttttgtatgtgt

SEQ ID NO: 4372651 - DNA, 19 bp, Homo sapiens
agaaaaaaaaattcacatg

SEQ ID NO: 4372652 - DNA, 18 bp, Homo sapiens
agaaaaaaacattctatc

SEQ ID NO: 4372653 - DNA, 15 bp, Homo sapiens
agaaaaaaagcaaaa

SEQ ID NO: 4372654 - DNA, 17 bp, Homo sapiens
agaaaaaagaaaaatct

SEQ ID NO: 4372655 - DNA, 17 bp, Homo sapiens
agaaaaacatttaaact

SEQ ID NO: 4372656 - DNA, 18 bp, Homo sapiens
agaaaaagaacatgcagt

SEQ ID NO: 4372657 - DNA, 22 bp, Homo sapiens
agaaaaagaacatgcagtttga

SEQ ID NO: 4372658 - DNA, 20 bp, Homo sapiens
agaaaaataggtgcaataat

SEQ ID NO: 4372659 - DNA, 21 bp, Homo sapiens
agaaaaatgagcatacatctt

SEQ ID NO: 4372660 - DNA, 13 bp, Homo sapiens
agaaaaatgttct

SEQ ID NO: 4372661 - DNA, 21 bp, Homo sapiens
agaaaacaaaaaacgaatgaa

SEQ ID NO: 4372662 - DNA, 15 bp, Homo sapiens
agaaaacaatggggc

SEQ ID NO: 4372663 - DNA, 22 bp, Homo sapiens
agaaaacaggaaaaaaactttt

SEQ ID NO: 4372664 - DNA, 23 bp, Homo sapiens
agaaaacaggaaaaaaactttta

SEQ ID NO: 4372665 - DNA, 19 bp, Homo sapiens
agaaaacataatatagctt

SEQ ID NO: 4372666 - DNA, 17 bp, Homo sapiens
agaaaacgccagtgtgt

SEQ ID NO: 4372667 - DNA, 18 bp, Homo sapiens
agaaaactcccaatacaa

SEQ ID NO: 4372668 - DNA, 17 bp, Homo sapiens
agaaaagcaatactgtt

SEQ ID NO: 4372669 - DNA, 19 bp, Homo sapiens
agaaaagcgcgttgtgtat

SEQ ID NO: 4372670 - DNA, 13 bp, Homo sapiens
agaaaagtaatga

SEQ ID NO: 4372671 - DNA, 21 bp, Homo sapiens
agaaaagtaatgaagaatcac

SEQ ID NO: 4372672 - DNA, 23 bp, Homo sapiens
agaaaagtagacaatcattgttt

SEQ ID NO: 4372673 - DNA, 11 bp, Homo sapiens
agaaaagttat

SEQ ID NO: 4372674 - DNA, 18 bp, Homo sapiens
agaaaagttgctcttaaa

SEQ ID NO: 4372675 - DNA, 16 bp, Homo sapiens
agaaaataaagacaac

SEQ ID NO: 4372676 - DNA, 22 bp, Homo sapiens
agaaaataaggcacccatctgt

SEQ ID NO: 4372677 - DNA, 17 bp, Homo sapiens
agaaaatatatgtattt

SEQ ID NO: 4372678 - DNA, 14 bp, Homo sapiens
agaaaatattctct

SEQ ID NO: 4372679 - DNA, 13 bp, Homo sapiens
agaaaatcactta

SEQ ID NO: 4372680 - DNA, 15 bp, Homo sapiens
agaaaattaaaagaa

SEQ ID NO: 4372681 - DNA, 23 bp, Homo sapiens
agaaaattaaactacagaatatt

SEQ ID NO: 4372682 - DNA, 16 bp, Homo sapiens
agaaaattcctataag

SEQ ID NO: 4372683 - DNA, 23 bp, Homo sapiens
agaaaattctgtgccttgttttt

SEQ ID NO: 4372684 - DNA, 17 bp, Homo sapiens
agaaacaactctttgag

SEQ ID NO: 4372685 - DNA, 20 bp, Homo sapiens
agaaacaactctttgagaaa

SEQ ID NO: 4372686 - DNA, 19 bp, Homo sapiens
agaaacactgaaaagaagg

SEQ ID NO: 4372687 - DNA, 16 bp, Homo sapiens
agaaacactgcaaatt

SEQ ID NO: 4372688 - DNA, 20 bp, Homo sapiens
agaaacagagtggcctccct

SEQ ID NO: 4372689 - DNA, 21 bp, Homo sapiens
agaaacagagtggcctccctg

SEQ ID NO: 4372690 - DNA, 22 bp, Homo sapiens
agaaacagagtggcctccctgc

SEQ ID NO: 4372691 - DNA, 23 bp, Homo sapiens
agaaacagagtggcctccctgct

SEQ ID NO: 4372692 - DNA, 19 bp, Homo sapiens
agaaacagttggtaacttt

SEQ ID NO: 4372693 - DNA, 17 bp, Homo sapiens
agaaacatttttgttct

SEQ ID NO: 4372694 - DNA, 14 bp, Homo sapiens
agaaaccttgctct

SEQ ID NO: 4372695 - DNA, 15 bp, Homo sapiens
agaaacgtcttctaa

SEQ ID NO: 4372696 - DNA, 15 bp, Homo sapiens
agaaactgcagggaa

SEQ ID NO: 4372697 - DNA, 13 bp, Homo sapiens
agaaactgctgca

SEQ ID NO: 4372698 - DNA, 18 bp, Homo sapiens
agaaactgtccaaatgct

SEQ ID NO: 4372699 - DNA, 17 bp, Homo sapiens
agaaacttaaatgttat

SEQ ID NO: 4372700 - DNA, 14 bp, Homo sapiens
agaaacttccaaat

SEQ ID NO: 4372701 - DNA, 23 bp, Homo sapiens
agaaagaaactaaacagaaaact

SEQ ID NO: 4372702 - DNA, 15 bp, Homo sapiens
agaaagaataaaatg

SEQ ID NO: 4372703 - DNA, 22 bp, Homo sapiens
agaaagaatgttactgccttaa

SEQ ID NO: 4372704 - DNA, 18 bp, Homo sapiens
agaaagactattcaaaca

SEQ ID NO: 4372705 - DNA, 23 bp, Homo sapiens
agaaagactattcaaacagtctc

SEQ ID NO: 4372706 - DNA, 14 bp, Homo sapiens
agaaagagggacaa

SEQ ID NO: 4372707 - DNA, 12 bp, Homo sapiens
agaaagatgtat

SEQ ID NO: 4372708 - DNA, 18 bp, Homo sapiens
agaaagcagaacagtgat

SEQ ID NO: 4372709 - DNA, 21 bp, Homo sapiens
agaaagcagatacctcaccct

SEQ ID NO: 4372710 - DNA, 19 bp, Homo sapiens
agaaagccaccttgttaca

SEQ ID NO: 4372711 - DNA, 13 bp, Homo sapiens
agaaagccacgcc

SEQ ID NO: 4372712 - DNA, 21 bp, Homo sapiens
agaaagccacgccctccctgc

SEQ ID NO: 4372713 - DNA, 12 bp, Homo sapiens
agaaagcctcct

SEQ ID NO: 4372714 - DNA, 16 bp, Homo sapiens
agaaagcctcctgccc

SEQ ID NO: 4372715 - DNA, 23 bp, Homo sapiens
agaaagcctcctgccccctgcca

SEQ ID NO: 4372716 - DNA, 13 bp, Homo sapiens
agaaagctaaatg

SEQ ID NO: 4372717 - DNA, 21 bp, Homo sapiens
agaaagctattccaagactca

SEQ ID NO: 4372718 - DNA, 17 bp, Homo sapiens
agaaagctccttccaga

SEQ ID NO: 4372719 - DNA, 16 bp, Homo sapiens
agaaagcttaatatat

SEQ ID NO: 4372720 - DNA, 17 bp, Homo sapiens
agaaagcttaatatatt

SEQ ID NO: 4372721 - DNA, 21 bp, Homo sapiens
agaaagcttcatccacagcct

SEQ ID NO: 4372722 - DNA, 18 bp, Homo sapiens
agaaaggaaaaacaaact

SEQ ID NO: 4372723 - DNA, 23 bp, Homo sapiens
agaaaggaaatgagatgacagta

SEQ ID NO: 4372724 - DNA, 22 bp, Homo sapiens
agaaaggaagcattgtaaaata

SEQ ID NO: 4372725 - DNA, 11 bp, Homo sapiens
agaaaggaagt

SEQ ID NO: 4372726 - DNA, 11 bp, Homo sapiens
agaaaggagac

SEQ ID NO: 4372727 - DNA, 16 bp, Homo sapiens
agaaaggcaggtttca

SEQ ID NO: 4372728 - DNA, 16 bp, Homo sapiens
agaaaggctgttaaat

SEQ ID NO: 4372729 - DNA, 19 bp, Homo sapiens
agaaagggaaactggctga

SEQ ID NO: 4372730 - DNA, 22 bp, Homo sapiens
agaaaggtgagtttgagctgcc

SEQ ID NO: 4372731 - DNA, 16 bp, Homo sapiens
agaaaggttctgcccg

SEQ ID NO: 4372732 - DNA, 14 bp, Homo sapiens
agaaagtacccagc

SEQ ID NO: 4372733 - DNA, 16 bp, Homo sapiens
agaaagtacccagcaa

SEQ ID NO: 4372734 - DNA, 19 bp, Homo sapiens
agaaagtgggggtggagga

SEQ ID NO: 4372735 - DNA, 17 bp, Homo sapiens
agaaataaaccttaata

SEQ ID NO: 4372736 - DNA, 23 bp, Homo sapiens
agaaataaaccttaatatttctt

SEQ ID NO: 4372737 - DNA, 14 bp, Homo sapiens
agaaataagttttt

SEQ ID NO: 4372738 - DNA, 14 bp, Homo sapiens
agaaatacagtctt

SEQ ID NO: 4372739 - DNA, 22 bp, Homo sapiens
agaaatagacaaaaagtatatt

SEQ ID NO: 4372740 - DNA, 16 bp, Homo sapiens
agaaatatatcctgtg

SEQ ID NO: 4372741 - DNA, 23 bp, Homo sapiens
agaaatatctgtgaaatatcatc

SEQ ID NO: 4372742 - DNA, 22 bp, Homo sapiens
agaaatcattttgcaatccctt

SEQ ID NO: 4372743 - DNA, 19 bp, Homo sapiens
agaaatccccccttcagaa

SEQ ID NO: 4372744 - DNA, 17 bp, Homo sapiens
agaaatcggttgctgtt

SEQ ID NO: 4372745 - DNA, 20 bp, Homo sapiens
agaaatctactgaattggct

SEQ ID NO: 4372746 - DNA, 22 bp, Homo sapiens
agaaatctatagaactgaatga

SEQ ID NO: 4372747 - DNA, 23 bp, Homo sapiens
agaaatctggctgtccttccatt

SEQ ID NO: 4372748 - DNA, 15 bp, Homo sapiens
agaaatgaacattcc

SEQ ID NO: 4372749 - DNA, 13 bp, Homo sapiens
agaaatgaatgct

SEQ ID NO: 4372750 - DNA, 22 bp, Homo sapiens
agaaatgattcaaattgctgct

SEQ ID NO: 4372751 - DNA, 18 bp, Homo sapiens
agaaatgcatccattcct

SEQ ID NO: 4372752 - DNA, 22 bp, Homo sapiens
agacaaaatggatacataaaga

SEQ ID NO: 4372753 - DNA, 15 bp, Homo sapiens
agacaaagatttctt

SEQ ID NO: 4372754 - DNA, 16 bp, Homo sapiens
agacaaagatttcttc

SEQ ID NO: 4372755 - DNA, 16 bp, Homo sapiens
agacaaaggaggaatt

SEQ ID NO: 4372756 - DNA, 21 bp, Homo sapiens
agacaagagatctacacatgt

SEQ ID NO: 4372757 - DNA, 17 bp, Homo sapiens
agacaagcctggcctac

SEQ ID NO: 4372758 - DNA, 15 bp, Homo sapiens
agacaataattctac

SEQ ID NO: 4372759 - DNA, 13 bp, Homo sapiens
agacaatagtatt

SEQ ID NO: 4372760 - DNA, 16 bp, Homo sapiens
agacaatagtatttct

SEQ ID NO: 4372761 - DNA, 14 bp, Homo sapiens
agacaatcattgtt

SEQ ID NO: 4372762 - DNA, 18 bp, Homo sapiens
agacaatggacccttttt

SEQ ID NO: 4372763 - DNA, 19 bp, Homo sapiens
agacaattttttttcaaat

SEQ ID NO: 4372764 - DNA, 22 bp, Homo sapiens
agacaattttttttcaaatgtg

SEQ ID NO: 4372765 - DNA, 22 bp, Homo sapiens
agacacaaggtgatttcagact

SEQ ID NO: 4372766 - DNA, 20 bp, Homo sapiens
agacacaatttcatttccag

SEQ ID NO: 4372767 - DNA, 20 bp, Homo sapiens
agacacactatcatagttaa

SEQ ID NO: 4372768 - DNA, 16 bp, Homo sapiens
agacacacttaactac

SEQ ID NO: 4372769 - DNA, 16 bp, Homo sapiens
agacacatactcattt

SEQ ID NO: 4372770 - DNA, 13 bp, Homo sapiens
agacacatgaagg

SEQ ID NO: 4372771 - DNA, 22 bp, Homo sapiens
agacacattgactcctttccaa

SEQ ID NO: 4372772 - DNA, 14 bp, Homo sapiens
agacacatttaagg

SEQ ID NO: 4372773 - DNA, 17 bp, Homo sapiens
agacacctaaccccagg

SEQ ID NO: 4372774 - DNA, 17 bp, Homo sapiens
agacacctgcacctccc

SEQ ID NO: 4372775 - DNA, 17 bp, Homo sapiens
agacactaaatgcagac

SEQ ID NO: 4372776 - DNA, 17 bp, Homo sapiens
agacactccagtttgcc

SEQ ID NO: 4372777 - DNA, 19 bp, Homo sapiens
agacactgaccatccactc

SEQ ID NO: 4372778 - DNA, 14 bp, Homo sapiens
agacacttgctccc

SEQ ID NO: 4372779 - DNA, 14 bp, Homo sapiens
agacagaagaaaca

SEQ ID NO: 4372780 - DNA, 15 bp, Homo sapiens
agacagacattcacc

SEQ ID NO: 4372781 - DNA, 17 bp, Homo sapiens
agacagagacaagtaat

SEQ ID NO: 4372782 - DNA, 20 bp, Homo sapiens
agacagaggaaagggctggc

SEQ ID NO: 4372783 - DNA, 19 bp, Homo sapiens
agacagagtttcaccatgt

SEQ ID NO: 4372784 - DNA, 15 bp, Homo sapiens
agacagatgagcagg

SEQ ID NO: 4372785 - DNA, 15 bp, Homo sapiens
agacagatgccccag

SEQ ID NO: 4372786 - DNA, 19 bp, Homo sapiens
agacagatgctggtggagg

SEQ ID NO: 4372787 - DNA, 16 bp, Homo sapiens
agacagcagcagcctg

SEQ ID NO: 4372788 - DNA, 11 bp, Homo sapiens
agacagcctgt

SEQ ID NO: 4372789 - DNA, 14 bp, Homo sapiens
agacagcttctctg

SEQ ID NO: 4372790 - DNA, 18 bp, Homo sapiens
agacagcttctctgcagt

SEQ ID NO: 4372791 - DNA, 21 bp, Homo sapiens
agacaggaaaatcctctggct

SEQ ID NO: 4372792 - DNA, 14 bp, Homo sapiens
agacaggacagaat

SEQ ID NO: 4372793 - DNA, 19 bp, Homo sapiens
agacaggacagaatgtgtt

SEQ ID NO: 4372794 - DNA, 22 bp, Homo sapiens
agacaggacagaatgtgttctt

SEQ ID NO: 4372795 - DNA, 13 bp, Homo sapiens
agacaggccctcc

SEQ ID NO: 4372796 - DNA, 18 bp, Homo sapiens
agacaggccctccctgtc

SEQ ID NO: 4372797 - DNA, 16 bp, Homo sapiens
agacaggctgggtcct

SEQ ID NO: 4372798 - DNA, 12 bp, Homo sapiens
agacagtcttgc

SEQ ID NO: 4372799 - DNA, 11 bp, Homo sapiens
agacagtgccc

SEQ ID NO: 4372800 - DNA, 17 bp, Homo sapiens
agacagtgcccttggtg

SEQ ID NO: 4372801 - DNA, 14 bp, Homo sapiens
agacagttctctgt

SEQ ID NO: 4372802 - DNA, 16 bp, Homo sapiens
agacagttttgcttta

SEQ ID NO: 4372803 - DNA, 19 bp, Homo sapiens
agacataaagaagaaactt

SEQ ID NO: 4372804 - DNA, 15 bp, Homo sapiens
agacataaagccttt

SEQ ID NO: 4372805 - DNA, 21 bp, Homo sapiens
agacatagaattaacacatga

SEQ ID NO: 4372806 - DNA, 16 bp, Homo sapiens
agacatatttaactgg

SEQ ID NO: 4372807 - DNA, 14 bp, Homo sapiens
agacatcattgtca

SEQ ID NO: 4372808 - DNA, 20 bp, Homo sapiens
agacatcattgtcagccttg

SEQ ID NO: 4372809 - DNA, 21 bp, Homo sapiens
agacatcgatatacatttatt

SEQ ID NO: 4372810 - DNA, 19 bp, Homo sapiens
agacatctgaggttttatt

SEQ ID NO: 4372811 - DNA, 14 bp, Homo sapiens
agacatctgcctgt

SEQ ID NO: 4372812 - DNA, 15 bp, Homo sapiens
agacatgatttcctt

SEQ ID NO: 4372813 - DNA, 22 bp, Homo sapiens
agacatgatttccttgaatgtg

SEQ ID NO: 4372814 - DNA, 23 bp, Homo sapiens
agacatgcatttttaaaactagc

SEQ ID NO: 4372815 - DNA, 17 bp, Homo sapiens
agacatgctttccattt

SEQ ID NO: 4372816 - DNA, 14 bp, Homo sapiens
agacattagaaaaa

SEQ ID NO: 4372817 - DNA, 15 bp, Homo sapiens
agacattctcacata

SEQ ID NO: 4372818 - DNA, 16 bp, Homo sapiens
agacattcttttaatg

SEQ ID NO: 4372819 - DNA, 21 bp, Homo sapiens
agacattgctctatgtctgcc

SEQ ID NO: 4372820 - DNA, 18 bp, Homo sapiens
agacattgtttttaaaaa

SEQ ID NO: 4372821 - DNA, 17 bp, Homo sapiens
agacatttgctgaactc

SEQ ID NO: 4372822 - DNA, 20 bp, Homo sapiens
agacatttgctgaactcagc

SEQ ID NO: 4372823 - DNA, 20 bp, Homo sapiens
agacattttaaaaaatggtc

SEQ ID NO: 4372824 - DNA, 13 bp, Homo sapiens
agacattttgtta

SEQ ID NO: 4372825 - DNA, 18 bp, Homo sapiens
agacattttgttacataa

SEQ ID NO: 4372826 - DNA, 20 bp, Homo sapiens
agacattttgtttttactgt

SEQ ID NO: 4372827 - DNA, 15 bp, Homo sapiens
agacatttttcattc

SEQ ID NO: 4372828 - DNA, 21 bp, Homo sapiens
agacatttttcattcatgaat

SEQ ID NO: 4372829 - DNA, 15 bp, Homo sapiens
agaccaaatctcagt

SEQ ID NO: 4372830 - DNA, 14 bp, Homo sapiens
agaccaacctgacc

SEQ ID NO: 4372831 - DNA, 21 bp, Homo sapiens
agaccacccaacctcaccctc

SEQ ID NO: 4372832 - DNA, 19 bp, Homo sapiens
agaccacccatatcatgca

SEQ ID NO: 4372833 - DNA, 16 bp, Homo sapiens
agaccacttgccacgc

SEQ ID NO: 4372834 - DNA, 13 bp, Homo sapiens
agaccagggtggc

SEQ ID NO: 4372835 - DNA, 19 bp, Homo sapiens
agaccagggtggccacaca

SEQ ID NO: 4372836 - DNA, 16 bp, Homo sapiens
agaccagtgcttagca

SEQ ID NO: 4372837 - DNA, 19 bp, Homo sapiens
agaccatattacctggatt

SEQ ID NO: 4372838 - DNA, 18 bp, Homo sapiens
agaccattggggctccca

SEQ ID NO: 4372839 - DNA, 20 bp, Homo sapiens
agaccattggggctcccagc

SEQ ID NO: 4372840 - DNA, 23 bp, Homo sapiens
agaccattggggctcccagccag

SEQ ID NO: 4372841 - DNA, 22 bp, Homo sapiens
agacccaaagcggtccctgtcc

SEQ ID NO: 4372842 - DNA, 15 bp, Homo sapiens
agacccacccccagc

SEQ ID NO: 4372843 - DNA, 17 bp, Homo sapiens
agacccacccccagcct

SEQ ID NO: 4372844 - DNA, 18 bp, Homo sapiens
agacccacccccagcctt

SEQ ID NO: 4372845 - DNA, 15 bp, Homo sapiens
agacccagaggtcca

SEQ ID NO: 4372846 - DNA, 20 bp, Homo sapiens
agacccagaggtccaggtcc

SEQ ID NO: 4372847 - DNA, 17 bp, Homo sapiens
agacccaggagtccagc

SEQ ID NO: 4372848 - DNA, 16 bp, Homo sapiens
agacccaggggtccag

SEQ ID NO: 4372849 - DNA, 19 bp, Homo sapiens
agacccaggggtccaggcc

SEQ ID NO: 4372850 - DNA, 21 bp, Homo sapiens
agacccaggggtccaggcccc

SEQ ID NO: 4372851 - DNA, 14 bp, Homo sapiens
agacccccagcact

SEQ ID NO: 4372852 - DNA, 15 bp, Homo sapiens
agacccccaggcaga

SEQ ID NO: 4372853 - DNA, 14 bp, Homo sapiens
agacccccaggcct

SEQ ID NO: 4372854 - DNA, 21 bp, Homo sapiens
agacccccatttgtcccagac

SEQ ID NO: 4372855 - DNA, 20 bp, Homo sapiens
agaccccccagcccctcctc

SEQ ID NO: 4372856 - DNA, 11 bp, Homo sapiens
agaccccgccc

SEQ ID NO: 4372857 - DNA, 12 bp, Homo sapiens
agacccctggcc

SEQ ID NO: 4372858 - DNA, 18 bp, Homo sapiens
agaccctaccccaccacg

SEQ ID NO: 4372859 - DNA, 13 bp, Homo sapiens
agaccctcgggcc

SEQ ID NO: 4372860 - DNA, 20 bp, Homo sapiens
agaccctcttgcccatcctg

SEQ ID NO: 4372861 - DNA, 18 bp, Homo sapiens
agaccctgaggccctggg

SEQ ID NO: 4372862 - DNA, 24 bp, Homo sapiens
agaccctgccacagccagaggagg

SEQ ID NO: 4372863 - DNA, 15 bp, Homo sapiens
agaccctgggagaga

SEQ ID NO: 4372864 - DNA, 17 bp, Homo sapiens
agaccctgggtgggctc

SEQ ID NO: 4372865 - DNA, 19 bp, Homo sapiens
agaccctgggtgggctctg

SEQ ID NO: 4372866 - DNA, 22 bp, Homo sapiens
agaccctgggtgggctctgtgc

SEQ ID NO: 4372867 - DNA, 16 bp, Homo sapiens
agaccctttgtctctg

SEQ ID NO: 4372868 - DNA, 18 bp, Homo sapiens
agacctaaagcaagcctg

SEQ ID NO: 4372869 - DNA, 14 bp, Homo sapiens
agacctcagccatg

SEQ ID NO: 4372870 - DNA, 14 bp, Homo sapiens
agagaagacaaaac

SEQ ID NO: 4372871 - DNA, 16 bp, Homo sapiens
agagaagacaggctgg

SEQ ID NO: 4372872 - DNA, 19 bp, Homo sapiens
agagaagagggcccagccc

SEQ ID NO: 4372873 - DNA, 17 bp, Homo sapiens
agagaagccacgctgtc

SEQ ID NO: 4372874 - DNA, 20 bp, Homo sapiens
agagaagctaaaacctgagc

SEQ ID NO: 4372875 - DNA, 16 bp, Homo sapiens
agagaaggaaaagact

SEQ ID NO: 4372876 - DNA, 23 bp, Homo sapiens
agagaaggaaaagactgaatcta

SEQ ID NO: 4372877 - DNA, 20 bp, Homo sapiens
agagaaggcaggaatgtgtg

SEQ ID NO: 4372878 - DNA, 19 bp, Homo sapiens
agagaataggggagccaag

SEQ ID NO: 4372879 - DNA, 12 bp, Homo sapiens
agagaatcaaca

SEQ ID NO: 4372880 - DNA, 14 bp, Homo sapiens
agagaatgtatttg

SEQ ID NO: 4372881 - DNA, 16 bp, Homo sapiens
agagaattgaaatgag

SEQ ID NO: 4372882 - DNA, 22 bp, Homo sapiens
agagacaaactgtaaaaaatgt

SEQ ID NO: 4372883 - DNA, 15 bp, Homo sapiens
agagacacctgcacc

SEQ ID NO: 4372884 - DNA, 14 bp, Homo sapiens
agagacagaaagca

SEQ ID NO: 4372885 - DNA, 13 bp, Homo sapiens
agagacaggaaaa

SEQ ID NO: 4372886 - DNA, 20 bp, Homo sapiens
agagacaggcagcccagcag

SEQ ID NO: 4372887 - DNA, 15 bp, Homo sapiens
agagacatttcaaaa

SEQ ID NO: 4372888 - DNA, 14 bp, Homo sapiens
agagaccacacatt

SEQ ID NO: 4372889 - DNA, 12 bp, Homo sapiens
agagacccccag

SEQ ID NO: 4372890 - DNA, 15 bp, Homo sapiens
agagacccccaggcc

SEQ ID NO: 4372891 - DNA, 17 bp, Homo sapiens
agagacccttgtttgat

SEQ ID NO: 4372892 - DNA, 14 bp, Homo sapiens
agagacctgctcag

SEQ ID NO: 4372893 - DNA, 14 bp, Homo sapiens
agagacgccactcc

SEQ ID NO: 4372894 - DNA, 18 bp, Homo sapiens
agagacgccactccctgg

SEQ ID NO: 4372895 - DNA, 17 bp, Homo sapiens
agagacgggccctggtg

SEQ ID NO: 4372896 - DNA, 16 bp, Homo sapiens
agagactcccatgaag

SEQ ID NO: 4372897 - DNA, 17 bp, Homo sapiens
agagactcccatgaagc

SEQ ID NO: 4372898 - DNA, 17 bp, Homo sapiens
agagactgagcagccgc

SEQ ID NO: 4372899 - DNA, 15 bp, Homo sapiens
agagactgcgttctg

SEQ ID NO: 4372900 - DNA, 19 bp, Homo sapiens
agagacttgtgctcaagga

SEQ ID NO: 4372901 - DNA, 13 bp, Homo sapiens
agagagacctcat

SEQ ID NO: 4372902 - DNA, 20 bp, Homo sapiens
agagagacctcatcctgctc

SEQ ID NO: 4372903 - DNA, 13 bp, Homo sapiens
agagagagagaaa

SEQ ID NO: 4372904 - DNA, 14 bp, Homo sapiens
agagagagagaaag

SEQ ID NO: 4372905 - DNA, 15 bp, Homo sapiens
agagagagaggacag

SEQ ID NO: 4372906 - DNA, 19 bp, Homo sapiens
agagagatgggagctcctc

SEQ ID NO: 4372907 - DNA, 16 bp, Homo sapiens
agagagattggatttt

SEQ ID NO: 4372908 - DNA, 21 bp, Homo sapiens
agagagccctgggtgacttca

SEQ ID NO: 4372909 - DNA, 17 bp, Homo sapiens
agagagcccttcccagg

SEQ ID NO: 4372910 - DNA, 19 bp, Homo sapiens
agagagcccttcccagggc

SEQ ID NO: 4372911 - DNA, 17 bp, Homo sapiens
agagaggaatcagactt

SEQ ID NO: 4372912 - DNA, 23 bp, Homo sapiens
agagaggccattctttcccaaca

SEQ ID NO: 4372913 - DNA, 17 bp, Homo sapiens
agagaggcttgaaggcc

SEQ ID NO: 4372914 - DNA, 20 bp, Homo sapiens
agagaggcttgaaggccagc

SEQ ID NO: 4372915 - DNA, 16 bp, Homo sapiens
agagaggtaaagggtg

SEQ ID NO: 4372916 - DNA, 17 bp, Homo sapiens
agagagtgtgtgtttgt

SEQ ID NO: 4372917 - DNA, 16 bp, Homo sapiens
agagatagcttctctt

SEQ ID NO: 4372918 - DNA, 14 bp, Homo sapiens
agagatattttgta

SEQ ID NO: 4372919 - DNA, 14 bp, Homo sapiens
agagatctcccttc

SEQ ID NO: 4372920 - DNA, 22 bp, Homo sapiens
agagatctcccttctcatctcc

SEQ ID NO: 4372921 - DNA, 15 bp, Homo sapiens
agagatgagaaagct

SEQ ID NO: 4372922 - DNA, 13 bp, Homo sapiens
agagatgagccca

SEQ ID NO: 4372923 - DNA, 17 bp, Homo sapiens
agagatgagcccaccct

SEQ ID NO: 4372924 - DNA, 14 bp, Homo sapiens
agagatgcctccac

SEQ ID NO: 4372925 - DNA, 19 bp, Homo sapiens
agagatgggaatgaggtgg

SEQ ID NO: 4372926 - DNA, 15 bp, Homo sapiens
agagatgggagctcc

SEQ ID NO: 4372927 - DNA, 17 bp, Homo sapiens
agagatgggagctcctc

SEQ ID NO: 4372928 - DNA, 24 bp, Homo sapiens
agagatgggagctcctctcctgga

SEQ ID NO: 4372929 - DNA, 19 bp, Homo sapiens
agagcaaaactccgtctca

SEQ ID NO: 4372930 - DNA, 13 bp, Homo sapiens
agagcaaacagaa

SEQ ID NO: 4372931 - DNA, 16 bp, Homo sapiens
agagcaaacagaaaaa

SEQ ID NO: 4372932 - DNA, 18 bp, Homo sapiens
agagcaaagatggcttcc

SEQ ID NO: 4372933 - DNA, 13 bp, Homo sapiens
agagcaagaagga

SEQ ID NO: 4372934 - DNA, 15 bp, Homo sapiens
agagcaagaaggaaa

SEQ ID NO: 4372935 - DNA, 22 bp, Homo sapiens
agagcaaggtcatgaaggaggg

SEQ ID NO: 4372936 - DNA, 14 bp, Homo sapiens
agagcaagtctgga

SEQ ID NO: 4372937 - DNA, 15 bp, Homo sapiens
agagcacctgtagct

SEQ ID NO: 4372938 - DNA, 23 bp, Homo sapiens
agagcactttaaaaacaggccag

SEQ ID NO: 4372939 - DNA, 15 bp, Homo sapiens
agagcagcagcacca

SEQ ID NO: 4372940 - DNA, 12 bp, Homo sapiens
agagcagcctgt

SEQ ID NO: 4372941 - DNA, 13 bp, Homo sapiens
agagcaggactcc

SEQ ID NO: 4372942 - DNA, 20 bp, Homo sapiens
agagcaggactccaggccca

SEQ ID NO: 4372943 - DNA, 17 bp, Homo sapiens
agagcataaaacctaaa

SEQ ID NO: 4372944 - DNA, 14 bp, Homo sapiens
agagcatgcacatg

SEQ ID NO: 4372945 - DNA, 13 bp, Homo sapiens
agagcatggatgc

SEQ ID NO: 4372946 - DNA, 15 bp, Homo sapiens
agagcatggatgcat

SEQ ID NO: 4372947 - DNA, 13 bp, Homo sapiens
agagccacctgca

SEQ ID NO: 4372948 - DNA, 22 bp, Homo sapiens
agagccagaacctggagggcta

SEQ ID NO: 4372949 - DNA, 14 bp, Homo sapiens
agagccagccctcc

SEQ ID NO: 4372950 - DNA, 20 bp, Homo sapiens
agagccagccctccctgtcc

SEQ ID NO: 4372951 - DNA, 21 bp, Homo sapiens
agagccagccctccctgtcct

SEQ ID NO: 4372952 - DNA, 14 bp, Homo sapiens
agagccagcctggc

SEQ ID NO: 4372953 - DNA, 15 bp, Homo sapiens
agagccagcctggct

SEQ ID NO: 4372954 - DNA, 21 bp, Homo sapiens
agagccagcctggctctgccc

SEQ ID NO: 4372955 - DNA, 15 bp, Homo sapiens
agagccagggcaggg

SEQ ID NO: 4372956 - DNA, 17 bp, Homo sapiens
agagcccagcccaggag

SEQ ID NO: 4372957 - DNA, 16 bp, Homo sapiens
agagccctgctgtggg

SEQ ID NO: 4372958 - DNA, 19 bp, Homo sapiens
agagccggtggtgcccgtg

SEQ ID NO: 4372959 - DNA, 12 bp, Homo sapiens
agagcctctggc

SEQ ID NO: 4372960 - DNA, 19 bp, Homo sapiens
agagcctgacgctcagccc

SEQ ID NO: 4372961 - DNA, 23 bp, Homo sapiens
agagcctgacgctcagccccagg

SEQ ID NO: 4372962 - DNA, 16 bp, Homo sapiens
agagcctgcctggagc

SEQ ID NO: 4372963 - DNA, 11 bp, Homo sapiens
agagcctgctg

SEQ ID NO: 4372964 - DNA, 13 bp, Homo sapiens
agagcctgctggc

SEQ ID NO: 4372965 - DNA, 19 bp, Homo sapiens
agagcctgctggcacccac

SEQ ID NO: 4372966 - DNA, 17 bp, Homo sapiens
agagcctggccccaggc

SEQ ID NO: 4372967 - DNA, 18 bp, Homo sapiens
agagcctggccccaggcc

SEQ ID NO: 4372968 - DNA, 19 bp, Homo sapiens
agagcctgtggaggggctt

SEQ ID NO: 4372969 - DNA, 18 bp, Homo sapiens
agagccttagcagccctg

SEQ ID NO: 4372970 - DNA, 14 bp, Homo sapiens
agagccttcaagtg

SEQ ID NO: 4372971 - DNA, 15 bp, Homo sapiens
agagccttcaagtgc

SEQ ID NO: 4372972 - DNA, 19 bp, Homo sapiens
agagccttcaagtgccaaa

SEQ ID NO: 4372973 - DNA, 20 bp, Homo sapiens
agagccttcaagtgccaaac

SEQ ID NO: 4372974 - DNA, 23 bp, Homo sapiens
agagccttcagaatgctcctgag

SEQ ID NO: 4372975 - DNA, 16 bp, Homo sapiens
agagccttcagcctta

SEQ ID NO: 4372976 - DNA, 18 bp, Homo sapiens
agagccttctcagaagca

SEQ ID NO: 4372977 - DNA, 19 bp, Homo sapiens
agagcctttcctcaaaact

SEQ ID NO: 4372978 - DNA, 19 bp, Homo sapiens
agagcgagaccctgtctca

SEQ ID NO: 4372979 - DNA, 19 bp, Homo sapiens
agagcgagagatcaaagat

SEQ ID NO: 4372980 - DNA, 14 bp, Homo sapiens
agagcgcacaggga

SEQ ID NO: 4372981 - DNA, 14 bp, Homo sapiens
agagcgccaggaag

SEQ ID NO: 4372982 - DNA, 17 bp, Homo sapiens
agagcgggtaaagtgca

SEQ ID NO: 4372983 - DNA, 14 bp, Homo sapiens
agagctaataaatc

SEQ ID NO: 4372984 - DNA, 14 bp, Homo sapiens
agagctacataatt

SEQ ID NO: 4372985 - DNA, 14 bp, Homo sapiens
agagctacgtattt

SEQ ID NO: 4372986 - DNA, 17 bp, Homo sapiens
agagctacgtatttaat

SEQ ID NO: 4372987 - DNA, 17 bp, Homo sapiens
agagctagaacatggag

SEQ ID NO: 4372988 - DNA, 19 bp, Homo sapiens
agagctagaacatggagag

SEQ ID NO: 4372989 - DNA, 18 bp, Homo sapiens
agatcgagaccatcctgg

SEQ ID NO: 4372990 - DNA, 20 bp, Homo sapiens
agatcgagaccatcctggct

SEQ ID NO: 4372991 - DNA, 21 bp, Homo sapiens
agatcgagaccatcctggcta

SEQ ID NO: 4372992 - DNA, 20 bp, Homo sapiens
agatctaaacagttatttct

SEQ ID NO: 4372993 - DNA, 21 bp, Homo sapiens
agatctaaacagttatttctg

SEQ ID NO: 4372994 - DNA, 13 bp, Homo sapiens
agatctacacatg

SEQ ID NO: 4372995 - DNA, 18 bp, Homo sapiens
agatctacacatgttgcc

SEQ ID NO: 4372996 - DNA, 16 bp, Homo sapiens
agatctatgggaagat

SEQ ID NO: 4372997 - DNA, 16 bp, Homo sapiens
agatctcggtttgcca

SEQ ID NO: 4372998 - DNA, 14 bp, Homo sapiens
agatctctcctgca

SEQ ID NO: 4372999 - DNA, 13 bp, Homo sapiens
agatctgtgcccc

SEQ ID NO: 4373000 - DNA, 13 bp, Homo sapiens
agatcttaagcag

SEQ ID NO: 4373001 - DNA, 21 bp, Homo sapiens
agatcttaagcagtaatctgt

SEQ ID NO: 4373002 - DNA, 13 bp, Homo sapiens
agatcttaatata

SEQ ID NO: 4373003 - DNA, 18 bp, Homo sapiens
agatcttccgtggtcaga

SEQ ID NO: 4373004 - DNA, 20 bp, Homo sapiens
agatcttccgtggtcagagt

SEQ ID NO: 4373005 - DNA, 12 bp, Homo sapiens
agatcttcctgc

SEQ ID NO: 4373006 - DNA, 14 bp, Homo sapiens
agatcttcctgctg

SEQ ID NO: 4373007 - DNA, 16 bp, Homo sapiens
agatctttctccttga

SEQ ID NO: 4373008 - DNA, 17 bp, Homo sapiens
agatctttgtaaatgca

SEQ ID NO: 4373009 - DNA, 17 bp, Homo sapiens
agatgaaaatatcagct

SEQ ID NO: 4373010 - DNA, 14 bp, Homo sapiens
agatgaaagagcag

SEQ ID NO: 4373011 - DNA, 15 bp, Homo sapiens
agatgaaagagcagt

SEQ ID NO: 4373012 - DNA, 12 bp, Homo sapiens
agatgaaataat

SEQ ID NO: 4373013 - DNA, 21 bp, Homo sapiens
agatgaaatatatattgtaaa

SEQ ID NO: 4373014 - DNA, 11 bp, Homo sapiens
agatgaatgtc

SEQ ID NO: 4373015 - DNA, 17 bp, Homo sapiens
agatgaatgtcctgaaa

SEQ ID NO: 4373016 - DNA, 19 bp, Homo sapiens
agatgacaaaagaaaattt

SEQ ID NO: 4373017 - DNA, 14 bp, Homo sapiens
agatgacaaatatt

SEQ ID NO: 4373018 - DNA, 16 bp, Homo sapiens
agatgacaaatattct

SEQ ID NO: 4373019 - DNA, 17 bp, Homo sapiens
agatgacaacctccatt

SEQ ID NO: 4373020 - DNA, 15 bp, Homo sapiens
agatgaccagggatg

SEQ ID NO: 4373021 - DNA, 19 bp, Homo sapiens
agatgagcaaccacattta

SEQ ID NO: 4373022 - DNA, 14 bp, Homo sapiens
agatgagcaggagc

SEQ ID NO: 4373023 - DNA, 20 bp, Homo sapiens
agatgagcaggagcttgggt

SEQ ID NO: 4373024 - DNA, 17 bp, Homo sapiens
agatgaggacagagtgg

SEQ ID NO: 4373025 - DNA, 14 bp, Homo sapiens
agatgagtgggctt

SEQ ID NO: 4373026 - DNA, 14 bp, Homo sapiens
agatgataattttt

SEQ ID NO: 4373027 - DNA, 14 bp, Homo sapiens
agatgcaacctcac

SEQ ID NO: 4373028 - DNA, 19 bp, Homo sapiens
agatgcaacctcactatgg

SEQ ID NO: 4373029 - DNA, 15 bp, Homo sapiens
agatgcaaggaccag

SEQ ID NO: 4373030 - DNA, 20 bp, Homo sapiens
agatgcaaggaccaggactc

SEQ ID NO: 4373031 - DNA, 19 bp, Homo sapiens
agatgcacgtggggcccac

SEQ ID NO: 4373032 - DNA, 21 bp, Homo sapiens
agatgcacgtggggcccactg

SEQ ID NO: 4373033 - DNA, 22 bp, Homo sapiens
agatgcagccaccacatccctt

SEQ ID NO: 4373034 - DNA, 17 bp, Homo sapiens
agatgcagctactggaa

SEQ ID NO: 4373035 - DNA, 22 bp, Homo sapiens
agatgccacttctcactcacca

SEQ ID NO: 4373036 - DNA, 12 bp, Homo sapiens
agatgccccaga

SEQ ID NO: 4373037 - DNA, 17 bp, Homo sapiens
agatgccccagagctgt

SEQ ID NO: 4373038 - DNA, 17 bp, Homo sapiens
agatgccccattccttg

SEQ ID NO: 4373039 - DNA, 23 bp, Homo sapiens
agatgccccattccttgcgcctc

SEQ ID NO: 4373040 - DNA, 18 bp, Homo sapiens
agatgcccgagggagggg

SEQ ID NO: 4373041 - DNA, 22 bp, Homo sapiens
agatgcgcattctaacctggag

SEQ ID NO: 4373042 - DNA, 15 bp, Homo sapiens
agatgctccttgggc

SEQ ID NO: 4373043 - DNA, 16 bp, Homo sapiens
agatgctggtggagga

SEQ ID NO: 4373044 - DNA, 17 bp, Homo sapiens
agatgctggtggaggaa

SEQ ID NO: 4373045 - DNA, 23 bp, Homo sapiens
agatgctggtggaggaagggctg

SEQ ID NO: 4373046 - DNA, 13 bp, Homo sapiens
agatgcttctctc

SEQ ID NO: 4373047 - DNA, 20 bp, Homo sapiens
agatgcttggagcaatcaga

SEQ ID NO: 4373048 - DNA, 13 bp, Homo sapiens
agatggaaaaaaa

SEQ ID NO: 4373049 - DNA, 18 bp, Homo sapiens
agatggaaaattcatttt

SEQ ID NO: 4373050 - DNA, 22 bp, Homo sapiens
agatggaaaattcattttttaa

SEQ ID NO: 4373051 - DNA, 15 bp, Homo sapiens
agatggaaatacagt

SEQ ID NO: 4373052 - DNA, 14 bp, Homo sapiens
agatggaccccagc

SEQ ID NO: 4373053 - DNA, 18 bp, Homo sapiens
agatggaccccagcattt

SEQ ID NO: 4373054 - DNA, 15 bp, Homo sapiens
agatggagcaaatgt

SEQ ID NO: 4373055 - DNA, 22 bp, Homo sapiens
agatggagcccataggccaccc

SEQ ID NO: 4373056 - DNA, 17 bp, Homo sapiens
agatggagggcttggcc

SEQ ID NO: 4373057 - DNA, 19 bp, Homo sapiens
agatggagggggctggggt

SEQ ID NO: 4373058 - DNA, 22 bp, Homo sapiens
agatggagtcttgctctgtcac

SEQ ID NO: 4373059 - DNA, 20 bp, Homo sapiens
agatggcaacattggacaga

SEQ ID NO: 4373060 - DNA, 23 bp, Homo sapiens
agatggcatatatgtgatctggg

SEQ ID NO: 4373061 - DNA, 20 bp, Homo sapiens
agatggcatcaaaaaagata

SEQ ID NO: 4373062 - DNA, 13 bp, Homo sapiens
agatggcccctcc

SEQ ID NO: 4373063 - DNA, 15 bp, Homo sapiens
agatggcccctccac

SEQ ID NO: 4373064 - DNA, 21 bp, Homo sapiens
agatggctggaaggggtccag

SEQ ID NO: 4373065 - DNA, 21 bp, Homo sapiens
agatggcttccgtgagacaca

SEQ ID NO: 4373066 - DNA, 16 bp, Homo sapiens
agatgggacagcaaca

SEQ ID NO: 4373067 - DNA, 18 bp, Homo sapiens
agatgggagctcctctcc

SEQ ID NO: 4373068 - DNA, 23 bp, Homo sapiens
agatgggcaaaccctggtgcttt

SEQ ID NO: 4373069 - DNA, 16 bp, Homo sapiens
agatgggcatcttttg

SEQ ID NO: 4373070 - DNA, 13 bp, Homo sapiens
agatgggtccagg

SEQ ID NO: 4373071 - DNA, 15 bp, Homo sapiens
agatgggtgggagga

SEQ ID NO: 4373072 - DNA, 22 bp, Homo sapiens
agatgggtgggaggagatgaaa

SEQ ID NO: 4373073 - DNA, 11 bp, Homo sapiens
agatggtgctg

SEQ ID NO: 4373074 - DNA, 17 bp, Homo sapiens
agatggtggagattggc

SEQ ID NO: 4373075 - DNA, 18 bp, Homo sapiens
agatggtttgagcctgag

SEQ ID NO: 4373076 - DNA, 13 bp, Homo sapiens
agatggttttgat

SEQ ID NO: 4373077 - DNA, 12 bp, Homo sapiens
agatgtacattt

SEQ ID NO: 4373078 - DNA, 17 bp, Homo sapiens
agatgtacatttaataa

SEQ ID NO: 4373079 - DNA, 23 bp, Homo sapiens
agatgtcatttagttcagcatcc

SEQ ID NO: 4373080 - DNA, 16 bp, Homo sapiens
agatgtcttctgcctg

SEQ ID NO: 4373081 - DNA, 18 bp, Homo sapiens
agatgtcttctgcctgtt

SEQ ID NO: 4373082 - DNA, 19 bp, Homo sapiens
agatgtcttctgcctgtta

SEQ ID NO: 4373083 - DNA, 17 bp, Homo sapiens
agatgtcttttatagtg

SEQ ID NO: 4373084 - DNA, 18 bp, Homo sapiens
agatgtgaaaatatactt

SEQ ID NO: 4373085 - DNA, 19 bp, Homo sapiens
agatgtgaaaatatacttg

SEQ ID NO: 4373086 - DNA, 22 bp, Homo sapiens
agatgtgaacacatcagcttgc

SEQ ID NO: 4373087 - DNA, 16 bp, Homo sapiens
agatgtgaattattga

SEQ ID NO: 4373088 - DNA, 22 bp, Homo sapiens
agatgtgaattattgacactga

SEQ ID NO: 4373089 - DNA, 22 bp, Homo sapiens
agatgtgagccaccgtgcctgg

SEQ ID NO: 4373090 - DNA, 15 bp, Homo sapiens
agatgtgcacccatg

SEQ ID NO: 4373091 - DNA, 20 bp, Homo sapiens
agatgtgtaaacaggtattt

SEQ ID NO: 4373092 - DNA, 22 bp, Homo sapiens
agatgtgtatcagtgtttatgt

SEQ ID NO: 4373093 - DNA, 17 bp, Homo sapiens
agatgtgttttgttttg

SEQ ID NO: 4373094 - DNA, 19 bp, Homo sapiens
agatgtgttttgttttgga

SEQ ID NO: 4373095 - DNA, 15 bp, Homo sapiens
agatgttaaaataaa

SEQ ID NO: 4373096 - DNA, 17 bp, Homo sapiens
agatgttctaagtcttt

SEQ ID NO: 4373097 - DNA, 20 bp, Homo sapiens
agatgttctaagtctttcca

SEQ ID NO: 4373098 - DNA, 22 bp, Homo sapiens
agatgttctaagtctttccatt

SEQ ID NO: 4373099 - DNA, 16 bp, Homo sapiens
agatgtttatttcagg

SEQ ID NO: 4373100 - DNA, 16 bp, Homo sapiens
agatgtttcttgcctt

SEQ ID NO: 4373101 - DNA, 23 bp, Homo sapiens
agatgtttcttgccttttgttaa

SEQ ID NO: 4373102 - DNA, 17 bp, Homo sapiens
agatgtttgatagattt

SEQ ID NO: 4373103 - DNA, 23 bp, Homo sapiens
agatgtttgttttcaaaatactt

SEQ ID NO: 4373104 - DNA, 18 bp, Homo sapiens
agattaaattacagcttt

SEQ ID NO: 4373105 - DNA, 21 bp, Homo sapiens
agattaaattacagcttttat

SEQ ID NO: 4373106 - DNA, 18 bp, Homo sapiens
agattaacctgaaagaac

SEQ ID NO: 4373107 - DNA, 23 bp, Homo sapiens
agcagacttctcggaattcataa

SEQ ID NO: 4373108 - DNA, 16 bp, Homo sapiens
agcagaggcaggctgg

SEQ ID NO: 4373109 - DNA, 11 bp, Homo sapiens
agcagaggccc

SEQ ID NO: 4373110 - DNA, 16 bp, Homo sapiens
agcagaggccctgccc

SEQ ID NO: 4373111 - DNA, 19 bp, Homo sapiens
agcagaggccctgccccca

SEQ ID NO: 4373112 - DNA, 14 bp, Homo sapiens
agcagaggggctga

SEQ ID NO: 4373113 - DNA, 18 bp, Homo sapiens
agcagagggggagtagcc

SEQ ID NO: 4373114 - DNA, 19 bp, Homo sapiens
agcagagggggagtagcca

SEQ ID NO: 4373115 - DNA, 16 bp, Homo sapiens
agcagagtaacaggat

SEQ ID NO: 4373116 - DNA, 18 bp, Homo sapiens
agcagagttaaatctcaa

SEQ ID NO: 4373117 - DNA, 18 bp, Homo sapiens
agcagatctgttttgtgg

SEQ ID NO: 4373118 - DNA, 20 bp, Homo sapiens
agcagcaaaaccaaactggg

SEQ ID NO: 4373119 - DNA, 17 bp, Homo sapiens
agcagcaatattttgta

SEQ ID NO: 4373120 - DNA, 18 bp, Homo sapiens
agcagcaccaaccacagc

SEQ ID NO: 4373121 - DNA, 19 bp, Homo sapiens
agcagcacgattttgcaca

SEQ ID NO: 4373122 - DNA, 21 bp, Homo sapiens
agcagcacgattttgcacaaa

SEQ ID NO: 4373123 - DNA, 23 bp, Homo sapiens
agcagcactccgcatcacctcac

SEQ ID NO: 4373124 - DNA, 18 bp, Homo sapiens
agcagcacttagacctgc

SEQ ID NO: 4373125 - DNA, 20 bp, Homo sapiens
agcagcacttagacctgcca

SEQ ID NO: 4373126 - DNA, 13 bp, Homo sapiens
agcagcagcacca

SEQ ID NO: 4373127 - DNA, 14 bp, Homo sapiens
agcagcagcctgca

SEQ ID NO: 4373128 - DNA, 18 bp, Homo sapiens
agcagcagcctgcacctg

SEQ ID NO: 4373129 - DNA, 19 bp, Homo sapiens
agcagcagcttggggagag

SEQ ID NO: 4373130 - DNA, 14 bp, Homo sapiens
agcagcaggctcag

SEQ ID NO: 4373131 - DNA, 14 bp, Homo sapiens
agcagcatcttctg

SEQ ID NO: 4373132 - DNA, 13 bp, Homo sapiens
agcagccccccag

SEQ ID NO: 4373133 - DNA, 22 bp, Homo sapiens
agcagcccccgggccgctggct

SEQ ID NO: 4373134 - DNA, 15 bp, Homo sapiens
agcagcccctgagag

SEQ ID NO: 4373135 - DNA, 19 bp, Homo sapiens
agcagccctagcggctgct

SEQ ID NO: 4373136 - DNA, 17 bp, Homo sapiens
agcagccctcctcaccc

SEQ ID NO: 4373137 - DNA, 12 bp, Homo sapiens
agcagccgccag

SEQ ID NO: 4373138 - DNA, 19 bp, Homo sapiens
agcagccgccagctgggag

SEQ ID NO: 4373139 - DNA, 22 bp, Homo sapiens
agcagcctctggacagccagtg

SEQ ID NO: 4373140 - DNA, 16 bp, Homo sapiens
agcagcctgcacctgc

SEQ ID NO: 4373141 - DNA, 19 bp, Homo sapiens
agcagcctgcacctgcccc

SEQ ID NO: 4373142 - DNA, 20 bp, Homo sapiens
agcagcctgcacctgccccg

SEQ ID NO: 4373143 - DNA, 13 bp, Homo sapiens
agcagcctgtggc

SEQ ID NO: 4373144 - DNA, 21 bp, Homo sapiens
agcagcgaccacccctgcctc

SEQ ID NO: 4373145 - DNA, 15 bp, Homo sapiens
agcagctccctttct

SEQ ID NO: 4373146 - DNA, 17 bp, Homo sapiens
agcagctctgagccaga

SEQ ID NO: 4373147 - DNA, 21 bp, Homo sapiens
agcagctctgagccagattac

SEQ ID NO: 4373148 - DNA, 22 bp, Homo sapiens
agcagctctgagccagattaca

SEQ ID NO: 4373149 - DNA, 14 bp, Homo sapiens
agcagctctggctc

SEQ ID NO: 4373150 - DNA, 16 bp, Homo sapiens
agcagctctggctctg

SEQ ID NO: 4373151 - DNA, 14 bp, Homo sapiens
agcagcttggggag

SEQ ID NO: 4373152 - DNA, 20 bp, Homo sapiens
agcaggacccagtggtcagc

SEQ ID NO: 4373153 - DNA, 15 bp, Homo sapiens
agcaggactccaggc

SEQ ID NO: 4373154 - DNA, 19 bp, Homo sapiens
agcaggactccaggcccaa

SEQ ID NO: 4373155 - DNA, 23 bp, Homo sapiens
agcaggactccaggcccaaggct

SEQ ID NO: 4373156 - DNA, 18 bp, Homo sapiens
agcaggagagactgagca

SEQ ID NO: 4373157 - DNA, 15 bp, Homo sapiens
agcaggcaccgccac

SEQ ID NO: 4373158 - DNA, 22 bp, Homo sapiens
agcaggcatttgctaaggcagc

SEQ ID NO: 4373159 - DNA, 17 bp, Homo sapiens
agcaggccaaggtctga

SEQ ID NO: 4373160 - DNA, 18 bp, Homo sapiens
agcaggccaaggtctgag

SEQ ID NO: 4373161 - DNA, 17 bp, Homo sapiens
agcaggcctctggttgc

SEQ ID NO: 4373162 - DNA, 12 bp, Homo sapiens
agcaggcgggct

SEQ ID NO: 4373163 - DNA, 15 bp, Homo sapiens
agcaggcgggctcct

SEQ ID NO: 4373164 - DNA, 20 bp, Homo sapiens
agcaggctgccagtgcctgg

SEQ ID NO: 4373165 - DNA, 16 bp, Homo sapiens
agcagggctgctgtga

SEQ ID NO: 4373166 - DNA, 18 bp, Homo sapiens
agcaggggaagcaggacc

SEQ ID NO: 4373167 - DNA, 21 bp, Homo sapiens
agcaggggaagcaggacccag

SEQ ID NO: 4373168 - DNA, 23 bp, Homo sapiens
agcaggggaattccctccccctc

SEQ ID NO: 4373169 - DNA, 13 bp, Homo sapiens
agcaggggcccct

SEQ ID NO: 4373170 - DNA, 19 bp, Homo sapiens
agcaggggcccctggggac

SEQ ID NO: 4373171 - DNA, 18 bp, Homo sapiens
agcaggtagcctgctggt

SEQ ID NO: 4373172 - DNA, 20 bp, Homo sapiens
agcaggttggcttttttccc

SEQ ID NO: 4373173 - DNA, 22 bp, Homo sapiens
agcaggttggcttttttccctg

SEQ ID NO: 4373174 - DNA, 20 bp, Homo sapiens
agcagtatatgttaatttgt

SEQ ID NO: 4373175 - DNA, 16 bp, Homo sapiens
agcagtatattagtat

SEQ ID NO: 4373176 - DNA, 13 bp, Homo sapiens
agcagtattttgg

SEQ ID NO: 4373177 - DNA, 17 bp, Homo sapiens
agcagtcgcctgcctgc

SEQ ID NO: 4373178 - DNA, 22 bp, Homo sapiens
agcagtgagccgcatcttctcc

SEQ ID NO: 4373179 - DNA, 19 bp, Homo sapiens
agcagtgattgtcttaata

SEQ ID NO: 4373180 - DNA, 12 bp, Homo sapiens
agcagtggcctt

SEQ ID NO: 4373181 - DNA, 15 bp, Homo sapiens
agcagtgtgaggcca

SEQ ID NO: 4373182 - DNA, 22 bp, Homo sapiens
agcagtgtggggggacagacag

SEQ ID NO: 4373183 - DNA, 15 bp, Homo sapiens
agcagtgttctgggt

SEQ ID NO: 4373184 - DNA, 16 bp, Homo sapiens
agcagtgttctgggtg

SEQ ID NO: 4373185 - DNA, 12 bp, Homo sapiens
agcagtgtttgc

SEQ ID NO: 4373186 - DNA, 13 bp, Homo sapiens
agcagttataaca

SEQ ID NO: 4373187 - DNA, 22 bp, Homo sapiens
agcagttataacagatgtgaaa

SEQ ID NO: 4373188 - DNA, 21 bp, Homo sapiens
agcagttatggtgatgactta

SEQ ID NO: 4373189 - DNA, 13 bp, Homo sapiens
agcagttgaaaag

SEQ ID NO: 4373190 - DNA, 23 bp, Homo sapiens
agcataaaagatgaaagagcagt

SEQ ID NO: 4373191 - DNA, 20 bp, Homo sapiens
agcataaaatggaataacat

SEQ ID NO: 4373192 - DNA, 15 bp, Homo sapiens
agcataatctgaaaa

SEQ ID NO: 4373193 - DNA, 21 bp, Homo sapiens
agcataatctgaaaacatcta

SEQ ID NO: 4373194 - DNA, 17 bp, Homo sapiens
agcatagctacaatttg

SEQ ID NO: 4373195 - DNA, 15 bp, Homo sapiens
agcatataaatgttt

SEQ ID NO: 4373196 - DNA, 14 bp, Homo sapiens
agcatattttctta

SEQ ID NO: 4373197 - DNA, 15 bp, Homo sapiens
agcatcaatcttgtt

SEQ ID NO: 4373198 - DNA, 14 bp, Homo sapiens
agcatcacccacct

SEQ ID NO: 4373199 - DNA, 20 bp, Homo sapiens
agcatcactgatgggaataa

SEQ ID NO: 4373200 - DNA, 15 bp, Homo sapiens
agcatccaccccacc

SEQ ID NO: 4373201 - DNA, 17 bp, Homo sapiens
agcatccagacctgagc

SEQ ID NO: 4373202 - DNA, 15 bp, Homo sapiens
agcatccaggctggc

SEQ ID NO: 4373203 - DNA, 15 bp, Homo sapiens
agcatccctcaccca

SEQ ID NO: 4373204 - DNA, 13 bp, Homo sapiens
agcatccctggag

SEQ ID NO: 4373205 - DNA, 14 bp, Homo sapiens
agcatccctggagc

SEQ ID NO: 4373206 - DNA, 21 bp, Homo sapiens
agcatccctggagcaggagcc

SEQ ID NO: 4373207 - DNA, 16 bp, Homo sapiens
agcatccgcaggtgct

SEQ ID NO: 4373208 - DNA, 20 bp, Homo sapiens
agcatcgggagcacccagag

SEQ ID NO: 4373209 - DNA, 13 bp, Homo sapiens
agcatctcccagt

SEQ ID NO: 4373210 - DNA, 15 bp, Homo sapiens
agcatctgccccagg

SEQ ID NO: 4373211 - DNA, 18 bp, Homo sapiens
agcatctggctctaattc

SEQ ID NO: 4373212 - DNA, 17 bp, Homo sapiens
agcatgaacgccaagga

SEQ ID NO: 4373213 - DNA, 16 bp, Homo sapiens
agcatgaataaaatta

SEQ ID NO: 4373214 - DNA, 20 bp, Homo sapiens
agcatgaataaaattaggtt

SEQ ID NO: 4373215 - DNA, 21 bp, Homo sapiens
agcatgaataacatttaaatt

SEQ ID NO: 4373216 - DNA, 18 bp, Homo sapiens
agcatgattttaagaggc

SEQ ID NO: 4373217 - DNA, 19 bp, Homo sapiens
agcatgattttaagaggct

SEQ ID NO: 4373218 - DNA, 14 bp, Homo sapiens
agcatgcataaatc

SEQ ID NO: 4373219 - DNA, 16 bp, Homo sapiens
agcatgcataaatcaa

SEQ ID NO: 4373220 - DNA, 19 bp, Homo sapiens
agcatggagctgtcacctc

SEQ ID NO: 4373221 - DNA, 19 bp, Homo sapiens
agcatggatgcatttcaaa

SEQ ID NO: 4373222 - DNA, 21 bp, Homo sapiens
agcatggatgcatttcaaatg

SEQ ID NO: 4373223 - DNA, 13 bp, Homo sapiens
agcatggcagctg

SEQ ID NO: 4373224 - DNA, 20 bp, Homo sapiens
agcatggcatagccccggcc

SEQ ID NO: 4373225 - DNA, 23 bp, Homo sapiens
agcccctatagcactgagctcac

SEQ ID NO: 4373226 - DNA, 21 bp, Homo sapiens
agcccctccccagccagccct

SEQ ID NO: 4373227 - DNA, 14 bp, Homo sapiens
agcccctcctccct

SEQ ID NO: 4373228 - DNA, 15 bp, Homo sapiens
agcccctcctccctc

SEQ ID NO: 4373229 - DNA, 16 bp, Homo sapiens
agcccctcctccctca

SEQ ID NO: 4373230 - DNA, 18 bp, Homo sapiens
agcccctcctccctcagg

SEQ ID NO: 4373231 - DNA, 22 bp, Homo sapiens
agcccctcctccctcaggccca

SEQ ID NO: 4373232 - DNA, 12 bp, Homo sapiens
agcccctcctct

SEQ ID NO: 4373233 - DNA, 16 bp, Homo sapiens
agcccctcctctgcca

SEQ ID NO: 4373234 - DNA, 20 bp, Homo sapiens
agcccctcctctgccacctc

SEQ ID NO: 4373235 - DNA, 12 bp, Homo sapiens
agcccctgagag

SEQ ID NO: 4373236 - DNA, 13 bp, Homo sapiens
agcccctgagagc

SEQ ID NO: 4373237 - DNA, 14 bp, Homo sapiens
agcccctgagagcc

SEQ ID NO: 4373238 - DNA, 15 bp, Homo sapiens
agcccctgagagcct

SEQ ID NO: 4373239 - DNA, 10 bp, Homo sapiens
agcccctgca

SEQ ID NO: 4373240 - DNA, 13 bp, Homo sapiens
agcccctgcagat

SEQ ID NO: 4373241 - DNA, 14 bp, Homo sapiens
agcccctggagcct

SEQ ID NO: 4373242 - DNA, 14 bp, Homo sapiens
agcccctgggccca

SEQ ID NO: 4373243 - DNA, 16 bp, Homo sapiens
agcccctgggcccagt

SEQ ID NO: 4373244 - DNA, 17 bp, Homo sapiens
agcccctggggcccagc

SEQ ID NO: 4373245 - DNA, 18 bp, Homo sapiens
agcccctggggcccagcc

SEQ ID NO: 4373246 - DNA, 20 bp, Homo sapiens
agcccctggggcccagcccc

SEQ ID NO: 4373247 - DNA, 21 bp, Homo sapiens
agcccctggggcccagcccct

SEQ ID NO: 4373248 - DNA, 13 bp, Homo sapiens
agccccttcccca

SEQ ID NO: 4373249 - DNA, 17 bp, Homo sapiens
agccccttccccatggg

SEQ ID NO: 4373250 - DNA, 22 bp, Homo sapiens
agcccctttgcctgtcaagttg

SEQ ID NO: 4373251 - DNA, 18 bp, Homo sapiens
agcccgatattctccctg

SEQ ID NO: 4373252 - DNA, 20 bp, Homo sapiens
agcccgatattctccctgac

SEQ ID NO: 4373253 - DNA, 22 bp, Homo sapiens
agcccgatattctccctgacct

SEQ ID NO: 4373254 - DNA, 15 bp, Homo sapiens
agcccgcctgccagt

SEQ ID NO: 4373255 - DNA, 19 bp, Homo sapiens
agcccgcctgccagtccta

SEQ ID NO: 4373256 - DNA, 17 bp, Homo sapiens
agccttcccctccctgt

SEQ ID NO: 4373257 - DNA, 15 bp, Homo sapiens
agccttctgccacca

SEQ ID NO: 4373258 - DNA, 14 bp, Homo sapiens
agccttgcccagct

SEQ ID NO: 4373259 - DNA, 15 bp, Homo sapiens
agccttgcccagctt

SEQ ID NO: 4373260 - DNA, 12 bp, Homo sapiens
agccttgctcag

SEQ ID NO: 4373261 - DNA, 16 bp, Homo sapiens
agccttgctcaggtgc

SEQ ID NO: 4373262 - DNA, 17 bp, Homo sapiens
agccttgctctcttcaa

SEQ ID NO: 4373263 - DNA, 20 bp, Homo sapiens
agccttgctctcttcaataa

SEQ ID NO: 4373264 - DNA, 20 bp, Homo sapiens
agccttggataatgctgttg

SEQ ID NO: 4373265 - DNA, 22 bp, Homo sapiens
agccttggataatgctgttgcc

SEQ ID NO: 4373266 - DNA, 19 bp, Homo sapiens
agccttggcctctttcctc

SEQ ID NO: 4373267 - DNA, 17 bp, Homo sapiens
agccttggtgtccacct

SEQ ID NO: 4373268 - DNA, 18 bp, Homo sapiens
agccttggtgtccacctg

SEQ ID NO: 4373269 - DNA, 21 bp, Homo sapiens
agccttggtgtccacctggcc

SEQ ID NO: 4373270 - DNA, 16 bp, Homo sapiens
agcctttactgtttga

SEQ ID NO: 4373271 - DNA, 13 bp, Homo sapiens
agccttttgctct

SEQ ID NO: 4373272 - DNA, 14 bp, Homo sapiens
agccttttgctctc

SEQ ID NO: 4373273 - DNA, 15 bp, Homo sapiens
agccttttgctctct

SEQ ID NO: 4373274 - DNA, 18 bp, Homo sapiens
agcctttttgtttcaatg

SEQ ID NO: 4373275 - DNA, 20 bp, Homo sapiens
agcgaagggggtcaaaggaa

SEQ ID NO: 4373276 - DNA, 20 bp, Homo sapiens
agcgaatgctaggtctcgga

SEQ ID NO: 4373277 - DNA, 19 bp, Homo sapiens
agcgaccacccctgcctcc

SEQ ID NO: 4373278 - DNA, 17 bp, Homo sapiens
agcgacccattcagaga

SEQ ID NO: 4373279 - DNA, 17 bp, Homo sapiens
agcgagactccatctct

SEQ ID NO: 4373280 - DNA, 15 bp, Homo sapiens
agcgagcaagccggc

SEQ ID NO: 4373281 - DNA, 19 bp, Homo sapiens
agcgaggtcaacagagaag

SEQ ID NO: 4373282 - DNA, 22 bp, Homo sapiens
agcgaggtcaacagagaaggca

SEQ ID NO: 4373283 - DNA, 17 bp, Homo sapiens
agcgatctctcctggcc

SEQ ID NO: 4373284 - DNA, 18 bp, Homo sapiens
agcgatctctcctggcct

SEQ ID NO: 4373285 - DNA, 17 bp, Homo sapiens
agcgccaggaagccaga

SEQ ID NO: 4373286 - DNA, 20 bp, Homo sapiens
agcgccaggaagccagagcc

SEQ ID NO: 4373287 - DNA, 14 bp, Homo sapiens
agcgcccccgagcc

SEQ ID NO: 4373288 - DNA, 23 bp, Homo sapiens
agcgcctagtggggtctccctct

SEQ ID NO: 4373289 - DNA, 14 bp, Homo sapiens
agcgcctccctcca

SEQ ID NO: 4373290 - DNA, 21 bp, Homo sapiens
agcgcctccctccaccccagg

SEQ ID NO: 4373291 - DNA, 21 bp, Homo sapiens
agcgcggacccttctgggtcc

SEQ ID NO: 4373292 - DNA, 17 bp, Homo sapiens
agcgctcctgccgcaga

SEQ ID NO: 4373293 - DNA, 21 bp, Homo sapiens
agcgctcctgccgcagagctg

SEQ ID NO: 4373294 - DNA, 21 bp, Homo sapiens
agcgctcgatggacctcagca

SEQ ID NO: 4373295 - DNA, 22 bp, Homo sapiens
agcgctcgatggacctcagcaa

SEQ ID NO: 4373296 - DNA, 17 bp, Homo sapiens
agcgctgccgcacccca

SEQ ID NO: 4373297 - DNA, 19 bp, Homo sapiens
agcggaacatgtgcttcat

SEQ ID NO: 4373298 - DNA, 15 bp, Homo sapiens
agcggagcccagcct

SEQ ID NO: 4373299 - DNA, 16 bp, Homo sapiens
agcggagcccagcctg

SEQ ID NO: 4373300 - DNA, 18 bp, Homo sapiens
agcggagcccagcctggg

SEQ ID NO: 4373301 - DNA, 20 bp, Homo sapiens
agcggcaaacctttccccct

SEQ ID NO: 4373302 - DNA, 12 bp, Homo sapiens
agcggcatagca

SEQ ID NO: 4373303 - DNA, 15 bp, Homo sapiens
agcggcatagcaccc

SEQ ID NO: 4373304 - DNA, 14 bp, Homo sapiens
agcggccctggagg

SEQ ID NO: 4373305 - DNA, 14 bp, Homo sapiens
agcggctgctcctt

SEQ ID NO: 4373306 - DNA, 14 bp, Homo sapiens
agcgggaaaaggag

SEQ ID NO: 4373307 - DNA, 15 bp, Homo sapiens
agcgggaggcagcgc

SEQ ID NO: 4373308 - DNA, 23 bp, Homo sapiens
agcgggagtcagggacctgctgc

SEQ ID NO: 4373309 - DNA, 18 bp, Homo sapiens
agcgggggcctaaaaaaa

SEQ ID NO: 4373310 - DNA, 16 bp, Homo sapiens
agcgggtaaagtgcaa

SEQ ID NO: 4373311 - DNA, 15 bp, Homo sapiens
agcggtatctctggc

SEQ ID NO: 4373312 - DNA, 21 bp, Homo sapiens
agcgtcagaagtctagtttta

SEQ ID NO: 4373313 - DNA, 20 bp, Homo sapiens
agcgtcccctgctactcctg

SEQ ID NO: 4373314 - DNA, 17 bp, Homo sapiens
agcgtgacggagcccac

SEQ ID NO: 4373315 - DNA, 21 bp, Homo sapiens
agcgtgcagtagagagcaaag

SEQ ID NO: 4373316 - DNA, 19 bp, Homo sapiens
agcgtgcgcactgcatggg

SEQ ID NO: 4373317 - DNA, 16 bp, Homo sapiens
agcgtggggtagcaga

SEQ ID NO: 4373318 - DNA, 14 bp, Homo sapiens
agcgtgtgggtccc

SEQ ID NO: 4373319 - DNA, 14 bp, Homo sapiens
agcgttaatgtaaa

SEQ ID NO: 4373320 - DNA, 15 bp, Homo sapiens
agcgttcctggcctt

SEQ ID NO: 4373321 - DNA, 18 bp, Homo sapiens
agcgttcctggccttctg

SEQ ID NO: 4373322 - DNA, 18 bp, Homo sapiens
agcgttttttaaatgtat

SEQ ID NO: 4373323 - DNA, 23 bp, Homo sapiens
agcgttttttaaatgtatactat

SEQ ID NO: 4373324 - DNA, 15 bp, Homo sapiens
agctaaaacctgagc

SEQ ID NO: 4373325 - DNA, 14 bp, Homo sapiens
agctaaaatatata

SEQ ID NO: 4373326 - DNA, 21 bp, Homo sapiens
agctaaagtgatcctaaatat

SEQ ID NO: 4373327 - DNA, 17 bp, Homo sapiens
agctaaattcagggaga

SEQ ID NO: 4373328 - DNA, 21 bp, Homo sapiens
agctaaccacttcgcacacac

SEQ ID NO: 4373329 - DNA, 23 bp, Homo sapiens
agctaaggaggggaaaaaaatgt

SEQ ID NO: 4373330 - DNA, 12 bp, Homo sapiens
agctaataaatc

SEQ ID NO: 4373331 - DNA, 19 bp, Homo sapiens
agctaataaatctcttctt

SEQ ID NO: 4373332 - DNA, 22 bp, Homo sapiens
agctaatctgcctggttttatt

SEQ ID NO: 4373333 - DNA, 22 bp, Homo sapiens
agctaatgtcacaacatggtgc

SEQ ID NO: 4373334 - DNA, 18 bp, Homo sapiens
agctaatgtgcagggata

SEQ ID NO: 4373335 - DNA, 19 bp, Homo sapiens
agctaattctttgacctgt

SEQ ID NO: 4373336 - DNA, 14 bp, Homo sapiens
agctaatttgcatt

SEQ ID NO: 4373337 - DNA, 20 bp, Homo sapiens
agctaatttgcattaaattc

SEQ ID NO: 4373338 - DNA, 22 bp, Homo sapiens
agctaatttgcattaaattcac

SEQ ID NO: 4373339 - DNA, 12 bp, Homo sapiens
agctaatttttg

SEQ ID NO: 4373340 - DNA, 18 bp, Homo sapiens
agctacaaacttttaaga

SEQ ID NO: 4373341 - DNA, 22 bp, Homo sapiens
agctacccttttcctttgtggt

SEQ ID NO: 4373342 - DNA, 14 bp, Homo sapiens
agctactgccatcc

SEQ ID NO: 4373343 - DNA, 18 bp, Homo sapiens
agctactgccatcctggc

SEQ ID NO: 4373344 - DNA, 19 bp, Homo sapiens
agctactggaatggtgttt

SEQ ID NO: 4373345 - DNA, 13 bp, Homo sapiens
agctactggggag

SEQ ID NO: 4373346 - DNA, 21 bp, Homo sapiens
agctacttgggaggctgaggc

SEQ ID NO: 4373347 - DNA, 21 bp, Homo sapiens
agctagaagtgggccaggaca

SEQ ID NO: 4373348 - DNA, 22 bp, Homo sapiens
agctagaagtgggccaggacag

SEQ ID NO: 4373349 - DNA, 15 bp, Homo sapiens
agctagacacatgaa

SEQ ID NO: 4373350 - DNA, 14 bp, Homo sapiens
agctagcgctgccg

SEQ ID NO: 4373351 - DNA, 21 bp, Homo sapiens
agctagcgctgccgcacccca

SEQ ID NO: 4373352 - DNA, 21 bp, Homo sapiens
agctaggaagagcaggactcc

SEQ ID NO: 4373353 - DNA, 19 bp, Homo sapiens
agctaggatggttctgtga

SEQ ID NO: 4373354 - DNA, 20 bp, Homo sapiens
agctaggatggttctgtgac

SEQ ID NO: 4373355 - DNA, 21 bp, Homo sapiens
agctaggatggttctgtgacc

SEQ ID NO: 4373356 - DNA, 16 bp, Homo sapiens
agctagtagcaatgtg

SEQ ID NO: 4373357 - DNA, 18 bp, Homo sapiens
agctagtgccaaataatt

SEQ ID NO: 4373358 - DNA, 21 bp, Homo sapiens
agctagtgccaaataattgat

SEQ ID NO: 4373359 - DNA, 12 bp, Homo sapiens
agctagtgcctt

SEQ ID NO: 4373360 - DNA, 21 bp, Homo sapiens
agctagtgcctttagagggta

SEQ ID NO: 4373361 - DNA, 17 bp, Homo sapiens
agctagttaataattct

SEQ ID NO: 4373362 - DNA, 22 bp, Homo sapiens
agctataaagcagtatttttct

SEQ ID NO: 4373363 - DNA, 16 bp, Homo sapiens
agctatatttgattat

SEQ ID NO: 4373364 - DNA, 20 bp, Homo sapiens
agctatatttgattatgtat

SEQ ID NO: 4373365 - DNA, 15 bp, Homo sapiens
agctatcttcatgta

SEQ ID NO: 4373366 - DNA, 17 bp, Homo sapiens
agctatcttcatgtaaa

SEQ ID NO: 4373367 - DNA, 20 bp, Homo sapiens
agctatcttcatgtaaattg

SEQ ID NO: 4373368 - DNA, 17 bp, Homo sapiens
agctatgcgcaatgtgg

SEQ ID NO: 4373369 - DNA, 15 bp, Homo sapiens
agctatgctgtatct

SEQ ID NO: 4373370 - DNA, 17 bp, Homo sapiens
agctatgctgtatctgt

SEQ ID NO: 4373371 - DNA, 17 bp, Homo sapiens
agctatgggagccccag

SEQ ID NO: 4373372 - DNA, 18 bp, Homo sapiens
agctatgggagccccagg

SEQ ID NO: 4373373 - DNA, 21 bp, Homo sapiens
agctgcttgtcctgggcctgc

SEQ ID NO: 4373374 - DNA, 14 bp, Homo sapiens
agctgctttcttct

SEQ ID NO: 4373375 - DNA, 20 bp, Homo sapiens
agctgcttttgcagaaatca

SEQ ID NO: 4373376 - DNA, 18 bp, Homo sapiens
agctggaatgtgccacag

SEQ ID NO: 4373377 - DNA, 22 bp, Homo sapiens
agctggagcccagcgtcagaag

SEQ ID NO: 4373378 - DNA, 18 bp, Homo sapiens
agctggagcccccagcag

SEQ ID NO: 4373379 - DNA, 20 bp, Homo sapiens
agctggaggactagaacctg

SEQ ID NO: 4373380 - DNA, 15 bp, Homo sapiens
agctggatcgctgca

SEQ ID NO: 4373381 - DNA, 20 bp, Homo sapiens
agctggccgagggtcctggc

SEQ ID NO: 4373382 - DNA, 15 bp, Homo sapiens
agctggcctgcggtg

SEQ ID NO: 4373383 - DNA, 16 bp, Homo sapiens
agctggcgctcagcag

SEQ ID NO: 4373384 - DNA, 17 bp, Homo sapiens
agctggcgctcagcagc

SEQ ID NO: 4373385 - DNA, 19 bp, Homo sapiens
agctggcgctcagcagccc

SEQ ID NO: 4373386 - DNA, 21 bp, Homo sapiens
agctggcgctcagcagcccta

SEQ ID NO: 4373387 - DNA, 22 bp, Homo sapiens
agctggcgctcagcagccctag

SEQ ID NO: 4373388 - DNA, 15 bp, Homo sapiens
agctgggaaagcata

SEQ ID NO: 4373389 - DNA, 20 bp, Homo sapiens
agctgggaaattcatgtgga

SEQ ID NO: 4373390 - DNA, 18 bp, Homo sapiens
agctgggactacaggcgc

SEQ ID NO: 4373391 - DNA, 13 bp, Homo sapiens
agctgggagacaa

SEQ ID NO: 4373392 - DNA, 12 bp, Homo sapiens
agctgggaggaa

SEQ ID NO: 4373393 - DNA, 15 bp, Homo sapiens
agctgggattacagg

SEQ ID NO: 4373394 - DNA, 20 bp, Homo sapiens
agctgggcccaaccctgtct

SEQ ID NO: 4373395 - DNA, 14 bp, Homo sapiens
agctgggccccagc

SEQ ID NO: 4373396 - DNA, 14 bp, Homo sapiens
agctgggcccctgc

SEQ ID NO: 4373397 - DNA, 22 bp, Homo sapiens
agctgggcccctgcacaggcac

SEQ ID NO: 4373398 - DNA, 12 bp, Homo sapiens
agctgggccctg

SEQ ID NO: 4373399 - DNA, 15 bp, Homo sapiens
agctgggccctgcct

SEQ ID NO: 4373400 - DNA, 17 bp, Homo sapiens
agctgggccctgcctgc

SEQ ID NO: 4373401 - DNA, 18 bp, Homo sapiens
agctgggccctgcctgca

SEQ ID NO: 4373402 - DNA, 20 bp, Homo sapiens
agctgggccctgcctgcagc

SEQ ID NO: 4373403 - DNA, 14 bp, Homo sapiens
agctggggccagag

SEQ ID NO: 4373404 - DNA, 17 bp, Homo sapiens
agctggggccagaggct

SEQ ID NO: 4373405 - DNA, 17 bp, Homo sapiens
agctggtagaggggaga

SEQ ID NO: 4373406 - DNA, 14 bp, Homo sapiens
agctggtgcccgga

SEQ ID NO: 4373407 - DNA, 13 bp, Homo sapiens
agctggtgggaag

SEQ ID NO: 4373408 - DNA, 21 bp, Homo sapiens
agctggtggtgcagccttccc

SEQ ID NO: 4373409 - DNA, 22 bp, Homo sapiens
agctggtggtgcagccttcccc

SEQ ID NO: 4373410 - DNA, 15 bp, Homo sapiens
agctggttggagagc

SEQ ID NO: 4373411 - DNA, 12 bp, Homo sapiens
agctgtactctt

SEQ ID NO: 4373412 - DNA, 22 bp, Homo sapiens
agctgtactcttctgactgccc

SEQ ID NO: 4373413 - DNA, 19 bp, Homo sapiens
agctgtacttcttgaatat

SEQ ID NO: 4373414 - DNA, 21 bp, Homo sapiens
agctgtagagtaacgagaagt

SEQ ID NO: 4373415 - DNA, 12 bp, Homo sapiens
agctgtatttat

SEQ ID NO: 4373416 - DNA, 14 bp, Homo sapiens
agctgtatttatat

SEQ ID NO: 4373417 - DNA, 12 bp, Homo sapiens
agctgtcacctc

SEQ ID NO: 4373418 - DNA, 15 bp, Homo sapiens
agctgtcacctctca

SEQ ID NO: 4373419 - DNA, 21 bp, Homo sapiens
agctgtcacctctcagctgct

SEQ ID NO: 4373420 - DNA, 22 bp, Homo sapiens
agctgtcacctctcagctgctg

SEQ ID NO: 4373421 - DNA, 18 bp, Homo sapiens
agctgtcagatgtcacat

SEQ ID NO: 4373422 - DNA, 17 bp, Homo sapiens
agctgtcatcactcaac

SEQ ID NO: 4373423 - DNA, 14 bp, Homo sapiens
agctgtccctgtca

SEQ ID NO: 4373424 - DNA, 15 bp, Homo sapiens
agctgtccctgtcac

SEQ ID NO: 4373425 - DNA, 15 bp, Homo sapiens
agctgtctactggac

SEQ ID NO: 4373426 - DNA, 13 bp, Homo sapiens
agctgtgacccag

SEQ ID NO: 4373427 - DNA, 22 bp, Homo sapiens
agctgtgccgggaggcagccac

SEQ ID NO: 4373428 - DNA, 17 bp, Homo sapiens
agctgtgctgtggagag

SEQ ID NO: 4373429 - DNA, 21 bp, Homo sapiens
agctgtgggcggctcctggtg

SEQ ID NO: 4373430 - DNA, 22 bp, Homo sapiens
agctgtgtgtttggaagactat

SEQ ID NO: 4373431 - DNA, 14 bp, Homo sapiens
agctgtgttcacag

SEQ ID NO: 4373432 - DNA, 15 bp, Homo sapiens
agctgttaccattca

SEQ ID NO: 4373433 - DNA, 16 bp, Homo sapiens
agctgttaccattcac

SEQ ID NO: 4373434 - DNA, 17 bp, Homo sapiens
agctgttaccattcaca

SEQ ID NO: 4373435 - DNA, 15 bp, Homo sapiens
agctgttatttcttc

SEQ ID NO: 4373436 - DNA, 19 bp, Homo sapiens
agctgttatttcttccctg

SEQ ID NO: 4373437 - DNA, 20 bp, Homo sapiens
agctgttatttcttccctgc

SEQ ID NO: 4373438 - DNA, 21 bp, Homo sapiens
agctgttatttcttccctgct

SEQ ID NO: 4373439 - DNA, 14 bp, Homo sapiens
agctgttctaatta

SEQ ID NO: 4373440 - DNA, 15 bp, Homo sapiens
agctgttctaattaa

SEQ ID NO: 4373441 - DNA, 18 bp, Homo sapiens
agctgttgatctttcact

SEQ ID NO: 4373442 - DNA, 16 bp, Homo sapiens
agctgtttactaggga

SEQ ID NO: 4373443 - DNA, 13 bp, Homo sapiens
agctgtttatgca

SEQ ID NO: 4373444 - DNA, 20 bp, Homo sapiens
agctgtttatggcctcagct

SEQ ID NO: 4373445 - DNA, 14 bp, Homo sapiens
agctgttttggaac

SEQ ID NO: 4373446 - DNA, 12 bp, Homo sapiens
agcttaaaactt

SEQ ID NO: 4373447 - DNA, 16 bp, Homo sapiens
agcttaaaactttgaa

SEQ ID NO: 4373448 - DNA, 23 bp, Homo sapiens
agcttaaacccatacaatgtatg

SEQ ID NO: 4373449 - DNA, 12 bp, Homo sapiens
agcttaaagctt

SEQ ID NO: 4373450 - DNA, 17 bp, Homo sapiens
agcttaacatttcatgt

SEQ ID NO: 4373451 - DNA, 19 bp, Homo sapiens
agcttaagtgtaaatgaag

SEQ ID NO: 4373452 - DNA, 13 bp, Homo sapiens
agcttaatatatt

SEQ ID NO: 4373453 - DNA, 15 bp, Homo sapiens
agcttagactaaggc

SEQ ID NO: 4373454 - DNA, 16 bp, Homo sapiens
agcttagatttcatag

SEQ ID NO: 4373455 - DNA, 21 bp, Homo sapiens
agcttagctttagaaacagtg

SEQ ID NO: 4373456 - DNA, 17 bp, Homo sapiens
agcttatctgcccctcc

SEQ ID NO: 4373457 - DNA, 21 bp, Homo sapiens
agcttatctgcccctccccca

SEQ ID NO: 4373458 - DNA, 15 bp, Homo sapiens
agcttcaatataaga

SEQ ID NO: 4373459 - DNA, 17 bp, Homo sapiens
agcttcatataccagca

SEQ ID NO: 4373460 - DNA, 19 bp, Homo sapiens
agcttcatggcagaaggca

SEQ ID NO: 4373461 - DNA, 16 bp, Homo sapiens
agcttcatgtggcttc

SEQ ID NO: 4373462 - DNA, 18 bp, Homo sapiens
agcttccacaaaattaga

SEQ ID NO: 4373463 - DNA, 19 bp, Homo sapiens
agcttccacaaaattagaa

SEQ ID NO: 4373464 - DNA, 19 bp, Homo sapiens
agcttccatagctgctgcc

SEQ ID NO: 4373465 - DNA, 22 bp, Homo sapiens
agcttccatgattctatttata

SEQ ID NO: 4373466 - DNA, 15 bp, Homo sapiens
agcttcctgtctgtt

SEQ ID NO: 4373467 - DNA, 18 bp, Homo sapiens
agcttcctgtctgtttat

SEQ ID NO: 4373468 - DNA, 19 bp, Homo sapiens
agcttcggagggcccctgc

SEQ ID NO: 4373469 - DNA, 21 bp, Homo sapiens
agcttcggagggcccctgcgt

SEQ ID NO: 4373470 - DNA, 13 bp, Homo sapiens
agcttctcccaag

SEQ ID NO: 4373471 - DNA, 19 bp, Homo sapiens
agcttctcttctttctgaa

SEQ ID NO: 4373472 - DNA, 22 bp, Homo sapiens
agcttctgcttttctgccctgg

SEQ ID NO: 4373473 - DNA, 17 bp, Homo sapiens
agcttgaaactgagatg

SEQ ID NO: 4373474 - DNA, 21 bp, Homo sapiens
agcttgagccgggcccctggg

SEQ ID NO: 4373475 - DNA, 23 bp, Homo sapiens
agcttgagccgggcccctgggct

SEQ ID NO: 4373476 - DNA, 15 bp, Homo sapiens
agcttgattaaatca

SEQ ID NO: 4373477 - DNA, 18 bp, Homo sapiens
agcttgatttgatctttg

SEQ ID NO: 4373478 - DNA, 19 bp, Homo sapiens
agcttgatttgatctttgt

SEQ ID NO: 4373479 - DNA, 14 bp, Homo sapiens
agcttgcacagcca

SEQ ID NO: 4373480 - DNA, 14 bp, Homo sapiens
agcttgccagggat

SEQ ID NO: 4373481 - DNA, 19 bp, Homo sapiens
agcttgctcttcagtggga

SEQ ID NO: 4373482 - DNA, 16 bp, Homo sapiens
agcttggacagtctga

SEQ ID NO: 4373483 - DNA, 17 bp, Homo sapiens
agcttggactacacaat

SEQ ID NO: 4373484 - DNA, 22 bp, Homo sapiens
agcttgggaagtcgaggctgca

SEQ ID NO: 4373485 - DNA, 21 bp, Homo sapiens
agcttgggcagtgccccaggg

SEQ ID NO: 4373486 - DNA, 19 bp, Homo sapiens
agcttggtgacaaaattca

SEQ ID NO: 4373487 - DNA, 23 bp, Homo sapiens
agcttgtctgtgatctctgctgg

SEQ ID NO: 4373488 - DNA, 15 bp, Homo sapiens
agcttgttgtctcca

SEQ ID NO: 4373489 - DNA, 21 bp, Homo sapiens
agctttaaatgacagtaatat

SEQ ID NO: 4373490 - DNA, 14 bp, Homo sapiens
agctttaatgttac

SEQ ID NO: 4373491 - DNA, 18 bp, Homo sapiens
agctttagaaacagtgca

SEQ ID NO: 4373492 - DNA, 21 bp, Homo sapiens
agctttatccccgtttcttgc

SEQ ID NO: 4373493 - DNA, 23 bp, Homo sapiens
agctttatctttgtgtaatctaa

SEQ ID NO: 4373494 - DNA, 15 bp, Homo sapiens
agctttatgattttc

SEQ ID NO: 4373495 - DNA, 18 bp, Homo sapiens
agctttatgattttcata

SEQ ID NO: 4373496 - DNA, 23 bp, Homo sapiens
agctttatgattttcataactta

SEQ ID NO: 4373497 - DNA, 12 bp, Homo sapiens
agctttccctgc

SEQ ID NO: 4373498 - DNA, 14 bp, Homo sapiens
agctttcctggtcc

SEQ ID NO: 4373499 - DNA, 13 bp, Homo sapiens
agctttctgccac

SEQ ID NO: 4373500 - DNA, 18 bp, Homo sapiens
agctttgcatgttccact

SEQ ID NO: 4373501 - DNA, 15 bp, Homo sapiens
agctttggaatattt

SEQ ID NO: 4373502 - DNA, 17 bp, Homo sapiens
agctttggtgcaatggc

SEQ ID NO: 4373503 - DNA, 16 bp, Homo sapiens
agctttggttggtttt

SEQ ID NO: 4373504 - DNA, 16 bp, Homo sapiens
agctttgtatgtttat

SEQ ID NO: 4373505 - DNA, 12 bp, Homo sapiens
agctttgtcact

SEQ ID NO: 4373506 - DNA, 13 bp, Homo sapiens
agctttgtcactt

SEQ ID NO: 4373507 - DNA, 17 bp, Homo sapiens
agctttgtcacttgcca

SEQ ID NO: 4373508 - DNA, 16 bp, Homo sapiens
agcttttaaaatgtag

SEQ ID NO: 4373509 - DNA, 17 bp, Homo sapiens
agcttttcattttaata

SEQ ID NO: 4373510 - DNA, 23 bp, Homo sapiens
agcttttcattttaatatataat

SEQ ID NO: 4373511 - DNA, 18 bp, Homo sapiens
agcttttcccaggagacc

SEQ ID NO: 4373512 - DNA, 20 bp, Homo sapiens
agcttttcttattccttttt

SEQ ID NO: 4373513 - DNA, 15 bp, Homo sapiens
agcttttggttaata

SEQ ID NO: 4373514 - DNA, 17 bp, Homo sapiens
agctttttaattaagca

SEQ ID NO: 4373515 - DNA, 14 bp, Homo sapiens
agctttttggaatc

SEQ ID NO: 4373516 - DNA, 23 bp, Homo sapiens
agcttttttcctgttggtttcat

SEQ ID NO: 4373517 - DNA, 22 bp, Homo sapiens
aggaaaaaaactgggataactg

SEQ ID NO: 4373518 - DNA, 14 bp, Homo sapiens
aggaaaaaaacttt

SEQ ID NO: 4373519 - DNA, 14 bp, Homo sapiens
aggaaaaacaggtc

SEQ ID NO: 4373520 - DNA, 14 bp, Homo sapiens
aggaaaacaaaaaa

SEQ ID NO: 4373521 - DNA, 18 bp, Homo sapiens
aggaaaaggctaagaaaa

SEQ ID NO: 4373522 - DNA, 17 bp, Homo sapiens
aggaaaaggttgaataa

SEQ ID NO: 4373523 - DNA, 17 bp, Homo sapiens
aggaaaagtgcaatgcg

SEQ ID NO: 4373524 - DNA, 18 bp, Homo sapiens
aggaaaagtgcaatgcgt

SEQ ID NO: 4373525 - DNA, 20 bp, Homo sapiens
aggaaaatgtattgattcaa

SEQ ID NO: 4373526 - DNA, 13 bp, Homo sapiens
aggaaacaaagat

SEQ ID NO: 4373527 - DNA, 17 bp, Homo sapiens
aggaaacagttgcatgt

SEQ ID NO: 4373528 - DNA, 19 bp, Homo sapiens
aggaaacagttgcatgtag

SEQ ID NO: 4373529 - DNA, 20 bp, Homo sapiens
aggaaacagttgcatgtagt

SEQ ID NO: 4373530 - DNA, 20 bp, Homo sapiens
aggaaactccacatctgcct

SEQ ID NO: 4373531 - DNA, 15 bp, Homo sapiens
aggaaactgaagcat

SEQ ID NO: 4373532 - DNA, 14 bp, Homo sapiens
aggaaactgagtca

SEQ ID NO: 4373533 - DNA, 22 bp, Homo sapiens
aggaaactgagtcactcacatt

SEQ ID NO: 4373534 - DNA, 21 bp, Homo sapiens
aggaaacttctgatgtttatt

SEQ ID NO: 4373535 - DNA, 16 bp, Homo sapiens
aggaaactttttaatt

SEQ ID NO: 4373536 - DNA, 17 bp, Homo sapiens
aggaaactttttaattg

SEQ ID NO: 4373537 - DNA, 12 bp, Homo sapiens
aggaaagaatag

SEQ ID NO: 4373538 - DNA, 17 bp, Homo sapiens
aggaaagccctccccct

SEQ ID NO: 4373539 - DNA, 23 bp, Homo sapiens
aggaaaggattttaccaaagcat

SEQ ID NO: 4373540 - DNA, 21 bp, Homo sapiens
aggaaaggctcatttaaaaca

SEQ ID NO: 4373541 - DNA, 22 bp, Homo sapiens
aggaaagggctggctccccctc

SEQ ID NO: 4373542 - DNA, 16 bp, Homo sapiens
aggaaataaaattaat

SEQ ID NO: 4373543 - DNA, 15 bp, Homo sapiens
aggaaatactcagca

SEQ ID NO: 4373544 - DNA, 19 bp, Homo sapiens
aggaaatcaaatatgcaaa

SEQ ID NO: 4373545 - DNA, 20 bp, Homo sapiens
aggaaatcaaatatgcaaag

SEQ ID NO: 4373546 - DNA, 21 bp, Homo sapiens
aggaaatcaaatatgcaaagc

SEQ ID NO: 4373547 - DNA, 22 bp, Homo sapiens
aggaaatcaaatatgcaaagca

SEQ ID NO: 4373548 - DNA, 18 bp, Homo sapiens
aggaaatccggtcagcca

SEQ ID NO: 4373549 - DNA, 19 bp, Homo sapiens
aggaaatgaaaatgtcttg

SEQ ID NO: 4373550 - DNA, 14 bp, Homo sapiens
aggaaatgtggaaa

SEQ ID NO: 4373551 - DNA, 17 bp, Homo sapiens
aggaacagtattacagt

SEQ ID NO: 4373552 - DNA, 23 bp, Homo sapiens
aggaaccacaatgtttcttcatt

SEQ ID NO: 4373553 - DNA, 19 bp, Homo sapiens
aggaacccttacagtagga

SEQ ID NO: 4373554 - DNA, 21 bp, Homo sapiens
aggaacccttgcatccattgt

SEQ ID NO: 4373555 - DNA, 14 bp, Homo sapiens
aggaacctctgatt

SEQ ID NO: 4373556 - DNA, 20 bp, Homo sapiens
aggaaccttccttcctgctt

SEQ ID NO: 4373557 - DNA, 23 bp, Homo sapiens
aggaactagaaagaaggacccag

SEQ ID NO: 4373558 - DNA, 16 bp, Homo sapiens
aggaactagtaaacat

SEQ ID NO: 4373559 - DNA, 17 bp, Homo sapiens
aggaactccttgcacac

SEQ ID NO: 4373560 - DNA, 22 bp, Homo sapiens
aggaactcttaagcaatggtaa

SEQ ID NO: 4373561 - DNA, 16 bp, Homo sapiens
aggaactgctgggctt

SEQ ID NO: 4373562 - DNA, 22 bp, Homo sapiens
aggaactgctgggcttggcagc

SEQ ID NO: 4373563 - DNA, 13 bp, Homo sapiens
aggaactgggctg

SEQ ID NO: 4373564 - DNA, 16 bp, Homo sapiens
aggaactgggctgggc

SEQ ID NO: 4373565 - DNA, 18 bp, Homo sapiens
aggaactgggctgggcct

SEQ ID NO: 4373566 - DNA, 18 bp, Homo sapiens
aggaagaacggggctctt

SEQ ID NO: 4373567 - DNA, 12 bp, Homo sapiens
aggaagagccac

SEQ ID NO: 4373568 - DNA, 18 bp, Homo sapiens
aggaagagccacctgcaa

SEQ ID NO: 4373569 - DNA, 19 bp, Homo sapiens
aggaagagccacctgcaag

SEQ ID NO: 4373570 - DNA, 16 bp, Homo sapiens
aggaagagctaataaa

SEQ ID NO: 4373571 - DNA, 18 bp, Homo sapiens
aggaagcaccccatgcca

SEQ ID NO: 4373572 - DNA, 22 bp, Homo sapiens
aggaagcattgtaaaataattc

SEQ ID NO: 4373573 - DNA, 19 bp, Homo sapiens
aggaagccagagccccaag

SEQ ID NO: 4373574 - DNA, 19 bp, Homo sapiens
aggaagcccagcccaagca

SEQ ID NO: 4373575 - DNA, 18 bp, Homo sapiens
aggaagccgccagtactt

SEQ ID NO: 4373576 - DNA, 16 bp, Homo sapiens
aggaaggactatgaaa

SEQ ID NO: 4373577 - DNA, 15 bp, Homo sapiens
aggaaggagagcctg

SEQ ID NO: 4373578 - DNA, 18 bp, Homo sapiens
aggaaggagagcctgctg

SEQ ID NO: 4373579 - DNA, 20 bp, Homo sapiens
aggaaggaggggagagacag

SEQ ID NO: 4373580 - DNA, 19 bp, Homo sapiens
aggaaggattttcttttta

SEQ ID NO: 4373581 - DNA, 21 bp, Homo sapiens
aggaaggccaaaatcaagagt

SEQ ID NO: 4373582 - DNA, 17 bp, Homo sapiens
aggaaggcctgagcccc

SEQ ID NO: 4373583 - DNA, 16 bp, Homo sapiens
aggaagggctgggcca

SEQ ID NO: 4373584 - DNA, 23 bp, Homo sapiens
aggaagggctgggccaccaggga

SEQ ID NO: 4373585 - DNA, 17 bp, Homo sapiens
aggaagtatcagcacta

SEQ ID NO: 4373586 - DNA, 18 bp, Homo sapiens
aggaagtctaggagctgg

SEQ ID NO: 4373587 - DNA, 22 bp, Homo sapiens
aggaagtgagcagtcgcctgcc

SEQ ID NO: 4373588 - DNA, 17 bp, Homo sapiens
aggaagtggctgtccct

SEQ ID NO: 4373589 - DNA, 13 bp, Homo sapiens
aggaataaataaa

SEQ ID NO: 4373590 - DNA, 21 bp, Homo sapiens
aggaataaatgagagggaatc

SEQ ID NO: 4373591 - DNA, 15 bp, Homo sapiens
aggaatacaatatat

SEQ ID NO: 4373592 - DNA, 15 bp, Homo sapiens
aggaatacattttat

SEQ ID NO: 4373593 - DNA, 17 bp, Homo sapiens
aggaatagaggaagaaa

SEQ ID NO: 4373594 - DNA, 12 bp, Homo sapiens
aggaatagcttt

SEQ ID NO: 4373595 - DNA, 16 bp, Homo sapiens
aggaatagctttgtat

SEQ ID NO: 4373596 - DNA, 17 bp, Homo sapiens
aggaatataagaaaagt

SEQ ID NO: 4373597 - DNA, 22 bp, Homo sapiens
aggaatatttagcagtattgtt

SEQ ID NO: 4373598 - DNA, 18 bp, Homo sapiens
aggaatcacccctctgcc

SEQ ID NO: 4373599 - DNA, 22 bp, Homo sapiens
aggaatcacccctctgcccctg

SEQ ID NO: 4373600 - DNA, 18 bp, Homo sapiens
aggaatctgtttctctgc

SEQ ID NO: 4373601 - DNA, 15 bp, Homo sapiens
aggaatgaagaactg

SEQ ID NO: 4373602 - DNA, 20 bp, Homo sapiens
aggaatgaagaactgttgcc

SEQ ID NO: 4373603 - DNA, 14 bp, Homo sapiens
aggaattaaagaca

SEQ ID NO: 4373604 - DNA, 22 bp, Homo sapiens
aggaattactttattataaaat

SEQ ID NO: 4373605 - DNA, 19 bp, Homo sapiens
aggaattgacccacaagaa

SEQ ID NO: 4373606 - DNA, 13 bp, Homo sapiens
aggaatttacttt

SEQ ID NO: 4373607 - DNA, 18 bp, Homo sapiens
aggaatttcacctgtaaa

SEQ ID NO: 4373608 - DNA, 23 bp, Homo sapiens
aggaatttcttaacttcttgctt

SEQ ID NO: 4373609 - DNA, 18 bp, Homo sapiens
aggaggaaaaggcttggt

SEQ ID NO: 4373610 - DNA, 15 bp, Homo sapiens
aggaggagctggcct

SEQ ID NO: 4373611 - DNA, 16 bp, Homo sapiens
aggaggagctggcctg

SEQ ID NO: 4373612 - DNA, 23 bp, Homo sapiens
aggaggcaacactgatcccccag

SEQ ID NO: 4373613 - DNA, 16 bp, Homo sapiens
aggaggcagctcagga

SEQ ID NO: 4373614 - DNA, 22 bp, Homo sapiens
aggaggccataagctacacaga

SEQ ID NO: 4373615 - DNA, 21 bp, Homo sapiens
aggaggcctccactccttcca

SEQ ID NO: 4373616 - DNA, 16 bp, Homo sapiens
aggaggcctgtcccaa

SEQ ID NO: 4373617 - DNA, 15 bp, Homo sapiens
aggaggcgaataaat

SEQ ID NO: 4373618 - DNA, 15 bp, Homo sapiens
aggagggagagggag

SEQ ID NO: 4373619 - DNA, 15 bp, Homo sapiens
aggagggagggggct

SEQ ID NO: 4373620 - DNA, 15 bp, Homo sapiens
aggagggaggtgctt

SEQ ID NO: 4373621 - DNA, 22 bp, Homo sapiens
aggagggcagagggagaatcca

SEQ ID NO: 4373622 - DNA, 14 bp, Homo sapiens
aggagggcagcccg

SEQ ID NO: 4373623 - DNA, 22 bp, Homo sapiens
aggagggcgtgactcacccaag

SEQ ID NO: 4373624 - DNA, 19 bp, Homo sapiens
aggagggctttgaatctgg

SEQ ID NO: 4373625 - DNA, 18 bp, Homo sapiens
aggaggggaaacaatgaa

SEQ ID NO: 4373626 - DNA, 16 bp, Homo sapiens
aggaggggctgtaaaa

SEQ ID NO: 4373627 - DNA, 19 bp, Homo sapiens
aggagggggccgggcgcgg

SEQ ID NO: 4373628 - DNA, 21 bp, Homo sapiens
aggaggtcacctgccgccctg

SEQ ID NO: 4373629 - DNA, 22 bp, Homo sapiens
aggaggtgaaatccctgcctca

SEQ ID NO: 4373630 - DNA, 20 bp, Homo sapiens
aggaggtggaggttgcagtg

SEQ ID NO: 4373631 - DNA, 13 bp, Homo sapiens
aggaggtgggcca

SEQ ID NO: 4373632 - DNA, 19 bp, Homo sapiens
aggaggttgggaattcttg

SEQ ID NO: 4373633 - DNA, 20 bp, Homo sapiens
aggagtaaataattggaaaa

SEQ ID NO: 4373634 - DNA, 21 bp, Homo sapiens
aggagtcaactggctggccag

SEQ ID NO: 4373635 - DNA, 11 bp, Homo sapiens
aggagtccaga

SEQ ID NO: 4373636 - DNA, 12 bp, Homo sapiens
aggagtccagac

SEQ ID NO: 4373637 - DNA, 13 bp, Homo sapiens
aggagtccagcac

SEQ ID NO: 4373638 - DNA, 19 bp, Homo sapiens
aggagtccagcccctcctc

SEQ ID NO: 4373639 - DNA, 22 bp, Homo sapiens
aggagtccagcccctcctccct

SEQ ID NO: 4373640 - DNA, 21 bp, Homo sapiens
aggagtccctgccatcatgtt

SEQ ID NO: 4373641 - DNA, 23 bp, Homo sapiens
aggagtcctttttgtcatgccct

SEQ ID NO: 4373642 - DNA, 13 bp, Homo sapiens
aggagtctgccac

SEQ ID NO: 4373643 - DNA, 17 bp, Homo sapiens
aggagtctgccacttgt

SEQ ID NO: 4373644 - DNA, 16 bp, Homo sapiens
aggagtgcagccttct

SEQ ID NO: 4373645 - DNA, 14 bp, Homo sapiens
aggagtgtcctctt

SEQ ID NO: 4373646 - DNA, 18 bp, Homo sapiens
aggagttagaaccacagc

SEQ ID NO: 4373647 - DNA, 13 bp, Homo sapiens
aggagttctgaag

SEQ ID NO: 4373648 - DNA, 20 bp, Homo sapiens
aggagttctgaagctgacag

SEQ ID NO: 4373649 - DNA, 20 bp, Homo sapiens
aggagtttgagaccaggctg

SEQ ID NO: 4373650 - DNA, 22 bp, Homo sapiens
aggagtttgagaccaggctggg

SEQ ID NO: 4373651 - DNA, 20 bp, Homo sapiens
aggagtttgaggctgcaatg

SEQ ID NO: 4373652 - DNA, 17 bp, Homo sapiens
aggagttttactgcctg

SEQ ID NO: 4373653 - DNA, 15 bp, Homo sapiens
aggatacagaggaga

SEQ ID NO: 4373654 - DNA, 18 bp, Homo sapiens
aggatactggcacagagg

SEQ ID NO: 4373655 - DNA, 23 bp, Homo sapiens
aggatagctaactgtaaatcatg

SEQ ID NO: 4373656 - DNA, 14 bp, Homo sapiens
aggatagtattttt

SEQ ID NO: 4373657 - DNA, 16 bp, Homo sapiens
aggatagtatttttat

SEQ ID NO: 4373658 - DNA, 22 bp, Homo sapiens
aggatataagagggctttttaa

SEQ ID NO: 4373659 - DNA, 18 bp, Homo sapiens
aggatatcagagctggga

SEQ ID NO: 4373660 - DNA, 13 bp, Homo sapiens
aggatatgattaa

SEQ ID NO: 4373661 - DNA, 18 bp, Homo sapiens
aggatcacctgaggtcag

SEQ ID NO: 4373662 - DNA, 20 bp, Homo sapiens
aggatcacctgaggtcagga

SEQ ID NO: 4373663 - DNA, 23 bp, Homo sapiens
aggatcagttaactattgcattt

SEQ ID NO: 4373664 - DNA, 14 bp, Homo sapiens
aggatccagagagc

SEQ ID NO: 4373665 - DNA, 21 bp, Homo sapiens
aggatccagagagcagctccc

SEQ ID NO: 4373666 - DNA, 19 bp, Homo sapiens
aggatcccatgagctcctt

SEQ ID NO: 4373667 - DNA, 15 bp, Homo sapiens
aggatgacaggctct

SEQ ID NO: 4373668 - DNA, 11 bp, Homo sapiens
aggatgacttt

SEQ ID NO: 4373669 - DNA, 13 bp, Homo sapiens
aggatgaggatgt

SEQ ID NO: 4373670 - DNA, 15 bp, Homo sapiens
aggatgctaatggaa

SEQ ID NO: 4373671 - DNA, 22 bp, Homo sapiens
aggatgcttagtcttaaaataa

SEQ ID NO: 4373672 - DNA, 17 bp, Homo sapiens
aggatggtgtcctgagg

SEQ ID NO: 4373673 - DNA, 16 bp, Homo sapiens
aggatggttctgtgac

SEQ ID NO: 4373674 - DNA, 21 bp, Homo sapiens
aggatgtaaacagtgcctgct

SEQ ID NO: 4373675 - DNA, 22 bp, Homo sapiens
aggatgtaaacagtgcctgctg

SEQ ID NO: 4373676 - DNA, 23 bp, Homo sapiens
aggatgtaggggttaacttggtc

SEQ ID NO: 4373677 - DNA, 21 bp, Homo sapiens
aggatgtatattttatataaa

SEQ ID NO: 4373678 - DNA, 17 bp, Homo sapiens
aggatgttgaaaaagtt

SEQ ID NO: 4373679 - DNA, 15 bp, Homo sapiens
aggattatggaaaaa

SEQ ID NO: 4373680 - DNA, 16 bp, Homo sapiens
aggattctttccccag

SEQ ID NO: 4373681 - DNA, 24 bp, Homo sapiens
aggattctttccccagaggctccc

SEQ ID NO: 4373682 - DNA, 21 bp, Homo sapiens
aggattgaaaatgtccaggaa

SEQ ID NO: 4373683 - DNA, 13 bp, Homo sapiens
aggatttggccac

SEQ ID NO: 4373684 - DNA, 14 bp, Homo sapiens
aggatttggccaca

SEQ ID NO: 4373685 - DNA, 20 bp, Homo sapiens
aggattttaatttcaggaaa

SEQ ID NO: 4373686 - DNA, 21 bp, Homo sapiens
aggattttaatttcaggaaaa

SEQ ID NO: 4373687 - DNA, 14 bp, Homo sapiens
aggattttcacaca

SEQ ID NO: 4373688 - DNA, 17 bp, Homo sapiens
aggcaaaattgcaaatc

SEQ ID NO: 4373689 - DNA, 19 bp, Homo sapiens
aggcaaaattgcaaatctt

SEQ ID NO: 4373690 - DNA, 20 bp, Homo sapiens
aggcaaaattgcaaatcttg

SEQ ID NO: 4373691 - DNA, 16 bp, Homo sapiens
aggcaaagaaaggaga

SEQ ID NO: 4373692 - DNA, 20 bp, Homo sapiens
aggcaaatattgaagttgtt

SEQ ID NO: 4373693 - DNA, 18 bp, Homo sapiens
aggcaacataattcttcc

SEQ ID NO: 4373694 - DNA, 16 bp, Homo sapiens
aggcaacatccaaaat

SEQ ID NO: 4373695 - DNA, 19 bp, Homo sapiens
aggcaagcgtgttctcagc

SEQ ID NO: 4373696 - DNA, 16 bp, Homo sapiens
aggcaagctgaaattt

SEQ ID NO: 4373697 - DNA, 15 bp, Homo sapiens
aggcaatcctacctt

SEQ ID NO: 4373698 - DNA, 16 bp, Homo sapiens
aggcaatcgttctgct

SEQ ID NO: 4373699 - DNA, 22 bp, Homo sapiens
aggcaatgattgttaatttaca

SEQ ID NO: 4373700 - DNA, 17 bp, Homo sapiens
aggcaattttagtgtat

SEQ ID NO: 4373701 - DNA, 20 bp, Homo sapiens
aggcacacactgtgctttct

SEQ ID NO: 4373702 - DNA, 17 bp, Homo sapiens
aggcacacagcagcccc

SEQ ID NO: 4373703 - DNA, 18 bp, Homo sapiens
aggcacacagcagccccc

SEQ ID NO: 4373704 - DNA, 20 bp, Homo sapiens
aggcacacagcagcccccca

SEQ ID NO: 4373705 - DNA, 13 bp, Homo sapiens
aggcacacagcta

SEQ ID NO: 4373706 - DNA, 15 bp, Homo sapiens
aggcacacagggccc

SEQ ID NO: 4373707 - DNA, 20 bp, Homo sapiens
aggcacacagggcccggcca

SEQ ID NO: 4373708 - DNA, 13 bp, Homo sapiens
aggcaccaggaag

SEQ ID NO: 4373709 - DNA, 16 bp, Homo sapiens
aggcaccaggaagccg

SEQ ID NO: 4373710 - DNA, 13 bp, Homo sapiens
aggcaccagtcca

SEQ ID NO: 4373711 - DNA, 18 bp, Homo sapiens
aggcaccagtccagcaaa

SEQ ID NO: 4373712 - DNA, 20 bp, Homo sapiens
aggcaccagtccagcaaata

SEQ ID NO: 4373713 - DNA, 22 bp, Homo sapiens
aggcacccgtccccacacgagg

SEQ ID NO: 4373714 - DNA, 13 bp, Homo sapiens
aggcaccctcagg

SEQ ID NO: 4373715 - DNA, 14 bp, Homo sapiens
aggcaccctcaggg

SEQ ID NO: 4373716 - DNA, 20 bp, Homo sapiens
aggcaccgccacgtcccagc

SEQ ID NO: 4373717 - DNA, 22 bp, Homo sapiens
aggcaccgccacgtcccagcat

SEQ ID NO: 4373718 - DNA, 21 bp, Homo sapiens
aggcacctacactcacctgca

SEQ ID NO: 4373719 - DNA, 20 bp, Homo sapiens
aggcaccttcttaaaagaaa

SEQ ID NO: 4373720 - DNA, 16 bp, Homo sapiens
aggcacttattgtaaa

SEQ ID NO: 4373721 - DNA, 21 bp, Homo sapiens
aggcacttattgtaaatttta

SEQ ID NO: 4373722 - DNA, 17 bp, Homo sapiens
aggcacttttattttca

SEQ ID NO: 4373723 - DNA, 20 bp, Homo sapiens
aggcacttttattttcattg

SEQ ID NO: 4373724 - DNA, 15 bp, Homo sapiens
aggcagaagaattga

SEQ ID NO: 4373725 - DNA, 14 bp, Homo sapiens
aggcagagaaatct

SEQ ID NO: 4373726 - DNA, 18 bp, Homo sapiens
aggcctgagcgctcctgc

SEQ ID NO: 4373727 - DNA, 21 bp, Homo sapiens
aggcctgcaaaccttcctggg

SEQ ID NO: 4373728 - DNA, 21 bp, Homo sapiens
aggcctgcctccagggctgga

SEQ ID NO: 4373729 - DNA, 17 bp, Homo sapiens
aggcctgctagtcactg

SEQ ID NO: 4373730 - DNA, 15 bp, Homo sapiens
aggcctggcctcatc

SEQ ID NO: 4373731 - DNA, 15 bp, Homo sapiens
aggcctgtccaccct

SEQ ID NO: 4373732 - DNA, 16 bp, Homo sapiens
aggcctgtccaccctg

SEQ ID NO: 4373733 - DNA, 18 bp, Homo sapiens
aggcctgtccaccctgcc

SEQ ID NO: 4373734 - DNA, 13 bp, Homo sapiens
aggcctgtcccaa

SEQ ID NO: 4373735 - DNA, 18 bp, Homo sapiens
aggcctgtcccaattctg

SEQ ID NO: 4373736 - DNA, 14 bp, Homo sapiens
aggcctgtccctgg

SEQ ID NO: 4373737 - DNA, 16 bp, Homo sapiens
aggcctgtccctggga

SEQ ID NO: 4373738 - DNA, 20 bp, Homo sapiens
aggcctgtcccttgcctctg

SEQ ID NO: 4373739 - DNA, 13 bp, Homo sapiens
aggccttgtccta

SEQ ID NO: 4373740 - DNA, 19 bp, Homo sapiens
aggccttttatgtaatttc

SEQ ID NO: 4373741 - DNA, 16 bp, Homo sapiens
aggcgaataaatgttc

SEQ ID NO: 4373742 - DNA, 15 bp, Homo sapiens
aggcgagtttcccca

SEQ ID NO: 4373743 - DNA, 17 bp, Homo sapiens
aggcgattttgtctacc

SEQ ID NO: 4373744 - DNA, 12 bp, Homo sapiens
aggcgcccgcca

SEQ ID NO: 4373745 - DNA, 18 bp, Homo sapiens
aggcgcctataatcccag

SEQ ID NO: 4373746 - DNA, 20 bp, Homo sapiens
aggcgcctataatcccagct

SEQ ID NO: 4373747 - DNA, 23 bp, Homo sapiens
aggcgcctataatcccagctact

SEQ ID NO: 4373748 - DNA, 19 bp, Homo sapiens
aggcggacaaagttcagtg

SEQ ID NO: 4373749 - DNA, 18 bp, Homo sapiens
aggcggacgttccagccg

SEQ ID NO: 4373750 - DNA, 20 bp, Homo sapiens
aggcggaggttgcagtgagc

SEQ ID NO: 4373751 - DNA, 12 bp, Homo sapiens
aggcggcccctc

SEQ ID NO: 4373752 - DNA, 18 bp, Homo sapiens
aggcgggacagtgctgca

SEQ ID NO: 4373753 - DNA, 13 bp, Homo sapiens
aggcggtacacta

SEQ ID NO: 4373754 - DNA, 17 bp, Homo sapiens
aggcggtgaggagtcca

SEQ ID NO: 4373755 - DNA, 16 bp, Homo sapiens
aggcgtgagccactgc

SEQ ID NO: 4373756 - DNA, 17 bp, Homo sapiens
aggcgtgcccccctcct

SEQ ID NO: 4373757 - DNA, 18 bp, Homo sapiens
aggcgtgcccccctcctc

SEQ ID NO: 4373758 - DNA, 20 bp, Homo sapiens
aggcgtgcccccctcctcca

SEQ ID NO: 4373759 - DNA, 23 bp, Homo sapiens
aggcgtgcccccctcctccagta

SEQ ID NO: 4373760 - DNA, 13 bp, Homo sapiens
aggcgttttttgg

SEQ ID NO: 4373761 - DNA, 14 bp, Homo sapiens
aggctaaaaagcaa

SEQ ID NO: 4373762 - DNA, 20 bp, Homo sapiens
aggctaaaaggcttccaggc

SEQ ID NO: 4373763 - DNA, 12 bp, Homo sapiens
aggctaaatgtt

SEQ ID NO: 4373764 - DNA, 15 bp, Homo sapiens
aggctaagaaaaagg

SEQ ID NO: 4373765 - DNA, 14 bp, Homo sapiens
aggctacagaacta

SEQ ID NO: 4373766 - DNA, 17 bp, Homo sapiens
aggctacccgctgtggc

SEQ ID NO: 4373767 - DNA, 18 bp, Homo sapiens
aggctacccgctgtggcc

SEQ ID NO: 4373768 - DNA, 21 bp, Homo sapiens
aggctagaaccacctgcctat

SEQ ID NO: 4373769 - DNA, 19 bp, Homo sapiens
aggctagagacagatgctg

SEQ ID NO: 4373770 - DNA, 20 bp, Homo sapiens
aggctagagacagatgctgg

SEQ ID NO: 4373771 - DNA, 15 bp, Homo sapiens
aggctagggtgggga

SEQ ID NO: 4373772 - DNA, 16 bp, Homo sapiens
aggctagggtggggag

SEQ ID NO: 4373773 - DNA, 16 bp, Homo sapiens
aggctcacccccttct

SEQ ID NO: 4373774 - DNA, 13 bp, Homo sapiens
aggctcactgcca

SEQ ID NO: 4373775 - DNA, 23 bp, Homo sapiens
aggctcactgccaggccagcctc

SEQ ID NO: 4373776 - DNA, 24 bp, Homo sapiens
aggctcactgccaggccagcctcc

SEQ ID NO: 4373777 - DNA, 13 bp, Homo sapiens
aggctcagagatg

SEQ ID NO: 4373778 - DNA, 18 bp, Homo sapiens
aggctcagagggtgtcct

SEQ ID NO: 4373779 - DNA, 19 bp, Homo sapiens
aggctcagagggtgtcctg

SEQ ID NO: 4373780 - DNA, 15 bp, Homo sapiens
aggctcatctttctg

SEQ ID NO: 4373781 - DNA, 16 bp, Homo sapiens
aggctccagctctggc

SEQ ID NO: 4373782 - DNA, 18 bp, Homo sapiens
aggctcccaatcagcttt

SEQ ID NO: 4373783 - DNA, 13 bp, Homo sapiens
aggctccccgcct

SEQ ID NO: 4373784 - DNA, 17 bp, Homo sapiens
aggctccccgcctccac

SEQ ID NO: 4373785 - DNA, 19 bp, Homo sapiens
aggctccccgcctccactc

SEQ ID NO: 4373786 - DNA, 17 bp, Homo sapiens
aggctccgggcaccagg

SEQ ID NO: 4373787 - DNA, 22 bp, Homo sapiens
aggctccgggcaccaggggcca

SEQ ID NO: 4373788 - DNA, 16 bp, Homo sapiens
aggctcctgttttgca

SEQ ID NO: 4373789 - DNA, 11 bp, Homo sapiens
aggctctcccc

SEQ ID NO: 4373790 - DNA, 14 bp, Homo sapiens
aggctctcccctct

SEQ ID NO: 4373791 - DNA, 14 bp, Homo sapiens
aggctctcctggct

SEQ ID NO: 4373792 - DNA, 14 bp, Homo sapiens
aggctctctctgtc

SEQ ID NO: 4373793 - DNA, 12 bp, Homo sapiens
aggctctggaca

SEQ ID NO: 4373794 - DNA, 13 bp, Homo sapiens
aggctctgtgctg

SEQ ID NO: 4373795 - DNA, 19 bp, Homo sapiens
aggctgacattcactgagt

SEQ ID NO: 4373796 - DNA, 21 bp, Homo sapiens
aggctgagaactcgttcacct

SEQ ID NO: 4373797 - DNA, 13 bp, Homo sapiens
aggctgagaagga

SEQ ID NO: 4373798 - DNA, 18 bp, Homo sapiens
aggctgagacagtgaatt

SEQ ID NO: 4373799 - DNA, 13 bp, Homo sapiens
aggctgaggcagg

SEQ ID NO: 4373800 - DNA, 17 bp, Homo sapiens
aggctgaggcaggagaa

SEQ ID NO: 4373801 - DNA, 19 bp, Homo sapiens
aggctgatgggcaaaaaac

SEQ ID NO: 4373802 - DNA, 19 bp, Homo sapiens
aggctgcaatgagccatga

SEQ ID NO: 4373803 - DNA, 18 bp, Homo sapiens
aggctgcacccctgggcc

SEQ ID NO: 4373804 - DNA, 19 bp, Homo sapiens
aggctgcacccctgggcca

SEQ ID NO: 4373805 - DNA, 19 bp, Homo sapiens
aggctgcagagctgaccca

SEQ ID NO: 4373806 - DNA, 14 bp, Homo sapiens
aggctgcagtcagc

SEQ ID NO: 4373807 - DNA, 15 bp, Homo sapiens
aggctgcagtggctc

SEQ ID NO: 4373808 - DNA, 22 bp, Homo sapiens
aggctgccacacggaagcaagc

SEQ ID NO: 4373809 - DNA, 13 bp, Homo sapiens
aggctgcctccca

SEQ ID NO: 4373810 - DNA, 14 bp, Homo sapiens
aggctgcctcccaa

SEQ ID NO: 4373811 - DNA, 10 bp, Homo sapiens
aggctgctag

SEQ ID NO: 4373812 - DNA, 18 bp, Homo sapiens
aggctgctggcgcctctg

SEQ ID NO: 4373813 - DNA, 14 bp, Homo sapiens
aggctggaaggcag

SEQ ID NO: 4373814 - DNA, 16 bp, Homo sapiens
aggctggaggcagggc

SEQ ID NO: 4373815 - DNA, 22 bp, Homo sapiens
aggctgggagtccctacctgct

SEQ ID NO: 4373816 - DNA, 13 bp, Homo sapiens
aggctgggcatca

SEQ ID NO: 4373817 - DNA, 10 bp, Homo sapiens
aggctgggcc

SEQ ID NO: 4373818 - DNA, 12 bp, Homo sapiens
aggctgggccat

SEQ ID NO: 4373819 - DNA, 20 bp, Homo sapiens
aggctgggccatgtccaaag

SEQ ID NO: 4373820 - DNA, 21 bp, Homo sapiens
aggctgggccatgtccaaaga

SEQ ID NO: 4373821 - DNA, 17 bp, Homo sapiens
aggctggggaggtgctg

SEQ ID NO: 4373822 - DNA, 22 bp, Homo sapiens
aggctggggaggtgctggggga

SEQ ID NO: 4373823 - DNA, 17 bp, Homo sapiens
aggctgggtcctgccag

SEQ ID NO: 4373824 - DNA, 12 bp, Homo sapiens
aggctggtgaca

SEQ ID NO: 4373825 - DNA, 17 bp, Homo sapiens
aggctgtaactgagaga

SEQ ID NO: 4373826 - DNA, 18 bp, Homo sapiens
aggctgtagaaaggggag

SEQ ID NO: 4373827 - DNA, 22 bp, Homo sapiens
aggctgtagaaaggggagaatg

SEQ ID NO: 4373828 - DNA, 23 bp, Homo sapiens
aggctgtagaaaggggagaatgt

SEQ ID NO: 4373829 - DNA, 17 bp, Homo sapiens
aggctgtctggccaggc

SEQ ID NO: 4373830 - DNA, 14 bp, Homo sapiens
aggctgtgctccgc

SEQ ID NO: 4373831 - DNA, 23 bp, Homo sapiens
aggctgttaaatacaggaaacag

SEQ ID NO: 4373832 - DNA, 13 bp, Homo sapiens
aggctgttctcag

SEQ ID NO: 4373833 - DNA, 22 bp, Homo sapiens
aggctgttctttaaatgtctga

SEQ ID NO: 4373834 - DNA, 14 bp, Homo sapiens
aggcttaaacccat

SEQ ID NO: 4373835 - DNA, 23 bp, Homo sapiens
aggcttaaggagaggagaaactg

SEQ ID NO: 4373836 - DNA, 17 bp, Homo sapiens
aggcttcaggttgcatt

SEQ ID NO: 4373837 - DNA, 12 bp, Homo sapiens
aggcttccaggc

SEQ ID NO: 4373838 - DNA, 19 bp, Homo sapiens
aggcttccaggctgagagc

SEQ ID NO: 4373839 - DNA, 21 bp, Homo sapiens
aggcttcctgcgtcctcctca

SEQ ID NO: 4373840 - DNA, 22 bp, Homo sapiens
aggcttcctgcgtcctcctcac

SEQ ID NO: 4373841 - DNA, 13 bp, Homo sapiens
aggcttctaataa

SEQ ID NO: 4373842 - DNA, 16 bp, Homo sapiens
aggcttctcacggcga

SEQ ID NO: 4373843 - DNA, 14 bp, Homo sapiens
aggcttctccgcca

SEQ ID NO: 4373844 - DNA, 15 bp, Homo sapiens
aggcttctccgccag

SEQ ID NO: 4373845 - DNA, 18 bp, Homo sapiens
aggcttctccgccagcct

SEQ ID NO: 4373846 - DNA, 19 bp, Homo sapiens
aggcttctccgccagcctc

SEQ ID NO: 4373847 - DNA, 23 bp, Homo sapiens
aggcttctccgccagcctcctct

SEQ ID NO: 4373848 - DNA, 16 bp, Homo sapiens
aggctttatgtacaaa

SEQ ID NO: 4373849 - DNA, 14 bp, Homo sapiens
aggctttggcccaa

SEQ ID NO: 4373850 - DNA, 22 bp, Homo sapiens
aggctttggggtcctagcccag

SEQ ID NO: 4373851 - DNA, 13 bp, Homo sapiens
agggaaaaatata

SEQ ID NO: 4373852 - DNA, 15 bp, Homo sapiens
agggaaaacagaaaa

SEQ ID NO: 4373853 - DNA, 15 bp, Homo sapiens
agggaaactgccagc

SEQ ID NO: 4373854 - DNA, 21 bp, Homo sapiens
agggaaactgccagcaacgca

SEQ ID NO: 4373855 - DNA, 13 bp, Homo sapiens
agggaaactggct

SEQ ID NO: 4373856 - DNA, 16 bp, Homo sapiens
agggaaactgggaaac

SEQ ID NO: 4373857 - DNA, 13 bp, Homo sapiens
agggaaagcgggc

SEQ ID NO: 4373858 - DNA, 21 bp, Homo sapiens
agggaaagcgggcagccccgt

SEQ ID NO: 4373859 - DNA, 23 bp, Homo sapiens
agggaaatgtacactttttacag

SEQ ID NO: 4373860 - DNA, 15 bp, Homo sapiens
agggaacagacagga

SEQ ID NO: 4373861 - DNA, 21 bp, Homo sapiens
agggaacagacaggagaaatg

SEQ ID NO: 4373862 - DNA, 13 bp, Homo sapiens
agggaacttagta

SEQ ID NO: 4373863 - DNA, 13 bp, Homo sapiens
agggaagaacatt

SEQ ID NO: 4373864 - DNA, 15 bp, Homo sapiens
agggaagagccttta

SEQ ID NO: 4373865 - DNA, 16 bp, Homo sapiens
agggaagctggcctga

SEQ ID NO: 4373866 - DNA, 17 bp, Homo sapiens
agggaaggacagtccct

SEQ ID NO: 4373867 - DNA, 21 bp, Homo sapiens
agggaaggacagtccctgctg

SEQ ID NO: 4373868 - DNA, 14 bp, Homo sapiens
agggaaggcctgac

SEQ ID NO: 4373869 - DNA, 14 bp, Homo sapiens
agggaagggcctgc

SEQ ID NO: 4373870 - DNA, 16 bp, Homo sapiens
agggaagggcctgcca

SEQ ID NO: 4373871 - DNA, 18 bp, Homo sapiens
agggaagggcctgccaca

SEQ ID NO: 4373872 - DNA, 19 bp, Homo sapiens
agggaaggggaatggaaga

SEQ ID NO: 4373873 - DNA, 17 bp, Homo sapiens
agggaagggtttctcta

SEQ ID NO: 4373874 - DNA, 17 bp, Homo sapiens
agggaagtaacagacac

SEQ ID NO: 4373875 - DNA, 13 bp, Homo sapiens
agggaagtggtct

SEQ ID NO: 4373876 - DNA, 14 bp, Homo sapiens
agggaatgcagcag

SEQ ID NO: 4373877 - DNA, 16 bp, Homo sapiens
agggaattcttacagc

SEQ ID NO: 4373878 - DNA, 18 bp, Homo sapiens
agggaattcttacagcca

SEQ ID NO: 4373879 - DNA, 12 bp, Homo sapiens
agggaattgctc

SEQ ID NO: 4373880 - DNA, 19 bp, Homo sapiens
agggaatttaatacttttc

SEQ ID NO: 4373881 - DNA, 20 bp, Homo sapiens
agggaatttaatacttttcc

SEQ ID NO: 4373882 - DNA, 14 bp, Homo sapiens
agggacaccagcca

SEQ ID NO: 4373883 - DNA, 18 bp, Homo sapiens
agggacaccagccaggct

SEQ ID NO: 4373884 - DNA, 21 bp, Homo sapiens
agggacaccagccaggctctg

SEQ ID NO: 4373885 - DNA, 19 bp, Homo sapiens
agggacagagacacctgca

SEQ ID NO: 4373886 - DNA, 17 bp, Homo sapiens
agggaccaactgggccc

SEQ ID NO: 4373887 - DNA, 18 bp, Homo sapiens
agggaccactgggtgaga

SEQ ID NO: 4373888 - DNA, 23 bp, Homo sapiens
agggaccactgggtgagagagga

SEQ ID NO: 4373889 - DNA, 18 bp, Homo sapiens
agggaccatcaagaacct

SEQ ID NO: 4373890 - DNA, 21 bp, Homo sapiens
agggaccatcaagaacctaca

SEQ ID NO: 4373891 - DNA, 22 bp, Homo sapiens
agggacccctcgccccagcctc

SEQ ID NO: 4373892 - DNA, 22 bp, Homo sapiens
agggaccggcggaccccagcca

SEQ ID NO: 4373893 - DNA, 22 bp, Homo sapiens
agggaccggtgctgcaggagtg

SEQ ID NO: 4373894 - DNA, 14 bp, Homo sapiens
agggacctgctgct

SEQ ID NO: 4373895 - DNA, 18 bp, Homo sapiens
agggacctgctgctcagt

SEQ ID NO: 4373896 - DNA, 23 bp, Homo sapiens
agggacgcctgggggtgccagga

SEQ ID NO: 4373897 - DNA, 16 bp, Homo sapiens
agggagaagaaaggtg

SEQ ID NO: 4373898 - DNA, 14 bp, Homo sapiens
agggagacaggaac

SEQ ID NO: 4373899 - DNA, 16 bp, Homo sapiens
agggagactcagcctt

SEQ ID NO: 4373900 - DNA, 11 bp, Homo sapiens
agggagagaga

SEQ ID NO: 4373901 - DNA, 14 bp, Homo sapiens
agggagagcggggc

SEQ ID NO: 4373902 - DNA, 13 bp, Homo sapiens
agggagaggagtg

SEQ ID NO: 4373903 - DNA, 13 bp, Homo sapiens
agggagagggagg

SEQ ID NO: 4373904 - DNA, 17 bp, Homo sapiens
agggagcaccctgccca

SEQ ID NO: 4373905 - DNA, 16 bp, Homo sapiens
agggagcagggaaggc

SEQ ID NO: 4373906 - DNA, 14 bp, Homo sapiens
agggaggcccagcc

SEQ ID NO: 4373907 - DNA, 21 bp, Homo sapiens
agggaggctcccggggcctgg

SEQ ID NO: 4373908 - DNA, 13 bp, Homo sapiens
agggaggggctgt

SEQ ID NO: 4373909 - DNA, 13 bp, Homo sapiens
agggagtccaggg

SEQ ID NO: 4373910 - DNA, 21 bp, Homo sapiens
agggagtttaatacaggaaat

SEQ ID NO: 4373911 - DNA, 20 bp, Homo sapiens
agggagttttaaagaaattt

SEQ ID NO: 4373912 - DNA, 19 bp, Homo sapiens
agggatattgccttatttg

SEQ ID NO: 4373913 - DNA, 22 bp, Homo sapiens
agggatccctcatctgtccctc

SEQ ID NO: 4373914 - DNA, 23 bp, Homo sapiens
agggatgattaaaggcagcattt

SEQ ID NO: 4373915 - DNA, 18 bp, Homo sapiens
agggatgattcaagccat

SEQ ID NO: 4373916 - DNA, 19 bp, Homo sapiens
agggatgattcaagccatt

SEQ ID NO: 4373917 - DNA, 20 bp, Homo sapiens
agggatgcgtgttccagcca

SEQ ID NO: 4373918 - DNA, 17 bp, Homo sapiens
agggatgctgggctggg

SEQ ID NO: 4373919 - DNA, 17 bp, Homo sapiens
agggatgggcagcccaa

SEQ ID NO: 4373920 - DNA, 20 bp, Homo sapiens
agggattagggagagaagat

SEQ ID NO: 4373921 - DNA, 19 bp, Homo sapiens
agggattcaggctgcttgg

SEQ ID NO: 4373922 - DNA, 16 bp, Homo sapiens
agggattctcacaata

SEQ ID NO: 4373923 - DNA, 17 bp, Homo sapiens
agggattctcacaatag

SEQ ID NO: 4373924 - DNA, 23 bp, Homo sapiens
agggattctgggcttggggtgtg

SEQ ID NO: 4373925 - DNA, 19 bp, Homo sapiens
agggattgaggggccctgg

SEQ ID NO: 4373926 - DNA, 13 bp, Homo sapiens
agggatttccctg

SEQ ID NO: 4373927 - DNA, 14 bp, Homo sapiens
agggatttccctgc

SEQ ID NO: 4373928 - DNA, 22 bp, Homo sapiens
agggatttggggctcagagtgg

SEQ ID NO: 4373929 - DNA, 23 bp, Homo sapiens
agggcaaaatattcactgggcca

SEQ ID NO: 4373930 - DNA, 18 bp, Homo sapiens
agggcaacagatcagtaa

SEQ ID NO: 4373931 - DNA, 17 bp, Homo sapiens
agggcaactcttggaag

SEQ ID NO: 4373932 - DNA, 22 bp, Homo sapiens
agggcaagcctctagtgtacca

SEQ ID NO: 4373933 - DNA, 14 bp, Homo sapiens
agggcaatggacaa

SEQ ID NO: 4373934 - DNA, 14 bp, Homo sapiens
agggcaattggaac

SEQ ID NO: 4373935 - DNA, 17 bp, Homo sapiens
agggcagaacactaacc

SEQ ID NO: 4373936 - DNA, 14 bp, Homo sapiens
agggcagaatgaat

SEQ ID NO: 4373937 - DNA, 22 bp, Homo sapiens
agggcagaggctggaggcaggg

SEQ ID NO: 4373938 - DNA, 15 bp, Homo sapiens
agggcagcagaaggg

SEQ ID NO: 4373939 - DNA, 21 bp, Homo sapiens
agggcagcccgtcctctctct

SEQ ID NO: 4373940 - DNA, 14 bp, Homo sapiens
agggcagctgggcc

SEQ ID NO: 4373941 - DNA, 15 bp, Homo sapiens
agggcagctgggccc

SEQ ID NO: 4373942 - DNA, 18 bp, Homo sapiens
agggcaggaaggagagcc

SEQ ID NO: 4373943 - DNA, 19 bp, Homo sapiens
agggcaggaaggagagcct

SEQ ID NO: 4373944 - DNA, 22 bp, Homo sapiens
agggcaggatggcctttccttc

SEQ ID NO: 4373945 - DNA, 12 bp, Homo sapiens
agggcagggccc

SEQ ID NO: 4373946 - DNA, 15 bp, Homo sapiens
agggcagtaccctcc

SEQ ID NO: 4373947 - DNA, 19 bp, Homo sapiens
agggcattctgttggccta

SEQ ID NO: 4373948 - DNA, 13 bp, Homo sapiens
agggcattttaaa

SEQ ID NO: 4373949 - DNA, 19 bp, Homo sapiens
agggccaaacgctgagcca

SEQ ID NO: 4373950 - DNA, 22 bp, Homo sapiens
agggccaaacgctgagccacct

SEQ ID NO: 4373951 - DNA, 21 bp, Homo sapiens
agggccaagcccagcactgct

SEQ ID NO: 4373952 - DNA, 18 bp, Homo sapiens
agggccacatagatgctg

SEQ ID NO: 4373953 - DNA, 17 bp, Homo sapiens
agggccacgctccagct

SEQ ID NO: 4373954 - DNA, 20 bp, Homo sapiens
agggccacgctccagctgcc

SEQ ID NO: 4373955 - DNA, 17 bp, Homo sapiens
agggccaggcctctgct

SEQ ID NO: 4373956 - DNA, 23 bp, Homo sapiens
agggccaggcctctgctggctca

SEQ ID NO: 4373957 - DNA, 17 bp, Homo sapiens
agggccagtcctgcctg

SEQ ID NO: 4373958 - DNA, 19 bp, Homo sapiens
agggccattttggtgctta

SEQ ID NO: 4373959 - DNA, 19 bp, Homo sapiens
agggcccacccatgtcacc

SEQ ID NO: 4373960 - DNA, 15 bp, Homo sapiens
agggcccagcccaga

SEQ ID NO: 4373961 - DNA, 23 bp, Homo sapiens
agggcccagcccagagccacctg

SEQ ID NO: 4373962 - DNA, 22 bp, Homo sapiens
agggcccccaataaaccagtgt

SEQ ID NO: 4373963 - DNA, 23 bp, Homo sapiens
agggtagccccctcatctgcagg

SEQ ID NO: 4373964 - DNA, 23 bp, Homo sapiens
agggtagcccgcctgccagtcct

SEQ ID NO: 4373965 - DNA, 20 bp, Homo sapiens
agggtaggagggtgggaagg

SEQ ID NO: 4373966 - DNA, 22 bp, Homo sapiens
agggtataagttgctgtaaaat

SEQ ID NO: 4373967 - DNA, 17 bp, Homo sapiens
agggtcaccctggcctg

SEQ ID NO: 4373968 - DNA, 20 bp, Homo sapiens
agggtcagaggacctgtatt

SEQ ID NO: 4373969 - DNA, 18 bp, Homo sapiens
agggtcccaagctgggcc

SEQ ID NO: 4373970 - DNA, 19 bp, Homo sapiens
agggtcccaagctgggccc

SEQ ID NO: 4373971 - DNA, 15 bp, Homo sapiens
agggtccctgcccac

SEQ ID NO: 4373972 - DNA, 16 bp, Homo sapiens
agggtccctgcccact

SEQ ID NO: 4373973 - DNA, 20 bp, Homo sapiens
agggtccgtggaccaggagg

SEQ ID NO: 4373974 - DNA, 13 bp, Homo sapiens
agggtcctctctt

SEQ ID NO: 4373975 - DNA, 15 bp, Homo sapiens
agggtcctctcttcc

SEQ ID NO: 4373976 - DNA, 18 bp, Homo sapiens
agggtcctctcttccaca

SEQ ID NO: 4373977 - DNA, 21 bp, Homo sapiens
agggtcctctcttccacagtg

SEQ ID NO: 4373978 - DNA, 15 bp, Homo sapiens
agggtcctcttttcc

SEQ ID NO: 4373979 - DNA, 14 bp, Homo sapiens
agggtcctgccggt

SEQ ID NO: 4373980 - DNA, 22 bp, Homo sapiens
agggtccttttgacactgctct

SEQ ID NO: 4373981 - DNA, 15 bp, Homo sapiens
agggtctggagaagc

SEQ ID NO: 4373982 - DNA, 18 bp, Homo sapiens
agggtcttgctctgtccc

SEQ ID NO: 4373983 - DNA, 19 bp, Homo sapiens
agggtcttggctgcctgtg

SEQ ID NO: 4373984 - DNA, 18 bp, Homo sapiens
agggtgactcacagccgc

SEQ ID NO: 4373985 - DNA, 21 bp, Homo sapiens
agggtgccctttggggtcccg

SEQ ID NO: 4373986 - DNA, 18 bp, Homo sapiens
agggtggccacacaggca

SEQ ID NO: 4373987 - DNA, 22 bp, Homo sapiens
agggtggccacacaggcagggc

SEQ ID NO: 4373988 - DNA, 22 bp, Homo sapiens
agggtggccacacctctatccc

SEQ ID NO: 4373989 - DNA, 14 bp, Homo sapiens
agggtggcccttgc

SEQ ID NO: 4373990 - DNA, 14 bp, Homo sapiens
agggtgggagggag

SEQ ID NO: 4373991 - DNA, 15 bp, Homo sapiens
agggtgggagggagg

SEQ ID NO: 4373992 - DNA, 16 bp, Homo sapiens
agggtgggagtggggc

SEQ ID NO: 4373993 - DNA, 17 bp, Homo sapiens
agggtgggcttcctgcc

SEQ ID NO: 4373994 - DNA, 19 bp, Homo sapiens
agggtgggcttcctgccct

SEQ ID NO: 4373995 - DNA, 14 bp, Homo sapiens
agggtgtatagtgt

SEQ ID NO: 4373996 - DNA, 17 bp, Homo sapiens
agggtgtcacgagccca

SEQ ID NO: 4373997 - DNA, 14 bp, Homo sapiens
agggtgtctgggga

SEQ ID NO: 4373998 - DNA, 15 bp, Homo sapiens
agggtgtggctttcc

SEQ ID NO: 4373999 - DNA, 13 bp, Homo sapiens
agggtgtttcctc

SEQ ID NO: 4374000 - DNA, 15 bp, Homo sapiens
agggttctaaatgca

SEQ ID NO: 4374001 - DNA, 22 bp, Homo sapiens
agggttctaaatgcaataagat

SEQ ID NO: 4374002 - DNA, 19 bp, Homo sapiens
agggttctgcctctccagg

SEQ ID NO: 4374003 - DNA, 18 bp, Homo sapiens
agggtttggacagaccca

SEQ ID NO: 4374004 - DNA, 13 bp, Homo sapiens
agggttttccagg

SEQ ID NO: 4374005 - DNA, 16 bp, Homo sapiens
agggttttccaggtgt

SEQ ID NO: 4374006 - DNA, 12 bp, Homo sapiens
aggtaaagatat

SEQ ID NO: 4374007 - DNA, 22 bp, Homo sapiens
aggtaaagggtggggcattgag

SEQ ID NO: 4374008 - DNA, 14 bp, Homo sapiens
aggtaaataaaaag

SEQ ID NO: 4374009 - DNA, 16 bp, Homo sapiens
aggtaaatacaatggt

SEQ ID NO: 4374010 - DNA, 12 bp, Homo sapiens
aggtaacactac

SEQ ID NO: 4374011 - DNA, 20 bp, Homo sapiens
aggtaactatcaatatttaa

SEQ ID NO: 4374012 - DNA, 18 bp, Homo sapiens
aggtaatataaaaagctt

SEQ ID NO: 4374013 - DNA, 21 bp, Homo sapiens
aggtaatgtagggttatattt

SEQ ID NO: 4374014 - DNA, 17 bp, Homo sapiens
aggtaatttttttcacc

SEQ ID NO: 4374015 - DNA, 16 bp, Homo sapiens
aggtacaactgtattt

SEQ ID NO: 4374016 - DNA, 13 bp, Homo sapiens
aggtacacctccc

SEQ ID NO: 4374017 - DNA, 16 bp, Homo sapiens
aggtacacctccccct

SEQ ID NO: 4374018 - DNA, 16 bp, Homo sapiens
aggtacactgtttcca

SEQ ID NO: 4374019 - DNA, 16 bp, Homo sapiens
aggtagaaaaagggtc

SEQ ID NO: 4374020 - DNA, 20 bp, Homo sapiens
aggtagacttttatgagaac

SEQ ID NO: 4374021 - DNA, 20 bp, Homo sapiens
aggtagcattctttggagtt

SEQ ID NO: 4374022 - DNA, 16 bp, Homo sapiens
aggtagctcggcacca

SEQ ID NO: 4374023 - DNA, 20 bp, Homo sapiens
aggtaggtggatcacctgag

SEQ ID NO: 4374024 - DNA, 17 bp, Homo sapiens
aggtatattggaagagg

SEQ ID NO: 4374025 - DNA, 17 bp, Homo sapiens
aggtatctagcaatgga

SEQ ID NO: 4374026 - DNA, 20 bp, Homo sapiens
aggtatggaagggtttgtgg

SEQ ID NO: 4374027 - DNA, 19 bp, Homo sapiens
aggtattacaagtaatgta

SEQ ID NO: 4374028 - DNA, 14 bp, Homo sapiens
aggtcaacagagaa

SEQ ID NO: 4374029 - DNA, 19 bp, Homo sapiens
aggtcacagaaaggcaggt

SEQ ID NO: 4374030 - DNA, 14 bp, Homo sapiens
aggtcactccacca

SEQ ID NO: 4374031 - DNA, 23 bp, Homo sapiens
aggtcactccaccatccccaccc

SEQ ID NO: 4374032 - DNA, 21 bp, Homo sapiens
aggtcactggaaaggggagag

SEQ ID NO: 4374033 - DNA, 13 bp, Homo sapiens
aggtcagcagtat

SEQ ID NO: 4374034 - DNA, 21 bp, Homo sapiens
aggtcagcgcggtcctgactc

SEQ ID NO: 4374035 - DNA, 17 bp, Homo sapiens
aggtcaggacggctcct

SEQ ID NO: 4374036 - DNA, 22 bp, Homo sapiens
aggtcaggacggctcctcagag

SEQ ID NO: 4374037 - DNA, 22 bp, Homo sapiens
aggtcaggagttcaagaccagc

SEQ ID NO: 4374038 - DNA, 19 bp, Homo sapiens
aggtcccagcccctcctcc

SEQ ID NO: 4374039 - DNA, 22 bp, Homo sapiens
aggtcccagcccctcctccctc

SEQ ID NO: 4374040 - DNA, 19 bp, Homo sapiens
aggtcccttggtctgtaca

SEQ ID NO: 4374041 - DNA, 15 bp, Homo sapiens
aggtccgcaccctgt

SEQ ID NO: 4374042 - DNA, 17 bp, Homo sapiens
aggtccgtagctcccct

SEQ ID NO: 4374043 - DNA, 18 bp, Homo sapiens
aggtccgtagctcccctg

SEQ ID NO: 4374044 - DNA, 20 bp, Homo sapiens
aggtccgtagctcccctggc

SEQ ID NO: 4374045 - DNA, 23 bp, Homo sapiens
aggtccgtagctcccctggctgg

SEQ ID NO: 4374046 - DNA, 13 bp, Homo sapiens
aggtccgtttcct

SEQ ID NO: 4374047 - DNA, 18 bp, Homo sapiens
aggtcctcccctctcttg

SEQ ID NO: 4374048 - DNA, 13 bp, Homo sapiens
aggtcctctcagt

SEQ ID NO: 4374049 - DNA, 17 bp, Homo sapiens
aggtcctgcccatgtgt

SEQ ID NO: 4374050 - DNA, 21 bp, Homo sapiens
aggtccttgcctgaactccag

SEQ ID NO: 4374051 - DNA, 15 bp, Homo sapiens
aggtcgggacagctg

SEQ ID NO: 4374052 - DNA, 19 bp, Homo sapiens
aggtcgttttccaaagagc

SEQ ID NO: 4374053 - DNA, 19 bp, Homo sapiens
aggtctcatctcccaggcc

SEQ ID NO: 4374054 - DNA, 21 bp, Homo sapiens
aggtctcatctcccaggcccc

SEQ ID NO: 4374055 - DNA, 18 bp, Homo sapiens
aggtctcatgctgttgct

SEQ ID NO: 4374056 - DNA, 14 bp, Homo sapiens
aggtctccacctgc

SEQ ID NO: 4374057 - DNA, 16 bp, Homo sapiens
aggtctccacctgcac

SEQ ID NO: 4374058 - DNA, 19 bp, Homo sapiens
aggtctccacctgcacatt

SEQ ID NO: 4374059 - DNA, 19 bp, Homo sapiens
aggtctcctcagggtgggg

SEQ ID NO: 4374060 - DNA, 20 bp, Homo sapiens
aggtctcctcagggtggggg

SEQ ID NO: 4374061 - DNA, 23 bp, Homo sapiens
aggtctgagccctggtgtgtttc

SEQ ID NO: 4374062 - DNA, 22 bp, Homo sapiens
aggtctgcactcctttatctgt

SEQ ID NO: 4374063 - DNA, 20 bp, Homo sapiens
aggtctgtttaaagtggcaa

SEQ ID NO: 4374064 - DNA, 15 bp, Homo sapiens
aggtctttctctcag

SEQ ID NO: 4374065 - DNA, 13 bp, Homo sapiens
aggtcttttcaaa

SEQ ID NO: 4374066 - DNA, 21 bp, Homo sapiens
aggtgaaaattgtataaatta

SEQ ID NO: 4374067 - DNA, 16 bp, Homo sapiens
aggtgaaagggagcta

SEQ ID NO: 4374068 - DNA, 15 bp, Homo sapiens
aggtgaaatccctgc

SEQ ID NO: 4374069 - DNA, 21 bp, Homo sapiens
aggtgaaatccctgcctcagg

SEQ ID NO: 4374070 - DNA, 19 bp, Homo sapiens
aggtgacacgcttctgagc

SEQ ID NO: 4374071 - DNA, 19 bp, Homo sapiens
aggtgacagtggctgctct

SEQ ID NO: 4374072 - DNA, 20 bp, Homo sapiens
aggtgacagtggctgctctg

SEQ ID NO: 4374073 - DNA, 20 bp, Homo sapiens
aggtgagtttgagctgcctt

SEQ ID NO: 4374074 - DNA, 22 bp, Homo sapiens
aggtgagtttgagctgccttcc

SEQ ID NO: 4374075 - DNA, 18 bp, Homo sapiens
aggtgatgccattacaga

SEQ ID NO: 4374076 - DNA, 16 bp, Homo sapiens
aggtgatttcagactg

SEQ ID NO: 4374077 - DNA, 17 bp, Homo sapiens
aggtgcaagtgccccag

SEQ ID NO: 4374078 - DNA, 15 bp, Homo sapiens
aggtgcagggaagtg

SEQ ID NO: 4374079 - DNA, 15 bp, Homo sapiens
aggtgcatttttact

SEQ ID NO: 4374080 - DNA, 22 bp, Homo sapiens
agtaatgaatttttatgatatt

SEQ ID NO: 4374081 - DNA, 19 bp, Homo sapiens
agtaatgacttagaaactg

SEQ ID NO: 4374082 - DNA, 14 bp, Homo sapiens
agtaatgagtttaa

SEQ ID NO: 4374083 - DNA, 21 bp, Homo sapiens
agtaatgagtttaaaaatcaa

SEQ ID NO: 4374084 - DNA, 19 bp, Homo sapiens
agtaattatgcactaaata

SEQ ID NO: 4374085 - DNA, 21 bp, Homo sapiens
agtaattcaagcctctaaaca

SEQ ID NO: 4374086 - DNA, 22 bp, Homo sapiens
agtaattctaccctgaaagtga

SEQ ID NO: 4374087 - DNA, 13 bp, Homo sapiens
agtaattcttctg

SEQ ID NO: 4374088 - DNA, 13 bp, Homo sapiens
agtaattgaaaaa

SEQ ID NO: 4374089 - DNA, 18 bp, Homo sapiens
agtaattgacatgtgcca

SEQ ID NO: 4374090 - DNA, 22 bp, Homo sapiens
agtaatttattgtctgtctaca

SEQ ID NO: 4374091 - DNA, 12 bp, Homo sapiens
agtaatttcagt

SEQ ID NO: 4374092 - DNA, 13 bp, Homo sapiens
agtaatttcagtg

SEQ ID NO: 4374093 - DNA, 19 bp, Homo sapiens
agtaatttcagtgtaaagt

SEQ ID NO: 4374094 - DNA, 21 bp, Homo sapiens
agtaatttctttttttccttt

SEQ ID NO: 4374095 - DNA, 14 bp, Homo sapiens
agtaatttgtaaag

SEQ ID NO: 4374096 - DNA, 17 bp, Homo sapiens
agtacaaacatgaaaaa

SEQ ID NO: 4374097 - DNA, 16 bp, Homo sapiens
agtacacaactatgga

SEQ ID NO: 4374098 - DNA, 15 bp, Homo sapiens
agtacactcagccac

SEQ ID NO: 4374099 - DNA, 22 bp, Homo sapiens
agtacactcagccactgtcaca

SEQ ID NO: 4374100 - DNA, 17 bp, Homo sapiens
agtacactctgctgttt

SEQ ID NO: 4374101 - DNA, 14 bp, Homo sapiens
agtacagaaggcaa

SEQ ID NO: 4374102 - DNA, 14 bp, Homo sapiens
agtacagaatttga

SEQ ID NO: 4374103 - DNA, 17 bp, Homo sapiens
agtacagaatttgaatt

SEQ ID NO: 4374104 - DNA, 13 bp, Homo sapiens
agtacagcctgga

SEQ ID NO: 4374105 - DNA, 13 bp, Homo sapiens
agtacagcggctc

SEQ ID NO: 4374106 - DNA, 14 bp, Homo sapiens
agtacagcggctcc

SEQ ID NO: 4374107 - DNA, 19 bp, Homo sapiens
agtacattgcttaaaatat

SEQ ID NO: 4374108 - DNA, 16 bp, Homo sapiens
agtacatttaaatttt

SEQ ID NO: 4374109 - DNA, 19 bp, Homo sapiens
agtacatttaaattttttg

SEQ ID NO: 4374110 - DNA, 12 bp, Homo sapiens
agtacccagcaa

SEQ ID NO: 4374111 - DNA, 19 bp, Homo sapiens
agtacccagcaaatgggca

SEQ ID NO: 4374112 - DNA, 17 bp, Homo sapiens
agtacctgattgtattt

SEQ ID NO: 4374113 - DNA, 19 bp, Homo sapiens
agtaccttaggttctttct

SEQ ID NO: 4374114 - DNA, 21 bp, Homo sapiens
agtacgaatcttatttttcct

SEQ ID NO: 4374115 - DNA, 18 bp, Homo sapiens
agtacgtcccgctgctgt

SEQ ID NO: 4374116 - DNA, 21 bp, Homo sapiens
agtacgtcccgctgctgtgct

SEQ ID NO: 4374117 - DNA, 16 bp, Homo sapiens
agtactaatagaactt

SEQ ID NO: 4374118 - DNA, 21 bp, Homo sapiens
agtactagagatattttgtaa

SEQ ID NO: 4374119 - DNA, 22 bp, Homo sapiens
agtactattactattactattt

SEQ ID NO: 4374120 - DNA, 19 bp, Homo sapiens
agtactctttctctcccct

SEQ ID NO: 4374121 - DNA, 19 bp, Homo sapiens
agtactggtaagattgtta

SEQ ID NO: 4374122 - DNA, 17 bp, Homo sapiens
agtactggttactttca

SEQ ID NO: 4374123 - DNA, 20 bp, Homo sapiens
agtactggttactttcaaaa

SEQ ID NO: 4374124 - DNA, 13 bp, Homo sapiens
agtactgtactat

SEQ ID NO: 4374125 - DNA, 13 bp, Homo sapiens
agtactgtgggca

SEQ ID NO: 4374126 - DNA, 17 bp, Homo sapiens
agtactgtgggcaattt

SEQ ID NO: 4374127 - DNA, 21 bp, Homo sapiens
agtactgtgggcaatttagaa

SEQ ID NO: 4374128 - DNA, 23 bp, Homo sapiens
agtactgtgggcaatttagaaaa

SEQ ID NO: 4374129 - DNA, 17 bp, Homo sapiens
agtactgtttaccattt

SEQ ID NO: 4374130 - DNA, 12 bp, Homo sapiens
agtacttctaag

SEQ ID NO: 4374131 - DNA, 14 bp, Homo sapiens
agtacttcttctgt

SEQ ID NO: 4374132 - DNA, 15 bp, Homo sapiens
agtacttgtcatatg

SEQ ID NO: 4374133 - DNA, 23 bp, Homo sapiens
agtacttttttaaatattttcta

SEQ ID NO: 4374134 - DNA, 20 bp, Homo sapiens
agtagaaagacatctgcctg

SEQ ID NO: 4374135 - DNA, 12 bp, Homo sapiens
agtagaaagcta

SEQ ID NO: 4374136 - DNA, 13 bp, Homo sapiens
agtagaaagctaa

SEQ ID NO: 4374137 - DNA, 15 bp, Homo sapiens
agtagaaagctaaag

SEQ ID NO: 4374138 - DNA, 23 bp, Homo sapiens
agtagaggggtctcatgtctccc

SEQ ID NO: 4374139 - DNA, 15 bp, Homo sapiens
agtagattcatgaaa

SEQ ID NO: 4374140 - DNA, 20 bp, Homo sapiens
agtagatttacagaacaaag

SEQ ID NO: 4374141 - DNA, 21 bp, Homo sapiens
agtagcaaatgtttactgtat

SEQ ID NO: 4374142 - DNA, 15 bp, Homo sapiens
agtagcaatgtgcct

SEQ ID NO: 4374143 - DNA, 20 bp, Homo sapiens
agtagcctcctcctgggctc

SEQ ID NO: 4374144 - DNA, 22 bp, Homo sapiens
agtagcctctcctgtatttaac

SEQ ID NO: 4374145 - DNA, 17 bp, Homo sapiens
agtagctgcccttcctg

SEQ ID NO: 4374146 - DNA, 17 bp, Homo sapiens
agtagtacttcttctgt

SEQ ID NO: 4374147 - DNA, 21 bp, Homo sapiens
agtagtcaaaaacaaagctga

SEQ ID NO: 4374148 - DNA, 22 bp, Homo sapiens
agtagtcaaaaacaaagctgat

SEQ ID NO: 4374149 - DNA, 16 bp, Homo sapiens
agtagtcatcaatgca

SEQ ID NO: 4374150 - DNA, 12 bp, Homo sapiens
agtagtggccac

SEQ ID NO: 4374151 - DNA, 18 bp, Homo sapiens
agtagttatataattgtt

SEQ ID NO: 4374152 - DNA, 18 bp, Homo sapiens
agtagttgttggtctgta

SEQ ID NO: 4374153 - DNA, 16 bp, Homo sapiens
agtataaatgtacatc

SEQ ID NO: 4374154 - DNA, 22 bp, Homo sapiens
agtataacagttttgagtaatt

SEQ ID NO: 4374155 - DNA, 19 bp, Homo sapiens
agtataagactactgaatc

SEQ ID NO: 4374156 - DNA, 20 bp, Homo sapiens
agtataatctcctctgctca

SEQ ID NO: 4374157 - DNA, 17 bp, Homo sapiens
agtatacgtataaatat

SEQ ID NO: 4374158 - DNA, 19 bp, Homo sapiens
agtatacgtataaatatca

SEQ ID NO: 4374159 - DNA, 22 bp, Homo sapiens
agtatacgtataaatatcagta

SEQ ID NO: 4374160 - DNA, 14 bp, Homo sapiens
agtatagagagaag

SEQ ID NO: 4374161 - DNA, 15 bp, Homo sapiens
agtatataagctttt

SEQ ID NO: 4374162 - DNA, 21 bp, Homo sapiens
agtatattgataaccttgaaa

SEQ ID NO: 4374163 - DNA, 17 bp, Homo sapiens
agtatatttatttctag

SEQ ID NO: 4374164 - DNA, 13 bp, Homo sapiens
agtatattttatt

SEQ ID NO: 4374165 - DNA, 20 bp, Homo sapiens
agtatattttatttcaatgt

SEQ ID NO: 4374166 - DNA, 19 bp, Homo sapiens
agtatcagtattttcacac

SEQ ID NO: 4374167 - DNA, 11 bp, Homo sapiens
agtatccaggc

SEQ ID NO: 4374168 - DNA, 23 bp, Homo sapiens
agtatcccttatccaaaatgctt

SEQ ID NO: 4374169 - DNA, 17 bp, Homo sapiens
agtatcctttatacagt

SEQ ID NO: 4374170 - DNA, 17 bp, Homo sapiens
agtatcttgtgcttctt

SEQ ID NO: 4374171 - DNA, 22 bp, Homo sapiens
agtatgcaaagcaatcttttat

SEQ ID NO: 4374172 - DNA, 16 bp, Homo sapiens
agtatgcattattaaa

SEQ ID NO: 4374173 - DNA, 21 bp, Homo sapiens
agtatgcattattaaattgta

SEQ ID NO: 4374174 - DNA, 21 bp, Homo sapiens
agtatggcctgacagctctgt

SEQ ID NO: 4374175 - DNA, 22 bp, Homo sapiens
agtatggtacatttttcaactt

SEQ ID NO: 4374176 - DNA, 23 bp, Homo sapiens
agtatggtacatttttcaacttt

SEQ ID NO: 4374177 - DNA, 13 bp, Homo sapiens
agtatgtattatt

SEQ ID NO: 4374178 - DNA, 18 bp, Homo sapiens
agtatgtccttcagctga

SEQ ID NO: 4374179 - DNA, 15 bp, Homo sapiens
agtatgtggaagtgt

SEQ ID NO: 4374180 - DNA, 13 bp, Homo sapiens
agtattaactatt

SEQ ID NO: 4374181 - DNA, 17 bp, Homo sapiens
agtattacaaccatata

SEQ ID NO: 4374182 - DNA, 17 bp, Homo sapiens
agtattacatgatttaa

SEQ ID NO: 4374183 - DNA, 21 bp, Homo sapiens
agtattactaaattgaccttt

SEQ ID NO: 4374184 - DNA, 19 bp, Homo sapiens
agtattatagacaaaagaa

SEQ ID NO: 4374185 - DNA, 14 bp, Homo sapiens
agtattccacctta

SEQ ID NO: 4374186 - DNA, 23 bp, Homo sapiens
agtattccaccttaaattaaaca

SEQ ID NO: 4374187 - DNA, 12 bp, Homo sapiens
agtattctgaca

SEQ ID NO: 4374188 - DNA, 17 bp, Homo sapiens
agtattctgacatgtaa

SEQ ID NO: 4374189 - DNA, 19 bp, Homo sapiens
agtattctgacatgtaaga

SEQ ID NO: 4374190 - DNA, 14 bp, Homo sapiens
agtattctttttct

SEQ ID NO: 4374191 - DNA, 12 bp, Homo sapiens
agtattgtaaat

SEQ ID NO: 4374192 - DNA, 14 bp, Homo sapiens
agtattgtaaatta

SEQ ID NO: 4374193 - DNA, 16 bp, Homo sapiens
agtattgtaaattata

SEQ ID NO: 4374194 - DNA, 19 bp, Homo sapiens
agtattgttcgttctgata

SEQ ID NO: 4374195 - DNA, 20 bp, Homo sapiens
agtatttaaactttcaatat

SEQ ID NO: 4374196 - DNA, 22 bp, Homo sapiens
agtatttaactacatctgcctc

SEQ ID NO: 4374197 - DNA, 20 bp, Homo sapiens
agtatttactttttaaaaat

SEQ ID NO: 4374198 - DNA, 17 bp, Homo sapiens
agtcccttcccctccct

SEQ ID NO: 4374199 - DNA, 22 bp, Homo sapiens
agtcccttcccctccctggctc

SEQ ID NO: 4374200 - DNA, 23 bp, Homo sapiens
agtcccttcccctccctggctcc

SEQ ID NO: 4374201 - DNA, 15 bp, Homo sapiens
agtccgcagaagccc

SEQ ID NO: 4374202 - DNA, 13 bp, Homo sapiens
agtccgctgaaga

SEQ ID NO: 4374203 - DNA, 13 bp, Homo sapiens
agtccgtgggacg

SEQ ID NO: 4374204 - DNA, 19 bp, Homo sapiens
agtcctaacttcctgtgcc

SEQ ID NO: 4374205 - DNA, 16 bp, Homo sapiens
agtcctagaatgtttc

SEQ ID NO: 4374206 - DNA, 15 bp, Homo sapiens
agtcctagctgcaca

SEQ ID NO: 4374207 - DNA, 21 bp, Homo sapiens
agtcctagctgcacagggcag

SEQ ID NO: 4374208 - DNA, 13 bp, Homo sapiens
agtcctatttcag

SEQ ID NO: 4374209 - DNA, 17 bp, Homo sapiens
agtcctcactcccagtc

SEQ ID NO: 4374210 - DNA, 18 bp, Homo sapiens
agtcctcactcccagtcc

SEQ ID NO: 4374211 - DNA, 19 bp, Homo sapiens
agtcctccctgacttttct

SEQ ID NO: 4374212 - DNA, 22 bp, Homo sapiens
agtcctccctgacttttctgtg

SEQ ID NO: 4374213 - DNA, 20 bp, Homo sapiens
agtcctgcctggccaggcag

SEQ ID NO: 4374214 - DNA, 21 bp, Homo sapiens
agtcctgcctggccaggcaga

SEQ ID NO: 4374215 - DNA, 20 bp, Homo sapiens
agtcctggaagccagctttc

SEQ ID NO: 4374216 - DNA, 22 bp, Homo sapiens
agtcctggaagccagctttccc

SEQ ID NO: 4374217 - DNA, 21 bp, Homo sapiens
agtcctgtagttttattttat

SEQ ID NO: 4374218 - DNA, 17 bp, Homo sapiens
agtcctgtctctgcctg

SEQ ID NO: 4374219 - DNA, 23 bp, Homo sapiens
agtccttatgttaagccctggca

SEQ ID NO: 4374220 - DNA, 13 bp, Homo sapiens
agtcctttttcca

SEQ ID NO: 4374221 - DNA, 21 bp, Homo sapiens
agtcctttttccaatgtttta

SEQ ID NO: 4374222 - DNA, 16 bp, Homo sapiens
agtcctttttttccat

SEQ ID NO: 4374223 - DNA, 21 bp, Homo sapiens
agtcctttttttccatcttta

SEQ ID NO: 4374224 - DNA, 15 bp, Homo sapiens
agtcgctcagtctgt

SEQ ID NO: 4374225 - DNA, 18 bp, Homo sapiens
agtcgtacagaaagctgc

SEQ ID NO: 4374226 - DNA, 14 bp, Homo sapiens
agtcgtgatgtgga

SEQ ID NO: 4374227 - DNA, 17 bp, Homo sapiens
agtcgtgatgtggagga

SEQ ID NO: 4374228 - DNA, 13 bp, Homo sapiens
agtcgttttccaa

SEQ ID NO: 4374229 - DNA, 21 bp, Homo sapiens
agtctaaagctggtttaatgt

SEQ ID NO: 4374230 - DNA, 18 bp, Homo sapiens
agtctaacgctgaactga

SEQ ID NO: 4374231 - DNA, 14 bp, Homo sapiens
agtctacccagaga

SEQ ID NO: 4374232 - DNA, 18 bp, Homo sapiens
agtctagaatgttattgt

SEQ ID NO: 4374233 - DNA, 16 bp, Homo sapiens
agtctagacacaattt

SEQ ID NO: 4374234 - DNA, 19 bp, Homo sapiens
agtctagacacaatttcat

SEQ ID NO: 4374235 - DNA, 22 bp, Homo sapiens
agtctaggagctgggaggaaaa

SEQ ID NO: 4374236 - DNA, 13 bp, Homo sapiens
agtctattgtctc

SEQ ID NO: 4374237 - DNA, 13 bp, Homo sapiens
agtctatttttaa

SEQ ID NO: 4374238 - DNA, 17 bp, Homo sapiens
agtctatttttaatgca

SEQ ID NO: 4374239 - DNA, 19 bp, Homo sapiens
agtctcactctgttgccca

SEQ ID NO: 4374240 - DNA, 13 bp, Homo sapiens
agtctcaggaaat

SEQ ID NO: 4374241 - DNA, 18 bp, Homo sapiens
agtctcaggagtctctgg

SEQ ID NO: 4374242 - DNA, 15 bp, Homo sapiens
agtctcatcctccca

SEQ ID NO: 4374243 - DNA, 19 bp, Homo sapiens
agtctcatcctcccattgc

SEQ ID NO: 4374244 - DNA, 15 bp, Homo sapiens
agtctcatttctcat

SEQ ID NO: 4374245 - DNA, 20 bp, Homo sapiens
agtctcatttgggctagact

SEQ ID NO: 4374246 - DNA, 22 bp, Homo sapiens
agtctccaacatgtttctgttt

SEQ ID NO: 4374247 - DNA, 13 bp, Homo sapiens
agtctccccttcc

SEQ ID NO: 4374248 - DNA, 19 bp, Homo sapiens
agtctccccttcctggcac

SEQ ID NO: 4374249 - DNA, 14 bp, Homo sapiens
agtctcctcactct

SEQ ID NO: 4374250 - DNA, 15 bp, Homo sapiens
agtctcctcactctg

SEQ ID NO: 4374251 - DNA, 20 bp, Homo sapiens
agtctcctcactctgtccct

SEQ ID NO: 4374252 - DNA, 23 bp, Homo sapiens
agtctcctcactctgtccctgtc

SEQ ID NO: 4374253 - DNA, 13 bp, Homo sapiens
agtctcctcttta

SEQ ID NO: 4374254 - DNA, 18 bp, Homo sapiens
agtctcctctttaaaaca

SEQ ID NO: 4374255 - DNA, 21 bp, Homo sapiens
agtctcctctttaaaacaaaa

SEQ ID NO: 4374256 - DNA, 22 bp, Homo sapiens
agtctcctctttaaaacaaaac

SEQ ID NO: 4374257 - DNA, 12 bp, Homo sapiens
agtctctattta

SEQ ID NO: 4374258 - DNA, 18 bp, Homo sapiens
agtctctatttaaattct

SEQ ID NO: 4374259 - DNA, 13 bp, Homo sapiens
agtctctcctgta

SEQ ID NO: 4374260 - DNA, 16 bp, Homo sapiens
agtctctcttctctcc

SEQ ID NO: 4374261 - DNA, 21 bp, Homo sapiens
agtctctcttctctccagctg

SEQ ID NO: 4374262 - DNA, 11 bp, Homo sapiens
agtctctgagc

SEQ ID NO: 4374263 - DNA, 21 bp, Homo sapiens
agtctctggggcaggctgctt

SEQ ID NO: 4374264 - DNA, 23 bp, Homo sapiens
agtctctgtataatctatttaca

SEQ ID NO: 4374265 - DNA, 23 bp, Homo sapiens
agtctgagagaggccattctttc

SEQ ID NO: 4374266 - DNA, 19 bp, Homo sapiens
agtctgagtcctgtctctg

SEQ ID NO: 4374267 - DNA, 23 bp, Homo sapiens
agtctgagtcctgtctctgcctg

SEQ ID NO: 4374268 - DNA, 16 bp, Homo sapiens
agtctgatgttctttc

SEQ ID NO: 4374269 - DNA, 22 bp, Homo sapiens
agtctgattataccatgtgtgc

SEQ ID NO: 4374270 - DNA, 16 bp, Homo sapiens
agtctgatttttaaga

SEQ ID NO: 4374271 - DNA, 17 bp, Homo sapiens
agtctgatttttaagat

SEQ ID NO: 4374272 - DNA, 17 bp, Homo sapiens
agtctgcatttcatatt

SEQ ID NO: 4374273 - DNA, 11 bp, Homo sapiens
agtctgccact

SEQ ID NO: 4374274 - DNA, 13 bp, Homo sapiens
agtctgctttctc

SEQ ID NO: 4374275 - DNA, 16 bp, Homo sapiens
agtctgctttctctac

SEQ ID NO: 4374276 - DNA, 17 bp, Homo sapiens
agtctggatctgggacc

SEQ ID NO: 4374277 - DNA, 22 bp, Homo sapiens
agtctggcaccatgttggcctc

SEQ ID NO: 4374278 - DNA, 15 bp, Homo sapiens
agtctggggacctgg

SEQ ID NO: 4374279 - DNA, 15 bp, Homo sapiens
agtctggtgaagctc

SEQ ID NO: 4374280 - DNA, 13 bp, Homo sapiens
agtctgtcatgaa

SEQ ID NO: 4374281 - DNA, 20 bp, Homo sapiens
agtctgtgccacgtgtttgt

SEQ ID NO: 4374282 - DNA, 15 bp, Homo sapiens
agtctgtgtgaaggt

SEQ ID NO: 4374283 - DNA, 18 bp, Homo sapiens
agtctgtgtgggactgta

SEQ ID NO: 4374284 - DNA, 14 bp, Homo sapiens
agtctgttgcattt

SEQ ID NO: 4374285 - DNA, 24 bp, Homo sapiens
agtcttaaaataaaaataaattta

SEQ ID NO: 4374286 - DNA, 19 bp, Homo sapiens
agtcttaactgtatttcag

SEQ ID NO: 4374287 - DNA, 19 bp, Homo sapiens
agtcttaagggtcactggc

SEQ ID NO: 4374288 - DNA, 22 bp, Homo sapiens
agtcttacataaaccatttttg

SEQ ID NO: 4374289 - DNA, 21 bp, Homo sapiens
agtcttccacaaagaaaattc

SEQ ID NO: 4374290 - DNA, 17 bp, Homo sapiens
agtcttccatttgcaag

SEQ ID NO: 4374291 - DNA, 12 bp, Homo sapiens
agtcttcctgac

SEQ ID NO: 4374292 - DNA, 15 bp, Homo sapiens
agtcttcctgacact

SEQ ID NO: 4374293 - DNA, 18 bp, Homo sapiens
agtcttgaaatgaaaggg

SEQ ID NO: 4374294 - DNA, 20 bp, Homo sapiens
agtcttgaaatgaaagggaa

SEQ ID NO: 4374295 - DNA, 22 bp, Homo sapiens
agtcttgaaatgaaagggaaac

SEQ ID NO: 4374296 - DNA, 23 bp, Homo sapiens
agtcttgaaatgaaagggaaact

SEQ ID NO: 4374297 - DNA, 20 bp, Homo sapiens
agtcttgtcccaattaaaat

SEQ ID NO: 4374298 - DNA, 12 bp, Homo sapiens
agtcttgtgaaa

SEQ ID NO: 4374299 - DNA, 13 bp, Homo sapiens
agtcttgtgaaag

SEQ ID NO: 4374300 - DNA, 14 bp, Homo sapiens
agtcttgtgaactt

SEQ ID NO: 4374301 - DNA, 18 bp, Homo sapiens
agtctttagctattactg

SEQ ID NO: 4374302 - DNA, 17 bp, Homo sapiens
agtctttcaactgtttc

SEQ ID NO: 4374303 - DNA, 22 bp, Homo sapiens
agtctttcattcggtgtgaact

SEQ ID NO: 4374304 - DNA, 19 bp, Homo sapiens
agtctttccttagttaaaa

SEQ ID NO: 4374305 - DNA, 19 bp, Homo sapiens
agtctttgagactaaattc

SEQ ID NO: 4374306 - DNA, 13 bp, Homo sapiens
agtctttgtttac

SEQ ID NO: 4374307 - DNA, 15 bp, Homo sapiens
agtcttttgtaatat

SEQ ID NO: 4374308 - DNA, 20 bp, Homo sapiens
agtcttttgtaatatcaagc

SEQ ID NO: 4374309 - DNA, 14 bp, Homo sapiens
agtctttttttcct

SEQ ID NO: 4374310 - DNA, 16 bp, Homo sapiens
agtgaaagctagagat

SEQ ID NO: 4374311 - DNA, 14 bp, Homo sapiens
agtgaaataataga

SEQ ID NO: 4374312 - DNA, 21 bp, Homo sapiens
agtgaaccaaaaatagaaatt

SEQ ID NO: 4374313 - DNA, 21 bp, Homo sapiens
agtgaagactagaaaattaga

SEQ ID NO: 4374314 - DNA, 23 bp, Homo sapiens
agtgaatacattaacggtgctaa

SEQ ID NO: 4374315 - DNA, 12 bp, Homo sapiens
agtgaattgaag

SEQ ID NO: 4374316 - DNA, 14 bp, Homo sapiens
agtgaatttttgca

SEQ ID NO: 4374317 - DNA, 16 bp, Homo sapiens
agtgaccagtgcctgt

SEQ ID NO: 4374318 - DNA, 20 bp, Homo sapiens
agtgaccattattcacaggt

SEQ ID NO: 4374319 - DNA, 15 bp, Homo sapiens
agtgacctcggacag

SEQ ID NO: 4374320 - DNA, 14 bp, Homo sapiens
agtgactctccagg

SEQ ID NO: 4374321 - DNA, 17 bp, Homo sapiens
agtgagaaaactgtgac

SEQ ID NO: 4374322 - DNA, 14 bp, Homo sapiens
agtgagacagctct

SEQ ID NO: 4374323 - DNA, 15 bp, Homo sapiens
agtgagaccctgtct

SEQ ID NO: 4374324 - DNA, 15 bp, Homo sapiens
agtgagactccatct

SEQ ID NO: 4374325 - DNA, 16 bp, Homo sapiens
agtgagactgtacata

SEQ ID NO: 4374326 - DNA, 17 bp, Homo sapiens
agtgagcccctccccag

SEQ ID NO: 4374327 - DNA, 19 bp, Homo sapiens
agtgagcccctccccagcc

SEQ ID NO: 4374328 - DNA, 14 bp, Homo sapiens
agtgagccctgctc

SEQ ID NO: 4374329 - DNA, 16 bp, Homo sapiens
agtgagccctgctctt

SEQ ID NO: 4374330 - DNA, 20 bp, Homo sapiens
agtgagccgcatcttctcca

SEQ ID NO: 4374331 - DNA, 24 bp, Homo sapiens
agtgagccgcatcttctccatctg

SEQ ID NO: 4374332 - DNA, 21 bp, Homo sapiens
agtgagcctcctgtgcctggc

SEQ ID NO: 4374333 - DNA, 13 bp, Homo sapiens
agtgagggaggag

SEQ ID NO: 4374334 - DNA, 16 bp, Homo sapiens
agtgaggtgtgtcaca

SEQ ID NO: 4374335 - DNA, 22 bp, Homo sapiens
agtgagtcgagattgcactgct

SEQ ID NO: 4374336 - DNA, 18 bp, Homo sapiens
agtgagttgttgccctgg

SEQ ID NO: 4374337 - DNA, 19 bp, Homo sapiens
agtgagttttttagtgcgt

SEQ ID NO: 4374338 - DNA, 22 bp, Homo sapiens
agtgataatgttcattttgaaa

SEQ ID NO: 4374339 - DNA, 23 bp, Homo sapiens
agtgatacaacttcaagtgcatg

SEQ ID NO: 4374340 - DNA, 13 bp, Homo sapiens
agtgatactggct

SEQ ID NO: 4374341 - DNA, 13 bp, Homo sapiens
agtgatgaatgta

SEQ ID NO: 4374342 - DNA, 21 bp, Homo sapiens
agtgatggagttccttctggt

SEQ ID NO: 4374343 - DNA, 13 bp, Homo sapiens
agtgattaccagg

SEQ ID NO: 4374344 - DNA, 15 bp, Homo sapiens
agtgattgtcttaat

SEQ ID NO: 4374345 - DNA, 20 bp, Homo sapiens
agtgatttttatgccacctg

SEQ ID NO: 4374346 - DNA, 21 bp, Homo sapiens
agtgatttttatgccacctga

SEQ ID NO: 4374347 - DNA, 21 bp, Homo sapiens
agtgcaaaaactgtaaaagtg

SEQ ID NO: 4374348 - DNA, 13 bp, Homo sapiens
agtgcaacactgg

SEQ ID NO: 4374349 - DNA, 24 bp, Homo sapiens
agtgcaacttagatctctcctgca

SEQ ID NO: 4374350 - DNA, 12 bp, Homo sapiens
agtgcaatgggt

SEQ ID NO: 4374351 - DNA, 18 bp, Homo sapiens
agtgcaattccaagaaaa

SEQ ID NO: 4374352 - DNA, 23 bp, Homo sapiens
agtgcactccggcctgggtgaca

SEQ ID NO: 4374353 - DNA, 20 bp, Homo sapiens
agtgcactgcattcctgtgc

SEQ ID NO: 4374354 - DNA, 12 bp, Homo sapiens
agtgcagagaaa

SEQ ID NO: 4374355 - DNA, 16 bp, Homo sapiens
agtgcagcagaggaca

SEQ ID NO: 4374356 - DNA, 22 bp, Homo sapiens
agtgcagccaagtagcctctcc

SEQ ID NO: 4374357 - DNA, 14 bp, Homo sapiens
agtgcagccactgg

SEQ ID NO: 4374358 - DNA, 16 bp, Homo sapiens
agtgcagggcaaaata

SEQ ID NO: 4374359 - DNA, 19 bp, Homo sapiens
agtgcaggtgcagtttcat

SEQ ID NO: 4374360 - DNA, 17 bp, Homo sapiens
agtgcagtccatttcct

SEQ ID NO: 4374361 - DNA, 16 bp, Homo sapiens
agtgcatctcagatgc

SEQ ID NO: 4374362 - DNA, 17 bp, Homo sapiens
agtgcatgctctctgca

SEQ ID NO: 4374363 - DNA, 14 bp, Homo sapiens
agtgcatgtgcatg

SEQ ID NO: 4374364 - DNA, 21 bp, Homo sapiens
agtgcatttgtgctagaaatt

SEQ ID NO: 4374365 - DNA, 13 bp, Homo sapiens
agtgcatttttaa

SEQ ID NO: 4374366 - DNA, 15 bp, Homo sapiens
agtgccacctatgcc

SEQ ID NO: 4374367 - DNA, 17 bp, Homo sapiens
agtgccacctatgcctg

SEQ ID NO: 4374368 - DNA, 17 bp, Homo sapiens
agtgccactgttgtttt

SEQ ID NO: 4374369 - DNA, 16 bp, Homo sapiens
agtgccacttaatgta

SEQ ID NO: 4374370 - DNA, 21 bp, Homo sapiens
agtgccacttaatgtatgtta

SEQ ID NO: 4374371 - DNA, 12 bp, Homo sapiens
agtgccagcatt

SEQ ID NO: 4374372 - DNA, 13 bp, Homo sapiens
agtgccagcattc

SEQ ID NO: 4374373 - DNA, 17 bp, Homo sapiens
agtgccagcattccaga

SEQ ID NO: 4374374 - DNA, 18 bp, Homo sapiens
agtgccaggatggaatga

SEQ ID NO: 4374375 - DNA, 14 bp, Homo sapiens
agtgccattgtctt

SEQ ID NO: 4374376 - DNA, 16 bp, Homo sapiens
agtgccattgtcttta

SEQ ID NO: 4374377 - DNA, 18 bp, Homo sapiens
agtgccattgtctttata

SEQ ID NO: 4374378 - DNA, 20 bp, Homo sapiens
agtgcccaccaacatcccat

SEQ ID NO: 4374379 - DNA, 21 bp, Homo sapiens
agtgccccagggagtccaggg

SEQ ID NO: 4374380 - DNA, 14 bp, Homo sapiens
agtgccgaggacat

SEQ ID NO: 4374381 - DNA, 15 bp, Homo sapiens
agtgcctagactgtt

SEQ ID NO: 4374382 - DNA, 19 bp, Homo sapiens
agtgcctctccctgctgct

SEQ ID NO: 4374383 - DNA, 23 bp, Homo sapiens
agtgcctcttctttttcttcttg

SEQ ID NO: 4374384 - DNA, 23 bp, Homo sapiens
agtgcctgccactctctgggact

SEQ ID NO: 4374385 - DNA, 21 bp, Homo sapiens
agtgcctgtaatcacagctac

SEQ ID NO: 4374386 - DNA, 23 bp, Homo sapiens
agtgcctgtgagcatggggccag

SEQ ID NO: 4374387 - DNA, 22 bp, Homo sapiens
agtgccttggggaatttcctct

SEQ ID NO: 4374388 - DNA, 14 bp, Homo sapiens
agtgccttttggaa

SEQ ID NO: 4374389 - DNA, 21 bp, Homo sapiens
agtgcgggctgaggccagagt

SEQ ID NO: 4374390 - DNA, 21 bp, Homo sapiens
agtgctctgatccctctacag

SEQ ID NO: 4374391 - DNA, 12 bp, Homo sapiens
agtgctctgcct

SEQ ID NO: 4374392 - DNA, 13 bp, Homo sapiens
agtgctctgcctc

SEQ ID NO: 4374393 - DNA, 16 bp, Homo sapiens
agtgctctgcctcaga

SEQ ID NO: 4374394 - DNA, 17 bp, Homo sapiens
agtgctctgcctcagac

SEQ ID NO: 4374395 - DNA, 15 bp, Homo sapiens
agtgctgaatttccc

SEQ ID NO: 4374396 - DNA, 16 bp, Homo sapiens
agtgctgcagcctaat

SEQ ID NO: 4374397 - DNA, 22 bp, Homo sapiens
agtgctgcagctccctggcttc

SEQ ID NO: 4374398 - DNA, 16 bp, Homo sapiens
agtgctgcccatgagc

SEQ ID NO: 4374399 - DNA, 12 bp, Homo sapiens
agtgctggactg

SEQ ID NO: 4374400 - DNA, 17 bp, Homo sapiens
agtgctggatttgatga

SEQ ID NO: 4374401 - DNA, 16 bp, Homo sapiens
agtgctggcccaccca

SEQ ID NO: 4374402 - DNA, 20 bp, Homo sapiens
agtgctggcccacccagtcc

SEQ ID NO: 4374403 - DNA, 20 bp, Homo sapiens
agtgctgggattacaggcgt

SEQ ID NO: 4374404 - DNA, 23 bp, Homo sapiens
agtgctggtcagagagacctcat

SEQ ID NO: 4374405 - DNA, 20 bp, Homo sapiens
agtgctgtccatgcttctca

SEQ ID NO: 4374406 - DNA, 22 bp, Homo sapiens
agtgctgtctgatctgtgcttt

SEQ ID NO: 4374407 - DNA, 18 bp, Homo sapiens
agtgctgtgttttagtct

SEQ ID NO: 4374408 - DNA, 21 bp, Homo sapiens
agtgctgtttattaatcttag

SEQ ID NO: 4374409 - DNA, 18 bp, Homo sapiens
agtgcttcacaaaatgca

SEQ ID NO: 4374410 - DNA, 21 bp, Homo sapiens
agtgcttcacaggttttatgt

SEQ ID NO: 4374411 - DNA, 23 bp, Homo sapiens
agtgcttcacaggttttatgtgt

SEQ ID NO: 4374412 - DNA, 14 bp, Homo sapiens
agtgcttcctacaa

SEQ ID NO: 4374413 - DNA, 19 bp, Homo sapiens
agtgcttctccaacactga

SEQ ID NO: 4374414 - DNA, 19 bp, Homo sapiens
agtgcttgagtttggggaa

SEQ ID NO: 4374415 - DNA, 13 bp, Homo sapiens
agtgctttgtgat

SEQ ID NO: 4374416 - DNA, 19 bp, Homo sapiens
agtgcttttaagtgaaaat

SEQ ID NO: 4374417 - DNA, 12 bp, Homo sapiens
agtggaaaaaca

SEQ ID NO: 4374418 - DNA, 14 bp, Homo sapiens
agtggaaaaacaca

SEQ ID NO: 4374419 - DNA, 21 bp, Homo sapiens
agtggaaaataggctttttaa

SEQ ID NO: 4374420 - DNA, 20 bp, Homo sapiens
agtggaaactatgtgttttt

SEQ ID NO: 4374421 - DNA, 15 bp, Homo sapiens
agtggaaatgttcta

SEQ ID NO: 4374422 - DNA, 16 bp, Homo sapiens
agtggaaggaagaaca

SEQ ID NO: 4374423 - DNA, 13 bp, Homo sapiens
agtggaccaggac

SEQ ID NO: 4374424 - DNA, 14 bp, Homo sapiens
agtggaccaggaca

SEQ ID NO: 4374425 - DNA, 15 bp, Homo sapiens
agtggaccaggacag

SEQ ID NO: 4374426 - DNA, 15 bp, Homo sapiens
agtggactggcccct

SEQ ID NO: 4374427 - DNA, 14 bp, Homo sapiens
agtggagtctgagt

SEQ ID NO: 4374428 - DNA, 18 bp, Homo sapiens
agtggagtctgagtctga

SEQ ID NO: 4374429 - DNA, 15 bp, Homo sapiens
agtggatcacaaagt

SEQ ID NO: 4374430 - DNA, 16 bp, Homo sapiens
agtggatcacaaagtg

SEQ ID NO: 4374431 - DNA, 14 bp, Homo sapiens
agtggatcttcaga

SEQ ID NO: 4374432 - DNA, 18 bp, Homo sapiens
agtggatcttcagaactg

SEQ ID NO: 4374433 - DNA, 23 bp, Homo sapiens
agtggatgatatacacagtggca

SEQ ID NO: 4374434 - DNA, 13 bp, Homo sapiens
agtgttttcagag

SEQ ID NO: 4374435 - DNA, 16 bp, Homo sapiens
agttaaagaaaggaaa

SEQ ID NO: 4374436 - DNA, 18 bp, Homo sapiens
agttaaagaaaggaaaag

SEQ ID NO: 4374437 - DNA, 11 bp, Homo sapiens
agttaaataaa

SEQ ID NO: 4374438 - DNA, 14 bp, Homo sapiens
agttaaatctcaaa

SEQ ID NO: 4374439 - DNA, 17 bp, Homo sapiens
agttaactattgcattt

SEQ ID NO: 4374440 - DNA, 20 bp, Homo sapiens
agttaagcaaatttcatttc

SEQ ID NO: 4374441 - DNA, 15 bp, Homo sapiens
agttaatgtatataa

SEQ ID NO: 4374442 - DNA, 18 bp, Homo sapiens
agttaatgtatataaaaa

SEQ ID NO: 4374443 - DNA, 16 bp, Homo sapiens
agttaattcttaaaac

SEQ ID NO: 4374444 - DNA, 18 bp, Homo sapiens
agttaattcttaaaacta

SEQ ID NO: 4374445 - DNA, 23 bp, Homo sapiens
agttaattcttaaaactataaca

SEQ ID NO: 4374446 - DNA, 15 bp, Homo sapiens
agttaatttttccaa

SEQ ID NO: 4374447 - DNA, 16 bp, Homo sapiens
agttacacatttttca

SEQ ID NO: 4374448 - DNA, 19 bp, Homo sapiens
agttacacatttttcagat

SEQ ID NO: 4374449 - DNA, 17 bp, Homo sapiens
agttacagttgatgttt

SEQ ID NO: 4374450 - DNA, 20 bp, Homo sapiens
agttacctggaatcaaataa

SEQ ID NO: 4374451 - DNA, 20 bp, Homo sapiens
agttaccttatagttactgt

SEQ ID NO: 4374452 - DNA, 22 bp, Homo sapiens
agttaccttatagttactgtgt

SEQ ID NO: 4374453 - DNA, 17 bp, Homo sapiens
agttacgtataatgctt

SEQ ID NO: 4374454 - DNA, 16 bp, Homo sapiens
agttactaaaattatg

SEQ ID NO: 4374455 - DNA, 14 bp, Homo sapiens
agttactaaaattt

SEQ ID NO: 4374456 - DNA, 12 bp, Homo sapiens
agttactcagcc

SEQ ID NO: 4374457 - DNA, 16 bp, Homo sapiens
agttactcagccctgg

SEQ ID NO: 4374458 - DNA, 21 bp, Homo sapiens
agttactcccttctcgtgttt

SEQ ID NO: 4374459 - DNA, 14 bp, Homo sapiens
agttactgtgtaat

SEQ ID NO: 4374460 - DNA, 16 bp, Homo sapiens
agttactgtgtaatta

SEQ ID NO: 4374461 - DNA, 15 bp, Homo sapiens
agttagaacatttgc

SEQ ID NO: 4374462 - DNA, 16 bp, Homo sapiens
agttagaaccacagca

SEQ ID NO: 4374463 - DNA, 20 bp, Homo sapiens
agttagaaccacagcagaca

SEQ ID NO: 4374464 - DNA, 21 bp, Homo sapiens
agttagagaactaaactagtt

SEQ ID NO: 4374465 - DNA, 16 bp, Homo sapiens
agttagatctttgtaa

SEQ ID NO: 4374466 - DNA, 19 bp, Homo sapiens
agttagcagggatgttcct

SEQ ID NO: 4374467 - DNA, 20 bp, Homo sapiens
agttagcagggatgttcctt

SEQ ID NO: 4374468 - DNA, 23 bp, Homo sapiens
agttagccatctaatgcttgttt

SEQ ID NO: 4374469 - DNA, 20 bp, Homo sapiens
agttagtatcttttgatatg

SEQ ID NO: 4374470 - DNA, 14 bp, Homo sapiens
agttagtggaaatc

SEQ ID NO: 4374471 - DNA, 14 bp, Homo sapiens
agttataaaattaa

SEQ ID NO: 4374472 - DNA, 15 bp, Homo sapiens
agttataaaattaaa

SEQ ID NO: 4374473 - DNA, 18 bp, Homo sapiens
agttataaaattaaaagt

SEQ ID NO: 4374474 - DNA, 18 bp, Homo sapiens
agttatacagttataaaa

SEQ ID NO: 4374475 - DNA, 21 bp, Homo sapiens
agttatacagttataaaatta

SEQ ID NO: 4374476 - DNA, 16 bp, Homo sapiens
agttataggattttca

SEQ ID NO: 4374477 - DNA, 19 bp, Homo sapiens
agttatatttcagatgtaa

SEQ ID NO: 4374478 - DNA, 22 bp, Homo sapiens
agttatatttcagatgtaatgt

SEQ ID NO: 4374479 - DNA, 15 bp, Homo sapiens
agttatcatgaattt

SEQ ID NO: 4374480 - DNA, 20 bp, Homo sapiens
agttatcatgaattttaaag

SEQ ID NO: 4374481 - DNA, 14 bp, Homo sapiens
agttatctattgaa

SEQ ID NO: 4374482 - DNA, 14 bp, Homo sapiens
agttatctgtttgt

SEQ ID NO: 4374483 - DNA, 17 bp, Homo sapiens
agttatcttctttatta

SEQ ID NO: 4374484 - DNA, 22 bp, Homo sapiens
agttatcttctttattattcct

SEQ ID NO: 4374485 - DNA, 17 bp, Homo sapiens
agttatggtgatgactt

SEQ ID NO: 4374486 - DNA, 18 bp, Homo sapiens
agttatggtgatgactta

SEQ ID NO: 4374487 - DNA, 18 bp, Homo sapiens
agttatgtatttaaagtt

SEQ ID NO: 4374488 - DNA, 15 bp, Homo sapiens
agttattcaaatgaa

SEQ ID NO: 4374489 - DNA, 16 bp, Homo sapiens
agttattcaaatgaag

SEQ ID NO: 4374490 - DNA, 22 bp, Homo sapiens
agttattccacaaacacattat

SEQ ID NO: 4374491 - DNA, 20 bp, Homo sapiens
agttattcttgtcattttga

SEQ ID NO: 4374492 - DNA, 13 bp, Homo sapiens
agttattgcagtt

SEQ ID NO: 4374493 - DNA, 18 bp, Homo sapiens
agttattgcagtttatca

SEQ ID NO: 4374494 - DNA, 21 bp, Homo sapiens
agttatttcatcttttattca

SEQ ID NO: 4374495 - DNA, 23 bp, Homo sapiens
agttattttctacagtggtttta

SEQ ID NO: 4374496 - DNA, 20 bp, Homo sapiens
agttcaacctggtggcacca

SEQ ID NO: 4374497 - DNA, 22 bp, Homo sapiens
agttcaacctggtggcaccaga

SEQ ID NO: 4374498 - DNA, 19 bp, Homo sapiens
agttcaagaaataagtttt

SEQ ID NO: 4374499 - DNA, 16 bp, Homo sapiens
agttcaagaccagcct

SEQ ID NO: 4374500 - DNA, 19 bp, Homo sapiens
agttcaagactagcctggc

SEQ ID NO: 4374501 - DNA, 22 bp, Homo sapiens
agttcaagcctgtgggagtaga

SEQ ID NO: 4374502 - DNA, 22 bp, Homo sapiens
agttcaattgtgaaaatgaata

SEQ ID NO: 4374503 - DNA, 15 bp, Homo sapiens
agttcagcaaaactg

SEQ ID NO: 4374504 - DNA, 14 bp, Homo sapiens
agttcagcacttgt

SEQ ID NO: 4374505 - DNA, 18 bp, Homo sapiens
agttcataaatttatggt

SEQ ID NO: 4374506 - DNA, 18 bp, Homo sapiens
agttcataacagtgccat

SEQ ID NO: 4374507 - DNA, 18 bp, Homo sapiens
agttcatcgattttctat

SEQ ID NO: 4374508 - DNA, 23 bp, Homo sapiens
agttcattagaaatattttaaaa

SEQ ID NO: 4374509 - DNA, 15 bp, Homo sapiens
agttcattgcaatta

SEQ ID NO: 4374510 - DNA, 19 bp, Homo sapiens
agttccagccttctctcaa

SEQ ID NO: 4374511 - DNA, 20 bp, Homo sapiens
agttccagtcctaactttct

SEQ ID NO: 4374512 - DNA, 14 bp, Homo sapiens
agttcccaagaaag

SEQ ID NO: 4374513 - DNA, 23 bp, Homo sapiens
agttcccaagaaaggaaaccttt

SEQ ID NO: 4374514 - DNA, 16 bp, Homo sapiens
agttccccaaatacaa

SEQ ID NO: 4374515 - DNA, 21 bp, Homo sapiens
agttccctgaaaacccagaga

SEQ ID NO: 4374516 - DNA, 13 bp, Homo sapiens
agttcccttggcc

SEQ ID NO: 4374517 - DNA, 16 bp, Homo sapiens
agttcccttggcctca

SEQ ID NO: 4374518 - DNA, 15 bp, Homo sapiens
agttcctcgccctgg

SEQ ID NO: 4374519 - DNA, 13 bp, Homo sapiens
agttcctctgggt

SEQ ID NO: 4374520 - DNA, 19 bp, Homo sapiens
agttccttatccctctctt

SEQ ID NO: 4374521 - DNA, 18 bp, Homo sapiens
agttcgagaccaacctga

SEQ ID NO: 4374522 - DNA, 21 bp, Homo sapiens
agttctaaaaagatgtaataa

SEQ ID NO: 4374523 - DNA, 10 bp, Homo sapiens
agttctagat

SEQ ID NO: 4374524 - DNA, 13 bp, Homo sapiens
agttctataagaa

SEQ ID NO: 4374525 - DNA, 21 bp, Homo sapiens
agttctatccttttgcctgca

SEQ ID NO: 4374526 - DNA, 18 bp, Homo sapiens
agttctatggagactttg

SEQ ID NO: 4374527 - DNA, 22 bp, Homo sapiens
agttctatggagactttgctgt

SEQ ID NO: 4374528 - DNA, 23 bp, Homo sapiens
agttctatggagactttgctgtt

SEQ ID NO: 4374529 - DNA, 13 bp, Homo sapiens
agttctcagagct

SEQ ID NO: 4374530 - DNA, 16 bp, Homo sapiens
agttctctcccttcct

SEQ ID NO: 4374531 - DNA, 22 bp, Homo sapiens
agttctctcccttcctctctcc

SEQ ID NO: 4374532 - DNA, 14 bp, Homo sapiens
agttctgagctgta

SEQ ID NO: 4374533 - DNA, 20 bp, Homo sapiens
agttctgcaaatagaaaaca

SEQ ID NO: 4374534 - DNA, 15 bp, Homo sapiens
agttctgtaatgtag

SEQ ID NO: 4374535 - DNA, 19 bp, Homo sapiens
agttctgtgcctcccccca

SEQ ID NO: 4374536 - DNA, 20 bp, Homo sapiens
agttctgtgcctccccccag

SEQ ID NO: 4374537 - DNA, 23 bp, Homo sapiens
agttctgtgcctccccccagacc

SEQ ID NO: 4374538 - DNA, 20 bp, Homo sapiens
agttcttaaaaaatttatac

SEQ ID NO: 4374539 - DNA, 23 bp, Homo sapiens
agttcttacaataaaccctcctt

SEQ ID NO: 4374540 - DNA, 15 bp, Homo sapiens
agttcttcctgtaat

SEQ ID NO: 4374541 - DNA, 12 bp, Homo sapiens
agttctttcctc

SEQ ID NO: 4374542 - DNA, 13 bp, Homo sapiens
agttctttcctcc

SEQ ID NO: 4374543 - DNA, 21 bp, Homo sapiens
agttctttcctccccctgcaa

SEQ ID NO: 4374544 - DNA, 22 bp, Homo sapiens
agttctttcctccccctgcaac

SEQ ID NO: 4374545 - DNA, 18 bp, Homo sapiens
agttctttgctgcccctg

SEQ ID NO: 4374546 - DNA, 20 bp, Homo sapiens
agttctttgctgcccctgtc

SEQ ID NO: 4374547 - DNA, 23 bp, Homo sapiens
agttctttttgccagttttccct

SEQ ID NO: 4374548 - DNA, 13 bp, Homo sapiens
agttgaataaaca

SEQ ID NO: 4374549 - DNA, 11 bp, Homo sapiens
agttgaccttt

SEQ ID NO: 4374550 - DNA, 23 bp, Homo sapiens
agttgacctttatttattaaact

SEQ ID NO: 4374551 - DNA, 18 bp, Homo sapiens
agttgacttatagtacat

SEQ ID NO: 4374552 - DNA, 21 bp, Homo sapiens
agttttgtggattaaaccttt

SEQ ID NO: 4374553 - DNA, 12 bp, Homo sapiens
agttttgtgttt

SEQ ID NO: 4374554 - DNA, 16 bp, Homo sapiens
agtttttaatttgatg

SEQ ID NO: 4374555 - DNA, 14 bp, Homo sapiens
agtttttcacttct

SEQ ID NO: 4374556 - DNA, 12 bp, Homo sapiens
agtttttcatac

SEQ ID NO: 4374557 - DNA, 20 bp, Homo sapiens
agtttttcattaaataaatt

SEQ ID NO: 4374558 - DNA, 19 bp, Homo sapiens
agtttttgtttttgcatga

SEQ ID NO: 4374559 - DNA, 22 bp, Homo sapiens
agttttttgaaaatgggctcaa

SEQ ID NO: 4374560 - DNA, 16 bp, Homo sapiens
agtttttttttttcca

SEQ ID NO: 4374561 - DNA, 17 bp, Homo sapiens
agtttttttttttccag

SEQ ID NO: 4374562 - DNA, 22 bp, Homo sapiens
ataaaaaaaaatagatgtcttt

SEQ ID NO: 4374563 - DNA, 19 bp, Homo sapiens
ataaaaaagaacttttgta

SEQ ID NO: 4374564 - DNA, 15 bp, Homo sapiens
ataaaaaagtctcta

SEQ ID NO: 4374565 - DNA, 14 bp, Homo sapiens
ataaaaaatatgta

SEQ ID NO: 4374566 - DNA, 16 bp, Homo sapiens
ataaaaaatcatgcca

SEQ ID NO: 4374567 - DNA, 14 bp, Homo sapiens
ataaaaaatctgaa

SEQ ID NO: 4374568 - DNA, 12 bp, Homo sapiens
ataaaaaattaa

SEQ ID NO: 4374569 - DNA, 22 bp, Homo sapiens
ataaaaaattaacttagttttt

SEQ ID NO: 4374570 - DNA, 23 bp, Homo sapiens
ataaaaacattgcctttgaatgt

SEQ ID NO: 4374571 - DNA, 14 bp, Homo sapiens
ataaaaactgattt

SEQ ID NO: 4374572 - DNA, 18 bp, Homo sapiens
ataaaaagatcactttct

SEQ ID NO: 4374573 - DNA, 17 bp, Homo sapiens
ataaaaagcttccatga

SEQ ID NO: 4374574 - DNA, 11 bp, Homo sapiens
ataaaaaggaa

SEQ ID NO: 4374575 - DNA, 11 bp, Homo sapiens
ataaaaaggac

SEQ ID NO: 4374576 - DNA, 14 bp, Homo sapiens
ataaaaaggacatc

SEQ ID NO: 4374577 - DNA, 12 bp, Homo sapiens
ataaaaaggtgt

SEQ ID NO: 4374578 - DNA, 14 bp, Homo sapiens
ataaaaatataaat

SEQ ID NO: 4374579 - DNA, 16 bp, Homo sapiens
ataaaaatgatctaaa

SEQ ID NO: 4374580 - DNA, 16 bp, Homo sapiens
ataaaaattctagatt

SEQ ID NO: 4374581 - DNA, 14 bp, Homo sapiens
ataaaaattgatga

SEQ ID NO: 4374582 - DNA, 15 bp, Homo sapiens
ataaaaatttattat

SEQ ID NO: 4374583 - DNA, 12 bp, Homo sapiens
ataaaacaggta

SEQ ID NO: 4374584 - DNA, 21 bp, Homo sapiens
ataaaacagtcatggcctgag

SEQ ID NO: 4374585 - DNA, 23 bp, Homo sapiens
ataaaacattaattgctaacaat

SEQ ID NO: 4374586 - DNA, 17 bp, Homo sapiens
ataaaaccaaacatgct

SEQ ID NO: 4374587 - DNA, 19 bp, Homo sapiens
ataaaactgtttgacttct

SEQ ID NO: 4374588 - DNA, 23 bp, Homo sapiens
ataaaactgtttgacttctcaag

SEQ ID NO: 4374589 - DNA, 18 bp, Homo sapiens
ataaaacttaaaaacaag

SEQ ID NO: 4374590 - DNA, 19 bp, Homo sapiens
ataaaagcaattccaacct

SEQ ID NO: 4374591 - DNA, 21 bp, Homo sapiens
ataaaagcaattctgactgtc

SEQ ID NO: 4374592 - DNA, 16 bp, Homo sapiens
ataaaagcacactgct

SEQ ID NO: 4374593 - DNA, 23 bp, Homo sapiens
ataaaagcaccactgttctgttc

SEQ ID NO: 4374594 - DNA, 19 bp, Homo sapiens
ataaaagctttgactccct

SEQ ID NO: 4374595 - DNA, 15 bp, Homo sapiens
ataaaagtacatgtt

SEQ ID NO: 4374596 - DNA, 13 bp, Homo sapiens
ataaaataactaa

SEQ ID NO: 4374597 - DNA, 18 bp, Homo sapiens
ataaaataactaaaatgt

SEQ ID NO: 4374598 - DNA, 16 bp, Homo sapiens
ataaaatattattgaa

SEQ ID NO: 4374599 - DNA, 18 bp, Homo sapiens
ataaaatattattgaact

SEQ ID NO: 4374600 - DNA, 22 bp, Homo sapiens
ataaaatattttgttaactttt

SEQ ID NO: 4374601 - DNA, 13 bp, Homo sapiens
ataaaatgaaaat

SEQ ID NO: 4374602 - DNA, 18 bp, Homo sapiens
ataaaatgcccatttcga

SEQ ID NO: 4374603 - DNA, 12 bp, Homo sapiens
ataaaatgcctc

SEQ ID NO: 4374604 - DNA, 15 bp, Homo sapiens
ataaaattaaaagtt

SEQ ID NO: 4374605 - DNA, 14 bp, Homo sapiens
ataaaattctgtaa

SEQ ID NO: 4374606 - DNA, 19 bp, Homo sapiens
ataaacaagtcaaagactt

SEQ ID NO: 4374607 - DNA, 23 bp, Homo sapiens
ataaacacagctgctttcttctt

SEQ ID NO: 4374608 - DNA, 20 bp, Homo sapiens
ataaacacatagattcacct

SEQ ID NO: 4374609 - DNA, 16 bp, Homo sapiens
ataaacacgattttat

SEQ ID NO: 4374610 - DNA, 19 bp, Homo sapiens
ataaacactgcataaagca

SEQ ID NO: 4374611 - DNA, 14 bp, Homo sapiens
ataaacactgtgta

SEQ ID NO: 4374612 - DNA, 17 bp, Homo sapiens
ataaacagacaaaaaca

SEQ ID NO: 4374613 - DNA, 17 bp, Homo sapiens
ataaacagatgaataaa

SEQ ID NO: 4374614 - DNA, 11 bp, Homo sapiens
ataaacagtca

SEQ ID NO: 4374615 - DNA, 17 bp, Homo sapiens
ataaaccaaaaacattt

SEQ ID NO: 4374616 - DNA, 13 bp, Homo sapiens
ataaaccagtgtg

SEQ ID NO: 4374617 - DNA, 14 bp, Homo sapiens
ataaaccagtgtga

SEQ ID NO: 4374618 - DNA, 17 bp, Homo sapiens
ataaaccagtgtgaacc

SEQ ID NO: 4374619 - DNA, 13 bp, Homo sapiens
ataaaccctcctt

SEQ ID NO: 4374620 - DNA, 19 bp, Homo sapiens
ataaactatttatatcaca

SEQ ID NO: 4374621 - DNA, 17 bp, Homo sapiens
ataaactgtattttgaa

SEQ ID NO: 4374622 - DNA, 16 bp, Homo sapiens
ataaacttaagggcaa

SEQ ID NO: 4374623 - DNA, 15 bp, Homo sapiens
ataaacttatttgct

SEQ ID NO: 4374624 - DNA, 17 bp, Homo sapiens
ataaagaaattcaagaa

SEQ ID NO: 4374625 - DNA, 20 bp, Homo sapiens
ataaagaaattcaagaagta

SEQ ID NO: 4374626 - DNA, 21 bp, Homo sapiens
ataaagaagaaacttgtaaat

SEQ ID NO: 4374627 - DNA, 20 bp, Homo sapiens
ataaagaagctactattttg

SEQ ID NO: 4374628 - DNA, 12 bp, Homo sapiens
ataaagaatact

SEQ ID NO: 4374629 - DNA, 13 bp, Homo sapiens
ataaagaatactt

SEQ ID NO: 4374630 - DNA, 19 bp, Homo sapiens
ataaagacaaccatattta

SEQ ID NO: 4374631 - DNA, 10 bp, Homo sapiens
ataaagactt

SEQ ID NO: 4374632 - DNA, 14 bp, Homo sapiens
ataaagatacatga

SEQ ID NO: 4374633 - DNA, 17 bp, Homo sapiens
ataaagatcatttataa

SEQ ID NO: 4374634 - DNA, 17 bp, Homo sapiens
ataaagattttttaata

SEQ ID NO: 4374635 - DNA, 18 bp, Homo sapiens
ataaagcaaggcaaaaat

SEQ ID NO: 4374636 - DNA, 14 bp, Homo sapiens
ataaagcctgactt

SEQ ID NO: 4374637 - DNA, 17 bp, Homo sapiens
ataaagcttaggtcaaa

SEQ ID NO: 4374638 - DNA, 19 bp, Homo sapiens
ataaaggaaaacaaaaaac

SEQ ID NO: 4374639 - DNA, 22 bp, Homo sapiens
ataaaggcagctgcctctgctc

SEQ ID NO: 4374640 - DNA, 17 bp, Homo sapiens
ataaaggcagttttcta

SEQ ID NO: 4374641 - DNA, 19 bp, Homo sapiens
ataaagggagaatggtgct

SEQ ID NO: 4374642 - DNA, 11 bp, Homo sapiens
ataaagggtca

SEQ ID NO: 4374643 - DNA, 14 bp, Homo sapiens
ataaagtatcatca

SEQ ID NO: 4374644 - DNA, 16 bp, Homo sapiens
ataaagtattccacct

SEQ ID NO: 4374645 - DNA, 18 bp, Homo sapiens
ataaagtattccacctta

SEQ ID NO: 4374646 - DNA, 14 bp, Homo sapiens
ataaagtattcttt

SEQ ID NO: 4374647 - DNA, 15 bp, Homo sapiens
ataaagtattctttt

SEQ ID NO: 4374648 - DNA, 16 bp, Homo sapiens
ataaagtgttttcaga

SEQ ID NO: 4374649 - DNA, 18 bp, Homo sapiens
ataaagtgttttcagagc

SEQ ID NO: 4374650 - DNA, 13 bp, Homo sapiens
ataaagttaaagt

SEQ ID NO: 4374651 - DNA, 22 bp, Homo sapiens
ataaagttattcttgtcatttt

SEQ ID NO: 4374652 - DNA, 15 bp, Homo sapiens
ataaagttcagatgt

SEQ ID NO: 4374653 - DNA, 20 bp, Homo sapiens
ataaagttctgcaaaataca

SEQ ID NO: 4374654 - DNA, 20 bp, Homo sapiens
ataaagttgaatattatata

SEQ ID NO: 4374655 - DNA, 17 bp, Homo sapiens
ataaagttgataaagat

SEQ ID NO: 4374656 - DNA, 17 bp, Homo sapiens
ataaataaaaatggata

SEQ ID NO: 4374657 - DNA, 14 bp, Homo sapiens
ataaatatatataa

SEQ ID NO: 4374658 - DNA, 16 bp, Homo sapiens
ataaatatatataaag

SEQ ID NO: 4374659 - DNA, 19 bp, Homo sapiens
ataaatatatataaagaat

SEQ ID NO: 4374660 - DNA, 14 bp, Homo sapiens
ataaatatcagtat

SEQ ID NO: 4374661 - DNA, 21 bp, Homo sapiens
ataaatatcagtattctgaca

SEQ ID NO: 4374662 - DNA, 21 bp, Homo sapiens
ataaatcatgttgttgtgtgt

SEQ ID NO: 4374663 - DNA, 19 bp, Homo sapiens
ataaatctaggatgtgatg

SEQ ID NO: 4374664 - DNA, 17 bp, Homo sapiens
ataaatcttcttattaa

SEQ ID NO: 4374665 - DNA, 18 bp, Homo sapiens
ataaatgatgattgaact

SEQ ID NO: 4374666 - DNA, 15 bp, Homo sapiens
ataaatgattatatt

SEQ ID NO: 4374667 - DNA, 19 bp, Homo sapiens
ataaatgattatattcaca

SEQ ID NO: 4374668 - DNA, 17 bp, Homo sapiens
ataaatgcataatttat

SEQ ID NO: 4374669 - DNA, 18 bp, Homo sapiens
ataaatggttaagacaaa

SEQ ID NO: 4374670 - DNA, 21 bp, Homo sapiens
ataaatgtaaaaatgaaggaa

SEQ ID NO: 4374671 - DNA, 20 bp, Homo sapiens
ataagttcaaattcttctga

SEQ ID NO: 4374672 - DNA, 21 bp, Homo sapiens
ataagttcaaattcttctgaa

SEQ ID NO: 4374673 - DNA, 14 bp, Homo sapiens
ataagttgctgtaa

SEQ ID NO: 4374674 - DNA, 23 bp, Homo sapiens
ataagttgtataggctaaatgtt

SEQ ID NO: 4374675 - DNA, 16 bp, Homo sapiens
ataagtttctattctg

SEQ ID NO: 4374676 - DNA, 21 bp, Homo sapiens
ataagtttctattctgtcagt

SEQ ID NO: 4374677 - DNA, 11 bp, Homo sapiens
ataataaagga

SEQ ID NO: 4374678 - DNA, 18 bp, Homo sapiens
ataataaaggactgtaat

SEQ ID NO: 4374679 - DNA, 12 bp, Homo sapiens
ataataaatact

SEQ ID NO: 4374680 - DNA, 14 bp, Homo sapiens
ataataaattttct

SEQ ID NO: 4374681 - DNA, 14 bp, Homo sapiens
ataataataataaa

SEQ ID NO: 4374682 - DNA, 13 bp, Homo sapiens
ataatactgtttt

SEQ ID NO: 4374683 - DNA, 21 bp, Homo sapiens
ataatactttgtatacaagta

SEQ ID NO: 4374684 - DNA, 23 bp, Homo sapiens
ataatagtcaatttctacttctg

SEQ ID NO: 4374685 - DNA, 13 bp, Homo sapiens
ataatatatttct

SEQ ID NO: 4374686 - DNA, 21 bp, Homo sapiens
ataatatcagatttcattaat

SEQ ID NO: 4374687 - DNA, 20 bp, Homo sapiens
ataatatctaaagttatatt

SEQ ID NO: 4374688 - DNA, 16 bp, Homo sapiens
ataatattgaaaattg

SEQ ID NO: 4374689 - DNA, 21 bp, Homo sapiens
ataatattgaaaattgaaaag

SEQ ID NO: 4374690 - DNA, 16 bp, Homo sapiens
ataatatttcaagtgc

SEQ ID NO: 4374691 - DNA, 19 bp, Homo sapiens
ataatatttcaagtgccta

SEQ ID NO: 4374692 - DNA, 19 bp, Homo sapiens
ataatattttacatacact

SEQ ID NO: 4374693 - DNA, 14 bp, Homo sapiens
ataatcaaatgatt

SEQ ID NO: 4374694 - DNA, 18 bp, Homo sapiens
ataatcaaatgatttcat

SEQ ID NO: 4374695 - DNA, 19 bp, Homo sapiens
ataatcaaatgatttcata

SEQ ID NO: 4374696 - DNA, 16 bp, Homo sapiens
ataatcacgctttcct

SEQ ID NO: 4374697 - DNA, 18 bp, Homo sapiens
ataatcacgctttcctga

SEQ ID NO: 4374698 - DNA, 19 bp, Homo sapiens
ataatcagaatggaagaga

SEQ ID NO: 4374699 - DNA, 16 bp, Homo sapiens
ataatcattttagaat

SEQ ID NO: 4374700 - DNA, 22 bp, Homo sapiens
ataatcattttagaattaaaat

SEQ ID NO: 4374701 - DNA, 15 bp, Homo sapiens
ataatcccagctact

SEQ ID NO: 4374702 - DNA, 20 bp, Homo sapiens
ataatccctggatgatattt

SEQ ID NO: 4374703 - DNA, 18 bp, Homo sapiens
ataatcgaagcaaaagta

SEQ ID NO: 4374704 - DNA, 19 bp, Homo sapiens
ataatcgaagcaaaagtaa

SEQ ID NO: 4374705 - DNA, 22 bp, Homo sapiens
ataatcggcccacagctcccac

SEQ ID NO: 4374706 - DNA, 20 bp, Homo sapiens
ataatctatattaaatgagg

SEQ ID NO: 4374707 - DNA, 15 bp, Homo sapiens
ataatctatttacat

SEQ ID NO: 4374708 - DNA, 20 bp, Homo sapiens
ataatctcctctaaaacaac

SEQ ID NO: 4374709 - DNA, 16 bp, Homo sapiens
ataatctcttcttata

SEQ ID NO: 4374710 - DNA, 20 bp, Homo sapiens
ataatctgtttttacgtatg

SEQ ID NO: 4374711 - DNA, 17 bp, Homo sapiens
ataatcttataattgtt

SEQ ID NO: 4374712 - DNA, 15 bp, Homo sapiens
ataatcttctgcctt

SEQ ID NO: 4374713 - DNA, 13 bp, Homo sapiens
ataatgaacaatt

SEQ ID NO: 4374714 - DNA, 17 bp, Homo sapiens
ataatgaacagaacata

SEQ ID NO: 4374715 - DNA, 21 bp, Homo sapiens
ataatgagctattaaaactca

SEQ ID NO: 4374716 - DNA, 15 bp, Homo sapiens
ataatgataaaacac

SEQ ID NO: 4374717 - DNA, 17 bp, Homo sapiens
ataatgataaaacacct

SEQ ID NO: 4374718 - DNA, 14 bp, Homo sapiens
ataatgcagtatgg

SEQ ID NO: 4374719 - DNA, 15 bp, Homo sapiens
ataatgcagtatggt

SEQ ID NO: 4374720 - DNA, 17 bp, Homo sapiens
ataatgccaccaaagga

SEQ ID NO: 4374721 - DNA, 20 bp, Homo sapiens
ataatgcttggaatgggaga

SEQ ID NO: 4374722 - DNA, 21 bp, Homo sapiens
ataatgcttttctaattaata

SEQ ID NO: 4374723 - DNA, 16 bp, Homo sapiens
ataatggaaaatgcca

SEQ ID NO: 4374724 - DNA, 22 bp, Homo sapiens
ataatggaaaatgccatgaatt

SEQ ID NO: 4374725 - DNA, 17 bp, Homo sapiens
ataatgggccactgaaa

SEQ ID NO: 4374726 - DNA, 21 bp, Homo sapiens
ataatgggccactgaaatctg

SEQ ID NO: 4374727 - DNA, 22 bp, Homo sapiens
ataatgggccactgaaatctgt

SEQ ID NO: 4374728 - DNA, 11 bp, Homo sapiens
ataatgtattt

SEQ ID NO: 4374729 - DNA, 18 bp, Homo sapiens
ataatgtatttgaaaatt

SEQ ID NO: 4374730 - DNA, 19 bp, Homo sapiens
ataatgtcagcttatccta

SEQ ID NO: 4374731 - DNA, 11 bp, Homo sapiens
ataatgtctct

SEQ ID NO: 4374732 - DNA, 15 bp, Homo sapiens
ataatgtctctgtga

SEQ ID NO: 4374733 - DNA, 13 bp, Homo sapiens
ataatgtgaaaat

SEQ ID NO: 4374734 - DNA, 15 bp, Homo sapiens
ataatgtgtctgtgt

SEQ ID NO: 4374735 - DNA, 23 bp, Homo sapiens
ataatgtgtctgtgttgcttcaa

SEQ ID NO: 4374736 - DNA, 15 bp, Homo sapiens
ataatgttattcatt

SEQ ID NO: 4374737 - DNA, 17 bp, Homo sapiens
ataatgttcattttgaa

SEQ ID NO: 4374738 - DNA, 18 bp, Homo sapiens
ataatgtttaaatagcat

SEQ ID NO: 4374739 - DNA, 19 bp, Homo sapiens
ataattatataactgtatt

SEQ ID NO: 4374740 - DNA, 13 bp, Homo sapiens
ataattatgaaaa

SEQ ID NO: 4374741 - DNA, 15 bp, Homo sapiens
ataattatgaaaact

SEQ ID NO: 4374742 - DNA, 15 bp, Homo sapiens
ataattcatatctaa

SEQ ID NO: 4374743 - DNA, 13 bp, Homo sapiens
ataattcctacag

SEQ ID NO: 4374744 - DNA, 16 bp, Homo sapiens
ataattcctacagcac

SEQ ID NO: 4374745 - DNA, 18 bp, Homo sapiens
ataattcctacagcacta

SEQ ID NO: 4374746 - DNA, 22 bp, Homo sapiens
ataattctcattaaaagaatat

SEQ ID NO: 4374747 - DNA, 23 bp, Homo sapiens
ataattgaagtgttccctttttc

SEQ ID NO: 4374748 - DNA, 16 bp, Homo sapiens
ataattgcatgaaaat

SEQ ID NO: 4374749 - DNA, 17 bp, Homo sapiens
ataattgcatgaaaata

SEQ ID NO: 4374750 - DNA, 17 bp, Homo sapiens
ataattggatttcctaa

SEQ ID NO: 4374751 - DNA, 15 bp, Homo sapiens
ataattgtactgtgt

SEQ ID NO: 4374752 - DNA, 23 bp, Homo sapiens
ataatttaactacccttaattac

SEQ ID NO: 4374753 - DNA, 21 bp, Homo sapiens
ataatttaatgtaaataaaac

SEQ ID NO: 4374754 - DNA, 16 bp, Homo sapiens
ataatttagtggatta

SEQ ID NO: 4374755 - DNA, 15 bp, Homo sapiens
ataatttatttcaat

SEQ ID NO: 4374756 - DNA, 13 bp, Homo sapiens
ataatttgtctta

SEQ ID NO: 4374757 - DNA, 15 bp, Homo sapiens
ataatttgtcttagt

SEQ ID NO: 4374758 - DNA, 16 bp, Homo sapiens
ataatttgtttccagc

SEQ ID NO: 4374759 - DNA, 23 bp, Homo sapiens
ataattttactcactcactctga

SEQ ID NO: 4374760 - DNA, 21 bp, Homo sapiens
ataattttttttttttaggaa

SEQ ID NO: 4374761 - DNA, 18 bp, Homo sapiens
atacaaaaacatacttca

SEQ ID NO: 4374762 - DNA, 20 bp, Homo sapiens
atacaaaaattagccgggca

SEQ ID NO: 4374763 - DNA, 23 bp, Homo sapiens
atacaaaagttcaacctcttaca

SEQ ID NO: 4374764 - DNA, 15 bp, Homo sapiens
atacaaactctcacc

SEQ ID NO: 4374765 - DNA, 18 bp, Homo sapiens
atacaaactctcaccatg

SEQ ID NO: 4374766 - DNA, 18 bp, Homo sapiens
atacaacagaaaccagaa

SEQ ID NO: 4374767 - DNA, 16 bp, Homo sapiens
atacaacatgcatgtt

SEQ ID NO: 4374768 - DNA, 17 bp, Homo sapiens
atacaacctaacttatg

SEQ ID NO: 4374769 - DNA, 17 bp, Homo sapiens
atacaataaaacaaata

SEQ ID NO: 4374770 - DNA, 17 bp, Homo sapiens
atacaatggtttctgaa

SEQ ID NO: 4374771 - DNA, 20 bp, Homo sapiens
atacaatggtttctgaaaga

SEQ ID NO: 4374772 - DNA, 15 bp, Homo sapiens
atacaatgtacaatt

SEQ ID NO: 4374773 - DNA, 17 bp, Homo sapiens
atacaatgtacaattat

SEQ ID NO: 4374774 - DNA, 21 bp, Homo sapiens
atacaatgtacaattatgtct

SEQ ID NO: 4374775 - DNA, 12 bp, Homo sapiens
atacaatgtatg

SEQ ID NO: 4374776 - DNA, 13 bp, Homo sapiens
atacaatgtatgt

SEQ ID NO: 4374777 - DNA, 14 bp, Homo sapiens
atacaatgtatgta

SEQ ID NO: 4374778 - DNA, 18 bp, Homo sapiens
atacaatttttatttctt

SEQ ID NO: 4374779 - DNA, 11 bp, Homo sapiens
atacacaaatt

SEQ ID NO: 4374780 - DNA, 18 bp, Homo sapiens
atacacactcaaatcaag

SEQ ID NO: 4374781 - DNA, 20 bp, Homo sapiens
atacacactcaaatcaagaa

SEQ ID NO: 4374782 - DNA, 17 bp, Homo sapiens
atacacagttaaataaa

SEQ ID NO: 4374783 - DNA, 20 bp, Homo sapiens
atacacatagttctgtaata

SEQ ID NO: 4374784 - DNA, 21 bp, Homo sapiens
atacacgtttatcttacattc

SEQ ID NO: 4374785 - DNA, 19 bp, Homo sapiens
atacactgcactttgttta

SEQ ID NO: 4374786 - DNA, 23 bp, Homo sapiens
atacactgcactttgtttagaaa

SEQ ID NO: 4374787 - DNA, 21 bp, Homo sapiens
atacactttgttgcaagatgt

SEQ ID NO: 4374788 - DNA, 23 bp, Homo sapiens
atacactttgttgcaagatgtga

SEQ ID NO: 4374789 - DNA, 14 bp, Homo sapiens
atacagaactcttt

SEQ ID NO: 4374790 - DNA, 16 bp, Homo sapiens
atacagaactctttca

SEQ ID NO: 4374791 - DNA, 18 bp, Homo sapiens
atacagaatcttgttttg

SEQ ID NO: 4374792 - DNA, 19 bp, Homo sapiens
atacagatggagcaaatgt

SEQ ID NO: 4374793 - DNA, 14 bp, Homo sapiens
atacagctcagtaa

SEQ ID NO: 4374794 - DNA, 16 bp, Homo sapiens
atacaggaaacagttg

SEQ ID NO: 4374795 - DNA, 11 bp, Homo sapiens
atacaggaaat

SEQ ID NO: 4374796 - DNA, 21 bp, Homo sapiens
atacaggatttgaactcagat

SEQ ID NO: 4374797 - DNA, 12 bp, Homo sapiens
atacagggaggc

SEQ ID NO: 4374798 - DNA, 12 bp, Homo sapiens
atacagtacaca

SEQ ID NO: 4374799 - DNA, 20 bp, Homo sapiens
atacagtcttccatttgcaa

SEQ ID NO: 4374800 - DNA, 21 bp, Homo sapiens
atacagtgcagagccttctca

SEQ ID NO: 4374801 - DNA, 23 bp, Homo sapiens
atacagtgcagagccttctcaga

SEQ ID NO: 4374802 - DNA, 16 bp, Homo sapiens
atacagttttaaagaa

SEQ ID NO: 4374803 - DNA, 17 bp, Homo sapiens
atacagttttaaagaat

SEQ ID NO: 4374804 - DNA, 14 bp, Homo sapiens
atacataaagacta

SEQ ID NO: 4374805 - DNA, 14 bp, Homo sapiens
atacatcacatctt

SEQ ID NO: 4374806 - DNA, 18 bp, Homo sapiens
atacatcacatcttattt

SEQ ID NO: 4374807 - DNA, 18 bp, Homo sapiens
atacatcacgttaaagta

SEQ ID NO: 4374808 - DNA, 15 bp, Homo sapiens
atacatctttcccta

SEQ ID NO: 4374809 - DNA, 17 bp, Homo sapiens
atacatgatacattttt

SEQ ID NO: 4374810 - DNA, 14 bp, Homo sapiens
atacatgcacagtc

SEQ ID NO: 4374811 - DNA, 18 bp, Homo sapiens
atacatggtttaaagtca

SEQ ID NO: 4374812 - DNA, 21 bp, Homo sapiens
atacattacatctgagtattt

SEQ ID NO: 4374813 - DNA, 14 bp, Homo sapiens
atacattgtcttga

SEQ ID NO: 4374814 - DNA, 23 bp, Homo sapiens
atacattgtcttgatgttttttc

SEQ ID NO: 4374815 - DNA, 11 bp, Homo sapiens
atacatttaat

SEQ ID NO: 4374816 - DNA, 13 bp, Homo sapiens
atacatttaataa

SEQ ID NO: 4374817 - DNA, 18 bp, Homo sapiens
atacatttaataaaactg

SEQ ID NO: 4374818 - DNA, 13 bp, Homo sapiens
atacattttataa

SEQ ID NO: 4374819 - DNA, 21 bp, Homo sapiens
ataccaatgaaaaaatgtata

SEQ ID NO: 4374820 - DNA, 16 bp, Homo sapiens
ataccacagctattta

SEQ ID NO: 4374821 - DNA, 17 bp, Homo sapiens
ataccactctttacctt

SEQ ID NO: 4374822 - DNA, 13 bp, Homo sapiens
ataccacttgaat

SEQ ID NO: 4374823 - DNA, 12 bp, Homo sapiens
ataccagagcct

SEQ ID NO: 4374824 - DNA, 21 bp, Homo sapiens
ataccagagccttcaagtgcc

SEQ ID NO: 4374825 - DNA, 24 bp, Homo sapiens
ataccagcagcaactgaaaatgaa

SEQ ID NO: 4374826 - DNA, 16 bp, Homo sapiens
ataccagcgaggaggc

SEQ ID NO: 4374827 - DNA, 22 bp, Homo sapiens
ataccagcgaggaggctccaga

SEQ ID NO: 4374828 - DNA, 14 bp, Homo sapiens
ataccctccctccc

SEQ ID NO: 4374829 - DNA, 16 bp, Homo sapiens
ataccctccctcccta

SEQ ID NO: 4374830 - DNA, 22 bp, Homo sapiens
ataccctccctccctaccctaa

SEQ ID NO: 4374831 - DNA, 24 bp, Homo sapiens
atacctcactagccatgctttatg

SEQ ID NO: 4374832 - DNA, 18 bp, Homo sapiens
atacctcaggaaagaata

SEQ ID NO: 4374833 - DNA, 21 bp, Homo sapiens
atacctcaggaaagaatagaa

SEQ ID NO: 4374834 - DNA, 22 bp, Homo sapiens
atacctgattgatcacacagtg

SEQ ID NO: 4374835 - DNA, 20 bp, Homo sapiens
atacctgattttttttcctt

SEQ ID NO: 4374836 - DNA, 13 bp, Homo sapiens
ataccttatttat

SEQ ID NO: 4374837 - DNA, 21 bp, Homo sapiens
ataccttatttatttttgtgt

SEQ ID NO: 4374838 - DNA, 17 bp, Homo sapiens
ataccttctatgtatta

SEQ ID NO: 4374839 - DNA, 20 bp, Homo sapiens
atacgagagcagaggtctcc

SEQ ID NO: 4374840 - DNA, 23 bp, Homo sapiens
atacgctcagctcatccatgcct

SEQ ID NO: 4374841 - DNA, 16 bp, Homo sapiens
atacgtataaatatca

SEQ ID NO: 4374842 - DNA, 21 bp, Homo sapiens
atacgtgccagatataactgt

SEQ ID NO: 4374843 - DNA, 13 bp, Homo sapiens
atactaaaaagaa

SEQ ID NO: 4374844 - DNA, 17 bp, Homo sapiens
atactacagtagttcca

SEQ ID NO: 4374845 - DNA, 14 bp, Homo sapiens
atactatagtacca

SEQ ID NO: 4374846 - DNA, 13 bp, Homo sapiens
atactatgcagta

SEQ ID NO: 4374847 - DNA, 16 bp, Homo sapiens
atactcattaggatgg

SEQ ID NO: 4374848 - DNA, 16 bp, Homo sapiens
atactcctgtcaccta

SEQ ID NO: 4374849 - DNA, 20 bp, Homo sapiens
atactcttgaattcctctca

SEQ ID NO: 4374850 - DNA, 14 bp, Homo sapiens
atactctttctgta

SEQ ID NO: 4374851 - DNA, 17 bp, Homo sapiens
atactctttctgtatat

SEQ ID NO: 4374852 - DNA, 22 bp, Homo sapiens
atactctttctgtatatacttt

SEQ ID NO: 4374853 - DNA, 12 bp, Homo sapiens
atactgaaccag

SEQ ID NO: 4374854 - DNA, 14 bp, Homo sapiens
atactgagggacca

SEQ ID NO: 4374855 - DNA, 14 bp, Homo sapiens
atactgattatgaa

SEQ ID NO: 4374856 - DNA, 15 bp, Homo sapiens
atactggaggaacac

SEQ ID NO: 4374857 - DNA, 13 bp, Homo sapiens
atactggcacaga

SEQ ID NO: 4374858 - DNA, 18 bp, Homo sapiens
atactgtaatcaaaagga

SEQ ID NO: 4374859 - DNA, 11 bp, Homo sapiens
atactgtacac

SEQ ID NO: 4374860 - DNA, 15 bp, Homo sapiens
atactgtacacattt

SEQ ID NO: 4374861 - DNA, 14 bp, Homo sapiens
atactgtacagggg

SEQ ID NO: 4374862 - DNA, 21 bp, Homo sapiens
atactgtatcctgaaaggcaa

SEQ ID NO: 4374863 - DNA, 13 bp, Homo sapiens
atactgtctgtat

SEQ ID NO: 4374864 - DNA, 16 bp, Homo sapiens
atactgtctgtatctt

SEQ ID NO: 4374865 - DNA, 23 bp, Homo sapiens
atacttaacacgtgaatattttg

SEQ ID NO: 4374866 - DNA, 14 bp, Homo sapiens
atacttaacatttc

SEQ ID NO: 4374867 - DNA, 17 bp, Homo sapiens
atacttagcaaaaagtg

SEQ ID NO: 4374868 - DNA, 19 bp, Homo sapiens
atacttagcaaaaagtggg

SEQ ID NO: 4374869 - DNA, 18 bp, Homo sapiens
atacttatctctctgtgc

SEQ ID NO: 4374870 - DNA, 18 bp, Homo sapiens
atacttatttgtatatgg

SEQ ID NO: 4374871 - DNA, 17 bp, Homo sapiens
atacttctttttcatta

SEQ ID NO: 4374872 - DNA, 14 bp, Homo sapiens
atacttgaacaaaa

SEQ ID NO: 4374873 - DNA, 15 bp, Homo sapiens
atacttgaacaaaag

SEQ ID NO: 4374874 - DNA, 17 bp, Homo sapiens
atacttgaacaaaaggg

SEQ ID NO: 4374875 - DNA, 22 bp, Homo sapiens
atacttgaacaaaagggtcaga

SEQ ID NO: 4374876 - DNA, 20 bp, Homo sapiens
atacttgactctaatatgat

SEQ ID NO: 4374877 - DNA, 21 bp, Homo sapiens
atacttgagaccaacttttca

SEQ ID NO: 4374878 - DNA, 12 bp, Homo sapiens
atacttggattt

SEQ ID NO: 4374879 - DNA, 17 bp, Homo sapiens
atacttggatttagttt

SEQ ID NO: 4374880 - DNA, 17 bp, Homo sapiens
atactttaaataattta

SEQ ID NO: 4374881 - DNA, 14 bp, Homo sapiens
atactttacaaacc

SEQ ID NO: 4374882 - DNA, 18 bp, Homo sapiens
atactttactttttccat

SEQ ID NO: 4374883 - DNA, 18 bp, Homo sapiens
atactttatatctgtaat

SEQ ID NO: 4374884 - DNA, 20 bp, Homo sapiens
atactttatatctgtaatga

SEQ ID NO: 4374885 - DNA, 15 bp, Homo sapiens
atactttatcaatgt

SEQ ID NO: 4374886 - DNA, 14 bp, Homo sapiens
atactttttcatga

SEQ ID NO: 4374887 - DNA, 15 bp, Homo sapiens
atagaaaaatgtata

SEQ ID NO: 4374888 - DNA, 23 bp, Homo sapiens
atagaaaacaggaaaaaaacttt

SEQ ID NO: 4374889 - DNA, 14 bp, Homo sapiens
atagaaaagttatt

SEQ ID NO: 4374890 - DNA, 15 bp, Homo sapiens
atagaaaagttatta

SEQ ID NO: 4374891 - DNA, 17 bp, Homo sapiens
atagaaacgtaaactat

SEQ ID NO: 4374892 - DNA, 14 bp, Homo sapiens
atagaaagaaacta

SEQ ID NO: 4374893 - DNA, 12 bp, Homo sapiens
atagaaatggaa

SEQ ID NO: 4374894 - DNA, 19 bp, Homo sapiens
atagaaattagatttgtgc

SEQ ID NO: 4374895 - DNA, 17 bp, Homo sapiens
atagaaattttgtaaga

SEQ ID NO: 4374896 - DNA, 22 bp, Homo sapiens
atagaacaagatgcactcgctg

SEQ ID NO: 4374897 - DNA, 18 bp, Homo sapiens
atagaactctgaaatgaa

SEQ ID NO: 4374898 - DNA, 14 bp, Homo sapiens
atagaactgaatga

SEQ ID NO: 4374899 - DNA, 16 bp, Homo sapiens
atagaacttcatggat

SEQ ID NO: 4374900 - DNA, 21 bp, Homo sapiens
atagaaggaagtgtgtttgcc

SEQ ID NO: 4374901 - DNA, 12 bp, Homo sapiens
atagaataaagg

SEQ ID NO: 4374902 - DNA, 13 bp, Homo sapiens
atagaattgcagt

SEQ ID NO: 4374903 - DNA, 16 bp, Homo sapiens
atagacaaaaagtata

SEQ ID NO: 4374904 - DNA, 17 bp, Homo sapiens
atagacaaaagaataag

SEQ ID NO: 4374905 - DNA, 20 bp, Homo sapiens
atagacaattcctccagaga

SEQ ID NO: 4374906 - DNA, 21 bp, Homo sapiens
atagacaattcctccagagac

SEQ ID NO: 4374907 - DNA, 22 bp, Homo sapiens
atagacaattcctccagagaca

SEQ ID NO: 4374908 - DNA, 15 bp, Homo sapiens
atagtgtaagaactg

SEQ ID NO: 4374909 - DNA, 20 bp, Homo sapiens
atagtgtaagaactgtacat

SEQ ID NO: 4374910 - DNA, 19 bp, Homo sapiens
atagtgtagctgaggaggc

SEQ ID NO: 4374911 - DNA, 17 bp, Homo sapiens
atagtgttaactgtcag

SEQ ID NO: 4374912 - DNA, 18 bp, Homo sapiens
atagtgttttattataaa

SEQ ID NO: 4374913 - DNA, 14 bp, Homo sapiens
atagttactgtgta

SEQ ID NO: 4374914 - DNA, 15 bp, Homo sapiens
atagttagaacctgg

SEQ ID NO: 4374915 - DNA, 13 bp, Homo sapiens
atagttagaactg

SEQ ID NO: 4374916 - DNA, 19 bp, Homo sapiens
atagttagaactgattaca

SEQ ID NO: 4374917 - DNA, 18 bp, Homo sapiens
atagttcagaatttagtg

SEQ ID NO: 4374918 - DNA, 19 bp, Homo sapiens
atagttctgtaataaaact

SEQ ID NO: 4374919 - DNA, 21 bp, Homo sapiens
atagttgaattagtgagtata

SEQ ID NO: 4374920 - DNA, 18 bp, Homo sapiens
atagttgcatagcagtat

SEQ ID NO: 4374921 - DNA, 20 bp, Homo sapiens
atagttgctcttctacacta

SEQ ID NO: 4374922 - DNA, 12 bp, Homo sapiens
atagttgctttt

SEQ ID NO: 4374923 - DNA, 13 bp, Homo sapiens
atagtttatttct

SEQ ID NO: 4374924 - DNA, 14 bp, Homo sapiens
atagtttatttctg

SEQ ID NO: 4374925 - DNA, 14 bp, Homo sapiens
atagttttcatttt

SEQ ID NO: 4374926 - DNA, 19 bp, Homo sapiens
atagttttcattttaactg

SEQ ID NO: 4374927 - DNA, 20 bp, Homo sapiens
atagttttcttcctttgaaa

SEQ ID NO: 4374928 - DNA, 23 bp, Homo sapiens
atataaaaaccccaaactgttga

SEQ ID NO: 4374929 - DNA, 15 bp, Homo sapiens
atataaaaatggctt

SEQ ID NO: 4374930 - DNA, 16 bp, Homo sapiens
atataaaacagtcatg

SEQ ID NO: 4374931 - DNA, 15 bp, Homo sapiens
atataaagtattctt

SEQ ID NO: 4374932 - DNA, 11 bp, Homo sapiens
atataaatata

SEQ ID NO: 4374933 - DNA, 17 bp, Homo sapiens
atataaatgatgattga

SEQ ID NO: 4374934 - DNA, 12 bp, Homo sapiens
atataaatgttg

SEQ ID NO: 4374935 - DNA, 17 bp, Homo sapiens
atataaattattacttt

SEQ ID NO: 4374936 - DNA, 22 bp, Homo sapiens
atataaattgtacattttgtaa

SEQ ID NO: 4374937 - DNA, 17 bp, Homo sapiens
atataaattttttttgt

SEQ ID NO: 4374938 - DNA, 22 bp, Homo sapiens
atataaattttttttgtttcat

SEQ ID NO: 4374939 - DNA, 16 bp, Homo sapiens
atataactgtcttgtt

SEQ ID NO: 4374940 - DNA, 20 bp, Homo sapiens
atataactgtcttgtttcag

SEQ ID NO: 4374941 - DNA, 21 bp, Homo sapiens
atataagaaaagtaatgaaga

SEQ ID NO: 4374942 - DNA, 23 bp, Homo sapiens
atataagaaaagtaatgaagaat

SEQ ID NO: 4374943 - DNA, 13 bp, Homo sapiens
atataagcttttt

SEQ ID NO: 4374944 - DNA, 17 bp, Homo sapiens
atataagtttctttaga

SEQ ID NO: 4374945 - DNA, 18 bp, Homo sapiens
atataagtttctttagaa

SEQ ID NO: 4374946 - DNA, 12 bp, Homo sapiens
atataataaagt

SEQ ID NO: 4374947 - DNA, 12 bp, Homo sapiens
atataataaata

SEQ ID NO: 4374948 - DNA, 12 bp, Homo sapiens
atataatacata

SEQ ID NO: 4374949 - DNA, 22 bp, Homo sapiens
atataatattcagccagcttaa

SEQ ID NO: 4374950 - DNA, 17 bp, Homo sapiens
atataatcatcaagtaa

SEQ ID NO: 4374951 - DNA, 14 bp, Homo sapiens
atataatgtatttt

SEQ ID NO: 4374952 - DNA, 22 bp, Homo sapiens
atataatgtattttctttttat

SEQ ID NO: 4374953 - DNA, 18 bp, Homo sapiens
atataattgttttatctg

SEQ ID NO: 4374954 - DNA, 18 bp, Homo sapiens
atataatttactttgtag

SEQ ID NO: 4374955 - DNA, 21 bp, Homo sapiens
atataatttactttgtagact

SEQ ID NO: 4374956 - DNA, 16 bp, Homo sapiens
atatacaaaactttat

SEQ ID NO: 4374957 - DNA, 15 bp, Homo sapiens
atatacaaacatgta

SEQ ID NO: 4374958 - DNA, 22 bp, Homo sapiens
atatacatatgagaatatacct

SEQ ID NO: 4374959 - DNA, 22 bp, Homo sapiens
atataccactctttacctttat

SEQ ID NO: 4374960 - DNA, 17 bp, Homo sapiens
atataccccaaattgtg

SEQ ID NO: 4374961 - DNA, 13 bp, Homo sapiens
atatactcattag

SEQ ID NO: 4374962 - DNA, 15 bp, Homo sapiens
atatactcattagaa

SEQ ID NO: 4374963 - DNA, 21 bp, Homo sapiens
atatactgtatcctgaaaggc

SEQ ID NO: 4374964 - DNA, 22 bp, Homo sapiens
atatactgtatcctgaaaggca

SEQ ID NO: 4374965 - DNA, 17 bp, Homo sapiens
atatactttactttttc

SEQ ID NO: 4374966 - DNA, 20 bp, Homo sapiens
atatactttactttttccat

SEQ ID NO: 4374967 - DNA, 16 bp, Homo sapiens
atatactttttcatga

SEQ ID NO: 4374968 - DNA, 19 bp, Homo sapiens
atatactttttcatgaaaa

SEQ ID NO: 4374969 - DNA, 14 bp, Homo sapiens
atatagaatttcct

SEQ ID NO: 4374970 - DNA, 18 bp, Homo sapiens
atatagacattctcacat

SEQ ID NO: 4374971 - DNA, 21 bp, Homo sapiens
atatagagacaggacagaatg

SEQ ID NO: 4374972 - DNA, 23 bp, Homo sapiens
atatagagacaggacagaatgtg

SEQ ID NO: 4374973 - DNA, 15 bp, Homo sapiens
atatagattttatta

SEQ ID NO: 4374974 - DNA, 19 bp, Homo sapiens
atatagattttattatgtt

SEQ ID NO: 4374975 - DNA, 15 bp, Homo sapiens
atatagcctttaaat

SEQ ID NO: 4374976 - DNA, 21 bp, Homo sapiens
atatagtggatgatatacaca

SEQ ID NO: 4374977 - DNA, 12 bp, Homo sapiens
atatagttttac

SEQ ID NO: 4374978 - DNA, 18 bp, Homo sapiens
atatagttttttctttcc

SEQ ID NO: 4374979 - DNA, 17 bp, Homo sapiens
atatataaaacggtgct

SEQ ID NO: 4374980 - DNA, 17 bp, Homo sapiens
atatataaagaatatat

SEQ ID NO: 4374981 - DNA, 15 bp, Homo sapiens
atatataaagtatag

SEQ ID NO: 4374982 - DNA, 18 bp, Homo sapiens
atatataaagtatagaga

SEQ ID NO: 4374983 - DNA, 13 bp, Homo sapiens
atatataactatt

SEQ ID NO: 4374984 - DNA, 12 bp, Homo sapiens
atatataataaa

SEQ ID NO: 4374985 - DNA, 16 bp, Homo sapiens
atatataataaatact

SEQ ID NO: 4374986 - DNA, 15 bp, Homo sapiens
atatataatatacta

SEQ ID NO: 4374987 - DNA, 16 bp, Homo sapiens
atatataatttaatgt

SEQ ID NO: 4374988 - DNA, 21 bp, Homo sapiens
atatatacacatagttctgta

SEQ ID NO: 4374989 - DNA, 23 bp, Homo sapiens
atatatacacattagaaatattc

SEQ ID NO: 4374990 - DNA, 13 bp, Homo sapiens
atatatacatgga

SEQ ID NO: 4374991 - DNA, 13 bp, Homo sapiens
atatatataaagt

SEQ ID NO: 4374992 - DNA, 13 bp, Homo sapiens
atatatatataaa

SEQ ID NO: 4374993 - DNA, 14 bp, Homo sapiens
atatatatatataa

SEQ ID NO: 4374994 - DNA, 17 bp, Homo sapiens
atatatattataaatat

SEQ ID NO: 4374995 - DNA, 19 bp, Homo sapiens
atatatattataaatatat

SEQ ID NO: 4374996 - DNA, 23 bp, Homo sapiens
atatatattctattacattttca

SEQ ID NO: 4374997 - DNA, 17 bp, Homo sapiens
atatatattgtaaagaa

SEQ ID NO: 4374998 - DNA, 13 bp, Homo sapiens
atatatatttcta

SEQ ID NO: 4374999 - DNA, 20 bp, Homo sapiens
atatatcattatctttgctg

SEQ ID NO: 4375000 - DNA, 22 bp, Homo sapiens
atatatcctgaaagcattattt

SEQ ID NO: 4375001 - DNA, 13 bp, Homo sapiens
atatatctattat

SEQ ID NO: 4375002 - DNA, 16 bp, Homo sapiens
atatatctctatttga

SEQ ID NO: 4375003 - DNA, 20 bp, Homo sapiens
atatatctgctgtccagaca

SEQ ID NO: 4375004 - DNA, 16 bp, Homo sapiens
atatatcttaagcagg

SEQ ID NO: 4375005 - DNA, 19 bp, Homo sapiens
atatatcttataactgttt

SEQ ID NO: 4375006 - DNA, 20 bp, Homo sapiens
atatatgcacttaatttgtt

SEQ ID NO: 4375007 - DNA, 15 bp, Homo sapiens
atatatgctgtattt

SEQ ID NO: 4375008 - DNA, 16 bp, Homo sapiens
atatatgctgtatttc

SEQ ID NO: 4375009 - DNA, 18 bp, Homo sapiens
atatatgctgtatttctt

SEQ ID NO: 4375010 - DNA, 15 bp, Homo sapiens
atatatgtatgtaaa

SEQ ID NO: 4375011 - DNA, 13 bp, Homo sapiens
atatatgtatttt

SEQ ID NO: 4375012 - DNA, 20 bp, Homo sapiens
atatatgtgtatacatacat

SEQ ID NO: 4375013 - DNA, 22 bp, Homo sapiens
atatatgtgtatacatacatgt

SEQ ID NO: 4375014 - DNA, 19 bp, Homo sapiens
atatatgtgtgccctggac

SEQ ID NO: 4375015 - DNA, 15 bp, Homo sapiens
atatattaaaacaat

SEQ ID NO: 4375016 - DNA, 17 bp, Homo sapiens
atatattaaaacaataa

SEQ ID NO: 4375017 - DNA, 16 bp, Homo sapiens
atatattaaaattcca

SEQ ID NO: 4375018 - DNA, 17 bp, Homo sapiens
atatattataaatatat

SEQ ID NO: 4375019 - DNA, 15 bp, Homo sapiens
atatattatatacat

SEQ ID NO: 4375020 - DNA, 14 bp, Homo sapiens
atatattatgtgaa

SEQ ID NO: 4375021 - DNA, 16 bp, Homo sapiens
atatattatgtgaaga

SEQ ID NO: 4375022 - DNA, 13 bp, Homo sapiens
atatattattata

SEQ ID NO: 4375023 - DNA, 18 bp, Homo sapiens
atatattcatctaataaa

SEQ ID NO: 4375024 - DNA, 15 bp, Homo sapiens
atatattcccaagct

SEQ ID NO: 4375025 - DNA, 20 bp, Homo sapiens
atatattgaaagttgctttt

SEQ ID NO: 4375026 - DNA, 21 bp, Homo sapiens
atatattgaaagttgctttta

SEQ ID NO: 4375027 - DNA, 13 bp, Homo sapiens
atattacaatgat

SEQ ID NO: 4375028 - DNA, 21 bp, Homo sapiens
atattacctaatgaaagtgat

SEQ ID NO: 4375029 - DNA, 23 bp, Homo sapiens
atattactctagtttattctaat

SEQ ID NO: 4375030 - DNA, 17 bp, Homo sapiens
atattagcaaagaagct

SEQ ID NO: 4375031 - DNA, 19 bp, Homo sapiens
atattagtattatcttgtt

SEQ ID NO: 4375032 - DNA, 15 bp, Homo sapiens
atattataagttgac

SEQ ID NO: 4375033 - DNA, 12 bp, Homo sapiens
atattatagaaa

SEQ ID NO: 4375034 - DNA, 13 bp, Homo sapiens
atattatagaaaa

SEQ ID NO: 4375035 - DNA, 15 bp, Homo sapiens
atattatgtgaagaa

SEQ ID NO: 4375036 - DNA, 19 bp, Homo sapiens
atattattagttttgattt

SEQ ID NO: 4375037 - DNA, 18 bp, Homo sapiens
atattattataatcttat

SEQ ID NO: 4375038 - DNA, 19 bp, Homo sapiens
atattattataatcttata

SEQ ID NO: 4375039 - DNA, 13 bp, Homo sapiens
atattatttgtct

SEQ ID NO: 4375040 - DNA, 18 bp, Homo sapiens
atattatttgtgtttcct

SEQ ID NO: 4375041 - DNA, 14 bp, Homo sapiens
atattattttaaat

SEQ ID NO: 4375042 - DNA, 15 bp, Homo sapiens
atattattttagtgt

SEQ ID NO: 4375043 - DNA, 21 bp, Homo sapiens
atattattttagtgtgtaaaa

SEQ ID NO: 4375044 - DNA, 23 bp, Homo sapiens
atattattttagtgtgtaaaatt

SEQ ID NO: 4375045 - DNA, 21 bp, Homo sapiens
atattcaactattcttcattt

SEQ ID NO: 4375046 - DNA, 22 bp, Homo sapiens
atattcaactattcttcattta

SEQ ID NO: 4375047 - DNA, 14 bp, Homo sapiens
atattcaaggcttt

SEQ ID NO: 4375048 - DNA, 14 bp, Homo sapiens
atattcaatgtatt

SEQ ID NO: 4375049 - DNA, 15 bp, Homo sapiens
atattcactgggcca

SEQ ID NO: 4375050 - DNA, 12 bp, Homo sapiens
atattcagaaat

SEQ ID NO: 4375051 - DNA, 19 bp, Homo sapiens
atattcagacaaaatggat

SEQ ID NO: 4375052 - DNA, 19 bp, Homo sapiens
atattcagccagcttaaac

SEQ ID NO: 4375053 - DNA, 12 bp, Homo sapiens
atattcatattg

SEQ ID NO: 4375054 - DNA, 17 bp, Homo sapiens
atattcatattggaaaa

SEQ ID NO: 4375055 - DNA, 17 bp, Homo sapiens
atattcattctttttga

SEQ ID NO: 4375056 - DNA, 22 bp, Homo sapiens
atattcctattgtgcaatgtaa

SEQ ID NO: 4375057 - DNA, 16 bp, Homo sapiens
atattcctttttctat

SEQ ID NO: 4375058 - DNA, 21 bp, Homo sapiens
atattcctttttctatgaaat

SEQ ID NO: 4375059 - DNA, 16 bp, Homo sapiens
atattctaattaaaat

SEQ ID NO: 4375060 - DNA, 22 bp, Homo sapiens
atattctattacattttcagtg

SEQ ID NO: 4375061 - DNA, 22 bp, Homo sapiens
atattctcacgggcagtagctg

SEQ ID NO: 4375062 - DNA, 21 bp, Homo sapiens
atattctgttttgttaatata

SEQ ID NO: 4375063 - DNA, 12 bp, Homo sapiens
atattctttctt

SEQ ID NO: 4375064 - DNA, 21 bp, Homo sapiens
atattgaaaattgaaaagtac

SEQ ID NO: 4375065 - DNA, 16 bp, Homo sapiens
atattgaaagttgctt

SEQ ID NO: 4375066 - DNA, 18 bp, Homo sapiens
atattgaaggagaaaata

SEQ ID NO: 4375067 - DNA, 13 bp, Homo sapiens
atattgaatgtga

SEQ ID NO: 4375068 - DNA, 16 bp, Homo sapiens
atattgaatgtgaaac

SEQ ID NO: 4375069 - DNA, 12 bp, Homo sapiens
atattgataaat

SEQ ID NO: 4375070 - DNA, 16 bp, Homo sapiens
atattgataaatttta

SEQ ID NO: 4375071 - DNA, 22 bp, Homo sapiens
atattgatctttttatcatgat

SEQ ID NO: 4375072 - DNA, 12 bp, Homo sapiens
atattgcaatga

SEQ ID NO: 4375073 - DNA, 18 bp, Homo sapiens
atattgcaattgatgtga

SEQ ID NO: 4375074 - DNA, 16 bp, Homo sapiens
atattgcccaaataat

SEQ ID NO: 4375075 - DNA, 21 bp, Homo sapiens
atattgccttatttgtctgta

SEQ ID NO: 4375076 - DNA, 19 bp, Homo sapiens
atattgctactataatcaa

SEQ ID NO: 4375077 - DNA, 21 bp, Homo sapiens
atattgctgaagaatctactt

SEQ ID NO: 4375078 - DNA, 23 bp, Homo sapiens
atattgcttcctgtgtaacatct

SEQ ID NO: 4375079 - DNA, 22 bp, Homo sapiens
atattggaagctgctgaggccc

SEQ ID NO: 4375080 - DNA, 22 bp, Homo sapiens
atattggtgctatttaacattt

SEQ ID NO: 4375081 - DNA, 14 bp, Homo sapiens
atattgtaaagaag

SEQ ID NO: 4375082 - DNA, 12 bp, Homo sapiens
atattgtacagt

SEQ ID NO: 4375083 - DNA, 22 bp, Homo sapiens
atattgtattgttagatgtttg

SEQ ID NO: 4375084 - DNA, 14 bp, Homo sapiens
atattgtgattctg

SEQ ID NO: 4375085 - DNA, 19 bp, Homo sapiens
atattgtgattctgccttt

SEQ ID NO: 4375086 - DNA, 20 bp, Homo sapiens
atattgtgttgactttataa

SEQ ID NO: 4375087 - DNA, 15 bp, Homo sapiens
atattgttataaata

SEQ ID NO: 4375088 - DNA, 16 bp, Homo sapiens
atattgttataaataa

SEQ ID NO: 4375089 - DNA, 17 bp, Homo sapiens
atattgtttttctttct

SEQ ID NO: 4375090 - DNA, 17 bp, Homo sapiens
atatttaaaaatgtctt

SEQ ID NO: 4375091 - DNA, 18 bp, Homo sapiens
atatttaaaaatgtcttg

SEQ ID NO: 4375092 - DNA, 16 bp, Homo sapiens
atatttaactggtgca

SEQ ID NO: 4375093 - DNA, 14 bp, Homo sapiens
atatttaagtttgt

SEQ ID NO: 4375094 - DNA, 15 bp, Homo sapiens
atatttaatatcaaa

SEQ ID NO: 4375095 - DNA, 21 bp, Homo sapiens
atatttaatgttttaaatgta

SEQ ID NO: 4375096 - DNA, 18 bp, Homo sapiens
atatttagcagtattgtt

SEQ ID NO: 4375097 - DNA, 13 bp, Homo sapiens
atatttagctgtt

SEQ ID NO: 4375098 - DNA, 20 bp, Homo sapiens
atatttaggaaaatgcttat

SEQ ID NO: 4375099 - DNA, 19 bp, Homo sapiens
atatttagggtactattca

SEQ ID NO: 4375100 - DNA, 19 bp, Homo sapiens
atatttatatactttttca

SEQ ID NO: 4375101 - DNA, 16 bp, Homo sapiens
atatttattcattatt

SEQ ID NO: 4375102 - DNA, 21 bp, Homo sapiens
atatttattgcattgctggta

SEQ ID NO: 4375103 - DNA, 16 bp, Homo sapiens
atatttattgttagaa

SEQ ID NO: 4375104 - DNA, 14 bp, Homo sapiens
atatttatttctag

SEQ ID NO: 4375105 - DNA, 18 bp, Homo sapiens
atatttatttctagcaaa

SEQ ID NO: 4375106 - DNA, 23 bp, Homo sapiens
atatttatttttacctgcttttt

SEQ ID NO: 4375107 - DNA, 15 bp, Homo sapiens
atatttcagatgtaa

SEQ ID NO: 4375108 - DNA, 19 bp, Homo sapiens
atatttcagatgtaatgtt

SEQ ID NO: 4375109 - DNA, 21 bp, Homo sapiens
atatttcagatgtaatgtttt

SEQ ID NO: 4375110 - DNA, 20 bp, Homo sapiens
atatttcctttatgtgaatt

SEQ ID NO: 4375111 - DNA, 13 bp, Homo sapiens
atatttcttaagt

SEQ ID NO: 4375112 - DNA, 15 bp, Homo sapiens
atatttcttcaaata

SEQ ID NO: 4375113 - DNA, 13 bp, Homo sapiens
atatttcttgctt

SEQ ID NO: 4375114 - DNA, 15 bp, Homo sapiens
atatttcttgctttc

SEQ ID NO: 4375115 - DNA, 20 bp, Homo sapiens
atatttcttgctttcaatta

SEQ ID NO: 4375116 - DNA, 21 bp, Homo sapiens
atatttcttttgttgtacttt

SEQ ID NO: 4375117 - DNA, 17 bp, Homo sapiens
atatttgaaataaagtt

SEQ ID NO: 4375118 - DNA, 18 bp, Homo sapiens
atatttgaaatagtatac

SEQ ID NO: 4375119 - DNA, 23 bp, Homo sapiens
atatttgaaatagtatacattgt

SEQ ID NO: 4375120 - DNA, 23 bp, Homo sapiens
atatttgcagtttttcattttaa

SEQ ID NO: 4375121 - DNA, 17 bp, Homo sapiens
atatttgctaagaatgt

SEQ ID NO: 4375122 - DNA, 16 bp, Homo sapiens
atatttggaattgaac

SEQ ID NO: 4375123 - DNA, 20 bp, Homo sapiens
atatttgtaaatttatgtga

SEQ ID NO: 4375124 - DNA, 15 bp, Homo sapiens
atatttgtaaggctt

SEQ ID NO: 4375125 - DNA, 13 bp, Homo sapiens
atatttgtatgat

SEQ ID NO: 4375126 - DNA, 18 bp, Homo sapiens
atatttgtatgtttttct

SEQ ID NO: 4375127 - DNA, 13 bp, Homo sapiens
atatttgttactt

SEQ ID NO: 4375128 - DNA, 23 bp, Homo sapiens
atatttgttactttacttttgct

SEQ ID NO: 4375129 - DNA, 15 bp, Homo sapiens
atattttaaaatttg

SEQ ID NO: 4375130 - DNA, 14 bp, Homo sapiens
atattttaaagaat

SEQ ID NO: 4375131 - DNA, 20 bp, Homo sapiens
atattttaaagaattgtgtc

SEQ ID NO: 4375132 - DNA, 15 bp, Homo sapiens
atattttaaattctc

SEQ ID NO: 4375133 - DNA, 13 bp, Homo sapiens
atattttaacttt

SEQ ID NO: 4375134 - DNA, 14 bp, Homo sapiens
atattttacataca

SEQ ID NO: 4375135 - DNA, 13 bp, Homo sapiens
atattttatgaac

SEQ ID NO: 4375136 - DNA, 14 bp, Homo sapiens
atattttatgaaca

SEQ ID NO: 4375137 - DNA, 15 bp, Homo sapiens
atattttatgtgaga

SEQ ID NO: 4375138 - DNA, 15 bp, Homo sapiens
atattttatttcaat

SEQ ID NO: 4375139 - DNA, 17 bp, Homo sapiens
atattttatttcaatgt

SEQ ID NO: 4375140 - DNA, 18 bp, Homo sapiens
atattttcaagtttttca

SEQ ID NO: 4375141 - DNA, 20 bp, Homo sapiens
atattttcatcctataagct

SEQ ID NO: 4375142 - DNA, 20 bp, Homo sapiens
atattttctttctagtttgt

SEQ ID NO: 4375143 - DNA, 18 bp, Homo sapiens
atattttgatgcagataa

SEQ ID NO: 4375144 - DNA, 21 bp, Homo sapiens
atattttgtaatattctgttt

SEQ ID NO: 4375145 - DNA, 22 bp, Homo sapiens
atcagaatagccacatttggaa

SEQ ID NO: 4375146 - DNA, 13 bp, Homo sapiens
atcagaatttgtg

SEQ ID NO: 4375147 - DNA, 20 bp, Homo sapiens
atcagacccaacccatgaag

SEQ ID NO: 4375148 - DNA, 14 bp, Homo sapiens
atcagagaaggaac

SEQ ID NO: 4375149 - DNA, 23 bp, Homo sapiens
atcagagataaagcttaggtcaa

SEQ ID NO: 4375150 - DNA, 23 bp, Homo sapiens
atcagagcctttcctcaaaactg

SEQ ID NO: 4375151 - DNA, 15 bp, Homo sapiens
atcagaggtatctta

SEQ ID NO: 4375152 - DNA, 16 bp, Homo sapiens
atcagatatgcttact

SEQ ID NO: 4375153 - DNA, 15 bp, Homo sapiens
atcagatggtgtcat

SEQ ID NO: 4375154 - DNA, 13 bp, Homo sapiens
atcagcaaaaaag

SEQ ID NO: 4375155 - DNA, 14 bp, Homo sapiens
atcagcaaagaaaa

SEQ ID NO: 4375156 - DNA, 11 bp, Homo sapiens
atcagccctgc

SEQ ID NO: 4375157 - DNA, 14 bp, Homo sapiens
atcagcctgtgcca

SEQ ID NO: 4375158 - DNA, 17 bp, Homo sapiens
atcagcgctctgtagct

SEQ ID NO: 4375159 - DNA, 13 bp, Homo sapiens
atcagctccttcc

SEQ ID NO: 4375160 - DNA, 15 bp, Homo sapiens
atcagctccttcctg

SEQ ID NO: 4375161 - DNA, 14 bp, Homo sapiens
atcagctctgcctt

SEQ ID NO: 4375162 - DNA, 21 bp, Homo sapiens
atcagctgctgaaacaacaaa

SEQ ID NO: 4375163 - DNA, 23 bp, Homo sapiens
atcagctgctgaaacaacaaata

SEQ ID NO: 4375164 - DNA, 18 bp, Homo sapiens
atcagcttttctgatggt

SEQ ID NO: 4375165 - DNA, 19 bp, Homo sapiens
atcagcttttcttattcct

SEQ ID NO: 4375166 - DNA, 18 bp, Homo sapiens
atcagcttttgttctaga

SEQ ID NO: 4375167 - DNA, 19 bp, Homo sapiens
atcagcttttgttctagac

SEQ ID NO: 4375168 - DNA, 14 bp, Homo sapiens
atcaggaaagagag

SEQ ID NO: 4375169 - DNA, 12 bp, Homo sapiens
atcaggagagca

SEQ ID NO: 4375170 - DNA, 19 bp, Homo sapiens
atcaggataccagaggaag

SEQ ID NO: 4375171 - DNA, 21 bp, Homo sapiens
atcaggatccagtctggaaaa

SEQ ID NO: 4375172 - DNA, 20 bp, Homo sapiens
atcagggcggcctcccaggt

SEQ ID NO: 4375173 - DNA, 22 bp, Homo sapiens
atcagggcggcctcccaggtcc

SEQ ID NO: 4375174 - DNA, 16 bp, Homo sapiens
atcagtagaaagctaa

SEQ ID NO: 4375175 - DNA, 16 bp, Homo sapiens
atcagtagttcacata

SEQ ID NO: 4375176 - DNA, 20 bp, Homo sapiens
atcagtatattttctgtatt

SEQ ID NO: 4375177 - DNA, 16 bp, Homo sapiens
atcagtattctgacat

SEQ ID NO: 4375178 - DNA, 16 bp, Homo sapiens
atcagtcctagaatgt

SEQ ID NO: 4375179 - DNA, 21 bp, Homo sapiens
atcagtcctagaatgtttcat

SEQ ID NO: 4375180 - DNA, 13 bp, Homo sapiens
atcagtgtccttt

SEQ ID NO: 4375181 - DNA, 16 bp, Homo sapiens
atcagttactcagccc

SEQ ID NO: 4375182 - DNA, 22 bp, Homo sapiens
atcagttccagccttctctcaa

SEQ ID NO: 4375183 - DNA, 20 bp, Homo sapiens
atcagtttaaaagcacgaca

SEQ ID NO: 4375184 - DNA, 13 bp, Homo sapiens
atcataaagtcag

SEQ ID NO: 4375185 - DNA, 21 bp, Homo sapiens
atcataaggagttggtgtaat

SEQ ID NO: 4375186 - DNA, 14 bp, Homo sapiens
atcatactcttcta

SEQ ID NO: 4375187 - DNA, 15 bp, Homo sapiens
atcatactcttctaa

SEQ ID NO: 4375188 - DNA, 15 bp, Homo sapiens
atcatacttaacatt

SEQ ID NO: 4375189 - DNA, 19 bp, Homo sapiens
atcatacttaacatttcat

SEQ ID NO: 4375190 - DNA, 18 bp, Homo sapiens
atcatagaaaattgaaac

SEQ ID NO: 4375191 - DNA, 21 bp, Homo sapiens
atcatagattattataaacta

SEQ ID NO: 4375192 - DNA, 22 bp, Homo sapiens
atcatagattattataaactat

SEQ ID NO: 4375193 - DNA, 23 bp, Homo sapiens
atcatagattattataaactata

SEQ ID NO: 4375194 - DNA, 20 bp, Homo sapiens
atcatagctcactgcagcct

SEQ ID NO: 4375195 - DNA, 14 bp, Homo sapiens
atcatagttaacat

SEQ ID NO: 4375196 - DNA, 21 bp, Homo sapiens
atcatcaagtaatacaaacta

SEQ ID NO: 4375197 - DNA, 17 bp, Homo sapiens
atcatcacgtatgttat

SEQ ID NO: 4375198 - DNA, 21 bp, Homo sapiens
atcatcacgtatgttatacaa

SEQ ID NO: 4375199 - DNA, 22 bp, Homo sapiens
atcatcacgtatgttatacaac

SEQ ID NO: 4375200 - DNA, 16 bp, Homo sapiens
atcatcactgtaaaga

SEQ ID NO: 4375201 - DNA, 17 bp, Homo sapiens
atcatcactgtaaagac

SEQ ID NO: 4375202 - DNA, 15 bp, Homo sapiens
atcatcagtgtagaa

SEQ ID NO: 4375203 - DNA, 13 bp, Homo sapiens
atcatccacacat

SEQ ID NO: 4375204 - DNA, 17 bp, Homo sapiens
atcatcctccattgctc

SEQ ID NO: 4375205 - DNA, 14 bp, Homo sapiens
atcatcctttcagt

SEQ ID NO: 4375206 - DNA, 21 bp, Homo sapiens
atcatctattttgatgcagca

SEQ ID NO: 4375207 - DNA, 13 bp, Homo sapiens
atcatctgtcatt

SEQ ID NO: 4375208 - DNA, 17 bp, Homo sapiens
atcatctgtcattatat

SEQ ID NO: 4375209 - DNA, 14 bp, Homo sapiens
atcatctgtttgta

SEQ ID NO: 4375210 - DNA, 15 bp, Homo sapiens
atcatcttataatta

SEQ ID NO: 4375211 - DNA, 15 bp, Homo sapiens
atcatcttgaacatt

SEQ ID NO: 4375212 - DNA, 13 bp, Homo sapiens
atcatgaagcctg

SEQ ID NO: 4375213 - DNA, 14 bp, Homo sapiens
atcatgaagcctgt

SEQ ID NO: 4375214 - DNA, 15 bp, Homo sapiens
atcatgaagcctgtg

SEQ ID NO: 4375215 - DNA, 18 bp, Homo sapiens
atcatgaatgcttttagt

SEQ ID NO: 4375216 - DNA, 19 bp, Homo sapiens
atcatgaattttaaagtat

SEQ ID NO: 4375217 - DNA, 19 bp, Homo sapiens
atcatgcacacaattagat

SEQ ID NO: 4375218 - DNA, 19 bp, Homo sapiens
atcatgcactttttctcct

SEQ ID NO: 4375219 - DNA, 17 bp, Homo sapiens
atcatggaagaaaagga

SEQ ID NO: 4375220 - DNA, 18 bp, Homo sapiens
atcatggaagaaaaggat

SEQ ID NO: 4375221 - DNA, 22 bp, Homo sapiens
atcatggacctggtgcccctgc

SEQ ID NO: 4375222 - DNA, 19 bp, Homo sapiens
atcatgtaacattcttcta

SEQ ID NO: 4375223 - DNA, 11 bp, Homo sapiens
atcatgtctgt

SEQ ID NO: 4375224 - DNA, 16 bp, Homo sapiens
atcatgtcttcatttt

SEQ ID NO: 4375225 - DNA, 22 bp, Homo sapiens
atcatgtcttcattttttaatg

SEQ ID NO: 4375226 - DNA, 16 bp, Homo sapiens
atcatgttgatcatgt

SEQ ID NO: 4375227 - DNA, 22 bp, Homo sapiens
atcatgttgttgtgtgtatatg

SEQ ID NO: 4375228 - DNA, 23 bp, Homo sapiens
atcatgttgttgtgtgtatatgt

SEQ ID NO: 4375229 - DNA, 17 bp, Homo sapiens
atcattatctttgctgt

SEQ ID NO: 4375230 - DNA, 12 bp, Homo sapiens
atcattcaagtg

SEQ ID NO: 4375231 - DNA, 12 bp, Homo sapiens
atcattctctgt

SEQ ID NO: 4375232 - DNA, 16 bp, Homo sapiens
atcattctctgtctca

SEQ ID NO: 4375233 - DNA, 21 bp, Homo sapiens
atcattctctgtctcatccat

SEQ ID NO: 4375234 - DNA, 16 bp, Homo sapiens
atcattgtcagccttg

SEQ ID NO: 4375235 - DNA, 21 bp, Homo sapiens
atcattgtcagccttgctact

SEQ ID NO: 4375236 - DNA, 15 bp, Homo sapiens
atcattgttttgaat

SEQ ID NO: 4375237 - DNA, 18 bp, Homo sapiens
atcattgttttgaatatt

SEQ ID NO: 4375238 - DNA, 19 bp, Homo sapiens
atcatttaaacatgcagaa

SEQ ID NO: 4375239 - DNA, 13 bp, Homo sapiens
atcatttcagcca

SEQ ID NO: 4375240 - DNA, 15 bp, Homo sapiens
atcatttcagccaaa

SEQ ID NO: 4375241 - DNA, 16 bp, Homo sapiens
atcatttcagccaaag

SEQ ID NO: 4375242 - DNA, 20 bp, Homo sapiens
atcatttctgcatcagctgc

SEQ ID NO: 4375243 - DNA, 18 bp, Homo sapiens
atcatttggcttgctgtt

SEQ ID NO: 4375244 - DNA, 13 bp, Homo sapiens
atcatttgtttaa

SEQ ID NO: 4375245 - DNA, 14 bp, Homo sapiens
atcatttgtttaaa

SEQ ID NO: 4375246 - DNA, 15 bp, Homo sapiens
atcatttgtttaaaa

SEQ ID NO: 4375247 - DNA, 15 bp, Homo sapiens
atcattttaggaaag

SEQ ID NO: 4375248 - DNA, 22 bp, Homo sapiens
atcattttgcaatcccttaata

SEQ ID NO: 4375249 - DNA, 17 bp, Homo sapiens
atcatttttgagcaact

SEQ ID NO: 4375250 - DNA, 19 bp, Homo sapiens
atccaaaaagctctgaaaa

SEQ ID NO: 4375251 - DNA, 21 bp, Homo sapiens
atccaaaaagctctgaaaaca

SEQ ID NO: 4375252 - DNA, 13 bp, Homo sapiens
atccaaaagcttt

SEQ ID NO: 4375253 - DNA, 15 bp, Homo sapiens
atccaaccattttca

SEQ ID NO: 4375254 - DNA, 16 bp, Homo sapiens
atccaactaatgcctt

SEQ ID NO: 4375255 - DNA, 20 bp, Homo sapiens
atccaactaatgccttactc

SEQ ID NO: 4375256 - DNA, 15 bp, Homo sapiens
atccaactattaaga

SEQ ID NO: 4375257 - DNA, 14 bp, Homo sapiens
atccaaggaaacat

SEQ ID NO: 4375258 - DNA, 20 bp, Homo sapiens
atccaaggaaacatgcagct

SEQ ID NO: 4375259 - DNA, 21 bp, Homo sapiens
atccaaggaagggatgtattt

SEQ ID NO: 4375260 - DNA, 12 bp, Homo sapiens
atccacacaaat

SEQ ID NO: 4375261 - DNA, 14 bp, Homo sapiens
atccacacatgaat

SEQ ID NO: 4375262 - DNA, 17 bp, Homo sapiens
atccacagccttgcagc

SEQ ID NO: 4375263 - DNA, 16 bp, Homo sapiens
atccacatgtttcaga

SEQ ID NO: 4375264 - DNA, 18 bp, Homo sapiens
atccacatgtttcagagc

SEQ ID NO: 4375265 - DNA, 14 bp, Homo sapiens
atccacccagccca

SEQ ID NO: 4375266 - DNA, 23 bp, Homo sapiens
atccacccgggggagcccagtga

SEQ ID NO: 4375267 - DNA, 15 bp, Homo sapiens
atccacgctgggcct

SEQ ID NO: 4375268 - DNA, 23 bp, Homo sapiens
atccacgctgggcctaggatggg

SEQ ID NO: 4375269 - DNA, 20 bp, Homo sapiens
atccactctaccctcccacc

SEQ ID NO: 4375270 - DNA, 23 bp, Homo sapiens
atccactctaccctcccaccccc

SEQ ID NO: 4375271 - DNA, 19 bp, Homo sapiens
atccactctgcctgcttac

SEQ ID NO: 4375272 - DNA, 17 bp, Homo sapiens
atccactgggaccccca

SEQ ID NO: 4375273 - DNA, 15 bp, Homo sapiens
atccagacctgagcg

SEQ ID NO: 4375274 - DNA, 14 bp, Homo sapiens
atccagagagcagc

SEQ ID NO: 4375275 - DNA, 17 bp, Homo sapiens
atccagcagcagcactt

SEQ ID NO: 4375276 - DNA, 15 bp, Homo sapiens
atccagcctcagaga

SEQ ID NO: 4375277 - DNA, 15 bp, Homo sapiens
atccagctatgttat

SEQ ID NO: 4375278 - DNA, 24 bp, Homo sapiens
atccaggctggccagtgctgccca

SEQ ID NO: 4375279 - DNA, 17 bp, Homo sapiens
atccaggctgttctcag

SEQ ID NO: 4375280 - DNA, 19 bp, Homo sapiens
atccaggttccctcccaga

SEQ ID NO: 4375281 - DNA, 20 bp, Homo sapiens
atccagtcattttattttgt

SEQ ID NO: 4375282 - DNA, 18 bp, Homo sapiens
atccagtctatcattgtt

SEQ ID NO: 4375283 - DNA, 16 bp, Homo sapiens
atccagtttctttccc

SEQ ID NO: 4375284 - DNA, 13 bp, Homo sapiens
atccataaaaaaa

SEQ ID NO: 4375285 - DNA, 18 bp, Homo sapiens
atccatattgagtcaaat

SEQ ID NO: 4375286 - DNA, 20 bp, Homo sapiens
atccatattgagtcaaatgg

SEQ ID NO: 4375287 - DNA, 15 bp, Homo sapiens
atccatatttgctaa

SEQ ID NO: 4375288 - DNA, 18 bp, Homo sapiens
atccatcatcatgtgtgt

SEQ ID NO: 4375289 - DNA, 20 bp, Homo sapiens
atccatgacctagttttcca

SEQ ID NO: 4375290 - DNA, 21 bp, Homo sapiens
atccatgacctagttttccat

SEQ ID NO: 4375291 - DNA, 15 bp, Homo sapiens
atccatgcattatat

SEQ ID NO: 4375292 - DNA, 12 bp, Homo sapiens
atccatgcctca

SEQ ID NO: 4375293 - DNA, 10 bp, Homo sapiens
atccatgctt

SEQ ID NO: 4375294 - DNA, 15 bp, Homo sapiens
atccatgcttcactc

SEQ ID NO: 4375295 - DNA, 19 bp, Homo sapiens
atccattcacaagcctcct

SEQ ID NO: 4375296 - DNA, 19 bp, Homo sapiens
atccattccaggtagctcg

SEQ ID NO: 4375297 - DNA, 13 bp, Homo sapiens
atccattgttgtg

SEQ ID NO: 4375298 - DNA, 14 bp, Homo sapiens
atccatttatcttt

SEQ ID NO: 4375299 - DNA, 16 bp, Homo sapiens
atccatttatttcatt

SEQ ID NO: 4375300 - DNA, 16 bp, Homo sapiens
atcccaacactgccag

SEQ ID NO: 4375301 - DNA, 17 bp, Homo sapiens
atcccaacactgccagc

SEQ ID NO: 4375302 - DNA, 20 bp, Homo sapiens
atcccaaggcaagcatgaat

SEQ ID NO: 4375303 - DNA, 13 bp, Homo sapiens
atcccacccacct

SEQ ID NO: 4375304 - DNA, 13 bp, Homo sapiens
atcccaccttccc

SEQ ID NO: 4375305 - DNA, 17 bp, Homo sapiens
atcccacgttctgttaa

SEQ ID NO: 4375306 - DNA, 11 bp, Homo sapiens
atcccagcact

SEQ ID NO: 4375307 - DNA, 17 bp, Homo sapiens
atcccagctactcagga

SEQ ID NO: 4375308 - DNA, 18 bp, Homo sapiens
atcccaggcccctggagg

SEQ ID NO: 4375309 - DNA, 24 bp, Homo sapiens
atcccaggcccctggaggctgcct

SEQ ID NO: 4375310 - DNA, 18 bp, Homo sapiens
atcccatctctacaaaaa

SEQ ID NO: 4375311 - DNA, 23 bp, Homo sapiens
atcccatctctacaaaaaatgca

SEQ ID NO: 4375312 - DNA, 15 bp, Homo sapiens
atccccaactgctcc

SEQ ID NO: 4375313 - DNA, 22 bp, Homo sapiens
atccccaactgctccagcctct

SEQ ID NO: 4375314 - DNA, 12 bp, Homo sapiens
atccccaccact

SEQ ID NO: 4375315 - DNA, 13 bp, Homo sapiens
atccccaccccac

SEQ ID NO: 4375316 - DNA, 15 bp, Homo sapiens
atccccaccccaccc

SEQ ID NO: 4375317 - DNA, 23 bp, Homo sapiens
atccccaggggtcccagccaccc

SEQ ID NO: 4375318 - DNA, 15 bp, Homo sapiens
atcccctccctgcct

SEQ ID NO: 4375319 - DNA, 17 bp, Homo sapiens
atcccctccctgcctgc

SEQ ID NO: 4375320 - DNA, 19 bp, Homo sapiens
atcccctccctgcctgctc

SEQ ID NO: 4375321 - DNA, 20 bp, Homo sapiens
atcccctccctgcctgctcc

SEQ ID NO: 4375322 - DNA, 12 bp, Homo sapiens
atccctaccact

SEQ ID NO: 4375323 - DNA, 14 bp, Homo sapiens
atccctacccccta

SEQ ID NO: 4375324 - DNA, 12 bp, Homo sapiens
atccctcaccca

SEQ ID NO: 4375325 - DNA, 22 bp, Homo sapiens
atccctcccctctctccctggt

SEQ ID NO: 4375326 - DNA, 17 bp, Homo sapiens
atccctctacagagctt

SEQ ID NO: 4375327 - DNA, 16 bp, Homo sapiens
atccctctcttcccct

SEQ ID NO: 4375328 - DNA, 21 bp, Homo sapiens
atccctctcttccccttccct

SEQ ID NO: 4375329 - DNA, 22 bp, Homo sapiens
atccctgaatcccccttgccac

SEQ ID NO: 4375330 - DNA, 18 bp, Homo sapiens
atccctgaggactgattt

SEQ ID NO: 4375331 - DNA, 22 bp, Homo sapiens
atccctgaggactgatttcaga

SEQ ID NO: 4375332 - DNA, 16 bp, Homo sapiens
atccctgcggcctcca

SEQ ID NO: 4375333 - DNA, 18 bp, Homo sapiens
atccctgcttgcccgctc

SEQ ID NO: 4375334 - DNA, 18 bp, Homo sapiens
atccctggagcaggagcc

SEQ ID NO: 4375335 - DNA, 22 bp, Homo sapiens
atccctggagcaggagccccgc

SEQ ID NO: 4375336 - DNA, 13 bp, Homo sapiens
atccctgggcccc

SEQ ID NO: 4375337 - DNA, 16 bp, Homo sapiens
atccctgggcccctcc

SEQ ID NO: 4375338 - DNA, 21 bp, Homo sapiens
atccctgggcccctccacgcc

SEQ ID NO: 4375339 - DNA, 21 bp, Homo sapiens
atcccttaatatcctaaacat

SEQ ID NO: 4375340 - DNA, 18 bp, Homo sapiens
atcccttatccaaaatgc

SEQ ID NO: 4375341 - DNA, 19 bp, Homo sapiens
atcccttcccacatgcctg

SEQ ID NO: 4375342 - DNA, 17 bp, Homo sapiens
atcccttggacatttta

SEQ ID NO: 4375343 - DNA, 20 bp, Homo sapiens
atcccttggacattttatgt

SEQ ID NO: 4375344 - DNA, 22 bp, Homo sapiens
atccgagtgtttgccaggctta

SEQ ID NO: 4375345 - DNA, 20 bp, Homo sapiens
atccgctgccagccttgagc

SEQ ID NO: 4375346 - DNA, 16 bp, Homo sapiens
atccggtcagccaagt

SEQ ID NO: 4375347 - DNA, 16 bp, Homo sapiens
atcctaaactctctag

SEQ ID NO: 4375348 - DNA, 18 bp, Homo sapiens
atcctaaatatgacagtg

SEQ ID NO: 4375349 - DNA, 21 bp, Homo sapiens
atcctaagatgtgttcttatt

SEQ ID NO: 4375350 - DNA, 16 bp, Homo sapiens
atcctaaggttcttgc

SEQ ID NO: 4375351 - DNA, 16 bp, Homo sapiens
atcctaatttctcctc

SEQ ID NO: 4375352 - DNA, 20 bp, Homo sapiens
atcctaatttctcctccctt

SEQ ID NO: 4375353 - DNA, 14 bp, Homo sapiens
atcctaccccctgt

SEQ ID NO: 4375354 - DNA, 15 bp, Homo sapiens
atcctaccttgcttt

SEQ ID NO: 4375355 - DNA, 22 bp, Homo sapiens
atcctaccttgcttttgcttct

SEQ ID NO: 4375356 - DNA, 16 bp, Homo sapiens
atcctagagtcttaaa

SEQ ID NO: 4375357 - DNA, 20 bp, Homo sapiens
atcctcaaacgacagaggag

SEQ ID NO: 4375358 - DNA, 15 bp, Homo sapiens
atcctcaaagaaagt

SEQ ID NO: 4375359 - DNA, 19 bp, Homo sapiens
atcctcaaagaaagtgtat

SEQ ID NO: 4375360 - DNA, 21 bp, Homo sapiens
atcctcaaagaaagtgtattg

SEQ ID NO: 4375361 - DNA, 21 bp, Homo sapiens
atcctcagccgagaaattggg

SEQ ID NO: 4375362 - DNA, 16 bp, Homo sapiens
atcctcatatggccca

SEQ ID NO: 4375363 - DNA, 15 bp, Homo sapiens
atcctcatccctgac

SEQ ID NO: 4375364 - DNA, 13 bp, Homo sapiens
atcctccacagag

SEQ ID NO: 4375365 - DNA, 19 bp, Homo sapiens
atcctccacgttctgctca

SEQ ID NO: 4375366 - DNA, 13 bp, Homo sapiens
atcctcccattgc

SEQ ID NO: 4375367 - DNA, 19 bp, Homo sapiens
atcctcccattgcccagtg

SEQ ID NO: 4375368 - DNA, 12 bp, Homo sapiens
atcctccctcca

SEQ ID NO: 4375369 - DNA, 16 bp, Homo sapiens
atcctccctggcagac

SEQ ID NO: 4375370 - DNA, 13 bp, Homo sapiens
atcctcctgcctc

SEQ ID NO: 4375371 - DNA, 16 bp, Homo sapiens
atcctctcacctcagc

SEQ ID NO: 4375372 - DNA, 14 bp, Homo sapiens
atcctctcctttga

SEQ ID NO: 4375373 - DNA, 15 bp, Homo sapiens
atcctctcctttgaa

SEQ ID NO: 4375374 - DNA, 10 bp, Homo sapiens
atcctctggc

SEQ ID NO: 4375375 - DNA, 13 bp, Homo sapiens
atcctctgttgat

SEQ ID NO: 4375376 - DNA, 15 bp, Homo sapiens
atcctctgttttctc

SEQ ID NO: 4375377 - DNA, 18 bp, Homo sapiens
atcctctgttttctctct

SEQ ID NO: 4375378 - DNA, 17 bp, Homo sapiens
atcctgaactttctccc

SEQ ID NO: 4375379 - DNA, 20 bp, Homo sapiens
atcctgaactttctccctca

SEQ ID NO: 4375380 - DNA, 17 bp, Homo sapiens
atcctgaatctgtgcaa

SEQ ID NO: 4375381 - DNA, 17 bp, Homo sapiens
atcctgagtccagaatg

SEQ ID NO: 4375382 - DNA, 21 bp, Homo sapiens
atctcagaccctgcttaggat

SEQ ID NO: 4375383 - DNA, 19 bp, Homo sapiens
atctcagagtccactgtgg

SEQ ID NO: 4375384 - DNA, 20 bp, Homo sapiens
atctcagatgttaaaataaa

SEQ ID NO: 4375385 - DNA, 13 bp, Homo sapiens
atctcatcatgtc

SEQ ID NO: 4375386 - DNA, 19 bp, Homo sapiens
atctcatctcagtgaagaa

SEQ ID NO: 4375387 - DNA, 19 bp, Homo sapiens
atctcatgccagtgcctta

SEQ ID NO: 4375388 - DNA, 19 bp, Homo sapiens
atctcatgtatcatctgga

SEQ ID NO: 4375389 - DNA, 16 bp, Homo sapiens
atctcatgtgtgctca

SEQ ID NO: 4375390 - DNA, 15 bp, Homo sapiens
atctcattatttcaa

SEQ ID NO: 4375391 - DNA, 21 bp, Homo sapiens
atctcattatttcaaaatgat

SEQ ID NO: 4375392 - DNA, 14 bp, Homo sapiens
atctcattatttct

SEQ ID NO: 4375393 - DNA, 16 bp, Homo sapiens
atctcattatttctgg

SEQ ID NO: 4375394 - DNA, 19 bp, Homo sapiens
atctcattggacccttcca

SEQ ID NO: 4375395 - DNA, 20 bp, Homo sapiens
atctcattggacccttccat

SEQ ID NO: 4375396 - DNA, 14 bp, Homo sapiens
atctccatggccct

SEQ ID NO: 4375397 - DNA, 19 bp, Homo sapiens
atctcccagataatgtgaa

SEQ ID NO: 4375398 - DNA, 20 bp, Homo sapiens
atctcccagataatgtgaaa

SEQ ID NO: 4375399 - DNA, 12 bp, Homo sapiens
atctcccaggcc

SEQ ID NO: 4375400 - DNA, 17 bp, Homo sapiens
atctcccattttggaat

SEQ ID NO: 4375401 - DNA, 17 bp, Homo sapiens
atctccctagcccaccc

SEQ ID NO: 4375402 - DNA, 20 bp, Homo sapiens
atctccctgcctggccccca

SEQ ID NO: 4375403 - DNA, 18 bp, Homo sapiens
atctccgcctccacactg

SEQ ID NO: 4375404 - DNA, 22 bp, Homo sapiens
atctccgcctccacactgacca

SEQ ID NO: 4375405 - DNA, 14 bp, Homo sapiens
atctcctctgctca

SEQ ID NO: 4375406 - DNA, 16 bp, Homo sapiens
atctcctgccttcctc

SEQ ID NO: 4375407 - DNA, 17 bp, Homo sapiens
atctccttcccctacac

SEQ ID NO: 4375408 - DNA, 17 bp, Homo sapiens
atctccttttatctggt

SEQ ID NO: 4375409 - DNA, 20 bp, Homo sapiens
atctctacaaaaataaagaa

SEQ ID NO: 4375410 - DNA, 20 bp, Homo sapiens
atctctccccatatataaat

SEQ ID NO: 4375411 - DNA, 22 bp, Homo sapiens
atctctcctggcctatccgctg

SEQ ID NO: 4375412 - DNA, 21 bp, Homo sapiens
atctctctgtcttttttctct

SEQ ID NO: 4375413 - DNA, 15 bp, Homo sapiens
atctctcttgtcctc

SEQ ID NO: 4375414 - DNA, 20 bp, Homo sapiens
atctctcttgtcctcttctg

SEQ ID NO: 4375415 - DNA, 22 bp, Homo sapiens
atctctgaactggtagaaaaac

SEQ ID NO: 4375416 - DNA, 15 bp, Homo sapiens
atctcttaaattggg

SEQ ID NO: 4375417 - DNA, 21 bp, Homo sapiens
atctcttaagacagcatgtgt

SEQ ID NO: 4375418 - DNA, 14 bp, Homo sapiens
atctcttctggtgt

SEQ ID NO: 4375419 - DNA, 22 bp, Homo sapiens
atctctttctaaagacaggaga

SEQ ID NO: 4375420 - DNA, 17 bp, Homo sapiens
atctctttgatctactt

SEQ ID NO: 4375421 - DNA, 10 bp, Homo sapiens
atctcttttc

SEQ ID NO: 4375422 - DNA, 16 bp, Homo sapiens
atctgaaagtaaagtt

SEQ ID NO: 4375423 - DNA, 20 bp, Homo sapiens
atctgaagaggcttctcctg

SEQ ID NO: 4375424 - DNA, 21 bp, Homo sapiens
atctgaagaggcttctcctgt

SEQ ID NO: 4375425 - DNA, 21 bp, Homo sapiens
atctgaaggggcaaattcttt

SEQ ID NO: 4375426 - DNA, 17 bp, Homo sapiens
atctgaattaaataaat

SEQ ID NO: 4375427 - DNA, 18 bp, Homo sapiens
atctgaattaaataaata

SEQ ID NO: 4375428 - DNA, 12 bp, Homo sapiens
atctgaattttt

SEQ ID NO: 4375429 - DNA, 21 bp, Homo sapiens
atctgacccactttgtaattt

SEQ ID NO: 4375430 - DNA, 19 bp, Homo sapiens
atctgatggccttaatttc

SEQ ID NO: 4375431 - DNA, 18 bp, Homo sapiens
atctgcacagtcagaagg

SEQ ID NO: 4375432 - DNA, 22 bp, Homo sapiens
atctgcaccccttctctcctcc

SEQ ID NO: 4375433 - DNA, 23 bp, Homo sapiens
atctgcaccccttctctcctccc

SEQ ID NO: 4375434 - DNA, 12 bp, Homo sapiens
atctgcccctcc

SEQ ID NO: 4375435 - DNA, 15 bp, Homo sapiens
atctgcccctccccc

SEQ ID NO: 4375436 - DNA, 16 bp, Homo sapiens
atctgcccctccccca

SEQ ID NO: 4375437 - DNA, 23 bp, Homo sapiens
atctgcctcctgtgcctcccttt

SEQ ID NO: 4375438 - DNA, 12 bp, Homo sapiens
atctgcctgggt

SEQ ID NO: 4375439 - DNA, 21 bp, Homo sapiens
atctgccttaaaaccaaagag

SEQ ID NO: 4375440 - DNA, 18 bp, Homo sapiens
atctgcgggggcagtgct

SEQ ID NO: 4375441 - DNA, 18 bp, Homo sapiens
atctgctaccaaaacagt

SEQ ID NO: 4375442 - DNA, 13 bp, Homo sapiens
atctgctcctccc

SEQ ID NO: 4375443 - DNA, 20 bp, Homo sapiens
atctgctctccttcctggag

SEQ ID NO: 4375444 - DNA, 22 bp, Homo sapiens
atctgctgtccagacagcctgt

SEQ ID NO: 4375445 - DNA, 23 bp, Homo sapiens
atctgctgtccagacagcctgta

SEQ ID NO: 4375446 - DNA, 22 bp, Homo sapiens
atctgctgtcctgtttctgtca

SEQ ID NO: 4375447 - DNA, 21 bp, Homo sapiens
atctgcttggttggctggcag

SEQ ID NO: 4375448 - DNA, 19 bp, Homo sapiens
atctgcttttcctctgcct

SEQ ID NO: 4375449 - DNA, 23 bp, Homo sapiens
atctggaaataatatcatttata

SEQ ID NO: 4375450 - DNA, 22 bp, Homo sapiens
atctggagagctagaacctgga

SEQ ID NO: 4375451 - DNA, 22 bp, Homo sapiens
atctggataggagcctgctggt

SEQ ID NO: 4375452 - DNA, 15 bp, Homo sapiens
atctggattcaaatt

SEQ ID NO: 4375453 - DNA, 16 bp, Homo sapiens
atctggcaacatcttt

SEQ ID NO: 4375454 - DNA, 12 bp, Homo sapiens
atctggcagggt

SEQ ID NO: 4375455 - DNA, 14 bp, Homo sapiens
atctggcttctgca

SEQ ID NO: 4375456 - DNA, 15 bp, Homo sapiens
atctggcttctgcat

SEQ ID NO: 4375457 - DNA, 16 bp, Homo sapiens
atctgggaccctttcc

SEQ ID NO: 4375458 - DNA, 16 bp, Homo sapiens
atctgggactgtgcct

SEQ ID NO: 4375459 - DNA, 18 bp, Homo sapiens
atctgggactgtgcctgg

SEQ ID NO: 4375460 - DNA, 17 bp, Homo sapiens
atctgggcattttcctc

SEQ ID NO: 4375461 - DNA, 24 bp, Homo sapiens
atctgggcattttcctcctctgcc

SEQ ID NO: 4375462 - DNA, 21 bp, Homo sapiens
atctgggcttatatgtacttt

SEQ ID NO: 4375463 - DNA, 22 bp, Homo sapiens
atctggggcagcaccctataaa

SEQ ID NO: 4375464 - DNA, 15 bp, Homo sapiens
atctggtattaaatg

SEQ ID NO: 4375465 - DNA, 18 bp, Homo sapiens
atctggtattaaatgcca

SEQ ID NO: 4375466 - DNA, 14 bp, Homo sapiens
atctggtcatttgg

SEQ ID NO: 4375467 - DNA, 17 bp, Homo sapiens
atctgtaaactgtgtat

SEQ ID NO: 4375468 - DNA, 13 bp, Homo sapiens
atctgtaaagata

SEQ ID NO: 4375469 - DNA, 16 bp, Homo sapiens
atctgtaaatctacac

SEQ ID NO: 4375470 - DNA, 12 bp, Homo sapiens
atctgtaatgat

SEQ ID NO: 4375471 - DNA, 15 bp, Homo sapiens
atctgtataatactt

SEQ ID NO: 4375472 - DNA, 16 bp, Homo sapiens
atctgtataatacttt

SEQ ID NO: 4375473 - DNA, 21 bp, Homo sapiens
atctgtcaagagtagttatat

SEQ ID NO: 4375474 - DNA, 22 bp, Homo sapiens
atctgtcaagagtagttatata

SEQ ID NO: 4375475 - DNA, 17 bp, Homo sapiens
atctgtcacaccagcca

SEQ ID NO: 4375476 - DNA, 16 bp, Homo sapiens
atctgtcatctctctg

SEQ ID NO: 4375477 - DNA, 19 bp, Homo sapiens
atctgtcatctctctgggg

SEQ ID NO: 4375478 - DNA, 19 bp, Homo sapiens
atctgtctgccaacctaaa

SEQ ID NO: 4375479 - DNA, 13 bp, Homo sapiens
atctgtcttttat

SEQ ID NO: 4375480 - DNA, 11 bp, Homo sapiens
atctgtgaaat

SEQ ID NO: 4375481 - DNA, 12 bp, Homo sapiens
atctgtgaaata

SEQ ID NO: 4375482 - DNA, 16 bp, Homo sapiens
atctgtgaaatatcat

SEQ ID NO: 4375483 - DNA, 17 bp, Homo sapiens
atctgtgaaatatcatc

SEQ ID NO: 4375484 - DNA, 20 bp, Homo sapiens
atctgtgaagaaagaggtta

SEQ ID NO: 4375485 - DNA, 19 bp, Homo sapiens
atctgtgacctgtcagaat

SEQ ID NO: 4375486 - DNA, 21 bp, Homo sapiens
atctgtgaggggctctctcat

SEQ ID NO: 4375487 - DNA, 22 bp, Homo sapiens
atctgtgaggggctctctcatg

SEQ ID NO: 4375488 - DNA, 15 bp, Homo sapiens
atctgtgattccccc

SEQ ID NO: 4375489 - DNA, 14 bp, Homo sapiens
atctgtgcaaacag

SEQ ID NO: 4375490 - DNA, 13 bp, Homo sapiens
atctgtgccccat

SEQ ID NO: 4375491 - DNA, 16 bp, Homo sapiens
atctgtgctttccagc

SEQ ID NO: 4375492 - DNA, 19 bp, Homo sapiens
atctgtgggcatggtcaaa

SEQ ID NO: 4375493 - DNA, 23 bp, Homo sapiens
atctgtgggtctgggagtcacac

SEQ ID NO: 4375494 - DNA, 14 bp, Homo sapiens
atctgtgtcttgtt

SEQ ID NO: 4375495 - DNA, 14 bp, Homo sapiens
atctgtgtgcatat

SEQ ID NO: 4375496 - DNA, 17 bp, Homo sapiens
atctgtgtgcatatttg

SEQ ID NO: 4375497 - DNA, 21 bp, Homo sapiens
atctgtgtgcatatttgttac

SEQ ID NO: 4375498 - DNA, 21 bp, Homo sapiens
atctgttattcaaatttgatg

SEQ ID NO: 4375499 - DNA, 18 bp, Homo sapiens
atctgttcccagcccctc

SEQ ID NO: 4375500 - DNA, 23 bp, Homo sapiens
atctgttcccagcccctcctccc

SEQ ID NO: 4375501 - DNA, 19 bp, Homo sapiens
atctgttgcaagcccctct

SEQ ID NO: 4375502 - DNA, 15 bp, Homo sapiens
atctgtttctctgct

SEQ ID NO: 4375503 - DNA, 18 bp, Homo sapiens
atctgtttctctgctgtc

SEQ ID NO: 4375504 - DNA, 22 bp, Homo sapiens
atcttaaaagtgtgtaaatgct

SEQ ID NO: 4375505 - DNA, 11 bp, Homo sapiens
atcttaaacta

SEQ ID NO: 4375506 - DNA, 12 bp, Homo sapiens
atcttaagcagg

SEQ ID NO: 4375507 - DNA, 14 bp, Homo sapiens
atcttaatataaat

SEQ ID NO: 4375508 - DNA, 17 bp, Homo sapiens
atcttaattgcaagtct

SEQ ID NO: 4375509 - DNA, 14 bp, Homo sapiens
atcttacagaaaat

SEQ ID NO: 4375510 - DNA, 19 bp, Homo sapiens
atcttagataacttcttga

SEQ ID NO: 4375511 - DNA, 19 bp, Homo sapiens
atcttagtgtatgattact

SEQ ID NO: 4375512 - DNA, 13 bp, Homo sapiens
atcttagtgttca

SEQ ID NO: 4375513 - DNA, 15 bp, Homo sapiens
atcttataactgttt

SEQ ID NO: 4375514 - DNA, 16 bp, Homo sapiens
atcttataactgtttt

SEQ ID NO: 4375515 - DNA, 16 bp, Homo sapiens
atcttataattgttct

SEQ ID NO: 4375516 - DNA, 12 bp, Homo sapiens
atcttatattgg

SEQ ID NO: 4375517 - DNA, 16 bp, Homo sapiens
atcttatgcaaaactt

SEQ ID NO: 4375518 - DNA, 18 bp, Homo sapiens
atcttatgcaaaactttt

SEQ ID NO: 4375519 - DNA, 20 bp, Homo sapiens
atcttatttattttagcaaa

SEQ ID NO: 4375520 - DNA, 16 bp, Homo sapiens
atcttatttttcctgt

SEQ ID NO: 4375521 - DNA, 21 bp, Homo sapiens
atcttatttttcctgtcctgc

SEQ ID NO: 4375522 - DNA, 14 bp, Homo sapiens
atcttcactagaag

SEQ ID NO: 4375523 - DNA, 17 bp, Homo sapiens
atcttcactgccaagca

SEQ ID NO: 4375524 - DNA, 19 bp, Homo sapiens
atcttcagcatagaaggaa

SEQ ID NO: 4375525 - DNA, 18 bp, Homo sapiens
atcttcatgtaaattgac

SEQ ID NO: 4375526 - DNA, 15 bp, Homo sapiens
atcttcattaccaat

SEQ ID NO: 4375527 - DNA, 13 bp, Homo sapiens
atcttcctgctga

SEQ ID NO: 4375528 - DNA, 15 bp, Homo sapiens
atcttctacttttaa

SEQ ID NO: 4375529 - DNA, 11 bp, Homo sapiens
atcttctggat

SEQ ID NO: 4375530 - DNA, 12 bp, Homo sapiens
atcttctggatt

SEQ ID NO: 4375531 - DNA, 12 bp, Homo sapiens
atcttgaaatta

SEQ ID NO: 4375532 - DNA, 21 bp, Homo sapiens
atcttgaatactctgccctct

SEQ ID NO: 4375533 - DNA, 17 bp, Homo sapiens
atcttgactacagtcag

SEQ ID NO: 4375534 - DNA, 22 bp, Homo sapiens
atcttgagccacagtcactgga

SEQ ID NO: 4375535 - DNA, 23 bp, Homo sapiens
atcttgggggacagggctggccc

SEQ ID NO: 4375536 - DNA, 18 bp, Homo sapiens
atcttggtagtacatttt

SEQ ID NO: 4375537 - DNA, 18 bp, Homo sapiens
atcttggtagttctgtgc

SEQ ID NO: 4375538 - DNA, 19 bp, Homo sapiens
atcttggtagttctgtgcc

SEQ ID NO: 4375539 - DNA, 21 bp, Homo sapiens
atcttggtagttctgtgcctc

SEQ ID NO: 4375540 - DNA, 22 bp, Homo sapiens
atcttggtagttctgtgcctcc

SEQ ID NO: 4375541 - DNA, 21 bp, Homo sapiens
atcttggtttgtcagtttatc

SEQ ID NO: 4375542 - DNA, 19 bp, Homo sapiens
atcttgtacaaactttgtt

SEQ ID NO: 4375543 - DNA, 11 bp, Homo sapiens
atcttgtgaaa

SEQ ID NO: 4375544 - DNA, 15 bp, Homo sapiens
atcttgttcaggaaa

SEQ ID NO: 4375545 - DNA, 15 bp, Homo sapiens
atcttgtttacaata

SEQ ID NO: 4375546 - DNA, 23 bp, Homo sapiens
atcttgtttacaataaagaattc

SEQ ID NO: 4375547 - DNA, 20 bp, Homo sapiens
atcttgtttgttactgtcat

SEQ ID NO: 4375548 - DNA, 21 bp, Homo sapiens
atcttgtttgttactgtcatt

SEQ ID NO: 4375549 - DNA, 15 bp, Homo sapiens
atctttaaaatacac

SEQ ID NO: 4375550 - DNA, 15 bp, Homo sapiens
atctttataaatgta

SEQ ID NO: 4375551 - DNA, 15 bp, Homo sapiens
atctttattaaaaca

SEQ ID NO: 4375552 - DNA, 13 bp, Homo sapiens
atctttattgaaa

SEQ ID NO: 4375553 - DNA, 15 bp, Homo sapiens
atctttattgaaatt

SEQ ID NO: 4375554 - DNA, 14 bp, Homo sapiens
atctttattggctt

SEQ ID NO: 4375555 - DNA, 17 bp, Homo sapiens
atctttcaaaccagctt

SEQ ID NO: 4375556 - DNA, 15 bp, Homo sapiens
atctttcaaccacct

SEQ ID NO: 4375557 - DNA, 13 bp, Homo sapiens
atctttcaccttt

SEQ ID NO: 4375558 - DNA, 15 bp, Homo sapiens
atctttcacctttct

SEQ ID NO: 4375559 - DNA, 21 bp, Homo sapiens
atctttcagttattaaatgat

SEQ ID NO: 4375560 - DNA, 14 bp, Homo sapiens
atctttcatgtctt

SEQ ID NO: 4375561 - DNA, 15 bp, Homo sapiens
atctttcatgtcttg

SEQ ID NO: 4375562 - DNA, 17 bp, Homo sapiens
atctttcgataaacaac

SEQ ID NO: 4375563 - DNA, 21 bp, Homo sapiens
atctttctgcacacaaatatt

SEQ ID NO: 4375564 - DNA, 13 bp, Homo sapiens
atctttcttgatc

SEQ ID NO: 4375565 - DNA, 21 bp, Homo sapiens
atctttgaaaggttagagaat

SEQ ID NO: 4375566 - DNA, 12 bp, Homo sapiens
atctttgaaata

SEQ ID NO: 4375567 - DNA, 17 bp, Homo sapiens
atctttgactgaaaaaa

SEQ ID NO: 4375568 - DNA, 12 bp, Homo sapiens
atctttgagccc

SEQ ID NO: 4375569 - DNA, 14 bp, Homo sapiens
atctttgagcccat

SEQ ID NO: 4375570 - DNA, 23 bp, Homo sapiens
atctttgagcccattcttctggg

SEQ ID NO: 4375571 - DNA, 14 bp, Homo sapiens
atctttgccaagta

SEQ ID NO: 4375572 - DNA, 13 bp, Homo sapiens
atctttgccttgg

SEQ ID NO: 4375573 - DNA, 20 bp, Homo sapiens
atctttgccttgggctgctc

SEQ ID NO: 4375574 - DNA, 22 bp, Homo sapiens
atctttgccttgggctgctcct

SEQ ID NO: 4375575 - DNA, 21 bp, Homo sapiens
atctttgtaccaaaattttaa

SEQ ID NO: 4375576 - DNA, 21 bp, Homo sapiens
atctttgtgacaggaaagccc

SEQ ID NO: 4375577 - DNA, 16 bp, Homo sapiens
atctttgttacttcct

SEQ ID NO: 4375578 - DNA, 16 bp, Homo sapiens
atctttgttttaacca

SEQ ID NO: 4375579 - DNA, 18 bp, Homo sapiens
atctttgttttaaccagt

SEQ ID NO: 4375580 - DNA, 13 bp, Homo sapiens
atcttttaactgc

SEQ ID NO: 4375581 - DNA, 15 bp, Homo sapiens
atcttttacattttt

SEQ ID NO: 4375582 - DNA, 13 bp, Homo sapiens
atcttttattctt

SEQ ID NO: 4375583 - DNA, 22 bp, Homo sapiens
atcttttctagagacacattgg

SEQ ID NO: 4375584 - DNA, 23 bp, Homo sapiens
atcttttcttgcctctgtcccct

SEQ ID NO: 4375585 - DNA, 14 bp, Homo sapiens
atcttttgtatatc

SEQ ID NO: 4375586 - DNA, 16 bp, Homo sapiens
atcttttgtattaaga

SEQ ID NO: 4375587 - DNA, 13 bp, Homo sapiens
atctttttctaac

SEQ ID NO: 4375588 - DNA, 23 bp, Homo sapiens
atctttttctagagttatcttct

SEQ ID NO: 4375589 - DNA, 22 bp, Homo sapiens
atctttttgcttctactttcat

SEQ ID NO: 4375590 - DNA, 17 bp, Homo sapiens
atgaaaaaaagggaaaa

SEQ ID NO: 4375591 - DNA, 16 bp, Homo sapiens
atgaaaaagaagaatc

SEQ ID NO: 4375592 - DNA, 18 bp, Homo sapiens
atgaaaacatgtactaca

SEQ ID NO: 4375593 - DNA, 17 bp, Homo sapiens
atgaaaactaaggattt

SEQ ID NO: 4375594 - DNA, 18 bp, Homo sapiens
atgaaaagacaagaaaat

SEQ ID NO: 4375595 - DNA, 13 bp, Homo sapiens
atgaaaagctaga

SEQ ID NO: 4375596 - DNA, 18 bp, Homo sapiens
atgaaaagctagaattga

SEQ ID NO: 4375597 - DNA, 16 bp, Homo sapiens
atgaaaataaaacaca

SEQ ID NO: 4375598 - DNA, 20 bp, Homo sapiens
atgaaaataaaacacacctc

SEQ ID NO: 4375599 - DNA, 16 bp, Homo sapiens
atgaaaatagctattt

SEQ ID NO: 4375600 - DNA, 16 bp, Homo sapiens
atgaaaatgagccctg

SEQ ID NO: 4375601 - DNA, 13 bp, Homo sapiens
atgaaaatgtctt

SEQ ID NO: 4375602 - DNA, 20 bp, Homo sapiens
atgaaaattatactgagaac

SEQ ID NO: 4375603 - DNA, 11 bp, Homo sapiens
atgaaaattgt

SEQ ID NO: 4375604 - DNA, 20 bp, Homo sapiens
atgaaacaaaaaaaaaatga

SEQ ID NO: 4375605 - DNA, 17 bp, Homo sapiens
atgaaacatcatttcaa

SEQ ID NO: 4375606 - DNA, 19 bp, Homo sapiens
atgaaactggttcctacat

SEQ ID NO: 4375607 - DNA, 13 bp, Homo sapiens
atgaaagggaaac

SEQ ID NO: 4375608 - DNA, 18 bp, Homo sapiens
atgaaagggtttgtaata

SEQ ID NO: 4375609 - DNA, 23 bp, Homo sapiens
atgaaagggtttgtaatacttta

SEQ ID NO: 4375610 - DNA, 15 bp, Homo sapiens
atgaaagtgttaatt

SEQ ID NO: 4375611 - DNA, 15 bp, Homo sapiens
atgaaatatatgtga

SEQ ID NO: 4375612 - DNA, 14 bp, Homo sapiens
atgaaatgacttct

SEQ ID NO: 4375613 - DNA, 20 bp, Homo sapiens
atgaaatgtcccctcaaact

SEQ ID NO: 4375614 - DNA, 23 bp, Homo sapiens
atgaaatgtcccctcaaactcat

SEQ ID NO: 4375615 - DNA, 20 bp, Homo sapiens
atgaaatgtgttttgtcttt

SEQ ID NO: 4375616 - DNA, 21 bp, Homo sapiens
atgaaatgtgttttgtctttt

SEQ ID NO: 4375617 - DNA, 13 bp, Homo sapiens
atgaaatgtttac

SEQ ID NO: 4375618 - DNA, 15 bp, Homo sapiens
atgagcttgattaaa

SEQ ID NO: 4375619 - DNA, 23 bp, Homo sapiens
atgaggaaatgccacaaattgta

SEQ ID NO: 4375620 - DNA, 17 bp, Homo sapiens
atgaggaggggagggta

SEQ ID NO: 4375621 - DNA, 14 bp, Homo sapiens
atgaggagttgctg

SEQ ID NO: 4375622 - DNA, 23 bp, Homo sapiens
atgaggatccgaaacggcagcct

SEQ ID NO: 4375623 - DNA, 13 bp, Homo sapiens
atgaggcagagga

SEQ ID NO: 4375624 - DNA, 22 bp, Homo sapiens
atgaggccatctcaggagatgg

SEQ ID NO: 4375625 - DNA, 16 bp, Homo sapiens
atgaggccggacagag

SEQ ID NO: 4375626 - DNA, 15 bp, Homo sapiens
atgagggtgtttcct

SEQ ID NO: 4375627 - DNA, 15 bp, Homo sapiens
atgaggtactgagag

SEQ ID NO: 4375628 - DNA, 16 bp, Homo sapiens
atgaggtctgggctag

SEQ ID NO: 4375629 - DNA, 14 bp, Homo sapiens
atgaggtctgttta

SEQ ID NO: 4375630 - DNA, 16 bp, Homo sapiens
atgagtcatttgttta

SEQ ID NO: 4375631 - DNA, 18 bp, Homo sapiens
atgagttcaaatactttt

SEQ ID NO: 4375632 - DNA, 17 bp, Homo sapiens
atgagttggacttcagt

SEQ ID NO: 4375633 - DNA, 18 bp, Homo sapiens
atgagttggctgggaata

SEQ ID NO: 4375634 - DNA, 19 bp, Homo sapiens
atgagttgttttcagactc

SEQ ID NO: 4375635 - DNA, 15 bp, Homo sapiens
atgagtttaaaaatc

SEQ ID NO: 4375636 - DNA, 14 bp, Homo sapiens
atgataaaagagaa

SEQ ID NO: 4375637 - DNA, 12 bp, Homo sapiens
atgataaagact

SEQ ID NO: 4375638 - DNA, 13 bp, Homo sapiens
atgataaagactt

SEQ ID NO: 4375639 - DNA, 15 bp, Homo sapiens
atgataaagactttt

SEQ ID NO: 4375640 - DNA, 13 bp, Homo sapiens
atgataagacatt

SEQ ID NO: 4375641 - DNA, 14 bp, Homo sapiens
atgataagacattt

SEQ ID NO: 4375642 - DNA, 17 bp, Homo sapiens
atgatacagtgttaaaa

SEQ ID NO: 4375643 - DNA, 19 bp, Homo sapiens
atgatacagtgttaaaaga

SEQ ID NO: 4375644 - DNA, 13 bp, Homo sapiens
atgatacattttt

SEQ ID NO: 4375645 - DNA, 19 bp, Homo sapiens
atgatacccaacagtttat

SEQ ID NO: 4375646 - DNA, 18 bp, Homo sapiens
atgatactgattatgaaa

SEQ ID NO: 4375647 - DNA, 19 bp, Homo sapiens
atgatactgattatgaaat

SEQ ID NO: 4375648 - DNA, 20 bp, Homo sapiens
atgatagaaagaataaaatg

SEQ ID NO: 4375649 - DNA, 19 bp, Homo sapiens
atgatagtaataggataca

SEQ ID NO: 4375650 - DNA, 17 bp, Homo sapiens
atgatattgctgaagaa

SEQ ID NO: 4375651 - DNA, 23 bp, Homo sapiens
atgatattgctgaagaatctact

SEQ ID NO: 4375652 - DNA, 13 bp, Homo sapiens
atgatcaaaaata

SEQ ID NO: 4375653 - DNA, 15 bp, Homo sapiens
atgatcaaaaataat

SEQ ID NO: 4375654 - DNA, 15 bp, Homo sapiens
atgatcaaagttttg

SEQ ID NO: 4375655 - DNA, 17 bp, Homo sapiens
atgatcaagatatatgt

SEQ ID NO: 4375656 - DNA, 17 bp, Homo sapiens
atgatcaatcctttatt

SEQ ID NO: 4375657 - DNA, 15 bp, Homo sapiens
atgatcacatctaaa

SEQ ID NO: 4375658 - DNA, 21 bp, Homo sapiens
atgatccaactaatgccttac

SEQ ID NO: 4375659 - DNA, 12 bp, Homo sapiens
atgatctcttct

SEQ ID NO: 4375660 - DNA, 15 bp, Homo sapiens
atgatctgtctgtgg

SEQ ID NO: 4375661 - DNA, 16 bp, Homo sapiens
atgatgagaggccagc

SEQ ID NO: 4375662 - DNA, 14 bp, Homo sapiens
atgatgatgaaaac

SEQ ID NO: 4375663 - DNA, 14 bp, Homo sapiens
atgatgcagtctcc

SEQ ID NO: 4375664 - DNA, 15 bp, Homo sapiens
atgatggagcaactg

SEQ ID NO: 4375665 - DNA, 17 bp, Homo sapiens
atgatgtgaaacacttt

SEQ ID NO: 4375666 - DNA, 11 bp, Homo sapiens
atgattaaatt

SEQ ID NO: 4375667 - DNA, 14 bp, Homo sapiens
atgattagcaagtt

SEQ ID NO: 4375668 - DNA, 15 bp, Homo sapiens
atgattatattcaca

SEQ ID NO: 4375669 - DNA, 16 bp, Homo sapiens
atgattcaaatgtttt

SEQ ID NO: 4375670 - DNA, 15 bp, Homo sapiens
atgattcaagccatt

SEQ ID NO: 4375671 - DNA, 16 bp, Homo sapiens
atgattcaagccattc

SEQ ID NO: 4375672 - DNA, 19 bp, Homo sapiens
atgattcctggacatcacc

SEQ ID NO: 4375673 - DNA, 22 bp, Homo sapiens
atgattgaatttttaagcaaat

SEQ ID NO: 4375674 - DNA, 19 bp, Homo sapiens
atgattgcttgagctcagg

SEQ ID NO: 4375675 - DNA, 13 bp, Homo sapiens
atgattggttcag

SEQ ID NO: 4375676 - DNA, 18 bp, Homo sapiens
atgattgtttcttcttca

SEQ ID NO: 4375677 - DNA, 15 bp, Homo sapiens
atgatttaagtatac

SEQ ID NO: 4375678 - DNA, 13 bp, Homo sapiens
atgatttagtgtt

SEQ ID NO: 4375679 - DNA, 12 bp, Homo sapiens
atgatttcatat

SEQ ID NO: 4375680 - DNA, 14 bp, Homo sapiens
atgatttcatattg

SEQ ID NO: 4375681 - DNA, 20 bp, Homo sapiens
atgatttccaaagagaaaaa

SEQ ID NO: 4375682 - DNA, 14 bp, Homo sapiens
atgatttcccccct

SEQ ID NO: 4375683 - DNA, 16 bp, Homo sapiens
atgatttccttgaatg

SEQ ID NO: 4375684 - DNA, 20 bp, Homo sapiens
atgatttccttgaatgtggc

SEQ ID NO: 4375685 - DNA, 14 bp, Homo sapiens
atgatttcttctta

SEQ ID NO: 4375686 - DNA, 22 bp, Homo sapiens
atgattttacaagtataacagt

SEQ ID NO: 4375687 - DNA, 14 bp, Homo sapiens
atgattttcctttt

SEQ ID NO: 4375688 - DNA, 22 bp, Homo sapiens
atgattttggaactgtgtttca

SEQ ID NO: 4375689 - DNA, 15 bp, Homo sapiens
atgattttttgaaag

SEQ ID NO: 4375690 - DNA, 23 bp, Homo sapiens
atgattttttgaaagttaacatt

SEQ ID NO: 4375691 - DNA, 17 bp, Homo sapiens
atgcaaaaactctttga

SEQ ID NO: 4375692 - DNA, 18 bp, Homo sapiens
atgcaaaaatgacccaag

SEQ ID NO: 4375693 - DNA, 15 bp, Homo sapiens
atgcaaaagttctca

SEQ ID NO: 4375694 - DNA, 17 bp, Homo sapiens
atgcaaaatatgtttaa

SEQ ID NO: 4375695 - DNA, 16 bp, Homo sapiens
atgcaaactgctttat

SEQ ID NO: 4375696 - DNA, 14 bp, Homo sapiens
atgcaaagtacaat

SEQ ID NO: 4375697 - DNA, 19 bp, Homo sapiens
atgcaaagtacaatgtgtt

SEQ ID NO: 4375698 - DNA, 14 bp, Homo sapiens
atgcaacagaagtg

SEQ ID NO: 4375699 - DNA, 15 bp, Homo sapiens
atgcaaggaccagga

SEQ ID NO: 4375700 - DNA, 17 bp, Homo sapiens
atgcaaggggctgcatg

SEQ ID NO: 4375701 - DNA, 19 bp, Homo sapiens
atgcaataaaattatttgc

SEQ ID NO: 4375702 - DNA, 21 bp, Homo sapiens
atgcaataacaagcatgcata

SEQ ID NO: 4375703 - DNA, 18 bp, Homo sapiens
atgcaataactctgggag

SEQ ID NO: 4375704 - DNA, 15 bp, Homo sapiens
atgcaataagattta

SEQ ID NO: 4375705 - DNA, 13 bp, Homo sapiens
atgcaatatttgt

SEQ ID NO: 4375706 - DNA, 15 bp, Homo sapiens
atgcaatatttgtaa

SEQ ID NO: 4375707 - DNA, 23 bp, Homo sapiens
atgcaatttgaagtaacttattt

SEQ ID NO: 4375708 - DNA, 18 bp, Homo sapiens
atgcacactgagaatgct

SEQ ID NO: 4375709 - DNA, 21 bp, Homo sapiens
atgcacactgagaatgctaat

SEQ ID NO: 4375710 - DNA, 13 bp, Homo sapiens
atgcacagatata

SEQ ID NO: 4375711 - DNA, 15 bp, Homo sapiens
atgcacagtatttgt

SEQ ID NO: 4375712 - DNA, 15 bp, Homo sapiens
atgcacagtcataca

SEQ ID NO: 4375713 - DNA, 17 bp, Homo sapiens
atgcacccatcagcact

SEQ ID NO: 4375714 - DNA, 19 bp, Homo sapiens
atgcacccatcagcactct

SEQ ID NO: 4375715 - DNA, 22 bp, Homo sapiens
atgcacccatcagcactctgta

SEQ ID NO: 4375716 - DNA, 14 bp, Homo sapiens
atgcacctaaagaa

SEQ ID NO: 4375717 - DNA, 18 bp, Homo sapiens
atgcacctaaagaaaaac

SEQ ID NO: 4375718 - DNA, 16 bp, Homo sapiens
atgcacgaccttggga

SEQ ID NO: 4375719 - DNA, 14 bp, Homo sapiens
atgcactaagacaa

SEQ ID NO: 4375720 - DNA, 17 bp, Homo sapiens
atgcactcgctgtgatt

SEQ ID NO: 4375721 - DNA, 19 bp, Homo sapiens
atgcactgaagagctcttg

SEQ ID NO: 4375722 - DNA, 21 bp, Homo sapiens
atgcactgaagagctcttggc

SEQ ID NO: 4375723 - DNA, 22 bp, Homo sapiens
atgcactgaagagctcttggcc

SEQ ID NO: 4375724 - DNA, 16 bp, Homo sapiens
atgcactgatgttgtg

SEQ ID NO: 4375725 - DNA, 14 bp, Homo sapiens
atgcactgtaaata

SEQ ID NO: 4375726 - DNA, 19 bp, Homo sapiens
atgcactgtaaatatccct

SEQ ID NO: 4375727 - DNA, 21 bp, Homo sapiens
atgcactgttccccctgtgca

SEQ ID NO: 4375728 - DNA, 19 bp, Homo sapiens
atgcacttataattttcct

SEQ ID NO: 4375729 - DNA, 22 bp, Homo sapiens
atgcactttaaatggaataatt

SEQ ID NO: 4375730 - DNA, 20 bp, Homo sapiens
atgcactttttccttactgt

SEQ ID NO: 4375731 - DNA, 18 bp, Homo sapiens
atgcagaaatagacaaaa

SEQ ID NO: 4375732 - DNA, 21 bp, Homo sapiens
atgcagaaatagacaaaaagt

SEQ ID NO: 4375733 - DNA, 22 bp, Homo sapiens
atgcagaaatagacaaaaagta

SEQ ID NO: 4375734 - DNA, 21 bp, Homo sapiens
atgcagacaacaccttcctcc

SEQ ID NO: 4375735 - DNA, 22 bp, Homo sapiens
atgcagcaggaaggaacaaaga

SEQ ID NO: 4375736 - DNA, 15 bp, Homo sapiens
atgcagcccatgccc

SEQ ID NO: 4375737 - DNA, 12 bp, Homo sapiens
atgctattgtct

SEQ ID NO: 4375738 - DNA, 12 bp, Homo sapiens
atgctatttctg

SEQ ID NO: 4375739 - DNA, 13 bp, Homo sapiens
atgctatttgaac

SEQ ID NO: 4375740 - DNA, 17 bp, Homo sapiens
atgctcaacccccctcc

SEQ ID NO: 4375741 - DNA, 21 bp, Homo sapiens
atgctcaacccccctcccaga

SEQ ID NO: 4375742 - DNA, 14 bp, Homo sapiens
atgctcaagaatgt

SEQ ID NO: 4375743 - DNA, 15 bp, Homo sapiens
atgctcaatttcagc

SEQ ID NO: 4375744 - DNA, 13 bp, Homo sapiens
atgctcaggctac

SEQ ID NO: 4375745 - DNA, 14 bp, Homo sapiens
atgctccaggatct

SEQ ID NO: 4375746 - DNA, 17 bp, Homo sapiens
atgctccagggtcaggc

SEQ ID NO: 4375747 - DNA, 12 bp, Homo sapiens
atgctcccagct

SEQ ID NO: 4375748 - DNA, 19 bp, Homo sapiens
atgctccctcccctgccct

SEQ ID NO: 4375749 - DNA, 18 bp, Homo sapiens
atgctccttgagaggaga

SEQ ID NO: 4375750 - DNA, 19 bp, Homo sapiens
atgctccttgagaggagaa

SEQ ID NO: 4375751 - DNA, 19 bp, Homo sapiens
atgctctctgcagccagcc

SEQ ID NO: 4375752 - DNA, 17 bp, Homo sapiens
atgctcttgaaatattc

SEQ ID NO: 4375753 - DNA, 20 bp, Homo sapiens
atgctcttgaaatattcaga

SEQ ID NO: 4375754 - DNA, 16 bp, Homo sapiens
atgctctttaaataat

SEQ ID NO: 4375755 - DNA, 19 bp, Homo sapiens
atgctctttaaataataaa

SEQ ID NO: 4375756 - DNA, 20 bp, Homo sapiens
atgctctttaaataataaag

SEQ ID NO: 4375757 - DNA, 23 bp, Homo sapiens
atgctgcatatgttacaattctc

SEQ ID NO: 4375758 - DNA, 12 bp, Homo sapiens
atgctgccttca

SEQ ID NO: 4375759 - DNA, 22 bp, Homo sapiens
atgctgctaaagggagaaatgc

SEQ ID NO: 4375760 - DNA, 22 bp, Homo sapiens
atgctgctctcagcctcccaca

SEQ ID NO: 4375761 - DNA, 21 bp, Homo sapiens
atgctgctgcccctgcacagc

SEQ ID NO: 4375762 - DNA, 12 bp, Homo sapiens
atgctggccagc

SEQ ID NO: 4375763 - DNA, 13 bp, Homo sapiens
atgctggccagca

SEQ ID NO: 4375764 - DNA, 14 bp, Homo sapiens
atgctggccagcac

SEQ ID NO: 4375765 - DNA, 18 bp, Homo sapiens
atgctggccagcaccctc

SEQ ID NO: 4375766 - DNA, 20 bp, Homo sapiens
atgctggccagcaccctctc

SEQ ID NO: 4375767 - DNA, 22 bp, Homo sapiens
atgctggccagcaccctctcct

SEQ ID NO: 4375768 - DNA, 19 bp, Homo sapiens
atgctggctgaagaggacc

SEQ ID NO: 4375769 - DNA, 14 bp, Homo sapiens
atgctgtatctgtg

SEQ ID NO: 4375770 - DNA, 14 bp, Homo sapiens
atgctgtatttctt

SEQ ID NO: 4375771 - DNA, 18 bp, Homo sapiens
atgctgtatttctttgta

SEQ ID NO: 4375772 - DNA, 17 bp, Homo sapiens
atgctgtatttttacag

SEQ ID NO: 4375773 - DNA, 23 bp, Homo sapiens
atgctgtcatggtcctttctgga

SEQ ID NO: 4375774 - DNA, 17 bp, Homo sapiens
atgctgtctggccctgg

SEQ ID NO: 4375775 - DNA, 23 bp, Homo sapiens
atgctgtgacacatggcccctcc

SEQ ID NO: 4375776 - DNA, 17 bp, Homo sapiens
atgctgtgctatgaatt

SEQ ID NO: 4375777 - DNA, 15 bp, Homo sapiens
atgctgttgcctcat

SEQ ID NO: 4375778 - DNA, 17 bp, Homo sapiens
atgctgttgcctcatct

SEQ ID NO: 4375779 - DNA, 13 bp, Homo sapiens
atgctgttgctgc

SEQ ID NO: 4375780 - DNA, 16 bp, Homo sapiens
atgcttaaatttcaga

SEQ ID NO: 4375781 - DNA, 14 bp, Homo sapiens
atgcttaataaaca

SEQ ID NO: 4375782 - DNA, 17 bp, Homo sapiens
atgcttagatgttccag

SEQ ID NO: 4375783 - DNA, 20 bp, Homo sapiens
atgcttagtgtgaagttgat

SEQ ID NO: 4375784 - DNA, 20 bp, Homo sapiens
atgcttcaaagtccacatta

SEQ ID NO: 4375785 - DNA, 15 bp, Homo sapiens
atgcttcatgaattt

SEQ ID NO: 4375786 - DNA, 16 bp, Homo sapiens
atgcttcatttgtatg

SEQ ID NO: 4375787 - DNA, 11 bp, Homo sapiens
atgcttctctc

SEQ ID NO: 4375788 - DNA, 17 bp, Homo sapiens
atgcttctctccttgcc

SEQ ID NO: 4375789 - DNA, 15 bp, Homo sapiens
atgcttgacatacct

SEQ ID NO: 4375790 - DNA, 18 bp, Homo sapiens
atgcttgcataagagctt

SEQ ID NO: 4375791 - DNA, 18 bp, Homo sapiens
atgcttgcggcaaaagga

SEQ ID NO: 4375792 - DNA, 22 bp, Homo sapiens
atgcttgcggcaaaaggaaagc

SEQ ID NO: 4375793 - DNA, 17 bp, Homo sapiens
atgcttggagcaatcag

SEQ ID NO: 4375794 - DNA, 21 bp, Homo sapiens
atgcttgggaccagaagtgtt

SEQ ID NO: 4375795 - DNA, 22 bp, Homo sapiens
atgcttgggaccagaagtgttt

SEQ ID NO: 4375796 - DNA, 23 bp, Homo sapiens
atgcttgggaccagaagtgtttc

SEQ ID NO: 4375797 - DNA, 17 bp, Homo sapiens
atgcttgtttatgatat

SEQ ID NO: 4375798 - DNA, 14 bp, Homo sapiens
atgctttccttctt

SEQ ID NO: 4375799 - DNA, 20 bp, Homo sapiens
atgctttctctctagtagtt

SEQ ID NO: 4375800 - DNA, 14 bp, Homo sapiens
atgctttgaacttt

SEQ ID NO: 4375801 - DNA, 12 bp, Homo sapiens
atgctttggaaa

SEQ ID NO: 4375802 - DNA, 15 bp, Homo sapiens
atgcttttatattct

SEQ ID NO: 4375803 - DNA, 16 bp, Homo sapiens
atgctttttatttctg

SEQ ID NO: 4375804 - DNA, 19 bp, Homo sapiens
atgctttttatttctgcat

SEQ ID NO: 4375805 - DNA, 14 bp, Homo sapiens
atggaaaaataaca

SEQ ID NO: 4375806 - DNA, 14 bp, Homo sapiens
atggaaaaatgcca

SEQ ID NO: 4375807 - DNA, 19 bp, Homo sapiens
atggaaaactgtgttgcca

SEQ ID NO: 4375808 - DNA, 13 bp, Homo sapiens
atggaaaatacca

SEQ ID NO: 4375809 - DNA, 13 bp, Homo sapiens
atggaaactgcca

SEQ ID NO: 4375810 - DNA, 17 bp, Homo sapiens
atggaaatacagttatt

SEQ ID NO: 4375811 - DNA, 16 bp, Homo sapiens
atggaaattttgctat

SEQ ID NO: 4375812 - DNA, 15 bp, Homo sapiens
atggaactgtgtatt

SEQ ID NO: 4375813 - DNA, 14 bp, Homo sapiens
atggaacttagcca

SEQ ID NO: 4375814 - DNA, 17 bp, Homo sapiens
atggaactttatttaca

SEQ ID NO: 4375815 - DNA, 17 bp, Homo sapiens
atggaaggaggcctcca

SEQ ID NO: 4375816 - DNA, 15 bp, Homo sapiens
atggaataaattatg

SEQ ID NO: 4375817 - DNA, 16 bp, Homo sapiens
atggaataattagctt

SEQ ID NO: 4375818 - DNA, 20 bp, Homo sapiens
atggaatatcatctgtcatt

SEQ ID NO: 4375819 - DNA, 22 bp, Homo sapiens
atggaatgattggttaaaatgt

SEQ ID NO: 4375820 - DNA, 18 bp, Homo sapiens
atggaattgatttgcatt

SEQ ID NO: 4375821 - DNA, 19 bp, Homo sapiens
atggaattttgcaaagatt

SEQ ID NO: 4375822 - DNA, 14 bp, Homo sapiens
atggacacgagcca

SEQ ID NO: 4375823 - DNA, 15 bp, Homo sapiens
atggacacgagccac

SEQ ID NO: 4375824 - DNA, 22 bp, Homo sapiens
atggaccaacctgctctgtccc

SEQ ID NO: 4375825 - DNA, 23 bp, Homo sapiens
atggaccaacctgctctgtcccc

SEQ ID NO: 4375826 - DNA, 14 bp, Homo sapiens
atggacctcagcaa

SEQ ID NO: 4375827 - DNA, 20 bp, Homo sapiens
atggacctcagcaagctgcc

SEQ ID NO: 4375828 - DNA, 18 bp, Homo sapiens
atggacctggtgcccctg

SEQ ID NO: 4375829 - DNA, 20 bp, Homo sapiens
atggacctggtgcccctgct

SEQ ID NO: 4375830 - DNA, 21 bp, Homo sapiens
atggactccagcctgcctggc

SEQ ID NO: 4375831 - DNA, 15 bp, Homo sapiens
atggactggtttgag

SEQ ID NO: 4375832 - DNA, 17 bp, Homo sapiens
atggactggtttgagat

SEQ ID NO: 4375833 - DNA, 17 bp, Homo sapiens
atggagactttgctgtt

SEQ ID NO: 4375834 - DNA, 20 bp, Homo sapiens
atggagagctagaacccggc

SEQ ID NO: 4375835 - DNA, 16 bp, Homo sapiens
atggagaggacagagc

SEQ ID NO: 4375836 - DNA, 19 bp, Homo sapiens
atggagaggacagagcagg

SEQ ID NO: 4375837 - DNA, 20 bp, Homo sapiens
atggagaggcggcctcgtgc

SEQ ID NO: 4375838 - DNA, 18 bp, Homo sapiens
atggagattctgattcag

SEQ ID NO: 4375839 - DNA, 21 bp, Homo sapiens
atggagcccataggccacccc

SEQ ID NO: 4375840 - DNA, 12 bp, Homo sapiens
atggagccccag

SEQ ID NO: 4375841 - DNA, 14 bp, Homo sapiens
atggagcctgctct

SEQ ID NO: 4375842 - DNA, 14 bp, Homo sapiens
atggagctgtcacc

SEQ ID NO: 4375843 - DNA, 17 bp, Homo sapiens
atggagctgtcacctct

SEQ ID NO: 4375844 - DNA, 22 bp, Homo sapiens
atggagctgtcacctctcagct

SEQ ID NO: 4375845 - DNA, 23 bp, Homo sapiens
atggagctgtcacctctcagctg

SEQ ID NO: 4375846 - DNA, 22 bp, Homo sapiens
atggaggaaatccggtcagcca

SEQ ID NO: 4375847 - DNA, 17 bp, Homo sapiens
atggaggagaagaattt

SEQ ID NO: 4375848 - DNA, 21 bp, Homo sapiens
atggaggattctttccccaga

SEQ ID NO: 4375849 - DNA, 14 bp, Homo sapiens
atggagggggctgg

SEQ ID NO: 4375850 - DNA, 22 bp, Homo sapiens
atggagggggctggggtcacag

SEQ ID NO: 4375851 - DNA, 15 bp, Homo sapiens
atggagtcttgtgaa

SEQ ID NO: 4375852 - DNA, 17 bp, Homo sapiens
atggagtcttgtgaaag

SEQ ID NO: 4375853 - DNA, 12 bp, Homo sapiens
atggagttaaat

SEQ ID NO: 4375854 - DNA, 14 bp, Homo sapiens
atggagttatcagt

SEQ ID NO: 4375855 - DNA, 22 bp, Homo sapiens
atggatatagttttacttttaa

SEQ ID NO: 4375856 - DNA, 21 bp, Homo sapiens
atggatatatttgaaatagta

SEQ ID NO: 4375857 - DNA, 20 bp, Homo sapiens
atggatgattcttttcccat

SEQ ID NO: 4375858 - DNA, 14 bp, Homo sapiens
atggatgcatttca

SEQ ID NO: 4375859 - DNA, 22 bp, Homo sapiens
atggatgccaatattaaatctg

SEQ ID NO: 4375860 - DNA, 16 bp, Homo sapiens
atggattcagtttcta

SEQ ID NO: 4375861 - DNA, 15 bp, Homo sapiens
atggattccaaacca

SEQ ID NO: 4375862 - DNA, 16 bp, Homo sapiens
atggatttccactgct

SEQ ID NO: 4375863 - DNA, 20 bp, Homo sapiens
atggcaacattggacagaaa

SEQ ID NO: 4375864 - DNA, 21 bp, Homo sapiens
atggcaccttcagactttgct

SEQ ID NO: 4375865 - DNA, 16 bp, Homo sapiens
atggcataacctgtct

SEQ ID NO: 4375866 - DNA, 17 bp, Homo sapiens
atggcatttgcagattt

SEQ ID NO: 4375867 - DNA, 12 bp, Homo sapiens
atggccagagcc

SEQ ID NO: 4375868 - DNA, 19 bp, Homo sapiens
atggccagagcctctggcc

SEQ ID NO: 4375869 - DNA, 14 bp, Homo sapiens
atggccagcccctg

SEQ ID NO: 4375870 - DNA, 14 bp, Homo sapiens
atggcccagtgtca

SEQ ID NO: 4375871 - DNA, 13 bp, Homo sapiens
atggcccccaata

SEQ ID NO: 4375872 - DNA, 16 bp, Homo sapiens
atggcccccaataaag

SEQ ID NO: 4375873 - DNA, 18 bp, Homo sapiens
atggcccccaataaaggc

SEQ ID NO: 4375874 - DNA, 20 bp, Homo sapiens
atggcccccaataaaggcag

SEQ ID NO: 4375875 - DNA, 11 bp, Homo sapiens
atggccctgtc

SEQ ID NO: 4375876 - DNA, 18 bp, Homo sapiens
atggccctgtcccaggcc

SEQ ID NO: 4375877 - DNA, 18 bp, Homo sapiens
atggcctcagccctgctc

SEQ ID NO: 4375878 - DNA, 21 bp, Homo sapiens
atggcctcagccctgctccct

SEQ ID NO: 4375879 - DNA, 14 bp, Homo sapiens
atggcctcagctgc

SEQ ID NO: 4375880 - DNA, 17 bp, Homo sapiens
atggcctgacagctctg

SEQ ID NO: 4375881 - DNA, 19 bp, Homo sapiens
atggcctgacagctctgtt

SEQ ID NO: 4375882 - DNA, 15 bp, Homo sapiens
atggcctgagcatcc

SEQ ID NO: 4375883 - DNA, 16 bp, Homo sapiens
atggcctgggggatgt

SEQ ID NO: 4375884 - DNA, 18 bp, Homo sapiens
atggccttaatttccttt

SEQ ID NO: 4375885 - DNA, 14 bp, Homo sapiens
atggcctttccttc

SEQ ID NO: 4375886 - DNA, 15 bp, Homo sapiens
atggcctttccttcc

SEQ ID NO: 4375887 - DNA, 17 bp, Homo sapiens
atggcctttccttccct

SEQ ID NO: 4375888 - DNA, 22 bp, Homo sapiens
atggcctttccttccctctctg

SEQ ID NO: 4375889 - DNA, 17 bp, Homo sapiens
atggcctttggacccag

SEQ ID NO: 4375890 - DNA, 16 bp, Homo sapiens
atggctataggtgcta

SEQ ID NO: 4375891 - DNA, 19 bp, Homo sapiens
atggctatgtttttaatgt

SEQ ID NO: 4375892 - DNA, 14 bp, Homo sapiens
atggctattaacaa

SEQ ID NO: 4375893 - DNA, 17 bp, Homo sapiens
atggctcctgtctggct

SEQ ID NO: 4375894 - DNA, 22 bp, Homo sapiens
atggctctctattccctcagcc

SEQ ID NO: 4375895 - DNA, 20 bp, Homo sapiens
atggctgataattttaaatt

SEQ ID NO: 4375896 - DNA, 12 bp, Homo sapiens
atggctgcccag

SEQ ID NO: 4375897 - DNA, 13 bp, Homo sapiens
atggctgcccagg

SEQ ID NO: 4375898 - DNA, 14 bp, Homo sapiens
atggctgcccagga

SEQ ID NO: 4375899 - DNA, 13 bp, Homo sapiens
atggctgtgagga

SEQ ID NO: 4375900 - DNA, 17 bp, Homo sapiens
atggctttgtgattcaa

SEQ ID NO: 4375901 - DNA, 17 bp, Homo sapiens
atgggaaatagcggccc

SEQ ID NO: 4375902 - DNA, 18 bp, Homo sapiens
atgggaaatagcggccct

SEQ ID NO: 4375903 - DNA, 17 bp, Homo sapiens
atgggaagacgaggccc

SEQ ID NO: 4375904 - DNA, 18 bp, Homo sapiens
atgggaatgaggtgggag

SEQ ID NO: 4375905 - DNA, 23 bp, Homo sapiens
atgggagaggcaataaataaatg

SEQ ID NO: 4375906 - DNA, 20 bp, Homo sapiens
atgggagattaaaaccagag

SEQ ID NO: 4375907 - DNA, 19 bp, Homo sapiens
atgggagctcctctcctgg

SEQ ID NO: 4375908 - DNA, 23 bp, Homo sapiens
atgggagctcctctcctggagga

SEQ ID NO: 4375909 - DNA, 16 bp, Homo sapiens
atgggagggatcagcc

SEQ ID NO: 4375910 - DNA, 20 bp, Homo sapiens
atgggagggggcttgaagcc

SEQ ID NO: 4375911 - DNA, 23 bp, Homo sapiens
atgggaggtggaagcagaggccc

SEQ ID NO: 4375912 - DNA, 20 bp, Homo sapiens
atgggatatgattggttcag

SEQ ID NO: 4375913 - DNA, 22 bp, Homo sapiens
atgggatggtcggatctcacag

SEQ ID NO: 4375914 - DNA, 17 bp, Homo sapiens
atgggcatcttttgtat

SEQ ID NO: 4375915 - DNA, 23 bp, Homo sapiens
atgggccagggtttacccagtgg

SEQ ID NO: 4375916 - DNA, 16 bp, Homo sapiens
atgggcctgtggggac

SEQ ID NO: 4375917 - DNA, 20 bp, Homo sapiens
atggggatagatgtgtggac

SEQ ID NO: 4375918 - DNA, 19 bp, Homo sapiens
atggggctgaacggggaga

SEQ ID NO: 4375919 - DNA, 19 bp, Homo sapiens
atggggctgacagcactaa

SEQ ID NO: 4375920 - DNA, 16 bp, Homo sapiens
atgggggaaaattatt

SEQ ID NO: 4375921 - DNA, 22 bp, Homo sapiens
atgggggacaggatttggccac

SEQ ID NO: 4375922 - DNA, 18 bp, Homo sapiens
atgggggatgggccaggg

SEQ ID NO: 4375923 - DNA, 11 bp, Homo sapiens
atggggtgaga

SEQ ID NO: 4375924 - DNA, 18 bp, Homo sapiens
atgggtaacctagacttc

SEQ ID NO: 4375925 - DNA, 17 bp, Homo sapiens
atgggtaagggagggaa

SEQ ID NO: 4375926 - DNA, 20 bp, Homo sapiens
atgggtatattgataaattt

SEQ ID NO: 4375927 - DNA, 15 bp, Homo sapiens
atgggtcatgacaag

SEQ ID NO: 4375928 - DNA, 20 bp, Homo sapiens
atgggtcctagcccttccct

SEQ ID NO: 4375929 - DNA, 21 bp, Homo sapiens
atgggtcctagcccttccctg

SEQ ID NO: 4375930 - DNA, 22 bp, Homo sapiens
atgggtcctagcccttccctga

SEQ ID NO: 4375931 - DNA, 13 bp, Homo sapiens
atgggtcctctgg

SEQ ID NO: 4375932 - DNA, 16 bp, Homo sapiens
atgggtggacacggat

SEQ ID NO: 4375933 - DNA, 20 bp, Homo sapiens
atgggtgtgcccttggggta

SEQ ID NO: 4375934 - DNA, 21 bp, Homo sapiens
atgggtgttgtatggggaggc

SEQ ID NO: 4375935 - DNA, 13 bp, Homo sapiens
atggtaagagaaa

SEQ ID NO: 4375936 - DNA, 16 bp, Homo sapiens
atggtaagagaaaaga

SEQ ID NO: 4375937 - DNA, 16 bp, Homo sapiens
atggtacatttttcaa

SEQ ID NO: 4375938 - DNA, 14 bp, Homo sapiens
atggtactacccca

SEQ ID NO: 4375939 - DNA, 13 bp, Homo sapiens
atggtagaaaaat

SEQ ID NO: 4375940 - DNA, 18 bp, Homo sapiens
atggtagaaaaatttcac

SEQ ID NO: 4375941 - DNA, 21 bp, Homo sapiens
atggtagttttacagtgtttc

SEQ ID NO: 4375942 - DNA, 18 bp, Homo sapiens
atggtatcaaaattacat

SEQ ID NO: 4375943 - DNA, 21 bp, Homo sapiens
atggtatctgggtaagaagaa

SEQ ID NO: 4375944 - DNA, 22 bp, Homo sapiens
atggtatgctggccagcaccct

SEQ ID NO: 4375945 - DNA, 18 bp, Homo sapiens
atggtatgtacaagttga

SEQ ID NO: 4375946 - DNA, 19 bp, Homo sapiens
atggtcacacactgatgct

SEQ ID NO: 4375947 - DNA, 20 bp, Homo sapiens
atggtcacacactgatgctt

SEQ ID NO: 4375948 - DNA, 23 bp, Homo sapiens
atggtcacgaggtccagacccac

SEQ ID NO: 4375949 - DNA, 13 bp, Homo sapiens
atggtccaggaga

SEQ ID NO: 4375950 - DNA, 21 bp, Homo sapiens
atggtccagtgtcattttgat

SEQ ID NO: 4375951 - DNA, 15 bp, Homo sapiens
atggtccggtgtcct

SEQ ID NO: 4375952 - DNA, 20 bp, Homo sapiens
atggtcctaaaagcaaaata

SEQ ID NO: 4375953 - DNA, 15 bp, Homo sapiens
atggtcggatctcac

SEQ ID NO: 4375954 - DNA, 17 bp, Homo sapiens
atggtcggatctcacag

SEQ ID NO: 4375955 - DNA, 22 bp, Homo sapiens
atggtctcttccctttgtgtat

SEQ ID NO: 4375956 - DNA, 23 bp, Homo sapiens
atggtctcttccctttgtgtatc

SEQ ID NO: 4375957 - DNA, 14 bp, Homo sapiens
atggtgcctgagag

SEQ ID NO: 4375958 - DNA, 15 bp, Homo sapiens
atggtgcctgagagg

SEQ ID NO: 4375959 - DNA, 20 bp, Homo sapiens
atggtgcctgagaggcaggc

SEQ ID NO: 4375960 - DNA, 20 bp, Homo sapiens
atggtgccttaggaatgact

SEQ ID NO: 4375961 - DNA, 16 bp, Homo sapiens
atggtgctgcccaggc

SEQ ID NO: 4375962 - DNA, 13 bp, Homo sapiens
atggtggagggcc

SEQ ID NO: 4375963 - DNA, 23 bp, Homo sapiens
atggtggttggttgggttttttg

SEQ ID NO: 4375964 - DNA, 12 bp, Homo sapiens
atggtgtatttt

SEQ ID NO: 4375965 - DNA, 12 bp, Homo sapiens
atggtgtcccgg

SEQ ID NO: 4375966 - DNA, 12 bp, Homo sapiens
atggtgtctccc

SEQ ID NO: 4375967 - DNA, 13 bp, Homo sapiens
atggttacactgt

SEQ ID NO: 4375968 - DNA, 23 bp, Homo sapiens
atggttacactgttagaacacta

SEQ ID NO: 4375969 - DNA, 13 bp, Homo sapiens
atggttagctgtc

SEQ ID NO: 4375970 - DNA, 21 bp, Homo sapiens
atggttagctgtcacatacaa

SEQ ID NO: 4375971 - DNA, 13 bp, Homo sapiens
atggttctaaata

SEQ ID NO: 4375972 - DNA, 16 bp, Homo sapiens
atggttctcaggcctg

SEQ ID NO: 4375973 - DNA, 13 bp, Homo sapiens
atggttctgcctc

SEQ ID NO: 4375974 - DNA, 21 bp, Homo sapiens
atgtatttgaaaattacatgt

SEQ ID NO: 4375975 - DNA, 23 bp, Homo sapiens
atgtatttgaaaattacatgttt

SEQ ID NO: 4375976 - DNA, 15 bp, Homo sapiens
atgtatttgctgaca

SEQ ID NO: 4375977 - DNA, 14 bp, Homo sapiens
atgtatttgttata

SEQ ID NO: 4375978 - DNA, 17 bp, Homo sapiens
atgtatttgttatatat

SEQ ID NO: 4375979 - DNA, 21 bp, Homo sapiens
atgtatttgttatatataata

SEQ ID NO: 4375980 - DNA, 12 bp, Homo sapiens
atgtattttaca

SEQ ID NO: 4375981 - DNA, 13 bp, Homo sapiens
atgtattttcata

SEQ ID NO: 4375982 - DNA, 21 bp, Homo sapiens
atgtattttctttttattttg

SEQ ID NO: 4375983 - DNA, 13 bp, Homo sapiens
atgtcactatttg

SEQ ID NO: 4375984 - DNA, 14 bp, Homo sapiens
atgtcagattcctt

SEQ ID NO: 4375985 - DNA, 16 bp, Homo sapiens
atgtcagcttatccta

SEQ ID NO: 4375986 - DNA, 18 bp, Homo sapiens
atgtcaggaatttaagaa

SEQ ID NO: 4375987 - DNA, 13 bp, Homo sapiens
atgtcagtatgtg

SEQ ID NO: 4375988 - DNA, 16 bp, Homo sapiens
atgtcagtatgtggaa

SEQ ID NO: 4375989 - DNA, 17 bp, Homo sapiens
atgtcatttcagaagtt

SEQ ID NO: 4375990 - DNA, 15 bp, Homo sapiens
atgtcatttgcacac

SEQ ID NO: 4375991 - DNA, 18 bp, Homo sapiens
atgtcatttgcacacaaa

SEQ ID NO: 4375992 - DNA, 15 bp, Homo sapiens
atgtcatttttaatg

SEQ ID NO: 4375993 - DNA, 18 bp, Homo sapiens
atgtccaaagaggctgcc

SEQ ID NO: 4375994 - DNA, 20 bp, Homo sapiens
atgtccaaagaggctgcccc

SEQ ID NO: 4375995 - DNA, 21 bp, Homo sapiens
atgtccaaagaggctgcccct

SEQ ID NO: 4375996 - DNA, 17 bp, Homo sapiens
atgtccactggttcttc

SEQ ID NO: 4375997 - DNA, 13 bp, Homo sapiens
atgtccatacact

SEQ ID NO: 4375998 - DNA, 15 bp, Homo sapiens
atgtcccacccaccc

SEQ ID NO: 4375999 - DNA, 19 bp, Homo sapiens
atgtcccaccctccctaga

SEQ ID NO: 4376000 - DNA, 13 bp, Homo sapiens
atgtcccctgcgg

SEQ ID NO: 4376001 - DNA, 23 bp, Homo sapiens
atgtcctattactgatgtgtgca

SEQ ID NO: 4376002 - DNA, 18 bp, Homo sapiens
atgtcctccagaagcctc

SEQ ID NO: 4376003 - DNA, 23 bp, Homo sapiens
atgtcctccagaagcctctggct

SEQ ID NO: 4376004 - DNA, 13 bp, Homo sapiens
atgtcctgtaaag

SEQ ID NO: 4376005 - DNA, 13 bp, Homo sapiens
atgtcggcctcta

SEQ ID NO: 4376006 - DNA, 16 bp, Homo sapiens
atgtctagagaacact

SEQ ID NO: 4376007 - DNA, 16 bp, Homo sapiens
atgtctatttccaaga

SEQ ID NO: 4376008 - DNA, 23 bp, Homo sapiens
atgtctcaggtttgttttgtgaa

SEQ ID NO: 4376009 - DNA, 15 bp, Homo sapiens
atgtctcgtggtagg

SEQ ID NO: 4376010 - DNA, 19 bp, Homo sapiens
atgtctcgtggtaggactg

SEQ ID NO: 4376011 - DNA, 13 bp, Homo sapiens
atgtctctcagaa

SEQ ID NO: 4376012 - DNA, 16 bp, Homo sapiens
atgtctctcagaattc

SEQ ID NO: 4376013 - DNA, 21 bp, Homo sapiens
atgtctctcagaattcttcag

SEQ ID NO: 4376014 - DNA, 17 bp, Homo sapiens
atgtctcttctgagcta

SEQ ID NO: 4376015 - DNA, 11 bp, Homo sapiens
atgtctgaaat

SEQ ID NO: 4376016 - DNA, 16 bp, Homo sapiens
atgtctgaagtacaaa

SEQ ID NO: 4376017 - DNA, 21 bp, Homo sapiens
atgtctgaagtacaaacatga

SEQ ID NO: 4376018 - DNA, 17 bp, Homo sapiens
atgtctgtatactcctg

SEQ ID NO: 4376019 - DNA, 18 bp, Homo sapiens
atgtctgtatactcctgt

SEQ ID NO: 4376020 - DNA, 17 bp, Homo sapiens
atgtcttaacctcaggg

SEQ ID NO: 4376021 - DNA, 18 bp, Homo sapiens
atgtcttaacctcaggga

SEQ ID NO: 4376022 - DNA, 15 bp, Homo sapiens
atgtcttatttttag

SEQ ID NO: 4376023 - DNA, 12 bp, Homo sapiens
atgtcttccctg

SEQ ID NO: 4376024 - DNA, 16 bp, Homo sapiens
atgtcttccctgggct

SEQ ID NO: 4376025 - DNA, 24 bp, Homo sapiens
atgtcttccctgggctgccaccag

SEQ ID NO: 4376026 - DNA, 23 bp, Homo sapiens
atgtcttgatgcatgcactgttc

SEQ ID NO: 4376027 - DNA, 20 bp, Homo sapiens
atgtcttgctgttgacatat

SEQ ID NO: 4376028 - DNA, 21 bp, Homo sapiens
atgtcttgtatttaaaaacat

SEQ ID NO: 4376029 - DNA, 17 bp, Homo sapiens
atgtcttgttcctgtgc

SEQ ID NO: 4376030 - DNA, 18 bp, Homo sapiens
atgtcttgttcctgtgca

SEQ ID NO: 4376031 - DNA, 19 bp, Homo sapiens
atgtctttccaaattattt

SEQ ID NO: 4376032 - DNA, 20 bp, Homo sapiens
atgtcttttatagtggaaaa

SEQ ID NO: 4376033 - DNA, 21 bp, Homo sapiens
atgtcttttatagtggaaaaa

SEQ ID NO: 4376034 - DNA, 13 bp, Homo sapiens
atgtgaaaatata

SEQ ID NO: 4376035 - DNA, 18 bp, Homo sapiens
atgtgaaaatatacttga

SEQ ID NO: 4376036 - DNA, 18 bp, Homo sapiens
atgtgaaaatatttaaag

SEQ ID NO: 4376037 - DNA, 21 bp, Homo sapiens
atgtgaaaatggtccaggaga

SEQ ID NO: 4376038 - DNA, 13 bp, Homo sapiens
atgtgaaacactt

SEQ ID NO: 4376039 - DNA, 22 bp, Homo sapiens
atgtgaaacactttgcctcctg

SEQ ID NO: 4376040 - DNA, 12 bp, Homo sapiens
atgtgaaacatt

SEQ ID NO: 4376041 - DNA, 20 bp, Homo sapiens
atgtgaaaggatatgaatct

SEQ ID NO: 4376042 - DNA, 16 bp, Homo sapiens
atgtgaacaactgttt

SEQ ID NO: 4376043 - DNA, 22 bp, Homo sapiens
atgtgaacaactgtttgtcttt

SEQ ID NO: 4376044 - DNA, 16 bp, Homo sapiens
atgtgaagaatttaga

SEQ ID NO: 4376045 - DNA, 19 bp, Homo sapiens
atgtgaataggttatatgc

SEQ ID NO: 4376046 - DNA, 14 bp, Homo sapiens
atgtgaattattga

SEQ ID NO: 4376047 - DNA, 18 bp, Homo sapiens
atgtgaattattgacact

SEQ ID NO: 4376048 - DNA, 19 bp, Homo sapiens
atgtgaattattgacactg

SEQ ID NO: 4376049 - DNA, 21 bp, Homo sapiens
atgtgaattattgacactgaa

SEQ ID NO: 4376050 - DNA, 21 bp, Homo sapiens
atgtgaatttgtttgtgacaa

SEQ ID NO: 4376051 - DNA, 12 bp, Homo sapiens
atgtgaattttt

SEQ ID NO: 4376052 - DNA, 18 bp, Homo sapiens
atgtgaatttttaagctg

SEQ ID NO: 4376053 - DNA, 21 bp, Homo sapiens
atgtgaatttttaagctgcaa

SEQ ID NO: 4376054 - DNA, 20 bp, Homo sapiens
atgtgacaattttgtacaaa

SEQ ID NO: 4376055 - DNA, 14 bp, Homo sapiens
atgtgacatttctc

SEQ ID NO: 4376056 - DNA, 16 bp, Homo sapiens
atgtgaccataatgta

SEQ ID NO: 4376057 - DNA, 21 bp, Homo sapiens
atgtgactctttccaaccggc

SEQ ID NO: 4376058 - DNA, 16 bp, Homo sapiens
atgtgacttgcgctta

SEQ ID NO: 4376059 - DNA, 14 bp, Homo sapiens
atgtgagagaaagt

SEQ ID NO: 4376060 - DNA, 16 bp, Homo sapiens
atgtgagaggtttgac

SEQ ID NO: 4376061 - DNA, 17 bp, Homo sapiens
atgtgagaggtttgact

SEQ ID NO: 4376062 - DNA, 12 bp, Homo sapiens
atgtgagatttc

SEQ ID NO: 4376063 - DNA, 15 bp, Homo sapiens
atgtgagatttcctt

SEQ ID NO: 4376064 - DNA, 17 bp, Homo sapiens
atgtgagatttccttat

SEQ ID NO: 4376065 - DNA, 22 bp, Homo sapiens
atgtgagccaccgtgcctggcc

SEQ ID NO: 4376066 - DNA, 17 bp, Homo sapiens
atgtgagtagttactaa

SEQ ID NO: 4376067 - DNA, 13 bp, Homo sapiens
atgtgatattctg

SEQ ID NO: 4376068 - DNA, 22 bp, Homo sapiens
atgtgatctgggcattttcctc

SEQ ID NO: 4376069 - DNA, 16 bp, Homo sapiens
atgtgattcttctaaa

SEQ ID NO: 4376070 - DNA, 15 bp, Homo sapiens
atgtgattgtggaat

SEQ ID NO: 4376071 - DNA, 19 bp, Homo sapiens
atgtgcaaggattgtacac

SEQ ID NO: 4376072 - DNA, 13 bp, Homo sapiens
atgtgcaatagaa

SEQ ID NO: 4376073 - DNA, 16 bp, Homo sapiens
atgtgcacccatgggc

SEQ ID NO: 4376074 - DNA, 22 bp, Homo sapiens
atgtgcacccatgggctctgac

SEQ ID NO: 4376075 - DNA, 12 bp, Homo sapiens
atgtgcagggat

SEQ ID NO: 4376076 - DNA, 19 bp, Homo sapiens
atgtgcagggatattgcct

SEQ ID NO: 4376077 - DNA, 21 bp, Homo sapiens
atgtgcagggatattgcctta

SEQ ID NO: 4376078 - DNA, 15 bp, Homo sapiens
atgtgccacagaggc

SEQ ID NO: 4376079 - DNA, 17 bp, Homo sapiens
atgtgccacagaggccc

SEQ ID NO: 4376080 - DNA, 22 bp, Homo sapiens
atgtgccacagaggccccacct

SEQ ID NO: 4376081 - DNA, 20 bp, Homo sapiens
atgtgccagggcaatgatga

SEQ ID NO: 4376082 - DNA, 21 bp, Homo sapiens
atgtgccagggcaatgatgaa

SEQ ID NO: 4376083 - DNA, 22 bp, Homo sapiens
atgtgccccttcgcagctgaag

SEQ ID NO: 4376084 - DNA, 24 bp, Homo sapiens
atgtgccttgattgattagataaa

SEQ ID NO: 4376085 - DNA, 13 bp, Homo sapiens
atgtgcctttctt

SEQ ID NO: 4376086 - DNA, 19 bp, Homo sapiens
atgtgcctttctttgcctc

SEQ ID NO: 4376087 - DNA, 22 bp, Homo sapiens
atgtgcctttctttgcctctgc

SEQ ID NO: 4376088 - DNA, 19 bp, Homo sapiens
atgtgctatactgcatact

SEQ ID NO: 4376089 - DNA, 17 bp, Homo sapiens
atgtgctattaatattt

SEQ ID NO: 4376090 - DNA, 16 bp, Homo sapiens
atgtgctcagccaaat

SEQ ID NO: 4376091 - DNA, 18 bp, Homo sapiens
atgtgctcagccaaattt

SEQ ID NO: 4376092 - DNA, 21 bp, Homo sapiens
atgttttccacataaatttta

SEQ ID NO: 4376093 - DNA, 23 bp, Homo sapiens
atgttttccacataaattttaat

SEQ ID NO: 4376094 - DNA, 12 bp, Homo sapiens
atgttttctttc

SEQ ID NO: 4376095 - DNA, 17 bp, Homo sapiens
atgttttctttgcaaag

SEQ ID NO: 4376096 - DNA, 15 bp, Homo sapiens
atgttttgatcaaat

SEQ ID NO: 4376097 - DNA, 13 bp, Homo sapiens
atgtttttaatgt

SEQ ID NO: 4376098 - DNA, 14 bp, Homo sapiens
atgtttttaatgta

SEQ ID NO: 4376099 - DNA, 16 bp, Homo sapiens
atgtttttaatgtata

SEQ ID NO: 4376100 - DNA, 13 bp, Homo sapiens
atgtttttccctc

SEQ ID NO: 4376101 - DNA, 22 bp, Homo sapiens
atgtttttctgccagggagctt

SEQ ID NO: 4376102 - DNA, 15 bp, Homo sapiens
atgttttttatgttc

SEQ ID NO: 4376103 - DNA, 15 bp, Homo sapiens
atgttttttctgtaa

SEQ ID NO: 4376104 - DNA, 16 bp, Homo sapiens
atgttttttctgtaat

SEQ ID NO: 4376105 - DNA, 17 bp, Homo sapiens
attaaaaaaaaattgta

SEQ ID NO: 4376106 - DNA, 19 bp, Homo sapiens
attaaaaaagcatacttct

SEQ ID NO: 4376107 - DNA, 13 bp, Homo sapiens
attaaaaaagtct

SEQ ID NO: 4376108 - DNA, 13 bp, Homo sapiens
attaaaaacttta

SEQ ID NO: 4376109 - DNA, 19 bp, Homo sapiens
attaaaaatattttttaaa

SEQ ID NO: 4376110 - DNA, 18 bp, Homo sapiens
attaaaacagaagcaaat

SEQ ID NO: 4376111 - DNA, 14 bp, Homo sapiens
attaaaagaatatc

SEQ ID NO: 4376112 - DNA, 16 bp, Homo sapiens
attaaaagaatatctg

SEQ ID NO: 4376113 - DNA, 15 bp, Homo sapiens
attaaaagaatattt

SEQ ID NO: 4376114 - DNA, 22 bp, Homo sapiens
attaaaagcaaatcatttgttt

SEQ ID NO: 4376115 - DNA, 16 bp, Homo sapiens
attaaaatcctcaatc

SEQ ID NO: 4376116 - DNA, 12 bp, Homo sapiens
attaaaatggat

SEQ ID NO: 4376117 - DNA, 13 bp, Homo sapiens
attaaaatggatg

SEQ ID NO: 4376118 - DNA, 17 bp, Homo sapiens
attaaaatgtttgagca

SEQ ID NO: 4376119 - DNA, 19 bp, Homo sapiens
attaaaattctgaattttg

SEQ ID NO: 4376120 - DNA, 14 bp, Homo sapiens
attaaaatttctta

SEQ ID NO: 4376121 - DNA, 13 bp, Homo sapiens
attaaacaaagtt

SEQ ID NO: 4376122 - DNA, 20 bp, Homo sapiens
attaaacaaagtttcagagt

SEQ ID NO: 4376123 - DNA, 20 bp, Homo sapiens
attaaacagtgaacttgtct

SEQ ID NO: 4376124 - DNA, 19 bp, Homo sapiens
attaaacctttccatttta

SEQ ID NO: 4376125 - DNA, 24 bp, Homo sapiens
attaaacctttccattttacgttt

SEQ ID NO: 4376126 - DNA, 15 bp, Homo sapiens
attaaactgattcca

SEQ ID NO: 4376127 - DNA, 13 bp, Homo sapiens
attaaactgttaa

SEQ ID NO: 4376128 - DNA, 13 bp, Homo sapiens
attaaacttcagc

SEQ ID NO: 4376129 - DNA, 14 bp, Homo sapiens
attaaacttcagca

SEQ ID NO: 4376130 - DNA, 21 bp, Homo sapiens
attaaacttccaaagaaagtt

SEQ ID NO: 4376131 - DNA, 12 bp, Homo sapiens
attaaacttttt

SEQ ID NO: 4376132 - DNA, 15 bp, Homo sapiens
attaaagatgctatg

SEQ ID NO: 4376133 - DNA, 20 bp, Homo sapiens
attaaagatttatttagcta

SEQ ID NO: 4376134 - DNA, 17 bp, Homo sapiens
attaaagcgcaaatgaa

SEQ ID NO: 4376135 - DNA, 11 bp, Homo sapiens
attaaagtcag

SEQ ID NO: 4376136 - DNA, 13 bp, Homo sapiens
attaaagtcagaa

SEQ ID NO: 4376137 - DNA, 16 bp, Homo sapiens
attaaatatatgtatg

SEQ ID NO: 4376138 - DNA, 13 bp, Homo sapiens
attaaatatttat

SEQ ID NO: 4376139 - DNA, 16 bp, Homo sapiens
attaaatctagacatt

SEQ ID NO: 4376140 - DNA, 19 bp, Homo sapiens
attaaatctagacattctt

SEQ ID NO: 4376141 - DNA, 18 bp, Homo sapiens
attaaatgaacttatgta

SEQ ID NO: 4376142 - DNA, 13 bp, Homo sapiens
attaaatgaatat

SEQ ID NO: 4376143 - DNA, 14 bp, Homo sapiens
attaaatgtagctt

SEQ ID NO: 4376144 - DNA, 24 bp, Homo sapiens
attaaatgtagcttcagtcattaa

SEQ ID NO: 4376145 - DNA, 22 bp, Homo sapiens
attaaattacacaattacactt

SEQ ID NO: 4376146 - DNA, 13 bp, Homo sapiens
attaaattacagc

SEQ ID NO: 4376147 - DNA, 20 bp, Homo sapiens
attaaattacagcttttatg

SEQ ID NO: 4376148 - DNA, 22 bp, Homo sapiens
attaaattactatagcaaagta

SEQ ID NO: 4376149 - DNA, 18 bp, Homo sapiens
attaaattagtttgtgaa

SEQ ID NO: 4376150 - DNA, 11 bp, Homo sapiens
attaaattatg

SEQ ID NO: 4376151 - DNA, 12 bp, Homo sapiens
attaaattatga

SEQ ID NO: 4376152 - DNA, 15 bp, Homo sapiens
attaaattgtaaaac

SEQ ID NO: 4376153 - DNA, 19 bp, Homo sapiens
attaaattttttttacatt

SEQ ID NO: 4376154 - DNA, 20 bp, Homo sapiens
attaaattttttttacattt

SEQ ID NO: 4376155 - DNA, 17 bp, Homo sapiens
attaacaaagcaacctt

SEQ ID NO: 4376156 - DNA, 15 bp, Homo sapiens
attaacacaaaggaa

SEQ ID NO: 4376157 - DNA, 14 bp, Homo sapiens
attaacatgcaata

SEQ ID NO: 4376158 - DNA, 17 bp, Homo sapiens
attaacccaaagaagct

SEQ ID NO: 4376159 - DNA, 18 bp, Homo sapiens
attaaccccataattaga

SEQ ID NO: 4376160 - DNA, 22 bp, Homo sapiens
attaacctgaaagaacatacat

SEQ ID NO: 4376161 - DNA, 15 bp, Homo sapiens
attaacggtgctaaa

SEQ ID NO: 4376162 - DNA, 13 bp, Homo sapiens
attaactaaatgc

SEQ ID NO: 4376163 - DNA, 15 bp, Homo sapiens
attaactattagtat

SEQ ID NO: 4376164 - DNA, 19 bp, Homo sapiens
attaactttcaaaagcaaa

SEQ ID NO: 4376165 - DNA, 14 bp, Homo sapiens
attaagaaaactat

SEQ ID NO: 4376166 - DNA, 12 bp, Homo sapiens
attaagaaacct

SEQ ID NO: 4376167 - DNA, 21 bp, Homo sapiens
attaagaaaccttgctctcct

SEQ ID NO: 4376168 - DNA, 19 bp, Homo sapiens
attaagaaggcaaaaatgt

SEQ ID NO: 4376169 - DNA, 22 bp, Homo sapiens
attaagaaggcaaaaatgtaaa

SEQ ID NO: 4376170 - DNA, 16 bp, Homo sapiens
attaagagctatttta

SEQ ID NO: 4376171 - DNA, 23 bp, Homo sapiens
attaagagctattttagaaagct

SEQ ID NO: 4376172 - DNA, 13 bp, Homo sapiens
attaagatcctaa

SEQ ID NO: 4376173 - DNA, 17 bp, Homo sapiens
attaagatcctaaactc

SEQ ID NO: 4376174 - DNA, 14 bp, Homo sapiens
attaagatgagcaa

SEQ ID NO: 4376175 - DNA, 12 bp, Homo sapiens
attaagcagaaa

SEQ ID NO: 4376176 - DNA, 17 bp, Homo sapiens
attaagcagactggaaa

SEQ ID NO: 4376177 - DNA, 18 bp, Homo sapiens
attaagcttttcatttta

SEQ ID NO: 4376178 - DNA, 17 bp, Homo sapiens
attaagggacatttcta

SEQ ID NO: 4376179 - DNA, 16 bp, Homo sapiens
attaagtgtgtataaa

SEQ ID NO: 4376180 - DNA, 12 bp, Homo sapiens
attaataaaata

SEQ ID NO: 4376181 - DNA, 20 bp, Homo sapiens
attaataactttctctgtga

SEQ ID NO: 4376182 - DNA, 19 bp, Homo sapiens
attaataagatttttcaaa

SEQ ID NO: 4376183 - DNA, 21 bp, Homo sapiens
attaataagatttttcaaaat

SEQ ID NO: 4376184 - DNA, 13 bp, Homo sapiens
attaataatattt

SEQ ID NO: 4376185 - DNA, 17 bp, Homo sapiens
attaataatatttatgt

SEQ ID NO: 4376186 - DNA, 19 bp, Homo sapiens
attaatagccaaagatttc

SEQ ID NO: 4376187 - DNA, 18 bp, Homo sapiens
attaatagtaatttgtaa

SEQ ID NO: 4376188 - DNA, 18 bp, Homo sapiens
attaatataagtttcttt

SEQ ID NO: 4376189 - DNA, 14 bp, Homo sapiens
attaatatattaaa

SEQ ID NO: 4376190 - DNA, 13 bp, Homo sapiens
attaatcaagaga

SEQ ID NO: 4376191 - DNA, 20 bp, Homo sapiens
attaatcaagagaaacttca

SEQ ID NO: 4376192 - DNA, 22 bp, Homo sapiens
attaatcatacaaactctcacc

SEQ ID NO: 4376193 - DNA, 18 bp, Homo sapiens
attaatccacatgtttca

SEQ ID NO: 4376194 - DNA, 15 bp, Homo sapiens
attaatctactgtat

SEQ ID NO: 4376195 - DNA, 16 bp, Homo sapiens
attaatcttagtgtat

SEQ ID NO: 4376196 - DNA, 15 bp, Homo sapiens
attaatcttggatag

SEQ ID NO: 4376197 - DNA, 21 bp, Homo sapiens
attaatcttggatagctaata

SEQ ID NO: 4376198 - DNA, 17 bp, Homo sapiens
attaatgaaaataagaa

SEQ ID NO: 4376199 - DNA, 20 bp, Homo sapiens
attaatgaaatgataaagac

SEQ ID NO: 4376200 - DNA, 21 bp, Homo sapiens
attaatgaaatgataaagact

SEQ ID NO: 4376201 - DNA, 23 bp, Homo sapiens
attaatgaaatgataaagacttt

SEQ ID NO: 4376202 - DNA, 12 bp, Homo sapiens
attaatgactta

SEQ ID NO: 4376203 - DNA, 15 bp, Homo sapiens
attaatgacttactt

SEQ ID NO: 4376204 - DNA, 12 bp, Homo sapiens
attaatgcactt

SEQ ID NO: 4376205 - DNA, 15 bp, Homo sapiens
attaatgcctgcttt

SEQ ID NO: 4376206 - DNA, 17 bp, Homo sapiens
attaatgcctgcttttt

SEQ ID NO: 4376207 - DNA, 22 bp, Homo sapiens
attaatgcctgctttttggaaa

SEQ ID NO: 4376208 - DNA, 14 bp, Homo sapiens
attaatgtaataaa

SEQ ID NO: 4376209 - DNA, 17 bp, Homo sapiens
attaatgtaataaagtg

SEQ ID NO: 4376210 - DNA, 16 bp, Homo sapiens
attaatgtctcacttt

SEQ ID NO: 4376211 - DNA, 15 bp, Homo sapiens
attatataactgtat

SEQ ID NO: 4376212 - DNA, 19 bp, Homo sapiens
attatataactgtatttga

SEQ ID NO: 4376213 - DNA, 20 bp, Homo sapiens
attatatacatactgcatct

SEQ ID NO: 4376214 - DNA, 18 bp, Homo sapiens
attatatatttacagaag

SEQ ID NO: 4376215 - DNA, 18 bp, Homo sapiens
attatatgatatgcatgt

SEQ ID NO: 4376216 - DNA, 20 bp, Homo sapiens
attatatgggtatatattca

SEQ ID NO: 4376217 - DNA, 16 bp, Homo sapiens
attatattatgtttaa

SEQ ID NO: 4376218 - DNA, 19 bp, Homo sapiens
attatattcacagactgat

SEQ ID NO: 4376219 - DNA, 15 bp, Homo sapiens
attatattgcaatga

SEQ ID NO: 4376220 - DNA, 13 bp, Homo sapiens
attatctaattta

SEQ ID NO: 4376221 - DNA, 19 bp, Homo sapiens
attatctatagctaagtac

SEQ ID NO: 4376222 - DNA, 12 bp, Homo sapiens
attatctctttg

SEQ ID NO: 4376223 - DNA, 14 bp, Homo sapiens
attatcttacgttt

SEQ ID NO: 4376224 - DNA, 21 bp, Homo sapiens
attatcttcaccctcatcctt

SEQ ID NO: 4376225 - DNA, 12 bp, Homo sapiens
attatcttcata

SEQ ID NO: 4376226 - DNA, 17 bp, Homo sapiens
attatcttcttaacagt

SEQ ID NO: 4376227 - DNA, 14 bp, Homo sapiens
attatgaaaatctt

SEQ ID NO: 4376228 - DNA, 22 bp, Homo sapiens
attatgagctatcctttcaaac

SEQ ID NO: 4376229 - DNA, 16 bp, Homo sapiens
attatgcactaaatat

SEQ ID NO: 4376230 - DNA, 17 bp, Homo sapiens
attatgctttgaacttt

SEQ ID NO: 4376231 - DNA, 19 bp, Homo sapiens
attatggaaaaataaaact

SEQ ID NO: 4376232 - DNA, 20 bp, Homo sapiens
attatggaaaaataaaactg

SEQ ID NO: 4376233 - DNA, 14 bp, Homo sapiens
attatggaaaactg

SEQ ID NO: 4376234 - DNA, 14 bp, Homo sapiens
attatggcatttct

SEQ ID NO: 4376235 - DNA, 20 bp, Homo sapiens
attatgtatggatatatttg

SEQ ID NO: 4376236 - DNA, 21 bp, Homo sapiens
attatgtatggatatatttga

SEQ ID NO: 4376237 - DNA, 21 bp, Homo sapiens
attatgtctcttgagcatcaa

SEQ ID NO: 4376238 - DNA, 11 bp, Homo sapiens
attatgtgaag

SEQ ID NO: 4376239 - DNA, 14 bp, Homo sapiens
attatgtgaagaat

SEQ ID NO: 4376240 - DNA, 16 bp, Homo sapiens
attatgtgaagaattt

SEQ ID NO: 4376241 - DNA, 18 bp, Homo sapiens
attatgtgaagaatttag

SEQ ID NO: 4376242 - DNA, 19 bp, Homo sapiens
attatgtgacattttacat

SEQ ID NO: 4376243 - DNA, 12 bp, Homo sapiens
attatgtgactt

SEQ ID NO: 4376244 - DNA, 13 bp, Homo sapiens
attatgttaatat

SEQ ID NO: 4376245 - DNA, 20 bp, Homo sapiens
attatgtttatttcatgtgg

SEQ ID NO: 4376246 - DNA, 18 bp, Homo sapiens
attatgtttgatttctct

SEQ ID NO: 4376247 - DNA, 15 bp, Homo sapiens
attattacaaatatt

SEQ ID NO: 4376248 - DNA, 13 bp, Homo sapiens
attattactttaa

SEQ ID NO: 4376249 - DNA, 14 bp, Homo sapiens
attattactttaaa

SEQ ID NO: 4376250 - DNA, 12 bp, Homo sapiens
attattactttt

SEQ ID NO: 4376251 - DNA, 23 bp, Homo sapiens
attattagaacattcacttttgt

SEQ ID NO: 4376252 - DNA, 14 bp, Homo sapiens
attattataaaaat

SEQ ID NO: 4376253 - DNA, 16 bp, Homo sapiens
attattataaaaatat

SEQ ID NO: 4376254 - DNA, 15 bp, Homo sapiens
attattataaactat

SEQ ID NO: 4376255 - DNA, 13 bp, Homo sapiens
attattcagtgtc

SEQ ID NO: 4376256 - DNA, 14 bp, Homo sapiens
attattcagtgtca

SEQ ID NO: 4376257 - DNA, 14 bp, Homo sapiens
attattgacactga

SEQ ID NO: 4376258 - DNA, 18 bp, Homo sapiens
attattgacactgaactt

SEQ ID NO: 4376259 - DNA, 15 bp, Homo sapiens
attattgatatatat

SEQ ID NO: 4376260 - DNA, 15 bp, Homo sapiens
attattgcttattgc

SEQ ID NO: 4376261 - DNA, 19 bp, Homo sapiens
attattgcttattgcttag

SEQ ID NO: 4376262 - DNA, 14 bp, Homo sapiens
attattggcaaagt

SEQ ID NO: 4376263 - DNA, 16 bp, Homo sapiens
attattgtagacatgc

SEQ ID NO: 4376264 - DNA, 14 bp, Homo sapiens
attattgtagtttg

SEQ ID NO: 4376265 - DNA, 17 bp, Homo sapiens
attattgtgacttcact

SEQ ID NO: 4376266 - DNA, 18 bp, Homo sapiens
attattgtgacttcactg

SEQ ID NO: 4376267 - DNA, 12 bp, Homo sapiens
attatttcaaaa

SEQ ID NO: 4376268 - DNA, 16 bp, Homo sapiens
attatttctccatccc

SEQ ID NO: 4376269 - DNA, 21 bp, Homo sapiens
attatttctccatcccctccc

SEQ ID NO: 4376270 - DNA, 22 bp, Homo sapiens
attatttctccatcccctccct

SEQ ID NO: 4376271 - DNA, 15 bp, Homo sapiens
attatttctgtcaca

SEQ ID NO: 4376272 - DNA, 22 bp, Homo sapiens
attatttctgtcacagtaaaaa

SEQ ID NO: 4376273 - DNA, 20 bp, Homo sapiens
attatttgggagggaaaagg

SEQ ID NO: 4376274 - DNA, 15 bp, Homo sapiens
attatttgtaagata

SEQ ID NO: 4376275 - DNA, 14 bp, Homo sapiens
attattttaaatta

SEQ ID NO: 4376276 - DNA, 18 bp, Homo sapiens
attattttaaattataag

SEQ ID NO: 4376277 - DNA, 20 bp, Homo sapiens
attattttaaattataagga

SEQ ID NO: 4376278 - DNA, 22 bp, Homo sapiens
attattttaaattataaggact

SEQ ID NO: 4376279 - DNA, 13 bp, Homo sapiens
attattttagtgt

SEQ ID NO: 4376280 - DNA, 18 bp, Homo sapiens
attattttagtgtgtaaa

SEQ ID NO: 4376281 - DNA, 22 bp, Homo sapiens
attatttttcttttaaagattt

SEQ ID NO: 4376282 - DNA, 13 bp, Homo sapiens
attattttttaat

SEQ ID NO: 4376283 - DNA, 16 bp, Homo sapiens
attattttttaataaa

SEQ ID NO: 4376284 - DNA, 20 bp, Homo sapiens
attattttttaataaactgc

SEQ ID NO: 4376285 - DNA, 14 bp, Homo sapiens
attattttttgcat

SEQ ID NO: 4376286 - DNA, 16 bp, Homo sapiens
attattttttgttgaa

SEQ ID NO: 4376287 - DNA, 21 bp, Homo sapiens
attattttttttttttgaaaa

SEQ ID NO: 4376288 - DNA, 22 bp, Homo sapiens
attcaaaaagacagcagacaaa

SEQ ID NO: 4376289 - DNA, 23 bp, Homo sapiens
attcaaaaattatctatagctaa

SEQ ID NO: 4376290 - DNA, 22 bp, Homo sapiens
attcaaaatatttaaaaatgtc

SEQ ID NO: 4376291 - DNA, 12 bp, Homo sapiens
attcaaaatctt

SEQ ID NO: 4376292 - DNA, 15 bp, Homo sapiens
attcaaacagtctca

SEQ ID NO: 4376293 - DNA, 19 bp, Homo sapiens
attcaaacagtctcaggaa

SEQ ID NO: 4376294 - DNA, 22 bp, Homo sapiens
attcaaacagtctcaggaaatc

SEQ ID NO: 4376295 - DNA, 13 bp, Homo sapiens
attcaaacccagg

SEQ ID NO: 4376296 - DNA, 14 bp, Homo sapiens
attcaaagagaaaa

SEQ ID NO: 4376297 - DNA, 15 bp, Homo sapiens
attcaaagatgataa

SEQ ID NO: 4376298 - DNA, 17 bp, Homo sapiens
attcaaatcctcttttg

SEQ ID NO: 4376299 - DNA, 12 bp, Homo sapiens
attcaaatttat

SEQ ID NO: 4376300 - DNA, 21 bp, Homo sapiens
attcaaatttatttccaatgt

SEQ ID NO: 4376301 - DNA, 14 bp, Homo sapiens
attcaaatttgtaa

SEQ ID NO: 4376302 - DNA, 15 bp, Homo sapiens
attcaaatttgtaat

SEQ ID NO: 4376303 - DNA, 20 bp, Homo sapiens
attcaactaatacatggttt

SEQ ID NO: 4376304 - DNA, 15 bp, Homo sapiens
attcaagaagtattt

SEQ ID NO: 4376305 - DNA, 17 bp, Homo sapiens
attcaagaagtattttt

SEQ ID NO: 4376306 - DNA, 19 bp, Homo sapiens
attcaagcctctaaacaga

SEQ ID NO: 4376307 - DNA, 16 bp, Homo sapiens
attcaaggaatttctt

SEQ ID NO: 4376308 - DNA, 20 bp, Homo sapiens
attcaagtgtaaaatatttt

SEQ ID NO: 4376309 - DNA, 22 bp, Homo sapiens
attcaatacaaacaatctctta

SEQ ID NO: 4376310 - DNA, 13 bp, Homo sapiens
attcaatattgaa

SEQ ID NO: 4376311 - DNA, 14 bp, Homo sapiens
attcaatattgaat

SEQ ID NO: 4376312 - DNA, 16 bp, Homo sapiens
attcaatcatttattc

SEQ ID NO: 4376313 - DNA, 14 bp, Homo sapiens
attcaatctgtaaa

SEQ ID NO: 4376314 - DNA, 14 bp, Homo sapiens
attcacaaactttt

SEQ ID NO: 4376315 - DNA, 18 bp, Homo sapiens
attcacaagacccaaaag

SEQ ID NO: 4376316 - DNA, 15 bp, Homo sapiens
attcacaagcctcct

SEQ ID NO: 4376317 - DNA, 20 bp, Homo sapiens
attcacagtgctcttttctc

SEQ ID NO: 4376318 - DNA, 21 bp, Homo sapiens
attcacagtgctcttttctcc

SEQ ID NO: 4376319 - DNA, 17 bp, Homo sapiens
attcacatctaacctca

SEQ ID NO: 4376320 - DNA, 15 bp, Homo sapiens
attcaccagtgttcc

SEQ ID NO: 4376321 - DNA, 16 bp, Homo sapiens
attcaccctgggcagt

SEQ ID NO: 4376322 - DNA, 13 bp, Homo sapiens
attcacctgtaaa

SEQ ID NO: 4376323 - DNA, 14 bp, Homo sapiens
attcacctgtaaaa

SEQ ID NO: 4376324 - DNA, 15 bp, Homo sapiens
attcacctgtaaaac

SEQ ID NO: 4376325 - DNA, 19 bp, Homo sapiens
attcacctgtaaaacttta

SEQ ID NO: 4376326 - DNA, 17 bp, Homo sapiens
attcacgcatacttgga

SEQ ID NO: 4376327 - DNA, 14 bp, Homo sapiens
attcactgggccaa

SEQ ID NO: 4376328 - DNA, 20 bp, Homo sapiens
attcactggttttacacaga

SEQ ID NO: 4376329 - DNA, 18 bp, Homo sapiens
attcagaaaatgttctgt

SEQ ID NO: 4376330 - DNA, 17 bp, Homo sapiens
attcagaagaaaaagaa

SEQ ID NO: 4376331 - DNA, 18 bp, Homo sapiens
attcagaagaaaaagaag

SEQ ID NO: 4376332 - DNA, 11 bp, Homo sapiens
attcagacatc

SEQ ID NO: 4376333 - DNA, 15 bp, Homo sapiens
attcagacatctgag

SEQ ID NO: 4376334 - DNA, 19 bp, Homo sapiens
attcagcagcaaattttca

SEQ ID NO: 4376335 - DNA, 17 bp, Homo sapiens
attcagcagttttatcc

SEQ ID NO: 4376336 - DNA, 14 bp, Homo sapiens
attcagccagctta

SEQ ID NO: 4376337 - DNA, 17 bp, Homo sapiens
attcagctagaatttct

SEQ ID NO: 4376338 - DNA, 18 bp, Homo sapiens
attcagctagaatttctg

SEQ ID NO: 4376339 - DNA, 23 bp, Homo sapiens
attcagctctgatctgaggctaa

SEQ ID NO: 4376340 - DNA, 21 bp, Homo sapiens
attcagctgaggttcattaca

SEQ ID NO: 4376341 - DNA, 20 bp, Homo sapiens
attcaggaatatctgttccc

SEQ ID NO: 4376342 - DNA, 18 bp, Homo sapiens
attcaggacttgaaagaa

SEQ ID NO: 4376343 - DNA, 12 bp, Homo sapiens
attcaggcactg

SEQ ID NO: 4376344 - DNA, 19 bp, Homo sapiens
attcaggccagcccagcca

SEQ ID NO: 4376345 - DNA, 13 bp, Homo sapiens
attcaggctgctt

SEQ ID NO: 4376346 - DNA, 17 bp, Homo sapiens
attcagggagaatgttg

SEQ ID NO: 4376347 - DNA, 19 bp, Homo sapiens
attcaggtgacctcctgca

SEQ ID NO: 4376348 - DNA, 19 bp, Homo sapiens
attcagtggtgaaatcttg

SEQ ID NO: 4376349 - DNA, 20 bp, Homo sapiens
attcagtggtgaaatcttgt

SEQ ID NO: 4376350 - DNA, 23 bp, Homo sapiens
attcagtggtgaaatcttgtttg

SEQ ID NO: 4376351 - DNA, 19 bp, Homo sapiens
attcagttaggctagagac

SEQ ID NO: 4376352 - DNA, 14 bp, Homo sapiens
attcagtttcactt

SEQ ID NO: 4376353 - DNA, 14 bp, Homo sapiens
attcagtttcataa

SEQ ID NO: 4376354 - DNA, 15 bp, Homo sapiens
attcagttttcattt

SEQ ID NO: 4376355 - DNA, 14 bp, Homo sapiens
attcatacttaaaa

SEQ ID NO: 4376356 - DNA, 16 bp, Homo sapiens
attcatagtaacttct

SEQ ID NO: 4376357 - DNA, 17 bp, Homo sapiens
attcatagtaacttctt

SEQ ID NO: 4376358 - DNA, 20 bp, Homo sapiens
attcatagtctttggagaaa

SEQ ID NO: 4376359 - DNA, 21 bp, Homo sapiens
attcatatctaaatagtattt

SEQ ID NO: 4376360 - DNA, 15 bp, Homo sapiens
attcatattggaaaa

SEQ ID NO: 4376361 - DNA, 17 bp, Homo sapiens
attcatgacattatgtg

SEQ ID NO: 4376362 - DNA, 15 bp, Homo sapiens
attcattatttgtca

SEQ ID NO: 4376363 - DNA, 18 bp, Homo sapiens
attcattcactcttcctg

SEQ ID NO: 4376364 - DNA, 15 bp, Homo sapiens
attcattcagtattt

SEQ ID NO: 4376365 - DNA, 20 bp, Homo sapiens
attcattctcataattccta

SEQ ID NO: 4376366 - DNA, 12 bp, Homo sapiens
attcattggtga

SEQ ID NO: 4376367 - DNA, 14 bp, Homo sapiens
attcattgtgttac

SEQ ID NO: 4376368 - DNA, 12 bp, Homo sapiens
attcatttctaa

SEQ ID NO: 4376369 - DNA, 14 bp, Homo sapiens
attcattttctaga

SEQ ID NO: 4376370 - DNA, 15 bp, Homo sapiens
attcattttctagat

SEQ ID NO: 4376371 - DNA, 22 bp, Homo sapiens
attcatttttgaaactgcattt

SEQ ID NO: 4376372 - DNA, 17 bp, Homo sapiens
attccaaaaagcacata

SEQ ID NO: 4376373 - DNA, 14 bp, Homo sapiens
attccaaaatatta

SEQ ID NO: 4376374 - DNA, 20 bp, Homo sapiens
attccaacatttctcactga

SEQ ID NO: 4376375 - DNA, 11 bp, Homo sapiens
attccaacctt

SEQ ID NO: 4376376 - DNA, 15 bp, Homo sapiens
attccaagaaaatat

SEQ ID NO: 4376377 - DNA, 22 bp, Homo sapiens
attccaagacatgtctgttcta

SEQ ID NO: 4376378 - DNA, 19 bp, Homo sapiens
attccacaaacacattata

SEQ ID NO: 4376379 - DNA, 20 bp, Homo sapiens
attccacaaacacattataa

SEQ ID NO: 4376380 - DNA, 21 bp, Homo sapiens
attccacaaacacattataaa

SEQ ID NO: 4376381 - DNA, 19 bp, Homo sapiens
attccacactccttgtcaa

SEQ ID NO: 4376382 - DNA, 23 bp, Homo sapiens
attccaccttaaattaaacaatt

SEQ ID NO: 4376383 - DNA, 15 bp, Homo sapiens
attccagaacaaatt

SEQ ID NO: 4376384 - DNA, 18 bp, Homo sapiens
attccagaacaaattgtt

SEQ ID NO: 4376385 - DNA, 14 bp, Homo sapiens
attccagaatgctg

SEQ ID NO: 4376386 - DNA, 20 bp, Homo sapiens
attccagaatgctgtacatc

SEQ ID NO: 4376387 - DNA, 23 bp, Homo sapiens
attccagaatgctgtacatctat

SEQ ID NO: 4376388 - DNA, 19 bp, Homo sapiens
attccagagcgtgtagtga

SEQ ID NO: 4376389 - DNA, 16 bp, Homo sapiens
attccagatcccaggc

SEQ ID NO: 4376390 - DNA, 13 bp, Homo sapiens
attccagggatga

SEQ ID NO: 4376391 - DNA, 18 bp, Homo sapiens
attccagggatgagccaa

SEQ ID NO: 4376392 - DNA, 20 bp, Homo sapiens
attccatctagtttttggaa

SEQ ID NO: 4376393 - DNA, 22 bp, Homo sapiens
attccatgctaagcaagctaac

SEQ ID NO: 4376394 - DNA, 18 bp, Homo sapiens
attcccaacatttcttaa

SEQ ID NO: 4376395 - DNA, 16 bp, Homo sapiens
attcccattccttttc

SEQ ID NO: 4376396 - DNA, 21 bp, Homo sapiens
attccccaggtggctgaccca

SEQ ID NO: 4376397 - DNA, 20 bp, Homo sapiens
attcccctccccactcctct

SEQ ID NO: 4376398 - DNA, 17 bp, Homo sapiens
attccctagaaacttcc

SEQ ID NO: 4376399 - DNA, 21 bp, Homo sapiens
attccctagaaacttccaaat

SEQ ID NO: 4376400 - DNA, 12 bp, Homo sapiens
attccctccccc

SEQ ID NO: 4376401 - DNA, 17 bp, Homo sapiens
attccctccccctcctt

SEQ ID NO: 4376402 - DNA, 17 bp, Homo sapiens
attccctgcacacacat

SEQ ID NO: 4376403 - DNA, 21 bp, Homo sapiens
attccctgcccaaacccttaa

SEQ ID NO: 4376404 - DNA, 23 bp, Homo sapiens
attcccttttcaccttttcagga

SEQ ID NO: 4376405 - DNA, 23 bp, Homo sapiens
attccgattagacctttatccag

SEQ ID NO: 4376406 - DNA, 16 bp, Homo sapiens
attcctagaattaaac

SEQ ID NO: 4376407 - DNA, 17 bp, Homo sapiens
attcctagattacatct

SEQ ID NO: 4376408 - DNA, 18 bp, Homo sapiens
attcctagtctttccagt

SEQ ID NO: 4376409 - DNA, 20 bp, Homo sapiens
attcctatgctgcaatacat

SEQ ID NO: 4376410 - DNA, 17 bp, Homo sapiens
attcctcaacgtattgt

SEQ ID NO: 4376411 - DNA, 21 bp, Homo sapiens
attcctcagtgaggttatctt

SEQ ID NO: 4376412 - DNA, 16 bp, Homo sapiens
attcctccagagacac

SEQ ID NO: 4376413 - DNA, 15 bp, Homo sapiens
attcctccagcctcc

SEQ ID NO: 4376414 - DNA, 19 bp, Homo sapiens
attcctccagcctcccctc

SEQ ID NO: 4376415 - DNA, 20 bp, Homo sapiens
attcctctactaacaatcag

SEQ ID NO: 4376416 - DNA, 23 bp, Homo sapiens
attcctctcaaattcagctctga

SEQ ID NO: 4376417 - DNA, 13 bp, Homo sapiens
attcctcttttta

SEQ ID NO: 4376418 - DNA, 15 bp, Homo sapiens
attcctgcctttgat

SEQ ID NO: 4376419 - DNA, 15 bp, Homo sapiens
attcctggacatcac

SEQ ID NO: 4376420 - DNA, 17 bp, Homo sapiens
attcctgggaaatattc

SEQ ID NO: 4376421 - DNA, 19 bp, Homo sapiens
attccttagactcttttcc

SEQ ID NO: 4376422 - DNA, 22 bp, Homo sapiens
attccttagactcttttccttc

SEQ ID NO: 4376423 - DNA, 18 bp, Homo sapiens
attccttcacacagttca

SEQ ID NO: 4376424 - DNA, 14 bp, Homo sapiens
attccttcactcat

SEQ ID NO: 4376425 - DNA, 19 bp, Homo sapiens
attccttgagtttcatata

SEQ ID NO: 4376426 - DNA, 19 bp, Homo sapiens
attccttgcgcctcagccc

SEQ ID NO: 4376427 - DNA, 12 bp, Homo sapiens
attccttgtgaa

SEQ ID NO: 4376428 - DNA, 12 bp, Homo sapiens
attcctttcctt

SEQ ID NO: 4376429 - DNA, 15 bp, Homo sapiens
attcctttccttttt

SEQ ID NO: 4376430 - DNA, 23 bp, Homo sapiens
attcctttccttttttgagattt

SEQ ID NO: 4376431 - DNA, 15 bp, Homo sapiens
attccttttcgttta

SEQ ID NO: 4376432 - DNA, 18 bp, Homo sapiens
attccttttcgtttagaa

SEQ ID NO: 4376433 - DNA, 14 bp, Homo sapiens
attcctttttctat

SEQ ID NO: 4376434 - DNA, 17 bp, Homo sapiens
attcctttttcttcact

SEQ ID NO: 4376435 - DNA, 13 bp, Homo sapiens
attcgaatctctg

SEQ ID NO: 4376436 - DNA, 16 bp, Homo sapiens
attcgaatctctgccc

SEQ ID NO: 4376437 - DNA, 18 bp, Homo sapiens
attcggtgtgctgccaac

SEQ ID NO: 4376438 - DNA, 19 bp, Homo sapiens
attcggtgtgctgccaact

SEQ ID NO: 4376439 - DNA, 22 bp, Homo sapiens
attcggtgtgctgccaacttga

SEQ ID NO: 4376440 - DNA, 16 bp, Homo sapiens
attcgtgtgttttttt

SEQ ID NO: 4376441 - DNA, 22 bp, Homo sapiens
attctaaaacacaacaagaaac

SEQ ID NO: 4376442 - DNA, 15 bp, Homo sapiens
attctaacctggagg

SEQ ID NO: 4376443 - DNA, 16 bp, Homo sapiens
attctaacttattaaa

SEQ ID NO: 4376444 - DNA, 23 bp, Homo sapiens
attctaagaaatatctgtgaaat

SEQ ID NO: 4376445 - DNA, 13 bp, Homo sapiens
attctaatctaac

SEQ ID NO: 4376446 - DNA, 16 bp, Homo sapiens
attctacagctaggac

SEQ ID NO: 4376447 - DNA, 13 bp, Homo sapiens
attctacttttaa

SEQ ID NO: 4376448 - DNA, 19 bp, Homo sapiens
attgaaggcttaaacccat

SEQ ID NO: 4376449 - DNA, 20 bp, Homo sapiens
attgaaggtgataagggaaa

SEQ ID NO: 4376450 - DNA, 16 bp, Homo sapiens
attgaagtaatgaatt

SEQ ID NO: 4376451 - DNA, 17 bp, Homo sapiens
attgaagttgtttatca

SEQ ID NO: 4376452 - DNA, 22 bp, Homo sapiens
attgaagttgtttatcaacttc

SEQ ID NO: 4376453 - DNA, 13 bp, Homo sapiens
attgaataaagag

SEQ ID NO: 4376454 - DNA, 18 bp, Homo sapiens
attgaatagtttatttct

SEQ ID NO: 4376455 - DNA, 19 bp, Homo sapiens
attgaatagtttatttctg

SEQ ID NO: 4376456 - DNA, 13 bp, Homo sapiens
attgaatgtgaaa

SEQ ID NO: 4376457 - DNA, 23 bp, Homo sapiens
attgaattcttggttgaggaaac

SEQ ID NO: 4376458 - DNA, 17 bp, Homo sapiens
attgaatttttcctatg

SEQ ID NO: 4376459 - DNA, 13 bp, Homo sapiens
attgacaataaaa

SEQ ID NO: 4376460 - DNA, 18 bp, Homo sapiens
attgacaataaaatatta

SEQ ID NO: 4376461 - DNA, 14 bp, Homo sapiens
attgacacagaaaa

SEQ ID NO: 4376462 - DNA, 20 bp, Homo sapiens
attgacacttaaaaatggtt

SEQ ID NO: 4376463 - DNA, 20 bp, Homo sapiens
attgacctttaggtattaca

SEQ ID NO: 4376464 - DNA, 23 bp, Homo sapiens
attgacgtctagctatgctgtat

SEQ ID NO: 4376465 - DNA, 14 bp, Homo sapiens
attgactcaaacca

SEQ ID NO: 4376466 - DNA, 17 bp, Homo sapiens
attgactcaaaccatat

SEQ ID NO: 4376467 - DNA, 21 bp, Homo sapiens
attgactcctttccaatagaa

SEQ ID NO: 4376468 - DNA, 23 bp, Homo sapiens
attgactcgatttaaactccagc

SEQ ID NO: 4376469 - DNA, 14 bp, Homo sapiens
attgactgatgatt

SEQ ID NO: 4376470 - DNA, 13 bp, Homo sapiens
attgacttcattt

SEQ ID NO: 4376471 - DNA, 20 bp, Homo sapiens
attgacttcattttatattt

SEQ ID NO: 4376472 - DNA, 13 bp, Homo sapiens
attgagaaatgtg

SEQ ID NO: 4376473 - DNA, 18 bp, Homo sapiens
attgagaataagaatttg

SEQ ID NO: 4376474 - DNA, 20 bp, Homo sapiens
attgagcagaattcattcat

SEQ ID NO: 4376475 - DNA, 15 bp, Homo sapiens
attgagctctctcat

SEQ ID NO: 4376476 - DNA, 19 bp, Homo sapiens
attgaggggccctggccag

SEQ ID NO: 4376477 - DNA, 17 bp, Homo sapiens
attgagtaagatttacc

SEQ ID NO: 4376478 - DNA, 18 bp, Homo sapiens
attgagtcttaactgtat

SEQ ID NO: 4376479 - DNA, 19 bp, Homo sapiens
attgagtcttaactgtatt

SEQ ID NO: 4376480 - DNA, 14 bp, Homo sapiens
attgagtttgtagg

SEQ ID NO: 4376481 - DNA, 16 bp, Homo sapiens
attgagttttcagtgg

SEQ ID NO: 4376482 - DNA, 23 bp, Homo sapiens
attgatacctgttcctttttctg

SEQ ID NO: 4376483 - DNA, 22 bp, Homo sapiens
attgatagggagttttaaagaa

SEQ ID NO: 4376484 - DNA, 21 bp, Homo sapiens
attgatatacacggatgactt

SEQ ID NO: 4376485 - DNA, 16 bp, Homo sapiens
attgatcacacagtgt

SEQ ID NO: 4376486 - DNA, 18 bp, Homo sapiens
attgatcaccatgaaaga

SEQ ID NO: 4376487 - DNA, 19 bp, Homo sapiens
attgatctgttttacagga

SEQ ID NO: 4376488 - DNA, 21 bp, Homo sapiens
attgatctgttttacaggaaa

SEQ ID NO: 4376489 - DNA, 23 bp, Homo sapiens
attgatctgttttacaggaaaca

SEQ ID NO: 4376490 - DNA, 21 bp, Homo sapiens
attgatgtacagtctgtcatg

SEQ ID NO: 4376491 - DNA, 16 bp, Homo sapiens
attgatgttttcatag

SEQ ID NO: 4376492 - DNA, 15 bp, Homo sapiens
attgattaaattgca

SEQ ID NO: 4376493 - DNA, 13 bp, Homo sapiens
attgattgtattg

SEQ ID NO: 4376494 - DNA, 16 bp, Homo sapiens
attgattgtattgttg

SEQ ID NO: 4376495 - DNA, 20 bp, Homo sapiens
attgatttgtcccagaattt

SEQ ID NO: 4376496 - DNA, 23 bp, Homo sapiens
attgcaagaagctttatttctag

SEQ ID NO: 4376497 - DNA, 16 bp, Homo sapiens
attgcaataaagtata

SEQ ID NO: 4376498 - DNA, 16 bp, Homo sapiens
attgcaatgaaggaaa

SEQ ID NO: 4376499 - DNA, 16 bp, Homo sapiens
attgcactccagcctg

SEQ ID NO: 4376500 - DNA, 17 bp, Homo sapiens
attgcagaaaattctgt

SEQ ID NO: 4376501 - DNA, 15 bp, Homo sapiens
attgcatctcccaga

SEQ ID NO: 4376502 - DNA, 18 bp, Homo sapiens
attgcatgaaaatagcta

SEQ ID NO: 4376503 - DNA, 14 bp, Homo sapiens
attgccagtgtctt

SEQ ID NO: 4376504 - DNA, 13 bp, Homo sapiens
attgcccagtgag

SEQ ID NO: 4376505 - DNA, 15 bp, Homo sapiens
attgcccagtgagcc

SEQ ID NO: 4376506 - DNA, 23 bp, Homo sapiens
attgcccagtgagccctgctctt

SEQ ID NO: 4376507 - DNA, 13 bp, Homo sapiens
attgcccctggct

SEQ ID NO: 4376508 - DNA, 18 bp, Homo sapiens
attgcctttgaatgttaa

SEQ ID NO: 4376509 - DNA, 22 bp, Homo sapiens
attgcctttgaatgttaatttt

SEQ ID NO: 4376510 - DNA, 17 bp, Homo sapiens
attgcgccattgcactc

SEQ ID NO: 4376511 - DNA, 18 bp, Homo sapiens
attgctaaaagcatgtat

SEQ ID NO: 4376512 - DNA, 15 bp, Homo sapiens
attgctaatgttgct

SEQ ID NO: 4376513 - DNA, 18 bp, Homo sapiens
attgctaatgttgctgga

SEQ ID NO: 4376514 - DNA, 17 bp, Homo sapiens
attgctaccgagaaggt

SEQ ID NO: 4376515 - DNA, 21 bp, Homo sapiens
attgctactataatcaaatga

SEQ ID NO: 4376516 - DNA, 20 bp, Homo sapiens
attgctactgctcagcttct

SEQ ID NO: 4376517 - DNA, 20 bp, Homo sapiens
attgctatttaaatagataa

SEQ ID NO: 4376518 - DNA, 23 bp, Homo sapiens
attgctcccatcagggaagaacc

SEQ ID NO: 4376519 - DNA, 22 bp, Homo sapiens
attgctcctgcatgcaactaat

SEQ ID NO: 4376520 - DNA, 20 bp, Homo sapiens
attgctcgcccagacaccat

SEQ ID NO: 4376521 - DNA, 22 bp, Homo sapiens
attgctcgcccagacaccatgt

SEQ ID NO: 4376522 - DNA, 18 bp, Homo sapiens
attgctctgtgtatatct

SEQ ID NO: 4376523 - DNA, 12 bp, Homo sapiens
attgctgactgt

SEQ ID NO: 4376524 - DNA, 15 bp, Homo sapiens
attgctgactgtgta

SEQ ID NO: 4376525 - DNA, 21 bp, Homo sapiens
attgctgccccatcagtgctc

SEQ ID NO: 4376526 - DNA, 13 bp, Homo sapiens
attgctgctgccc

SEQ ID NO: 4376527 - DNA, 14 bp, Homo sapiens
attgctgtcctgga

SEQ ID NO: 4376528 - DNA, 22 bp, Homo sapiens
attgctgtccttgaatgccata

SEQ ID NO: 4376529 - DNA, 15 bp, Homo sapiens
attgctgtgtctcct

SEQ ID NO: 4376530 - DNA, 13 bp, Homo sapiens
attgcttaaaagc

SEQ ID NO: 4376531 - DNA, 14 bp, Homo sapiens
attgcttaaaagca

SEQ ID NO: 4376532 - DNA, 13 bp, Homo sapiens
attgcttagtaaa

SEQ ID NO: 4376533 - DNA, 15 bp, Homo sapiens
attgcttagtaaaat

SEQ ID NO: 4376534 - DNA, 23 bp, Homo sapiens
attgcttcctgtgtaacatctgc

SEQ ID NO: 4376535 - DNA, 13 bp, Homo sapiens
attgcttctgact

SEQ ID NO: 4376536 - DNA, 14 bp, Homo sapiens
attgcttcttgtgt

SEQ ID NO: 4376537 - DNA, 17 bp, Homo sapiens
attgcttgagcccagga

SEQ ID NO: 4376538 - DNA, 18 bp, Homo sapiens
attgcttgagctcaggag

SEQ ID NO: 4376539 - DNA, 16 bp, Homo sapiens
attgcttgagcttggg

SEQ ID NO: 4376540 - DNA, 21 bp, Homo sapiens
attgctttgtattgtatatta

SEQ ID NO: 4376541 - DNA, 12 bp, Homo sapiens
attggaaatgga

SEQ ID NO: 4376542 - DNA, 23 bp, Homo sapiens
attggaaatggatgcaaagtaca

SEQ ID NO: 4376543 - DNA, 14 bp, Homo sapiens
attggaattctttc

SEQ ID NO: 4376544 - DNA, 14 bp, Homo sapiens
attggacccttcca

SEQ ID NO: 4376545 - DNA, 15 bp, Homo sapiens
attggacccttccat

SEQ ID NO: 4376546 - DNA, 20 bp, Homo sapiens
attggacgcattttggtttt

SEQ ID NO: 4376547 - DNA, 20 bp, Homo sapiens
attggagatgccatcctctt

SEQ ID NO: 4376548 - DNA, 17 bp, Homo sapiens
attggagctgactgttc

SEQ ID NO: 4376549 - DNA, 22 bp, Homo sapiens
attggagctgactgttcttggt

SEQ ID NO: 4376550 - DNA, 15 bp, Homo sapiens
attggaggaaagcaa

SEQ ID NO: 4376551 - DNA, 21 bp, Homo sapiens
attggatattctcctcggact

SEQ ID NO: 4376552 - DNA, 11 bp, Homo sapiens
attggatattt

SEQ ID NO: 4376553 - DNA, 21 bp, Homo sapiens
attggatctattgatttgaaa

SEQ ID NO: 4376554 - DNA, 19 bp, Homo sapiens
attggatttgctgtgacta

SEQ ID NO: 4376555 - DNA, 12 bp, Homo sapiens
attggcaaagtt

SEQ ID NO: 4376556 - DNA, 21 bp, Homo sapiens
attggcacatgccacctggca

SEQ ID NO: 4376557 - DNA, 23 bp, Homo sapiens
attggcatctctccccatatata

SEQ ID NO: 4376558 - DNA, 18 bp, Homo sapiens
attggccgagctcctggg

SEQ ID NO: 4376559 - DNA, 20 bp, Homo sapiens
attggctaaaagacatgcat

SEQ ID NO: 4376560 - DNA, 22 bp, Homo sapiens
attggcttccagattttaaatt

SEQ ID NO: 4376561 - DNA, 20 bp, Homo sapiens
attggcttgataaacataat

SEQ ID NO: 4376562 - DNA, 18 bp, Homo sapiens
attgggagaagtggaaat

SEQ ID NO: 4376563 - DNA, 17 bp, Homo sapiens
attgggcacagtccaga

SEQ ID NO: 4376564 - DNA, 18 bp, Homo sapiens
attggggaattaaatagt

SEQ ID NO: 4376565 - DNA, 19 bp, Homo sapiens
attggggaattaaatagtg

SEQ ID NO: 4376566 - DNA, 16 bp, Homo sapiens
atttaaactttcaata

SEQ ID NO: 4376567 - DNA, 24 bp, Homo sapiens
atttaaagtatcttgcactgataa

SEQ ID NO: 4376568 - DNA, 15 bp, Homo sapiens
atttaaagtatttta

SEQ ID NO: 4376569 - DNA, 16 bp, Homo sapiens
atttaaagtattttaa

SEQ ID NO: 4376570 - DNA, 21 bp, Homo sapiens
atttaaagtattttaatttta

SEQ ID NO: 4376571 - DNA, 15 bp, Homo sapiens
atttaaatatctgtt

SEQ ID NO: 4376572 - DNA, 22 bp, Homo sapiens
atttaaatcattttaacttcta

SEQ ID NO: 4376573 - DNA, 23 bp, Homo sapiens
atttaaatctgattaatccattt

SEQ ID NO: 4376574 - DNA, 15 bp, Homo sapiens
atttaaatgtgtaca

SEQ ID NO: 4376575 - DNA, 14 bp, Homo sapiens
atttaaattccaca

SEQ ID NO: 4376576 - DNA, 16 bp, Homo sapiens
atttaaatttaagtaa

SEQ ID NO: 4376577 - DNA, 17 bp, Homo sapiens
atttaaatttttttcct

SEQ ID NO: 4376578 - DNA, 17 bp, Homo sapiens
atttaacaaaaaatgta

SEQ ID NO: 4376579 - DNA, 21 bp, Homo sapiens
atttaacactttttgtgaatt

SEQ ID NO: 4376580 - DNA, 14 bp, Homo sapiens
atttaacagaaatt

SEQ ID NO: 4376581 - DNA, 17 bp, Homo sapiens
atttaacagaaattgta

SEQ ID NO: 4376582 - DNA, 13 bp, Homo sapiens
atttaacattgtt

SEQ ID NO: 4376583 - DNA, 17 bp, Homo sapiens
atttaacattttacagt

SEQ ID NO: 4376584 - DNA, 22 bp, Homo sapiens
atttaaccccttggtactgaaa

SEQ ID NO: 4376585 - DNA, 23 bp, Homo sapiens
atttaactacccttaattactta

SEQ ID NO: 4376586 - DNA, 15 bp, Homo sapiens
atttaactccctgta

SEQ ID NO: 4376587 - DNA, 18 bp, Homo sapiens
atttaactccctgtaaca

SEQ ID NO: 4376588 - DNA, 22 bp, Homo sapiens
atttaactctttgaaactgtat

SEQ ID NO: 4376589 - DNA, 23 bp, Homo sapiens
atttaactggtgcactttgtaaa

SEQ ID NO: 4376590 - DNA, 21 bp, Homo sapiens
atttaagaatgaaactataaa

SEQ ID NO: 4376591 - DNA, 22 bp, Homo sapiens
atttaagaattgccagtctttt

SEQ ID NO: 4376592 - DNA, 17 bp, Homo sapiens
atttaagatgtacattt

SEQ ID NO: 4376593 - DNA, 21 bp, Homo sapiens
atttaagcataatctgaaaac

SEQ ID NO: 4376594 - DNA, 15 bp, Homo sapiens
atttaagctttaaat

SEQ ID NO: 4376595 - DNA, 14 bp, Homo sapiens
atttaagggaaaaa

SEQ ID NO: 4376596 - DNA, 16 bp, Homo sapiens
atttaagggaaaaata

SEQ ID NO: 4376597 - DNA, 23 bp, Homo sapiens
atttaagggggaaaaagtgtcaa

SEQ ID NO: 4376598 - DNA, 23 bp, Homo sapiens
atttaagtagtgggcatttcata

SEQ ID NO: 4376599 - DNA, 13 bp, Homo sapiens
atttaagtatctt

SEQ ID NO: 4376600 - DNA, 15 bp, Homo sapiens
atttaataaaactgc

SEQ ID NO: 4376601 - DNA, 22 bp, Homo sapiens
atttaatccttctttgtaatac

SEQ ID NO: 4376602 - DNA, 19 bp, Homo sapiens
atttaatcttttcttattt

SEQ ID NO: 4376603 - DNA, 18 bp, Homo sapiens
atttaatgatgattatgg

SEQ ID NO: 4376604 - DNA, 15 bp, Homo sapiens
atttaatggcagcta

SEQ ID NO: 4376605 - DNA, 22 bp, Homo sapiens
atttaatggcagctagtgcctt

SEQ ID NO: 4376606 - DNA, 16 bp, Homo sapiens
atttaatgtaaataaa

SEQ ID NO: 4376607 - DNA, 20 bp, Homo sapiens
atttaatgttttaaatgtac

SEQ ID NO: 4376608 - DNA, 14 bp, Homo sapiens
atttaatgttttca

SEQ ID NO: 4376609 - DNA, 21 bp, Homo sapiens
atttaatgtttttaatcacat

SEQ ID NO: 4376610 - DNA, 12 bp, Homo sapiens
atttaattgctt

SEQ ID NO: 4376611 - DNA, 13 bp, Homo sapiens
atttaattgcttt

SEQ ID NO: 4376612 - DNA, 16 bp, Homo sapiens
atttaattgctttgaa

SEQ ID NO: 4376613 - DNA, 13 bp, Homo sapiens
atttaattgtaaa

SEQ ID NO: 4376614 - DNA, 15 bp, Homo sapiens
atttaattgtaaact

SEQ ID NO: 4376615 - DNA, 18 bp, Homo sapiens
atttaattgtaaactgta

SEQ ID NO: 4376616 - DNA, 12 bp, Homo sapiens
atttaatttcat

SEQ ID NO: 4376617 - DNA, 13 bp, Homo sapiens
atttaatttcatg

SEQ ID NO: 4376618 - DNA, 17 bp, Homo sapiens
atttaatttcatgtata

SEQ ID NO: 4376619 - DNA, 15 bp, Homo sapiens
atttacaaaagattt

SEQ ID NO: 4376620 - DNA, 14 bp, Homo sapiens
atttacaaaattta

SEQ ID NO: 4376621 - DNA, 14 bp, Homo sapiens
atttacaagaagaa

SEQ ID NO: 4376622 - DNA, 14 bp, Homo sapiens
atttacaagatatt

SEQ ID NO: 4376623 - DNA, 17 bp, Homo sapiens
atttacaagatattatt

SEQ ID NO: 4376624 - DNA, 20 bp, Homo sapiens
atttacacagtgagactgta

SEQ ID NO: 4376625 - DNA, 20 bp, Homo sapiens
atttacacttttgagacttt

SEQ ID NO: 4376626 - DNA, 18 bp, Homo sapiens
atttacagaagaaaagca

SEQ ID NO: 4376627 - DNA, 23 bp, Homo sapiens
atttacagccagtgggagatgtt

SEQ ID NO: 4376628 - DNA, 19 bp, Homo sapiens
atttacccagaatgtcaga

SEQ ID NO: 4376629 - DNA, 15 bp, Homo sapiens
atttacctaagatta

SEQ ID NO: 4376630 - DNA, 15 bp, Homo sapiens
atttacgctttgatt

SEQ ID NO: 4376631 - DNA, 17 bp, Homo sapiens
atttacgctttgattca

SEQ ID NO: 4376632 - DNA, 14 bp, Homo sapiens
atttactcttagag

SEQ ID NO: 4376633 - DNA, 17 bp, Homo sapiens
atttactgctctttatt

SEQ ID NO: 4376634 - DNA, 22 bp, Homo sapiens
atttactgctctttattgcaga

SEQ ID NO: 4376635 - DNA, 17 bp, Homo sapiens
atttactgtgagactgt

SEQ ID NO: 4376636 - DNA, 19 bp, Homo sapiens
atttacttaagtgttcatt

SEQ ID NO: 4376637 - DNA, 14 bp, Homo sapiens
atttactttcttca

SEQ ID NO: 4376638 - DNA, 17 bp, Homo sapiens
atttactttttaaaaat

SEQ ID NO: 4376639 - DNA, 18 bp, Homo sapiens
atttactttttaaaaata

SEQ ID NO: 4376640 - DNA, 20 bp, Homo sapiens
atttagaaaaagtcaatgta

SEQ ID NO: 4376641 - DNA, 14 bp, Homo sapiens
atttagaaaacttt

SEQ ID NO: 4376642 - DNA, 18 bp, Homo sapiens
atttagaaaactttaaag

SEQ ID NO: 4376643 - DNA, 21 bp, Homo sapiens
atttagaaaagtgaattgaag

SEQ ID NO: 4376644 - DNA, 22 bp, Homo sapiens
atttagaaactaattgacttta

SEQ ID NO: 4376645 - DNA, 23 bp, Homo sapiens
atttagaagccaactatgattat

SEQ ID NO: 4376646 - DNA, 20 bp, Homo sapiens
atttagacaagagatgggaa

SEQ ID NO: 4376647 - DNA, 19 bp, Homo sapiens
atttagagcgtttggttaa

SEQ ID NO: 4376648 - DNA, 20 bp, Homo sapiens
atttagagcgtttggttaaa

SEQ ID NO: 4376649 - DNA, 20 bp, Homo sapiens
atttagatcttatattggtt

SEQ ID NO: 4376650 - DNA, 15 bp, Homo sapiens
atttagcatgttgtt

SEQ ID NO: 4376651 - DNA, 18 bp, Homo sapiens
atttagccagcgtttatt

SEQ ID NO: 4376652 - DNA, 21 bp, Homo sapiens
atttagccagcgtttattgta

SEQ ID NO: 4376653 - DNA, 22 bp, Homo sapiens
atttagctaaacggattccaaa

SEQ ID NO: 4376654 - DNA, 23 bp, Homo sapiens
atttagctaaacggattccaaag

SEQ ID NO: 4376655 - DNA, 23 bp, Homo sapiens
atttagctagtttttaatagtgt

SEQ ID NO: 4376656 - DNA, 15 bp, Homo sapiens
atttaggagcagaaa

SEQ ID NO: 4376657 - DNA, 16 bp, Homo sapiens
atttaggatccatgca

SEQ ID NO: 4376658 - DNA, 19 bp, Homo sapiens
atttagtaatagcctgggt

SEQ ID NO: 4376659 - DNA, 20 bp, Homo sapiens
atttagtgatactggctcag

SEQ ID NO: 4376660 - DNA, 21 bp, Homo sapiens
atttagtgatcaaattgtgca

SEQ ID NO: 4376661 - DNA, 12 bp, Homo sapiens
atttagtttcag

SEQ ID NO: 4376662 - DNA, 23 bp, Homo sapiens
atttagtttgttaaagcctgttc

SEQ ID NO: 4376663 - DNA, 20 bp, Homo sapiens
atttataaaaatataaattg

SEQ ID NO: 4376664 - DNA, 17 bp, Homo sapiens
atttataatactgtttt

SEQ ID NO: 4376665 - DNA, 20 bp, Homo sapiens
atttataatataaatatatg

SEQ ID NO: 4376666 - DNA, 19 bp, Homo sapiens
atttataatgtatttgaaa

SEQ ID NO: 4376667 - DNA, 15 bp, Homo sapiens
atttatacagttgaa

SEQ ID NO: 4376668 - DNA, 13 bp, Homo sapiens
atttatactttgc

SEQ ID NO: 4376669 - DNA, 14 bp, Homo sapiens
atttatactttgca

SEQ ID NO: 4376670 - DNA, 22 bp, Homo sapiens
atttataggcgttttttgggga

SEQ ID NO: 4376671 - DNA, 17 bp, Homo sapiens
atttatataagtctgtt

SEQ ID NO: 4376672 - DNA, 17 bp, Homo sapiens
atttatatactttttca

SEQ ID NO: 4376673 - DNA, 20 bp, Homo sapiens
atttatatactttttcatga

SEQ ID NO: 4376674 - DNA, 21 bp, Homo sapiens
atttatatcacacaatatagt

SEQ ID NO: 4376675 - DNA, 16 bp, Homo sapiens
atttatatgtacatga

SEQ ID NO: 4376676 - DNA, 10 bp, Homo sapiens
atttatctat

SEQ ID NO: 4376677 - DNA, 17 bp, Homo sapiens
atttatctttaccaaaa

SEQ ID NO: 4376678 - DNA, 16 bp, Homo sapiens
atttatgatgcagttt

SEQ ID NO: 4376679 - DNA, 13 bp, Homo sapiens
atttatgtgtgag

SEQ ID NO: 4376680 - DNA, 21 bp, Homo sapiens
atttatgttgttgaactaata

SEQ ID NO: 4376681 - DNA, 22 bp, Homo sapiens
atttatgttgttgaactaatat

SEQ ID NO: 4376682 - DNA, 16 bp, Homo sapiens
atttattaaacttcag

SEQ ID NO: 4376683 - DNA, 19 bp, Homo sapiens
atttctgccatttcatgtc

SEQ ID NO: 4376684 - DNA, 15 bp, Homo sapiens
atttctgcctcgctc

SEQ ID NO: 4376685 - DNA, 13 bp, Homo sapiens
atttctgctctgg

SEQ ID NO: 4376686 - DNA, 16 bp, Homo sapiens
atttctggtgtatatt

SEQ ID NO: 4376687 - DNA, 17 bp, Homo sapiens
atttctgtacatttgca

SEQ ID NO: 4376688 - DNA, 13 bp, Homo sapiens
atttctgtatata

SEQ ID NO: 4376689 - DNA, 23 bp, Homo sapiens
atttctgtcacagtaaaaataaa

SEQ ID NO: 4376690 - DNA, 13 bp, Homo sapiens
atttctgtgaaag

SEQ ID NO: 4376691 - DNA, 14 bp, Homo sapiens
atttctgtgaagtt

SEQ ID NO: 4376692 - DNA, 20 bp, Homo sapiens
atttctgttaaaatatatga

SEQ ID NO: 4376693 - DNA, 14 bp, Homo sapiens
atttctgttatttt

SEQ ID NO: 4376694 - DNA, 20 bp, Homo sapiens
atttctgttatttttaagct

SEQ ID NO: 4376695 - DNA, 17 bp, Homo sapiens
atttcttaacctttgct

SEQ ID NO: 4376696 - DNA, 17 bp, Homo sapiens
atttcttaacttcttgc

SEQ ID NO: 4376697 - DNA, 20 bp, Homo sapiens
atttcttaagtataaacctt

SEQ ID NO: 4376698 - DNA, 19 bp, Homo sapiens
atttcttaattattataaa

SEQ ID NO: 4376699 - DNA, 23 bp, Homo sapiens
atttcttaattattataaaaata

SEQ ID NO: 4376700 - DNA, 13 bp, Homo sapiens
atttcttatcaca

SEQ ID NO: 4376701 - DNA, 16 bp, Homo sapiens
atttcttatcacataa

SEQ ID NO: 4376702 - DNA, 20 bp, Homo sapiens
atttcttccctgctttgcat

SEQ ID NO: 4376703 - DNA, 19 bp, Homo sapiens
atttcttcctaccaagtca

SEQ ID NO: 4376704 - DNA, 19 bp, Homo sapiens
atttcttcgttctttttaa

SEQ ID NO: 4376705 - DNA, 16 bp, Homo sapiens
atttcttcttctaaga

SEQ ID NO: 4376706 - DNA, 18 bp, Homo sapiens
atttcttcttctaagaag

SEQ ID NO: 4376707 - DNA, 12 bp, Homo sapiens
atttcttgcttt

SEQ ID NO: 4376708 - DNA, 13 bp, Homo sapiens
atttcttgctttc

SEQ ID NO: 4376709 - DNA, 12 bp, Homo sapiens
atttcttggcat

SEQ ID NO: 4376710 - DNA, 22 bp, Homo sapiens
atttcttggcattggaattcta

SEQ ID NO: 4376711 - DNA, 23 bp, Homo sapiens
atttcttggcattggaattctac

SEQ ID NO: 4376712 - DNA, 21 bp, Homo sapiens
atttctttaaaagaatgacta

SEQ ID NO: 4376713 - DNA, 16 bp, Homo sapiens
atttctttatgtggaa

SEQ ID NO: 4376714 - DNA, 17 bp, Homo sapiens
atttctttcctttaaaa

SEQ ID NO: 4376715 - DNA, 20 bp, Homo sapiens
atttctttcctttaaaaata

SEQ ID NO: 4376716 - DNA, 21 bp, Homo sapiens
atttcttttaaaagccccagt

SEQ ID NO: 4376717 - DNA, 21 bp, Homo sapiens
atttcttttgttgtactttat

SEQ ID NO: 4376718 - DNA, 16 bp, Homo sapiens
atttgaaaaaaacttc

SEQ ID NO: 4376719 - DNA, 15 bp, Homo sapiens
atttgaaaaactttt

SEQ ID NO: 4376720 - DNA, 12 bp, Homo sapiens
atttgaaaatta

SEQ ID NO: 4376721 - DNA, 13 bp, Homo sapiens
atttgaaaattgt

SEQ ID NO: 4376722 - DNA, 21 bp, Homo sapiens
atttgaaataaagttgaatat

SEQ ID NO: 4376723 - DNA, 14 bp, Homo sapiens
atttgaaatagatt

SEQ ID NO: 4376724 - DNA, 17 bp, Homo sapiens
atttgaagacttcaaaa

SEQ ID NO: 4376725 - DNA, 23 bp, Homo sapiens
atttgaaggtagaatgttttcaa

SEQ ID NO: 4376726 - DNA, 22 bp, Homo sapiens
atttgaagtaacttatttgact

SEQ ID NO: 4376727 - DNA, 14 bp, Homo sapiens
atttgaataaatta

SEQ ID NO: 4376728 - DNA, 16 bp, Homo sapiens
atttgaataaattatg

SEQ ID NO: 4376729 - DNA, 17 bp, Homo sapiens
atttgaataaattatga

SEQ ID NO: 4376730 - DNA, 15 bp, Homo sapiens
atttgaatgcttaat

SEQ ID NO: 4376731 - DNA, 12 bp, Homo sapiens
atttgactaatt

SEQ ID NO: 4376732 - DNA, 13 bp, Homo sapiens
atttgactaattt

SEQ ID NO: 4376733 - DNA, 14 bp, Homo sapiens
atttgactaatttt

SEQ ID NO: 4376734 - DNA, 13 bp, Homo sapiens
atttgactattct

SEQ ID NO: 4376735 - DNA, 22 bp, Homo sapiens
atttgacttttctgtaattcag

SEQ ID NO: 4376736 - DNA, 15 bp, Homo sapiens
atttgagccatgtca

SEQ ID NO: 4376737 - DNA, 16 bp, Homo sapiens
atttgaggagtgttaa

SEQ ID NO: 4376738 - DNA, 16 bp, Homo sapiens
atttgagtgctctgat

SEQ ID NO: 4376739 - DNA, 19 bp, Homo sapiens
atttgataatgataaaaca

SEQ ID NO: 4376740 - DNA, 20 bp, Homo sapiens
atttgataatgataaaacac

SEQ ID NO: 4376741 - DNA, 14 bp, Homo sapiens
atttgatctttgtt

SEQ ID NO: 4376742 - DNA, 18 bp, Homo sapiens
atttgatctttgtttaaa

SEQ ID NO: 4376743 - DNA, 20 bp, Homo sapiens
atttgatctttgtttaaatg

SEQ ID NO: 4376744 - DNA, 21 bp, Homo sapiens
atttgatctttgtttaaatgc

SEQ ID NO: 4376745 - DNA, 17 bp, Homo sapiens
atttgatgagttaactg

SEQ ID NO: 4376746 - DNA, 21 bp, Homo sapiens
atttgatgagttaactgtgaa

SEQ ID NO: 4376747 - DNA, 23 bp, Homo sapiens
atttgatgggccacaactgtctt

SEQ ID NO: 4376748 - DNA, 13 bp, Homo sapiens
atttgatgtacat

SEQ ID NO: 4376749 - DNA, 19 bp, Homo sapiens
atttgatgtacattacaga

SEQ ID NO: 4376750 - DNA, 20 bp, Homo sapiens
atttgatgtacattacagat

SEQ ID NO: 4376751 - DNA, 13 bp, Homo sapiens
atttgattgattt

SEQ ID NO: 4376752 - DNA, 15 bp, Homo sapiens
atttgcaagggaaaa

SEQ ID NO: 4376753 - DNA, 14 bp, Homo sapiens
atttgcacaatatt

SEQ ID NO: 4376754 - DNA, 19 bp, Homo sapiens
atttgcacaatatttcttt

SEQ ID NO: 4376755 - DNA, 23 bp, Homo sapiens
atttgcaggatctgtctgtgcac

SEQ ID NO: 4376756 - DNA, 17 bp, Homo sapiens
atttgcatatttattgc

SEQ ID NO: 4376757 - DNA, 22 bp, Homo sapiens
atttgcatattttgagaaactg

SEQ ID NO: 4376758 - DNA, 18 bp, Homo sapiens
atttgcattaaattcaca

SEQ ID NO: 4376759 - DNA, 16 bp, Homo sapiens
atttgccaatgtatat

SEQ ID NO: 4376760 - DNA, 21 bp, Homo sapiens
atttgctaagaatgtctattt

SEQ ID NO: 4376761 - DNA, 14 bp, Homo sapiens
atttgctaattttt

SEQ ID NO: 4376762 - DNA, 16 bp, Homo sapiens
atttgctaatttttat

SEQ ID NO: 4376763 - DNA, 15 bp, Homo sapiens
atttgctactgtaca

SEQ ID NO: 4376764 - DNA, 20 bp, Homo sapiens
atttgctcacttggtaaatg

SEQ ID NO: 4376765 - DNA, 19 bp, Homo sapiens
atttgctgccaaatgcgta

SEQ ID NO: 4376766 - DNA, 20 bp, Homo sapiens
atttgctgccaaatgcgtat

SEQ ID NO: 4376767 - DNA, 14 bp, Homo sapiens
atttgctgtgacta

SEQ ID NO: 4376768 - DNA, 19 bp, Homo sapiens
atttgcttgcaatctaatc

SEQ ID NO: 4376769 - DNA, 17 bp, Homo sapiens
atttggaaataaagtca

SEQ ID NO: 4376770 - DNA, 15 bp, Homo sapiens
atttggactgtctat

SEQ ID NO: 4376771 - DNA, 16 bp, Homo sapiens
atttggcactatggtt

SEQ ID NO: 4376772 - DNA, 18 bp, Homo sapiens
atttggcatgggacagac

SEQ ID NO: 4376773 - DNA, 19 bp, Homo sapiens
atttggccacactggggct

SEQ ID NO: 4376774 - DNA, 13 bp, Homo sapiens
atttggccttaag

SEQ ID NO: 4376775 - DNA, 21 bp, Homo sapiens
atttggccttaagaactgtgt

SEQ ID NO: 4376776 - DNA, 19 bp, Homo sapiens
atttggcttcatactcttt

SEQ ID NO: 4376777 - DNA, 19 bp, Homo sapiens
atttggcttgacaaaggca

SEQ ID NO: 4376778 - DNA, 15 bp, Homo sapiens
atttggcttgctgtt

SEQ ID NO: 4376779 - DNA, 19 bp, Homo sapiens
atttggcttgctgtttact

SEQ ID NO: 4376780 - DNA, 17 bp, Homo sapiens
atttgggctgaatgtat

SEQ ID NO: 4376781 - DNA, 22 bp, Homo sapiens
atttgggctgaatgtatgtaaa

SEQ ID NO: 4376782 - DNA, 12 bp, Homo sapiens
atttggggtgga

SEQ ID NO: 4376783 - DNA, 19 bp, Homo sapiens
atttggtaaaaatgctgct

SEQ ID NO: 4376784 - DNA, 20 bp, Homo sapiens
atttggtaaaaatgctgctc

SEQ ID NO: 4376785 - DNA, 21 bp, Homo sapiens
atttggtaaaaatgctgctct

SEQ ID NO: 4376786 - DNA, 15 bp, Homo sapiens
atttggtacacatgt

SEQ ID NO: 4376787 - DNA, 16 bp, Homo sapiens
atttggtacacatgtg

SEQ ID NO: 4376788 - DNA, 17 bp, Homo sapiens
atttggtagatgacaaa

SEQ ID NO: 4376789 - DNA, 23 bp, Homo sapiens
atttggtgccgatgttgaacttt

SEQ ID NO: 4376790 - DNA, 19 bp, Homo sapiens
atttgtaaaaataatgaat

SEQ ID NO: 4376791 - DNA, 13 bp, Homo sapiens
atttgtaaagttg

SEQ ID NO: 4376792 - DNA, 13 bp, Homo sapiens
atttgtaagatat

SEQ ID NO: 4376793 - DNA, 18 bp, Homo sapiens
atttgtaagcaacttgct

SEQ ID NO: 4376794 - DNA, 21 bp, Homo sapiens
atttgtaagcaacttgcttct

SEQ ID NO: 4376795 - DNA, 17 bp, Homo sapiens
atttgtaataaaactat

SEQ ID NO: 4376796 - DNA, 22 bp, Homo sapiens
atttgtaatagatgtttgatag

SEQ ID NO: 4376797 - DNA, 13 bp, Homo sapiens
atttgtaattaaa

SEQ ID NO: 4376798 - DNA, 21 bp, Homo sapiens
atttgtaattaaaagcaaatc

SEQ ID NO: 4376799 - DNA, 18 bp, Homo sapiens
atttgtacaattttaaag

SEQ ID NO: 4376800 - DNA, 15 bp, Homo sapiens
atttgtatgatattt

SEQ ID NO: 4376801 - DNA, 18 bp, Homo sapiens
atttgtatgtcaaagctt

SEQ ID NO: 4376802 - DNA, 20 bp, Homo sapiens
atttgtatgtttttctgtat

SEQ ID NO: 4376803 - DNA, 11 bp, Homo sapiens
atttgtatttt

SEQ ID NO: 4376804 - DNA, 19 bp, Homo sapiens
atttgtcatgctgggattt

SEQ ID NO: 4376805 - DNA, 13 bp, Homo sapiens
atttgtcccaagt

SEQ ID NO: 4376806 - DNA, 13 bp, Homo sapiens
atttgtcttaaaa

SEQ ID NO: 4376807 - DNA, 22 bp, Homo sapiens
atttgtcttaaaaaatgtgaaa

SEQ ID NO: 4376808 - DNA, 17 bp, Homo sapiens
atttgtgaactggaaga

SEQ ID NO: 4376809 - DNA, 14 bp, Homo sapiens
atttgtgcaaacat

SEQ ID NO: 4376810 - DNA, 22 bp, Homo sapiens
atttgtgcaaacatggagaaat

SEQ ID NO: 4376811 - DNA, 18 bp, Homo sapiens
atttgtgctatagtattt

SEQ ID NO: 4376812 - DNA, 21 bp, Homo sapiens
atttgtgctttttaagaatat

SEQ ID NO: 4376813 - DNA, 13 bp, Homo sapiens
atttgtggtcaca

SEQ ID NO: 4376814 - DNA, 14 bp, Homo sapiens
atttgtgtaaattt

SEQ ID NO: 4376815 - DNA, 15 bp, Homo sapiens
atttgtgtaaatttg

SEQ ID NO: 4376816 - DNA, 16 bp, Homo sapiens
atttgtgtaataaagt

SEQ ID NO: 4376817 - DNA, 20 bp, Homo sapiens
atttgtgtaataaagtgttt

SEQ ID NO: 4376818 - DNA, 14 bp, Homo sapiens
atttgtgtctcttt

SEQ ID NO: 4376819 - DNA, 17 bp, Homo sapiens
atttgtgtgtatgtgta

SEQ ID NO: 4376820 - DNA, 19 bp, Homo sapiens
atttgtgttgaaggaactt

SEQ ID NO: 4376821 - DNA, 16 bp, Homo sapiens
atttgttatatataat

SEQ ID NO: 4376822 - DNA, 23 bp, Homo sapiens
atttgttatatataataaatact

SEQ ID NO: 4376823 - DNA, 23 bp, Homo sapiens
atttgttatatcagcagacactc

SEQ ID NO: 4376824 - DNA, 16 bp, Homo sapiens
atttgttattttgcaa

SEQ ID NO: 4376825 - DNA, 16 bp, Homo sapiens
atttgttcttgtattt

SEQ ID NO: 4376826 - DNA, 22 bp, Homo sapiens
atttgtttatggtaaaaaattt

SEQ ID NO: 4376827 - DNA, 16 bp, Homo sapiens
atttgtttcatctatt

SEQ ID NO: 4376828 - DNA, 13 bp, Homo sapiens
atttgtttccccc

SEQ ID NO: 4376829 - DNA, 20 bp, Homo sapiens
atttgtttcccccacagttt

SEQ ID NO: 4376830 - DNA, 22 bp, Homo sapiens
atttgtttcccccacagtttta

SEQ ID NO: 4376831 - DNA, 21 bp, Homo sapiens
atttgtttgtgttcaatatca

SEQ ID NO: 4376832 - DNA, 17 bp, Homo sapiens
atttgttttcaacaatt

SEQ ID NO: 4376833 - DNA, 19 bp, Homo sapiens
atttgtttttacctgtatt

SEQ ID NO: 4376834 - DNA, 14 bp, Homo sapiens
atttgtttttgcat

SEQ ID NO: 4376835 - DNA, 16 bp, Homo sapiens
atttgtttttgcattt

SEQ ID NO: 4376836 - DNA, 14 bp, Homo sapiens
attttaaaaaaggg

SEQ ID NO: 4376837 - DNA, 17 bp, Homo sapiens
attttaaaaaatggtca

SEQ ID NO: 4376838 - DNA, 23 bp, Homo sapiens
attttaaaaagtccataccttat

SEQ ID NO: 4376839 - DNA, 21 bp, Homo sapiens
attttaaaagcaattatattg

SEQ ID NO: 4376840 - DNA, 22 bp, Homo sapiens
attttaaaagcaattatattgt

SEQ ID NO: 4376841 - DNA, 20 bp, Homo sapiens
attttaaaatctcctaaatg

SEQ ID NO: 4376842 - DNA, 13 bp, Homo sapiens
attttaaaatttg

SEQ ID NO: 4376843 - DNA, 13 bp, Homo sapiens
attttaaagaatt

SEQ ID NO: 4376844 - DNA, 17 bp, Homo sapiens
attttaaagaattgtgt

SEQ ID NO: 4376845 - DNA, 13 bp, Homo sapiens
attttaaagtatg

SEQ ID NO: 4376846 - DNA, 13 bp, Homo sapiens
attttaaagttag

SEQ ID NO: 4376847 - DNA, 20 bp, Homo sapiens
attttaaatatccatttatc

SEQ ID NO: 4376848 - DNA, 11 bp, Homo sapiens
attttaaatta

SEQ ID NO: 4376849 - DNA, 17 bp, Homo sapiens
attttaaattataagga

SEQ ID NO: 4376850 - DNA, 21 bp, Homo sapiens
attttaaattataaggactgc

SEQ ID NO: 4376851 - DNA, 12 bp, Homo sapiens
attttaaatttc

SEQ ID NO: 4376852 - DNA, 21 bp, Homo sapiens
attttaaatttcttttattaa

SEQ ID NO: 4376853 - DNA, 23 bp, Homo sapiens
attttaaatttcttttattaata

SEQ ID NO: 4376854 - DNA, 17 bp, Homo sapiens
attttaaattttatgtc

SEQ ID NO: 4376855 - DNA, 18 bp, Homo sapiens
attttaaattttatgtca

SEQ ID NO: 4376856 - DNA, 19 bp, Homo sapiens
attttaaattttatgtcat

SEQ ID NO: 4376857 - DNA, 22 bp, Homo sapiens
attttaacctatgatattttct

SEQ ID NO: 4376858 - DNA, 23 bp, Homo sapiens
attttaacctgtatactcttgaa

SEQ ID NO: 4376859 - DNA, 22 bp, Homo sapiens
attttaactgatttaacacttt

SEQ ID NO: 4376860 - DNA, 16 bp, Homo sapiens
attttaagaagaaaga

SEQ ID NO: 4376861 - DNA, 16 bp, Homo sapiens
attttaagactgattt

SEQ ID NO: 4376862 - DNA, 17 bp, Homo sapiens
attttaaggaaactttt

SEQ ID NO: 4376863 - DNA, 13 bp, Homo sapiens
attttaagggtaa

SEQ ID NO: 4376864 - DNA, 20 bp, Homo sapiens
attttaagtaacgtgctcac

SEQ ID NO: 4376865 - DNA, 19 bp, Homo sapiens
attttaagtccctgtcacc

SEQ ID NO: 4376866 - DNA, 14 bp, Homo sapiens
attttaataaagta

SEQ ID NO: 4376867 - DNA, 13 bp, Homo sapiens
attttaatatata

SEQ ID NO: 4376868 - DNA, 14 bp, Homo sapiens
attttaatatataa

SEQ ID NO: 4376869 - DNA, 14 bp, Homo sapiens
attttaattcaaga

SEQ ID NO: 4376870 - DNA, 17 bp, Homo sapiens
attttaattcaagaaat

SEQ ID NO: 4376871 - DNA, 12 bp, Homo sapiens
attttacaattt

SEQ ID NO: 4376872 - DNA, 22 bp, Homo sapiens
attttacagctcattaaacttt

SEQ ID NO: 4376873 - DNA, 15 bp, Homo sapiens
attttacataacgga

SEQ ID NO: 4376874 - DNA, 16 bp, Homo sapiens
attttaccaaagcatc

SEQ ID NO: 4376875 - DNA, 17 bp, Homo sapiens
attttaccaaagcatca

SEQ ID NO: 4376876 - DNA, 18 bp, Homo sapiens
attttaccaaagcatcaa

SEQ ID NO: 4376877 - DNA, 17 bp, Homo sapiens
attttacgttttagaaa

SEQ ID NO: 4376878 - DNA, 18 bp, Homo sapiens
attttacgttttagaaaa

SEQ ID NO: 4376879 - DNA, 14 bp, Homo sapiens
attttagaaagcta

SEQ ID NO: 4376880 - DNA, 16 bp, Homo sapiens
attttagaaagctaaa

SEQ ID NO: 4376881 - DNA, 15 bp, Homo sapiens
attttagaaatattc

SEQ ID NO: 4376882 - DNA, 17 bp, Homo sapiens
attttagaaatattcac

SEQ ID NO: 4376883 - DNA, 22 bp, Homo sapiens
attttagatgtagatatttgaa

SEQ ID NO: 4376884 - DNA, 19 bp, Homo sapiens
attttagcagttctgcaaa

SEQ ID NO: 4376885 - DNA, 17 bp, Homo sapiens
attttaggtgctgttat

SEQ ID NO: 4376886 - DNA, 21 bp, Homo sapiens
attttaggtgctgttatgttt

SEQ ID NO: 4376887 - DNA, 15 bp, Homo sapiens
attttagtacatttt

SEQ ID NO: 4376888 - DNA, 16 bp, Homo sapiens
attttagtatgtgcag

SEQ ID NO: 4376889 - DNA, 14 bp, Homo sapiens
attttagtgtgtaa

SEQ ID NO: 4376890 - DNA, 16 bp, Homo sapiens
attttagtgtgtaaaa

SEQ ID NO: 4376891 - DNA, 20 bp, Homo sapiens
attttagtgtgtaaaattaa

SEQ ID NO: 4376892 - DNA, 23 bp, Homo sapiens
attttagtttttcattaaataaa

SEQ ID NO: 4376893 - DNA, 13 bp, Homo sapiens
attttataaaaca

SEQ ID NO: 4376894 - DNA, 13 bp, Homo sapiens
attttataatcag

SEQ ID NO: 4376895 - DNA, 19 bp, Homo sapiens
attttataggggatacttg

SEQ ID NO: 4376896 - DNA, 14 bp, Homo sapiens
attttatataataa

SEQ ID NO: 4376897 - DNA, 17 bp, Homo sapiens
attttatataataaagt

SEQ ID NO: 4376898 - DNA, 19 bp, Homo sapiens
attttatataataaagtat

SEQ ID NO: 4376899 - DNA, 18 bp, Homo sapiens
attttatatcatacagtt

SEQ ID NO: 4376900 - DNA, 15 bp, Homo sapiens
attttatatgcttac

SEQ ID NO: 4376901 - DNA, 23 bp, Homo sapiens
attttatatgcttactgatatat

SEQ ID NO: 4376902 - DNA, 15 bp, Homo sapiens
attttatatgtaaat

SEQ ID NO: 4376903 - DNA, 21 bp, Homo sapiens
attttatatgtaaatgtgtta

SEQ ID NO: 4376904 - DNA, 18 bp, Homo sapiens
attttatattacactaca

SEQ ID NO: 4376905 - DNA, 20 bp, Homo sapiens
attttatatttaaaaaatta

SEQ ID NO: 4376906 - DNA, 20 bp, Homo sapiens
attttatcatcctttcagtt

SEQ ID NO: 4376907 - DNA, 12 bp, Homo sapiens
attttatcctgt

SEQ ID NO: 4376908 - DNA, 16 bp, Homo sapiens
attttatcctgtattc

SEQ ID NO: 4376909 - DNA, 15 bp, Homo sapiens
attttatctggaaca

SEQ ID NO: 4376910 - DNA, 22 bp, Homo sapiens
attttatctggaacaacttgta

SEQ ID NO: 4376911 - DNA, 13 bp, Homo sapiens
attttatctttga

SEQ ID NO: 4376912 - DNA, 15 bp, Homo sapiens
attttatctttgatt

SEQ ID NO: 4376913 - DNA, 21 bp, Homo sapiens
attttatctttgattctcctt

SEQ ID NO: 4376914 - DNA, 14 bp, Homo sapiens
attttatgaacatt

SEQ ID NO: 4376915 - DNA, 17 bp, Homo sapiens
attttatgaacattgta

SEQ ID NO: 4376916 - DNA, 20 bp, Homo sapiens
attttatgaacattgtactg

SEQ ID NO: 4376917 - DNA, 24 bp, Homo sapiens
attttatgaacattgtactgttgc

SEQ ID NO: 4376918 - DNA, 21 bp, Homo sapiens
attttatgtattttaaaataa

SEQ ID NO: 4376919 - DNA, 14 bp, Homo sapiens
atttttatttcaaa

SEQ ID NO: 4376920 - DNA, 21 bp, Homo sapiens
atttttatttcagattttgat

SEQ ID NO: 4376921 - DNA, 13 bp, Homo sapiens
atttttatttctt

SEQ ID NO: 4376922 - DNA, 13 bp, Homo sapiens
atttttatttgca

SEQ ID NO: 4376923 - DNA, 12 bp, Homo sapiens
atttttcaaaat

SEQ ID NO: 4376924 - DNA, 23 bp, Homo sapiens
atttttcaaagcaattgaaatgc

SEQ ID NO: 4376925 - DNA, 22 bp, Homo sapiens
atttttcaacatttttttttct

SEQ ID NO: 4376926 - DNA, 14 bp, Homo sapiens
atttttcaactttg

SEQ ID NO: 4376927 - DNA, 23 bp, Homo sapiens
atttttcaactttgaataaagaa

SEQ ID NO: 4376928 - DNA, 12 bp, Homo sapiens
atttttcaatag

SEQ ID NO: 4376929 - DNA, 17 bp, Homo sapiens
atttttcaatatattga

SEQ ID NO: 4376930 - DNA, 15 bp, Homo sapiens
atttttcagaaatca

SEQ ID NO: 4376931 - DNA, 18 bp, Homo sapiens
atttttcatctttaagaa

SEQ ID NO: 4376932 - DNA, 15 bp, Homo sapiens
atttttcattcatga

SEQ ID NO: 4376933 - DNA, 13 bp, Homo sapiens
atttttccaacta

SEQ ID NO: 4376934 - DNA, 15 bp, Homo sapiens
atttttccatctgtg

SEQ ID NO: 4376935 - DNA, 16 bp, Homo sapiens
atttttccatctgtgt

SEQ ID NO: 4376936 - DNA, 19 bp, Homo sapiens
atttttctcccaagaaacc

SEQ ID NO: 4376937 - DNA, 19 bp, Homo sapiens
atttttctctcctgtcctc

SEQ ID NO: 4376938 - DNA, 15 bp, Homo sapiens
atttttctcttgtac

SEQ ID NO: 4376939 - DNA, 16 bp, Homo sapiens
atttttctgactttta

SEQ ID NO: 4376940 - DNA, 15 bp, Homo sapiens
atttttctttaactg

SEQ ID NO: 4376941 - DNA, 16 bp, Homo sapiens
atttttctttaactgc

SEQ ID NO: 4376942 - DNA, 14 bp, Homo sapiens
atttttctttccaa

SEQ ID NO: 4376943 - DNA, 20 bp, Homo sapiens
atttttcttttaaagatttg

SEQ ID NO: 4376944 - DNA, 20 bp, Homo sapiens
atttttcttttattcttctt

SEQ ID NO: 4376945 - DNA, 20 bp, Homo sapiens
atttttgactgtagccacag

SEQ ID NO: 4376946 - DNA, 19 bp, Homo sapiens
atttttgcaataatgcagt

SEQ ID NO: 4376947 - DNA, 18 bp, Homo sapiens
atttttggtcattgtaat

SEQ ID NO: 4376948 - DNA, 15 bp, Homo sapiens
atttttgtaatgctg

SEQ ID NO: 4376949 - DNA, 20 bp, Homo sapiens
atttttgtacgttatatatt

SEQ ID NO: 4376950 - DNA, 22 bp, Homo sapiens
atttttgtacgttatatattgt

SEQ ID NO: 4376951 - DNA, 17 bp, Homo sapiens
atttttgttagcaaaga

SEQ ID NO: 4376952 - DNA, 23 bp, Homo sapiens
atttttgttcttatggggtgaga

SEQ ID NO: 4376953 - DNA, 21 bp, Homo sapiens
atttttgttttcattatctca

SEQ ID NO: 4376954 - DNA, 20 bp, Homo sapiens
atttttgttttccactgtgc

SEQ ID NO: 4376955 - DNA, 14 bp, Homo sapiens
atttttgttttgaa

SEQ ID NO: 4376956 - DNA, 16 bp, Homo sapiens
atttttgttttgaaag

SEQ ID NO: 4376957 - DNA, 20 bp, Homo sapiens
attttttaaaaaaacaaatg

SEQ ID NO: 4376958 - DNA, 16 bp, Homo sapiens
attttttaaaaagtgt

SEQ ID NO: 4376959 - DNA, 22 bp, Homo sapiens
attttttaaaaagtgttttgaa

SEQ ID NO: 4376960 - DNA, 23 bp, Homo sapiens
attttttaaaacaagccaagaaa

SEQ ID NO: 4376961 - DNA, 15 bp, Homo sapiens
attttttaaaagaga

SEQ ID NO: 4376962 - DNA, 21 bp, Homo sapiens
attttttaaaagagacaaact

SEQ ID NO: 4376963 - DNA, 21 bp, Homo sapiens
attttttaaaattttggaata

SEQ ID NO: 4376964 - DNA, 14 bp, Homo sapiens
attttttaataatt

SEQ ID NO: 4376965 - DNA, 23 bp, Homo sapiens
attttttacttgaatcagatggt

SEQ ID NO: 4376966 - DNA, 21 bp, Homo sapiens
attttttatcatgcatgtcct

SEQ ID NO: 4376967 - DNA, 19 bp, Homo sapiens
attttttatgtacaaccct

SEQ ID NO: 4376968 - DNA, 13 bp, Homo sapiens
attttttatttct

SEQ ID NO: 4376969 - DNA, 13 bp, Homo sapiens
attttttcatttc

SEQ ID NO: 4376970 - DNA, 14 bp, Homo sapiens
attttttcatttca

SEQ ID NO: 4376971 - DNA, 21 bp, Homo sapiens
attttttcatttcaaaatgct

SEQ ID NO: 4376972 - DNA, 21 bp, Homo sapiens
attttttctaaaacattcccc

SEQ ID NO: 4376973 - DNA, 13 bp, Homo sapiens
attttttgaaagt

SEQ ID NO: 4376974 - DNA, 16 bp, Homo sapiens
attttttgtataattg

SEQ ID NO: 4376975 - DNA, 12 bp, Homo sapiens
attttttgttga

SEQ ID NO: 4376976 - DNA, 15 bp, Homo sapiens
attttttgttgaata

SEQ ID NO: 4376977 - DNA, 20 bp, Homo sapiens
attttttgttgaataggaaa

SEQ ID NO: 4376978 - DNA, 18 bp, Homo sapiens
atttttttaaaatcacta

SEQ ID NO: 4376979 - DNA, 21 bp, Homo sapiens
atttttttaaacaaaatttca

SEQ ID NO: 4376980 - DNA, 15 bp, Homo sapiens
atttttttaacttta

SEQ ID NO: 4376981 - DNA, 14 bp, Homo sapiens
atttttttagtttg

SEQ ID NO: 4376982 - DNA, 13 bp, Homo sapiens
atttttttcctaa

SEQ ID NO: 4376983 - DNA, 18 bp, Homo sapiens
atttttttcctaagacat

SEQ ID NO: 4376984 - DNA, 20 bp, Homo sapiens
atttttttcctaagacattt

SEQ ID NO: 4376985 - DNA, 16 bp, Homo sapiens
atttttttctacctat

SEQ ID NO: 4376986 - DNA, 15 bp, Homo sapiens
atttttttctttact

SEQ ID NO: 4376987 - DNA, 20 bp, Homo sapiens
atttttttctttacttatct

SEQ ID NO: 4376988 - DNA, 13 bp, Homo sapiens
atttttttgtaat

SEQ ID NO: 4376989 - DNA, 14 bp, Homo sapiens
attttttttatatt

SEQ ID NO: 4376990 - DNA, 17 bp, Homo sapiens
attttttttatatttat

SEQ ID NO: 4376991 - DNA, 19 bp, Homo sapiens
attttttttccttgcctgt

SEQ ID NO: 4376992 - DNA, 15 bp, Homo sapiens
attttttttgtaact

SEQ ID NO: 4376993 - DNA, 15 bp, Homo sapiens
attttttttgtttca

SEQ ID NO: 4376994 - DNA, 21 bp, Homo sapiens
atttttttttcatacacttat

SEQ ID NO: 4376995 - DNA, 19 bp, Homo sapiens
atttttttttctaagagaa

SEQ ID NO: 4376996 - DNA, 16 bp, Homo sapiens
attttttttttaagtg

SEQ ID NO: 4376997 - DNA, 22 bp, Homo sapiens
caaaaaaaaaaaaaagcatcta

SEQ ID NO: 4376998 - DNA, 15 bp, Homo sapiens
caaaaaaaaaaagat

SEQ ID NO: 4376999 - DNA, 14 bp, Homo sapiens
caaaaaaaaataca

SEQ ID NO: 4377000 - DNA, 19 bp, Homo sapiens
caaaaaactctctcccagg

SEQ ID NO: 4377001 - DNA, 20 bp, Homo sapiens
caaaaaactctctcccagga

SEQ ID NO: 4377002 - DNA, 22 bp, Homo sapiens
caaaaaaggtttcccaaaacaa

SEQ ID NO: 4377003 - DNA, 17 bp, Homo sapiens
caaaaaagtccaatttt

SEQ ID NO: 4377004 - DNA, 22 bp, Homo sapiens
caaaaaagtccaattttaattt

SEQ ID NO: 4377005 - DNA, 14 bp, Homo sapiens
caaaaacaaaaaga

SEQ ID NO: 4377006 - DNA, 15 bp, Homo sapiens
caaaaacaaagctga

SEQ ID NO: 4377007 - DNA, 16 bp, Homo sapiens
caaaaacaaagctgat

SEQ ID NO: 4377008 - DNA, 15 bp, Homo sapiens
caaaaacagcctcac

SEQ ID NO: 4377009 - DNA, 19 bp, Homo sapiens
caaaaacatacttcaaaaa

SEQ ID NO: 4377010 - DNA, 22 bp, Homo sapiens
caaaaacatacttcaaaaatgt

SEQ ID NO: 4377011 - DNA, 13 bp, Homo sapiens
caaaaacatttga

SEQ ID NO: 4377012 - DNA, 24 bp, Homo sapiens
caaaaaccaaacacccagaggtct

SEQ ID NO: 4377013 - DNA, 13 bp, Homo sapiens
caaaaaccatgtt

SEQ ID NO: 4377014 - DNA, 19 bp, Homo sapiens
caaaaaccatgttgcgttc

SEQ ID NO: 4377015 - DNA, 20 bp, Homo sapiens
caaaaagaaaagaaaatttt

SEQ ID NO: 4377016 - DNA, 17 bp, Homo sapiens
caaaaagaaccacttgt

SEQ ID NO: 4377017 - DNA, 14 bp, Homo sapiens
caaaaagctctgaa

SEQ ID NO: 4377018 - DNA, 21 bp, Homo sapiens
caaaaaggcaaatattgaagt

SEQ ID NO: 4377019 - DNA, 23 bp, Homo sapiens
caaaaaggcaaatattgaagttg

SEQ ID NO: 4377020 - DNA, 21 bp, Homo sapiens
caaaaagtggggcagagcctc

SEQ ID NO: 4377021 - DNA, 16 bp, Homo sapiens
caaaaataatcatgaa

SEQ ID NO: 4377022 - DNA, 19 bp, Homo sapiens
caaaaatcccaccttccca

SEQ ID NO: 4377023 - DNA, 15 bp, Homo sapiens
caaaaatgacccaag

SEQ ID NO: 4377024 - DNA, 18 bp, Homo sapiens
caaaaatgccacttaaca

SEQ ID NO: 4377025 - DNA, 21 bp, Homo sapiens
caaaaatgttcccttgaccat

SEQ ID NO: 4377026 - DNA, 18 bp, Homo sapiens
caaaaattaaatatatat

SEQ ID NO: 4377027 - DNA, 23 bp, Homo sapiens
caaaaatttattatatatttaca

SEQ ID NO: 4377028 - DNA, 22 bp, Homo sapiens
caaaaatttctgtaaaacaggt

SEQ ID NO: 4377029 - DNA, 16 bp, Homo sapiens
caaaaattttgaatgt

SEQ ID NO: 4377030 - DNA, 13 bp, Homo sapiens
caaaacaaaacaa

SEQ ID NO: 4377031 - DNA, 15 bp, Homo sapiens
caaaacaaaacaaaa

SEQ ID NO: 4377032 - DNA, 16 bp, Homo sapiens
caaaacaatctattta

SEQ ID NO: 4377033 - DNA, 17 bp, Homo sapiens
caaaacaatctatttaa

SEQ ID NO: 4377034 - DNA, 18 bp, Homo sapiens
caaaacaatctatttaaa

SEQ ID NO: 4377035 - DNA, 16 bp, Homo sapiens
caaaacaatgtttaaa

SEQ ID NO: 4377036 - DNA, 18 bp, Homo sapiens
caaaacaatgtttaaacc

SEQ ID NO: 4377037 - DNA, 14 bp, Homo sapiens
caaaacccatatcc

SEQ ID NO: 4377038 - DNA, 19 bp, Homo sapiens
caaaactatacttgaacaa

SEQ ID NO: 4377039 - DNA, 23 bp, Homo sapiens
caaaactatacttgaacaaaagg

SEQ ID NO: 4377040 - DNA, 14 bp, Homo sapiens
caaaactccgtctc

SEQ ID NO: 4377041 - DNA, 21 bp, Homo sapiens
caaaactccgtctcaaaaaaa

SEQ ID NO: 4377042 - DNA, 23 bp, Homo sapiens
caaaactttatcagggaaactaa

SEQ ID NO: 4377043 - DNA, 22 bp, Homo sapiens
caaaactttttgaccagtttct

SEQ ID NO: 4377044 - DNA, 23 bp, Homo sapiens
caaaactttttgaccagtttctt

SEQ ID NO: 4377045 - DNA, 11 bp, Homo sapiens
caaaagaaaat

SEQ ID NO: 4377046 - DNA, 16 bp, Homo sapiens
caaaagaaaattgata

SEQ ID NO: 4377047 - DNA, 14 bp, Homo sapiens
caaaagaagaagtt

SEQ ID NO: 4377048 - DNA, 14 bp, Homo sapiens
caaaagaataagac

SEQ ID NO: 4377049 - DNA, 17 bp, Homo sapiens
caaaagaccaaatctca

SEQ ID NO: 4377050 - DNA, 19 bp, Homo sapiens
caaaagaccaaatctcagt

SEQ ID NO: 4377051 - DNA, 21 bp, Homo sapiens
caaaagatccttcattttaga

SEQ ID NO: 4377052 - DNA, 22 bp, Homo sapiens
caaaagattgctgaaattttat

SEQ ID NO: 4377053 - DNA, 11 bp, Homo sapiens
caaaagcaaac

SEQ ID NO: 4377054 - DNA, 20 bp, Homo sapiens
caaaagcaagggaccttcat

SEQ ID NO: 4377055 - DNA, 16 bp, Homo sapiens
caaaagcacatgtatt

SEQ ID NO: 4377056 - DNA, 18 bp, Homo sapiens
caaaagcttacaaatact

SEQ ID NO: 4377057 - DNA, 14 bp, Homo sapiens
caaaaggaaaaagc

SEQ ID NO: 4377058 - DNA, 15 bp, Homo sapiens
caaaaggaaaaagct

SEQ ID NO: 4377059 - DNA, 20 bp, Homo sapiens
caaaaggaaagctgtgttta

SEQ ID NO: 4377060 - DNA, 21 bp, Homo sapiens
caaaaggaggaatttcagtgg

SEQ ID NO: 4377061 - DNA, 13 bp, Homo sapiens
caaaagggtcaga

SEQ ID NO: 4377062 - DNA, 16 bp, Homo sapiens
caaaagggtcagagga

SEQ ID NO: 4377063 - DNA, 18 bp, Homo sapiens
caaaagggttcatagaaa

SEQ ID NO: 4377064 - DNA, 13 bp, Homo sapiens
caaaaggtgcctg

SEQ ID NO: 4377065 - DNA, 16 bp, Homo sapiens
caaaagtccctccctg

SEQ ID NO: 4377066 - DNA, 20 bp, Homo sapiens
caaaagtggggctaaatgaa

SEQ ID NO: 4377067 - DNA, 21 bp, Homo sapiens
caaaagtggggctaaatgaag

SEQ ID NO: 4377068 - DNA, 22 bp, Homo sapiens
caaaagtggggctaaatgaagt

SEQ ID NO: 4377069 - DNA, 16 bp, Homo sapiens
caaaatacacgtttat

SEQ ID NO: 4377070 - DNA, 14 bp, Homo sapiens
caaaatacttcttt

SEQ ID NO: 4377071 - DNA, 13 bp, Homo sapiens
caaaatagggact

SEQ ID NO: 4377072 - DNA, 14 bp, Homo sapiens
caaaatatacaaaa

SEQ ID NO: 4377073 - DNA, 15 bp, Homo sapiens
caaaatatatacaca

SEQ ID NO: 4377074 - DNA, 16 bp, Homo sapiens
caaaatatgtttaaaa

SEQ ID NO: 4377075 - DNA, 18 bp, Homo sapiens
caaaatatttaaaaatgt

SEQ ID NO: 4377076 - DNA, 20 bp, Homo sapiens
caaaatatttaaaaatgtct

SEQ ID NO: 4377077 - DNA, 21 bp, Homo sapiens
caaaatatttaaaaatgtctt

SEQ ID NO: 4377078 - DNA, 16 bp, Homo sapiens
caaaatatttaagtga

SEQ ID NO: 4377079 - DNA, 14 bp, Homo sapiens
caaaatcaacatga

SEQ ID NO: 4377080 - DNA, 15 bp, Homo sapiens
caaaatcaacatgac

SEQ ID NO: 4377081 - DNA, 18 bp, Homo sapiens
caaaatccattccaggta

SEQ ID NO: 4377082 - DNA, 20 bp, Homo sapiens
caaaatcctgaactttctcc

SEQ ID NO: 4377083 - DNA, 19 bp, Homo sapiens
caaaatctaaaatgtttta

SEQ ID NO: 4377084 - DNA, 22 bp, Homo sapiens
caaaatctaaaatgttttatga

SEQ ID NO: 4377085 - DNA, 11 bp, Homo sapiens
caaaatgaaag

SEQ ID NO: 4377086 - DNA, 19 bp, Homo sapiens
caaaatgaatttttattga

SEQ ID NO: 4377087 - DNA, 16 bp, Homo sapiens
caaaatgacatctttt

SEQ ID NO: 4377088 - DNA, 23 bp, Homo sapiens
caaaatgacatctttttaaagct

SEQ ID NO: 4377089 - DNA, 15 bp, Homo sapiens
caaaatgcacttcta

SEQ ID NO: 4377090 - DNA, 18 bp, Homo sapiens
caaaatgcacttctattt

SEQ ID NO: 4377091 - DNA, 23 bp, Homo sapiens
caaaatgctttttatttctgcat

SEQ ID NO: 4377092 - DNA, 18 bp, Homo sapiens
caaaatggggcagaagag

SEQ ID NO: 4377093 - DNA, 16 bp, Homo sapiens
caaaatgtacttaaat

SEQ ID NO: 4377094 - DNA, 17 bp, Homo sapiens
caaaatgtacttaaatg

SEQ ID NO: 4377095 - DNA, 20 bp, Homo sapiens
caaaatgtgtttcagccgta

SEQ ID NO: 4377096 - DNA, 21 bp, Homo sapiens
caaaatgttggtcattttatg

SEQ ID NO: 4377097 - DNA, 23 bp, Homo sapiens
caaaattagatcctaagatgtgt

SEQ ID NO: 4377098 - DNA, 22 bp, Homo sapiens
caaaattgcaaatcttgaaatt

SEQ ID NO: 4377099 - DNA, 20 bp, Homo sapiens
caaaattgtctaaaatgtca

SEQ ID NO: 4377100 - DNA, 13 bp, Homo sapiens
caaaatttattct

SEQ ID NO: 4377101 - DNA, 18 bp, Homo sapiens
caaaatttcacagttctg

SEQ ID NO: 4377102 - DNA, 14 bp, Homo sapiens
caaaatttctatta

SEQ ID NO: 4377103 - DNA, 14 bp, Homo sapiens
caaaatttgactaa

SEQ ID NO: 4377104 - DNA, 12 bp, Homo sapiens
caaaattttaac

SEQ ID NO: 4377105 - DNA, 15 bp, Homo sapiens
caaacaaaatttcta

SEQ ID NO: 4377106 - DNA, 21 bp, Homo sapiens
caaacaatctcttaaattggg

SEQ ID NO: 4377107 - DNA, 21 bp, Homo sapiens
caaacacattataaagttcag

SEQ ID NO: 4377108 - DNA, 18 bp, Homo sapiens
caaacagccaagattttc

SEQ ID NO: 4377109 - DNA, 15 bp, Homo sapiens
caaacaggacagcac

SEQ ID NO: 4377110 - DNA, 14 bp, Homo sapiens
caaacaggctcaga

SEQ ID NO: 4377111 - DNA, 14 bp, Homo sapiens
caaacagggcctct

SEQ ID NO: 4377112 - DNA, 11 bp, Homo sapiens
caaacatgaaa

SEQ ID NO: 4377113 - DNA, 13 bp, Homo sapiens
caaacatgaaaaa

SEQ ID NO: 4377114 - DNA, 19 bp, Homo sapiens
caaacattcgtgagctggg

SEQ ID NO: 4377115 - DNA, 15 bp, Homo sapiens
caaaccaagggtaca

SEQ ID NO: 4377116 - DNA, 22 bp, Homo sapiens
caaaccaccaggactgaaagaa

SEQ ID NO: 4377117 - DNA, 17 bp, Homo sapiens
caaaccacgcctcttga

SEQ ID NO: 4377118 - DNA, 19 bp, Homo sapiens
caaaccacgcctcttgacc

SEQ ID NO: 4377119 - DNA, 16 bp, Homo sapiens
caaaccagcagggagt

SEQ ID NO: 4377120 - DNA, 23 bp, Homo sapiens
caaaccattgctcttagtcccaa

SEQ ID NO: 4377121 - DNA, 12 bp, Homo sapiens
caaacccaggct

SEQ ID NO: 4377122 - DNA, 12 bp, Homo sapiens
caaaccccagcc

SEQ ID NO: 4377123 - DNA, 22 bp, Homo sapiens
caaacccttgctttcctgggcc

SEQ ID NO: 4377124 - DNA, 20 bp, Homo sapiens
caaacctgacccctgctcag

SEQ ID NO: 4377125 - DNA, 20 bp, Homo sapiens
caaacctttattttagaatt

SEQ ID NO: 4377126 - DNA, 21 bp, Homo sapiens
caaacctttcccccttagcac

SEQ ID NO: 4377127 - DNA, 20 bp, Homo sapiens
caaacgctgagccacctgcc

SEQ ID NO: 4377128 - DNA, 16 bp, Homo sapiens
caaacgtaatttgtta

SEQ ID NO: 4377129 - DNA, 22 bp, Homo sapiens
caaacgttggagtttgggctgg

SEQ ID NO: 4377130 - DNA, 15 bp, Homo sapiens
caaacgtttgacaaa

SEQ ID NO: 4377131 - DNA, 21 bp, Homo sapiens
caaactactgaatgaagcagt

SEQ ID NO: 4377132 - DNA, 14 bp, Homo sapiens
caaactaggagatg

SEQ ID NO: 4377133 - DNA, 19 bp, Homo sapiens
caaactagggccaagccca

SEQ ID NO: 4377134 - DNA, 18 bp, Homo sapiens
caaactcattgcagcaga

SEQ ID NO: 4377135 - DNA, 20 bp, Homo sapiens
caaactcattgcagcagata

SEQ ID NO: 4377136 - DNA, 11 bp, Homo sapiens
caaactcccta

SEQ ID NO: 4377137 - DNA, 15 bp, Homo sapiens
caaactgctttattt

SEQ ID NO: 4377138 - DNA, 12 bp, Homo sapiens
caaactgtaaat

SEQ ID NO: 4377139 - DNA, 20 bp, Homo sapiens
caaactgtaaataaaaagaa

SEQ ID NO: 4377140 - DNA, 16 bp, Homo sapiens
caaacttgtggcctca

SEQ ID NO: 4377141 - DNA, 18 bp, Homo sapiens
caaacttgtggcctcaag

SEQ ID NO: 4377142 - DNA, 13 bp, Homo sapiens
caaactttgtttt

SEQ ID NO: 4377143 - DNA, 16 bp, Homo sapiens
caaacttttaagattt

SEQ ID NO: 4377144 - DNA, 15 bp, Homo sapiens
caaacttttgaaaga

SEQ ID NO: 4377145 - DNA, 21 bp, Homo sapiens
caaagaaaaaaaaaaaagcca

SEQ ID NO: 4377146 - DNA, 14 bp, Homo sapiens
caaagaaaaattaa

SEQ ID NO: 4377147 - DNA, 13 bp, Homo sapiens
caaagaaaggaga

SEQ ID NO: 4377148 - DNA, 13 bp, Homo sapiens
caaagaaagtgta

SEQ ID NO: 4377149 - DNA, 16 bp, Homo sapiens
caaagaaagtgtattg

SEQ ID NO: 4377150 - DNA, 23 bp, Homo sapiens
caaagaaatccccccttcagaac

SEQ ID NO: 4377151 - DNA, 13 bp, Homo sapiens
caaagaaatgaac

SEQ ID NO: 4377152 - DNA, 14 bp, Homo sapiens
caaagaaatgaaca

SEQ ID NO: 4377153 - DNA, 15 bp, Homo sapiens
caaagaaatgaacat

SEQ ID NO: 4377154 - DNA, 14 bp, Homo sapiens
caaagaaatgtaag

SEQ ID NO: 4377155 - DNA, 11 bp, Homo sapiens
caaagaagctt

SEQ ID NO: 4377156 - DNA, 22 bp, Homo sapiens
caaatgaatgattaaattatga

SEQ ID NO: 4377157 - DNA, 19 bp, Homo sapiens
caaatgaatttcatgtgaa

SEQ ID NO: 4377158 - DNA, 21 bp, Homo sapiens
caaatgcaaaaactctttgag

SEQ ID NO: 4377159 - DNA, 15 bp, Homo sapiens
caaatgcagggaggg

SEQ ID NO: 4377160 - DNA, 17 bp, Homo sapiens
caaatgcataaatgcat

SEQ ID NO: 4377161 - DNA, 20 bp, Homo sapiens
caaatggactgttacagact

SEQ ID NO: 4377162 - DNA, 19 bp, Homo sapiens
caaatggcgtctggaagtc

SEQ ID NO: 4377163 - DNA, 17 bp, Homo sapiens
caaatgggcattttaca

SEQ ID NO: 4377164 - DNA, 19 bp, Homo sapiens
caaatgggcattttacaag

SEQ ID NO: 4377165 - DNA, 20 bp, Homo sapiens
caaatgtaatagtttatctt

SEQ ID NO: 4377166 - DNA, 21 bp, Homo sapiens
caaatgtaatagtttatctta

SEQ ID NO: 4377167 - DNA, 18 bp, Homo sapiens
caaatgtagttttgtata

SEQ ID NO: 4377168 - DNA, 15 bp, Homo sapiens
caaatgtcattgtct

SEQ ID NO: 4377169 - DNA, 19 bp, Homo sapiens
caaatgtcctccagaagcc

SEQ ID NO: 4377170 - DNA, 20 bp, Homo sapiens
caaatgtcctttctcagagg

SEQ ID NO: 4377171 - DNA, 20 bp, Homo sapiens
caaatgtgcaatttgtaaat

SEQ ID NO: 4377172 - DNA, 24 bp, Homo sapiens
caaatgtgcaatttgtaaatattg

SEQ ID NO: 4377173 - DNA, 18 bp, Homo sapiens
caaatgttcatcaatgaa

SEQ ID NO: 4377174 - DNA, 11 bp, Homo sapiens
caaatgtttac

SEQ ID NO: 4377175 - DNA, 13 bp, Homo sapiens
caaattaaaaaaa

SEQ ID NO: 4377176 - DNA, 19 bp, Homo sapiens
caaattaaaaaaaaattgt

SEQ ID NO: 4377177 - DNA, 15 bp, Homo sapiens
caaattactaatgat

SEQ ID NO: 4377178 - DNA, 23 bp, Homo sapiens
caaattagaaacaccattcatct

SEQ ID NO: 4377179 - DNA, 14 bp, Homo sapiens
caaattagggcaat

SEQ ID NO: 4377180 - DNA, 15 bp, Homo sapiens
caaattagggcaatt

SEQ ID NO: 4377181 - DNA, 12 bp, Homo sapiens
caaattcagaac

SEQ ID NO: 4377182 - DNA, 13 bp, Homo sapiens
caaattcagctct

SEQ ID NO: 4377183 - DNA, 14 bp, Homo sapiens
caaattcagctctg

SEQ ID NO: 4377184 - DNA, 22 bp, Homo sapiens
caaattcagctctgatctgagg

SEQ ID NO: 4377185 - DNA, 18 bp, Homo sapiens
caaattcagtttcataaa

SEQ ID NO: 4377186 - DNA, 14 bp, Homo sapiens
caaattcttttgaa

SEQ ID NO: 4377187 - DNA, 16 bp, Homo sapiens
caaattcttttgaatt

SEQ ID NO: 4377188 - DNA, 23 bp, Homo sapiens
caaattgagtttaacaataataa

SEQ ID NO: 4377189 - DNA, 12 bp, Homo sapiens
caaattgctgct

SEQ ID NO: 4377190 - DNA, 12 bp, Homo sapiens
caaattgtgaaa

SEQ ID NO: 4377191 - DNA, 18 bp, Homo sapiens
caaattgtgcttctcccc

SEQ ID NO: 4377192 - DNA, 19 bp, Homo sapiens
caaattgtgcttctcccca

SEQ ID NO: 4377193 - DNA, 23 bp, Homo sapiens
caaattgtgcttctccccagaat

SEQ ID NO: 4377194 - DNA, 10 bp, Homo sapiens
caaatttagt

SEQ ID NO: 4377195 - DNA, 16 bp, Homo sapiens
caaatttagtttgtta

SEQ ID NO: 4377196 - DNA, 18 bp, Homo sapiens
caaatttagtttgttaaa

SEQ ID NO: 4377197 - DNA, 19 bp, Homo sapiens
caaatttagtttgttaaag

SEQ ID NO: 4377198 - DNA, 13 bp, Homo sapiens
caaatttcatttc

SEQ ID NO: 4377199 - DNA, 17 bp, Homo sapiens
caaatttctataaattt

SEQ ID NO: 4377200 - DNA, 17 bp, Homo sapiens
caaatttgtaataaaac

SEQ ID NO: 4377201 - DNA, 17 bp, Homo sapiens
caaattttaatttttgc

SEQ ID NO: 4377202 - DNA, 13 bp, Homo sapiens
caaattttctggt

SEQ ID NO: 4377203 - DNA, 21 bp, Homo sapiens
caaattttggcgaatctcaaa

SEQ ID NO: 4377204 - DNA, 21 bp, Homo sapiens
caaattttgtaccaagtaaat

SEQ ID NO: 4377205 - DNA, 19 bp, Homo sapiens
caaattttttaaaagagac

SEQ ID NO: 4377206 - DNA, 23 bp, Homo sapiens
caaattttttgactttttttgta

SEQ ID NO: 4377207 - DNA, 19 bp, Homo sapiens
caacaaaatcatggcttag

SEQ ID NO: 4377208 - DNA, 17 bp, Homo sapiens
caacaaagtcacagtcg

SEQ ID NO: 4377209 - DNA, 15 bp, Homo sapiens
caacaaagtgctttt

SEQ ID NO: 4377210 - DNA, 18 bp, Homo sapiens
caacaaagtgctttttca

SEQ ID NO: 4377211 - DNA, 20 bp, Homo sapiens
caacaaagttccacttccag

SEQ ID NO: 4377212 - DNA, 16 bp, Homo sapiens
caacaacaattggtaa

SEQ ID NO: 4377213 - DNA, 15 bp, Homo sapiens
caacaagaaactgtc

SEQ ID NO: 4377214 - DNA, 13 bp, Homo sapiens
caacaagatttcc

SEQ ID NO: 4377215 - DNA, 21 bp, Homo sapiens
caacaagatttccttgtgcaa

SEQ ID NO: 4377216 - DNA, 16 bp, Homo sapiens
caacaagctcatccct

SEQ ID NO: 4377217 - DNA, 20 bp, Homo sapiens
caacaaggtggtgtgatctt

SEQ ID NO: 4377218 - DNA, 13 bp, Homo sapiens
caacaagttgcct

SEQ ID NO: 4377219 - DNA, 15 bp, Homo sapiens
caacaataaaatttt

SEQ ID NO: 4377220 - DNA, 16 bp, Homo sapiens
caacaataaaattttt

SEQ ID NO: 4377221 - DNA, 14 bp, Homo sapiens
caacaattggtaaa

SEQ ID NO: 4377222 - DNA, 15 bp, Homo sapiens
caacaattggtaaaa

SEQ ID NO: 4377223 - DNA, 18 bp, Homo sapiens
caacaattggtaaaactc

SEQ ID NO: 4377224 - DNA, 19 bp, Homo sapiens
caacaattggtaaaactca

SEQ ID NO: 4377225 - DNA, 17 bp, Homo sapiens
caacaattggtgtcatt

SEQ ID NO: 4377226 - DNA, 20 bp, Homo sapiens
caacaattggtgtcattttc

SEQ ID NO: 4377227 - DNA, 14 bp, Homo sapiens
caacaatttatgaa

SEQ ID NO: 4377228 - DNA, 18 bp, Homo sapiens
caacaatttatgaattga

SEQ ID NO: 4377229 - DNA, 22 bp, Homo sapiens
caacacatcaggaaagagagca

SEQ ID NO: 4377230 - DNA, 13 bp, Homo sapiens
caacacattttta

SEQ ID NO: 4377231 - DNA, 22 bp, Homo sapiens
caacaccactaggaatcccaga

SEQ ID NO: 4377232 - DNA, 18 bp, Homo sapiens
caacacctcttggggagt

SEQ ID NO: 4377233 - DNA, 15 bp, Homo sapiens
caacacctgcctctg

SEQ ID NO: 4377234 - DNA, 13 bp, Homo sapiens
caacaccttcctc

SEQ ID NO: 4377235 - DNA, 20 bp, Homo sapiens
caacaccttcctcctgcaga

SEQ ID NO: 4377236 - DNA, 23 bp, Homo sapiens
caacacgagcaggctactgtcag

SEQ ID NO: 4377237 - DNA, 21 bp, Homo sapiens
caacactgatcccccagatgc

SEQ ID NO: 4377238 - DNA, 12 bp, Homo sapiens
caacactgccag

SEQ ID NO: 4377239 - DNA, 13 bp, Homo sapiens
caacactgccagc

SEQ ID NO: 4377240 - DNA, 18 bp, Homo sapiens
caacactggtctgctgtt

SEQ ID NO: 4377241 - DNA, 16 bp, Homo sapiens
caacagactctcacag

SEQ ID NO: 4377242 - DNA, 13 bp, Homo sapiens
caacagagcactt

SEQ ID NO: 4377243 - DNA, 15 bp, Homo sapiens
caacagagggagttt

SEQ ID NO: 4377244 - DNA, 15 bp, Homo sapiens
caacagcaaacaggt

SEQ ID NO: 4377245 - DNA, 17 bp, Homo sapiens
caacagcaaacaggtgc

SEQ ID NO: 4377246 - DNA, 17 bp, Homo sapiens
caacagcaaatcacgac

SEQ ID NO: 4377247 - DNA, 20 bp, Homo sapiens
caacagcacacaggcagcca

SEQ ID NO: 4377248 - DNA, 18 bp, Homo sapiens
caacagcacctccccgct

SEQ ID NO: 4377249 - DNA, 20 bp, Homo sapiens
caacagcacctccccgctgg

SEQ ID NO: 4377250 - DNA, 12 bp, Homo sapiens
caacagcacttt

SEQ ID NO: 4377251 - DNA, 18 bp, Homo sapiens
caacagctcgatccaaat

SEQ ID NO: 4377252 - DNA, 18 bp, Homo sapiens
caacagcttttcccagga

SEQ ID NO: 4377253 - DNA, 19 bp, Homo sapiens
caacagcttttcccaggag

SEQ ID NO: 4377254 - DNA, 18 bp, Homo sapiens
caacaggagggcagcccg

SEQ ID NO: 4377255 - DNA, 20 bp, Homo sapiens
caacagggccatgtgctgcc

SEQ ID NO: 4377256 - DNA, 17 bp, Homo sapiens
caacagtggggaagagt

SEQ ID NO: 4377257 - DNA, 20 bp, Homo sapiens
caacagttgtatgtttgctg

SEQ ID NO: 4377258 - DNA, 20 bp, Homo sapiens
caacagtttatttttattat

SEQ ID NO: 4377259 - DNA, 15 bp, Homo sapiens
caacatactgtaatc

SEQ ID NO: 4377260 - DNA, 20 bp, Homo sapiens
caacatagtgagacactgtc

SEQ ID NO: 4377261 - DNA, 20 bp, Homo sapiens
caacatcccattgccctggt

SEQ ID NO: 4377262 - DNA, 14 bp, Homo sapiens
caacatcgtggatg

SEQ ID NO: 4377263 - DNA, 21 bp, Homo sapiens
caacatgacatccagagatga

SEQ ID NO: 4377264 - DNA, 19 bp, Homo sapiens
caacatgaggccactggag

SEQ ID NO: 4377265 - DNA, 18 bp, Homo sapiens
caacattccagggatgag

SEQ ID NO: 4377266 - DNA, 16 bp, Homo sapiens
caacattggacagaaa

SEQ ID NO: 4377267 - DNA, 22 bp, Homo sapiens
caacatttctatagccaaaaat

SEQ ID NO: 4377268 - DNA, 16 bp, Homo sapiens
caacatttctcaataa

SEQ ID NO: 4377269 - DNA, 17 bp, Homo sapiens
caacatttctcaataat

SEQ ID NO: 4377270 - DNA, 21 bp, Homo sapiens
caaccacatttagaaatgttt

SEQ ID NO: 4377271 - DNA, 20 bp, Homo sapiens
caaccagaactttctgtcct

SEQ ID NO: 4377272 - DNA, 17 bp, Homo sapiens
caaccagatcaggagag

SEQ ID NO: 4377273 - DNA, 16 bp, Homo sapiens
caaccaggggaagggt

SEQ ID NO: 4377274 - DNA, 23 bp, Homo sapiens
caaccatcagaccaccagcaaat

SEQ ID NO: 4377275 - DNA, 14 bp, Homo sapiens
caaccattaaagtc

SEQ ID NO: 4377276 - DNA, 18 bp, Homo sapiens
caacccattcactacagg

SEQ ID NO: 4377277 - DNA, 12 bp, Homo sapiens
caacccccaccc

SEQ ID NO: 4377278 - DNA, 15 bp, Homo sapiens
caacccccatctccc

SEQ ID NO: 4377279 - DNA, 18 bp, Homo sapiens
caacccccatctccctag

SEQ ID NO: 4377280 - DNA, 16 bp, Homo sapiens
caaccccccagcactg

SEQ ID NO: 4377281 - DNA, 14 bp, Homo sapiens
caacccccctccca

SEQ ID NO: 4377282 - DNA, 16 bp, Homo sapiens
caacccccctcccaga

SEQ ID NO: 4377283 - DNA, 20 bp, Homo sapiens
caacccctcctccctcagac

SEQ ID NO: 4377284 - DNA, 23 bp, Homo sapiens
caacccctccttccccagaccca

SEQ ID NO: 4377285 - DNA, 20 bp, Homo sapiens
caacccgtctggcccaccag

SEQ ID NO: 4377286 - DNA, 12 bp, Homo sapiens
caaccctgaccg

SEQ ID NO: 4377287 - DNA, 11 bp, Homo sapiens
caaccctgtct

SEQ ID NO: 4377288 - DNA, 12 bp, Homo sapiens
caaccctgtctg

SEQ ID NO: 4377289 - DNA, 20 bp, Homo sapiens
caacccttaccccttagcct

SEQ ID NO: 4377290 - DNA, 22 bp, Homo sapiens
caaccgccacacacacaggagc

SEQ ID NO: 4377291 - DNA, 13 bp, Homo sapiens
caacctaaaactc

SEQ ID NO: 4377292 - DNA, 14 bp, Homo sapiens
caacctcaccctcc

SEQ ID NO: 4377293 - DNA, 15 bp, Homo sapiens
caacctcaccttcct

SEQ ID NO: 4377294 - DNA, 14 bp, Homo sapiens
caacctcaggctcc

SEQ ID NO: 4377295 - DNA, 15 bp, Homo sapiens
caacctcaggctcct

SEQ ID NO: 4377296 - DNA, 20 bp, Homo sapiens
caacctccaactccctggtt

SEQ ID NO: 4377297 - DNA, 20 bp, Homo sapiens
caacctccgcctcccaggtt

SEQ ID NO: 4377298 - DNA, 15 bp, Homo sapiens
caacctctgcctccc

SEQ ID NO: 4377299 - DNA, 20 bp, Homo sapiens
caacctctgcctcccaggtt

SEQ ID NO: 4377300 - DNA, 18 bp, Homo sapiens
caacctgcggaaggaggt

SEQ ID NO: 4377301 - DNA, 17 bp, Homo sapiens
caacctgctctgtcccc

SEQ ID NO: 4377302 - DNA, 14 bp, Homo sapiens
caacctggtggcac

SEQ ID NO: 4377303 - DNA, 17 bp, Homo sapiens
caacctggtggcaccag

SEQ ID NO: 4377304 - DNA, 13 bp, Homo sapiens
caacctgtaaatt

SEQ ID NO: 4377305 - DNA, 21 bp, Homo sapiens
caacctgtaaattattttaaa

SEQ ID NO: 4377306 - DNA, 16 bp, Homo sapiens
caaccttaaaggccgt

SEQ ID NO: 4377307 - DNA, 19 bp, Homo sapiens
caaccttccaacttcctgt

SEQ ID NO: 4377308 - DNA, 20 bp, Homo sapiens
caacggaaagtgctgtctta

SEQ ID NO: 4377309 - DNA, 14 bp, Homo sapiens
caacggcagtgaag

SEQ ID NO: 4377310 - DNA, 21 bp, Homo sapiens
caacgggattgaagggtcctg

SEQ ID NO: 4377311 - DNA, 15 bp, Homo sapiens
caacggggggctcct

SEQ ID NO: 4377312 - DNA, 17 bp, Homo sapiens
caacggggggctcctgc

SEQ ID NO: 4377313 - DNA, 17 bp, Homo sapiens
caactaaataacacaga

SEQ ID NO: 4377314 - DNA, 16 bp, Homo sapiens
caactaacaatgcctt

SEQ ID NO: 4377315 - DNA, 19 bp, Homo sapiens
caactacagtctaaagctg

SEQ ID NO: 4377316 - DNA, 17 bp, Homo sapiens
caactacattttaaaaa

SEQ ID NO: 4377317 - DNA, 21 bp, Homo sapiens
caactactaatagaataaagg

SEQ ID NO: 4377318 - DNA, 13 bp, Homo sapiens
caactagctggga

SEQ ID NO: 4377319 - DNA, 15 bp, Homo sapiens
caactattcttcatt

SEQ ID NO: 4377320 - DNA, 13 bp, Homo sapiens
caactatttttgt

SEQ ID NO: 4377321 - DNA, 22 bp, Homo sapiens
caactcacattgttcaactccc

SEQ ID NO: 4377322 - DNA, 15 bp, Homo sapiens
caactccaggaaaga

SEQ ID NO: 4377323 - DNA, 22 bp, Homo sapiens
caactccatggggttcgagact

SEQ ID NO: 4377324 - DNA, 17 bp, Homo sapiens
caactcccacgactgtt

SEQ ID NO: 4377325 - DNA, 19 bp, Homo sapiens
caactccgcccagcctctc

SEQ ID NO: 4377326 - DNA, 12 bp, Homo sapiens
caactcctccca

SEQ ID NO: 4377327 - DNA, 13 bp, Homo sapiens
caactcctcccat

SEQ ID NO: 4377328 - DNA, 18 bp, Homo sapiens
caactcctttcagccaca

SEQ ID NO: 4377329 - DNA, 15 bp, Homo sapiens
caactctacccctgc

SEQ ID NO: 4377330 - DNA, 21 bp, Homo sapiens
caactctcccaaagggcacac

SEQ ID NO: 4377331 - DNA, 14 bp, Homo sapiens
caactctccccagt

SEQ ID NO: 4377332 - DNA, 18 bp, Homo sapiens
caactctccccagtgcct

SEQ ID NO: 4377333 - DNA, 23 bp, Homo sapiens
caactctccccagtgcctgccac

SEQ ID NO: 4377334 - DNA, 15 bp, Homo sapiens
caactctttgagaaa

SEQ ID NO: 4377335 - DNA, 16 bp, Homo sapiens
caactctttgagaaac

SEQ ID NO: 4377336 - DNA, 14 bp, Homo sapiens
caactctttgttat

SEQ ID NO: 4377337 - DNA, 18 bp, Homo sapiens
caactctttgttatttga

SEQ ID NO: 4377338 - DNA, 22 bp, Homo sapiens
caactgaaggctaaaaagcaac

SEQ ID NO: 4377339 - DNA, 17 bp, Homo sapiens
caactgacctgccagcc

SEQ ID NO: 4377340 - DNA, 18 bp, Homo sapiens
caactgccaggctgcctc

SEQ ID NO: 4377341 - DNA, 12 bp, Homo sapiens
caactgccccag

SEQ ID NO: 4377342 - DNA, 16 bp, Homo sapiens
caactgccccaggggg

SEQ ID NO: 4377343 - DNA, 14 bp, Homo sapiens
caactgcctactcc

SEQ ID NO: 4377344 - DNA, 21 bp, Homo sapiens
caactgcctcgaaacacagaa

SEQ ID NO: 4377345 - DNA, 16 bp, Homo sapiens
caactgctccagcctc

SEQ ID NO: 4377346 - DNA, 21 bp, Homo sapiens
caactgctccagcctctgccg

SEQ ID NO: 4377347 - DNA, 19 bp, Homo sapiens
caactggccctatttagat

SEQ ID NO: 4377348 - DNA, 15 bp, Homo sapiens
caactggctggccag

SEQ ID NO: 4377349 - DNA, 23 bp, Homo sapiens
caactgtctcgatgcaatgaaca

SEQ ID NO: 4377350 - DNA, 15 bp, Homo sapiens
caactgtcttcctca

SEQ ID NO: 4377351 - DNA, 16 bp, Homo sapiens
caactgtcttcctcaa

SEQ ID NO: 4377352 - DNA, 17 bp, Homo sapiens
caactgtggtagctcca

SEQ ID NO: 4377353 - DNA, 18 bp, Homo sapiens
caactgtggtagctccag

SEQ ID NO: 4377354 - DNA, 19 bp, Homo sapiens
caactgtggtagctccagc

SEQ ID NO: 4377355 - DNA, 18 bp, Homo sapiens
caactgttagctgggaag

SEQ ID NO: 4377356 - DNA, 16 bp, Homo sapiens
caactgtttgcactta

SEQ ID NO: 4377357 - DNA, 20 bp, Homo sapiens
caacttaagtatttacaggg

SEQ ID NO: 4377358 - DNA, 14 bp, Homo sapiens
caacttacaaaaac

SEQ ID NO: 4377359 - DNA, 18 bp, Homo sapiens
caacttagatctccagga

SEQ ID NO: 4377360 - DNA, 18 bp, Homo sapiens
caacttcaagtgcatgct

SEQ ID NO: 4377361 - DNA, 15 bp, Homo sapiens
caacttccgctgagg

SEQ ID NO: 4377362 - DNA, 18 bp, Homo sapiens
caacttcctgtggcctga

SEQ ID NO: 4377363 - DNA, 14 bp, Homo sapiens
caacttcgtttcct

SEQ ID NO: 4377364 - DNA, 14 bp, Homo sapiens
caacttgcttctaa

SEQ ID NO: 4377365 - DNA, 23 bp, Homo sapiens
caacttgcttctaaatgcccagt

SEQ ID NO: 4377366 - DNA, 18 bp, Homo sapiens
caacttgtagcagctata

SEQ ID NO: 4377367 - DNA, 23 bp, Homo sapiens
caacttgtgataggtacctgagt

SEQ ID NO: 4377368 - DNA, 24 bp, Homo sapiens
caactttcactataatgtgaaatg

SEQ ID NO: 4377369 - DNA, 20 bp, Homo sapiens
caactttcttatctggaaat

SEQ ID NO: 4377370 - DNA, 23 bp, Homo sapiens
caacttttcaatgtgattcttct

SEQ ID NO: 4377371 - DNA, 22 bp, Homo sapiens
caactttttaaagtaaattatt

SEQ ID NO: 4377372 - DNA, 18 bp, Homo sapiens
caactttttattgccttc

SEQ ID NO: 4377373 - DNA, 21 bp, Homo sapiens
caactttttattgccttctca

SEQ ID NO: 4377374 - DNA, 14 bp, Homo sapiens
caactttttttcct

SEQ ID NO: 4377375 - DNA, 23 bp, Homo sapiens
caactttttttttttttgagatg

SEQ ID NO: 4377376 - DNA, 23 bp, Homo sapiens
caagaaaagaacctaatagcacc

SEQ ID NO: 4377377 - DNA, 12 bp, Homo sapiens
caagaaaatcag

SEQ ID NO: 4377378 - DNA, 20 bp, Homo sapiens
caagaaggaaagatttgtga

SEQ ID NO: 4377379 - DNA, 16 bp, Homo sapiens
caagaaggcaaaaata

SEQ ID NO: 4377380 - DNA, 20 bp, Homo sapiens
caagaagttaaactattttg

SEQ ID NO: 4377381 - DNA, 17 bp, Homo sapiens
caagaataatcacgctt

SEQ ID NO: 4377382 - DNA, 20 bp, Homo sapiens
caagaataatcacgctttcc

SEQ ID NO: 4377383 - DNA, 22 bp, Homo sapiens
caagaataatcacgctttcctg

SEQ ID NO: 4377384 - DNA, 23 bp, Homo sapiens
caagaataatcacgctttcctga

SEQ ID NO: 4377385 - DNA, 14 bp, Homo sapiens
caagaatctagaag

SEQ ID NO: 4377386 - DNA, 16 bp, Homo sapiens
caagaatctagaagat

SEQ ID NO: 4377387 - DNA, 14 bp, Homo sapiens
caagaatgaaatga

SEQ ID NO: 4377388 - DNA, 15 bp, Homo sapiens
caagaatggtggctt

SEQ ID NO: 4377389 - DNA, 14 bp, Homo sapiens
caagacacagaata

SEQ ID NO: 4377390 - DNA, 12 bp, Homo sapiens
caagacacatcc

SEQ ID NO: 4377391 - DNA, 12 bp, Homo sapiens
caagacagatga

SEQ ID NO: 4377392 - DNA, 22 bp, Homo sapiens
caagctgttatttcttccctgc

SEQ ID NO: 4377393 - DNA, 23 bp, Homo sapiens
caagctgttatttcttccctgct

SEQ ID NO: 4377394 - DNA, 14 bp, Homo sapiens
caagctttaaatta

SEQ ID NO: 4377395 - DNA, 16 bp, Homo sapiens
caagctttaaattatg

SEQ ID NO: 4377396 - DNA, 15 bp, Homo sapiens
caaggaaaaacaggt

SEQ ID NO: 4377397 - DNA, 17 bp, Homo sapiens
caaggaaaaagaaaata

SEQ ID NO: 4377398 - DNA, 17 bp, Homo sapiens
caaggaaggaaagatgt

SEQ ID NO: 4377399 - DNA, 22 bp, Homo sapiens
caaggaagttttaactttaata

SEQ ID NO: 4377400 - DNA, 14 bp, Homo sapiens
caaggaataaatga

SEQ ID NO: 4377401 - DNA, 23 bp, Homo sapiens
caaggaatttcttaacttcttgc

SEQ ID NO: 4377402 - DNA, 16 bp, Homo sapiens
caaggacaggagcctg

SEQ ID NO: 4377403 - DNA, 18 bp, Homo sapiens
caaggacaggagcctggt

SEQ ID NO: 4377404 - DNA, 15 bp, Homo sapiens
caaggaccaggactc

SEQ ID NO: 4377405 - DNA, 20 bp, Homo sapiens
caaggaccaggactccctcc

SEQ ID NO: 4377406 - DNA, 15 bp, Homo sapiens
caaggacccaggcgc

SEQ ID NO: 4377407 - DNA, 18 bp, Homo sapiens
caaggacggaaaatgctt

SEQ ID NO: 4377408 - DNA, 15 bp, Homo sapiens
caaggactgagggac

SEQ ID NO: 4377409 - DNA, 22 bp, Homo sapiens
caaggactgagggactctgaag

SEQ ID NO: 4377410 - DNA, 18 bp, Homo sapiens
caaggactgtttcagtgt

SEQ ID NO: 4377411 - DNA, 19 bp, Homo sapiens
caaggactgtttcagtgtg

SEQ ID NO: 4377412 - DNA, 15 bp, Homo sapiens
caaggagaacaaata

SEQ ID NO: 4377413 - DNA, 18 bp, Homo sapiens
caaggagaacaaatattc

SEQ ID NO: 4377414 - DNA, 21 bp, Homo sapiens
caaggagaatatgataaaaca

SEQ ID NO: 4377415 - DNA, 16 bp, Homo sapiens
caaggagaggcaaaga

SEQ ID NO: 4377416 - DNA, 18 bp, Homo sapiens
caaggagaggcaaagaaa

SEQ ID NO: 4377417 - DNA, 19 bp, Homo sapiens
caaggaggaaatgtggaaa

SEQ ID NO: 4377418 - DNA, 22 bp, Homo sapiens
caaggaggcctggggaggccct

SEQ ID NO: 4377419 - DNA, 17 bp, Homo sapiens
caaggaggtctgtgcca

SEQ ID NO: 4377420 - DNA, 22 bp, Homo sapiens
caaggagtttaaatgagactag

SEQ ID NO: 4377421 - DNA, 17 bp, Homo sapiens
caaggagtttattacaa

SEQ ID NO: 4377422 - DNA, 17 bp, Homo sapiens
caaggatatcagagctg

SEQ ID NO: 4377423 - DNA, 12 bp, Homo sapiens
caaggcaagcat

SEQ ID NO: 4377424 - DNA, 18 bp, Homo sapiens
caaggcaagcatgaataa

SEQ ID NO: 4377425 - DNA, 18 bp, Homo sapiens
caaggccagagtggcctg

SEQ ID NO: 4377426 - DNA, 21 bp, Homo sapiens
caaggccagagtggcctggcc

SEQ ID NO: 4377427 - DNA, 19 bp, Homo sapiens
caaggcctaccccagttcc

SEQ ID NO: 4377428 - DNA, 21 bp, Homo sapiens
caaggcctaccccagttccta

SEQ ID NO: 4377429 - DNA, 24 bp, Homo sapiens
caaggcctaccccagttcctagca

SEQ ID NO: 4377430 - DNA, 21 bp, Homo sapiens
caaggccttcccctggcactg

SEQ ID NO: 4377431 - DNA, 15 bp, Homo sapiens
caaggcggtacacta

SEQ ID NO: 4377432 - DNA, 10 bp, Homo sapiens
caaggctcag

SEQ ID NO: 4377433 - DNA, 16 bp, Homo sapiens
caaggctcagaaggaa

SEQ ID NO: 4377434 - DNA, 15 bp, Homo sapiens
caaggctctcccctc

SEQ ID NO: 4377435 - DNA, 16 bp, Homo sapiens
caaggctctcccctct

SEQ ID NO: 4377436 - DNA, 16 bp, Homo sapiens
caagggaagagccttt

SEQ ID NO: 4377437 - DNA, 17 bp, Homo sapiens
caaggggtggccgggca

SEQ ID NO: 4377438 - DNA, 17 bp, Homo sapiens
caagggtctagggagag

SEQ ID NO: 4377439 - DNA, 21 bp, Homo sapiens
caagggtgatgggaaagcatt

SEQ ID NO: 4377440 - DNA, 23 bp, Homo sapiens
caagggtgatgggaaagcattgt

SEQ ID NO: 4377441 - DNA, 14 bp, Homo sapiens
caagggttttccag

SEQ ID NO: 4377442 - DNA, 16 bp, Homo sapiens
caagggttttccaggt

SEQ ID NO: 4377443 - DNA, 23 bp, Homo sapiens
caagggttttccaggtgtagcta

SEQ ID NO: 4377444 - DNA, 11 bp, Homo sapiens
caaggtaacaa

SEQ ID NO: 4377445 - DNA, 16 bp, Homo sapiens
caaggtactctggtga

SEQ ID NO: 4377446 - DNA, 9 bp, Homo sapiens
caaggtcag

SEQ ID NO: 4377447 - DNA, 24 bp, Homo sapiens
caaggtcagggagcaagaggtgtg

SEQ ID NO: 4377448 - DNA, 24 bp, Homo sapiens
caaggtcatagacaattcctccag

SEQ ID NO: 4377449 - DNA, 10 bp, Homo sapiens
caaggtcctg

SEQ ID NO: 4377450 - DNA, 18 bp, Homo sapiens
caaggtgatttcagactg

SEQ ID NO: 4377451 - DNA, 21 bp, Homo sapiens
caaggtgatttcagactgcag

SEQ ID NO: 4377452 - DNA, 13 bp, Homo sapiens
caaggtgctaaca

SEQ ID NO: 4377453 - DNA, 15 bp, Homo sapiens
caaggtgctgatgtc

SEQ ID NO: 4377454 - DNA, 21 bp, Homo sapiens
caaggtgctgatgtcaaagtg

SEQ ID NO: 4377455 - DNA, 14 bp, Homo sapiens
caaggtggcagatg

SEQ ID NO: 4377456 - DNA, 21 bp, Homo sapiens
caaggtggcagatgtcttccc

SEQ ID NO: 4377457 - DNA, 23 bp, Homo sapiens
caaggtggcagatgtcttccctg

SEQ ID NO: 4377458 - DNA, 18 bp, Homo sapiens
caaggtggtgtgatctta

SEQ ID NO: 4377459 - DNA, 17 bp, Homo sapiens
caaggtgtgctctgagc

SEQ ID NO: 4377460 - DNA, 23 bp, Homo sapiens
caaggttactcagcagcagagag

SEQ ID NO: 4377461 - DNA, 17 bp, Homo sapiens
caaggttataatttttt

SEQ ID NO: 4377462 - DNA, 14 bp, Homo sapiens
caaggttgcacagc

SEQ ID NO: 4377463 - DNA, 15 bp, Homo sapiens
caaggttgcacagca

SEQ ID NO: 4377464 - DNA, 17 bp, Homo sapiens
caaggttgcacagcaag

SEQ ID NO: 4377465 - DNA, 19 bp, Homo sapiens
caagtaacatgacttcctt

SEQ ID NO: 4377466 - DNA, 17 bp, Homo sapiens
caagtaagagtggtggc

SEQ ID NO: 4377467 - DNA, 11 bp, Homo sapiens
caagtaattgt

SEQ ID NO: 4377468 - DNA, 23 bp, Homo sapiens
caagtaatttcagtgtaaagtgt

SEQ ID NO: 4377469 - DNA, 14 bp, Homo sapiens
caagtaccaccaag

SEQ ID NO: 4377470 - DNA, 13 bp, Homo sapiens
caagtactgctgt

SEQ ID NO: 4377471 - DNA, 14 bp, Homo sapiens
caagtactgctgta

SEQ ID NO: 4377472 - DNA, 20 bp, Homo sapiens
caagtagctgggattacagg

SEQ ID NO: 4377473 - DNA, 20 bp, Homo sapiens
caagtatatttatttctagc

SEQ ID NO: 4377474 - DNA, 22 bp, Homo sapiens
caagtatgtgggcagattttca

SEQ ID NO: 4377475 - DNA, 23 bp, Homo sapiens
caagtattactaaattgaccttt

SEQ ID NO: 4377476 - DNA, 22 bp, Homo sapiens
caagtatttgggaagtgaagac

SEQ ID NO: 4377477 - DNA, 16 bp, Homo sapiens
caagtatttgttaatt

SEQ ID NO: 4377478 - DNA, 13 bp, Homo sapiens
caagtcagtttct

SEQ ID NO: 4377479 - DNA, 16 bp, Homo sapiens
caagtcagtttctaca

SEQ ID NO: 4377480 - DNA, 18 bp, Homo sapiens
caagtcatggtcacagta

SEQ ID NO: 4377481 - DNA, 12 bp, Homo sapiens
caagtcattttt

SEQ ID NO: 4377482 - DNA, 22 bp, Homo sapiens
caagtccagctgggaagccctt

SEQ ID NO: 4377483 - DNA, 15 bp, Homo sapiens
caagtcccaccctct

SEQ ID NO: 4377484 - DNA, 16 bp, Homo sapiens
caagtccgcagaagcc

SEQ ID NO: 4377485 - DNA, 15 bp, Homo sapiens
caagtctcagaagag

SEQ ID NO: 4377486 - DNA, 17 bp, Homo sapiens
caagtctgcacagagca

SEQ ID NO: 4377487 - DNA, 18 bp, Homo sapiens
caagtctggatctgggac

SEQ ID NO: 4377488 - DNA, 19 bp, Homo sapiens
caagtctggatctgggacc

SEQ ID NO: 4377489 - DNA, 14 bp, Homo sapiens
caagtctggcacca

SEQ ID NO: 4377490 - DNA, 23 bp, Homo sapiens
caagtctttcttcttttttaagt

SEQ ID NO: 4377491 - DNA, 17 bp, Homo sapiens
caagtgcatgctctctg

SEQ ID NO: 4377492 - DNA, 18 bp, Homo sapiens
caagtgccgcaaattgta

SEQ ID NO: 4377493 - DNA, 15 bp, Homo sapiens
caagtgcctagactg

SEQ ID NO: 4377494 - DNA, 14 bp, Homo sapiens
caagtgcgtgactg

SEQ ID NO: 4377495 - DNA, 19 bp, Homo sapiens
caagtgcttaaaaatactt

SEQ ID NO: 4377496 - DNA, 23 bp, Homo sapiens
caagtgcttaaaaatacttctat

SEQ ID NO: 4377497 - DNA, 19 bp, Homo sapiens
caagtgcttcctacaaaga

SEQ ID NO: 4377498 - DNA, 21 bp, Homo sapiens
caagtggggtgctgggaggag

SEQ ID NO: 4377499 - DNA, 23 bp, Homo sapiens
caagtgtaaaatattttgaatca

SEQ ID NO: 4377500 - DNA, 14 bp, Homo sapiens
caagtgtcttttaa

SEQ ID NO: 4377501 - DNA, 18 bp, Homo sapiens
caagtgtggggggtcctt

SEQ ID NO: 4377502 - DNA, 14 bp, Homo sapiens
caagtgttttgtat

SEQ ID NO: 4377503 - DNA, 16 bp, Homo sapiens
caagttagaaaacata

SEQ ID NO: 4377504 - DNA, 16 bp, Homo sapiens
caagttagttcaatct

SEQ ID NO: 4377505 - DNA, 18 bp, Homo sapiens
caagttccaagttgctaa

SEQ ID NO: 4377506 - DNA, 22 bp, Homo sapiens
caagttccattatgaaaatctt

SEQ ID NO: 4377507 - DNA, 17 bp, Homo sapiens
caagttccctggagaaa

SEQ ID NO: 4377508 - DNA, 15 bp, Homo sapiens
caagttcgtctgttg

SEQ ID NO: 4377509 - DNA, 16 bp, Homo sapiens
caagttcgtctgttgt

SEQ ID NO: 4377510 - DNA, 19 bp, Homo sapiens
caatgatcacatctaaagc

SEQ ID NO: 4377511 - DNA, 21 bp, Homo sapiens
caatgatgaatgagaatctac

SEQ ID NO: 4377512 - DNA, 22 bp, Homo sapiens
caatgattgttaatttacagct

SEQ ID NO: 4377513 - DNA, 17 bp, Homo sapiens
caatgcacttttatgaa

SEQ ID NO: 4377514 - DNA, 21 bp, Homo sapiens
caatgcacttttatgaagttt

SEQ ID NO: 4377515 - DNA, 15 bp, Homo sapiens
caatgccacagacaa

SEQ ID NO: 4377516 - DNA, 17 bp, Homo sapiens
caatgccacctagactc

SEQ ID NO: 4377517 - DNA, 21 bp, Homo sapiens
caatgccacctagactctccc

SEQ ID NO: 4377518 - DNA, 19 bp, Homo sapiens
caatgccgccgtgtttcct

SEQ ID NO: 4377519 - DNA, 20 bp, Homo sapiens
caatgcctattgtaatatag

SEQ ID NO: 4377520 - DNA, 15 bp, Homo sapiens
caatgcctttttaga

SEQ ID NO: 4377521 - DNA, 20 bp, Homo sapiens
caatgctcttttcacagcta

SEQ ID NO: 4377522 - DNA, 17 bp, Homo sapiens
caatggaagaaatggct

SEQ ID NO: 4377523 - DNA, 14 bp, Homo sapiens
caatggaagatttg

SEQ ID NO: 4377524 - DNA, 15 bp, Homo sapiens
caatggccagagcct

SEQ ID NO: 4377525 - DNA, 16 bp, Homo sapiens
caatggccagagcctc

SEQ ID NO: 4377526 - DNA, 17 bp, Homo sapiens
caatggctattaacaat

SEQ ID NO: 4377527 - DNA, 21 bp, Homo sapiens
caatgggaagactcaggagtc

SEQ ID NO: 4377528 - DNA, 20 bp, Homo sapiens
caatgggtaagggagggaag

SEQ ID NO: 4377529 - DNA, 22 bp, Homo sapiens
caatgggtaagggagggaaggg

SEQ ID NO: 4377530 - DNA, 21 bp, Homo sapiens
caatggtgtcagtatccaggc

SEQ ID NO: 4377531 - DNA, 14 bp, Homo sapiens
caatgtaaatattt

SEQ ID NO: 4377532 - DNA, 13 bp, Homo sapiens
caatgtacaatta

SEQ ID NO: 4377533 - DNA, 19 bp, Homo sapiens
caatgtacaattatgtctc

SEQ ID NO: 4377534 - DNA, 16 bp, Homo sapiens
caatgtatacaatgca

SEQ ID NO: 4377535 - DNA, 19 bp, Homo sapiens
caatgtatacaatgcactt

SEQ ID NO: 4377536 - DNA, 16 bp, Homo sapiens
caatgtatgtacaata

SEQ ID NO: 4377537 - DNA, 17 bp, Homo sapiens
caatgtcatttttaaaa

SEQ ID NO: 4377538 - DNA, 16 bp, Homo sapiens
caatgtctaaaaacat

SEQ ID NO: 4377539 - DNA, 21 bp, Homo sapiens
caatgtcttgatgcatgcact

SEQ ID NO: 4377540 - DNA, 14 bp, Homo sapiens
caatgtgaatcaga

SEQ ID NO: 4377541 - DNA, 15 bp, Homo sapiens
caatgtgatctatgt

SEQ ID NO: 4377542 - DNA, 16 bp, Homo sapiens
caatgtgatctatgtt

SEQ ID NO: 4377543 - DNA, 22 bp, Homo sapiens
caatgtgatctatgtttcatct

SEQ ID NO: 4377544 - DNA, 16 bp, Homo sapiens
caatgtgattcttcta

SEQ ID NO: 4377545 - DNA, 20 bp, Homo sapiens
caatgtggaaaaaatatttt

SEQ ID NO: 4377546 - DNA, 18 bp, Homo sapiens
caatgtggtgacacctcc

SEQ ID NO: 4377547 - DNA, 21 bp, Homo sapiens
caatgtggtgacacctccccc

SEQ ID NO: 4377548 - DNA, 22 bp, Homo sapiens
caatgtggtgacacctccccct

SEQ ID NO: 4377549 - DNA, 15 bp, Homo sapiens
caatgtgtataaatt

SEQ ID NO: 4377550 - DNA, 15 bp, Homo sapiens
caatgtgtctttcta

SEQ ID NO: 4377551 - DNA, 15 bp, Homo sapiens
caatgtgttttctgt

SEQ ID NO: 4377552 - DNA, 16 bp, Homo sapiens
caatgtgtttttctcc

SEQ ID NO: 4377553 - DNA, 15 bp, Homo sapiens
caatgtttcttcatt

SEQ ID NO: 4377554 - DNA, 23 bp, Homo sapiens
caattaaaaaaaaagatctgttt

SEQ ID NO: 4377555 - DNA, 17 bp, Homo sapiens
caattaaaccgcatgtg

SEQ ID NO: 4377556 - DNA, 19 bp, Homo sapiens
caattaaacttccaaagaa

SEQ ID NO: 4377557 - DNA, 23 bp, Homo sapiens
caattaacatacatcattccaca

SEQ ID NO: 4377558 - DNA, 14 bp, Homo sapiens
caattaattgtctt

SEQ ID NO: 4377559 - DNA, 18 bp, Homo sapiens
caattacagggtgactca

SEQ ID NO: 4377560 - DNA, 15 bp, Homo sapiens
caattagtctgaaac

SEQ ID NO: 4377561 - DNA, 17 bp, Homo sapiens
caattatataaatcatt

SEQ ID NO: 4377562 - DNA, 12 bp, Homo sapiens
caattatattgt

SEQ ID NO: 4377563 - DNA, 15 bp, Homo sapiens
caattatgtctcttg

SEQ ID NO: 4377564 - DNA, 17 bp, Homo sapiens
caattattgatatatat

SEQ ID NO: 4377565 - DNA, 22 bp, Homo sapiens
caattattgatatatattataa

SEQ ID NO: 4377566 - DNA, 13 bp, Homo sapiens
caattcaaagctg

SEQ ID NO: 4377567 - DNA, 14 bp, Homo sapiens
caattcagacccct

SEQ ID NO: 4377568 - DNA, 16 bp, Homo sapiens
caattcataaaaacaa

SEQ ID NO: 4377569 - DNA, 21 bp, Homo sapiens
caattccaagaaaatatcact

SEQ ID NO: 4377570 - DNA, 17 bp, Homo sapiens
caattccaatatttctg

SEQ ID NO: 4377571 - DNA, 13 bp, Homo sapiens
caattcctccaga

SEQ ID NO: 4377572 - DNA, 23 bp, Homo sapiens
caattctaggatgaacaatgtat

SEQ ID NO: 4377573 - DNA, 23 bp, Homo sapiens
caattctatcttttgtttccttt

SEQ ID NO: 4377574 - DNA, 13 bp, Homo sapiens
caattctgactgt

SEQ ID NO: 4377575 - DNA, 14 bp, Homo sapiens
caattctgactgtc

SEQ ID NO: 4377576 - DNA, 14 bp, Homo sapiens
caattctgttttta

SEQ ID NO: 4377577 - DNA, 22 bp, Homo sapiens
caattgaaggatcatctgaagg

SEQ ID NO: 4377578 - DNA, 20 bp, Homo sapiens
caattgacattcctttgaat

SEQ ID NO: 4377579 - DNA, 14 bp, Homo sapiens
caattgagaaaaat

SEQ ID NO: 4377580 - DNA, 17 bp, Homo sapiens
caattgggagctgccaa

SEQ ID NO: 4377581 - DNA, 21 bp, Homo sapiens
caattgggagctgccaagagt

SEQ ID NO: 4377582 - DNA, 21 bp, Homo sapiens
caattggtaaaactcactgtg

SEQ ID NO: 4377583 - DNA, 16 bp, Homo sapiens
caattggtgtcatttt

SEQ ID NO: 4377584 - DNA, 18 bp, Homo sapiens
caattggtgtcattttct

SEQ ID NO: 4377585 - DNA, 21 bp, Homo sapiens
caattgtcgaaaagagtcttc

SEQ ID NO: 4377586 - DNA, 12 bp, Homo sapiens
caatttaaaaaa

SEQ ID NO: 4377587 - DNA, 13 bp, Homo sapiens
caatttaaatgtt

SEQ ID NO: 4377588 - DNA, 13 bp, Homo sapiens
caatttaattcct

SEQ ID NO: 4377589 - DNA, 11 bp, Homo sapiens
caatttagaaa

SEQ ID NO: 4377590 - DNA, 22 bp, Homo sapiens
caatttagtctagacacaattt

SEQ ID NO: 4377591 - DNA, 15 bp, Homo sapiens
caatttatgggagaa

SEQ ID NO: 4377592 - DNA, 19 bp, Homo sapiens
caatttattttattttagc

SEQ ID NO: 4377593 - DNA, 16 bp, Homo sapiens
caatttcaaacttttg

SEQ ID NO: 4377594 - DNA, 20 bp, Homo sapiens
caatttcaaacttttgaaag

SEQ ID NO: 4377595 - DNA, 19 bp, Homo sapiens
caatttcaccccattttct

SEQ ID NO: 4377596 - DNA, 16 bp, Homo sapiens
caatttcatttccagc

SEQ ID NO: 4377597 - DNA, 18 bp, Homo sapiens
caatttccccctgttctt

SEQ ID NO: 4377598 - DNA, 17 bp, Homo sapiens
caatttcggattttttc

SEQ ID NO: 4377599 - DNA, 14 bp, Homo sapiens
caatttctgtacat

SEQ ID NO: 4377600 - DNA, 19 bp, Homo sapiens
caatttctgtacatttgca

SEQ ID NO: 4377601 - DNA, 23 bp, Homo sapiens
caatttctgtacatttgcaatta

SEQ ID NO: 4377602 - DNA, 19 bp, Homo sapiens
caatttgcacaatatttct

SEQ ID NO: 4377603 - DNA, 20 bp, Homo sapiens
caatttgcacaatatttctt

SEQ ID NO: 4377604 - DNA, 21 bp, Homo sapiens
caatttggatttaaaagcctg

SEQ ID NO: 4377605 - DNA, 13 bp, Homo sapiens
caatttggtaaaa

SEQ ID NO: 4377606 - DNA, 15 bp, Homo sapiens
caatttgtttttgca

SEQ ID NO: 4377607 - DNA, 17 bp, Homo sapiens
caatttgtttttgcatt

SEQ ID NO: 4377608 - DNA, 16 bp, Homo sapiens
caattttaaagttctt

SEQ ID NO: 4377609 - DNA, 21 bp, Homo sapiens
caattttaatttagtaaatgt

SEQ ID NO: 4377610 - DNA, 23 bp, Homo sapiens
caattttaatttagtaaatgtta

SEQ ID NO: 4377611 - DNA, 14 bp, Homo sapiens
caattttactgtga

SEQ ID NO: 4377612 - DNA, 15 bp, Homo sapiens
caattttactgtgaa

SEQ ID NO: 4377613 - DNA, 17 bp, Homo sapiens
caattttactgtgaaaa

SEQ ID NO: 4377614 - DNA, 23 bp, Homo sapiens
caattttatgtttttatttatga

SEQ ID NO: 4377615 - DNA, 14 bp, Homo sapiens
caattttcctgtgg

SEQ ID NO: 4377616 - DNA, 19 bp, Homo sapiens
caattttctgtaatctttt

SEQ ID NO: 4377617 - DNA, 22 bp, Homo sapiens
caatttttaatggcagcagaaa

SEQ ID NO: 4377618 - DNA, 21 bp, Homo sapiens
caattttttatcatgcatgtc

SEQ ID NO: 4377619 - DNA, 20 bp, Homo sapiens
cacaaaaaaatgttcattgt

SEQ ID NO: 4377620 - DNA, 23 bp, Homo sapiens
cacaaaaaaatgttcattgtaga

SEQ ID NO: 4377621 - DNA, 17 bp, Homo sapiens
cacaaaaaggcaaatat

SEQ ID NO: 4377622 - DNA, 19 bp, Homo sapiens
cacaaaaaggcaaatattg

SEQ ID NO: 4377623 - DNA, 22 bp, Homo sapiens
cacaaaactacttttctaaaat

SEQ ID NO: 4377624 - DNA, 17 bp, Homo sapiens
cacaaaattagaaagga

SEQ ID NO: 4377625 - DNA, 16 bp, Homo sapiens
cacaaacacattataa

SEQ ID NO: 4377626 - DNA, 23 bp, Homo sapiens
cacaaacgtttacttatcttatg

SEQ ID NO: 4377627 - DNA, 13 bp, Homo sapiens
cacaaactgtaaa

SEQ ID NO: 4377628 - DNA, 20 bp, Homo sapiens
cacaaactgtgaaaatagtg

SEQ ID NO: 4377629 - DNA, 14 bp, Homo sapiens
cacaaagcccccca

SEQ ID NO: 4377630 - DNA, 23 bp, Homo sapiens
cacaaaggctgacattcactgag

SEQ ID NO: 4377631 - DNA, 18 bp, Homo sapiens
cacaaagttctcagagct

SEQ ID NO: 4377632 - DNA, 20 bp, Homo sapiens
cacaaataagtaatatcttt

SEQ ID NO: 4377633 - DNA, 17 bp, Homo sapiens
cacaaatgcagtatata

SEQ ID NO: 4377634 - DNA, 20 bp, Homo sapiens
cacaaattattaatgaaaat

SEQ ID NO: 4377635 - DNA, 23 bp, Homo sapiens
cacaaccagaggtggcaggagaa

SEQ ID NO: 4377636 - DNA, 23 bp, Homo sapiens
cacaacgtgggcttaaagcagaa

SEQ ID NO: 4377637 - DNA, 20 bp, Homo sapiens
cacaacgtttgacctcgact

SEQ ID NO: 4377638 - DNA, 15 bp, Homo sapiens
cacaactaacaatgc

SEQ ID NO: 4377639 - DNA, 23 bp, Homo sapiens
cacaactaacaatgccttgttgt

SEQ ID NO: 4377640 - DNA, 22 bp, Homo sapiens
cacaactgtgtgattaaaaggt

SEQ ID NO: 4377641 - DNA, 19 bp, Homo sapiens
cacaacttcccattaaaaa

SEQ ID NO: 4377642 - DNA, 12 bp, Homo sapiens
cacaacttgttt

SEQ ID NO: 4377643 - DNA, 13 bp, Homo sapiens
cacaagaaatgaa

SEQ ID NO: 4377644 - DNA, 15 bp, Homo sapiens
cacaagaaatgaaag

SEQ ID NO: 4377645 - DNA, 18 bp, Homo sapiens
cacaagaaatgaaagcag

SEQ ID NO: 4377646 - DNA, 15 bp, Homo sapiens
cacaagattcccaga

SEQ ID NO: 4377647 - DNA, 18 bp, Homo sapiens
cacaagattcccagagac

SEQ ID NO: 4377648 - DNA, 22 bp, Homo sapiens
cacaagattcccagagacagga

SEQ ID NO: 4377649 - DNA, 23 bp, Homo sapiens
cacaagcccaggtcctgctgcct

SEQ ID NO: 4377650 - DNA, 17 bp, Homo sapiens
cacaagccttactcacc

SEQ ID NO: 4377651 - DNA, 16 bp, Homo sapiens
cacaagctgcactgtg

SEQ ID NO: 4377652 - DNA, 17 bp, Homo sapiens
cacaagctgcactgtga

SEQ ID NO: 4377653 - DNA, 18 bp, Homo sapiens
cacaaggattgaaaattc

SEQ ID NO: 4377654 - DNA, 21 bp, Homo sapiens
cacaagggaagtggaaggaag

SEQ ID NO: 4377655 - DNA, 19 bp, Homo sapiens
cacaagttccctggagaaa

SEQ ID NO: 4377656 - DNA, 23 bp, Homo sapiens
cacaatacagtaagtaaagtggt

SEQ ID NO: 4377657 - DNA, 13 bp, Homo sapiens
cacaatacagtat

SEQ ID NO: 4377658 - DNA, 17 bp, Homo sapiens
cacaatacagtattata

SEQ ID NO: 4377659 - DNA, 20 bp, Homo sapiens
cacaatagccgatatcagaa

SEQ ID NO: 4377660 - DNA, 14 bp, Homo sapiens
cacaataggtcttt

SEQ ID NO: 4377661 - DNA, 20 bp, Homo sapiens
cacaataggtctttctctca

SEQ ID NO: 4377662 - DNA, 13 bp, Homo sapiens
cacaatatttctt

SEQ ID NO: 4377663 - DNA, 18 bp, Homo sapiens
cacaatatttcttttgtt

SEQ ID NO: 4377664 - DNA, 20 bp, Homo sapiens
cacaatctggcttagtgcca

SEQ ID NO: 4377665 - DNA, 21 bp, Homo sapiens
cacaatctggcttagtgccac

SEQ ID NO: 4377666 - DNA, 21 bp, Homo sapiens
cacaatgttccttttttgtat

SEQ ID NO: 4377667 - DNA, 22 bp, Homo sapiens
cacaatgttccttttttgtata

SEQ ID NO: 4377668 - DNA, 18 bp, Homo sapiens
cacaattattggcaaagt

SEQ ID NO: 4377669 - DNA, 18 bp, Homo sapiens
cacaatttcatttccagc

SEQ ID NO: 4377670 - DNA, 23 bp, Homo sapiens
cacaatttcatttccagcatttt

SEQ ID NO: 4377671 - DNA, 16 bp, Homo sapiens
cacaattttcctgtgg

SEQ ID NO: 4377672 - DNA, 13 bp, Homo sapiens
cacaatttttaat

SEQ ID NO: 4377673 - DNA, 15 bp, Homo sapiens
cacaatttttaatgg

SEQ ID NO: 4377674 - DNA, 22 bp, Homo sapiens
cacaatttttaatggcagcaga

SEQ ID NO: 4377675 - DNA, 22 bp, Homo sapiens
cacacaatgcccaacttactgt

SEQ ID NO: 4377676 - DNA, 16 bp, Homo sapiens
cacacacaataaagaa

SEQ ID NO: 4377677 - DNA, 13 bp, Homo sapiens
cacacacccatgt

SEQ ID NO: 4377678 - DNA, 14 bp, Homo sapiens
cacacacccctccg

SEQ ID NO: 4377679 - DNA, 12 bp, Homo sapiens
cacacagcagcc

SEQ ID NO: 4377680 - DNA, 12 bp, Homo sapiens
cacacagcccag

SEQ ID NO: 4377681 - DNA, 13 bp, Homo sapiens
cacacagccccta

SEQ ID NO: 4377682 - DNA, 12 bp, Homo sapiens
cacacaggcagc

SEQ ID NO: 4377683 - DNA, 19 bp, Homo sapiens
cacacaggcagccagccgt

SEQ ID NO: 4377684 - DNA, 17 bp, Homo sapiens
cacacaggcagggcctg

SEQ ID NO: 4377685 - DNA, 19 bp, Homo sapiens
cacacagtggatggacgga

SEQ ID NO: 4377686 - DNA, 15 bp, Homo sapiens
cacacatcctgtcag

SEQ ID NO: 4377687 - DNA, 14 bp, Homo sapiens
cacacattctgcct

SEQ ID NO: 4377688 - DNA, 15 bp, Homo sapiens
cacacattctgcctt

SEQ ID NO: 4377689 - DNA, 20 bp, Homo sapiens
cacacattgtgcttggcccc

SEQ ID NO: 4377690 - DNA, 23 bp, Homo sapiens
cacaccataagctactgccatcc

SEQ ID NO: 4377691 - DNA, 16 bp, Homo sapiens
cacacccatggcctca

SEQ ID NO: 4377692 - DNA, 20 bp, Homo sapiens
cacacccatgtaaccactgc

SEQ ID NO: 4377693 - DNA, 16 bp, Homo sapiens
cacacccctctgctgc

SEQ ID NO: 4377694 - DNA, 20 bp, Homo sapiens
cacacccctggggctgagtc

SEQ ID NO: 4377695 - DNA, 13 bp, Homo sapiens
cacaccctgggcc

SEQ ID NO: 4377696 - DNA, 15 bp, Homo sapiens
cacaccctgggccac

SEQ ID NO: 4377697 - DNA, 17 bp, Homo sapiens
cacaccctgggccacgc

SEQ ID NO: 4377698 - DNA, 16 bp, Homo sapiens
cacaccgcgtcccagc

SEQ ID NO: 4377699 - DNA, 18 bp, Homo sapiens
cacaccgcgtcccagctc

SEQ ID NO: 4377700 - DNA, 22 bp, Homo sapiens
cacaccgcgtcccagctcccct

SEQ ID NO: 4377701 - DNA, 13 bp, Homo sapiens
cacacctcagttc

SEQ ID NO: 4377702 - DNA, 20 bp, Homo sapiens
cacacctcagttcccttggc

SEQ ID NO: 4377703 - DNA, 14 bp, Homo sapiens
cacacctctgccag

SEQ ID NO: 4377704 - DNA, 15 bp, Homo sapiens
cacacctgccctaaa

SEQ ID NO: 4377705 - DNA, 18 bp, Homo sapiens
cacacggaagcaagcaga

SEQ ID NO: 4377706 - DNA, 21 bp, Homo sapiens
cacacgtttaatcccagcact

SEQ ID NO: 4377707 - DNA, 22 bp, Homo sapiens
cacacgtttaatcccagcactt

SEQ ID NO: 4377708 - DNA, 21 bp, Homo sapiens
cacactaacctgggttccctt

SEQ ID NO: 4377709 - DNA, 18 bp, Homo sapiens
cacactatcatagttaac

SEQ ID NO: 4377710 - DNA, 14 bp, Homo sapiens
cacactcaaggaca

SEQ ID NO: 4377711 - DNA, 17 bp, Homo sapiens
cacactcaaggacagga

SEQ ID NO: 4377712 - DNA, 20 bp, Homo sapiens
cacactcaaggacaggagcc

SEQ ID NO: 4377713 - DNA, 18 bp, Homo sapiens
cacactcactcctgagac

SEQ ID NO: 4377714 - DNA, 12 bp, Homo sapiens
cacactcagcca

SEQ ID NO: 4377715 - DNA, 23 bp, Homo sapiens
cacactgaccaagtgctggccca

SEQ ID NO: 4377716 - DNA, 14 bp, Homo sapiens
cacactgatgctta

SEQ ID NO: 4377717 - DNA, 17 bp, Homo sapiens
cacactgcaagagcctt

SEQ ID NO: 4377718 - DNA, 20 bp, Homo sapiens
cacactgctgctaggggctg

SEQ ID NO: 4377719 - DNA, 18 bp, Homo sapiens
cacactggaatataaaac

SEQ ID NO: 4377720 - DNA, 16 bp, Homo sapiens
cacactggctcaccca

SEQ ID NO: 4377721 - DNA, 18 bp, Homo sapiens
cacactggtacttagagt

SEQ ID NO: 4377722 - DNA, 14 bp, Homo sapiens
cacactgtgctttc

SEQ ID NO: 4377723 - DNA, 23 bp, Homo sapiens
cacactgtgtgggggacggcttc

SEQ ID NO: 4377724 - DNA, 19 bp, Homo sapiens
cacacttatattttatgaa

SEQ ID NO: 4377725 - DNA, 21 bp, Homo sapiens
cacacttatattttatgaaca

SEQ ID NO: 4377726 - DNA, 15 bp, Homo sapiens
cacacttctgtgaga

SEQ ID NO: 4377727 - DNA, 19 bp, Homo sapiens
cacacttgttccagctctt

SEQ ID NO: 4377728 - DNA, 20 bp, Homo sapiens
cacacttgttccagctcttt

SEQ ID NO: 4377729 - DNA, 19 bp, Homo sapiens
cacactttggcccagggtg

SEQ ID NO: 4377730 - DNA, 18 bp, Homo sapiens
cacagaaaatgtaaactg

SEQ ID NO: 4377731 - DNA, 19 bp, Homo sapiens
cacagaaaggcaggtttca

SEQ ID NO: 4377732 - DNA, 21 bp, Homo sapiens
cacagaaatcacagtcaatgg

SEQ ID NO: 4377733 - DNA, 21 bp, Homo sapiens
cacagaaccttcaacccagtg

SEQ ID NO: 4377734 - DNA, 14 bp, Homo sapiens
cacagagaaataca

SEQ ID NO: 4377735 - DNA, 16 bp, Homo sapiens
cacagagaggagggga

SEQ ID NO: 4377736 - DNA, 17 bp, Homo sapiens
cacagaggagtgcagcc

SEQ ID NO: 4377737 - DNA, 21 bp, Homo sapiens
cacagaggcagcccgcacacc

SEQ ID NO: 4377738 - DNA, 16 bp, Homo sapiens
cacagaggccccacct

SEQ ID NO: 4377739 - DNA, 12 bp, Homo sapiens
cacagagtgaga

SEQ ID NO: 4377740 - DNA, 16 bp, Homo sapiens
cacagagtgctggact

SEQ ID NO: 4377741 - DNA, 19 bp, Homo sapiens
cacagataactgaaaatta

SEQ ID NO: 4377742 - DNA, 19 bp, Homo sapiens
cacagatatatacacacag

SEQ ID NO: 4377743 - DNA, 16 bp, Homo sapiens
cacagattttgaatct

SEQ ID NO: 4377744 - DNA, 23 bp, Homo sapiens
cacagatttttatgttttctttc

SEQ ID NO: 4377745 - DNA, 23 bp, Homo sapiens
caccaggcgctaattcaaggaat

SEQ ID NO: 4377746 - DNA, 17 bp, Homo sapiens
caccagggatcacagac

SEQ ID NO: 4377747 - DNA, 21 bp, Homo sapiens
caccagggatcacagaccaca

SEQ ID NO: 4377748 - DNA, 22 bp, Homo sapiens
caccagggatcacagaccacag

SEQ ID NO: 4377749 - DNA, 23 bp, Homo sapiens
caccagggcaactcttggaagaa

SEQ ID NO: 4377750 - DNA, 23 bp, Homo sapiens
caccagggctccaggagcctcat

SEQ ID NO: 4377751 - DNA, 23 bp, Homo sapiens
caccagggttgaccccagaggat

SEQ ID NO: 4377752 - DNA, 23 bp, Homo sapiens
caccagtcccatgctggctgaag

SEQ ID NO: 4377753 - DNA, 11 bp, Homo sapiens
caccagtgcct

SEQ ID NO: 4377754 - DNA, 17 bp, Homo sapiens
caccagtgttcctgaag

SEQ ID NO: 4377755 - DNA, 18 bp, Homo sapiens
caccataagctactgcca

SEQ ID NO: 4377756 - DNA, 13 bp, Homo sapiens
caccatctgcttg

SEQ ID NO: 4377757 - DNA, 21 bp, Homo sapiens
caccatgctctctcacctgct

SEQ ID NO: 4377758 - DNA, 14 bp, Homo sapiens
caccatgcttccag

SEQ ID NO: 4377759 - DNA, 18 bp, Homo sapiens
caccatggaccagcccat

SEQ ID NO: 4377760 - DNA, 13 bp, Homo sapiens
caccatggagacg

SEQ ID NO: 4377761 - DNA, 20 bp, Homo sapiens
caccatggtatcatatatta

SEQ ID NO: 4377762 - DNA, 15 bp, Homo sapiens
caccatttaatttca

SEQ ID NO: 4377763 - DNA, 23 bp, Homo sapiens
caccatttctgggggccgcagag

SEQ ID NO: 4377764 - DNA, 23 bp, Homo sapiens
cacccaaaagtcaaaaggtgcct

SEQ ID NO: 4377765 - DNA, 20 bp, Homo sapiens
cacccaactccacagggctg

SEQ ID NO: 4377766 - DNA, 15 bp, Homo sapiens
cacccaagcctgctg

SEQ ID NO: 4377767 - DNA, 24 bp, Homo sapiens
cacccacccgccgcctcccacggc

SEQ ID NO: 4377768 - DNA, 16 bp, Homo sapiens
cacccaccgtggagga

SEQ ID NO: 4377769 - DNA, 22 bp, Homo sapiens
cacccagaggtctcatctccca

SEQ ID NO: 4377770 - DNA, 11 bp, Homo sapiens
cacccagccca

SEQ ID NO: 4377771 - DNA, 22 bp, Homo sapiens
cacccagcccattctctctcct

SEQ ID NO: 4377772 - DNA, 16 bp, Homo sapiens
cacccagccctggtct

SEQ ID NO: 4377773 - DNA, 18 bp, Homo sapiens
cacccagccctggtctca

SEQ ID NO: 4377774 - DNA, 11 bp, Homo sapiens
cacccaggcag

SEQ ID NO: 4377775 - DNA, 21 bp, Homo sapiens
cacccaggcccgagcgcctgc

SEQ ID NO: 4377776 - DNA, 20 bp, Homo sapiens
cacccaggctggagtgcagt

SEQ ID NO: 4377777 - DNA, 20 bp, Homo sapiens
cacccaggctggagtgcggt

SEQ ID NO: 4377778 - DNA, 23 bp, Homo sapiens
cacccaggctggagtgcggtggc

SEQ ID NO: 4377779 - DNA, 17 bp, Homo sapiens
cacccagtagcccagag

SEQ ID NO: 4377780 - DNA, 21 bp, Homo sapiens
cacccatgcgccttcgtgcct

SEQ ID NO: 4377781 - DNA, 22 bp, Homo sapiens
cacccatgcgccttcgtgcctg

SEQ ID NO: 4377782 - DNA, 15 bp, Homo sapiens
cacccatggcctcag

SEQ ID NO: 4377783 - DNA, 13 bp, Homo sapiens
cacccatgggctc

SEQ ID NO: 4377784 - DNA, 18 bp, Homo sapiens
cacccatgggctctgaca

SEQ ID NO: 4377785 - DNA, 20 bp, Homo sapiens
cacccatgggctctgacaga

SEQ ID NO: 4377786 - DNA, 17 bp, Homo sapiens
cacccatgtaaccactg

SEQ ID NO: 4377787 - DNA, 12 bp, Homo sapiens
cacccatttaaa

SEQ ID NO: 4377788 - DNA, 13 bp, Homo sapiens
caccccaaacccc

SEQ ID NO: 4377789 - DNA, 12 bp, Homo sapiens
caccccaactct

SEQ ID NO: 4377790 - DNA, 17 bp, Homo sapiens
caccccaactctcccca

SEQ ID NO: 4377791 - DNA, 18 bp, Homo sapiens
caccccaactctccccag

SEQ ID NO: 4377792 - DNA, 19 bp, Homo sapiens
caccccaactctccccagt

SEQ ID NO: 4377793 - DNA, 13 bp, Homo sapiens
caccccacagctg

SEQ ID NO: 4377794 - DNA, 16 bp, Homo sapiens
caccccacagctgggg

SEQ ID NO: 4377795 - DNA, 17 bp, Homo sapiens
caccccacagctggggc

SEQ ID NO: 4377796 - DNA, 13 bp, Homo sapiens
caccccaccaggg

SEQ ID NO: 4377797 - DNA, 10 bp, Homo sapiens
caccccaccc

SEQ ID NO: 4377798 - DNA, 22 bp, Homo sapiens
caccccacccccttcagtgccc

SEQ ID NO: 4377799 - DNA, 15 bp, Homo sapiens
caccccaccctccct

SEQ ID NO: 4377800 - DNA, 20 bp, Homo sapiens
caccccaccctccctggagt

SEQ ID NO: 4377801 - DNA, 13 bp, Homo sapiens
caccccagcattc

SEQ ID NO: 4377802 - DNA, 20 bp, Homo sapiens
caccccaggacgccactcat

SEQ ID NO: 4377803 - DNA, 15 bp, Homo sapiens
caccccattttctgt

SEQ ID NO: 4377804 - DNA, 19 bp, Homo sapiens
cacccccagccccgactcc

SEQ ID NO: 4377805 - DNA, 15 bp, Homo sapiens
cacccccagccttgc

SEQ ID NO: 4377806 - DNA, 13 bp, Homo sapiens
cacccccatgctg

SEQ ID NO: 4377807 - DNA, 16 bp, Homo sapiens
cacccccatgctgcct

SEQ ID NO: 4377808 - DNA, 23 bp, Homo sapiens
caccccccacactcactcctgag

SEQ ID NO: 4377809 - DNA, 18 bp, Homo sapiens
cacccccctctctttctc

SEQ ID NO: 4377810 - DNA, 20 bp, Homo sapiens
cacccccctctctttctctg

SEQ ID NO: 4377811 - DNA, 11 bp, Homo sapiens
caccccctccc

SEQ ID NO: 4377812 - DNA, 14 bp, Homo sapiens
caccccctcccacc

SEQ ID NO: 4377813 - DNA, 14 bp, Homo sapiens
caccccctccccag

SEQ ID NO: 4377814 - DNA, 11 bp, Homo sapiens
caccccctcct

SEQ ID NO: 4377815 - DNA, 18 bp, Homo sapiens
caccccctgctccaccag

SEQ ID NO: 4377816 - DNA, 21 bp, Homo sapiens
cacccccttcagtgcccacca

SEQ ID NO: 4377817 - DNA, 18 bp, Homo sapiens
cacccccttctccatcca

SEQ ID NO: 4377818 - DNA, 13 bp, Homo sapiens
cacccccttctct

SEQ ID NO: 4377819 - DNA, 13 bp, Homo sapiens
caccccgctctgc

SEQ ID NO: 4377820 - DNA, 14 bp, Homo sapiens
caccccgctctgca

SEQ ID NO: 4377821 - DNA, 17 bp, Homo sapiens
caccccggggaccctgt

SEQ ID NO: 4377822 - DNA, 17 bp, Homo sapiens
cacccctaaactccagg

SEQ ID NO: 4377823 - DNA, 13 bp, Homo sapiens
cacccctccccag

SEQ ID NO: 4377824 - DNA, 20 bp, Homo sapiens
cacccctccgtgtggagcac

SEQ ID NO: 4377825 - DNA, 18 bp, Homo sapiens
cacccctctgcccctgca

SEQ ID NO: 4377826 - DNA, 20 bp, Homo sapiens
cacccctctgcccctgcagc

SEQ ID NO: 4377827 - DNA, 20 bp, Homo sapiens
cacccctgaggacacccagg

SEQ ID NO: 4377828 - DNA, 21 bp, Homo sapiens
cacccctgagttgggcagcca

SEQ ID NO: 4377829 - DNA, 13 bp, Homo sapiens
cacccctgcacag

SEQ ID NO: 4377830 - DNA, 11 bp, Homo sapiens
cacccctgccc

SEQ ID NO: 4377831 - DNA, 18 bp, Homo sapiens
cacccctgcccccagccc

SEQ ID NO: 4377832 - DNA, 13 bp, Homo sapiens
cacccctgcctcc

SEQ ID NO: 4377833 - DNA, 16 bp, Homo sapiens
cacccctgcctccacc

SEQ ID NO: 4377834 - DNA, 18 bp, Homo sapiens
cacccctgcctccaccct

SEQ ID NO: 4377835 - DNA, 23 bp, Homo sapiens
cacccctgcctccaccctctgag

SEQ ID NO: 4377836 - DNA, 12 bp, Homo sapiens
cacccctgggcc

SEQ ID NO: 4377837 - DNA, 13 bp, Homo sapiens
cacccctgggcca

SEQ ID NO: 4377838 - DNA, 16 bp, Homo sapiens
caccccttcctgtctc

SEQ ID NO: 4377839 - DNA, 20 bp, Homo sapiens
caccccttcctgtctcactc

SEQ ID NO: 4377840 - DNA, 17 bp, Homo sapiens
cacccgagttcctctgg

SEQ ID NO: 4377841 - DNA, 19 bp, Homo sapiens
cacccgagttcctctgggt

SEQ ID NO: 4377842 - DNA, 20 bp, Homo sapiens
cacccgcccacccgccttgt

SEQ ID NO: 4377843 - DNA, 23 bp, Homo sapiens
cacccgccgccactaggtgtccc

SEQ ID NO: 4377844 - DNA, 16 bp, Homo sapiens
cacccgccttgtgaga

SEQ ID NO: 4377845 - DNA, 18 bp, Homo sapiens
cacccggccacagctgct

SEQ ID NO: 4377846 - DNA, 14 bp, Homo sapiens
cacccggcccggct

SEQ ID NO: 4377847 - DNA, 20 bp, Homo sapiens
cacccggcccggctgagccc

SEQ ID NO: 4377848 - DNA, 23 bp, Homo sapiens
cacccggcccggctgagccctgc

SEQ ID NO: 4377849 - DNA, 16 bp, Homo sapiens
cacccgtccccacacg

SEQ ID NO: 4377850 - DNA, 22 bp, Homo sapiens
cacccgtccccacacgagggcc

SEQ ID NO: 4377851 - DNA, 23 bp, Homo sapiens
cacccgtccccacacgagggccc

SEQ ID NO: 4377852 - DNA, 20 bp, Homo sapiens
cacccgtctctctgcccact

SEQ ID NO: 4377853 - DNA, 17 bp, Homo sapiens
cacccgtggggtgctgc

SEQ ID NO: 4377854 - DNA, 18 bp, Homo sapiens
cacccgtggggtgctgcc

SEQ ID NO: 4377855 - DNA, 19 bp, Homo sapiens
cacccgtggggtgctgccc

SEQ ID NO: 4377856 - DNA, 15 bp, Homo sapiens
caccctcatccttta

SEQ ID NO: 4377857 - DNA, 13 bp, Homo sapiens
caccctcatgaaa

SEQ ID NO: 4377858 - DNA, 22 bp, Homo sapiens
caccctccatgctcctcacctg

SEQ ID NO: 4377859 - DNA, 16 bp, Homo sapiens
caccctccctggagtg

SEQ ID NO: 4377860 - DNA, 14 bp, Homo sapiens
caccctcctcttgg

SEQ ID NO: 4377861 - DNA, 14 bp, Homo sapiens
caccctcctgtctt

SEQ ID NO: 4377862 - DNA, 12 bp, Homo sapiens
caccctgagccg

SEQ ID NO: 4377863 - DNA, 12 bp, Homo sapiens
caccctgagctc

SEQ ID NO: 4377864 - DNA, 19 bp, Homo sapiens
caccctgccaagactcctc

SEQ ID NO: 4377865 - DNA, 16 bp, Homo sapiens
caccctgggagccagt

SEQ ID NO: 4377866 - DNA, 15 bp, Homo sapiens
caccctgggccacgc

SEQ ID NO: 4377867 - DNA, 14 bp, Homo sapiens
caccctgtcctgca

SEQ ID NO: 4377868 - DNA, 19 bp, Homo sapiens
caccctgtcctgcacaccc

SEQ ID NO: 4377869 - DNA, 20 bp, Homo sapiens
caccctgtcctgcacaccct

SEQ ID NO: 4377870 - DNA, 13 bp, Homo sapiens
cacccttggcctg

SEQ ID NO: 4377871 - DNA, 17 bp, Homo sapiens
cacccttttccagctgg

SEQ ID NO: 4377872 - DNA, 13 bp, Homo sapiens
caccgagactcag

SEQ ID NO: 4377873 - DNA, 19 bp, Homo sapiens
caccgagactcagcctctg

SEQ ID NO: 4377874 - DNA, 18 bp, Homo sapiens
caccgagagtagccgaga

SEQ ID NO: 4377875 - DNA, 18 bp, Homo sapiens
caccgagcgggtgcaagc

SEQ ID NO: 4377876 - DNA, 14 bp, Homo sapiens
caccgaggttccca

SEQ ID NO: 4377877 - DNA, 14 bp, Homo sapiens
caccgcccatcagg

SEQ ID NO: 4377878 - DNA, 14 bp, Homo sapiens
caccgcctgaaggc

SEQ ID NO: 4377879 - DNA, 19 bp, Homo sapiens
caccgcctgaaggcacagc

SEQ ID NO: 4377880 - DNA, 15 bp, Homo sapiens
caccgccttgcccag

SEQ ID NO: 4377881 - DNA, 15 bp, Homo sapiens
caccgcgtcccagct

SEQ ID NO: 4377882 - DNA, 12 bp, Homo sapiens
caccgctgccta

SEQ ID NO: 4377883 - DNA, 13 bp, Homo sapiens
caccgctgcctcg

SEQ ID NO: 4377884 - DNA, 23 bp, Homo sapiens
caccgctggttggaaagagtgtt

SEQ ID NO: 4377885 - DNA, 19 bp, Homo sapiens
caccggaggtcactccacc

SEQ ID NO: 4377886 - DNA, 13 bp, Homo sapiens
caccgggagcctc

SEQ ID NO: 4377887 - DNA, 17 bp, Homo sapiens
caccgggagcctccccc

SEQ ID NO: 4377888 - DNA, 16 bp, Homo sapiens
caccggtcagtgcctt

SEQ ID NO: 4377889 - DNA, 15 bp, Homo sapiens
caccgtgaaccagag

SEQ ID NO: 4377890 - DNA, 16 bp, Homo sapiens
caccgtgaaccagagg

SEQ ID NO: 4377891 - DNA, 17 bp, Homo sapiens
caccgtgaaccagaggg

SEQ ID NO: 4377892 - DNA, 16 bp, Homo sapiens
caccgtgatggagagg

SEQ ID NO: 4377893 - DNA, 21 bp, Homo sapiens
caccgtgatggagaggacaga

SEQ ID NO: 4377894 - DNA, 19 bp, Homo sapiens
caccgtgcctggccagatt

SEQ ID NO: 4377895 - DNA, 17 bp, Homo sapiens
caccgtggaggaggaag

SEQ ID NO: 4377896 - DNA, 13 bp, Homo sapiens
caccgtgggctcc

SEQ ID NO: 4377897 - DNA, 18 bp, Homo sapiens
caccgtgggctccctgac

SEQ ID NO: 4377898 - DNA, 17 bp, Homo sapiens
cacctaaagaaaaacaa

SEQ ID NO: 4377899 - DNA, 16 bp, Homo sapiens
cacctaagcacttcta

SEQ ID NO: 4377900 - DNA, 21 bp, Homo sapiens
cacctagacaaccagaggctg

SEQ ID NO: 4377901 - DNA, 15 bp, Homo sapiens
cacctagccagctgt

SEQ ID NO: 4377902 - DNA, 16 bp, Homo sapiens
cacctaggccactcct

SEQ ID NO: 4377903 - DNA, 18 bp, Homo sapiens
cacctatctcagccatag

SEQ ID NO: 4377904 - DNA, 18 bp, Homo sapiens
cacctatgcctgtggtga

SEQ ID NO: 4377905 - DNA, 19 bp, Homo sapiens
cacctatgcctgtggtgaa

SEQ ID NO: 4377906 - DNA, 12 bp, Homo sapiens
cacctatttaat

SEQ ID NO: 4377907 - DNA, 15 bp, Homo sapiens
cacctcaagaccccc

SEQ ID NO: 4377908 - DNA, 15 bp, Homo sapiens
cacctcaccaaggat

SEQ ID NO: 4377909 - DNA, 13 bp, Homo sapiens
cacctcagccttg

SEQ ID NO: 4377910 - DNA, 15 bp, Homo sapiens
cacctcagccttgga

SEQ ID NO: 4377911 - DNA, 19 bp, Homo sapiens
cacctcagttcccttggcc

SEQ ID NO: 4377912 - DNA, 21 bp, Homo sapiens
cacctcagttcccttggcctc

SEQ ID NO: 4377913 - DNA, 23 bp, Homo sapiens
cacctcagttcccttggcctcag

SEQ ID NO: 4377914 - DNA, 12 bp, Homo sapiens
cacctcatgccc

SEQ ID NO: 4377915 - DNA, 15 bp, Homo sapiens
cacctcatgcccacc

SEQ ID NO: 4377916 - DNA, 17 bp, Homo sapiens
cacctcatgcccacccc

SEQ ID NO: 4377917 - DNA, 21 bp, Homo sapiens
cacctcatgcccaccccctgc

SEQ ID NO: 4377918 - DNA, 16 bp, Homo sapiens
cacctccacatcctcc

SEQ ID NO: 4377919 - DNA, 23 bp, Homo sapiens
cacctccccccactgcaggcccc

SEQ ID NO: 4377920 - DNA, 12 bp, Homo sapiens
cacctccccctt

SEQ ID NO: 4377921 - DNA, 21 bp, Homo sapiens
cacctccccctttcacactgg

SEQ ID NO: 4377922 - DNA, 13 bp, Homo sapiens
cacctcccctatc

SEQ ID NO: 4377923 - DNA, 21 bp, Homo sapiens
cacctccctactcccctgggc

SEQ ID NO: 4377924 - DNA, 20 bp, Homo sapiens
cacctcgtcaagagcatgca

SEQ ID NO: 4377925 - DNA, 22 bp, Homo sapiens
cacctctatcccggctttggtg

SEQ ID NO: 4377926 - DNA, 17 bp, Homo sapiens
cacctctggactggcta

SEQ ID NO: 4377927 - DNA, 19 bp, Homo sapiens
cacctctggactggctaga

SEQ ID NO: 4377928 - DNA, 13 bp, Homo sapiens
cacctcttccgac

SEQ ID NO: 4377929 - DNA, 15 bp, Homo sapiens
cacctgaaccccaga

SEQ ID NO: 4377930 - DNA, 19 bp, Homo sapiens
cacctgaaccccagaggca

SEQ ID NO: 4377931 - DNA, 21 bp, Homo sapiens
cacctgaaccccagaggcaga

SEQ ID NO: 4377932 - DNA, 13 bp, Homo sapiens
cacctgaagggtg

SEQ ID NO: 4377933 - DNA, 11 bp, Homo sapiens
cacctgaggtc

SEQ ID NO: 4377934 - DNA, 11 bp, Homo sapiens
cacctgcacct

SEQ ID NO: 4377935 - DNA, 15 bp, Homo sapiens
cacctgcacctcccc

SEQ ID NO: 4377936 - DNA, 19 bp, Homo sapiens
cacctgcacctccccccac

SEQ ID NO: 4377937 - DNA, 22 bp, Homo sapiens
cacctgcacctccccccactgc

SEQ ID NO: 4377938 - DNA, 15 bp, Homo sapiens
cacctgcactaacag

SEQ ID NO: 4377939 - DNA, 21 bp, Homo sapiens
cacctgcagcggctgccctct

SEQ ID NO: 4377940 - DNA, 17 bp, Homo sapiens
cacctgccgccctgtgg

SEQ ID NO: 4377941 - DNA, 17 bp, Homo sapiens
cacctgccttggcctcc

SEQ ID NO: 4377942 - DNA, 20 bp, Homo sapiens
cacctgctcccagtcctgcc

SEQ ID NO: 4377943 - DNA, 19 bp, Homo sapiens
cacctgctgagagacccaa

SEQ ID NO: 4377944 - DNA, 14 bp, Homo sapiens
cacctggccccatg

SEQ ID NO: 4377945 - DNA, 15 bp, Homo sapiens
cacctggccccatgt

SEQ ID NO: 4377946 - DNA, 14 bp, Homo sapiens
cacctggctctgtg

SEQ ID NO: 4377947 - DNA, 23 bp, Homo sapiens
cacctggctgaggttcctctgcc

SEQ ID NO: 4377948 - DNA, 17 bp, Homo sapiens
cacctgtaaaactttat

SEQ ID NO: 4377949 - DNA, 12 bp, Homo sapiens
cacctgtacatt

SEQ ID NO: 4377950 - DNA, 15 bp, Homo sapiens
cacctgtacattctt

SEQ ID NO: 4377951 - DNA, 17 bp, Homo sapiens
cacctgtttctggaaga

SEQ ID NO: 4377952 - DNA, 14 bp, Homo sapiens
caccttaaattaaa

SEQ ID NO: 4377953 - DNA, 16 bp, Homo sapiens
caccttaaattaaaca

SEQ ID NO: 4377954 - DNA, 18 bp, Homo sapiens
caccttaaattaaacaat

SEQ ID NO: 4377955 - DNA, 14 bp, Homo sapiens
caccttcaggcccc

SEQ ID NO: 4377956 - DNA, 13 bp, Homo sapiens
caccttcagggct

SEQ ID NO: 4377957 - DNA, 18 bp, Homo sapiens
caccttcagggctgagtt

SEQ ID NO: 4377958 - DNA, 14 bp, Homo sapiens
caccttcatattgg

SEQ ID NO: 4377959 - DNA, 12 bp, Homo sapiens
caccttcccagc

SEQ ID NO: 4377960 - DNA, 13 bp, Homo sapiens
caccttcccagct

SEQ ID NO: 4377961 - DNA, 16 bp, Homo sapiens
caccttcctcctgcag

SEQ ID NO: 4377962 - DNA, 18 bp, Homo sapiens
caccttcctcctgcagac

SEQ ID NO: 4377963 - DNA, 16 bp, Homo sapiens
caccttcctgtgggtg

SEQ ID NO: 4377964 - DNA, 15 bp, Homo sapiens
caccttctttctgga

SEQ ID NO: 4377965 - DNA, 16 bp, Homo sapiens
caccttctttctggac

SEQ ID NO: 4377966 - DNA, 21 bp, Homo sapiens
caccttggggtccctccaccc

SEQ ID NO: 4377967 - DNA, 13 bp, Homo sapiens
caccttgttacaa

SEQ ID NO: 4377968 - DNA, 16 bp, Homo sapiens
cacctttcccacctct

SEQ ID NO: 4377969 - DNA, 23 bp, Homo sapiens
cacctttcccacctctctcccca

SEQ ID NO: 4377970 - DNA, 16 bp, Homo sapiens
caccttttccaggagt

SEQ ID NO: 4377971 - DNA, 14 bp, Homo sapiens
caccttttctgtgg

SEQ ID NO: 4377972 - DNA, 22 bp, Homo sapiens
caccttttctgtggctggctct

SEQ ID NO: 4377973 - DNA, 16 bp, Homo sapiens
cacgaaactgccctgg

SEQ ID NO: 4377974 - DNA, 16 bp, Homo sapiens
cacgaacccacctgct

SEQ ID NO: 4377975 - DNA, 22 bp, Homo sapiens
cacgaacccacctgctgagaga

SEQ ID NO: 4377976 - DNA, 17 bp, Homo sapiens
cacgactgcgggagcca

SEQ ID NO: 4377977 - DNA, 18 bp, Homo sapiens
cacgactgcgggagccag

SEQ ID NO: 4377978 - DNA, 20 bp, Homo sapiens
cacgactgcgggagccagac

SEQ ID NO: 4377979 - DNA, 20 bp, Homo sapiens
cacgactgttgtacaagctc

SEQ ID NO: 4377980 - DNA, 22 bp, Homo sapiens
cacgactgttgtacaagctcag

SEQ ID NO: 4377981 - DNA, 17 bp, Homo sapiens
cacgagcaggctactgt

SEQ ID NO: 4377982 - DNA, 20 bp, Homo sapiens
cactcccaaatgaaaacccc

SEQ ID NO: 4377983 - DNA, 15 bp, Homo sapiens
cactccccagcccca

SEQ ID NO: 4377984 - DNA, 18 bp, Homo sapiens
cactccccagccccagcc

SEQ ID NO: 4377985 - DNA, 20 bp, Homo sapiens
cactcccctctcctcccctt

SEQ ID NO: 4377986 - DNA, 23 bp, Homo sapiens
cactcccctctcctccccttcct

SEQ ID NO: 4377987 - DNA, 20 bp, Homo sapiens
cactccctaatttatgtgct

SEQ ID NO: 4377988 - DNA, 22 bp, Homo sapiens
cactccctgggacacagaccca

SEQ ID NO: 4377989 - DNA, 18 bp, Homo sapiens
cactcccttctacctgcc

SEQ ID NO: 4377990 - DNA, 19 bp, Homo sapiens
cactcccttctacctgcca

SEQ ID NO: 4377991 - DNA, 22 bp, Homo sapiens
cactcccttctacctgccactc

SEQ ID NO: 4377992 - DNA, 17 bp, Homo sapiens
cactccgcgccgatgcc

SEQ ID NO: 4377993 - DNA, 14 bp, Homo sapiens
cactccgtctgctc

SEQ ID NO: 4377994 - DNA, 14 bp, Homo sapiens
cactcctactgagt

SEQ ID NO: 4377995 - DNA, 19 bp, Homo sapiens
cactcctagagaacgcagc

SEQ ID NO: 4377996 - DNA, 10 bp, Homo sapiens
cactcctcta

SEQ ID NO: 4377997 - DNA, 15 bp, Homo sapiens
cactcctctcccaca

SEQ ID NO: 4377998 - DNA, 16 bp, Homo sapiens
cactcctctcccacag

SEQ ID NO: 4377999 - DNA, 16 bp, Homo sapiens
cactcctgagacccct

SEQ ID NO: 4378000 - DNA, 20 bp, Homo sapiens
cactcctgagacccctggcc

SEQ ID NO: 4378001 - DNA, 12 bp, Homo sapiens
cactcctgggac

SEQ ID NO: 4378002 - DNA, 14 bp, Homo sapiens
cactccttccatct

SEQ ID NO: 4378003 - DNA, 19 bp, Homo sapiens
cactccttccttcaggact

SEQ ID NO: 4378004 - DNA, 18 bp, Homo sapiens
cactcctttatctgtaat

SEQ ID NO: 4378005 - DNA, 16 bp, Homo sapiens
cactcgccttcttaga

SEQ ID NO: 4378006 - DNA, 19 bp, Homo sapiens
cactcggggtccctggagg

SEQ ID NO: 4378007 - DNA, 19 bp, Homo sapiens
cactcgtcaccccagccct

SEQ ID NO: 4378008 - DNA, 21 bp, Homo sapiens
cactcgtcaccccagccctcg

SEQ ID NO: 4378009 - DNA, 15 bp, Homo sapiens
cactctaccctccca

SEQ ID NO: 4378010 - DNA, 17 bp, Homo sapiens
cactctaccctcccacc

SEQ ID NO: 4378011 - DNA, 21 bp, Homo sapiens
cactctaccctcccaccccct

SEQ ID NO: 4378012 - DNA, 21 bp, Homo sapiens
cactctatatgtagtgcattt

SEQ ID NO: 4378013 - DNA, 18 bp, Homo sapiens
cactctatgagttggact

SEQ ID NO: 4378014 - DNA, 21 bp, Homo sapiens
cactctccccacactaacctg

SEQ ID NO: 4378015 - DNA, 16 bp, Homo sapiens
cactctcccccacccc

SEQ ID NO: 4378016 - DNA, 18 bp, Homo sapiens
cactctcctgggcccctc

SEQ ID NO: 4378017 - DNA, 21 bp, Homo sapiens
cactctcctgggcccctccct

SEQ ID NO: 4378018 - DNA, 13 bp, Homo sapiens
cactctctgccat

SEQ ID NO: 4378019 - DNA, 22 bp, Homo sapiens
cactctctgccattctgtgcag

SEQ ID NO: 4378020 - DNA, 13 bp, Homo sapiens
cactctctgggac

SEQ ID NO: 4378021 - DNA, 19 bp, Homo sapiens
cactctctgggactctcct

SEQ ID NO: 4378022 - DNA, 15 bp, Homo sapiens
cactctgcaagaaga

SEQ ID NO: 4378023 - DNA, 12 bp, Homo sapiens
cactctgccccc

SEQ ID NO: 4378024 - DNA, 16 bp, Homo sapiens
cactctgcttgttatt

SEQ ID NO: 4378025 - DNA, 22 bp, Homo sapiens
cactctgtaattgcacttttta

SEQ ID NO: 4378026 - DNA, 23 bp, Homo sapiens
cactctgtagcaaatttgtttaa

SEQ ID NO: 4378027 - DNA, 18 bp, Homo sapiens
cactctgtcagccagccg

SEQ ID NO: 4378028 - DNA, 22 bp, Homo sapiens
cactctgtcagccagccgccct

SEQ ID NO: 4378029 - DNA, 23 bp, Homo sapiens
cactctgtcagccagccgccctg

SEQ ID NO: 4378030 - DNA, 12 bp, Homo sapiens
cactctgtccct

SEQ ID NO: 4378031 - DNA, 22 bp, Homo sapiens
cactctgtccctgtccttccct

SEQ ID NO: 4378032 - DNA, 20 bp, Homo sapiens
cactctgttgcccaggctgg

SEQ ID NO: 4378033 - DNA, 15 bp, Homo sapiens
cactcttctcttgag

SEQ ID NO: 4378034 - DNA, 18 bp, Homo sapiens
cactcttctgtcttgtcc

SEQ ID NO: 4378035 - DNA, 22 bp, Homo sapiens
cactcttctgtcttgtccccac

SEQ ID NO: 4378036 - DNA, 15 bp, Homo sapiens
cactcttgatctctc

SEQ ID NO: 4378037 - DNA, 16 bp, Homo sapiens
cactcttgatctctct

SEQ ID NO: 4378038 - DNA, 18 bp, Homo sapiens
cactcttgatctctcttg

SEQ ID NO: 4378039 - DNA, 20 bp, Homo sapiens
cactcttgatctctcttgtc

SEQ ID NO: 4378040 - DNA, 15 bp, Homo sapiens
cactcttttgcttta

SEQ ID NO: 4378041 - DNA, 12 bp, Homo sapiens
cactgaaaaaat

SEQ ID NO: 4378042 - DNA, 18 bp, Homo sapiens
cactgaaagttttgtaaa

SEQ ID NO: 4378043 - DNA, 11 bp, Homo sapiens
cactgaacagg

SEQ ID NO: 4378044 - DNA, 21 bp, Homo sapiens
cactgaagagagcatttggca

SEQ ID NO: 4378045 - DNA, 18 bp, Homo sapiens
cactgaagtgcttgcaga

SEQ ID NO: 4378046 - DNA, 22 bp, Homo sapiens
cactgaagtgcttgcagatcat

SEQ ID NO: 4378047 - DNA, 23 bp, Homo sapiens
cactgaccatccactctaccctc

SEQ ID NO: 4378048 - DNA, 15 bp, Homo sapiens
cactgacttctaagt

SEQ ID NO: 4378049 - DNA, 20 bp, Homo sapiens
cactgacttctaagtaaaac

SEQ ID NO: 4378050 - DNA, 22 bp, Homo sapiens
cactgagaatgctaatggttgg

SEQ ID NO: 4378051 - DNA, 23 bp, Homo sapiens
cactgagataccagcgaggaggc

SEQ ID NO: 4378052 - DNA, 18 bp, Homo sapiens
cactgagcatcactagtg

SEQ ID NO: 4378053 - DNA, 22 bp, Homo sapiens
cactgagcatcactagtgacaa

SEQ ID NO: 4378054 - DNA, 21 bp, Homo sapiens
cactgagctcacatgggactg

SEQ ID NO: 4378055 - DNA, 22 bp, Homo sapiens
cactgagctgtgacccagaggg

SEQ ID NO: 4378056 - DNA, 13 bp, Homo sapiens
cactgaggaagaa

SEQ ID NO: 4378057 - DNA, 14 bp, Homo sapiens
cactgaggaagaac

SEQ ID NO: 4378058 - DNA, 17 bp, Homo sapiens
cactgaggaagaacggg

SEQ ID NO: 4378059 - DNA, 19 bp, Homo sapiens
cactgatggacaaggaggt

SEQ ID NO: 4378060 - DNA, 13 bp, Homo sapiens
cactgatgggaat

SEQ ID NO: 4378061 - DNA, 14 bp, Homo sapiens
cactgatttggaga

SEQ ID NO: 4378062 - DNA, 14 bp, Homo sapiens
cactgcaacctctg

SEQ ID NO: 4378063 - DNA, 18 bp, Homo sapiens
cactgcaagagccttggt

SEQ ID NO: 4378064 - DNA, 12 bp, Homo sapiens
cactgcactcca

SEQ ID NO: 4378065 - DNA, 16 bp, Homo sapiens
cactgcactccagcct

SEQ ID NO: 4378066 - DNA, 19 bp, Homo sapiens
cactgcactccagcctgag

SEQ ID NO: 4378067 - DNA, 19 bp, Homo sapiens
cactgcactccagcctggg

SEQ ID NO: 4378068 - DNA, 21 bp, Homo sapiens
cactgcactttccaatgccac

SEQ ID NO: 4378069 - DNA, 14 bp, Homo sapiens
cactgcactttgtt

SEQ ID NO: 4378070 - DNA, 15 bp, Homo sapiens
cactgcactttgttt

SEQ ID NO: 4378071 - DNA, 20 bp, Homo sapiens
cactgcactttgtttagaaa

SEQ ID NO: 4378072 - DNA, 17 bp, Homo sapiens
cactgcagtcacctctt

SEQ ID NO: 4378073 - DNA, 16 bp, Homo sapiens
cactgcatgtcagagc

SEQ ID NO: 4378074 - DNA, 16 bp, Homo sapiens
cactgcattcctgtgc

SEQ ID NO: 4378075 - DNA, 18 bp, Homo sapiens
cactgcatttgcctgctt

SEQ ID NO: 4378076 - DNA, 18 bp, Homo sapiens
cactgccagcatttccct

SEQ ID NO: 4378077 - DNA, 16 bp, Homo sapiens
cactgccaggccagcc

SEQ ID NO: 4378078 - DNA, 13 bp, Homo sapiens
cactgccccacat

SEQ ID NO: 4378079 - DNA, 18 bp, Homo sapiens
cactgccccacatgcatg

SEQ ID NO: 4378080 - DNA, 14 bp, Homo sapiens
cactgccccccgag

SEQ ID NO: 4378081 - DNA, 22 bp, Homo sapiens
cactgcgaagaccctcttgccc

SEQ ID NO: 4378082 - DNA, 20 bp, Homo sapiens
cactgcgggagctctgtatg

SEQ ID NO: 4378083 - DNA, 13 bp, Homo sapiens
cactgctccaggc

SEQ ID NO: 4378084 - DNA, 14 bp, Homo sapiens
cactgctccaggcc

SEQ ID NO: 4378085 - DNA, 19 bp, Homo sapiens
cactgctcgtggactgtgc

SEQ ID NO: 4378086 - DNA, 17 bp, Homo sapiens
cactgcttgaactaggc

SEQ ID NO: 4378087 - DNA, 21 bp, Homo sapiens
cactgcttttccctttgtgag

SEQ ID NO: 4378088 - DNA, 18 bp, Homo sapiens
cactggaaaggggagagc

SEQ ID NO: 4378089 - DNA, 14 bp, Homo sapiens
cactggaaggaaca

SEQ ID NO: 4378090 - DNA, 22 bp, Homo sapiens
cactggaatataaaacagtcat

SEQ ID NO: 4378091 - DNA, 20 bp, Homo sapiens
cactggaggttgaagccaag

SEQ ID NO: 4378092 - DNA, 14 bp, Homo sapiens
cactggatcctgct

SEQ ID NO: 4378093 - DNA, 16 bp, Homo sapiens
cactggatcctgctgc

SEQ ID NO: 4378094 - DNA, 22 bp, Homo sapiens
cactggcaaacagggcctctgc

SEQ ID NO: 4378095 - DNA, 21 bp, Homo sapiens
cactggccttctgatgaaatg

SEQ ID NO: 4378096 - DNA, 13 bp, Homo sapiens
cactggcgaggag

SEQ ID NO: 4378097 - DNA, 20 bp, Homo sapiens
cactggcggtcaagtgtgga

SEQ ID NO: 4378098 - DNA, 21 bp, Homo sapiens
cactggcggtcaagtgtggag

SEQ ID NO: 4378099 - DNA, 13 bp, Homo sapiens
cactggctcaccc

SEQ ID NO: 4378100 - DNA, 18 bp, Homo sapiens
cacttttgacaaaggcaa

SEQ ID NO: 4378101 - DNA, 15 bp, Homo sapiens
cacttttgagacttt

SEQ ID NO: 4378102 - DNA, 16 bp, Homo sapiens
cactttttacagcagc

SEQ ID NO: 4378103 - DNA, 14 bp, Homo sapiens
cactttttatgcta

SEQ ID NO: 4378104 - DNA, 18 bp, Homo sapiens
cacttttttataaaagtt

SEQ ID NO: 4378105 - DNA, 23 bp, Homo sapiens
cacttttttgtttgaatgttaga

SEQ ID NO: 4378106 - DNA, 22 bp, Homo sapiens
cagaaaacctctcctgacccct

SEQ ID NO: 4378107 - DNA, 17 bp, Homo sapiens
cagaaaacctgatgctg

SEQ ID NO: 4378108 - DNA, 14 bp, Homo sapiens
cagaaaagcacctg

SEQ ID NO: 4378109 - DNA, 15 bp, Homo sapiens
cagaaaagcacctgc

SEQ ID NO: 4378110 - DNA, 17 bp, Homo sapiens
cagaaaagcacctgccg

SEQ ID NO: 4378111 - DNA, 19 bp, Homo sapiens
cagaaaagcacctgccgac

SEQ ID NO: 4378112 - DNA, 12 bp, Homo sapiens
cagaaaataagg

SEQ ID NO: 4378113 - DNA, 16 bp, Homo sapiens
cagaaaatgcaatgac

SEQ ID NO: 4378114 - DNA, 23 bp, Homo sapiens
cagaaaatgttgagaatcccaaa

SEQ ID NO: 4378115 - DNA, 14 bp, Homo sapiens
cagaaaattctgtg

SEQ ID NO: 4378116 - DNA, 15 bp, Homo sapiens
cagaaaattctgtgc

SEQ ID NO: 4378117 - DNA, 14 bp, Homo sapiens
cagaaacagggaca

SEQ ID NO: 4378118 - DNA, 18 bp, Homo sapiens
cagaaaccagaaaagcaa

SEQ ID NO: 4378119 - DNA, 20 bp, Homo sapiens
cagaaacttgtgaagtggaa

SEQ ID NO: 4378120 - DNA, 21 bp, Homo sapiens
cagaaagatttgatgggccac

SEQ ID NO: 4378121 - DNA, 13 bp, Homo sapiens
cagaaagcctcct

SEQ ID NO: 4378122 - DNA, 15 bp, Homo sapiens
cagaaagctgcctgg

SEQ ID NO: 4378123 - DNA, 21 bp, Homo sapiens
cagaaagcttcatccacagcc

SEQ ID NO: 4378124 - DNA, 17 bp, Homo sapiens
cagaaaggaaaaacaaa

SEQ ID NO: 4378125 - DNA, 23 bp, Homo sapiens
cagaaaggcaggtttcatttctt

SEQ ID NO: 4378126 - DNA, 17 bp, Homo sapiens
cagaaagtgggggtgga

SEQ ID NO: 4378127 - DNA, 15 bp, Homo sapiens
cagaaatagctcctc

SEQ ID NO: 4378128 - DNA, 23 bp, Homo sapiens
cagaaatcacaattttcctgtgg

SEQ ID NO: 4378129 - DNA, 22 bp, Homo sapiens
cagaaatcctctgttaatgtgg

SEQ ID NO: 4378130 - DNA, 17 bp, Homo sapiens
cagaaattattttctat

SEQ ID NO: 4378131 - DNA, 14 bp, Homo sapiens
cagaaattgtatat

SEQ ID NO: 4378132 - DNA, 16 bp, Homo sapiens
cagaaattgtatattg

SEQ ID NO: 4378133 - DNA, 19 bp, Homo sapiens
cagaaattgtatattgtaa

SEQ ID NO: 4378134 - DNA, 23 bp, Homo sapiens
cagaacagccctcggcctccgag

SEQ ID NO: 4378135 - DNA, 18 bp, Homo sapiens
cagaacatactgttctca

SEQ ID NO: 4378136 - DNA, 19 bp, Homo sapiens
cagaacatagacagaagaa

SEQ ID NO: 4378137 - DNA, 22 bp, Homo sapiens
cagaacattcgaatctctgccc

SEQ ID NO: 4378138 - DNA, 15 bp, Homo sapiens
cagaaccctgccatg

SEQ ID NO: 4378139 - DNA, 14 bp, Homo sapiens
cagaacctcttccc

SEQ ID NO: 4378140 - DNA, 15 bp, Homo sapiens
cagaacctcttcccc

SEQ ID NO: 4378141 - DNA, 16 bp, Homo sapiens
cagaacctcttcccca

SEQ ID NO: 4378142 - DNA, 18 bp, Homo sapiens
cagaacctcttccccaga

SEQ ID NO: 4378143 - DNA, 14 bp, Homo sapiens
cagaacctgagcta

SEQ ID NO: 4378144 - DNA, 21 bp, Homo sapiens
cagaacctggagggctagaac

SEQ ID NO: 4378145 - DNA, 20 bp, Homo sapiens
cagaaccttcaacccagtgg

SEQ ID NO: 4378146 - DNA, 14 bp, Homo sapiens
cagaacctttgtca

SEQ ID NO: 4378147 - DNA, 19 bp, Homo sapiens
cagaacctttgtcaacttc

SEQ ID NO: 4378148 - DNA, 18 bp, Homo sapiens
cagaacgcaccccactgg

SEQ ID NO: 4378149 - DNA, 22 bp, Homo sapiens
cagaacgcaccccactgggaga

SEQ ID NO: 4378150 - DNA, 14 bp, Homo sapiens
cagaactaaatttt

SEQ ID NO: 4378151 - DNA, 22 bp, Homo sapiens
cagaactaaatttttcatagaa

SEQ ID NO: 4378152 - DNA, 19 bp, Homo sapiens
cagaactagaatttgatta

SEQ ID NO: 4378153 - DNA, 14 bp, Homo sapiens
cagaactgcccttg

SEQ ID NO: 4378154 - DNA, 18 bp, Homo sapiens
cagaactgcccttgctgc

SEQ ID NO: 4378155 - DNA, 19 bp, Homo sapiens
cagaacttcaggtgtgact

SEQ ID NO: 4378156 - DNA, 18 bp, Homo sapiens
cagaactttgggaggcca

SEQ ID NO: 4378157 - DNA, 15 bp, Homo sapiens
cagaagaaataaata

SEQ ID NO: 4378158 - DNA, 18 bp, Homo sapiens
cagaagaatatgacagct

SEQ ID NO: 4378159 - DNA, 20 bp, Homo sapiens
cagaagaattgaacccagga

SEQ ID NO: 4378160 - DNA, 12 bp, Homo sapiens
cagaagaattta

SEQ ID NO: 4378161 - DNA, 21 bp, Homo sapiens
cagaagagaaaggactcagtg

SEQ ID NO: 4378162 - DNA, 22 bp, Homo sapiens
cagaagagaaaggactcagtgt

SEQ ID NO: 4378163 - DNA, 19 bp, Homo sapiens
cagaagaggttgggcttcc

SEQ ID NO: 4378164 - DNA, 17 bp, Homo sapiens
cagaagatgtttaaaaa

SEQ ID NO: 4378165 - DNA, 19 bp, Homo sapiens
cagaagcaacccaaatgtt

SEQ ID NO: 4378166 - DNA, 15 bp, Homo sapiens
cagaagcaagccaga

SEQ ID NO: 4378167 - DNA, 18 bp, Homo sapiens
cagaagcaagccagacct

SEQ ID NO: 4378168 - DNA, 20 bp, Homo sapiens
cagaagcacagaatattttt

SEQ ID NO: 4378169 - DNA, 14 bp, Homo sapiens
cagaagcagaggct

SEQ ID NO: 4378170 - DNA, 15 bp, Homo sapiens
cagaagcagaggcta

SEQ ID NO: 4378171 - DNA, 15 bp, Homo sapiens
cagaagccccacagc

SEQ ID NO: 4378172 - DNA, 15 bp, Homo sapiens
cagaagcctcctgtt

SEQ ID NO: 4378173 - DNA, 13 bp, Homo sapiens
cagaagcctctgg

SEQ ID NO: 4378174 - DNA, 19 bp, Homo sapiens
cagaagcctctggctagag

SEQ ID NO: 4378175 - DNA, 13 bp, Homo sapiens
cagaagcctgatc

SEQ ID NO: 4378176 - DNA, 20 bp, Homo sapiens
cagaagccttggaaccagcc

SEQ ID NO: 4378177 - DNA, 22 bp, Homo sapiens
cagaagctatttcatttgctgt

SEQ ID NO: 4378178 - DNA, 23 bp, Homo sapiens
cagaagctatttcatttgctgtt

SEQ ID NO: 4378179 - DNA, 19 bp, Homo sapiens
cagaaggaaggatgccact

SEQ ID NO: 4378180 - DNA, 21 bp, Homo sapiens
cagaaggaatggtgcgtggct

SEQ ID NO: 4378181 - DNA, 16 bp, Homo sapiens
cagaaggagaaggaaa

SEQ ID NO: 4378182 - DNA, 18 bp, Homo sapiens
cagaaggagaaggaagga

SEQ ID NO: 4378183 - DNA, 14 bp, Homo sapiens
cagaaggccccaga

SEQ ID NO: 4378184 - DNA, 17 bp, Homo sapiens
cagaagggaattgctca

SEQ ID NO: 4378185 - DNA, 14 bp, Homo sapiens
cagaagggggtggt

SEQ ID NO: 4378186 - DNA, 16 bp, Homo sapiens
cagaagtaagcctcat

SEQ ID NO: 4378187 - DNA, 17 bp, Homo sapiens
cagaagtcatcttgcta

SEQ ID NO: 4378188 - DNA, 15 bp, Homo sapiens
cagaagtccacagga

SEQ ID NO: 4378189 - DNA, 14 bp, Homo sapiens
cagaagtccctgtt

SEQ ID NO: 4378190 - DNA, 22 bp, Homo sapiens
cagaagtctagttttataggca

SEQ ID NO: 4378191 - DNA, 13 bp, Homo sapiens
cagaagtgtgact

SEQ ID NO: 4378192 - DNA, 16 bp, Homo sapiens
cagaagttagtttgta

SEQ ID NO: 4378193 - DNA, 18 bp, Homo sapiens
cagaagttagtttgtata

SEQ ID NO: 4378194 - DNA, 22 bp, Homo sapiens
cagaataaagttgtatttcaaa

SEQ ID NO: 4378195 - DNA, 17 bp, Homo sapiens
cagaataaatccttggg

SEQ ID NO: 4378196 - DNA, 17 bp, Homo sapiens
cagaataagttattgca

SEQ ID NO: 4378197 - DNA, 20 bp, Homo sapiens
cagaataagttattgcagtt

SEQ ID NO: 4378198 - DNA, 23 bp, Homo sapiens
cagaataagttattgcagtttat

SEQ ID NO: 4378199 - DNA, 16 bp, Homo sapiens
cagaataatcctgttt

SEQ ID NO: 4378200 - DNA, 22 bp, Homo sapiens
cagaatagccacatttggaata

SEQ ID NO: 4378201 - DNA, 14 bp, Homo sapiens
cagaatagtttaca

SEQ ID NO: 4378202 - DNA, 16 bp, Homo sapiens
cagaatagtttacaca

SEQ ID NO: 4378203 - DNA, 17 bp, Homo sapiens
cagaatagtttacacac

SEQ ID NO: 4378204 - DNA, 21 bp, Homo sapiens
cagaatagtttacacactgtg

SEQ ID NO: 4378205 - DNA, 19 bp, Homo sapiens
cagaatatgttgctttgaa

SEQ ID NO: 4378206 - DNA, 17 bp, Homo sapiens
cagaatattaaatatta

SEQ ID NO: 4378207 - DNA, 19 bp, Homo sapiens
cagaatattaaatattata

SEQ ID NO: 4378208 - DNA, 20 bp, Homo sapiens
cagaatattaaatattataa

SEQ ID NO: 4378209 - DNA, 22 bp, Homo sapiens
cagaatattgctaggttttgct

SEQ ID NO: 4378210 - DNA, 22 bp, Homo sapiens
cagaatatttttatatttcctt

SEQ ID NO: 4378211 - DNA, 16 bp, Homo sapiens
cagaatctagagcaaa

SEQ ID NO: 4378212 - DNA, 16 bp, Homo sapiens
cagaatctgaatgtaa

SEQ ID NO: 4378213 - DNA, 13 bp, Homo sapiens
cagaatcttgttt

SEQ ID NO: 4378214 - DNA, 17 bp, Homo sapiens
cagaatcttgttttgaa

SEQ ID NO: 4378215 - DNA, 19 bp, Homo sapiens
cagaatcttgttttgaaaa

SEQ ID NO: 4378216 - DNA, 12 bp, Homo sapiens
cagaatgaatct

SEQ ID NO: 4378217 - DNA, 21 bp, Homo sapiens
cagaatgagacatccagcaga

SEQ ID NO: 4378218 - DNA, 16 bp, Homo sapiens
cagagcaaacagaaaa

SEQ ID NO: 4378219 - DNA, 20 bp, Homo sapiens
cagagcaagtcctcactctt

SEQ ID NO: 4378220 - DNA, 13 bp, Homo sapiens
cagagcaccccct

SEQ ID NO: 4378221 - DNA, 16 bp, Homo sapiens
cagagcaccccctgct

SEQ ID NO: 4378222 - DNA, 23 bp, Homo sapiens
cagagcactttaaaaacaggcca

SEQ ID NO: 4378223 - DNA, 17 bp, Homo sapiens
cagagcaggggctccag

SEQ ID NO: 4378224 - DNA, 18 bp, Homo sapiens
cagagcataaaacctaaa

SEQ ID NO: 4378225 - DNA, 15 bp, Homo sapiens
cagagcatctgcccc

SEQ ID NO: 4378226 - DNA, 21 bp, Homo sapiens
cagagcatctgccccaggtac

SEQ ID NO: 4378227 - DNA, 12 bp, Homo sapiens
cagagccactct

SEQ ID NO: 4378228 - DNA, 22 bp, Homo sapiens
cagagccactctatgagttgga

SEQ ID NO: 4378229 - DNA, 13 bp, Homo sapiens
cagagccagcctg

SEQ ID NO: 4378230 - DNA, 16 bp, Homo sapiens
cagagccagcggctcc

SEQ ID NO: 4378231 - DNA, 14 bp, Homo sapiens
cagagccagggcag

SEQ ID NO: 4378232 - DNA, 21 bp, Homo sapiens
cagagcccaaggtcagggagg

SEQ ID NO: 4378233 - DNA, 17 bp, Homo sapiens
cagagcccagcccagga

SEQ ID NO: 4378234 - DNA, 19 bp, Homo sapiens
cagagccccaagcaggacg

SEQ ID NO: 4378235 - DNA, 16 bp, Homo sapiens
cagagccccacagccc

SEQ ID NO: 4378236 - DNA, 19 bp, Homo sapiens
cagagcctcccaaggagaa

SEQ ID NO: 4378237 - DNA, 14 bp, Homo sapiens
cagagcctctggcc

SEQ ID NO: 4378238 - DNA, 21 bp, Homo sapiens
cagagcctgacgctcagcccc

SEQ ID NO: 4378239 - DNA, 15 bp, Homo sapiens
cagagcctggcccca

SEQ ID NO: 4378240 - DNA, 16 bp, Homo sapiens
cagagcctggccccag

SEQ ID NO: 4378241 - DNA, 19 bp, Homo sapiens
cagagcctggggtgttctc

SEQ ID NO: 4378242 - DNA, 21 bp, Homo sapiens
cagagccttcaagtgccaaac

SEQ ID NO: 4378243 - DNA, 16 bp, Homo sapiens
cagagccttctcagaa

SEQ ID NO: 4378244 - DNA, 16 bp, Homo sapiens
cagagcgagactccat

SEQ ID NO: 4378245 - DNA, 13 bp, Homo sapiens
cagagcgcacagg

SEQ ID NO: 4378246 - DNA, 13 bp, Homo sapiens
cagagcgccagga

SEQ ID NO: 4378247 - DNA, 18 bp, Homo sapiens
cagagcgccaggaagcca

SEQ ID NO: 4378248 - DNA, 21 bp, Homo sapiens
cagagcgtccttggctgccgt

SEQ ID NO: 4378249 - DNA, 23 bp, Homo sapiens
cagagctcccccgtggtgcctgc

SEQ ID NO: 4378250 - DNA, 12 bp, Homo sapiens
cagagctgaccc

SEQ ID NO: 4378251 - DNA, 21 bp, Homo sapiens
cagagctggcatctatctggt

SEQ ID NO: 4378252 - DNA, 11 bp, Homo sapiens
cagagctgggc

SEQ ID NO: 4378253 - DNA, 18 bp, Homo sapiens
cagagcttgttgtctcca

SEQ ID NO: 4378254 - DNA, 21 bp, Homo sapiens
cagaggaaagggctggctccc

SEQ ID NO: 4378255 - DNA, 21 bp, Homo sapiens
cagaggaaggggccagaggct

SEQ ID NO: 4378256 - DNA, 21 bp, Homo sapiens
cagaggacagtctggagaagg

SEQ ID NO: 4378257 - DNA, 20 bp, Homo sapiens
cagaggacctgtatttaagc

SEQ ID NO: 4378258 - DNA, 22 bp, Homo sapiens
cagaggacctgtatttaagcaa

SEQ ID NO: 4378259 - DNA, 13 bp, Homo sapiens
cagaggagcagac

SEQ ID NO: 4378260 - DNA, 19 bp, Homo sapiens
cagaggagcagaccagcac

SEQ ID NO: 4378261 - DNA, 20 bp, Homo sapiens
cagaggagccaccagttctc

SEQ ID NO: 4378262 - DNA, 14 bp, Homo sapiens
cagaggagggcaga

SEQ ID NO: 4378263 - DNA, 15 bp, Homo sapiens
cagaggagggcagag

SEQ ID NO: 4378264 - DNA, 16 bp, Homo sapiens
cagaggaggggaaagt

SEQ ID NO: 4378265 - DNA, 23 bp, Homo sapiens
cagaggagtaaataattggaaaa

SEQ ID NO: 4378266 - DNA, 16 bp, Homo sapiens
cagaggagtgcagcct

SEQ ID NO: 4378267 - DNA, 20 bp, Homo sapiens
cagaggagtgcagccttctc

SEQ ID NO: 4378268 - DNA, 22 bp, Homo sapiens
cagaggagtgcagccttctcca

SEQ ID NO: 4378269 - DNA, 21 bp, Homo sapiens
cagaggcagcccgcacacctg

SEQ ID NO: 4378270 - DNA, 21 bp, Homo sapiens
cagaggcaggctgggacggac

SEQ ID NO: 4378271 - DNA, 14 bp, Homo sapiens
cagaggccagaccc

SEQ ID NO: 4378272 - DNA, 14 bp, Homo sapiens
cagaggccccacct

SEQ ID NO: 4378273 - DNA, 16 bp, Homo sapiens
cagaggccccacctga

SEQ ID NO: 4378274 - DNA, 20 bp, Homo sapiens
cagaggccctcgctgccagc

SEQ ID NO: 4378275 - DNA, 14 bp, Homo sapiens
cagaggccctgccc

SEQ ID NO: 4378276 - DNA, 16 bp, Homo sapiens
cagaggccctgccccc

SEQ ID NO: 4378277 - DNA, 14 bp, Homo sapiens
cagaggcctgcccg

SEQ ID NO: 4378278 - DNA, 17 bp, Homo sapiens
cagaggcctgctgccag

SEQ ID NO: 4378279 - DNA, 23 bp, Homo sapiens
cagaggcctgctgccagtgcagc

SEQ ID NO: 4378280 - DNA, 21 bp, Homo sapiens
cagaggctgcacccctgggcc

SEQ ID NO: 4378281 - DNA, 22 bp, Homo sapiens
cagaggctgcacccctgggcca

SEQ ID NO: 4378282 - DNA, 13 bp, Homo sapiens
cagaggctggagg

SEQ ID NO: 4378283 - DNA, 16 bp, Homo sapiens
cagaggcttcttcaga

SEQ ID NO: 4378284 - DNA, 21 bp, Homo sapiens
cagagggaagccagtcagggc

SEQ ID NO: 4378285 - DNA, 23 bp, Homo sapiens
cagagggaccaaattgcttctag

SEQ ID NO: 4378286 - DNA, 20 bp, Homo sapiens
cagagggcacatgaacagct

SEQ ID NO: 4378287 - DNA, 24 bp, Homo sapiens
cagagggcacatgaacagcttgcc

SEQ ID NO: 4378288 - DNA, 12 bp, Homo sapiens
cagagggctgga

SEQ ID NO: 4378289 - DNA, 15 bp, Homo sapiens
cagagggctggaggc

SEQ ID NO: 4378290 - DNA, 19 bp, Homo sapiens
cagagggggagtagccaag

SEQ ID NO: 4378291 - DNA, 20 bp, Homo sapiens
cagagggggagtagccaagc

SEQ ID NO: 4378292 - DNA, 17 bp, Homo sapiens
cagagggtgtcctgcac

SEQ ID NO: 4378293 - DNA, 15 bp, Homo sapiens
cagagggtgtggctt

SEQ ID NO: 4378294 - DNA, 15 bp, Homo sapiens
cagaggtccaggtcc

SEQ ID NO: 4378295 - DNA, 21 bp, Homo sapiens
cagaggtccaggtcccagccc

SEQ ID NO: 4378296 - DNA, 17 bp, Homo sapiens
cagaggtctagattaat

SEQ ID NO: 4378297 - DNA, 21 bp, Homo sapiens
cagaggttgtagtgagccaag

SEQ ID NO: 4378298 - DNA, 22 bp, Homo sapiens
cagaggttgtagtgagccaaga

SEQ ID NO: 4378299 - DNA, 19 bp, Homo sapiens
cagagtcagaggagaagag

SEQ ID NO: 4378300 - DNA, 15 bp, Homo sapiens
cagagtccactgtgg

SEQ ID NO: 4378301 - DNA, 12 bp, Homo sapiens
cagagtccagtg

SEQ ID NO: 4378302 - DNA, 14 bp, Homo sapiens
cagagtccagtgct

SEQ ID NO: 4378303 - DNA, 17 bp, Homo sapiens
cagagtccagtgctctg

SEQ ID NO: 4378304 - DNA, 18 bp, Homo sapiens
cagagtccagtgctctgc

SEQ ID NO: 4378305 - DNA, 21 bp, Homo sapiens
cagagtccagtgctctgcctc

SEQ ID NO: 4378306 - DNA, 20 bp, Homo sapiens
cagagtctggtgaagctcac

SEQ ID NO: 4378307 - DNA, 18 bp, Homo sapiens
cagagtgagaccctgtct

SEQ ID NO: 4378308 - DNA, 16 bp, Homo sapiens
cagagtgagactccat

SEQ ID NO: 4378309 - DNA, 16 bp, Homo sapiens
cagagtgctggactgt

SEQ ID NO: 4378310 - DNA, 17 bp, Homo sapiens
cagagtggagtctgagt

SEQ ID NO: 4378311 - DNA, 14 bp, Homo sapiens
cagagtggcccacc

SEQ ID NO: 4378312 - DNA, 16 bp, Homo sapiens
cagagtggcctccctg

SEQ ID NO: 4378313 - DNA, 19 bp, Homo sapiens
cagagtggcctccctgctg

SEQ ID NO: 4378314 - DNA, 15 bp, Homo sapiens
cagagtggcctggcc

SEQ ID NO: 4378315 - DNA, 21 bp, Homo sapiens
cagagtggcctggccaggagc

SEQ ID NO: 4378316 - DNA, 22 bp, Homo sapiens
cagagtggcctggccaggagct

SEQ ID NO: 4378317 - DNA, 20 bp, Homo sapiens
cagagtgtgggaagggagag

SEQ ID NO: 4378318 - DNA, 12 bp, Homo sapiens
cagagttacagt

SEQ ID NO: 4378319 - DNA, 14 bp, Homo sapiens
cagagttacagttc

SEQ ID NO: 4378320 - DNA, 16 bp, Homo sapiens
cagagttacagttctg

SEQ ID NO: 4378321 - DNA, 17 bp, Homo sapiens
cagagttacagttctgt

SEQ ID NO: 4378322 - DNA, 21 bp, Homo sapiens
cagagttgttgtttgccaagc

SEQ ID NO: 4378323 - DNA, 13 bp, Homo sapiens
cagataaaatatt

SEQ ID NO: 4378324 - DNA, 20 bp, Homo sapiens
cagataacttttttgagtca

SEQ ID NO: 4378325 - DNA, 21 bp, Homo sapiens
cagataacttttttgagtcat

SEQ ID NO: 4378326 - DNA, 23 bp, Homo sapiens
cagataacttttttgagtcattg

SEQ ID NO: 4378327 - DNA, 17 bp, Homo sapiens
cagataccttgaaagga

SEQ ID NO: 4378328 - DNA, 19 bp, Homo sapiens
cagataccttgaaaggaag

SEQ ID NO: 4378329 - DNA, 15 bp, Homo sapiens
cagatacttcagctt

SEQ ID NO: 4378330 - DNA, 18 bp, Homo sapiens
cagatagtgtagctgagg

SEQ ID NO: 4378331 - DNA, 20 bp, Homo sapiens
cagatagtgtagctgaggag

SEQ ID NO: 4378332 - DNA, 13 bp, Homo sapiens
cagatataactgt

SEQ ID NO: 4378333 - DNA, 19 bp, Homo sapiens
cagatatatacacacagtg

SEQ ID NO: 4378334 - DNA, 20 bp, Homo sapiens
cagatattgttataaataaa

SEQ ID NO: 4378335 - DNA, 15 bp, Homo sapiens
cagatatttgtcatg

SEQ ID NO: 4378336 - DNA, 20 bp, Homo sapiens
cagatcatctggggacctgg

SEQ ID NO: 4378337 - DNA, 23 bp, Homo sapiens
cagatcattatcagcctgtgcca

SEQ ID NO: 4378338 - DNA, 20 bp, Homo sapiens
cagatcccaggcccctggag

SEQ ID NO: 4378339 - DNA, 14 bp, Homo sapiens
cagatccccagccc

SEQ ID NO: 4378340 - DNA, 16 bp, Homo sapiens
cagatccccagcccct

SEQ ID NO: 4378341 - DNA, 23 bp, Homo sapiens
cagatccccagcccctcctccct

SEQ ID NO: 4378342 - DNA, 14 bp, Homo sapiens
cagatcctctctgg

SEQ ID NO: 4378343 - DNA, 13 bp, Homo sapiens
cagatcctcttgg

SEQ ID NO: 4378344 - DNA, 21 bp, Homo sapiens
cagatcctgttacttgcttca

SEQ ID NO: 4378345 - DNA, 17 bp, Homo sapiens
cagatcctttgaaaaga

SEQ ID NO: 4378346 - DNA, 20 bp, Homo sapiens
cagatctatatggcaaatag

SEQ ID NO: 4378347 - DNA, 17 bp, Homo sapiens
cagatctggtcccttgc

SEQ ID NO: 4378348 - DNA, 14 bp, Homo sapiens
cagatctgtgcccc

SEQ ID NO: 4378349 - DNA, 15 bp, Homo sapiens
cagatctgtgcccca

SEQ ID NO: 4378350 - DNA, 23 bp, Homo sapiens
cagatctgtgccccatgcctgtc

SEQ ID NO: 4378351 - DNA, 23 bp, Homo sapiens
cagatctgttttgtggtttggaa

SEQ ID NO: 4378352 - DNA, 15 bp, Homo sapiens
cagatcttaatataa

SEQ ID NO: 4378353 - DNA, 21 bp, Homo sapiens
cagatcttccgtggtcagagt

SEQ ID NO: 4378354 - DNA, 18 bp, Homo sapiens
cagatctttctccttgaa

SEQ ID NO: 4378355 - DNA, 19 bp, Homo sapiens
cagatcttttttttttccc

SEQ ID NO: 4378356 - DNA, 14 bp, Homo sapiens
cagatgaataaact

SEQ ID NO: 4378357 - DNA, 14 bp, Homo sapiens
cagatgagcaggag

SEQ ID NO: 4378358 - DNA, 15 bp, Homo sapiens
cagatgagcaggagc

SEQ ID NO: 4378359 - DNA, 15 bp, Homo sapiens
cagatgaggacagag

SEQ ID NO: 4378360 - DNA, 17 bp, Homo sapiens
cagatgaggatccgaaa

SEQ ID NO: 4378361 - DNA, 22 bp, Homo sapiens
cagatgaggatccgaaacggca

SEQ ID NO: 4378362 - DNA, 14 bp, Homo sapiens
cagatgagtcacac

SEQ ID NO: 4378363 - DNA, 13 bp, Homo sapiens
cagatgatgccag

SEQ ID NO: 4378364 - DNA, 16 bp, Homo sapiens
cagatgatttcccccc

SEQ ID NO: 4378365 - DNA, 13 bp, Homo sapiens
cagatgcaacctc

SEQ ID NO: 4378366 - DNA, 19 bp, Homo sapiens
cagatgcaattgctcccat

SEQ ID NO: 4378367 - DNA, 13 bp, Homo sapiens
cagatgccccaga

SEQ ID NO: 4378368 - DNA, 18 bp, Homo sapiens
cagatgcccgagggaggg

SEQ ID NO: 4378369 - DNA, 18 bp, Homo sapiens
cagatgcctggtgagcag

SEQ ID NO: 4378370 - DNA, 19 bp, Homo sapiens
cagatgcctggtgagcagg

SEQ ID NO: 4378371 - DNA, 14 bp, Homo sapiens
cagatgctggtgga

SEQ ID NO: 4378372 - DNA, 15 bp, Homo sapiens
cagatgctggtggag

SEQ ID NO: 4378373 - DNA, 16 bp, Homo sapiens
cagatgctggtggagg

SEQ ID NO: 4378374 - DNA, 23 bp, Homo sapiens
cagatgcttgcggcaaaaggaaa

SEQ ID NO: 4378375 - DNA, 17 bp, Homo sapiens
cagatggaaaaataaca

SEQ ID NO: 4378376 - DNA, 18 bp, Homo sapiens
cagatggactccagcctg

SEQ ID NO: 4378377 - DNA, 22 bp, Homo sapiens
cagatggcccctccactgggga

SEQ ID NO: 4378378 - DNA, 23 bp, Homo sapiens
cagatgggcaaaccctggtgctt

SEQ ID NO: 4378379 - DNA, 15 bp, Homo sapiens
cagatgtaatgtttt

SEQ ID NO: 4378380 - DNA, 22 bp, Homo sapiens
cagatgtaatgttttctttgca

SEQ ID NO: 4378381 - DNA, 15 bp, Homo sapiens
cagatgtacatagag

SEQ ID NO: 4378382 - DNA, 14 bp, Homo sapiens
cagatgtcttccct

SEQ ID NO: 4378383 - DNA, 20 bp, Homo sapiens
cagatgtcttccctgggctg

SEQ ID NO: 4378384 - DNA, 15 bp, Homo sapiens
cagatgtcttctgcc

SEQ ID NO: 4378385 - DNA, 22 bp, Homo sapiens
cagatgtggggagggtgtctgg

SEQ ID NO: 4378386 - DNA, 20 bp, Homo sapiens
cagatgtgtcccccccaggc

SEQ ID NO: 4378387 - DNA, 15 bp, Homo sapiens
cagatgttaaaataa

SEQ ID NO: 4378388 - DNA, 18 bp, Homo sapiens
cagatgttaaaataaatg

SEQ ID NO: 4378389 - DNA, 23 bp, Homo sapiens
cagatgttgggaggatacagagg

SEQ ID NO: 4378390 - DNA, 21 bp, Homo sapiens
cagatgtttcatcaatgcagt

SEQ ID NO: 4378391 - DNA, 16 bp, Homo sapiens
cagattaaattacagc

SEQ ID NO: 4378392 - DNA, 18 bp, Homo sapiens
cagattaaattacagctt

SEQ ID NO: 4378393 - DNA, 22 bp, Homo sapiens
cagattaaattacagcttttat

SEQ ID NO: 4378394 - DNA, 19 bp, Homo sapiens
cagattacaggaatgaaga

SEQ ID NO: 4378395 - DNA, 18 bp, Homo sapiens
cagattagttctttttgc

SEQ ID NO: 4378396 - DNA, 17 bp, Homo sapiens
cagattcaggccagccc

SEQ ID NO: 4378397 - DNA, 22 bp, Homo sapiens
cagattcaggccagcccagcca

SEQ ID NO: 4378398 - DNA, 22 bp, Homo sapiens
cagattcagggagaatgttgtt

SEQ ID NO: 4378399 - DNA, 20 bp, Homo sapiens
cagattcctttccctttagc

SEQ ID NO: 4378400 - DNA, 15 bp, Homo sapiens
cagattctgcctctc

SEQ ID NO: 4378401 - DNA, 13 bp, Homo sapiens
cagattgaactta

SEQ ID NO: 4378402 - DNA, 17 bp, Homo sapiens
cagattgtggaatgttg

SEQ ID NO: 4378403 - DNA, 20 bp, Homo sapiens
cagattgtggaatgttggat

SEQ ID NO: 4378404 - DNA, 17 bp, Homo sapiens
cagatttactaaatcaa

SEQ ID NO: 4378405 - DNA, 22 bp, Homo sapiens
cagatttagtgaaagctagaga

SEQ ID NO: 4378406 - DNA, 24 bp, Homo sapiens
cagatttgtctttttgttgtaaaa

SEQ ID NO: 4378407 - DNA, 13 bp, Homo sapiens
cagattttaaatt

SEQ ID NO: 4378408 - DNA, 15 bp, Homo sapiens
cagattttaaatttt

SEQ ID NO: 4378409 - DNA, 19 bp, Homo sapiens
cagattttcagcaaactct

SEQ ID NO: 4378410 - DNA, 12 bp, Homo sapiens
cagattttgata

SEQ ID NO: 4378411 - DNA, 15 bp, Homo sapiens
cagattttgataact

SEQ ID NO: 4378412 - DNA, 23 bp, Homo sapiens
cagattttgttggcatagctctg

SEQ ID NO: 4378413 - DNA, 23 bp, Homo sapiens
cagatttttatattagttgcttt

SEQ ID NO: 4378414 - DNA, 16 bp, Homo sapiens
cagatttttatttatg

SEQ ID NO: 4378415 - DNA, 17 bp, Homo sapiens
cagatttttatttatga

SEQ ID NO: 4378416 - DNA, 16 bp, Homo sapiens
cagattttttaaaatt

SEQ ID NO: 4378417 - DNA, 13 bp, Homo sapiens
cagcaaaagacca

SEQ ID NO: 4378418 - DNA, 14 bp, Homo sapiens
cagcaaacaaataa

SEQ ID NO: 4378419 - DNA, 14 bp, Homo sapiens
cagcaaagtggttc

SEQ ID NO: 4378420 - DNA, 12 bp, Homo sapiens
cagcaaatatat

SEQ ID NO: 4378421 - DNA, 16 bp, Homo sapiens
cagcaaatgggcattt

SEQ ID NO: 4378422 - DNA, 13 bp, Homo sapiens
cagcaaattttca

SEQ ID NO: 4378423 - DNA, 21 bp, Homo sapiens
cagcaacccttcctgctgctg

SEQ ID NO: 4378424 - DNA, 11 bp, Homo sapiens
cagcaactccc

SEQ ID NO: 4378425 - DNA, 12 bp, Homo sapiens
cagcaactccca

SEQ ID NO: 4378426 - DNA, 13 bp, Homo sapiens
cagcaactgaaaa

SEQ ID NO: 4378427 - DNA, 17 bp, Homo sapiens
cagcaactgaaaatgaa

SEQ ID NO: 4378428 - DNA, 14 bp, Homo sapiens
cagcaagaaaaggg

SEQ ID NO: 4378429 - DNA, 16 bp, Homo sapiens
cagcaagatgtttctt

SEQ ID NO: 4378430 - DNA, 17 bp, Homo sapiens
cagcaagatgtttcttg

SEQ ID NO: 4378431 - DNA, 22 bp, Homo sapiens
cagcaagatgtttcttgccttt

SEQ ID NO: 4378432 - DNA, 14 bp, Homo sapiens
cagcaagcgggagc

SEQ ID NO: 4378433 - DNA, 20 bp, Homo sapiens
cagcaagcgggagcccgtgg

SEQ ID NO: 4378434 - DNA, 23 bp, Homo sapiens
cagcaagggtgatgggaaagcat

SEQ ID NO: 4378435 - DNA, 17 bp, Homo sapiens
cagcaagtacagcggct

SEQ ID NO: 4378436 - DNA, 19 bp, Homo sapiens
cagcaagtacagcggctcc

SEQ ID NO: 4378437 - DNA, 15 bp, Homo sapiens
cagcaagttcataca

SEQ ID NO: 4378438 - DNA, 14 bp, Homo sapiens
cagcacaaaaggca

SEQ ID NO: 4378439 - DNA, 15 bp, Homo sapiens
cagcacaaaaggcag

SEQ ID NO: 4378440 - DNA, 22 bp, Homo sapiens
cagcacagcttagatttcatag

SEQ ID NO: 4378441 - DNA, 18 bp, Homo sapiens
cagcacatatttgcatgg

SEQ ID NO: 4378442 - DNA, 23 bp, Homo sapiens
cagcacatatttgcatgggaggg

SEQ ID NO: 4378443 - DNA, 22 bp, Homo sapiens
cagcacattaacttctggactg

SEQ ID NO: 4378444 - DNA, 16 bp, Homo sapiens
cagcaccaccatttaa

SEQ ID NO: 4378445 - DNA, 13 bp, Homo sapiens
cagcaccacccta

SEQ ID NO: 4378446 - DNA, 13 bp, Homo sapiens
cagcaccctaaga

SEQ ID NO: 4378447 - DNA, 16 bp, Homo sapiens
cagcaccctataaatc

SEQ ID NO: 4378448 - DNA, 11 bp, Homo sapiens
cagcaccctcc

SEQ ID NO: 4378449 - DNA, 18 bp, Homo sapiens
cagcaccctcccccgcag

SEQ ID NO: 4378450 - DNA, 19 bp, Homo sapiens
cagcaccctcccccgcagc

SEQ ID NO: 4378451 - DNA, 15 bp, Homo sapiens
cagcacctacagtgt

SEQ ID NO: 4378452 - DNA, 20 bp, Homo sapiens
cagcacctacagtgtacagt

SEQ ID NO: 4378453 - DNA, 17 bp, Homo sapiens
cagcaccttctttctgg

SEQ ID NO: 4378454 - DNA, 22 bp, Homo sapiens
cagcccaccctcctgtcttccc

SEQ ID NO: 4378455 - DNA, 12 bp, Homo sapiens
cagcccagagcc

SEQ ID NO: 4378456 - DNA, 14 bp, Homo sapiens
cagcccagccaggc

SEQ ID NO: 4378457 - DNA, 17 bp, Homo sapiens
cagcccagcccagctgg

SEQ ID NO: 4378458 - DNA, 20 bp, Homo sapiens
cagcccaggatactggcaca

SEQ ID NO: 4378459 - DNA, 17 bp, Homo sapiens
cagcccagttcccgtga

SEQ ID NO: 4378460 - DNA, 21 bp, Homo sapiens
cagcccatgcccacctgccca

SEQ ID NO: 4378461 - DNA, 17 bp, Homo sapiens
cagcccatggcccccaa

SEQ ID NO: 4378462 - DNA, 22 bp, Homo sapiens
cagcccatggcccccaataaag

SEQ ID NO: 4378463 - DNA, 18 bp, Homo sapiens
cagcccattctctctcct

SEQ ID NO: 4378464 - DNA, 23 bp, Homo sapiens
cagccccaactccaggggcacct

SEQ ID NO: 4378465 - DNA, 14 bp, Homo sapiens
cagccccacccagg

SEQ ID NO: 4378466 - DNA, 21 bp, Homo sapiens
cagccccacccaggagggagg

SEQ ID NO: 4378467 - DNA, 22 bp, Homo sapiens
cagccccacccaggagggaggg

SEQ ID NO: 4378468 - DNA, 19 bp, Homo sapiens
cagccccacttcaccccca

SEQ ID NO: 4378469 - DNA, 20 bp, Homo sapiens
cagcccccacagtgctgtct

SEQ ID NO: 4378470 - DNA, 16 bp, Homo sapiens
cagccccccagcacta

SEQ ID NO: 4378471 - DNA, 17 bp, Homo sapiens
cagcccccgccccagag

SEQ ID NO: 4378472 - DNA, 17 bp, Homo sapiens
cagccccctcccaccgc

SEQ ID NO: 4378473 - DNA, 19 bp, Homo sapiens
cagccccctcccaccgctg

SEQ ID NO: 4378474 - DNA, 23 bp, Homo sapiens
cagccccctcccaccgctgcctc

SEQ ID NO: 4378475 - DNA, 19 bp, Homo sapiens
cagccccgactccagccag

SEQ ID NO: 4378476 - DNA, 20 bp, Homo sapiens
cagccccgactccagccagc

SEQ ID NO: 4378477 - DNA, 21 bp, Homo sapiens
cagccccgactccagccagcg

SEQ ID NO: 4378478 - DNA, 16 bp, Homo sapiens
cagccccgcctgtcac

SEQ ID NO: 4378479 - DNA, 17 bp, Homo sapiens
cagccccgcctgtcaca

SEQ ID NO: 4378480 - DNA, 15 bp, Homo sapiens
cagccccgctcccag

SEQ ID NO: 4378481 - DNA, 17 bp, Homo sapiens
cagccccggccctgggc

SEQ ID NO: 4378482 - DNA, 22 bp, Homo sapiens
cagccccgttttggggacgtga

SEQ ID NO: 4378483 - DNA, 21 bp, Homo sapiens
cagcccctatagcactgagct

SEQ ID NO: 4378484 - DNA, 21 bp, Homo sapiens
cagcccctccccagactctca

SEQ ID NO: 4378485 - DNA, 13 bp, Homo sapiens
cagcccctcctcc

SEQ ID NO: 4378486 - DNA, 18 bp, Homo sapiens
cagcccctcctccctcag

SEQ ID NO: 4378487 - DNA, 20 bp, Homo sapiens
cagcccctcctccctcaggc

SEQ ID NO: 4378488 - DNA, 22 bp, Homo sapiens
cagcccctcctccctcaggccc

SEQ ID NO: 4378489 - DNA, 19 bp, Homo sapiens
cagcccctcctctgccacc

SEQ ID NO: 4378490 - DNA, 14 bp, Homo sapiens
cagcccctgagagc

SEQ ID NO: 4378491 - DNA, 13 bp, Homo sapiens
cagcccctggggc

SEQ ID NO: 4378492 - DNA, 17 bp, Homo sapiens
cagcccctggggcccag

SEQ ID NO: 4378493 - DNA, 20 bp, Homo sapiens
cagcccctggggcccagccc

SEQ ID NO: 4378494 - DNA, 16 bp, Homo sapiens
cagcccgcacacctgc

SEQ ID NO: 4378495 - DNA, 15 bp, Homo sapiens
cagcccggctcccac

SEQ ID NO: 4378496 - DNA, 14 bp, Homo sapiens
cagccctaaacatc

SEQ ID NO: 4378497 - DNA, 15 bp, Homo sapiens
cagccctagagcctg

SEQ ID NO: 4378498 - DNA, 16 bp, Homo sapiens
cagccctagagcctgc

SEQ ID NO: 4378499 - DNA, 20 bp, Homo sapiens
cagccctagagcctgcctgg

SEQ ID NO: 4378500 - DNA, 23 bp, Homo sapiens
cagccctagagcctgcctggagc

SEQ ID NO: 4378501 - DNA, 15 bp, Homo sapiens
cagccctagcggctg

SEQ ID NO: 4378502 - DNA, 20 bp, Homo sapiens
cagccctagcggctgctcct

SEQ ID NO: 4378503 - DNA, 21 bp, Homo sapiens
cagccctagcggctgctcctt

SEQ ID NO: 4378504 - DNA, 13 bp, Homo sapiens
cagccctcacccc

SEQ ID NO: 4378505 - DNA, 18 bp, Homo sapiens
cagccctcagttccttca

SEQ ID NO: 4378506 - DNA, 17 bp, Homo sapiens
cagccctcatcccgagc

SEQ ID NO: 4378507 - DNA, 13 bp, Homo sapiens
cagccctccctgt

SEQ ID NO: 4378508 - DNA, 21 bp, Homo sapiens
cagccctccctgtcctcctcg

SEQ ID NO: 4378509 - DNA, 18 bp, Homo sapiens
cagccctcctctgcactc

SEQ ID NO: 4378510 - DNA, 20 bp, Homo sapiens
cagccctctctctcactccc

SEQ ID NO: 4378511 - DNA, 22 bp, Homo sapiens
cagccctgattgtgccagtgca

SEQ ID NO: 4378512 - DNA, 19 bp, Homo sapiens
cagccctgctccctgcctc

SEQ ID NO: 4378513 - DNA, 23 bp, Homo sapiens
cagccctgctccctgcctcctgc

SEQ ID NO: 4378514 - DNA, 13 bp, Homo sapiens
cagccctgctggc

SEQ ID NO: 4378515 - DNA, 20 bp, Homo sapiens
cagccctgctggccgcctca

SEQ ID NO: 4378516 - DNA, 17 bp, Homo sapiens
cagccctggatggtggc

SEQ ID NO: 4378517 - DNA, 16 bp, Homo sapiens
cagccctggcccaggt

SEQ ID NO: 4378518 - DNA, 20 bp, Homo sapiens
cagccctggcccccatcagc

SEQ ID NO: 4378519 - DNA, 23 bp, Homo sapiens
cagccctggcccccatcagccct

SEQ ID NO: 4378520 - DNA, 18 bp, Homo sapiens
cagccctgggccccacca

SEQ ID NO: 4378521 - DNA, 20 bp, Homo sapiens
cagccctgggccccaccacc

SEQ ID NO: 4378522 - DNA, 12 bp, Homo sapiens
cagccctggtct

SEQ ID NO: 4378523 - DNA, 13 bp, Homo sapiens
cagcccttcatgg

SEQ ID NO: 4378524 - DNA, 17 bp, Homo sapiens
cagccgcattggtgact

SEQ ID NO: 4378525 - DNA, 18 bp, Homo sapiens
cagccgcattggtgactc

SEQ ID NO: 4378526 - DNA, 13 bp, Homo sapiens
cagccgccagctg

SEQ ID NO: 4378527 - DNA, 21 bp, Homo sapiens
cagccgccattgccaccagga

SEQ ID NO: 4378528 - DNA, 13 bp, Homo sapiens
cagccgccctggg

SEQ ID NO: 4378529 - DNA, 23 bp, Homo sapiens
cagccgcgggccaggaggctgcc

SEQ ID NO: 4378530 - DNA, 15 bp, Homo sapiens
cagccggtacctggg

SEQ ID NO: 4378531 - DNA, 15 bp, Homo sapiens
cagccgtccatagca

SEQ ID NO: 4378532 - DNA, 14 bp, Homo sapiens
cagccgtcccgcgt

SEQ ID NO: 4378533 - DNA, 19 bp, Homo sapiens
cagcctaagaaacactcat

SEQ ID NO: 4378534 - DNA, 17 bp, Homo sapiens
cagcctagcctggctct

SEQ ID NO: 4378535 - DNA, 19 bp, Homo sapiens
cagcctagcctggctctgc

SEQ ID NO: 4378536 - DNA, 23 bp, Homo sapiens
cagcctatagcagaagcacattt

SEQ ID NO: 4378537 - DNA, 23 bp, Homo sapiens
cagcctcagaaggccccagagag

SEQ ID NO: 4378538 - DNA, 19 bp, Homo sapiens
cagcctcagagatctccct

SEQ ID NO: 4378539 - DNA, 17 bp, Homo sapiens
cagcctcatactcctgg

SEQ ID NO: 4378540 - DNA, 14 bp, Homo sapiens
cagcctccagcctc

SEQ ID NO: 4378541 - DNA, 15 bp, Homo sapiens
cagcctccagcctct

SEQ ID NO: 4378542 - DNA, 18 bp, Homo sapiens
cagcctccaggcccccaa

SEQ ID NO: 4378543 - DNA, 14 bp, Homo sapiens
cagcctccagggcc

SEQ ID NO: 4378544 - DNA, 19 bp, Homo sapiens
cagcctccgagagggagag

SEQ ID NO: 4378545 - DNA, 17 bp, Homo sapiens
cagcctcctctggacgg

SEQ ID NO: 4378546 - DNA, 23 bp, Homo sapiens
cagcctcctctgtctgcccttca

SEQ ID NO: 4378547 - DNA, 22 bp, Homo sapiens
cagcctcgcggtcttgggcact

SEQ ID NO: 4378548 - DNA, 23 bp, Homo sapiens
cagcctctccactcatgtgactc

SEQ ID NO: 4378549 - DNA, 20 bp, Homo sapiens
cagcctctccccgctctgga

SEQ ID NO: 4378550 - DNA, 12 bp, Homo sapiens
cagcctctctcc

SEQ ID NO: 4378551 - DNA, 18 bp, Homo sapiens
cagcctctctcccagtct

SEQ ID NO: 4378552 - DNA, 23 bp, Homo sapiens
cagcctctctcccagtctaccca

SEQ ID NO: 4378553 - DNA, 16 bp, Homo sapiens
cagcctctctcttttc

SEQ ID NO: 4378554 - DNA, 22 bp, Homo sapiens
cagcctctgctggagaaagcca

SEQ ID NO: 4378555 - DNA, 16 bp, Homo sapiens
cagcctgagcaactct

SEQ ID NO: 4378556 - DNA, 21 bp, Homo sapiens
cagcctgagcaactcttgatt

SEQ ID NO: 4378557 - DNA, 18 bp, Homo sapiens
cagcctgagcgacagtga

SEQ ID NO: 4378558 - DNA, 19 bp, Homo sapiens
cagcctgagcgacagtgag

SEQ ID NO: 4378559 - DNA, 23 bp, Homo sapiens
cagcctgagcgacagtgagactc

SEQ ID NO: 4378560 - DNA, 15 bp, Homo sapiens
cagcctgcacctgcc

SEQ ID NO: 4378561 - DNA, 16 bp, Homo sapiens
cagcctgcacctgccc

SEQ ID NO: 4378562 - DNA, 17 bp, Homo sapiens
cagcctgcacctgcccc

SEQ ID NO: 4378563 - DNA, 20 bp, Homo sapiens
cagcctgctccttcccagga

SEQ ID NO: 4378564 - DNA, 22 bp, Homo sapiens
cagcctgctccttcccaggagt

SEQ ID NO: 4378565 - DNA, 21 bp, Homo sapiens
cagcctgctttcctgcagcag

SEQ ID NO: 4378566 - DNA, 11 bp, Homo sapiens
cagcctggatg

SEQ ID NO: 4378567 - DNA, 16 bp, Homo sapiens
cagcctggatgccatc

SEQ ID NO: 4378568 - DNA, 17 bp, Homo sapiens
cagcctggatgccatcc

SEQ ID NO: 4378569 - DNA, 23 bp, Homo sapiens
cagcctgggacagtttatcatga

SEQ ID NO: 4378570 - DNA, 21 bp, Homo sapiens
cagcctgggcagccaggctgc

SEQ ID NO: 4378571 - DNA, 12 bp, Homo sapiens
cagctgctgtgg

SEQ ID NO: 4378572 - DNA, 18 bp, Homo sapiens
cagctgctgttctcagga

SEQ ID NO: 4378573 - DNA, 21 bp, Homo sapiens
cagctgctgttctcaggacag

SEQ ID NO: 4378574 - DNA, 21 bp, Homo sapiens
cagctgcttttgcagaaatca

SEQ ID NO: 4378575 - DNA, 18 bp, Homo sapiens
cagctggaatgtgccaca

SEQ ID NO: 4378576 - DNA, 19 bp, Homo sapiens
cagctggaatgtgccacag

SEQ ID NO: 4378577 - DNA, 20 bp, Homo sapiens
cagctggaatgtgccacaga

SEQ ID NO: 4378578 - DNA, 23 bp, Homo sapiens
cagctggaatgtgccacagaggc

SEQ ID NO: 4378579 - DNA, 19 bp, Homo sapiens
cagctggaggaatacattt

SEQ ID NO: 4378580 - DNA, 20 bp, Homo sapiens
cagctggaggaatacatttt

SEQ ID NO: 4378581 - DNA, 21 bp, Homo sapiens
cagctggaggaatacatttta

SEQ ID NO: 4378582 - DNA, 14 bp, Homo sapiens
cagctggcctggtt

SEQ ID NO: 4378583 - DNA, 20 bp, Homo sapiens
cagctggcctggtttcctcg

SEQ ID NO: 4378584 - DNA, 14 bp, Homo sapiens
cagctgggcccaac

SEQ ID NO: 4378585 - DNA, 17 bp, Homo sapiens
cagctgggcccaaccct

SEQ ID NO: 4378586 - DNA, 17 bp, Homo sapiens
cagctggggccagaggc

SEQ ID NO: 4378587 - DNA, 18 bp, Homo sapiens
cagctggggccagaggct

SEQ ID NO: 4378588 - DNA, 19 bp, Homo sapiens
cagctggtgcaaattcaga

SEQ ID NO: 4378589 - DNA, 20 bp, Homo sapiens
cagctggtgggaagcgtctg

SEQ ID NO: 4378590 - DNA, 22 bp, Homo sapiens
cagctggtgggaagcgtctgtc

SEQ ID NO: 4378591 - DNA, 14 bp, Homo sapiens
cagctgtatagctg

SEQ ID NO: 4378592 - DNA, 17 bp, Homo sapiens
cagctgtatttatataa

SEQ ID NO: 4378593 - DNA, 13 bp, Homo sapiens
cagctgtccctgt

SEQ ID NO: 4378594 - DNA, 15 bp, Homo sapiens
cagctgtccctgtca

SEQ ID NO: 4378595 - DNA, 17 bp, Homo sapiens
cagctgtccctgtcacc

SEQ ID NO: 4378596 - DNA, 18 bp, Homo sapiens
cagctgtccctgtcacca

SEQ ID NO: 4378597 - DNA, 22 bp, Homo sapiens
cagctgtccctgtcaccaagct

SEQ ID NO: 4378598 - DNA, 15 bp, Homo sapiens
cagctgtcctgtgat

SEQ ID NO: 4378599 - DNA, 18 bp, Homo sapiens
cagctgtgggcggctcct

SEQ ID NO: 4378600 - DNA, 19 bp, Homo sapiens
cagctgtgggcggctcctg

SEQ ID NO: 4378601 - DNA, 19 bp, Homo sapiens
cagcttaaacccatacaat

SEQ ID NO: 4378602 - DNA, 16 bp, Homo sapiens
cagcttagatttcata

SEQ ID NO: 4378603 - DNA, 19 bp, Homo sapiens
cagcttagatttcatagtt

SEQ ID NO: 4378604 - DNA, 17 bp, Homo sapiens
cagcttattcacaagac

SEQ ID NO: 4378605 - DNA, 18 bp, Homo sapiens
cagcttcaacttttctct

SEQ ID NO: 4378606 - DNA, 20 bp, Homo sapiens
cagcttcacccaccaggcca

SEQ ID NO: 4378607 - DNA, 14 bp, Homo sapiens
cagcttcctaccca

SEQ ID NO: 4378608 - DNA, 21 bp, Homo sapiens
cagcttcctgtctgtttatat

SEQ ID NO: 4378609 - DNA, 18 bp, Homo sapiens
cagcttcgaggacaggaa

SEQ ID NO: 4378610 - DNA, 19 bp, Homo sapiens
cagcttctcccaagcccac

SEQ ID NO: 4378611 - DNA, 12 bp, Homo sapiens
cagcttctctgc

SEQ ID NO: 4378612 - DNA, 13 bp, Homo sapiens
cagcttctctgca

SEQ ID NO: 4378613 - DNA, 15 bp, Homo sapiens
cagcttctctgcagt

SEQ ID NO: 4378614 - DNA, 18 bp, Homo sapiens
cagcttgaaactgagatg

SEQ ID NO: 4378615 - DNA, 22 bp, Homo sapiens
cagcttgagccgggcccctggg

SEQ ID NO: 4378616 - DNA, 17 bp, Homo sapiens
cagcttggccctttcct

SEQ ID NO: 4378617 - DNA, 18 bp, Homo sapiens
cagcttgtggagccccac

SEQ ID NO: 4378618 - DNA, 17 bp, Homo sapiens
cagctttcaaaggacaa

SEQ ID NO: 4378619 - DNA, 23 bp, Homo sapiens
cagctttcctcaaaacttcagac

SEQ ID NO: 4378620 - DNA, 19 bp, Homo sapiens
cagctttgacgtattatct

SEQ ID NO: 4378621 - DNA, 16 bp, Homo sapiens
cagcttttaaccatct

SEQ ID NO: 4378622 - DNA, 21 bp, Homo sapiens
cagcttttcttattccttttt

SEQ ID NO: 4378623 - DNA, 23 bp, Homo sapiens
cagcttttcttattcctttttat

SEQ ID NO: 4378624 - DNA, 18 bp, Homo sapiens
cagcttttgttgtttata

SEQ ID NO: 4378625 - DNA, 18 bp, Homo sapiens
cagctttttattccctgc

SEQ ID NO: 4378626 - DNA, 21 bp, Homo sapiens
cagctttttattccctgccca

SEQ ID NO: 4378627 - DNA, 14 bp, Homo sapiens
cagcttttttcctg

SEQ ID NO: 4378628 - DNA, 15 bp, Homo sapiens
cagctttttttgtaa

SEQ ID NO: 4378629 - DNA, 15 bp, Homo sapiens
caggaaaaaaacttt

SEQ ID NO: 4378630 - DNA, 16 bp, Homo sapiens
caggaaaaaaactttt

SEQ ID NO: 4378631 - DNA, 18 bp, Homo sapiens
caggaaaaaaacttttat

SEQ ID NO: 4378632 - DNA, 20 bp, Homo sapiens
caggaaaactgacagaggag

SEQ ID NO: 4378633 - DNA, 21 bp, Homo sapiens
caggaaaaggctaagaaaaag

SEQ ID NO: 4378634 - DNA, 23 bp, Homo sapiens
caggaaaaggctaagaaaaagga

SEQ ID NO: 4378635 - DNA, 17 bp, Homo sapiens
caggaaaattgaatgca

SEQ ID NO: 4378636 - DNA, 21 bp, Homo sapiens
caggaaactccacatctgcct

SEQ ID NO: 4378637 - DNA, 18 bp, Homo sapiens
caggaaactcctgtgacc

SEQ ID NO: 4378638 - DNA, 12 bp, Homo sapiens
caggaaagaata

SEQ ID NO: 4378639 - DNA, 23 bp, Homo sapiens
caggaaagagcagtcagagtcca

SEQ ID NO: 4378640 - DNA, 19 bp, Homo sapiens
caggaaagcatgcattgaa

SEQ ID NO: 4378641 - DNA, 14 bp, Homo sapiens
caggaaagccctcc

SEQ ID NO: 4378642 - DNA, 19 bp, Homo sapiens
caggaaagccctccccctt

SEQ ID NO: 4378643 - DNA, 23 bp, Homo sapiens
caggaaagccctcccccttcccc

SEQ ID NO: 4378644 - DNA, 15 bp, Homo sapiens
caggaaaggaatcat

SEQ ID NO: 4378645 - DNA, 22 bp, Homo sapiens
caggaaatcaaatatgcaaagc

SEQ ID NO: 4378646 - DNA, 21 bp, Homo sapiens
caggaaatgaaaatgtcttgt

SEQ ID NO: 4378647 - DNA, 14 bp, Homo sapiens
caggaacaaacagg

SEQ ID NO: 4378648 - DNA, 15 bp, Homo sapiens
caggaacaaacaggg

SEQ ID NO: 4378649 - DNA, 22 bp, Homo sapiens
caggaacaaacagggctgcctt

SEQ ID NO: 4378650 - DNA, 22 bp, Homo sapiens
caggaacagctatgggagcccc

SEQ ID NO: 4378651 - DNA, 12 bp, Homo sapiens
caggaacccttg

SEQ ID NO: 4378652 - DNA, 19 bp, Homo sapiens
caggaacccttgcatccat

SEQ ID NO: 4378653 - DNA, 15 bp, Homo sapiens
caggaaccgaggcag

SEQ ID NO: 4378654 - DNA, 17 bp, Homo sapiens
caggaaccgaggcaggg

SEQ ID NO: 4378655 - DNA, 19 bp, Homo sapiens
caggaacctcgagtactgt

SEQ ID NO: 4378656 - DNA, 23 bp, Homo sapiens
caggaacctcgagtactgtgggc

SEQ ID NO: 4378657 - DNA, 21 bp, Homo sapiens
caggaacctgtcctaaggaac

SEQ ID NO: 4378658 - DNA, 18 bp, Homo sapiens
caggaactgggctgggcc

SEQ ID NO: 4378659 - DNA, 14 bp, Homo sapiens
caggaactgtcatg

SEQ ID NO: 4378660 - DNA, 14 bp, Homo sapiens
caggaagaaagaat

SEQ ID NO: 4378661 - DNA, 18 bp, Homo sapiens
caggaagatgggaggtgg

SEQ ID NO: 4378662 - DNA, 13 bp, Homo sapiens
caggaagatttta

SEQ ID NO: 4378663 - DNA, 15 bp, Homo sapiens
caggaagccagagcc

SEQ ID NO: 4378664 - DNA, 17 bp, Homo sapiens
caggaagccagagcccc

SEQ ID NO: 4378665 - DNA, 23 bp, Homo sapiens
caggaagccgccagtacttgtca

SEQ ID NO: 4378666 - DNA, 12 bp, Homo sapiens
caggaaggaaca

SEQ ID NO: 4378667 - DNA, 19 bp, Homo sapiens
caggaaggactatgaaaag

SEQ ID NO: 4378668 - DNA, 17 bp, Homo sapiens
caggaaggagagcctgc

SEQ ID NO: 4378669 - DNA, 22 bp, Homo sapiens
caggaaggccaaaatcaagagt

SEQ ID NO: 4378670 - DNA, 22 bp, Homo sapiens
caggaagggcctacagcccatt

SEQ ID NO: 4378671 - DNA, 15 bp, Homo sapiens
caggaagtggctcag

SEQ ID NO: 4378672 - DNA, 17 bp, Homo sapiens
caggaatcaagagctgc

SEQ ID NO: 4378673 - DNA, 23 bp, Homo sapiens
caggaatcaagagctgccctcct

SEQ ID NO: 4378674 - DNA, 17 bp, Homo sapiens
caggaatcacccctctg

SEQ ID NO: 4378675 - DNA, 22 bp, Homo sapiens
caggaatcacccctctgcccct

SEQ ID NO: 4378676 - DNA, 21 bp, Homo sapiens
caggaatgaagaactgttgcc

SEQ ID NO: 4378677 - DNA, 15 bp, Homo sapiens
caggaatggtgcttt

SEQ ID NO: 4378678 - DNA, 21 bp, Homo sapiens
caggaatttaagaatttgttt

SEQ ID NO: 4378679 - DNA, 23 bp, Homo sapiens
caggacagagggaagccagtcag

SEQ ID NO: 4378680 - DNA, 19 bp, Homo sapiens
caggacagcatcccttccc

SEQ ID NO: 4378681 - DNA, 20 bp, Homo sapiens
caggacagcatcccttccca

SEQ ID NO: 4378682 - DNA, 13 bp, Homo sapiens
caggacaggacca

SEQ ID NO: 4378683 - DNA, 13 bp, Homo sapiens
caggacaggcccg

SEQ ID NO: 4378684 - DNA, 14 bp, Homo sapiens
caggacatttctct

SEQ ID NO: 4378685 - DNA, 16 bp, Homo sapiens
caggacccagaggaag

SEQ ID NO: 4378686 - DNA, 14 bp, Homo sapiens
caggacccccgagg

SEQ ID NO: 4378687 - DNA, 15 bp, Homo sapiens
caggacccccgaggg

SEQ ID NO: 4378688 - DNA, 18 bp, Homo sapiens
caggacgccactcatttc

SEQ ID NO: 4378689 - DNA, 19 bp, Homo sapiens
caggacgccactcatttca

SEQ ID NO: 4378690 - DNA, 17 bp, Homo sapiens
caggacggctcctcaga

SEQ ID NO: 4378691 - DNA, 16 bp, Homo sapiens
caggactccaggccca

SEQ ID NO: 4378692 - DNA, 13 bp, Homo sapiens
caggactccctcc

SEQ ID NO: 4378693 - DNA, 15 bp, Homo sapiens
caggactccctcctc

SEQ ID NO: 4378694 - DNA, 16 bp, Homo sapiens
caggactccctcctca

SEQ ID NO: 4378695 - DNA, 19 bp, Homo sapiens
caggactccctcctcacct

SEQ ID NO: 4378696 - DNA, 20 bp, Homo sapiens
caggactccctcctcacctc

SEQ ID NO: 4378697 - DNA, 18 bp, Homo sapiens
caggactgaattgtcccc

SEQ ID NO: 4378698 - DNA, 20 bp, Homo sapiens
caggactgaattgtccccag

SEQ ID NO: 4378699 - DNA, 19 bp, Homo sapiens
caggactgcaacaggcttg

SEQ ID NO: 4378700 - DNA, 15 bp, Homo sapiens
caggactgggccact

SEQ ID NO: 4378701 - DNA, 16 bp, Homo sapiens
caggactgggccactt

SEQ ID NO: 4378702 - DNA, 20 bp, Homo sapiens
caggactgggccacttctgg

SEQ ID NO: 4378703 - DNA, 12 bp, Homo sapiens
caggagaaagga

SEQ ID NO: 4378704 - DNA, 21 bp, Homo sapiens
caggagaagaacaagaaatgg

SEQ ID NO: 4378705 - DNA, 22 bp, Homo sapiens
caggagaaggccaattcctata

SEQ ID NO: 4378706 - DNA, 24 bp, Homo sapiens
caggagaatctacacgcatgatgg

SEQ ID NO: 4378707 - DNA, 17 bp, Homo sapiens
caggagagagcagcact

SEQ ID NO: 4378708 - DNA, 20 bp, Homo sapiens
caggagagattatttacaag

SEQ ID NO: 4378709 - DNA, 17 bp, Homo sapiens
caggagagccagccctc

SEQ ID NO: 4378710 - DNA, 17 bp, Homo sapiens
caggagatggagggctt

SEQ ID NO: 4378711 - DNA, 21 bp, Homo sapiens
caggagatggagggcttggcc

SEQ ID NO: 4378712 - DNA, 20 bp, Homo sapiens
caggagatgggtccaggggt

SEQ ID NO: 4378713 - DNA, 14 bp, Homo sapiens
caggagccccgcca

SEQ ID NO: 4378714 - DNA, 16 bp, Homo sapiens
caggagcctagcggag

SEQ ID NO: 4378715 - DNA, 21 bp, Homo sapiens
caggagcctagcggagcccag

SEQ ID NO: 4378716 - DNA, 15 bp, Homo sapiens
caggagcctggtcct

SEQ ID NO: 4378717 - DNA, 20 bp, Homo sapiens
caggagctagttctcagctt

SEQ ID NO: 4378718 - DNA, 21 bp, Homo sapiens
caggagctagttctcagcttg

SEQ ID NO: 4378719 - DNA, 17 bp, Homo sapiens
caggagcttgggtctct

SEQ ID NO: 4378720 - DNA, 14 bp, Homo sapiens
caggagcttttgtg

SEQ ID NO: 4378721 - DNA, 15 bp, Homo sapiens
caggaggattgcctt

SEQ ID NO: 4378722 - DNA, 17 bp, Homo sapiens
caggaggcgaataaatg

SEQ ID NO: 4378723 - DNA, 18 bp, Homo sapiens
caggaggctgagacagga

SEQ ID NO: 4378724 - DNA, 22 bp, Homo sapiens
caggagggccagcgctgtggac

SEQ ID NO: 4378725 - DNA, 20 bp, Homo sapiens
caggagggtcaccctggcct

SEQ ID NO: 4378726 - DNA, 14 bp, Homo sapiens
caggaggtggaggc

SEQ ID NO: 4378727 - DNA, 15 bp, Homo sapiens
caggaggtggaggtt

SEQ ID NO: 4378728 - DNA, 19 bp, Homo sapiens
caggaggtggaggttgcag

SEQ ID NO: 4378729 - DNA, 11 bp, Homo sapiens
caggagtccag

SEQ ID NO: 4378730 - DNA, 13 bp, Homo sapiens
caggagtccagac

SEQ ID NO: 4378731 - DNA, 15 bp, Homo sapiens
caggagtccagaccc

SEQ ID NO: 4378732 - DNA, 17 bp, Homo sapiens
caggagtccagcccctc

SEQ ID NO: 4378733 - DNA, 12 bp, Homo sapiens
caggagtccagg

SEQ ID NO: 4378734 - DNA, 15 bp, Homo sapiens
caggagtccaggccc

SEQ ID NO: 4378735 - DNA, 20 bp, Homo sapiens
caggagtccaggcccccagc

SEQ ID NO: 4378736 - DNA, 22 bp, Homo sapiens
caggagtccaggcccccagccc

SEQ ID NO: 4378737 - DNA, 14 bp, Homo sapiens
caggagtccctgcc

SEQ ID NO: 4378738 - DNA, 22 bp, Homo sapiens
caggagtctctggtagcctgca

SEQ ID NO: 4378739 - DNA, 14 bp, Homo sapiens
caggagtctgccac

SEQ ID NO: 4378740 - DNA, 20 bp, Homo sapiens
caggagtctgccacttgtca

SEQ ID NO: 4378741 - DNA, 22 bp, Homo sapiens
caggagtctttcaactgtttca

SEQ ID NO: 4378742 - DNA, 17 bp, Homo sapiens
caggagtgcccccggga

SEQ ID NO: 4378743 - DNA, 19 bp, Homo sapiens
caggagtgtcctcttccct

SEQ ID NO: 4378744 - DNA, 14 bp, Homo sapiens
caggagtgtcctgc

SEQ ID NO: 4378745 - DNA, 17 bp, Homo sapiens
caggagtgtcctgccca

SEQ ID NO: 4378746 - DNA, 19 bp, Homo sapiens
caggagtgtcctgcccatg

SEQ ID NO: 4378747 - DNA, 18 bp, Homo sapiens
caggagtgtcctggctgt

SEQ ID NO: 4378748 - DNA, 19 bp, Homo sapiens
caggagtgtcctggctgtg

SEQ ID NO: 4378749 - DNA, 20 bp, Homo sapiens
caggagttcaagaccagcct

SEQ ID NO: 4378750 - DNA, 22 bp, Homo sapiens
caggagttcaagaccagcctgt

SEQ ID NO: 4378751 - DNA, 17 bp, Homo sapiens
caggagttcaagactag

SEQ ID NO: 4378752 - DNA, 21 bp, Homo sapiens
caggagttcaagactagcctg

SEQ ID NO: 4378753 - DNA, 17 bp, Homo sapiens
caggagtttgaggctgc

SEQ ID NO: 4378754 - DNA, 17 bp, Homo sapiens
caggagttttaagtcca

SEQ ID NO: 4378755 - DNA, 22 bp, Homo sapiens
caggagttttactgcctgtagc

SEQ ID NO: 4378756 - DNA, 18 bp, Homo sapiens
caggatactggcacagag

SEQ ID NO: 4378757 - DNA, 15 bp, Homo sapiens
caggatcagttaact

SEQ ID NO: 4378758 - DNA, 20 bp, Homo sapiens
caggatcctctcctttgaaa

SEQ ID NO: 4378759 - DNA, 17 bp, Homo sapiens
caggatctgctccaaca

SEQ ID NO: 4378760 - DNA, 20 bp, Homo sapiens
caggatctgtctgtgcacat

SEQ ID NO: 4378761 - DNA, 16 bp, Homo sapiens
caggatctttgactga

SEQ ID NO: 4378762 - DNA, 20 bp, Homo sapiens
caggatggaacatcagtgga

SEQ ID NO: 4378763 - DNA, 20 bp, Homo sapiens
caggatggatgcatcacact

SEQ ID NO: 4378764 - DNA, 13 bp, Homo sapiens
caggatggccttt

SEQ ID NO: 4378765 - DNA, 16 bp, Homo sapiens
caggatggcctttcct

SEQ ID NO: 4378766 - DNA, 22 bp, Homo sapiens
caggatggcctttccttccctc

SEQ ID NO: 4378767 - DNA, 21 bp, Homo sapiens
caggcaatcgttctgctggcc

SEQ ID NO: 4378768 - DNA, 18 bp, Homo sapiens
caggcaatcttgccttct

SEQ ID NO: 4378769 - DNA, 16 bp, Homo sapiens
caggcacacacagccc

SEQ ID NO: 4378770 - DNA, 15 bp, Homo sapiens
caggcacacactgtg

SEQ ID NO: 4378771 - DNA, 15 bp, Homo sapiens
caggcacacagcagc

SEQ ID NO: 4378772 - DNA, 16 bp, Homo sapiens
caggcacacagcagcc

SEQ ID NO: 4378773 - DNA, 14 bp, Homo sapiens
caggcacacagcta

SEQ ID NO: 4378774 - DNA, 23 bp, Homo sapiens
caggcacacagctactctcccca

SEQ ID NO: 4378775 - DNA, 20 bp, Homo sapiens
caggcaccaggactagggct

SEQ ID NO: 4378776 - DNA, 15 bp, Homo sapiens
caggcaccctcaggg

SEQ ID NO: 4378777 - DNA, 18 bp, Homo sapiens
caggcaccctcagggagc

SEQ ID NO: 4378778 - DNA, 22 bp, Homo sapiens
caggcaccctcagggagcctcc

SEQ ID NO: 4378779 - DNA, 21 bp, Homo sapiens
caggcaccgccacgtcccagc

SEQ ID NO: 4378780 - DNA, 22 bp, Homo sapiens
caggcaccgccacgtcccagca

SEQ ID NO: 4378781 - DNA, 19 bp, Homo sapiens
caggcacgaacccacctgc

SEQ ID NO: 4378782 - DNA, 22 bp, Homo sapiens
caggcacgaacccacctgctga

SEQ ID NO: 4378783 - DNA, 16 bp, Homo sapiens
caggcactgagaatga

SEQ ID NO: 4378784 - DNA, 17 bp, Homo sapiens
caggcagagctggagcc

SEQ ID NO: 4378785 - DNA, 15 bp, Homo sapiens
caggcagatctgtgc

SEQ ID NO: 4378786 - DNA, 17 bp, Homo sapiens
caggcagccacgtctca

SEQ ID NO: 4378787 - DNA, 16 bp, Homo sapiens
caggcagccagccgtg

SEQ ID NO: 4378788 - DNA, 16 bp, Homo sapiens
caggcagcccagcagt

SEQ ID NO: 4378789 - DNA, 16 bp, Homo sapiens
caggcaggccagatgg

SEQ ID NO: 4378790 - DNA, 20 bp, Homo sapiens
caggcaggccagatggcccc

SEQ ID NO: 4378791 - DNA, 16 bp, Homo sapiens
caggcagggcctggct

SEQ ID NO: 4378792 - DNA, 19 bp, Homo sapiens
caggcagggcctggctcca

SEQ ID NO: 4378793 - DNA, 21 bp, Homo sapiens
caggcaggggtgggggtggag

SEQ ID NO: 4378794 - DNA, 17 bp, Homo sapiens
caggcagtccaggcctc

SEQ ID NO: 4378795 - DNA, 23 bp, Homo sapiens
caggcagtccaggcctctctctg

SEQ ID NO: 4378796 - DNA, 22 bp, Homo sapiens
caggcatattccctgcacacac

SEQ ID NO: 4378797 - DNA, 20 bp, Homo sapiens
caggcatttgctaaggcagc

SEQ ID NO: 4378798 - DNA, 22 bp, Homo sapiens
caggcatttgctaaggcagctg

SEQ ID NO: 4378799 - DNA, 23 bp, Homo sapiens
caggcatttgctaaggcagctga

SEQ ID NO: 4378800 - DNA, 17 bp, Homo sapiens
caggccaagaaacgtct

SEQ ID NO: 4378801 - DNA, 21 bp, Homo sapiens
caggccagagcaaacagaaaa

SEQ ID NO: 4378802 - DNA, 22 bp, Homo sapiens
caggccagagcaaacagaaaaa

SEQ ID NO: 4378803 - DNA, 11 bp, Homo sapiens
caggccagatg

SEQ ID NO: 4378804 - DNA, 19 bp, Homo sapiens
caggccagcaggcgggctc

SEQ ID NO: 4378805 - DNA, 17 bp, Homo sapiens
cagggactatctttgct

SEQ ID NO: 4378806 - DNA, 15 bp, Homo sapiens
cagggagaagtagct

SEQ ID NO: 4378807 - DNA, 21 bp, Homo sapiens
cagggagacaggcagggaggg

SEQ ID NO: 4378808 - DNA, 23 bp, Homo sapiens
cagggagaggagtgactgagctt

SEQ ID NO: 4378809 - DNA, 20 bp, Homo sapiens
cagggagcagggaaggcctg

SEQ ID NO: 4378810 - DNA, 21 bp, Homo sapiens
cagggagcagggaaggcctga

SEQ ID NO: 4378811 - DNA, 19 bp, Homo sapiens
cagggagcatggctgtgag

SEQ ID NO: 4378812 - DNA, 13 bp, Homo sapiens
cagggagcctccc

SEQ ID NO: 4378813 - DNA, 16 bp, Homo sapiens
cagggaggaaggaggc

SEQ ID NO: 4378814 - DNA, 19 bp, Homo sapiens
cagggaggctcccggggcc

SEQ ID NO: 4378815 - DNA, 20 bp, Homo sapiens
cagggaggctcccggggcct

SEQ ID NO: 4378816 - DNA, 13 bp, Homo sapiens
cagggagtccagg

SEQ ID NO: 4378817 - DNA, 17 bp, Homo sapiens
cagggatcacagaccac

SEQ ID NO: 4378818 - DNA, 18 bp, Homo sapiens
cagggatgctgggctggg

SEQ ID NO: 4378819 - DNA, 21 bp, Homo sapiens
cagggatgggcagcccaacag

SEQ ID NO: 4378820 - DNA, 23 bp, Homo sapiens
cagggatgggggatgggccaggg

SEQ ID NO: 4378821 - DNA, 14 bp, Homo sapiens
cagggattctctca

SEQ ID NO: 4378822 - DNA, 21 bp, Homo sapiens
cagggcaactcttggaagaaa

SEQ ID NO: 4378823 - DNA, 18 bp, Homo sapiens
cagggcactgccagccca

SEQ ID NO: 4378824 - DNA, 16 bp, Homo sapiens
cagggcagaaatgatt

SEQ ID NO: 4378825 - DNA, 15 bp, Homo sapiens
cagggcagctgggcc

SEQ ID NO: 4378826 - DNA, 18 bp, Homo sapiens
cagggcagctgggcccaa

SEQ ID NO: 4378827 - DNA, 11 bp, Homo sapiens
cagggcagggc

SEQ ID NO: 4378828 - DNA, 13 bp, Homo sapiens
cagggcagggccc

SEQ ID NO: 4378829 - DNA, 20 bp, Homo sapiens
cagggcagggcgagctgcag

SEQ ID NO: 4378830 - DNA, 17 bp, Homo sapiens
cagggcatggctgggaa

SEQ ID NO: 4378831 - DNA, 22 bp, Homo sapiens
cagggcattctgttggcctaag

SEQ ID NO: 4378832 - DNA, 16 bp, Homo sapiens
cagggccacgctccag

SEQ ID NO: 4378833 - DNA, 17 bp, Homo sapiens
cagggccacgctccagc

SEQ ID NO: 4378834 - DNA, 23 bp, Homo sapiens
cagggccacgctccagctgcccc

SEQ ID NO: 4378835 - DNA, 17 bp, Homo sapiens
cagggccacgtgccagg

SEQ ID NO: 4378836 - DNA, 23 bp, Homo sapiens
cagggccactcaacagagaggac

SEQ ID NO: 4378837 - DNA, 12 bp, Homo sapiens
cagggccaggcc

SEQ ID NO: 4378838 - DNA, 17 bp, Homo sapiens
cagggccaggcctctgc

SEQ ID NO: 4378839 - DNA, 19 bp, Homo sapiens
cagggccatgtgctgccct

SEQ ID NO: 4378840 - DNA, 20 bp, Homo sapiens
cagggccatgtgctgccctg

SEQ ID NO: 4378841 - DNA, 21 bp, Homo sapiens
cagggccatgtgctgccctgt

SEQ ID NO: 4378842 - DNA, 20 bp, Homo sapiens
cagggccccaggcattgcca

SEQ ID NO: 4378843 - DNA, 18 bp, Homo sapiens
cagggcccggccacaccc

SEQ ID NO: 4378844 - DNA, 22 bp, Homo sapiens
cagggcccggccacacccagcg

SEQ ID NO: 4378845 - DNA, 21 bp, Homo sapiens
cagggcctctccttggaaggt

SEQ ID NO: 4378846 - DNA, 13 bp, Homo sapiens
cagggcctctgcg

SEQ ID NO: 4378847 - DNA, 17 bp, Homo sapiens
cagggcctgaaacccgc

SEQ ID NO: 4378848 - DNA, 13 bp, Homo sapiens
cagggcctgactt

SEQ ID NO: 4378849 - DNA, 15 bp, Homo sapiens
cagggccttgcccag

SEQ ID NO: 4378850 - DNA, 16 bp, Homo sapiens
cagggccttgcccaga

SEQ ID NO: 4378851 - DNA, 18 bp, Homo sapiens
cagggccttgcccagaga

SEQ ID NO: 4378852 - DNA, 19 bp, Homo sapiens
cagggccttgcccagagat

SEQ ID NO: 4378853 - DNA, 16 bp, Homo sapiens
cagggcgagctgcagg

SEQ ID NO: 4378854 - DNA, 20 bp, Homo sapiens
cagggcgccaagtctggcac

SEQ ID NO: 4378855 - DNA, 16 bp, Homo sapiens
cagggcggcctcccag

SEQ ID NO: 4378856 - DNA, 18 bp, Homo sapiens
cagggcggcctcccaggt

SEQ ID NO: 4378857 - DNA, 19 bp, Homo sapiens
cagggcgggcagagggctg

SEQ ID NO: 4378858 - DNA, 21 bp, Homo sapiens
cagggcgggcagagggctgga

SEQ ID NO: 4378859 - DNA, 13 bp, Homo sapiens
cagggcgtgagga

SEQ ID NO: 4378860 - DNA, 17 bp, Homo sapiens
cagggctaagagctagc

SEQ ID NO: 4378861 - DNA, 14 bp, Homo sapiens
cagggctaccctga

SEQ ID NO: 4378862 - DNA, 12 bp, Homo sapiens
cagggctccagg

SEQ ID NO: 4378863 - DNA, 14 bp, Homo sapiens
cagggctcccaggg

SEQ ID NO: 4378864 - DNA, 12 bp, Homo sapiens
cagggctcctgg

SEQ ID NO: 4378865 - DNA, 16 bp, Homo sapiens
cagggctgaggcctct

SEQ ID NO: 4378866 - DNA, 13 bp, Homo sapiens
cagggctgctccc

SEQ ID NO: 4378867 - DNA, 23 bp, Homo sapiens
cagggctgctccccaacacctgc

SEQ ID NO: 4378868 - DNA, 15 bp, Homo sapiens
cagggctggactgag

SEQ ID NO: 4378869 - DNA, 21 bp, Homo sapiens
cagggctggactgaggcctga

SEQ ID NO: 4378870 - DNA, 22 bp, Homo sapiens
cagggctggactgaggcctgag

SEQ ID NO: 4378871 - DNA, 23 bp, Homo sapiens
cagggctggactgaggcctgagc

SEQ ID NO: 4378872 - DNA, 13 bp, Homo sapiens
cagggctggccca

SEQ ID NO: 4378873 - DNA, 16 bp, Homo sapiens
cagggctggcccagcc

SEQ ID NO: 4378874 - DNA, 21 bp, Homo sapiens
cagggctggcccagccctgct

SEQ ID NO: 4378875 - DNA, 11 bp, Homo sapiens
cagggctgggg

SEQ ID NO: 4378876 - DNA, 15 bp, Homo sapiens
cagggctggggttgc

SEQ ID NO: 4378877 - DNA, 17 bp, Homo sapiens
cagggctggggttgcca

SEQ ID NO: 4378878 - DNA, 20 bp, Homo sapiens
cagggctggggttgccagag

SEQ ID NO: 4378879 - DNA, 22 bp, Homo sapiens
cagggctggggttgccagaggc

SEQ ID NO: 4378880 - DNA, 12 bp, Homo sapiens
cagggctggtct

SEQ ID NO: 4378881 - DNA, 19 bp, Homo sapiens
caggggaaggccctgaggc

SEQ ID NO: 4378882 - DNA, 14 bp, Homo sapiens
caggggacagctgg

SEQ ID NO: 4378883 - DNA, 18 bp, Homo sapiens
caggggactcagccctga

SEQ ID NO: 4378884 - DNA, 23 bp, Homo sapiens
caggggactcagccctgaggtga

SEQ ID NO: 4378885 - DNA, 18 bp, Homo sapiens
caggggagacaggagcct

SEQ ID NO: 4378886 - DNA, 21 bp, Homo sapiens
caggggattctgtgttttcag

SEQ ID NO: 4378887 - DNA, 23 bp, Homo sapiens
caggggccaacctcaggctccta

SEQ ID NO: 4378888 - DNA, 20 bp, Homo sapiens
caggggcccaaggcggcccc

SEQ ID NO: 4378889 - DNA, 15 bp, Homo sapiens
caggggcccctgggg

SEQ ID NO: 4378890 - DNA, 17 bp, Homo sapiens
caggggcccctggggac

SEQ ID NO: 4378891 - DNA, 17 bp, Homo sapiens
caggggcctctctcctg

SEQ ID NO: 4378892 - DNA, 17 bp, Homo sapiens
caggggcgggtggatca

SEQ ID NO: 4378893 - DNA, 13 bp, Homo sapiens
caggggctccatg

SEQ ID NO: 4378894 - DNA, 21 bp, Homo sapiens
caggggctccatgctgggtct

SEQ ID NO: 4378895 - DNA, 20 bp, Homo sapiens
caggggctgtggccgtctcc

SEQ ID NO: 4378896 - DNA, 16 bp, Homo sapiens
caggggcttggatttc

SEQ ID NO: 4378897 - DNA, 20 bp, Homo sapiens
caggggtcccagccaccccg

SEQ ID NO: 4378898 - DNA, 13 bp, Homo sapiens
caggggtctccct

SEQ ID NO: 4378899 - DNA, 14 bp, Homo sapiens
caggggtctccctg

SEQ ID NO: 4378900 - DNA, 19 bp, Homo sapiens
caggggtctccctggctcc

SEQ ID NO: 4378901 - DNA, 21 bp, Homo sapiens
caggggtctccctggctccct

SEQ ID NO: 4378902 - DNA, 15 bp, Homo sapiens
caggggtctgagcca

SEQ ID NO: 4378903 - DNA, 23 bp, Homo sapiens
caggggtgcacaataaagggggt

SEQ ID NO: 4378904 - DNA, 12 bp, Homo sapiens
caggggtggggg

SEQ ID NO: 4378905 - DNA, 20 bp, Homo sapiens
caggggtgggggtggaggct

SEQ ID NO: 4378906 - DNA, 13 bp, Homo sapiens
cagggtagcaggt

SEQ ID NO: 4378907 - DNA, 15 bp, Homo sapiens
cagggtagcccgcct

SEQ ID NO: 4378908 - DNA, 13 bp, Homo sapiens
cagggtagcctga

SEQ ID NO: 4378909 - DNA, 15 bp, Homo sapiens
cagggtcaggcggag

SEQ ID NO: 4378910 - DNA, 19 bp, Homo sapiens
cagggtcataagtggggag

SEQ ID NO: 4378911 - DNA, 14 bp, Homo sapiens
cagggtccttttga

SEQ ID NO: 4378912 - DNA, 22 bp, Homo sapiens
cagggtccttttgacactgctc

SEQ ID NO: 4378913 - DNA, 17 bp, Homo sapiens
cagggtcttccctacct

SEQ ID NO: 4378914 - DNA, 21 bp, Homo sapiens
cagggtcttccctacctcagg

SEQ ID NO: 4378915 - DNA, 22 bp, Homo sapiens
cagggtcttccctacctcaggc

SEQ ID NO: 4378916 - DNA, 14 bp, Homo sapiens
cagggtcttgctct

SEQ ID NO: 4378917 - DNA, 23 bp, Homo sapiens
cagggtcttgctctgtcccccag

SEQ ID NO: 4378918 - DNA, 14 bp, Homo sapiens
cagggtcttggctg

SEQ ID NO: 4378919 - DNA, 12 bp, Homo sapiens
cagggtggccac

SEQ ID NO: 4378920 - DNA, 16 bp, Homo sapiens
cagggtggccacacag

SEQ ID NO: 4378921 - DNA, 17 bp, Homo sapiens
cagggtggccacacagg

SEQ ID NO: 4378922 - DNA, 20 bp, Homo sapiens
cagggtggccacacaggcag

SEQ ID NO: 4378923 - DNA, 22 bp, Homo sapiens
cagtcagagtccagtgctctgc

SEQ ID NO: 4378924 - DNA, 13 bp, Homo sapiens
cagtcagcctctc

SEQ ID NO: 4378925 - DNA, 18 bp, Homo sapiens
cagtcagcctctctccca

SEQ ID NO: 4378926 - DNA, 16 bp, Homo sapiens
cagtcatctagaattc

SEQ ID NO: 4378927 - DNA, 21 bp, Homo sapiens
cagtcatggtactaccccagc

SEQ ID NO: 4378928 - DNA, 23 bp, Homo sapiens
cagtccaaatgtcctccagaagc

SEQ ID NO: 4378929 - DNA, 20 bp, Homo sapiens
cagtccacaggggccaccac

SEQ ID NO: 4378930 - DNA, 14 bp, Homo sapiens
cagtccactgagca

SEQ ID NO: 4378931 - DNA, 12 bp, Homo sapiens
cagtccagcaaa

SEQ ID NO: 4378932 - DNA, 12 bp, Homo sapiens
cagtccatgcat

SEQ ID NO: 4378933 - DNA, 15 bp, Homo sapiens
cagtccatgctccag

SEQ ID NO: 4378934 - DNA, 23 bp, Homo sapiens
cagtccatgctccagggtcaggc

SEQ ID NO: 4378935 - DNA, 21 bp, Homo sapiens
cagtcccagacaattccattc

SEQ ID NO: 4378936 - DNA, 18 bp, Homo sapiens
cagtccccacccctgccc

SEQ ID NO: 4378937 - DNA, 13 bp, Homo sapiens
cagtccccgagga

SEQ ID NO: 4378938 - DNA, 17 bp, Homo sapiens
cagtccctacttaggaa

SEQ ID NO: 4378939 - DNA, 12 bp, Homo sapiens
cagtccctgctg

SEQ ID NO: 4378940 - DNA, 13 bp, Homo sapiens
cagtccctgctgg

SEQ ID NO: 4378941 - DNA, 15 bp, Homo sapiens
cagtccctgctgggg

SEQ ID NO: 4378942 - DNA, 18 bp, Homo sapiens
cagtcctagctcttacac

SEQ ID NO: 4378943 - DNA, 18 bp, Homo sapiens
cagtcctagctgcacagg

SEQ ID NO: 4378944 - DNA, 23 bp, Homo sapiens
cagtcctagctgcacagggcagc

SEQ ID NO: 4378945 - DNA, 14 bp, Homo sapiens
cagtcctgcccgcc

SEQ ID NO: 4378946 - DNA, 16 bp, Homo sapiens
cagtcctgcctgaaca

SEQ ID NO: 4378947 - DNA, 20 bp, Homo sapiens
cagtcctgcctgaacagccc

SEQ ID NO: 4378948 - DNA, 14 bp, Homo sapiens
cagtcctgcctggc

SEQ ID NO: 4378949 - DNA, 16 bp, Homo sapiens
cagtcctgtagtttta

SEQ ID NO: 4378950 - DNA, 16 bp, Homo sapiens
cagtcgatagagctgt

SEQ ID NO: 4378951 - DNA, 18 bp, Homo sapiens
cagtcgcccaagcagaca

SEQ ID NO: 4378952 - DNA, 13 bp, Homo sapiens
cagtcgcctgcct

SEQ ID NO: 4378953 - DNA, 16 bp, Homo sapiens
cagtcgcctgcctgca

SEQ ID NO: 4378954 - DNA, 22 bp, Homo sapiens
cagtcgcctgcctgcagcaggc

SEQ ID NO: 4378955 - DNA, 19 bp, Homo sapiens
cagtcgtgatgtggaggaa

SEQ ID NO: 4378956 - DNA, 14 bp, Homo sapiens
cagtctacccagag

SEQ ID NO: 4378957 - DNA, 15 bp, Homo sapiens
cagtctcaggaaatc

SEQ ID NO: 4378958 - DNA, 19 bp, Homo sapiens
cagtctcctcactctgtcc

SEQ ID NO: 4378959 - DNA, 13 bp, Homo sapiens
cagtctcctcttt

SEQ ID NO: 4378960 - DNA, 22 bp, Homo sapiens
cagtctctcttctctccagctg

SEQ ID NO: 4378961 - DNA, 20 bp, Homo sapiens
cagtctctgaatacacagta

SEQ ID NO: 4378962 - DNA, 14 bp, Homo sapiens
cagtctctgagcag

SEQ ID NO: 4378963 - DNA, 19 bp, Homo sapiens
cagtctcttagaatttgtt

SEQ ID NO: 4378964 - DNA, 11 bp, Homo sapiens
cagtctgagct

SEQ ID NO: 4378965 - DNA, 15 bp, Homo sapiens
cagtctgctctgctg

SEQ ID NO: 4378966 - DNA, 15 bp, Homo sapiens
cagtctggagaaggt

SEQ ID NO: 4378967 - DNA, 14 bp, Homo sapiens
cagtctggagagct

SEQ ID NO: 4378968 - DNA, 15 bp, Homo sapiens
cagtctggagagctg

SEQ ID NO: 4378969 - DNA, 18 bp, Homo sapiens
cagtctgggtctgggttt

SEQ ID NO: 4378970 - DNA, 24 bp, Homo sapiens
cagtctgtcatgaacatgttcctg

SEQ ID NO: 4378971 - DNA, 15 bp, Homo sapiens
cagtctgttcactgc

SEQ ID NO: 4378972 - DNA, 21 bp, Homo sapiens
cagtctgttcactgcattcac

SEQ ID NO: 4378973 - DNA, 20 bp, Homo sapiens
cagtcttccacaaagaaaat

SEQ ID NO: 4378974 - DNA, 18 bp, Homo sapiens
cagtcttccatttgcaag

SEQ ID NO: 4378975 - DNA, 13 bp, Homo sapiens
cagtcttcctgac

SEQ ID NO: 4378976 - DNA, 14 bp, Homo sapiens
cagtcttgcctagg

SEQ ID NO: 4378977 - DNA, 11 bp, Homo sapiens
cagtcttgctc

SEQ ID NO: 4378978 - DNA, 13 bp, Homo sapiens
cagtcttgtgaac

SEQ ID NO: 4378979 - DNA, 22 bp, Homo sapiens
cagtctttaatctgagaggcca

SEQ ID NO: 4378980 - DNA, 13 bp, Homo sapiens
cagtgaacacatt

SEQ ID NO: 4378981 - DNA, 15 bp, Homo sapiens
cagtgaacacatttt

SEQ ID NO: 4378982 - DNA, 17 bp, Homo sapiens
cagtgaactcctgccag

SEQ ID NO: 4378983 - DNA, 15 bp, Homo sapiens
cagtgaacttgtctg

SEQ ID NO: 4378984 - DNA, 17 bp, Homo sapiens
cagtgaacttgtctggc

SEQ ID NO: 4378985 - DNA, 17 bp, Homo sapiens
cagtgaagcagcactgt

SEQ ID NO: 4378986 - DNA, 19 bp, Homo sapiens
cagtgaagtctagaatcat

SEQ ID NO: 4378987 - DNA, 20 bp, Homo sapiens
cagtgaagtctagaatcata

SEQ ID NO: 4378988 - DNA, 17 bp, Homo sapiens
cagtgaatgattcagtg

SEQ ID NO: 4378989 - DNA, 17 bp, Homo sapiens
cagtgaatttttgcaat

SEQ ID NO: 4378990 - DNA, 16 bp, Homo sapiens
cagtgaccagtgcctg

SEQ ID NO: 4378991 - DNA, 21 bp, Homo sapiens
cagtgacctttgacctcggtg

SEQ ID NO: 4378992 - DNA, 19 bp, Homo sapiens
cagtgactcgacaaaggcc

SEQ ID NO: 4378993 - DNA, 23 bp, Homo sapiens
cagtgactcgacaaaggccacag

SEQ ID NO: 4378994 - DNA, 23 bp, Homo sapiens
cagtgacttgcaatccaggctgt

SEQ ID NO: 4378995 - DNA, 21 bp, Homo sapiens
cagtgagcccctccccagcca

SEQ ID NO: 4378996 - DNA, 14 bp, Homo sapiens
cagtgagccctgct

SEQ ID NO: 4378997 - DNA, 16 bp, Homo sapiens
cagtgagcctcctgtg

SEQ ID NO: 4378998 - DNA, 13 bp, Homo sapiens
cagtgagctgaga

SEQ ID NO: 4378999 - DNA, 13 bp, Homo sapiens
cagtgaggactct

SEQ ID NO: 4379000 - DNA, 18 bp, Homo sapiens
cagtgagtcgagattgca

SEQ ID NO: 4379001 - DNA, 21 bp, Homo sapiens
cagtgagtcgagattgcactg

SEQ ID NO: 4379002 - DNA, 17 bp, Homo sapiens
cagtgagtgccatgctt

SEQ ID NO: 4379003 - DNA, 17 bp, Homo sapiens
cagtgattaccagggac

SEQ ID NO: 4379004 - DNA, 18 bp, Homo sapiens
cagtgattaccagggact

SEQ ID NO: 4379005 - DNA, 14 bp, Homo sapiens
cagtgcaacactgg

SEQ ID NO: 4379006 - DNA, 19 bp, Homo sapiens
cagtgcagagccttctcag

SEQ ID NO: 4379007 - DNA, 15 bp, Homo sapiens
cagtgcagcagagga

SEQ ID NO: 4379008 - DNA, 14 bp, Homo sapiens
cagtgcagccactg

SEQ ID NO: 4379009 - DNA, 15 bp, Homo sapiens
cagtgcagccactgg

SEQ ID NO: 4379010 - DNA, 13 bp, Homo sapiens
cagtgcagggctg

SEQ ID NO: 4379011 - DNA, 18 bp, Homo sapiens
cagtgcagtccatttcct

SEQ ID NO: 4379012 - DNA, 21 bp, Homo sapiens
cagtgcatagttgtagacaaa

SEQ ID NO: 4379013 - DNA, 16 bp, Homo sapiens
cagtgcatctcagatg

SEQ ID NO: 4379014 - DNA, 17 bp, Homo sapiens
cagtgcatgtgcatgca

SEQ ID NO: 4379015 - DNA, 19 bp, Homo sapiens
cagtgccacctatgcctgt

SEQ ID NO: 4379016 - DNA, 20 bp, Homo sapiens
cagtgccacctatgcctgtg

SEQ ID NO: 4379017 - DNA, 14 bp, Homo sapiens
cagtgccactgccc

SEQ ID NO: 4379018 - DNA, 14 bp, Homo sapiens
cagtgccattgtct

SEQ ID NO: 4379019 - DNA, 16 bp, Homo sapiens
cagtgcccaccaacat

SEQ ID NO: 4379020 - DNA, 21 bp, Homo sapiens
cagtgcccaccaacatcccat

SEQ ID NO: 4379021 - DNA, 18 bp, Homo sapiens
cagtgccccagggagtcc

SEQ ID NO: 4379022 - DNA, 22 bp, Homo sapiens
cagtgccccagggagtccaggg

SEQ ID NO: 4379023 - DNA, 13 bp, Homo sapiens
cagtgccctgaga

SEQ ID NO: 4379024 - DNA, 14 bp, Homo sapiens
cagtgcccttggtg

SEQ ID NO: 4379025 - DNA, 17 bp, Homo sapiens
cagtgccgaggacatgc

SEQ ID NO: 4379026 - DNA, 22 bp, Homo sapiens
cagtgcctctccctgctgctcc

SEQ ID NO: 4379027 - DNA, 15 bp, Homo sapiens
cagtgcctgccactc

SEQ ID NO: 4379028 - DNA, 16 bp, Homo sapiens
cagtgcctgccactct

SEQ ID NO: 4379029 - DNA, 12 bp, Homo sapiens
cagtgcctgctg

SEQ ID NO: 4379030 - DNA, 19 bp, Homo sapiens
cagtgccttacctcctgcc

SEQ ID NO: 4379031 - DNA, 23 bp, Homo sapiens
cagtgccttacctcctgcccagg

SEQ ID NO: 4379032 - DNA, 22 bp, Homo sapiens
cagtgccttattacccaggaag

SEQ ID NO: 4379033 - DNA, 11 bp, Homo sapiens
cagtgccttct

SEQ ID NO: 4379034 - DNA, 12 bp, Homo sapiens
cagtgccttctc

SEQ ID NO: 4379035 - DNA, 24 bp, Homo sapiens
cagtgcgcgtgcacgtggagagct

SEQ ID NO: 4379036 - DNA, 22 bp, Homo sapiens
cagtgctcaccagccctgcagc

SEQ ID NO: 4379037 - DNA, 19 bp, Homo sapiens
cagtgctcacccacaccat

SEQ ID NO: 4379038 - DNA, 12 bp, Homo sapiens
cagtgctcctgg

SEQ ID NO: 4379039 - DNA, 13 bp, Homo sapiens
cagtgctcctgga

SEQ ID NO: 4379040 - DNA, 17 bp, Homo sapiens
cagtgctcctggaaact

SEQ ID NO: 4379041 - DNA, 16 bp, Homo sapiens
cagtgctctgcctcag

SEQ ID NO: 4379042 - DNA, 14 bp, Homo sapiens
cagttgtttgcttc

SEQ ID NO: 4379043 - DNA, 17 bp, Homo sapiens
cagttgtttgcttcttg

SEQ ID NO: 4379044 - DNA, 23 bp, Homo sapiens
cagtttaaaaaataacttcattg

SEQ ID NO: 4379045 - DNA, 14 bp, Homo sapiens
cagtttatcattca

SEQ ID NO: 4379046 - DNA, 15 bp, Homo sapiens
cagtttatcattcaa

SEQ ID NO: 4379047 - DNA, 18 bp, Homo sapiens
cagtttatcattcaagtg

SEQ ID NO: 4379048 - DNA, 19 bp, Homo sapiens
cagtttatcattcaagtgt

SEQ ID NO: 4379049 - DNA, 18 bp, Homo sapiens
cagtttcatctaaatgaa

SEQ ID NO: 4379050 - DNA, 15 bp, Homo sapiens
cagtttcatgtatgt

SEQ ID NO: 4379051 - DNA, 16 bp, Homo sapiens
cagtttcattcaacac

SEQ ID NO: 4379052 - DNA, 14 bp, Homo sapiens
cagtttctaaaatt

SEQ ID NO: 4379053 - DNA, 14 bp, Homo sapiens
cagtttcttgtgta

SEQ ID NO: 4379054 - DNA, 22 bp, Homo sapiens
cagtttcttgtgtagatttgaa

SEQ ID NO: 4379055 - DNA, 14 bp, Homo sapiens
cagtttcttttctt

SEQ ID NO: 4379056 - DNA, 20 bp, Homo sapiens
cagtttgaaattctgaattt

SEQ ID NO: 4379057 - DNA, 13 bp, Homo sapiens
cagtttgactttt

SEQ ID NO: 4379058 - DNA, 20 bp, Homo sapiens
cagtttgactttttggaatt

SEQ ID NO: 4379059 - DNA, 17 bp, Homo sapiens
cagtttgcaaaaaatgt

SEQ ID NO: 4379060 - DNA, 11 bp, Homo sapiens
cagtttgccca

SEQ ID NO: 4379061 - DNA, 16 bp, Homo sapiens
cagtttgttctccggg

SEQ ID NO: 4379062 - DNA, 16 bp, Homo sapiens
cagttttaactgtgga

SEQ ID NO: 4379063 - DNA, 18 bp, Homo sapiens
cagttttaactgtggata

SEQ ID NO: 4379064 - DNA, 18 bp, Homo sapiens
cagttttaataagaacag

SEQ ID NO: 4379065 - DNA, 22 bp, Homo sapiens
cagttttaataagaacagatca

SEQ ID NO: 4379066 - DNA, 19 bp, Homo sapiens
cagtttttaactctactgt

SEQ ID NO: 4379067 - DNA, 12 bp, Homo sapiens
cagtttttaatt

SEQ ID NO: 4379068 - DNA, 22 bp, Homo sapiens
cataaaaatctagcacactctt

SEQ ID NO: 4379069 - DNA, 15 bp, Homo sapiens
cataaaatacaaaaa

SEQ ID NO: 4379070 - DNA, 20 bp, Homo sapiens
cataaaccatttttgttact

SEQ ID NO: 4379071 - DNA, 15 bp, Homo sapiens
cataaactttctcca

SEQ ID NO: 4379072 - DNA, 17 bp, Homo sapiens
cataaagtgagaaaact

SEQ ID NO: 4379073 - DNA, 22 bp, Homo sapiens
cataaatactgtcaaacaataa

SEQ ID NO: 4379074 - DNA, 20 bp, Homo sapiens
cataaatcaatggttcaagt

SEQ ID NO: 4379075 - DNA, 19 bp, Homo sapiens
cataaatcacagaaaattt

SEQ ID NO: 4379076 - DNA, 20 bp, Homo sapiens
cataaatcttcttattaaat

SEQ ID NO: 4379077 - DNA, 13 bp, Homo sapiens
cataaattttaat

SEQ ID NO: 4379078 - DNA, 13 bp, Homo sapiens
cataacagtgcca

SEQ ID NO: 4379079 - DNA, 16 bp, Homo sapiens
cataacagtgccattg

SEQ ID NO: 4379080 - DNA, 19 bp, Homo sapiens
cataacagtgccattgtct

SEQ ID NO: 4379081 - DNA, 16 bp, Homo sapiens
cataaccaatttgtaa

SEQ ID NO: 4379082 - DNA, 18 bp, Homo sapiens
cataaccaatttgtaatg

SEQ ID NO: 4379083 - DNA, 16 bp, Homo sapiens
cataaccgtgaagctc

SEQ ID NO: 4379084 - DNA, 12 bp, Homo sapiens
cataacctgtct

SEQ ID NO: 4379085 - DNA, 13 bp, Homo sapiens
cataacggaaagt

SEQ ID NO: 4379086 - DNA, 16 bp, Homo sapiens
cataactcctgtccct

SEQ ID NO: 4379087 - DNA, 17 bp, Homo sapiens
cataactcctgtccctt

SEQ ID NO: 4379088 - DNA, 16 bp, Homo sapiens
cataactgcttcttgg

SEQ ID NO: 4379089 - DNA, 21 bp, Homo sapiens
cataacttattgctgatttta

SEQ ID NO: 4379090 - DNA, 22 bp, Homo sapiens
cataacttattgctgattttaa

SEQ ID NO: 4379091 - DNA, 14 bp, Homo sapiens
cataagaaggcaat

SEQ ID NO: 4379092 - DNA, 19 bp, Homo sapiens
cataagagaaagaggccag

SEQ ID NO: 4379093 - DNA, 17 bp, Homo sapiens
cataagctactgccatc

SEQ ID NO: 4379094 - DNA, 22 bp, Homo sapiens
cataaggagttagaaccacagc

SEQ ID NO: 4379095 - DNA, 14 bp, Homo sapiens
cataagggtagccc

SEQ ID NO: 4379096 - DNA, 18 bp, Homo sapiens
cataagttaatagaaagt

SEQ ID NO: 4379097 - DNA, 19 bp, Homo sapiens
cataataaattttctaaaa

SEQ ID NO: 4379098 - DNA, 14 bp, Homo sapiens
cataatatagctta

SEQ ID NO: 4379099 - DNA, 17 bp, Homo sapiens
cataatatagcttaaaa

SEQ ID NO: 4379100 - DNA, 22 bp, Homo sapiens
cataatgcattcttctctgttg

SEQ ID NO: 4379101 - DNA, 12 bp, Homo sapiens
cataatgctttg

SEQ ID NO: 4379102 - DNA, 15 bp, Homo sapiens
cataatgctttggaa

SEQ ID NO: 4379103 - DNA, 16 bp, Homo sapiens
cataatgctttggaaa

SEQ ID NO: 4379104 - DNA, 19 bp, Homo sapiens
cataatgggccactgaaat

SEQ ID NO: 4379105 - DNA, 20 bp, Homo sapiens
cataatgtactgatttcagt

SEQ ID NO: 4379106 - DNA, 19 bp, Homo sapiens
cataattagatccattaat

SEQ ID NO: 4379107 - DNA, 21 bp, Homo sapiens
cataattatccaggaagggaa

SEQ ID NO: 4379108 - DNA, 15 bp, Homo sapiens
cataattatgaaaac

SEQ ID NO: 4379109 - DNA, 21 bp, Homo sapiens
cataattatgaaaactcatga

SEQ ID NO: 4379110 - DNA, 16 bp, Homo sapiens
cataattcctacagca

SEQ ID NO: 4379111 - DNA, 18 bp, Homo sapiens
cataattcctacagcact

SEQ ID NO: 4379112 - DNA, 21 bp, Homo sapiens
cataattctaatctaacaatg

SEQ ID NO: 4379113 - DNA, 13 bp, Homo sapiens
cataattctgaaa

SEQ ID NO: 4379114 - DNA, 14 bp, Homo sapiens
cataattctgaaac

SEQ ID NO: 4379115 - DNA, 19 bp, Homo sapiens
cataattcttccttccctc

SEQ ID NO: 4379116 - DNA, 13 bp, Homo sapiens
cataattgcatga

SEQ ID NO: 4379117 - DNA, 14 bp, Homo sapiens
cataattgctttgc

SEQ ID NO: 4379118 - DNA, 19 bp, Homo sapiens
cataattgctttgccaaaa

SEQ ID NO: 4379119 - DNA, 22 bp, Homo sapiens
cataatttaaaaatctccatta

SEQ ID NO: 4379120 - DNA, 12 bp, Homo sapiens
cataatttatgg

SEQ ID NO: 4379121 - DNA, 16 bp, Homo sapiens
cataatttctgtttca

SEQ ID NO: 4379122 - DNA, 17 bp, Homo sapiens
cataatttctgtttcag

SEQ ID NO: 4379123 - DNA, 14 bp, Homo sapiens
cataatttgtctta

SEQ ID NO: 4379124 - DNA, 21 bp, Homo sapiens
cataatttgtcttagttgata

SEQ ID NO: 4379125 - DNA, 16 bp, Homo sapiens
cataatttgtttccag

SEQ ID NO: 4379126 - DNA, 18 bp, Homo sapiens
cataatttgtttccagca

SEQ ID NO: 4379127 - DNA, 13 bp, Homo sapiens
catacaaatttat

SEQ ID NO: 4379128 - DNA, 16 bp, Homo sapiens
catacaacagaaacca

SEQ ID NO: 4379129 - DNA, 22 bp, Homo sapiens
catacaacagaaaccagaaaag

SEQ ID NO: 4379130 - DNA, 11 bp, Homo sapiens
catacaatgta

SEQ ID NO: 4379131 - DNA, 19 bp, Homo sapiens
catacaatgtatgtacaat

SEQ ID NO: 4379132 - DNA, 18 bp, Homo sapiens
catacacgcaaatacact

SEQ ID NO: 4379133 - DNA, 21 bp, Homo sapiens
catacactgtatgttatagaa

SEQ ID NO: 4379134 - DNA, 14 bp, Homo sapiens
catacactttttct

SEQ ID NO: 4379135 - DNA, 16 bp, Homo sapiens
catacagaggtaacta

SEQ ID NO: 4379136 - DNA, 14 bp, Homo sapiens
catacaggggaggg

SEQ ID NO: 4379137 - DNA, 23 bp, Homo sapiens
catacaggggaggggcgcacccc

SEQ ID NO: 4379138 - DNA, 11 bp, Homo sapiens
catacagtttt

SEQ ID NO: 4379139 - DNA, 14 bp, Homo sapiens
cataccaatgaaaa

SEQ ID NO: 4379140 - DNA, 21 bp, Homo sapiens
cataccacaagacatttcttt

SEQ ID NO: 4379141 - DNA, 21 bp, Homo sapiens
catacctcctatgggttgtca

SEQ ID NO: 4379142 - DNA, 18 bp, Homo sapiens
cataccttttctcttttc

SEQ ID NO: 4379143 - DNA, 18 bp, Homo sapiens
catactcctgggctcaag

SEQ ID NO: 4379144 - DNA, 18 bp, Homo sapiens
catactgagaatatacaa

SEQ ID NO: 4379145 - DNA, 20 bp, Homo sapiens
catactgagggaccaactgg

SEQ ID NO: 4379146 - DNA, 16 bp, Homo sapiens
catactgcgtccaccc

SEQ ID NO: 4379147 - DNA, 18 bp, Homo sapiens
catactgcgtccaccctg

SEQ ID NO: 4379148 - DNA, 19 bp, Homo sapiens
catactgcgtccaccctga

SEQ ID NO: 4379149 - DNA, 20 bp, Homo sapiens
catactgcgtccaccctgag

SEQ ID NO: 4379150 - DNA, 17 bp, Homo sapiens
catactgtaacattcag

SEQ ID NO: 4379151 - DNA, 21 bp, Homo sapiens
catactgtacacatttcttaa

SEQ ID NO: 4379152 - DNA, 21 bp, Homo sapiens
catactgttttgaataaattt

SEQ ID NO: 4379153 - DNA, 19 bp, Homo sapiens
catacttaacatttcattg

SEQ ID NO: 4379154 - DNA, 16 bp, Homo sapiens
catacttatctctctg

SEQ ID NO: 4379155 - DNA, 18 bp, Homo sapiens
catacttatctctctgtg

SEQ ID NO: 4379156 - DNA, 22 bp, Homo sapiens
catacttatctctctgtgctgt

SEQ ID NO: 4379157 - DNA, 17 bp, Homo sapiens
catactttcatcctgac

SEQ ID NO: 4379158 - DNA, 15 bp, Homo sapiens
catactttgtaaata

SEQ ID NO: 4379159 - DNA, 16 bp, Homo sapiens
catactttttaaatgt

SEQ ID NO: 4379160 - DNA, 16 bp, Homo sapiens
catcaacaagatttcc

SEQ ID NO: 4379161 - DNA, 22 bp, Homo sapiens
catcaagactatctacaaaaat

SEQ ID NO: 4379162 - DNA, 21 bp, Homo sapiens
catcaagaggtgggagggccc

SEQ ID NO: 4379163 - DNA, 16 bp, Homo sapiens
catcaatcttgttact

SEQ ID NO: 4379164 - DNA, 23 bp, Homo sapiens
catcaatggctttgtacttgtga

SEQ ID NO: 4379165 - DNA, 16 bp, Homo sapiens
catcacaatattcagt

SEQ ID NO: 4379166 - DNA, 17 bp, Homo sapiens
catcacacccatttaaa

SEQ ID NO: 4379167 - DNA, 23 bp, Homo sapiens
catcacactcaaggacaggagcc

SEQ ID NO: 4379168 - DNA, 22 bp, Homo sapiens
catcacacttatattttatgaa

SEQ ID NO: 4379169 - DNA, 19 bp, Homo sapiens
catcacagggttgggccca

SEQ ID NO: 4379170 - DNA, 15 bp, Homo sapiens
catcacataaagaaa

SEQ ID NO: 4379171 - DNA, 13 bp, Homo sapiens
catcacatagtat

SEQ ID NO: 4379172 - DNA, 14 bp, Homo sapiens
catcacatcttatt

SEQ ID NO: 4379173 - DNA, 18 bp, Homo sapiens
catcaccatttcctcctt

SEQ ID NO: 4379174 - DNA, 20 bp, Homo sapiens
catcaccatttcttggcatt

SEQ ID NO: 4379175 - DNA, 13 bp, Homo sapiens
catcacccacctt

SEQ ID NO: 4379176 - DNA, 23 bp, Homo sapiens
catcacccttccgacaggagcac

SEQ ID NO: 4379177 - DNA, 23 bp, Homo sapiens
catcacctcaccaaggatcggac

SEQ ID NO: 4379178 - DNA, 21 bp, Homo sapiens
catcacggatggtgcatgggc

SEQ ID NO: 4379179 - DNA, 15 bp, Homo sapiens
catcactagtgacaa

SEQ ID NO: 4379180 - DNA, 23 bp, Homo sapiens
catcactatcaattttaaggaaa

SEQ ID NO: 4379181 - DNA, 11 bp, Homo sapiens
catcactgatg

SEQ ID NO: 4379182 - DNA, 14 bp, Homo sapiens
catcactgtaaaga

SEQ ID NO: 4379183 - DNA, 15 bp, Homo sapiens
catcacttctccccg

SEQ ID NO: 4379184 - DNA, 15 bp, Homo sapiens
catcactttgaccta

SEQ ID NO: 4379185 - DNA, 17 bp, Homo sapiens
catcagaaaaccaaagg

SEQ ID NO: 4379186 - DNA, 14 bp, Homo sapiens
catcagaaggagaa

SEQ ID NO: 4379187 - DNA, 18 bp, Homo sapiens
catcagactctagaaaaa

SEQ ID NO: 4379188 - DNA, 13 bp, Homo sapiens
catcagcactctg

SEQ ID NO: 4379189 - DNA, 11 bp, Homo sapiens
catcagctctg

SEQ ID NO: 4379190 - DNA, 15 bp, Homo sapiens
catcaggaaagagag

SEQ ID NO: 4379191 - DNA, 21 bp, Homo sapiens
catcagggcggcctcccaggt

SEQ ID NO: 4379192 - DNA, 19 bp, Homo sapiens
catcaggtcccccccaggt

SEQ ID NO: 4379193 - DNA, 15 bp, Homo sapiens
catcaggtgaggtgt

SEQ ID NO: 4379194 - DNA, 18 bp, Homo sapiens
catcagtagcatttttct

SEQ ID NO: 4379195 - DNA, 20 bp, Homo sapiens
catcagtagcatttttctaa

SEQ ID NO: 4379196 - DNA, 21 bp, Homo sapiens
catcagtttgttccttttgta

SEQ ID NO: 4379197 - DNA, 20 bp, Homo sapiens
catcataaggagttggtgta

SEQ ID NO: 4379198 - DNA, 23 bp, Homo sapiens
catcataggtaaggttttcaagg

SEQ ID NO: 4379199 - DNA, 18 bp, Homo sapiens
catcatcacgacacattt

SEQ ID NO: 4379200 - DNA, 14 bp, Homo sapiens
catcatcactgtaa

SEQ ID NO: 4379201 - DNA, 15 bp, Homo sapiens
catcatcactgtaaa

SEQ ID NO: 4379202 - DNA, 16 bp, Homo sapiens
catcatcactgtaaag

SEQ ID NO: 4379203 - DNA, 13 bp, Homo sapiens
catcatcagagcc

SEQ ID NO: 4379204 - DNA, 13 bp, Homo sapiens
catcatctcctgc

SEQ ID NO: 4379205 - DNA, 14 bp, Homo sapiens
catcatctctgaag

SEQ ID NO: 4379206 - DNA, 14 bp, Homo sapiens
catcatgagttctg

SEQ ID NO: 4379207 - DNA, 17 bp, Homo sapiens
catcatgagttctgctg

SEQ ID NO: 4379208 - DNA, 21 bp, Homo sapiens
catcatgctggaacctgcaaa

SEQ ID NO: 4379209 - DNA, 14 bp, Homo sapiens
catcatgtctattg

SEQ ID NO: 4379210 - DNA, 13 bp, Homo sapiens
catcatgtctgta

SEQ ID NO: 4379211 - DNA, 16 bp, Homo sapiens
catcatgtctgtatac

SEQ ID NO: 4379212 - DNA, 14 bp, Homo sapiens
catcattattgtag

SEQ ID NO: 4379213 - DNA, 16 bp, Homo sapiens
catcattgtcagcctt

SEQ ID NO: 4379214 - DNA, 21 bp, Homo sapiens
catcatttaaacatgcagaag

SEQ ID NO: 4379215 - DNA, 14 bp, Homo sapiens
catcatttcagcca

SEQ ID NO: 4379216 - DNA, 15 bp, Homo sapiens
catcatttcagccaa

SEQ ID NO: 4379217 - DNA, 22 bp, Homo sapiens
catccaaggaagggatgtattt

SEQ ID NO: 4379218 - DNA, 14 bp, Homo sapiens
catccactctaccc

SEQ ID NO: 4379219 - DNA, 15 bp, Homo sapiens
catccactctaccct

SEQ ID NO: 4379220 - DNA, 18 bp, Homo sapiens
catccactctaccctccc

SEQ ID NO: 4379221 - DNA, 17 bp, Homo sapiens
catccagagtccctgcc

SEQ ID NO: 4379222 - DNA, 20 bp, Homo sapiens
catccagagtccctgcctgg

SEQ ID NO: 4379223 - DNA, 22 bp, Homo sapiens
catccagccagaccccacgctg

SEQ ID NO: 4379224 - DNA, 13 bp, Homo sapiens
catccagcctcag

SEQ ID NO: 4379225 - DNA, 15 bp, Homo sapiens
catccaggctggcca

SEQ ID NO: 4379226 - DNA, 20 bp, Homo sapiens
catccaggctggccagtgct

SEQ ID NO: 4379227 - DNA, 13 bp, Homo sapiens
catccagggggca

SEQ ID NO: 4379228 - DNA, 16 bp, Homo sapiens
catccagtttgttctc

SEQ ID NO: 4379229 - DNA, 20 bp, Homo sapiens
catccatatttgctaagaat

SEQ ID NO: 4379230 - DNA, 14 bp, Homo sapiens
catccatcatcatg

SEQ ID NO: 4379231 - DNA, 19 bp, Homo sapiens
catccatggggctgattgt

SEQ ID NO: 4379232 - DNA, 16 bp, Homo sapiens
catccattcctcaggg

SEQ ID NO: 4379233 - DNA, 17 bp, Homo sapiens
catccattcctcaggga

SEQ ID NO: 4379234 - DNA, 18 bp, Homo sapiens
catccattcctcagggac

SEQ ID NO: 4379235 - DNA, 18 bp, Homo sapiens
catccattctcctcagtg

SEQ ID NO: 4379236 - DNA, 19 bp, Homo sapiens
catccattctcctcagtgg

SEQ ID NO: 4379237 - DNA, 14 bp, Homo sapiens
catccccaactcca

SEQ ID NO: 4379238 - DNA, 14 bp, Homo sapiens
catccccaccccac

SEQ ID NO: 4379239 - DNA, 21 bp, Homo sapiens
catccccaggggtcccagcca

SEQ ID NO: 4379240 - DNA, 15 bp, Homo sapiens
catccccctgcctcc

SEQ ID NO: 4379241 - DNA, 14 bp, Homo sapiens
catcccctccctgc

SEQ ID NO: 4379242 - DNA, 17 bp, Homo sapiens
catcccctccctgcctg

SEQ ID NO: 4379243 - DNA, 21 bp, Homo sapiens
catcccctccctgcctgctcc

SEQ ID NO: 4379244 - DNA, 14 bp, Homo sapiens
catccccttccccc

SEQ ID NO: 4379245 - DNA, 15 bp, Homo sapiens
catccccttccccca

SEQ ID NO: 4379246 - DNA, 18 bp, Homo sapiens
catcccgtatcacagtgt

SEQ ID NO: 4379247 - DNA, 22 bp, Homo sapiens
catccctaccccctaagagcca

SEQ ID NO: 4379248 - DNA, 20 bp, Homo sapiens
catccctcacccatcctaga

SEQ ID NO: 4379249 - DNA, 15 bp, Homo sapiens
catccctccttgcct

SEQ ID NO: 4379250 - DNA, 22 bp, Homo sapiens
catccctgcttgcccgctccca

SEQ ID NO: 4379251 - DNA, 18 bp, Homo sapiens
catccctggagcaggagc

SEQ ID NO: 4379252 - DNA, 20 bp, Homo sapiens
catccctggagcaggagccc

SEQ ID NO: 4379253 - DNA, 11 bp, Homo sapiens
catccctgggc

SEQ ID NO: 4379254 - DNA, 13 bp, Homo sapiens
catccctgggccc

SEQ ID NO: 4379255 - DNA, 19 bp, Homo sapiens
catccctgggcccctccac

SEQ ID NO: 4379256 - DNA, 13 bp, Homo sapiens
catccctgtgagg

SEQ ID NO: 4379257 - DNA, 18 bp, Homo sapiens
catccgtaggacaagttt

SEQ ID NO: 4379258 - DNA, 11 bp, Homo sapiens
catcctataag

SEQ ID NO: 4379259 - DNA, 22 bp, Homo sapiens
catcctcaaagaaagtgtattg

SEQ ID NO: 4379260 - DNA, 16 bp, Homo sapiens
catcctcccattgccc

SEQ ID NO: 4379261 - DNA, 19 bp, Homo sapiens
catcctcccattgcccagt

SEQ ID NO: 4379262 - DNA, 23 bp, Homo sapiens
catcctcccattgcccagtgagc

SEQ ID NO: 4379263 - DNA, 13 bp, Homo sapiens
catcctccctcca

SEQ ID NO: 4379264 - DNA, 12 bp, Homo sapiens
catcctcctgtg

SEQ ID NO: 4379265 - DNA, 21 bp, Homo sapiens
catcctctgatagctgtttca

SEQ ID NO: 4379266 - DNA, 17 bp, Homo sapiens
catcctgactctgcccc

SEQ ID NO: 4379267 - DNA, 22 bp, Homo sapiens
catcctgactctgccccctgct

SEQ ID NO: 4379268 - DNA, 21 bp, Homo sapiens
catcctgccttagagccaggc

SEQ ID NO: 4379269 - DNA, 23 bp, Homo sapiens
catcctgccttagagccaggcac

SEQ ID NO: 4379270 - DNA, 20 bp, Homo sapiens
catcctgctcttttgtgatg

SEQ ID NO: 4379271 - DNA, 19 bp, Homo sapiens
catcctggcccagggcatc

SEQ ID NO: 4379272 - DNA, 17 bp, Homo sapiens
catccttcttccactgt

SEQ ID NO: 4379273 - DNA, 21 bp, Homo sapiens
catcctttagggttctgcctc

SEQ ID NO: 4379274 - DNA, 22 bp, Homo sapiens
catcctttagggttctgcctct

SEQ ID NO: 4379275 - DNA, 17 bp, Homo sapiens
catcgaagggattgtgt

SEQ ID NO: 4379276 - DNA, 17 bp, Homo sapiens
catcgacttagcctgag

SEQ ID NO: 4379277 - DNA, 16 bp, Homo sapiens
catcgctcgtgtgttc

SEQ ID NO: 4379278 - DNA, 16 bp, Homo sapiens
catcgctgttctgggc

SEQ ID NO: 4379279 - DNA, 15 bp, Homo sapiens
catcggaaaaataat

SEQ ID NO: 4379280 - DNA, 19 bp, Homo sapiens
catcggacaagacccccag

SEQ ID NO: 4379281 - DNA, 21 bp, Homo sapiens
catcggacaagacccccagca

SEQ ID NO: 4379282 - DNA, 19 bp, Homo sapiens
catcggaggctgggcccct

SEQ ID NO: 4379283 - DNA, 23 bp, Homo sapiens
catcgttgcaaccactgcaatat

SEQ ID NO: 4379284 - DNA, 19 bp, Homo sapiens
catctaaacacaacaataa

SEQ ID NO: 4379285 - DNA, 17 bp, Homo sapiens
catctaaagctttatct

SEQ ID NO: 4379286 - DNA, 18 bp, Homo sapiens
catctaacctcatcttct

SEQ ID NO: 4379287 - DNA, 17 bp, Homo sapiens
catctaatgcttgttta

SEQ ID NO: 4379288 - DNA, 18 bp, Homo sapiens
catctaatgcttgtttat

SEQ ID NO: 4379289 - DNA, 15 bp, Homo sapiens
catctagaattcact

SEQ ID NO: 4379290 - DNA, 15 bp, Homo sapiens
catctatggttctaa

SEQ ID NO: 4379291 - DNA, 14 bp, Homo sapiens
catctatgtgaata

SEQ ID NO: 4379292 - DNA, 14 bp, Homo sapiens
catctattttgatg

SEQ ID NO: 4379293 - DNA, 17 bp, Homo sapiens
catctattttgatgcag

SEQ ID NO: 4379294 - DNA, 22 bp, Homo sapiens
catctattttgatgcagcattt

SEQ ID NO: 4379295 - DNA, 16 bp, Homo sapiens
catctattttggattg

SEQ ID NO: 4379296 - DNA, 23 bp, Homo sapiens
catctcacctttttaaatcctaa

SEQ ID NO: 4379297 - DNA, 13 bp, Homo sapiens
catctcagagtcc

SEQ ID NO: 4379298 - DNA, 21 bp, Homo sapiens
catctcagtgaagaatacttc

SEQ ID NO: 4379299 - DNA, 22 bp, Homo sapiens
catctcagtgaagaatacttct

SEQ ID NO: 4379300 - DNA, 12 bp, Homo sapiens
catctcatcatg

SEQ ID NO: 4379301 - DNA, 19 bp, Homo sapiens
catctcatttaagggaaaa

SEQ ID NO: 4379302 - DNA, 20 bp, Homo sapiens
catctcatttaagggaaaaa

SEQ ID NO: 4379303 - DNA, 22 bp, Homo sapiens
catctcatttaagggaaaaata

SEQ ID NO: 4379304 - DNA, 22 bp, Homo sapiens
catctccaatggaaagcttttc

SEQ ID NO: 4379305 - DNA, 17 bp, Homo sapiens
catctccatcttgaagg

SEQ ID NO: 4379306 - DNA, 16 bp, Homo sapiens
catctccatgtagaat

SEQ ID NO: 4379307 - DNA, 19 bp, Homo sapiens
catctcccaggccccaggg

SEQ ID NO: 4379308 - DNA, 12 bp, Homo sapiens
catctccgcctc

SEQ ID NO: 4379309 - DNA, 16 bp, Homo sapiens
catctccgcctccaca

SEQ ID NO: 4379310 - DNA, 17 bp, Homo sapiens
catctccgcctccacac

SEQ ID NO: 4379311 - DNA, 19 bp, Homo sapiens
catctcctgccttcctcct

SEQ ID NO: 4379312 - DNA, 16 bp, Homo sapiens
catctccttgatcatg

SEQ ID NO: 4379313 - DNA, 18 bp, Homo sapiens
catctccttgatcatgtc

SEQ ID NO: 4379314 - DNA, 21 bp, Homo sapiens
catctctccccatatataaat

SEQ ID NO: 4379315 - DNA, 19 bp, Homo sapiens
catctctgtgaagcctctc

SEQ ID NO: 4379316 - DNA, 16 bp, Homo sapiens
catctcttagctcccc

SEQ ID NO: 4379317 - DNA, 19 bp, Homo sapiens
catctcttagctcccctcc

SEQ ID NO: 4379318 - DNA, 17 bp, Homo sapiens
catctcttccccagaga

SEQ ID NO: 4379319 - DNA, 16 bp, Homo sapiens
catctcttccttcaga

SEQ ID NO: 4379320 - DNA, 15 bp, Homo sapiens
catctcttctgcaag

SEQ ID NO: 4379321 - DNA, 12 bp, Homo sapiens
catctgaaagcc

SEQ ID NO: 4379322 - DNA, 21 bp, Homo sapiens
catctgaaggggcaaattctt

SEQ ID NO: 4379323 - DNA, 15 bp, Homo sapiens
catctgaggttttat

SEQ ID NO: 4379324 - DNA, 17 bp, Homo sapiens
catctgagtccagctcc

SEQ ID NO: 4379325 - DNA, 22 bp, Homo sapiens
catctgatatctatagtagaca

SEQ ID NO: 4379326 - DNA, 17 bp, Homo sapiens
catctgcaatatgaatt

SEQ ID NO: 4379327 - DNA, 16 bp, Homo sapiens
catctgcaccccttct

SEQ ID NO: 4379328 - DNA, 17 bp, Homo sapiens
catctgcaccccttctc

SEQ ID NO: 4379329 - DNA, 22 bp, Homo sapiens
catctgcaccccttctctcctc

SEQ ID NO: 4379330 - DNA, 15 bp, Homo sapiens
catctgcaggacaga

SEQ ID NO: 4379331 - DNA, 18 bp, Homo sapiens
catctgcaggacagaggg

SEQ ID NO: 4379332 - DNA, 13 bp, Homo sapiens
catctgcccctcc

SEQ ID NO: 4379333 - DNA, 14 bp, Homo sapiens
catctgcccctccc

SEQ ID NO: 4379334 - DNA, 19 bp, Homo sapiens
catctgcgggggcagtgct

SEQ ID NO: 4379335 - DNA, 20 bp, Homo sapiens
catctgcgggggcagtgctc

SEQ ID NO: 4379336 - DNA, 13 bp, Homo sapiens
catctgctctcct

SEQ ID NO: 4379337 - DNA, 22 bp, Homo sapiens
catctgcttggttggctggcag

SEQ ID NO: 4379338 - DNA, 22 bp, Homo sapiens
catctggaaagttttctccact

SEQ ID NO: 4379339 - DNA, 21 bp, Homo sapiens
catctggagggttctaagtgg

SEQ ID NO: 4379340 - DNA, 18 bp, Homo sapiens
catctggataggagcctg

SEQ ID NO: 4379341 - DNA, 20 bp, Homo sapiens
catctggcaacatctttatc

SEQ ID NO: 4379342 - DNA, 14 bp, Homo sapiens
catctggctctaat

SEQ ID NO: 4379343 - DNA, 18 bp, Homo sapiens
catctggctctaattcac

SEQ ID NO: 4379344 - DNA, 22 bp, Homo sapiens
catctgtaaatctacacacggt

SEQ ID NO: 4379345 - DNA, 12 bp, Homo sapiens
catctgtcatta

SEQ ID NO: 4379346 - DNA, 15 bp, Homo sapiens
catctgtcattatat

SEQ ID NO: 4379347 - DNA, 18 bp, Homo sapiens
catctgtccctccgggac

SEQ ID NO: 4379348 - DNA, 23 bp, Homo sapiens
catctgtctgccaacctaaaact

SEQ ID NO: 4379349 - DNA, 11 bp, Homo sapiens
catctgtgtct

SEQ ID NO: 4379350 - DNA, 13 bp, Homo sapiens
catctgtgtcttg

SEQ ID NO: 4379351 - DNA, 14 bp, Homo sapiens
catctgtttgtaat

SEQ ID NO: 4379352 - DNA, 20 bp, Homo sapiens
catcttaaaagctatcttca

SEQ ID NO: 4379353 - DNA, 18 bp, Homo sapiens
catcttaggggattatct

SEQ ID NO: 4379354 - DNA, 14 bp, Homo sapiens
catcttatttattt

SEQ ID NO: 4379355 - DNA, 21 bp, Homo sapiens
catcttctaaacccaatccaa

SEQ ID NO: 4379356 - DNA, 14 bp, Homo sapiens
catcttctccatct

SEQ ID NO: 4379357 - DNA, 13 bp, Homo sapiens
catcttctggctt

SEQ ID NO: 4379358 - DNA, 19 bp, Homo sapiens
catcttgatctttgagccc

SEQ ID NO: 4379359 - DNA, 20 bp, Homo sapiens
catcttgatctttgagccca

SEQ ID NO: 4379360 - DNA, 22 bp, Homo sapiens
catcttgatctttgagcccatt

SEQ ID NO: 4379361 - DNA, 14 bp, Homo sapiens
catcttgctaccag

SEQ ID NO: 4379362 - DNA, 16 bp, Homo sapiens
catcttgctaccagta

SEQ ID NO: 4379363 - DNA, 14 bp, Homo sapiens
catcttggcagggt

SEQ ID NO: 4379364 - DNA, 18 bp, Homo sapiens
catcttggtagttctgtg

SEQ ID NO: 4379365 - DNA, 23 bp, Homo sapiens
catcttggtagttctgtgcctcc

SEQ ID NO: 4379366 - DNA, 23 bp, Homo sapiens
catcttggttatttctgaaggta

SEQ ID NO: 4379367 - DNA, 21 bp, Homo sapiens
catctttattgaaattctatt

SEQ ID NO: 4379368 - DNA, 17 bp, Homo sapiens
catctttgccttgggct

SEQ ID NO: 4379369 - DNA, 22 bp, Homo sapiens
catcttttctagagacacattg

SEQ ID NO: 4379370 - DNA, 14 bp, Homo sapiens
catcttttcttgcc

SEQ ID NO: 4379371 - DNA, 15 bp, Homo sapiens
catcttttgatcttt

SEQ ID NO: 4379372 - DNA, 11 bp, Homo sapiens
catctttttaa

SEQ ID NO: 4379373 - DNA, 21 bp, Homo sapiens
catctttttaaagcttatcca

SEQ ID NO: 4379374 - DNA, 16 bp, Homo sapiens
catgaaaaacaaacaa

SEQ ID NO: 4379375 - DNA, 13 bp, Homo sapiens
catgaaaatgtat

SEQ ID NO: 4379376 - DNA, 13 bp, Homo sapiens
catgaaatgtgtt

SEQ ID NO: 4379377 - DNA, 14 bp, Homo sapiens
catgaaatgtgttt

SEQ ID NO: 4379378 - DNA, 13 bp, Homo sapiens
catgaacagcttg

SEQ ID NO: 4379379 - DNA, 18 bp, Homo sapiens
catgaagatgtagaggag

SEQ ID NO: 4379380 - DNA, 13 bp, Homo sapiens
catgaagcctgtg

SEQ ID NO: 4379381 - DNA, 11 bp, Homo sapiens
catgaagcctt

SEQ ID NO: 4379382 - DNA, 12 bp, Homo sapiens
catgaagccttt

SEQ ID NO: 4379383 - DNA, 15 bp, Homo sapiens
catgaagccttttga

SEQ ID NO: 4379384 - DNA, 14 bp, Homo sapiens
catgaaggtaaata

SEQ ID NO: 4379385 - DNA, 20 bp, Homo sapiens
catgaaggtaaataaaaaga

SEQ ID NO: 4379386 - DNA, 16 bp, Homo sapiens
catgaataaaattagg

SEQ ID NO: 4379387 - DNA, 17 bp, Homo sapiens
catgaataacatttaaa

SEQ ID NO: 4379388 - DNA, 20 bp, Homo sapiens
catgaataacatttaaattc

SEQ ID NO: 4379389 - DNA, 22 bp, Homo sapiens
catgaataacatttaaattcca

SEQ ID NO: 4379390 - DNA, 14 bp, Homo sapiens
catgaatatggtgt

SEQ ID NO: 4379391 - DNA, 17 bp, Homo sapiens
catgaatattttcaagt

SEQ ID NO: 4379392 - DNA, 21 bp, Homo sapiens
catgaattacctggatgttct

SEQ ID NO: 4379393 - DNA, 22 bp, Homo sapiens
catgaattccactccttccaga

SEQ ID NO: 4379394 - DNA, 16 bp, Homo sapiens
catgaattttaaagta

SEQ ID NO: 4379395 - DNA, 17 bp, Homo sapiens
catgaattttaaagtat

SEQ ID NO: 4379396 - DNA, 18 bp, Homo sapiens
catggagccccagccccc

SEQ ID NO: 4379397 - DNA, 15 bp, Homo sapiens
catggagccccctct

SEQ ID NO: 4379398 - DNA, 19 bp, Homo sapiens
catggagccccctctgccg

SEQ ID NO: 4379399 - DNA, 22 bp, Homo sapiens
catggagctataactaagcatc

SEQ ID NO: 4379400 - DNA, 16 bp, Homo sapiens
catggagctgtcacct

SEQ ID NO: 4379401 - DNA, 18 bp, Homo sapiens
catggagctgtcacctct

SEQ ID NO: 4379402 - DNA, 19 bp, Homo sapiens
catggaggatggtgtcctg

SEQ ID NO: 4379403 - DNA, 13 bp, Homo sapiens
catggatgattct

SEQ ID NO: 4379404 - DNA, 17 bp, Homo sapiens
catggatgattcttttc

SEQ ID NO: 4379405 - DNA, 15 bp, Homo sapiens
catggatgcatttca

SEQ ID NO: 4379406 - DNA, 20 bp, Homo sapiens
catggatgcatttcaaatgt

SEQ ID NO: 4379407 - DNA, 16 bp, Homo sapiens
catggatttccactgc

SEQ ID NO: 4379408 - DNA, 15 bp, Homo sapiens
catggcaatgaaaat

SEQ ID NO: 4379409 - DNA, 20 bp, Homo sapiens
catggcaatgaaaattttaa

SEQ ID NO: 4379410 - DNA, 13 bp, Homo sapiens
catggcagctggt

SEQ ID NO: 4379411 - DNA, 18 bp, Homo sapiens
catggcaggacagctcct

SEQ ID NO: 4379412 - DNA, 19 bp, Homo sapiens
catggcagggccaggcctc

SEQ ID NO: 4379413 - DNA, 13 bp, Homo sapiens
catggcatatttt

SEQ ID NO: 4379414 - DNA, 18 bp, Homo sapiens
catggcatgcttaaattt

SEQ ID NO: 4379415 - DNA, 13 bp, Homo sapiens
catggcccccaat

SEQ ID NO: 4379416 - DNA, 19 bp, Homo sapiens
catggcccccaataaaggc

SEQ ID NO: 4379417 - DNA, 13 bp, Homo sapiens
catggcctcagcc

SEQ ID NO: 4379418 - DNA, 16 bp, Homo sapiens
catggcctcagccctg

SEQ ID NO: 4379419 - DNA, 20 bp, Homo sapiens
catggcctgagatgcaggtg

SEQ ID NO: 4379420 - DNA, 18 bp, Homo sapiens
catggcctgagcatccag

SEQ ID NO: 4379421 - DNA, 18 bp, Homo sapiens
catggctaatttaacacc

SEQ ID NO: 4379422 - DNA, 17 bp, Homo sapiens
catggctattttatatt

SEQ ID NO: 4379423 - DNA, 13 bp, Homo sapiens
catggctcctgtc

SEQ ID NO: 4379424 - DNA, 16 bp, Homo sapiens
catggctcctgtctgg

SEQ ID NO: 4379425 - DNA, 24 bp, Homo sapiens
catggctgggaactgcagacctgt

SEQ ID NO: 4379426 - DNA, 14 bp, Homo sapiens
catggctgtgagga

SEQ ID NO: 4379427 - DNA, 22 bp, Homo sapiens
catgggaaatagcggccctgga

SEQ ID NO: 4379428 - DNA, 20 bp, Homo sapiens
catgggaagacgaggccctc

SEQ ID NO: 4379429 - DNA, 20 bp, Homo sapiens
catgggagcagtccatgcat

SEQ ID NO: 4379430 - DNA, 15 bp, Homo sapiens
catgggagggatcag

SEQ ID NO: 4379431 - DNA, 13 bp, Homo sapiens
catgggaggggga

SEQ ID NO: 4379432 - DNA, 17 bp, Homo sapiens
catgggcagagcccaag

SEQ ID NO: 4379433 - DNA, 18 bp, Homo sapiens
catgggcctgtggggact

SEQ ID NO: 4379434 - DNA, 20 bp, Homo sapiens
catgggcctttaagaacctt

SEQ ID NO: 4379435 - DNA, 15 bp, Homo sapiens
catggggaaaaaaat

SEQ ID NO: 4379436 - DNA, 18 bp, Homo sapiens
catggggaaaaaaatcat

SEQ ID NO: 4379437 - DNA, 23 bp, Homo sapiens
catggggaggttgtggggcctca

SEQ ID NO: 4379438 - DNA, 22 bp, Homo sapiens
catggggagtaataggaccaga

SEQ ID NO: 4379439 - DNA, 14 bp, Homo sapiens
catggggccaggaa

SEQ ID NO: 4379440 - DNA, 21 bp, Homo sapiens
catgggtcctagcccttccct

SEQ ID NO: 4379441 - DNA, 18 bp, Homo sapiens
catgggtgtgcccttggg

SEQ ID NO: 4379442 - DNA, 17 bp, Homo sapiens
catggtactaccccagc

SEQ ID NO: 4379443 - DNA, 18 bp, Homo sapiens
catggtactaccccagcc

SEQ ID NO: 4379444 - DNA, 13 bp, Homo sapiens
catggtacttcct

SEQ ID NO: 4379445 - DNA, 17 bp, Homo sapiens
catggtacttcctctgt

SEQ ID NO: 4379446 - DNA, 17 bp, Homo sapiens
catggtcacacactgat

SEQ ID NO: 4379447 - DNA, 13 bp, Homo sapiens
catggtcacagta

SEQ ID NO: 4379448 - DNA, 16 bp, Homo sapiens
catggtcagccctagg

SEQ ID NO: 4379449 - DNA, 21 bp, Homo sapiens
catggtgaaacccccatctct

SEQ ID NO: 4379450 - DNA, 19 bp, Homo sapiens
catggtgaaaccccgtctc

SEQ ID NO: 4379451 - DNA, 23 bp, Homo sapiens
catggtgagtctatttttaatgc

SEQ ID NO: 4379452 - DNA, 18 bp, Homo sapiens
catggtgcctgagaggca

SEQ ID NO: 4379453 - DNA, 19 bp, Homo sapiens
catggtgcctgagaggcag

SEQ ID NO: 4379454 - DNA, 21 bp, Homo sapiens
catggtgcctgagaggcaggc

SEQ ID NO: 4379455 - DNA, 13 bp, Homo sapiens
catggtgctactt

SEQ ID NO: 4379456 - DNA, 14 bp, Homo sapiens
catggtgctagtgg

SEQ ID NO: 4379457 - DNA, 21 bp, Homo sapiens
catggtgctagtgggccctct

SEQ ID NO: 4379458 - DNA, 17 bp, Homo sapiens
catggtggcgcaagcct

SEQ ID NO: 4379459 - DNA, 18 bp, Homo sapiens
catggtggcgcaagcctg

SEQ ID NO: 4379460 - DNA, 22 bp, Homo sapiens
catggtggcggcgaagaagaga

SEQ ID NO: 4379461 - DNA, 19 bp, Homo sapiens
catggtggctcatgcctgt

SEQ ID NO: 4379462 - DNA, 15 bp, Homo sapiens
catggtgtctcccaa

SEQ ID NO: 4379463 - DNA, 17 bp, Homo sapiens
catggtgtctcccaaca

SEQ ID NO: 4379464 - DNA, 19 bp, Homo sapiens
catggtgtctcccaacatg

SEQ ID NO: 4379465 - DNA, 18 bp, Homo sapiens
catggtgtgatcgtctga

SEQ ID NO: 4379466 - DNA, 14 bp, Homo sapiens
catggtgtgttaca

SEQ ID NO: 4379467 - DNA, 15 bp, Homo sapiens
catggtgtgttacac

SEQ ID NO: 4379468 - DNA, 14 bp, Homo sapiens
catggttctgcctc

SEQ ID NO: 4379469 - DNA, 15 bp, Homo sapiens
catggttctgcctcc

SEQ ID NO: 4379470 - DNA, 16 bp, Homo sapiens
catggttctgcctcct

SEQ ID NO: 4379471 - DNA, 20 bp, Homo sapiens
catggttctgcctcctggcc

SEQ ID NO: 4379472 - DNA, 14 bp, Homo sapiens
catggttgggggaa

SEQ ID NO: 4379473 - DNA, 22 bp, Homo sapiens
catggtttaaaagaaaaaatga

SEQ ID NO: 4379474 - DNA, 17 bp, Homo sapiens
catggtttgcatttaaa

SEQ ID NO: 4379475 - DNA, 15 bp, Homo sapiens
catgtaaactgtgca

SEQ ID NO: 4379476 - DNA, 16 bp, Homo sapiens
catgtaaactgtgcac

SEQ ID NO: 4379477 - DNA, 15 bp, Homo sapiens
catgtaaccactgca

SEQ ID NO: 4379478 - DNA, 18 bp, Homo sapiens
catgtaaccactgcactt

SEQ ID NO: 4379479 - DNA, 17 bp, Homo sapiens
catgtaagaaaatgtta

SEQ ID NO: 4379480 - DNA, 18 bp, Homo sapiens
catgtaagaaaatgttac

SEQ ID NO: 4379481 - DNA, 21 bp, Homo sapiens
catgtaatggtatcttaaagt

SEQ ID NO: 4379482 - DNA, 17 bp, Homo sapiens
catgtactacagctata

SEQ ID NO: 4379483 - DNA, 16 bp, Homo sapiens
catgtagactgtgcca

SEQ ID NO: 4379484 - DNA, 14 bp, Homo sapiens
catgtagcaggact

SEQ ID NO: 4379485 - DNA, 20 bp, Homo sapiens
catgtagcaggactgaattg

SEQ ID NO: 4379486 - DNA, 12 bp, Homo sapiens
catgtagcatat

SEQ ID NO: 4379487 - DNA, 17 bp, Homo sapiens
catgtagcatataaatg

SEQ ID NO: 4379488 - DNA, 21 bp, Homo sapiens
catgtagcatataaatgttta

SEQ ID NO: 4379489 - DNA, 22 bp, Homo sapiens
catgtagtaacactaatatatt

SEQ ID NO: 4379490 - DNA, 22 bp, Homo sapiens
catgtagttgaatttcagtcct

SEQ ID NO: 4379491 - DNA, 15 bp, Homo sapiens
catgtatcatctgga

SEQ ID NO: 4379492 - DNA, 14 bp, Homo sapiens
catgtatgtgtgct

SEQ ID NO: 4379493 - DNA, 15 bp, Homo sapiens
catgtatttgttata

SEQ ID NO: 4379494 - DNA, 16 bp, Homo sapiens
catgtcacaatacagt

SEQ ID NO: 4379495 - DNA, 19 bp, Homo sapiens
catgtcaccggtcagtgcc

SEQ ID NO: 4379496 - DNA, 20 bp, Homo sapiens
catgtcaccggtcagtgcct

SEQ ID NO: 4379497 - DNA, 23 bp, Homo sapiens
catgtcaccggtcagtgcctttt

SEQ ID NO: 4379498 - DNA, 13 bp, Homo sapiens
catgtcagagcac

SEQ ID NO: 4379499 - DNA, 19 bp, Homo sapiens
catgtcatcaaaatctgca

SEQ ID NO: 4379500 - DNA, 21 bp, Homo sapiens
catgtcatttgcacacaaaaa

SEQ ID NO: 4379501 - DNA, 17 bp, Homo sapiens
catgtccaaagaggctg

SEQ ID NO: 4379502 - DNA, 14 bp, Homo sapiens
catgtccatatgca

SEQ ID NO: 4379503 - DNA, 17 bp, Homo sapiens
catgtcccacccacccg

SEQ ID NO: 4379504 - DNA, 18 bp, Homo sapiens
catgtcccacccacccgc

SEQ ID NO: 4379505 - DNA, 14 bp, Homo sapiens
catgtcctgtaaag

SEQ ID NO: 4379506 - DNA, 13 bp, Homo sapiens
catgtcggcctct

SEQ ID NO: 4379507 - DNA, 18 bp, Homo sapiens
catgtctgccaaaatgca

SEQ ID NO: 4379508 - DNA, 20 bp, Homo sapiens
catgtctgccaaaatgcaac

SEQ ID NO: 4379509 - DNA, 17 bp, Homo sapiens
catgtctgcctatgcac

SEQ ID NO: 4379510 - DNA, 21 bp, Homo sapiens
catgtctgtatactcctgtca

SEQ ID NO: 4379511 - DNA, 22 bp, Homo sapiens
catgtctgtatactcctgtcac

SEQ ID NO: 4379512 - DNA, 22 bp, Homo sapiens
catgtcttcattttttaatgtg

SEQ ID NO: 4379513 - DNA, 21 bp, Homo sapiens
catgtcttgtcatacaaattt

SEQ ID NO: 4379514 - DNA, 15 bp, Homo sapiens
catgtcttttaaaat

SEQ ID NO: 4379515 - DNA, 16 bp, Homo sapiens
catgtgactctttcca

SEQ ID NO: 4379516 - DNA, 11 bp, Homo sapiens
catgtgcaata

SEQ ID NO: 4379517 - DNA, 11 bp, Homo sapiens
catgtgccttt

SEQ ID NO: 4379518 - DNA, 19 bp, Homo sapiens
catgtgcctttctttgcct

SEQ ID NO: 4379519 - DNA, 15 bp, Homo sapiens
catgtgctgccctgt

SEQ ID NO: 4379520 - DNA, 14 bp, Homo sapiens
catgtgtcccagga

SEQ ID NO: 4379521 - DNA, 20 bp, Homo sapiens
catgtgtcccctcactctgt

SEQ ID NO: 4379522 - DNA, 24 bp, Homo sapiens
catgtgtcccctcactctgtcagc

SEQ ID NO: 4379523 - DNA, 18 bp, Homo sapiens
catgtgtgctcacaatgt

SEQ ID NO: 4379524 - DNA, 21 bp, Homo sapiens
catgtgtggtacatggtgttt

SEQ ID NO: 4379525 - DNA, 12 bp, Homo sapiens
catgtgtgtcca

SEQ ID NO: 4379526 - DNA, 22 bp, Homo sapiens
catgtgtgtccacgactgtctc

SEQ ID NO: 4379527 - DNA, 14 bp, Homo sapiens
catgtgttcccttt

SEQ ID NO: 4379528 - DNA, 16 bp, Homo sapiens
catgtgttttcatcat

SEQ ID NO: 4379529 - DNA, 23 bp, Homo sapiens
catgtgttttcatcatttcagcc

SEQ ID NO: 4379530 - DNA, 15 bp, Homo sapiens
catgttaaattagaa

SEQ ID NO: 4379531 - DNA, 19 bp, Homo sapiens
catgttaagtcctccctga

SEQ ID NO: 4379532 - DNA, 17 bp, Homo sapiens
catgttactggataaat

SEQ ID NO: 4379533 - DNA, 15 bp, Homo sapiens
catgttatgtttcta

SEQ ID NO: 4379534 - DNA, 19 bp, Homo sapiens
catgttccccagttcagtg

SEQ ID NO: 4379535 - DNA, 13 bp, Homo sapiens
catgttctcccaa

SEQ ID NO: 4379536 - DNA, 19 bp, Homo sapiens
catgttctgggtgatggaa

SEQ ID NO: 4379537 - DNA, 17 bp, Homo sapiens
catgttgatcatgtact

SEQ ID NO: 4379538 - DNA, 20 bp, Homo sapiens
catgttgatcatgtactttt

SEQ ID NO: 4379539 - DNA, 18 bp, Homo sapiens
catgttggaaatgtgttt

SEQ ID NO: 4379540 - DNA, 19 bp, Homo sapiens
catgttggcctcttcaggc

SEQ ID NO: 4379541 - DNA, 20 bp, Homo sapiens
catgttggttgcactttgta

SEQ ID NO: 4379542 - DNA, 22 bp, Homo sapiens
catgttggttgcactttgtagt

SEQ ID NO: 4379543 - DNA, 14 bp, Homo sapiens
catgtttaaaacaa

SEQ ID NO: 4379544 - DNA, 23 bp, Homo sapiens
catgtttataaatcttatgctct

SEQ ID NO: 4379545 - DNA, 20 bp, Homo sapiens
catgtttatttttcttgtct

SEQ ID NO: 4379546 - DNA, 16 bp, Homo sapiens
catgtttgagctcaga

SEQ ID NO: 4379547 - DNA, 22 bp, Homo sapiens
catgttttaaaatctataacat

SEQ ID NO: 4379548 - DNA, 15 bp, Homo sapiens
catgtttttgaaaaa

SEQ ID NO: 4379549 - DNA, 19 bp, Homo sapiens
cattaaaacagaagcaaat

SEQ ID NO: 4379550 - DNA, 15 bp, Homo sapiens
cattaaacaaataaa

SEQ ID NO: 4379551 - DNA, 11 bp, Homo sapiens
cattaaacttt

SEQ ID NO: 4379552 - DNA, 19 bp, Homo sapiens
cattaaacttttttaacca

SEQ ID NO: 4379553 - DNA, 13 bp, Homo sapiens
cattaaagtcaga

SEQ ID NO: 4379554 - DNA, 19 bp, Homo sapiens
cattaacccatctctgaac

SEQ ID NO: 4379555 - DNA, 17 bp, Homo sapiens
cattaacggtgctaaaa

SEQ ID NO: 4379556 - DNA, 20 bp, Homo sapiens
cattaactatttttttcaaa

SEQ ID NO: 4379557 - DNA, 18 bp, Homo sapiens
cattaagaaaaacaataa

SEQ ID NO: 4379558 - DNA, 16 bp, Homo sapiens
cattaagaaaatattt

SEQ ID NO: 4379559 - DNA, 23 bp, Homo sapiens
cattaatgcctgctttttggaaa

SEQ ID NO: 4379560 - DNA, 12 bp, Homo sapiens
cattaattctat

SEQ ID NO: 4379561 - DNA, 17 bp, Homo sapiens
cattaattgctaacaat

SEQ ID NO: 4379562 - DNA, 14 bp, Homo sapiens
cattaatttaaatg

SEQ ID NO: 4379563 - DNA, 17 bp, Homo sapiens
cattaatttcaaaattt

SEQ ID NO: 4379564 - DNA, 23 bp, Homo sapiens
cattacaatcgagactgcaatgt

SEQ ID NO: 4379565 - DNA, 15 bp, Homo sapiens
cattaccactcaggc

SEQ ID NO: 4379566 - DNA, 19 bp, Homo sapiens
cattaccttttaccagctt

SEQ ID NO: 4379567 - DNA, 20 bp, Homo sapiens
cattactattaactctgcat

SEQ ID NO: 4379568 - DNA, 15 bp, Homo sapiens
cattacttgaatgta

SEQ ID NO: 4379569 - DNA, 15 bp, Homo sapiens
cattacttgtataaa

SEQ ID NO: 4379570 - DNA, 12 bp, Homo sapiens
cattacttttta

SEQ ID NO: 4379571 - DNA, 14 bp, Homo sapiens
cattagaaatattc

SEQ ID NO: 4379572 - DNA, 18 bp, Homo sapiens
cattagaaatattttaaa

SEQ ID NO: 4379573 - DNA, 18 bp, Homo sapiens
cattagaattaccatttg

SEQ ID NO: 4379574 - DNA, 17 bp, Homo sapiens
cattagagtcaactaca

SEQ ID NO: 4379575 - DNA, 14 bp, Homo sapiens
cattagccaaggat

SEQ ID NO: 4379576 - DNA, 13 bp, Homo sapiens
cattagttttgaa

SEQ ID NO: 4379577 - DNA, 14 bp, Homo sapiens
cattataaaagatc

SEQ ID NO: 4379578 - DNA, 19 bp, Homo sapiens
cattataaagttcagatgt

SEQ ID NO: 4379579 - DNA, 18 bp, Homo sapiens
cattatattctaattaaa

SEQ ID NO: 4379580 - DNA, 19 bp, Homo sapiens
cattatattctaattaaaa

SEQ ID NO: 4379581 - DNA, 17 bp, Homo sapiens
cattatctctttctctc

SEQ ID NO: 4379582 - DNA, 22 bp, Homo sapiens
cattatgagaggcaatgattgt

SEQ ID NO: 4379583 - DNA, 15 bp, Homo sapiens
cattatgctttgaac

SEQ ID NO: 4379584 - DNA, 18 bp, Homo sapiens
cattatggataaagatga

SEQ ID NO: 4379585 - DNA, 17 bp, Homo sapiens
cattatgttaatatttc

SEQ ID NO: 4379586 - DNA, 15 bp, Homo sapiens
cattatgtttaagat

SEQ ID NO: 4379587 - DNA, 20 bp, Homo sapiens
cattattaggtcttaaagta

SEQ ID NO: 4379588 - DNA, 22 bp, Homo sapiens
cattattatataaatcatgatg

SEQ ID NO: 4379589 - DNA, 18 bp, Homo sapiens
cattattatctagctaag

SEQ ID NO: 4379590 - DNA, 20 bp, Homo sapiens
cattattcatctctcctccc

SEQ ID NO: 4379591 - DNA, 24 bp, Homo sapiens
cattattctctgctatatataaaa

SEQ ID NO: 4379592 - DNA, 14 bp, Homo sapiens
cattattgcttatt

SEQ ID NO: 4379593 - DNA, 14 bp, Homo sapiens
cattattgtagttt

SEQ ID NO: 4379594 - DNA, 13 bp, Homo sapiens
cattatttattaa

SEQ ID NO: 4379595 - DNA, 17 bp, Homo sapiens
cattatttcaaaatgat

SEQ ID NO: 4379596 - DNA, 12 bp, Homo sapiens
cattatttgtca

SEQ ID NO: 4379597 - DNA, 13 bp, Homo sapiens
cattatttgtcaa

SEQ ID NO: 4379598 - DNA, 21 bp, Homo sapiens
cattatttttgttagcaaaga

SEQ ID NO: 4379599 - DNA, 21 bp, Homo sapiens
cattcaaaaaactctctccca

SEQ ID NO: 4379600 - DNA, 16 bp, Homo sapiens
cattcaacacattttt

SEQ ID NO: 4379601 - DNA, 18 bp, Homo sapiens
cattcaacagagactgaa

SEQ ID NO: 4379602 - DNA, 17 bp, Homo sapiens
cattcaatctttggagg

SEQ ID NO: 4379603 - DNA, 15 bp, Homo sapiens
cattcacaagcctcc

SEQ ID NO: 4379604 - DNA, 13 bp, Homo sapiens
cattcaggaaaac

SEQ ID NO: 4379605 - DNA, 23 bp, Homo sapiens
cattcaggaaaactgacagagga

SEQ ID NO: 4379606 - DNA, 13 bp, Homo sapiens
cattcaggaattc

SEQ ID NO: 4379607 - DNA, 21 bp, Homo sapiens
cattcaggtgacctcctgcag

SEQ ID NO: 4379608 - DNA, 15 bp, Homo sapiens
cattcagtgtaaatt

SEQ ID NO: 4379609 - DNA, 22 bp, Homo sapiens
cattcagtgtaaattaattaca

SEQ ID NO: 4379610 - DNA, 14 bp, Homo sapiens
cattccaccacccc

SEQ ID NO: 4379611 - DNA, 18 bp, Homo sapiens
cattccactgttggtatt

SEQ ID NO: 4379612 - DNA, 15 bp, Homo sapiens
cattccagacttcaa

SEQ ID NO: 4379613 - DNA, 16 bp, Homo sapiens
cattccagacttcaaa

SEQ ID NO: 4379614 - DNA, 19 bp, Homo sapiens
cattccagctctgcccccg

SEQ ID NO: 4379615 - DNA, 17 bp, Homo sapiens
cattcccagagtcagag

SEQ ID NO: 4379616 - DNA, 20 bp, Homo sapiens
cattcccagggaccttggaa

SEQ ID NO: 4379617 - DNA, 11 bp, Homo sapiens
cattcccattc

SEQ ID NO: 4379618 - DNA, 13 bp, Homo sapiens
cattccccaggtg

SEQ ID NO: 4379619 - DNA, 19 bp, Homo sapiens
cattccccattctgtgtcc

SEQ ID NO: 4379620 - DNA, 20 bp, Homo sapiens
cattcccctccccactcctc

SEQ ID NO: 4379621 - DNA, 17 bp, Homo sapiens
cattccctgagtcacca

SEQ ID NO: 4379622 - DNA, 19 bp, Homo sapiens
cattcctaaaacacccttc

SEQ ID NO: 4379623 - DNA, 22 bp, Homo sapiens
cattcctaaaacacccttcagc

SEQ ID NO: 4379624 - DNA, 16 bp, Homo sapiens
cattcctcagggacag

SEQ ID NO: 4379625 - DNA, 20 bp, Homo sapiens
cattcctccagtgcatactg

SEQ ID NO: 4379626 - DNA, 14 bp, Homo sapiens
cattcctctgccct

SEQ ID NO: 4379627 - DNA, 12 bp, Homo sapiens
cattcctgcctg

SEQ ID NO: 4379628 - DNA, 14 bp, Homo sapiens
cattcctgcctggt

SEQ ID NO: 4379629 - DNA, 15 bp, Homo sapiens
cattcctgcctggtc

SEQ ID NO: 4379630 - DNA, 21 bp, Homo sapiens
cattcctgggaaatattccct

SEQ ID NO: 4379631 - DNA, 11 bp, Homo sapiens
cattccttctc

SEQ ID NO: 4379632 - DNA, 19 bp, Homo sapiens
cattccttgcgcctcagcc

SEQ ID NO: 4379633 - DNA, 13 bp, Homo sapiens
catttcaaatgtt

SEQ ID NO: 4379634 - DNA, 18 bp, Homo sapiens
catttcaatgtgtataaa

SEQ ID NO: 4379635 - DNA, 21 bp, Homo sapiens
catttcagaagttagtttgta

SEQ ID NO: 4379636 - DNA, 15 bp, Homo sapiens
catttcatacaacag

SEQ ID NO: 4379637 - DNA, 17 bp, Homo sapiens
catttcatgaaaaagct

SEQ ID NO: 4379638 - DNA, 20 bp, Homo sapiens
catttcatgaaaaagctgct

SEQ ID NO: 4379639 - DNA, 15 bp, Homo sapiens
catttcatgtagtaa

SEQ ID NO: 4379640 - DNA, 20 bp, Homo sapiens
catttcatgtagtaagattt

SEQ ID NO: 4379641 - DNA, 12 bp, Homo sapiens
catttcattcca

SEQ ID NO: 4379642 - DNA, 21 bp, Homo sapiens
catttcattccattgcctagc

SEQ ID NO: 4379643 - DNA, 15 bp, Homo sapiens
catttcattgtacaa

SEQ ID NO: 4379644 - DNA, 17 bp, Homo sapiens
catttcattgtacaagt

SEQ ID NO: 4379645 - DNA, 18 bp, Homo sapiens
catttccaagaggctgta

SEQ ID NO: 4379646 - DNA, 21 bp, Homo sapiens
catttccaccaggccgtgcct

SEQ ID NO: 4379647 - DNA, 14 bp, Homo sapiens
catttccagcattt

SEQ ID NO: 4379648 - DNA, 20 bp, Homo sapiens
catttcccatctgcacccct

SEQ ID NO: 4379649 - DNA, 15 bp, Homo sapiens
catttccggctgctg

SEQ ID NO: 4379650 - DNA, 23 bp, Homo sapiens
catttccggctgctgtgtgtgag

SEQ ID NO: 4379651 - DNA, 12 bp, Homo sapiens
catttcctaatg

SEQ ID NO: 4379652 - DNA, 20 bp, Homo sapiens
catttcctagctgttctaat

SEQ ID NO: 4379653 - DNA, 23 bp, Homo sapiens
catttcctatcacctatttccat

SEQ ID NO: 4379654 - DNA, 16 bp, Homo sapiens
catttctactctagat

SEQ ID NO: 4379655 - DNA, 14 bp, Homo sapiens
catttctagactca

SEQ ID NO: 4379656 - DNA, 19 bp, Homo sapiens
catttctatttctcctcca

SEQ ID NO: 4379657 - DNA, 15 bp, Homo sapiens
catttctcactgaaa

SEQ ID NO: 4379658 - DNA, 16 bp, Homo sapiens
catttctcatgttgaa

SEQ ID NO: 4379659 - DNA, 17 bp, Homo sapiens
catttctcatgttgaaa

SEQ ID NO: 4379660 - DNA, 13 bp, Homo sapiens
catttctctgagc

SEQ ID NO: 4379661 - DNA, 14 bp, Homo sapiens
catttctctgagca

SEQ ID NO: 4379662 - DNA, 18 bp, Homo sapiens
catttctgaactgttaca

SEQ ID NO: 4379663 - DNA, 16 bp, Homo sapiens
catttcttaaaacaca

SEQ ID NO: 4379664 - DNA, 13 bp, Homo sapiens
catttcttatcac

SEQ ID NO: 4379665 - DNA, 16 bp, Homo sapiens
catttcttatcacata

SEQ ID NO: 4379666 - DNA, 15 bp, Homo sapiens
catttcttcacttca

SEQ ID NO: 4379667 - DNA, 17 bp, Homo sapiens
catttgaacctggatcc

SEQ ID NO: 4379668 - DNA, 19 bp, Homo sapiens
catttgacccttgctgtga

SEQ ID NO: 4379669 - DNA, 23 bp, Homo sapiens
catttgactgaagatgcagctca

SEQ ID NO: 4379670 - DNA, 14 bp, Homo sapiens
catttgataatgat

SEQ ID NO: 4379671 - DNA, 17 bp, Homo sapiens
catttgataatgataaa

SEQ ID NO: 4379672 - DNA, 19 bp, Homo sapiens
catttgatgatagcagaca

SEQ ID NO: 4379673 - DNA, 19 bp, Homo sapiens
catttgatgcatgtctttt

SEQ ID NO: 4379674 - DNA, 15 bp, Homo sapiens
catttgattaataaa

SEQ ID NO: 4379675 - DNA, 19 bp, Homo sapiens
catttgattaataaaatat

SEQ ID NO: 4379676 - DNA, 23 bp, Homo sapiens
catttgcaggatctgtctgtgca

SEQ ID NO: 4379677 - DNA, 14 bp, Homo sapiens
catttgcagggtcc

SEQ ID NO: 4379678 - DNA, 19 bp, Homo sapiens
catttgcagggtcctcttc

SEQ ID NO: 4379679 - DNA, 20 bp, Homo sapiens
catttgcagggtcctcttct

SEQ ID NO: 4379680 - DNA, 15 bp, Homo sapiens
catttggaatacttt

SEQ ID NO: 4379681 - DNA, 23 bp, Homo sapiens
catttggagctcttgggtcagag

SEQ ID NO: 4379682 - DNA, 16 bp, Homo sapiens
catttggcactatggt

SEQ ID NO: 4379683 - DNA, 14 bp, Homo sapiens
catttggcagagtc

SEQ ID NO: 4379684 - DNA, 16 bp, Homo sapiens
catttggttcattaat

SEQ ID NO: 4379685 - DNA, 16 bp, Homo sapiens
catttggttggcacta

SEQ ID NO: 4379686 - DNA, 21 bp, Homo sapiens
catttgtaaaaatgagtcatt

SEQ ID NO: 4379687 - DNA, 14 bp, Homo sapiens
catttgtattctca

SEQ ID NO: 4379688 - DNA, 18 bp, Homo sapiens
catttgtcccaagtgcca

SEQ ID NO: 4379689 - DNA, 22 bp, Homo sapiens
catttgtctattctccagctga

SEQ ID NO: 4379690 - DNA, 16 bp, Homo sapiens
catttgtgcgtatgca

SEQ ID NO: 4379691 - DNA, 16 bp, Homo sapiens
catttgtgctagaaat

SEQ ID NO: 4379692 - DNA, 20 bp, Homo sapiens
catttgtgctagaaattttc

SEQ ID NO: 4379693 - DNA, 23 bp, Homo sapiens
catttgtggtaatctacaccaat

SEQ ID NO: 4379694 - DNA, 22 bp, Homo sapiens
catttgtgttttgaaagcccaa

SEQ ID NO: 4379695 - DNA, 13 bp, Homo sapiens
catttgttaatat

SEQ ID NO: 4379696 - DNA, 16 bp, Homo sapiens
catttgttaatatcac

SEQ ID NO: 4379697 - DNA, 14 bp, Homo sapiens
catttgttgtttga

SEQ ID NO: 4379698 - DNA, 20 bp, Homo sapiens
cattttaaaagcaattatat

SEQ ID NO: 4379699 - DNA, 17 bp, Homo sapiens
cattttaaagttagtat

SEQ ID NO: 4379700 - DNA, 15 bp, Homo sapiens
cattttaaatgaaag

SEQ ID NO: 4379701 - DNA, 22 bp, Homo sapiens
cattttaagtggagacatattt

SEQ ID NO: 4379702 - DNA, 22 bp, Homo sapiens
cattttaccatcacacatgttc

SEQ ID NO: 4379703 - DNA, 17 bp, Homo sapiens
cattttacgttttagaa

SEQ ID NO: 4379704 - DNA, 18 bp, Homo sapiens
cattttacgttttagaaa

SEQ ID NO: 4379705 - DNA, 19 bp, Homo sapiens
cattttagaattaaaattt

SEQ ID NO: 4379706 - DNA, 18 bp, Homo sapiens
cattttatcatcctttca

SEQ ID NO: 4379707 - DNA, 17 bp, Homo sapiens
cattttatgctgtttat

SEQ ID NO: 4379708 - DNA, 21 bp, Homo sapiens
cattttattaagctttttgga

SEQ ID NO: 4379709 - DNA, 17 bp, Homo sapiens
cattttattaataatat

SEQ ID NO: 4379710 - DNA, 15 bp, Homo sapiens
cattttattttgtaa

SEQ ID NO: 4379711 - DNA, 14 bp, Homo sapiens
cattttatttttga

SEQ ID NO: 4379712 - DNA, 23 bp, Homo sapiens
cattttcaataacaaaacgaaac

SEQ ID NO: 4379713 - DNA, 16 bp, Homo sapiens
cattttcacttttaaa

SEQ ID NO: 4379714 - DNA, 14 bp, Homo sapiens
cattttcattccta

SEQ ID NO: 4379715 - DNA, 11 bp, Homo sapiens
cattttccagt

SEQ ID NO: 4379716 - DNA, 15 bp, Homo sapiens
cattttccccccact

SEQ ID NO: 4379717 - DNA, 20 bp, Homo sapiens
cattttccccccactctccc

SEQ ID NO: 4379718 - DNA, 18 bp, Homo sapiens
cattttcctacaggcagt

SEQ ID NO: 4379719 - DNA, 22 bp, Homo sapiens
cattttcctacaggcagtctct

SEQ ID NO: 4379720 - DNA, 19 bp, Homo sapiens
cattttcctgacatttgtt

SEQ ID NO: 4379721 - DNA, 15 bp, Homo sapiens
cattttctataacat

SEQ ID NO: 4379722 - DNA, 19 bp, Homo sapiens
cattttggaaggctgaggc

SEQ ID NO: 4379723 - DNA, 16 bp, Homo sapiens
cattttggtactttgg

SEQ ID NO: 4379724 - DNA, 16 bp, Homo sapiens
cattttgtaaaatatt

SEQ ID NO: 4379725 - DNA, 18 bp, Homo sapiens
cattttgttttgctctga

SEQ ID NO: 4379726 - DNA, 16 bp, Homo sapiens
cattttgtttttactg

SEQ ID NO: 4379727 - DNA, 17 bp, Homo sapiens
cattttgtttttactgt

SEQ ID NO: 4379728 - DNA, 18 bp, Homo sapiens
cattttgtttttactgta

SEQ ID NO: 4379729 - DNA, 20 bp, Homo sapiens
catttttaaacttgaaatat

SEQ ID NO: 4379730 - DNA, 13 bp, Homo sapiens
catttttaatgta

SEQ ID NO: 4379731 - DNA, 14 bp, Homo sapiens
catttttaatgtat

SEQ ID NO: 4379732 - DNA, 17 bp, Homo sapiens
catttttacactattgt

SEQ ID NO: 4379733 - DNA, 20 bp, Homo sapiens
catttttacactattgtgaa

SEQ ID NO: 4379734 - DNA, 20 bp, Homo sapiens
catttttactattgttacat

SEQ ID NO: 4379735 - DNA, 14 bp, Homo sapiens
catttttattatat

SEQ ID NO: 4379736 - DNA, 14 bp, Homo sapiens
catttttcaaagca

SEQ ID NO: 4379737 - DNA, 17 bp, Homo sapiens
catttttcaaagcaatt

SEQ ID NO: 4379738 - DNA, 17 bp, Homo sapiens
catttttcaactttgaa

SEQ ID NO: 4379739 - DNA, 18 bp, Homo sapiens
catttttcaactttgaat

SEQ ID NO: 4379740 - DNA, 12 bp, Homo sapiens
catttttcaata

SEQ ID NO: 4379741 - DNA, 12 bp, Homo sapiens
catttttcagca

SEQ ID NO: 4379742 - DNA, 13 bp, Homo sapiens
catttttcattca

SEQ ID NO: 4379743 - DNA, 17 bp, Homo sapiens
catttttcattcatgaa

SEQ ID NO: 4379744 - DNA, 19 bp, Homo sapiens
catttttggatttctgtga

SEQ ID NO: 4379745 - DNA, 22 bp, Homo sapiens
catttttggatttctgtgaagt

SEQ ID NO: 4379746 - DNA, 23 bp, Homo sapiens
catttttgtatttttcatcttta

SEQ ID NO: 4379747 - DNA, 14 bp, Homo sapiens
catttttgttttga

SEQ ID NO: 4379748 - DNA, 20 bp, Homo sapiens
catttttgttttgaaagttt

SEQ ID NO: 4379749 - DNA, 18 bp, Homo sapiens
cattttttacttgaatca

SEQ ID NO: 4379750 - DNA, 22 bp, Homo sapiens
cattttttgaggtatcactgca

SEQ ID NO: 4379751 - DNA, 23 bp, Homo sapiens
ccaactctcctggcctggccatc

SEQ ID NO: 4379752 - DNA, 12 bp, Homo sapiens
ccaactgaaggc

SEQ ID NO: 4379753 - DNA, 16 bp, Homo sapiens
ccaactgacctgccag

SEQ ID NO: 4379754 - DNA, 16 bp, Homo sapiens
ccaactgccaggctgc

SEQ ID NO: 4379755 - DNA, 13 bp, Homo sapiens
ccaactgccccag

SEQ ID NO: 4379756 - DNA, 15 bp, Homo sapiens
ccaactgccccaggg

SEQ ID NO: 4379757 - DNA, 15 bp, Homo sapiens
ccaactgctccagcc

SEQ ID NO: 4379758 - DNA, 21 bp, Homo sapiens
ccaactgtggtagctccagcg

SEQ ID NO: 4379759 - DNA, 17 bp, Homo sapiens
ccaacttcaccaccccc

SEQ ID NO: 4379760 - DNA, 18 bp, Homo sapiens
ccaacttcctgtggcctg

SEQ ID NO: 4379761 - DNA, 19 bp, Homo sapiens
ccaagacagatgccccaga

SEQ ID NO: 4379762 - DNA, 23 bp, Homo sapiens
ccaagacagatgccccagagctg

SEQ ID NO: 4379763 - DNA, 24 bp, Homo sapiens
ccaagacagatgccccagagctgt

SEQ ID NO: 4379764 - DNA, 17 bp, Homo sapiens
ccaagacagcagcagcc

SEQ ID NO: 4379765 - DNA, 21 bp, Homo sapiens
ccaagacatgtctgttctaca

SEQ ID NO: 4379766 - DNA, 12 bp, Homo sapiens
ccaagactccca

SEQ ID NO: 4379767 - DNA, 15 bp, Homo sapiens
ccaagactcccatga

SEQ ID NO: 4379768 - DNA, 17 bp, Homo sapiens
ccaagactcctcaggca

SEQ ID NO: 4379769 - DNA, 21 bp, Homo sapiens
ccaagaggaagttcagatctt

SEQ ID NO: 4379770 - DNA, 23 bp, Homo sapiens
ccaagaggggcgggctcagagct

SEQ ID NO: 4379771 - DNA, 15 bp, Homo sapiens
ccaagaggtctgagc

SEQ ID NO: 4379772 - DNA, 19 bp, Homo sapiens
ccaagaggtctgagccctg

SEQ ID NO: 4379773 - DNA, 17 bp, Homo sapiens
ccaagatcgcaccactg

SEQ ID NO: 4379774 - DNA, 22 bp, Homo sapiens
ccaagattttcctcttgtgatt

SEQ ID NO: 4379775 - DNA, 10 bp, Homo sapiens
ccaagcaaag

SEQ ID NO: 4379776 - DNA, 19 bp, Homo sapiens
ccaagcaaattaggaacct

SEQ ID NO: 4379777 - DNA, 16 bp, Homo sapiens
ccaagcacagagcctg

SEQ ID NO: 4379778 - DNA, 18 bp, Homo sapiens
ccaagcacccagagcttt

SEQ ID NO: 4379779 - DNA, 18 bp, Homo sapiens
ccaagcagagcgggtaaa

SEQ ID NO: 4379780 - DNA, 22 bp, Homo sapiens
ccaagcataccaacacgagcag

SEQ ID NO: 4379781 - DNA, 11 bp, Homo sapiens
ccaagccctgg

SEQ ID NO: 4379782 - DNA, 12 bp, Homo sapiens
ccaagccctggc

SEQ ID NO: 4379783 - DNA, 13 bp, Homo sapiens
ccaagcctgcctc

SEQ ID NO: 4379784 - DNA, 14 bp, Homo sapiens
ccaagcctgctggc

SEQ ID NO: 4379785 - DNA, 16 bp, Homo sapiens
ccaagcctgctggctg

SEQ ID NO: 4379786 - DNA, 17 bp, Homo sapiens
ccaagcctgctggctgc

SEQ ID NO: 4379787 - DNA, 19 bp, Homo sapiens
ccaagccttggctctaccc

SEQ ID NO: 4379788 - DNA, 22 bp, Homo sapiens
ccaagcgttcctggccttctga

SEQ ID NO: 4379789 - DNA, 17 bp, Homo sapiens
ccaagctaatctgcctg

SEQ ID NO: 4379790 - DNA, 22 bp, Homo sapiens
ccaagctccaaatccaaggaaa

SEQ ID NO: 4379791 - DNA, 15 bp, Homo sapiens
ccaagctgggcccca

SEQ ID NO: 4379792 - DNA, 20 bp, Homo sapiens
ccaagctgggccccagccca

SEQ ID NO: 4379793 - DNA, 21 bp, Homo sapiens
ccaagctgggccccagcccac

SEQ ID NO: 4379794 - DNA, 15 bp, Homo sapiens
ccaaggacaccctcc

SEQ ID NO: 4379795 - DNA, 14 bp, Homo sapiens
ccaaggacccaggc

SEQ ID NO: 4379796 - DNA, 18 bp, Homo sapiens
ccaaggacccaggcgctg

SEQ ID NO: 4379797 - DNA, 20 bp, Homo sapiens
ccaaggacccaggcgctgca

SEQ ID NO: 4379798 - DNA, 15 bp, Homo sapiens
ccaaggactgaggga

SEQ ID NO: 4379799 - DNA, 17 bp, Homo sapiens
ccaaggcaagcatgaat

SEQ ID NO: 4379800 - DNA, 15 bp, Homo sapiens
ccaaggccagagtgg

SEQ ID NO: 4379801 - DNA, 23 bp, Homo sapiens
ccaaggcctaccccagttcctag

SEQ ID NO: 4379802 - DNA, 13 bp, Homo sapiens
ccaaggccttccc

SEQ ID NO: 4379803 - DNA, 16 bp, Homo sapiens
ccaaggcggcccctcc

SEQ ID NO: 4379804 - DNA, 21 bp, Homo sapiens
ccaaggcggcccctcccgccc

SEQ ID NO: 4379805 - DNA, 22 bp, Homo sapiens
ccaaggggtggccgggcacagt

SEQ ID NO: 4379806 - DNA, 19 bp, Homo sapiens
ccaagggttgagagccagt

SEQ ID NO: 4379807 - DNA, 20 bp, Homo sapiens
ccaagggttgagagccagtg

SEQ ID NO: 4379808 - DNA, 16 bp, Homo sapiens
ccaaggtcctctcagt

SEQ ID NO: 4379809 - DNA, 14 bp, Homo sapiens
ccaaggtcctgctc

SEQ ID NO: 4379810 - DNA, 21 bp, Homo sapiens
ccaaggtgctgatgtcaaagt

SEQ ID NO: 4379811 - DNA, 17 bp, Homo sapiens
ccaaggttactcagcag

SEQ ID NO: 4379812 - DNA, 20 bp, Homo sapiens
ccaaggttactcagcagcag

SEQ ID NO: 4379813 - DNA, 17 bp, Homo sapiens
ccaaggttgcacagcaa

SEQ ID NO: 4379814 - DNA, 16 bp, Homo sapiens
ccaagtaaaatgtttt

SEQ ID NO: 4379815 - DNA, 21 bp, Homo sapiens
ccaagtaaccaggccccagcc

SEQ ID NO: 4379816 - DNA, 15 bp, Homo sapiens
ccaagtagcctctcc

SEQ ID NO: 4379817 - DNA, 20 bp, Homo sapiens
ccaagtatgattgacataat

SEQ ID NO: 4379818 - DNA, 14 bp, Homo sapiens
ccaagtctcagtgg

SEQ ID NO: 4379819 - DNA, 13 bp, Homo sapiens
ccaagtctggcac

SEQ ID NO: 4379820 - DNA, 18 bp, Homo sapiens
ccaagtctggcaccatgt

SEQ ID NO: 4379821 - DNA, 19 bp, Homo sapiens
ccaagtctttcttcttttt

SEQ ID NO: 4379822 - DNA, 16 bp, Homo sapiens
ccaagtgcaatagatt

SEQ ID NO: 4379823 - DNA, 14 bp, Homo sapiens
ccaagtgctggccc

SEQ ID NO: 4379824 - DNA, 15 bp, Homo sapiens
ccaagtgctggccca

SEQ ID NO: 4379825 - DNA, 23 bp, Homo sapiens
ccaagtgctggcccacccagtcc

SEQ ID NO: 4379826 - DNA, 16 bp, Homo sapiens
ccaagtgggggcagag

SEQ ID NO: 4379827 - DNA, 18 bp, Homo sapiens
ccaagtgggggcagaggg

SEQ ID NO: 4379828 - DNA, 14 bp, Homo sapiens
ccaagtggtgccta

SEQ ID NO: 4379829 - DNA, 21 bp, Homo sapiens
ccaataaaaacattttgaagt

SEQ ID NO: 4379830 - DNA, 23 bp, Homo sapiens
ccaataaaaacattttgaagtgt

SEQ ID NO: 4379831 - DNA, 10 bp, Homo sapiens
ccaataaacc

SEQ ID NO: 4379832 - DNA, 13 bp, Homo sapiens
ccaataaaccagt

SEQ ID NO: 4379833 - DNA, 18 bp, Homo sapiens
ccaataaaccagtgtgaa

SEQ ID NO: 4379834 - DNA, 19 bp, Homo sapiens
ccaataaaccagtgtgaac

SEQ ID NO: 4379835 - DNA, 19 bp, Homo sapiens
ccaataaaggcagctgcct

SEQ ID NO: 4379836 - DNA, 20 bp, Homo sapiens
ccaataaaggcagctgcctc

SEQ ID NO: 4379837 - DNA, 22 bp, Homo sapiens
ccaataaaggcagctgcctctg

SEQ ID NO: 4379838 - DNA, 14 bp, Homo sapiens
ccaataacattctt

SEQ ID NO: 4379839 - DNA, 19 bp, Homo sapiens
ccaatagcactttcattgc

SEQ ID NO: 4379840 - DNA, 21 bp, Homo sapiens
ccaatagcactttcattgcca

SEQ ID NO: 4379841 - DNA, 23 bp, Homo sapiens
ccaatatatagtgggtacatcaa

SEQ ID NO: 4379842 - DNA, 16 bp, Homo sapiens
ccaatattcatagcag

SEQ ID NO: 4379843 - DNA, 14 bp, Homo sapiens
ccaatattgtacag

SEQ ID NO: 4379844 - DNA, 16 bp, Homo sapiens
ccaatattgtacagtt

SEQ ID NO: 4379845 - DNA, 12 bp, Homo sapiens
ccaatatttctg

SEQ ID NO: 4379846 - DNA, 17 bp, Homo sapiens
ccaatcagcgctctgta

SEQ ID NO: 4379847 - DNA, 12 bp, Homo sapiens
ccaatcagcttt

SEQ ID NO: 4379848 - DNA, 22 bp, Homo sapiens
ccaatcagcttttgttctagac

SEQ ID NO: 4379849 - DNA, 14 bp, Homo sapiens
ccaatcctatgttt

SEQ ID NO: 4379850 - DNA, 14 bp, Homo sapiens
ccaatcggactgcc

SEQ ID NO: 4379851 - DNA, 18 bp, Homo sapiens
ccaatcgggtccagagac

SEQ ID NO: 4379852 - DNA, 17 bp, Homo sapiens
ccaatcggtgtgttctt

SEQ ID NO: 4379853 - DNA, 19 bp, Homo sapiens
ccaatcttgtttatagcaa

SEQ ID NO: 4379854 - DNA, 16 bp, Homo sapiens
ccaatgaaaacatgta

SEQ ID NO: 4379855 - DNA, 20 bp, Homo sapiens
ccaatgaaaacatgtactac

SEQ ID NO: 4379856 - DNA, 23 bp, Homo sapiens
ccaatgacacccatgccagagag

SEQ ID NO: 4379857 - DNA, 21 bp, Homo sapiens
ccaatgagactctagggtcca

SEQ ID NO: 4379858 - DNA, 15 bp, Homo sapiens
ccaatgagtctgtaa

SEQ ID NO: 4379859 - DNA, 18 bp, Homo sapiens
ccaatgcacctaaagaaa

SEQ ID NO: 4379860 - DNA, 19 bp, Homo sapiens
ccaatgccacctagactct

SEQ ID NO: 4379861 - DNA, 15 bp, Homo sapiens
ccaatgcctttttag

SEQ ID NO: 4379862 - DNA, 13 bp, Homo sapiens
ccaatgctgtggg

SEQ ID NO: 4379863 - DNA, 21 bp, Homo sapiens
ccaatggcattattaggtctt

SEQ ID NO: 4379864 - DNA, 14 bp, Homo sapiens
ccaatgtgttttct

SEQ ID NO: 4379865 - DNA, 15 bp, Homo sapiens
ccaatgtgttttctg

SEQ ID NO: 4379866 - DNA, 20 bp, Homo sapiens
ccaatgttatgccagctcca

SEQ ID NO: 4379867 - DNA, 12 bp, Homo sapiens
ccaatgttttat

SEQ ID NO: 4379868 - DNA, 15 bp, Homo sapiens
ccaattattgatata

SEQ ID NO: 4379869 - DNA, 15 bp, Homo sapiens
ccacccaacctcacc

SEQ ID NO: 4379870 - DNA, 17 bp, Homo sapiens
ccacccaactccacagg

SEQ ID NO: 4379871 - DNA, 22 bp, Homo sapiens
ccacccagaatgagacatccag

SEQ ID NO: 4379872 - DNA, 18 bp, Homo sapiens
ccacccaggagggagggg

SEQ ID NO: 4379873 - DNA, 23 bp, Homo sapiens
ccacccaggagggagggggctat

SEQ ID NO: 4379874 - DNA, 22 bp, Homo sapiens
ccacccatgcgccttcgtgcct

SEQ ID NO: 4379875 - DNA, 13 bp, Homo sapiens
ccaccccaactct

SEQ ID NO: 4379876 - DNA, 18 bp, Homo sapiens
ccaccccaactctcccca

SEQ ID NO: 4379877 - DNA, 12 bp, Homo sapiens
ccaccccaggac

SEQ ID NO: 4379878 - DNA, 13 bp, Homo sapiens
ccaccccaggacg

SEQ ID NO: 4379879 - DNA, 15 bp, Homo sapiens
ccacccccagccccg

SEQ ID NO: 4379880 - DNA, 13 bp, Homo sapiens
ccacccccctccc

SEQ ID NO: 4379881 - DNA, 19 bp, Homo sapiens
ccaccccctccccagggga

SEQ ID NO: 4379882 - DNA, 15 bp, Homo sapiens
ccaccccctcctccc

SEQ ID NO: 4379883 - DNA, 18 bp, Homo sapiens
ccaccccctcctccccca

SEQ ID NO: 4379884 - DNA, 22 bp, Homo sapiens
ccaccccctgtcccattctaga

SEQ ID NO: 4379885 - DNA, 18 bp, Homo sapiens
ccacccccttcagtgccc

SEQ ID NO: 4379886 - DNA, 20 bp, Homo sapiens
ccacccccttcagtgcccac

SEQ ID NO: 4379887 - DNA, 22 bp, Homo sapiens
ccacccccttcagtgcccacca

SEQ ID NO: 4379888 - DNA, 13 bp, Homo sapiens
ccacccccttctc

SEQ ID NO: 4379889 - DNA, 19 bp, Homo sapiens
ccacccccttctctgctcc

SEQ ID NO: 4379890 - DNA, 20 bp, Homo sapiens
ccaccccctttgactctggg

SEQ ID NO: 4379891 - DNA, 21 bp, Homo sapiens
ccaccccctttgactctgggg

SEQ ID NO: 4379892 - DNA, 18 bp, Homo sapiens
ccaccccgggctctctgc

SEQ ID NO: 4379893 - DNA, 20 bp, Homo sapiens
ccaccccggggaccctgtga

SEQ ID NO: 4379894 - DNA, 14 bp, Homo sapiens
ccacccctccccag

SEQ ID NO: 4379895 - DNA, 14 bp, Homo sapiens
ccacccctgcctcc

SEQ ID NO: 4379896 - DNA, 22 bp, Homo sapiens
ccacccctgcctccaccctctg

SEQ ID NO: 4379897 - DNA, 15 bp, Homo sapiens
ccacccgcccacccg

SEQ ID NO: 4379898 - DNA, 18 bp, Homo sapiens
ccacccgccttgtgagat

SEQ ID NO: 4379899 - DNA, 20 bp, Homo sapiens
ccacccgggggagcccagtg

SEQ ID NO: 4379900 - DNA, 21 bp, Homo sapiens
ccacccgggggagcccagtga

SEQ ID NO: 4379901 - DNA, 15 bp, Homo sapiens
ccaccctccctggag

SEQ ID NO: 4379902 - DNA, 13 bp, Homo sapiens
ccaccctcctgtc

SEQ ID NO: 4379903 - DNA, 15 bp, Homo sapiens
ccaccctcctgtctt

SEQ ID NO: 4379904 - DNA, 20 bp, Homo sapiens
ccaccctcctgtcttcccag

SEQ ID NO: 4379905 - DNA, 13 bp, Homo sapiens
ccaccctcttccc

SEQ ID NO: 4379906 - DNA, 15 bp, Homo sapiens
ccaccctgagccggc

SEQ ID NO: 4379907 - DNA, 12 bp, Homo sapiens
ccaccctgagct

SEQ ID NO: 4379908 - DNA, 13 bp, Homo sapiens
ccaccctgccaag

SEQ ID NO: 4379909 - DNA, 21 bp, Homo sapiens
ccaccctgccaagactcctca

SEQ ID NO: 4379910 - DNA, 16 bp, Homo sapiens
ccacccttggcctgtc

SEQ ID NO: 4379911 - DNA, 17 bp, Homo sapiens
ccacccttggcctgtct

SEQ ID NO: 4379912 - DNA, 17 bp, Homo sapiens
ccaccgccttgcccagc

SEQ ID NO: 4379913 - DNA, 14 bp, Homo sapiens
ccaccgctgcctcg

SEQ ID NO: 4379914 - DNA, 16 bp, Homo sapiens
ccaccggaactgggct

SEQ ID NO: 4379915 - DNA, 18 bp, Homo sapiens
ccaccggaactgggctgg

SEQ ID NO: 4379916 - DNA, 23 bp, Homo sapiens
ccaccggcctgtgggtctctgaa

SEQ ID NO: 4379917 - DNA, 16 bp, Homo sapiens
ccaccgggagcctccc

SEQ ID NO: 4379918 - DNA, 20 bp, Homo sapiens
ccaccgggagcctccccctc

SEQ ID NO: 4379919 - DNA, 23 bp, Homo sapiens
ccaccgtgaaccagagggtgtgg

SEQ ID NO: 4379920 - DNA, 13 bp, Homo sapiens
ccaccgtggagga

SEQ ID NO: 4379921 - DNA, 11 bp, Homo sapiens
ccacctagact

SEQ ID NO: 4379922 - DNA, 20 bp, Homo sapiens
ccacctaggccactcctcca

SEQ ID NO: 4379923 - DNA, 10 bp, Homo sapiens
ccacctcagc

SEQ ID NO: 4379924 - DNA, 14 bp, Homo sapiens
ccacctcagcctcc

SEQ ID NO: 4379925 - DNA, 14 bp, Homo sapiens
ccacctcagccttg

SEQ ID NO: 4379926 - DNA, 17 bp, Homo sapiens
ccacctcccctatccac

SEQ ID NO: 4379927 - DNA, 19 bp, Homo sapiens
ccacctcccctatccaccc

SEQ ID NO: 4379928 - DNA, 12 bp, Homo sapiens
ccacctctcctg

SEQ ID NO: 4379929 - DNA, 16 bp, Homo sapiens
ccacctgacacaccag

SEQ ID NO: 4379930 - DNA, 11 bp, Homo sapiens
ccacctgcaag

SEQ ID NO: 4379931 - DNA, 12 bp, Homo sapiens
ccacctgccaca

SEQ ID NO: 4379932 - DNA, 14 bp, Homo sapiens
ccacctgcccatca

SEQ ID NO: 4379933 - DNA, 23 bp, Homo sapiens
ccacctgcccatcacagggttgg

SEQ ID NO: 4379934 - DNA, 20 bp, Homo sapiens
ccacctgccttggcctccca

SEQ ID NO: 4379935 - DNA, 15 bp, Homo sapiens
ccacctgctgagaga

SEQ ID NO: 4379936 - DNA, 23 bp, Homo sapiens
ccacctggatctatccctgcggc

SEQ ID NO: 4379937 - DNA, 14 bp, Homo sapiens
ccacctggctctgt

SEQ ID NO: 4379938 - DNA, 19 bp, Homo sapiens
ccacctgtggggcctgggg

SEQ ID NO: 4379939 - DNA, 14 bp, Homo sapiens
ccaccttcaggccc

SEQ ID NO: 4379940 - DNA, 13 bp, Homo sapiens
ccaccttcccagc

SEQ ID NO: 4379941 - DNA, 16 bp, Homo sapiens
ccaccttcccagctct

SEQ ID NO: 4379942 - DNA, 19 bp, Homo sapiens
ccaccttcccagctctccc

SEQ ID NO: 4379943 - DNA, 13 bp, Homo sapiens
ccacctttgtgca

SEQ ID NO: 4379944 - DNA, 17 bp, Homo sapiens
ccacctttgtgcagctt

SEQ ID NO: 4379945 - DNA, 18 bp, Homo sapiens
ccacgactggccagggcc

SEQ ID NO: 4379946 - DNA, 20 bp, Homo sapiens
ccacgagggctggctggcct

SEQ ID NO: 4379947 - DNA, 18 bp, Homo sapiens
ccacgatgtggccctggc

SEQ ID NO: 4379948 - DNA, 13 bp, Homo sapiens
ccacgccatgagg

SEQ ID NO: 4379949 - DNA, 22 bp, Homo sapiens
ccacgcccgtctctttctcacc

SEQ ID NO: 4379950 - DNA, 12 bp, Homo sapiens
ccacgcctcacc

SEQ ID NO: 4379951 - DNA, 18 bp, Homo sapiens
ccacgcctcaccagcccc

SEQ ID NO: 4379952 - DNA, 19 bp, Homo sapiens
ccacgcctcaccagccccc

SEQ ID NO: 4379953 - DNA, 16 bp, Homo sapiens
ccacgcctcctggcca

SEQ ID NO: 4379954 - DNA, 17 bp, Homo sapiens
ccacgcctcctggccag

SEQ ID NO: 4379955 - DNA, 19 bp, Homo sapiens
ccacgcctcctggccagac

SEQ ID NO: 4379956 - DNA, 16 bp, Homo sapiens
ccacgctccagctgcc

SEQ ID NO: 4379957 - DNA, 12 bp, Homo sapiens
ccacgctgtcct

SEQ ID NO: 4379958 - DNA, 19 bp, Homo sapiens
ccacggaaggcgggctgag

SEQ ID NO: 4379959 - DNA, 21 bp, Homo sapiens
ccacggaaggcgggctgagga

SEQ ID NO: 4379960 - DNA, 23 bp, Homo sapiens
ccacgggcaggggtcagagcact

SEQ ID NO: 4379961 - DNA, 15 bp, Homo sapiens
ccacgtcccagcatc

SEQ ID NO: 4379962 - DNA, 15 bp, Homo sapiens
ccacgtgccaggccc

SEQ ID NO: 4379963 - DNA, 12 bp, Homo sapiens
ccactaaaaata

SEQ ID NO: 4379964 - DNA, 13 bp, Homo sapiens
ccactaaaaatat

SEQ ID NO: 4379965 - DNA, 16 bp, Homo sapiens
ccactaaaaatattgt

SEQ ID NO: 4379966 - DNA, 23 bp, Homo sapiens
ccactaaagtagggaagttttat

SEQ ID NO: 4379967 - DNA, 13 bp, Homo sapiens
ccactaaccatcc

SEQ ID NO: 4379968 - DNA, 17 bp, Homo sapiens
ccactaaccatccccaa

SEQ ID NO: 4379969 - DNA, 16 bp, Homo sapiens
ccactacacctggctg

SEQ ID NO: 4379970 - DNA, 13 bp, Homo sapiens
ccactaccagcca

SEQ ID NO: 4379971 - DNA, 14 bp, Homo sapiens
ccactaccagccag

SEQ ID NO: 4379972 - DNA, 17 bp, Homo sapiens
ccactaccagccagcct

SEQ ID NO: 4379973 - DNA, 14 bp, Homo sapiens
ccactagcttactg

SEQ ID NO: 4379974 - DNA, 22 bp, Homo sapiens
ccactagtaagtaattatgcac

SEQ ID NO: 4379975 - DNA, 14 bp, Homo sapiens
ccactcacacagcc

SEQ ID NO: 4379976 - DNA, 15 bp, Homo sapiens
ccactcacacagcca

SEQ ID NO: 4379977 - DNA, 12 bp, Homo sapiens
ccactcaccccg

SEQ ID NO: 4379978 - DNA, 18 bp, Homo sapiens
ccactcaggcatttgact

SEQ ID NO: 4379979 - DNA, 14 bp, Homo sapiens
ccactcatttcatc

SEQ ID NO: 4379980 - DNA, 17 bp, Homo sapiens
ccactcccaaagctcag

SEQ ID NO: 4379981 - DNA, 13 bp, Homo sapiens
ccactccccagcc

SEQ ID NO: 4379982 - DNA, 20 bp, Homo sapiens
ccactcccccgtttctcctt

SEQ ID NO: 4379983 - DNA, 21 bp, Homo sapiens
ccactcccccgtttctccttt

SEQ ID NO: 4379984 - DNA, 22 bp, Homo sapiens
ccactcccccgtttctcctttt

SEQ ID NO: 4379985 - DNA, 21 bp, Homo sapiens
ccactccggccctccagagcc

SEQ ID NO: 4379986 - DNA, 14 bp, Homo sapiens
ccactccttccaga

SEQ ID NO: 4379987 - DNA, 16 bp, Homo sapiens
ccactccttccatctc

SEQ ID NO: 4379988 - DNA, 22 bp, Homo sapiens
ccactccttccttcaggactct

SEQ ID NO: 4379989 - DNA, 14 bp, Homo sapiens
ccactcgaggcctg

SEQ ID NO: 4379990 - DNA, 15 bp, Homo sapiens
ccactcgaggcctgc

SEQ ID NO: 4379991 - DNA, 18 bp, Homo sapiens
ccactctaccctcccacc

SEQ ID NO: 4379992 - DNA, 19 bp, Homo sapiens
ccactctaccctcccaccc

SEQ ID NO: 4379993 - DNA, 20 bp, Homo sapiens
ccactctaccctcccacccc

SEQ ID NO: 4379994 - DNA, 15 bp, Homo sapiens
ccactctagttctag

SEQ ID NO: 4379995 - DNA, 17 bp, Homo sapiens
ccactctagttctagat

SEQ ID NO: 4379996 - DNA, 17 bp, Homo sapiens
ccactctatgagttgga

SEQ ID NO: 4379997 - DNA, 14 bp, Homo sapiens
ccactctcattccc

SEQ ID NO: 4379998 - DNA, 19 bp, Homo sapiens
ccactctcattccccaggt

SEQ ID NO: 4379999 - DNA, 12 bp, Homo sapiens
ccactctcccca

SEQ ID NO: 4380000 - DNA, 12 bp, Homo sapiens
ccactctgcttc

SEQ ID NO: 4380001 - DNA, 15 bp, Homo sapiens
ccactcttgatctct

SEQ ID NO: 4380002 - DNA, 17 bp, Homo sapiens
ccactgaaaaaatatat

SEQ ID NO: 4380003 - DNA, 19 bp, Homo sapiens
ccactgaggggccagggag

SEQ ID NO: 4380004 - DNA, 15 bp, Homo sapiens
ccactgcactccagc

SEQ ID NO: 4380005 - DNA, 23 bp, Homo sapiens
ccactgcactccagcctgagtga

SEQ ID NO: 4380006 - DNA, 13 bp, Homo sapiens
ccactgcagaaga

SEQ ID NO: 4380007 - DNA, 20 bp, Homo sapiens
ccactgccattacccagtgc

SEQ ID NO: 4380008 - DNA, 19 bp, Homo sapiens
ccactgccccccgaggctg

SEQ ID NO: 4380009 - DNA, 15 bp, Homo sapiens
ccactgcgcccggcc

SEQ ID NO: 4380010 - DNA, 20 bp, Homo sapiens
ccactgcttcttatggtggt

SEQ ID NO: 4380011 - DNA, 24 bp, Homo sapiens
ccactggaaggaacatggagctgt

SEQ ID NO: 4380012 - DNA, 15 bp, Homo sapiens
ccactggatcctgct

SEQ ID NO: 4380013 - DNA, 14 bp, Homo sapiens
ccactggccgctga

SEQ ID NO: 4380014 - DNA, 20 bp, Homo sapiens
ccactggcttttgcctgtaa

SEQ ID NO: 4380015 - DNA, 22 bp, Homo sapiens
ccactggggaatgctcccagct

SEQ ID NO: 4380016 - DNA, 14 bp, Homo sapiens
ccactgtgcccggc

SEQ ID NO: 4380017 - DNA, 16 bp, Homo sapiens
ccactgtggccccaag

SEQ ID NO: 4380018 - DNA, 18 bp, Homo sapiens
ccactgtgtactggagcc

SEQ ID NO: 4380019 - DNA, 23 bp, Homo sapiens
ccactgttcagcggagctgactg

SEQ ID NO: 4380020 - DNA, 20 bp, Homo sapiens
ccacttaatgtatgttacca

SEQ ID NO: 4380021 - DNA, 19 bp, Homo sapiens
ccacttcacccccaacttc

SEQ ID NO: 4380022 - DNA, 13 bp, Homo sapiens
ccacttccagggg

SEQ ID NO: 4380023 - DNA, 18 bp, Homo sapiens
ccacttccaggtctgcct

SEQ ID NO: 4380024 - DNA, 11 bp, Homo sapiens
ccacttctccc

SEQ ID NO: 4380025 - DNA, 12 bp, Homo sapiens
ccacttctcccc

SEQ ID NO: 4380026 - DNA, 19 bp, Homo sapiens
ccacttgactggcacacac

SEQ ID NO: 4380027 - DNA, 21 bp, Homo sapiens
ccacttgctgcactcttgcac

SEQ ID NO: 4380028 - DNA, 20 bp, Homo sapiens
ccactttaaaatatctacat

SEQ ID NO: 4380029 - DNA, 15 bp, Homo sapiens
ccagaaagcctcctg

SEQ ID NO: 4380030 - DNA, 20 bp, Homo sapiens
ccagaaagcctcctgccccc

SEQ ID NO: 4380031 - DNA, 14 bp, Homo sapiens
ccagaaaggagact

SEQ ID NO: 4380032 - DNA, 10 bp, Homo sapiens
ccagaaattc

SEQ ID NO: 4380033 - DNA, 13 bp, Homo sapiens
ccagaacagccct

SEQ ID NO: 4380034 - DNA, 15 bp, Homo sapiens
ccagaacagccctcg

SEQ ID NO: 4380035 - DNA, 20 bp, Homo sapiens
ccagaacagccctcggcctc

SEQ ID NO: 4380036 - DNA, 17 bp, Homo sapiens
ccagaacttagccttta

SEQ ID NO: 4380037 - DNA, 17 bp, Homo sapiens
ccagaagaagatggctg

SEQ ID NO: 4380038 - DNA, 22 bp, Homo sapiens
ccagaagatcccctcaggactg

SEQ ID NO: 4380039 - DNA, 14 bp, Homo sapiens
ccagaagccttgga

SEQ ID NO: 4380040 - DNA, 17 bp, Homo sapiens
ccagaagtccacaggac

SEQ ID NO: 4380041 - DNA, 16 bp, Homo sapiens
ccagaagtgtgactgg

SEQ ID NO: 4380042 - DNA, 15 bp, Homo sapiens
ccagaataagttatt

SEQ ID NO: 4380043 - DNA, 19 bp, Homo sapiens
ccagaataagttattgcag

SEQ ID NO: 4380044 - DNA, 21 bp, Homo sapiens
ccagaataagttattgcagtt

SEQ ID NO: 4380045 - DNA, 16 bp, Homo sapiens
ccagaatgagacatcc

SEQ ID NO: 4380046 - DNA, 21 bp, Homo sapiens
ccagaatgtcagattcctttc

SEQ ID NO: 4380047 - DNA, 23 bp, Homo sapiens
ccagaatgtcagattcctttccc

SEQ ID NO: 4380048 - DNA, 14 bp, Homo sapiens
ccagacagcctgta

SEQ ID NO: 4380049 - DNA, 17 bp, Homo sapiens
ccagacagcctgtatct

SEQ ID NO: 4380050 - DNA, 16 bp, Homo sapiens
ccagacagcctgtttc

SEQ ID NO: 4380051 - DNA, 15 bp, Homo sapiens
ccagacaggccctcc

SEQ ID NO: 4380052 - DNA, 21 bp, Homo sapiens
ccagacagtcgctcagtctgt

SEQ ID NO: 4380053 - DNA, 17 bp, Homo sapiens
ccagacccagaggtcca

SEQ ID NO: 4380054 - DNA, 18 bp, Homo sapiens
ccagaccccccagcccct

SEQ ID NO: 4380055 - DNA, 21 bp, Homo sapiens
ccagaccccccagcccctcct

SEQ ID NO: 4380056 - DNA, 22 bp, Homo sapiens
ccagaccccccagcccctcctc

SEQ ID NO: 4380057 - DNA, 23 bp, Homo sapiens
ccagaccccccagcccctcctcc

SEQ ID NO: 4380058 - DNA, 20 bp, Homo sapiens
ccagacctggctccactctt

SEQ ID NO: 4380059 - DNA, 15 bp, Homo sapiens
ccagacgtcaggccc

SEQ ID NO: 4380060 - DNA, 12 bp, Homo sapiens
ccagactacagg

SEQ ID NO: 4380061 - DNA, 14 bp, Homo sapiens
ccagactacagggc

SEQ ID NO: 4380062 - DNA, 18 bp, Homo sapiens
ccagactagatgtagtat

SEQ ID NO: 4380063 - DNA, 15 bp, Homo sapiens
ccagactcaggttcc

SEQ ID NO: 4380064 - DNA, 19 bp, Homo sapiens
ccagactcaggttccagaa

SEQ ID NO: 4380065 - DNA, 14 bp, Homo sapiens
ccagactgatgagc

SEQ ID NO: 4380066 - DNA, 15 bp, Homo sapiens
ccagactgatgagca

SEQ ID NO: 4380067 - DNA, 21 bp, Homo sapiens
ccagactgatgagcacatctc

SEQ ID NO: 4380068 - DNA, 14 bp, Homo sapiens
ccagactgtccagg

SEQ ID NO: 4380069 - DNA, 17 bp, Homo sapiens
ccagactgtccagggaa

SEQ ID NO: 4380070 - DNA, 23 bp, Homo sapiens
ccagacttcccacggctcctcga

SEQ ID NO: 4380071 - DNA, 15 bp, Homo sapiens
ccagactttcttttt

SEQ ID NO: 4380072 - DNA, 18 bp, Homo sapiens
ccagagaaaaagggaggg

SEQ ID NO: 4380073 - DNA, 18 bp, Homo sapiens
ccagagaacattggaaga

SEQ ID NO: 4380074 - DNA, 18 bp, Homo sapiens
ccagagaatgctttgaaa

SEQ ID NO: 4380075 - DNA, 15 bp, Homo sapiens
ccagagacactgagc

SEQ ID NO: 4380076 - DNA, 19 bp, Homo sapiens
ccagagacactgagccagt

SEQ ID NO: 4380077 - DNA, 14 bp, Homo sapiens
ccagagacaggaaa

SEQ ID NO: 4380078 - DNA, 19 bp, Homo sapiens
ccagagacccctcaatccc

SEQ ID NO: 4380079 - DNA, 17 bp, Homo sapiens
ccagagagaccctgcaa

SEQ ID NO: 4380080 - DNA, 23 bp, Homo sapiens
ccagagatgactattacttttct

SEQ ID NO: 4380081 - DNA, 17 bp, Homo sapiens
ccagagatgcctccacc

SEQ ID NO: 4380082 - DNA, 18 bp, Homo sapiens
ccagagatgcctccaccg

SEQ ID NO: 4380083 - DNA, 19 bp, Homo sapiens
ccagagcaaccagaaggag

SEQ ID NO: 4380084 - DNA, 24 bp, Homo sapiens
ccagagcagagcctacagaagggc

SEQ ID NO: 4380085 - DNA, 18 bp, Homo sapiens
ccagagcatctgccccag

SEQ ID NO: 4380086 - DNA, 19 bp, Homo sapiens
ccagagcatctgccccagg

SEQ ID NO: 4380087 - DNA, 21 bp, Homo sapiens
ccagagcatctgccccaggta

SEQ ID NO: 4380088 - DNA, 17 bp, Homo sapiens
ccagagccccaagcagg

SEQ ID NO: 4380089 - DNA, 16 bp, Homo sapiens
ccagagccccacagcc

SEQ ID NO: 4380090 - DNA, 23 bp, Homo sapiens
ccagagccccacagccccatctg

SEQ ID NO: 4380091 - DNA, 14 bp, Homo sapiens
ccagagccgggagg

SEQ ID NO: 4380092 - DNA, 16 bp, Homo sapiens
ccagagccgggaggaa

SEQ ID NO: 4380093 - DNA, 17 bp, Homo sapiens
ccagagccttcaagtgc

SEQ ID NO: 4380094 - DNA, 18 bp, Homo sapiens
ccagagcggtatctctgg

SEQ ID NO: 4380095 - DNA, 19 bp, Homo sapiens
ccagagcggtatctctggc

SEQ ID NO: 4380096 - DNA, 12 bp, Homo sapiens
ccagagctcccc

SEQ ID NO: 4380097 - DNA, 19 bp, Homo sapiens
ccagagctgagttgggggt

SEQ ID NO: 4380098 - DNA, 21 bp, Homo sapiens
ccagagctgtttatggcctca

SEQ ID NO: 4380099 - DNA, 19 bp, Homo sapiens
ccagagcttgttgtctcca

SEQ ID NO: 4380100 - DNA, 19 bp, Homo sapiens
ccagaggaaggggccagag

SEQ ID NO: 4380101 - DNA, 22 bp, Homo sapiens
ccagaggaaggggccagaggct

SEQ ID NO: 4380102 - DNA, 13 bp, Homo sapiens
ccagaggagcaga

SEQ ID NO: 4380103 - DNA, 21 bp, Homo sapiens
ccagaggagccaccagttctc

SEQ ID NO: 4380104 - DNA, 12 bp, Homo sapiens
ccagaggagggc

SEQ ID NO: 4380105 - DNA, 16 bp, Homo sapiens
ccagaggctcccaatc

SEQ ID NO: 4380106 - DNA, 15 bp, Homo sapiens
ccagccgccctgggc

SEQ ID NO: 4380107 - DNA, 17 bp, Homo sapiens
ccagccgccctgggctg

SEQ ID NO: 4380108 - DNA, 15 bp, Homo sapiens
ccagccgggcacagt

SEQ ID NO: 4380109 - DNA, 14 bp, Homo sapiens
ccagccgtatttta

SEQ ID NO: 4380110 - DNA, 16 bp, Homo sapiens
ccagccgtggccagag

SEQ ID NO: 4380111 - DNA, 23 bp, Homo sapiens
ccagcctcagagatctcccttct

SEQ ID NO: 4380112 - DNA, 16 bp, Homo sapiens
ccagcctccaggcccc

SEQ ID NO: 4380113 - DNA, 15 bp, Homo sapiens
ccagcctcccctccc

SEQ ID NO: 4380114 - DNA, 11 bp, Homo sapiens
ccagcctcctc

SEQ ID NO: 4380115 - DNA, 19 bp, Homo sapiens
ccagcctcgttggaagagg

SEQ ID NO: 4380116 - DNA, 13 bp, Homo sapiens
ccagcctctgccg

SEQ ID NO: 4380117 - DNA, 11 bp, Homo sapiens
ccagcctctgt

SEQ ID NO: 4380118 - DNA, 19 bp, Homo sapiens
ccagcctctgttcccctag

SEQ ID NO: 4380119 - DNA, 17 bp, Homo sapiens
ccagcctgagtgacaga

SEQ ID NO: 4380120 - DNA, 16 bp, Homo sapiens
ccagcctgcctggcag

SEQ ID NO: 4380121 - DNA, 19 bp, Homo sapiens
ccagcctgcctggcaggct

SEQ ID NO: 4380122 - DNA, 21 bp, Homo sapiens
ccagcctgcctggcaggctgt

SEQ ID NO: 4380123 - DNA, 15 bp, Homo sapiens
ccagcctggctctgc

SEQ ID NO: 4380124 - DNA, 18 bp, Homo sapiens
ccagcctggctctgcccc

SEQ ID NO: 4380125 - DNA, 13 bp, Homo sapiens
ccagcctgggagc

SEQ ID NO: 4380126 - DNA, 19 bp, Homo sapiens
ccagcctgggagcccagag

SEQ ID NO: 4380127 - DNA, 16 bp, Homo sapiens
ccagcctgggcagcca

SEQ ID NO: 4380128 - DNA, 23 bp, Homo sapiens
ccagcctgggcagccaggctgcc

SEQ ID NO: 4380129 - DNA, 13 bp, Homo sapiens
ccagcctgggcca

SEQ ID NO: 4380130 - DNA, 18 bp, Homo sapiens
ccagcctgggccatctct

SEQ ID NO: 4380131 - DNA, 14 bp, Homo sapiens
ccagccttatgtgt

SEQ ID NO: 4380132 - DNA, 18 bp, Homo sapiens
ccagccttgagccctggc

SEQ ID NO: 4380133 - DNA, 20 bp, Homo sapiens
ccagccttgagccctggctg

SEQ ID NO: 4380134 - DNA, 13 bp, Homo sapiens
ccagccttgctct

SEQ ID NO: 4380135 - DNA, 17 bp, Homo sapiens
ccagccttgctctcttc

SEQ ID NO: 4380136 - DNA, 18 bp, Homo sapiens
ccagccttgctctcttca

SEQ ID NO: 4380137 - DNA, 22 bp, Homo sapiens
ccagccttgctctcttcaataa

SEQ ID NO: 4380138 - DNA, 23 bp, Homo sapiens
ccagccttgctctcttcaataaa

SEQ ID NO: 4380139 - DNA, 16 bp, Homo sapiens
ccagcgaggaggctcc

SEQ ID NO: 4380140 - DNA, 19 bp, Homo sapiens
ccagcgatggtgctgccca

SEQ ID NO: 4380141 - DNA, 24 bp, Homo sapiens
ccagcgccaagtaaacagggtacc

SEQ ID NO: 4380142 - DNA, 15 bp, Homo sapiens
ccagcgcctccctcc

SEQ ID NO: 4380143 - DNA, 16 bp, Homo sapiens
ccagcgcctccctcca

SEQ ID NO: 4380144 - DNA, 20 bp, Homo sapiens
ccagcgcctccctccacccc

SEQ ID NO: 4380145 - DNA, 22 bp, Homo sapiens
ccagcgcctccctccaccccag

SEQ ID NO: 4380146 - DNA, 23 bp, Homo sapiens
ccagcgcctccctccaccccagg

SEQ ID NO: 4380147 - DNA, 22 bp, Homo sapiens
ccagcggccccccgcacagcca

SEQ ID NO: 4380148 - DNA, 23 bp, Homo sapiens
ccagcggccccccgcacagccac

SEQ ID NO: 4380149 - DNA, 13 bp, Homo sapiens
ccagcggctccaa

SEQ ID NO: 4380150 - DNA, 17 bp, Homo sapiens
ccagcggctccaactcc

SEQ ID NO: 4380151 - DNA, 18 bp, Homo sapiens
ccagcggctccaactcct

SEQ ID NO: 4380152 - DNA, 13 bp, Homo sapiens
ccagcggctgagt

SEQ ID NO: 4380153 - DNA, 13 bp, Homo sapiens
ccagcgggctggc

SEQ ID NO: 4380154 - DNA, 14 bp, Homo sapiens
ccagcgtgacggag

SEQ ID NO: 4380155 - DNA, 20 bp, Homo sapiens
ccagctaatttttgtatttt

SEQ ID NO: 4380156 - DNA, 23 bp, Homo sapiens
ccagctaccaagtcagacaccaa

SEQ ID NO: 4380157 - DNA, 15 bp, Homo sapiens
ccagctaccctgtgt

SEQ ID NO: 4380158 - DNA, 13 bp, Homo sapiens
ccagctactcagg

SEQ ID NO: 4380159 - DNA, 20 bp, Homo sapiens
ccagctactcaggaggctga

SEQ ID NO: 4380160 - DNA, 21 bp, Homo sapiens
ccagctactcaggaggctgag

SEQ ID NO: 4380161 - DNA, 15 bp, Homo sapiens
ccagctacttgggag

SEQ ID NO: 4380162 - DNA, 21 bp, Homo sapiens
ccagctagtgccaaataattg

SEQ ID NO: 4380163 - DNA, 14 bp, Homo sapiens
ccagctatctgtca

SEQ ID NO: 4380164 - DNA, 15 bp, Homo sapiens
ccagctatctgtcat

SEQ ID NO: 4380165 - DNA, 23 bp, Homo sapiens
ccagctcaccccccacactcact

SEQ ID NO: 4380166 - DNA, 12 bp, Homo sapiens
ccagctcaggaa

SEQ ID NO: 4380167 - DNA, 22 bp, Homo sapiens
ccagctcaggaattccctggaa

SEQ ID NO: 4380168 - DNA, 20 bp, Homo sapiens
ccagctccatgttctcccaa

SEQ ID NO: 4380169 - DNA, 15 bp, Homo sapiens
ccagctcccacaccg

SEQ ID NO: 4380170 - DNA, 15 bp, Homo sapiens
ccagctctgaaacca

SEQ ID NO: 4380171 - DNA, 12 bp, Homo sapiens
ccagctctgccc

SEQ ID NO: 4380172 - DNA, 13 bp, Homo sapiens
ccagctctggcac

SEQ ID NO: 4380173 - DNA, 14 bp, Homo sapiens
ccagctctggcaca

SEQ ID NO: 4380174 - DNA, 15 bp, Homo sapiens
ccagctctggcacag

SEQ ID NO: 4380175 - DNA, 14 bp, Homo sapiens
ccagctctgtatca

SEQ ID NO: 4380176 - DNA, 21 bp, Homo sapiens
ccagctctgtatcaggaccca

SEQ ID NO: 4380177 - DNA, 22 bp, Homo sapiens
ccagctgaccctggttctctct

SEQ ID NO: 4380178 - DNA, 17 bp, Homo sapiens
ccagctgactaaacttt

SEQ ID NO: 4380179 - DNA, 14 bp, Homo sapiens
ccagctgcaaagtg

SEQ ID NO: 4380180 - DNA, 16 bp, Homo sapiens
ccagctgcaaagtgtt

SEQ ID NO: 4380181 - DNA, 18 bp, Homo sapiens
ccagctgcccttgcaggg

SEQ ID NO: 4380182 - DNA, 19 bp, Homo sapiens
ccagctgcgcttgcttttc

SEQ ID NO: 4380183 - DNA, 21 bp, Homo sapiens
ccagctgcgcttgcttttctg

SEQ ID NO: 4380184 - DNA, 17 bp, Homo sapiens
ccagctgctcccctgga

SEQ ID NO: 4380185 - DNA, 20 bp, Homo sapiens
ccagctgctgagatcctgga

SEQ ID NO: 4380186 - DNA, 15 bp, Homo sapiens
ccagctggacttcct

SEQ ID NO: 4380187 - DNA, 17 bp, Homo sapiens
ccagctggatcgctgca

SEQ ID NO: 4380188 - DNA, 17 bp, Homo sapiens
ccagctgggaagccctt

SEQ ID NO: 4380189 - DNA, 12 bp, Homo sapiens
ccagctggggcc

SEQ ID NO: 4380190 - DNA, 15 bp, Homo sapiens
ccagctggggccaga

SEQ ID NO: 4380191 - DNA, 20 bp, Homo sapiens
ccagctggggccagaggctg

SEQ ID NO: 4380192 - DNA, 15 bp, Homo sapiens
ccagctgtcaagggc

SEQ ID NO: 4380193 - DNA, 14 bp, Homo sapiens
ccagctgtgctgtg

SEQ ID NO: 4380194 - DNA, 22 bp, Homo sapiens
ccagcttaaacccatacaatgt

SEQ ID NO: 4380195 - DNA, 23 bp, Homo sapiens
ccagcttaaacccatacaatgta

SEQ ID NO: 4380196 - DNA, 17 bp, Homo sapiens
ccagcttgcgaataaca

SEQ ID NO: 4380197 - DNA, 14 bp, Homo sapiens
ccagcttgctcttc

SEQ ID NO: 4380198 - DNA, 12 bp, Homo sapiens
ccagctttccct

SEQ ID NO: 4380199 - DNA, 16 bp, Homo sapiens
ccagcttttaaccatc

SEQ ID NO: 4380200 - DNA, 23 bp, Homo sapiens
ccaggaaactccacatctgcctt

SEQ ID NO: 4380201 - DNA, 23 bp, Homo sapiens
ccaggaaaggacggctgagcatg

SEQ ID NO: 4380202 - DNA, 14 bp, Homo sapiens
ccaggaagccagag

SEQ ID NO: 4380203 - DNA, 22 bp, Homo sapiens
ccaggaagccgtcctggcgcct

SEQ ID NO: 4380204 - DNA, 20 bp, Homo sapiens
ccaggaagggaaagcgggca

SEQ ID NO: 4380205 - DNA, 20 bp, Homo sapiens
ccaggaatattgtcatcctt

SEQ ID NO: 4380206 - DNA, 14 bp, Homo sapiens
ccaggacaggacca

SEQ ID NO: 4380207 - DNA, 13 bp, Homo sapiens
ccaggacaggccc

SEQ ID NO: 4380208 - DNA, 14 bp, Homo sapiens
ccaggacaggcccg

SEQ ID NO: 4380209 - DNA, 17 bp, Homo sapiens
ccaggacaggcccggcg

SEQ ID NO: 4380210 - DNA, 22 bp, Homo sapiens
ccaggacgccactcatttcatc

SEQ ID NO: 4380211 - DNA, 14 bp, Homo sapiens
ccaggactgaaaga

SEQ ID NO: 4380212 - DNA, 21 bp, Homo sapiens
ccaggagaaatcaacaggagg

SEQ ID NO: 4380213 - DNA, 19 bp, Homo sapiens
ccaggagaaccactacatg

SEQ ID NO: 4380214 - DNA, 13 bp, Homo sapiens
ccaggagacaggt

SEQ ID NO: 4380215 - DNA, 17 bp, Homo sapiens
ccaggagagccagccct

SEQ ID NO: 4380216 - DNA, 18 bp, Homo sapiens
ccaggagagccagccctc

SEQ ID NO: 4380217 - DNA, 23 bp, Homo sapiens
ccaggagagccagccctccctgt

SEQ ID NO: 4380218 - DNA, 15 bp, Homo sapiens
ccaggagatgggtcc

SEQ ID NO: 4380219 - DNA, 15 bp, Homo sapiens
ccaggagcagccctg

SEQ ID NO: 4380220 - DNA, 16 bp, Homo sapiens
ccaggagcagccctgg

SEQ ID NO: 4380221 - DNA, 21 bp, Homo sapiens
ccaggagcctcatccagcctc

SEQ ID NO: 4380222 - DNA, 23 bp, Homo sapiens
ccaggagcctcatccagcctcag

SEQ ID NO: 4380223 - DNA, 18 bp, Homo sapiens
ccaggagctcttcaggcc

SEQ ID NO: 4380224 - DNA, 22 bp, Homo sapiens
ccagggtcataagtggggagag

SEQ ID NO: 4380225 - DNA, 18 bp, Homo sapiens
ccagggtcctctcttcca

SEQ ID NO: 4380226 - DNA, 23 bp, Homo sapiens
ccagggtcctctcttccacagtg

SEQ ID NO: 4380227 - DNA, 19 bp, Homo sapiens
ccagggtggccacacaggc

SEQ ID NO: 4380228 - DNA, 20 bp, Homo sapiens
ccagggtggccacacaggca

SEQ ID NO: 4380229 - DNA, 23 bp, Homo sapiens
ccagggtggccacacaggcaggg

SEQ ID NO: 4380230 - DNA, 24 bp, Homo sapiens
ccagggtggccacacctctatccc

SEQ ID NO: 4380231 - DNA, 17 bp, Homo sapiens
ccagggtttacccagtg

SEQ ID NO: 4380232 - DNA, 14 bp, Homo sapiens
ccaggtacacctcc

SEQ ID NO: 4380233 - DNA, 18 bp, Homo sapiens
ccaggtacacctccccct

SEQ ID NO: 4380234 - DNA, 22 bp, Homo sapiens
ccaggtacacctccccctgcgc

SEQ ID NO: 4380235 - DNA, 18 bp, Homo sapiens
ccaggtaccagctgcgct

SEQ ID NO: 4380236 - DNA, 22 bp, Homo sapiens
ccaggtatccaaaaatgtgtaa

SEQ ID NO: 4380237 - DNA, 20 bp, Homo sapiens
ccaggtcccagcccctcctc

SEQ ID NO: 4380238 - DNA, 14 bp, Homo sapiens
ccaggtccttcctt

SEQ ID NO: 4380239 - DNA, 13 bp, Homo sapiens
ccaggtgccagtt

SEQ ID NO: 4380240 - DNA, 17 bp, Homo sapiens
ccaggtgccagttatgg

SEQ ID NO: 4380241 - DNA, 20 bp, Homo sapiens
ccaggtgccccgactgtggg

SEQ ID NO: 4380242 - DNA, 13 bp, Homo sapiens
ccaggtgccttgg

SEQ ID NO: 4380243 - DNA, 20 bp, Homo sapiens
ccaggtgcctttcaaattta

SEQ ID NO: 4380244 - DNA, 13 bp, Homo sapiens
ccaggtggcacct

SEQ ID NO: 4380245 - DNA, 14 bp, Homo sapiens
ccaggtggcacctg

SEQ ID NO: 4380246 - DNA, 16 bp, Homo sapiens
ccaggtggcacctgca

SEQ ID NO: 4380247 - DNA, 20 bp, Homo sapiens
ccaggtggctgacccagtcc

SEQ ID NO: 4380248 - DNA, 21 bp, Homo sapiens
ccaggtggctgacccagtccc

SEQ ID NO: 4380249 - DNA, 15 bp, Homo sapiens
ccaggttcccccagc

SEQ ID NO: 4380250 - DNA, 17 bp, Homo sapiens
ccaggttcccccagcaa

SEQ ID NO: 4380251 - DNA, 19 bp, Homo sapiens
ccaggtttaagtagatttc

SEQ ID NO: 4380252 - DNA, 17 bp, Homo sapiens
ccaggtttgcaggagcc

SEQ ID NO: 4380253 - DNA, 15 bp, Homo sapiens
ccagtaacctcggag

SEQ ID NO: 4380254 - DNA, 16 bp, Homo sapiens
ccagtaacctcggaga

SEQ ID NO: 4380255 - DNA, 15 bp, Homo sapiens
ccagtaaggaaatat

SEQ ID NO: 4380256 - DNA, 19 bp, Homo sapiens
ccagtacgtcccgctgctg

SEQ ID NO: 4380257 - DNA, 20 bp, Homo sapiens
ccagtacgtcccgctgctgt

SEQ ID NO: 4380258 - DNA, 14 bp, Homo sapiens
ccagtacttctaag

SEQ ID NO: 4380259 - DNA, 15 bp, Homo sapiens
ccagtacttctaaga

SEQ ID NO: 4380260 - DNA, 16 bp, Homo sapiens
ccagtacttctaagag

SEQ ID NO: 4380261 - DNA, 15 bp, Homo sapiens
ccagtacttgtcata

SEQ ID NO: 4380262 - DNA, 14 bp, Homo sapiens
ccagtagcttccca

SEQ ID NO: 4380263 - DNA, 16 bp, Homo sapiens
ccagtataaatttctg

SEQ ID NO: 4380264 - DNA, 16 bp, Homo sapiens
ccagtatgttttaaca

SEQ ID NO: 4380265 - DNA, 16 bp, Homo sapiens
ccagtattgccccctc

SEQ ID NO: 4380266 - DNA, 14 bp, Homo sapiens
ccagtatttttaaa

SEQ ID NO: 4380267 - DNA, 17 bp, Homo sapiens
ccagtatttttgctgct

SEQ ID NO: 4380268 - DNA, 19 bp, Homo sapiens
ccagtatttttgctgcttc

SEQ ID NO: 4380269 - DNA, 21 bp, Homo sapiens
ccagtcaacatcgtggatgta

SEQ ID NO: 4380270 - DNA, 17 bp, Homo sapiens
ccagtcacattgccatc

SEQ ID NO: 4380271 - DNA, 15 bp, Homo sapiens
ccagtcagcagtcat

SEQ ID NO: 4380272 - DNA, 12 bp, Homo sapiens
ccagtcagcctc

SEQ ID NO: 4380273 - DNA, 18 bp, Homo sapiens
ccagtcagcctctctccc

SEQ ID NO: 4380274 - DNA, 23 bp, Homo sapiens
ccagtcagcctctctcccagtct

SEQ ID NO: 4380275 - DNA, 21 bp, Homo sapiens
ccagtcaggctgcagaggcac

SEQ ID NO: 4380276 - DNA, 22 bp, Homo sapiens
ccagtcatggtactaccccagc

SEQ ID NO: 4380277 - DNA, 21 bp, Homo sapiens
ccagtcattatgttaatattt

SEQ ID NO: 4380278 - DNA, 18 bp, Homo sapiens
ccagtccaaatgtcctcc

SEQ ID NO: 4380279 - DNA, 18 bp, Homo sapiens
ccagtccatgctccaggg

SEQ ID NO: 4380280 - DNA, 16 bp, Homo sapiens
ccagtcccatgctggc

SEQ ID NO: 4380281 - DNA, 15 bp, Homo sapiens
ccagtccctggggga

SEQ ID NO: 4380282 - DNA, 23 bp, Homo sapiens
ccagtccctgggggaagccctgg

SEQ ID NO: 4380283 - DNA, 12 bp, Homo sapiens
ccagtcctgccc

SEQ ID NO: 4380284 - DNA, 12 bp, Homo sapiens
ccagtcctgcct

SEQ ID NO: 4380285 - DNA, 13 bp, Homo sapiens
ccagtcctgcctg

SEQ ID NO: 4380286 - DNA, 14 bp, Homo sapiens
ccagtcctgcctga

SEQ ID NO: 4380287 - DNA, 15 bp, Homo sapiens
ccagtcctgcctgaa

SEQ ID NO: 4380288 - DNA, 16 bp, Homo sapiens
ccagtcctgcctggcc

SEQ ID NO: 4380289 - DNA, 18 bp, Homo sapiens
ccagtcctgcctggccag

SEQ ID NO: 4380290 - DNA, 19 bp, Homo sapiens
ccagtcctgcctggccagg

SEQ ID NO: 4380291 - DNA, 21 bp, Homo sapiens
ccagtcctgcctggccaggca

SEQ ID NO: 4380292 - DNA, 18 bp, Homo sapiens
ccagtcggccccatctct

SEQ ID NO: 4380293 - DNA, 22 bp, Homo sapiens
ccagtcgtgatgtggaggaaga

SEQ ID NO: 4380294 - DNA, 18 bp, Homo sapiens
ccagtctaggagctcctt

SEQ ID NO: 4380295 - DNA, 22 bp, Homo sapiens
ccagtctcagacactaaatgca

SEQ ID NO: 4380296 - DNA, 16 bp, Homo sapiens
ccagtctcctcactct

SEQ ID NO: 4380297 - DNA, 22 bp, Homo sapiens
ccagtctcctcactctgtccct

SEQ ID NO: 4380298 - DNA, 21 bp, Homo sapiens
ccagtctgccttcccccaacc

SEQ ID NO: 4380299 - DNA, 17 bp, Homo sapiens
ccagtcttcctgacact

SEQ ID NO: 4380300 - DNA, 20 bp, Homo sapiens
ccagtctttgaactgcagca

SEQ ID NO: 4380301 - DNA, 18 bp, Homo sapiens
ccagtgaatttttgcaat

SEQ ID NO: 4380302 - DNA, 21 bp, Homo sapiens
ccagtgagactgccccacgga

SEQ ID NO: 4380303 - DNA, 14 bp, Homo sapiens
ccagtgagccctgc

SEQ ID NO: 4380304 - DNA, 15 bp, Homo sapiens
ccagtgagccctgct

SEQ ID NO: 4380305 - DNA, 17 bp, Homo sapiens
ccagtgagccctgctct

SEQ ID NO: 4380306 - DNA, 13 bp, Homo sapiens
ccagtgccactgc

SEQ ID NO: 4380307 - DNA, 16 bp, Homo sapiens
ccagtgccgaggacat

SEQ ID NO: 4380308 - DNA, 20 bp, Homo sapiens
ccagtgccgaggacatgcat

SEQ ID NO: 4380309 - DNA, 11 bp, Homo sapiens
ccagtgcctct

SEQ ID NO: 4380310 - DNA, 14 bp, Homo sapiens
ccagtgcctctccc

SEQ ID NO: 4380311 - DNA, 15 bp, Homo sapiens
ccagtgcctgccact

SEQ ID NO: 4380312 - DNA, 14 bp, Homo sapiens
ccagtgcctgggtg

SEQ ID NO: 4380313 - DNA, 18 bp, Homo sapiens
ccagtgctcaccagccct

SEQ ID NO: 4380314 - DNA, 22 bp, Homo sapiens
ccagtgctgaatttccctctct

SEQ ID NO: 4380315 - DNA, 13 bp, Homo sapiens
ccagtgctgccca

SEQ ID NO: 4380316 - DNA, 14 bp, Homo sapiens
ccagtgctgcccat

SEQ ID NO: 4380317 - DNA, 17 bp, Homo sapiens
ccagtgctgcccatgag

SEQ ID NO: 4380318 - DNA, 22 bp, Homo sapiens
ccagtgctgtccatgcttctca

SEQ ID NO: 4380319 - DNA, 12 bp, Homo sapiens
ccagtgcttctc

SEQ ID NO: 4380320 - DNA, 21 bp, Homo sapiens
ccagtgcttctccaacactga

SEQ ID NO: 4380321 - DNA, 22 bp, Homo sapiens
ccagtgcttctccaacactgaa

SEQ ID NO: 4380322 - DNA, 17 bp, Homo sapiens
ccagtgctttatgttgt

SEQ ID NO: 4380323 - DNA, 15 bp, Homo sapiens
ccagtggccactcag

SEQ ID NO: 4380324 - DNA, 12 bp, Homo sapiens
ccagtgggacag

SEQ ID NO: 4380325 - DNA, 16 bp, Homo sapiens
ccagtgggacagagga

SEQ ID NO: 4380326 - DNA, 17 bp, Homo sapiens
ccagtgggacagaggag

SEQ ID NO: 4380327 - DNA, 13 bp, Homo sapiens
ccagtgggactgt

SEQ ID NO: 4380328 - DNA, 15 bp, Homo sapiens
ccagtggtcagcagg

SEQ ID NO: 4380329 - DNA, 22 bp, Homo sapiens
ccagtgtcaagttgtgcttgtt

SEQ ID NO: 4380330 - DNA, 15 bp, Homo sapiens
ccagtgtcccctttc

SEQ ID NO: 4380331 - DNA, 14 bp, Homo sapiens
ccagtgtctttctt

SEQ ID NO: 4380332 - DNA, 10 bp, Homo sapiens
ccagtgtgaa

SEQ ID NO: 4380333 - DNA, 11 bp, Homo sapiens
ccagtgtgaac

SEQ ID NO: 4380334 - DNA, 20 bp, Homo sapiens
ccagtgttcctgaagctgct

SEQ ID NO: 4380335 - DNA, 19 bp, Homo sapiens
ccagtgttctatttgcttt

SEQ ID NO: 4380336 - DNA, 17 bp, Homo sapiens
ccagttaaaaaaaattt

SEQ ID NO: 4380337 - DNA, 14 bp, Homo sapiens
ccagttaaagatta

SEQ ID NO: 4380338 - DNA, 18 bp, Homo sapiens
ccagttaatttttccaac

SEQ ID NO: 4380339 - DNA, 14 bp, Homo sapiens
ccagttatggctat

SEQ ID NO: 4380340 - DNA, 22 bp, Homo sapiens
ccagttcctagcactgccccac

SEQ ID NO: 4380341 - DNA, 15 bp, Homo sapiens
ccagttcctcttttg

SEQ ID NO: 4380342 - DNA, 16 bp, Homo sapiens
ccagttcctcttttgt

SEQ ID NO: 4380343 - DNA, 17 bp, Homo sapiens
ccagttgcctccagggc

SEQ ID NO: 4380344 - DNA, 15 bp, Homo sapiens
ccagtttctcagaag

SEQ ID NO: 4380345 - DNA, 11 bp, Homo sapiens
ccagtttctta

SEQ ID NO: 4380346 - DNA, 14 bp, Homo sapiens
ccagtttctttccc

SEQ ID NO: 4380347 - DNA, 13 bp, Homo sapiens
ccagtttgcagaa

SEQ ID NO: 4380348 - DNA, 21 bp, Homo sapiens
ccataagctactgccatcctg

SEQ ID NO: 4380349 - DNA, 21 bp, Homo sapiens
ccataagtttaactgtatttt

SEQ ID NO: 4380350 - DNA, 20 bp, Homo sapiens
ccataattatgaaaactcat

SEQ ID NO: 4380351 - DNA, 19 bp, Homo sapiens
ccataattgctttgccaaa

SEQ ID NO: 4380352 - DNA, 15 bp, Homo sapiens
ccatacaatgtatgt

SEQ ID NO: 4380353 - DNA, 16 bp, Homo sapiens
ccatacaatgtatgta

SEQ ID NO: 4380354 - DNA, 18 bp, Homo sapiens
ccatacaatgtatgtaca

SEQ ID NO: 4380355 - DNA, 15 bp, Homo sapiens
ccatacacagaggag

SEQ ID NO: 4380356 - DNA, 16 bp, Homo sapiens
ccatacacagaggagt

SEQ ID NO: 4380357 - DNA, 14 bp, Homo sapiens
ccatacagcctcta

SEQ ID NO: 4380358 - DNA, 13 bp, Homo sapiens
ccataccttttct

SEQ ID NO: 4380359 - DNA, 16 bp, Homo sapiens
ccatactgcgtccacc

SEQ ID NO: 4380360 - DNA, 18 bp, Homo sapiens
ccatactgcgtccaccct

SEQ ID NO: 4380361 - DNA, 12 bp, Homo sapiens
ccatagacacag

SEQ ID NO: 4380362 - DNA, 13 bp, Homo sapiens
ccatagacacagt

SEQ ID NO: 4380363 - DNA, 17 bp, Homo sapiens
ccatagagtaatgatgt

SEQ ID NO: 4380364 - DNA, 18 bp, Homo sapiens
ccatagctgctgccctag

SEQ ID NO: 4380365 - DNA, 23 bp, Homo sapiens
ccatagctgggactacaggcgcc

SEQ ID NO: 4380366 - DNA, 19 bp, Homo sapiens
ccatagggtcggaggtgct

SEQ ID NO: 4380367 - DNA, 21 bp, Homo sapiens
ccatagggtcggaggtgctgt

SEQ ID NO: 4380368 - DNA, 19 bp, Homo sapiens
ccatagtcagcagcagctc

SEQ ID NO: 4380369 - DNA, 21 bp, Homo sapiens
ccatagtcagcagcagctctg

SEQ ID NO: 4380370 - DNA, 14 bp, Homo sapiens
ccatatataaatta

SEQ ID NO: 4380371 - DNA, 18 bp, Homo sapiens
ccatatataaattattac

SEQ ID NO: 4380372 - DNA, 23 bp, Homo sapiens
ccatatataaattattactttaa

SEQ ID NO: 4380373 - DNA, 19 bp, Homo sapiens
ccatatatgaccagaagcc

SEQ ID NO: 4380374 - DNA, 15 bp, Homo sapiens
ccatatatgctgtat

SEQ ID NO: 4380375 - DNA, 19 bp, Homo sapiens
ccatatatgctgtatttct

SEQ ID NO: 4380376 - DNA, 19 bp, Homo sapiens
ccatatctccttcccctac

SEQ ID NO: 4380377 - DNA, 16 bp, Homo sapiens
ccatatgcagaaatag

SEQ ID NO: 4380378 - DNA, 16 bp, Homo sapiens
ccatatgctccaggat

SEQ ID NO: 4380379 - DNA, 22 bp, Homo sapiens
ccatatgctccaggatctttga

SEQ ID NO: 4380380 - DNA, 13 bp, Homo sapiens
ccatatgtccact

SEQ ID NO: 4380381 - DNA, 14 bp, Homo sapiens
ccatattgtaaaac

SEQ ID NO: 4380382 - DNA, 14 bp, Homo sapiens
ccatatttagcagt

SEQ ID NO: 4380383 - DNA, 13 bp, Homo sapiens
ccatatttttaaa

SEQ ID NO: 4380384 - DNA, 17 bp, Homo sapiens
ccatcaaaggaatataa

SEQ ID NO: 4380385 - DNA, 23 bp, Homo sapiens
ccatcaaaggaatataagaaaag

SEQ ID NO: 4380386 - DNA, 14 bp, Homo sapiens
ccatcaagcacttc

SEQ ID NO: 4380387 - DNA, 16 bp, Homo sapiens
ccatcaagcacttccc

SEQ ID NO: 4380388 - DNA, 17 bp, Homo sapiens
ccatcaagcacttccca

SEQ ID NO: 4380389 - DNA, 13 bp, Homo sapiens
ccatcacccaagc

SEQ ID NO: 4380390 - DNA, 18 bp, Homo sapiens
ccatcactggagcaccag

SEQ ID NO: 4380391 - DNA, 19 bp, Homo sapiens
ccatcactggtccaggtct

SEQ ID NO: 4380392 - DNA, 17 bp, Homo sapiens
ccatcagaacctgagct

SEQ ID NO: 4380393 - DNA, 15 bp, Homo sapiens
ccatcagcactctgt

SEQ ID NO: 4380394 - DNA, 12 bp, Homo sapiens
ccatcagccctg

SEQ ID NO: 4380395 - DNA, 15 bp, Homo sapiens
ccatcagctctgcct

SEQ ID NO: 4380396 - DNA, 20 bp, Homo sapiens
ccatcagggttctcttagca

SEQ ID NO: 4380397 - DNA, 22 bp, Homo sapiens
ccatcaggtcccccccaggtgc

SEQ ID NO: 4380398 - DNA, 17 bp, Homo sapiens
ccatcagttccagcctt

SEQ ID NO: 4380399 - DNA, 20 bp, Homo sapiens
ccatcatcactgtaaagaca

SEQ ID NO: 4380400 - DNA, 14 bp, Homo sapiens
ccatcatgcccagc

SEQ ID NO: 4380401 - DNA, 13 bp, Homo sapiens
ccatcatgtctgt

SEQ ID NO: 4380402 - DNA, 15 bp, Homo sapiens
ccatcatgtggccca

SEQ ID NO: 4380403 - DNA, 22 bp, Homo sapiens
ccatccactctaccctcccacc

SEQ ID NO: 4380404 - DNA, 16 bp, Homo sapiens
ccatccagacctggct

SEQ ID NO: 4380405 - DNA, 14 bp, Homo sapiens
ccatccagccagac

SEQ ID NO: 4380406 - DNA, 15 bp, Homo sapiens
ccatccattctcctc

SEQ ID NO: 4380407 - DNA, 14 bp, Homo sapiens
ccatcccctccctg

SEQ ID NO: 4380408 - DNA, 17 bp, Homo sapiens
ccatcccctccctgcct

SEQ ID NO: 4380409 - DNA, 14 bp, Homo sapiens
ccatccccttcccc

SEQ ID NO: 4380410 - DNA, 12 bp, Homo sapiens
ccatccctgctt

SEQ ID NO: 4380411 - DNA, 13 bp, Homo sapiens
ccatccctgggcc

SEQ ID NO: 4380412 - DNA, 13 bp, Homo sapiens
ccatccctgtgag

SEQ ID NO: 4380413 - DNA, 18 bp, Homo sapiens
ccatccgactgcccctgc

SEQ ID NO: 4380414 - DNA, 18 bp, Homo sapiens
ccatcctaccccctgtgc

SEQ ID NO: 4380415 - DNA, 18 bp, Homo sapiens
ccatcctcaaacgacaga

SEQ ID NO: 4380416 - DNA, 22 bp, Homo sapiens
ccatcctcaaacgacagaggag

SEQ ID NO: 4380417 - DNA, 17 bp, Homo sapiens
ccatcctcatccctgac

SEQ ID NO: 4380418 - DNA, 21 bp, Homo sapiens
ccatcctcctgtgtcactgaa

SEQ ID NO: 4380419 - DNA, 12 bp, Homo sapiens
ccatcctgacca

SEQ ID NO: 4380420 - DNA, 13 bp, Homo sapiens
ccatcctgactga

SEQ ID NO: 4380421 - DNA, 18 bp, Homo sapiens
ccatctagtttttggaaa

SEQ ID NO: 4380422 - DNA, 17 bp, Homo sapiens
ccatctcaggagatgga

SEQ ID NO: 4380423 - DNA, 20 bp, Homo sapiens
ccatctcatgtatcatctgg

SEQ ID NO: 4380424 - DNA, 16 bp, Homo sapiens
ccatctccctccccag

SEQ ID NO: 4380425 - DNA, 16 bp, Homo sapiens
ccatctccctgcctgg

SEQ ID NO: 4380426 - DNA, 18 bp, Homo sapiens
ccatctccctgcctggcc

SEQ ID NO: 4380427 - DNA, 14 bp, Homo sapiens
ccatctctactaaa

SEQ ID NO: 4380428 - DNA, 15 bp, Homo sapiens
ccatctcttccttca

SEQ ID NO: 4380429 - DNA, 18 bp, Homo sapiens
ccatctctttaaaaacaa

SEQ ID NO: 4380430 - DNA, 16 bp, Homo sapiens
ccatctgatatctata

SEQ ID NO: 4380431 - DNA, 20 bp, Homo sapiens
ccatctgcaccccttctctc

SEQ ID NO: 4380432 - DNA, 23 bp, Homo sapiens
ccatctgcaccccttctctcctc

SEQ ID NO: 4380433 - DNA, 19 bp, Homo sapiens
ccatctgcttggttggctg

SEQ ID NO: 4380434 - DNA, 14 bp, Homo sapiens
ccatctggcagggt

SEQ ID NO: 4380435 - DNA, 16 bp, Homo sapiens
ccatctggcagggtgg

SEQ ID NO: 4380436 - DNA, 16 bp, Homo sapiens
ccatctggtcatttgg

SEQ ID NO: 4380437 - DNA, 21 bp, Homo sapiens
ccatctgtagtaatttattgt

SEQ ID NO: 4380438 - DNA, 15 bp, Homo sapiens
ccatctgtccagctg

SEQ ID NO: 4380439 - DNA, 20 bp, Homo sapiens
ccatctgtccagctggggcc

SEQ ID NO: 4380440 - DNA, 14 bp, Homo sapiens
ccatctgtccctgc

SEQ ID NO: 4380441 - DNA, 15 bp, Homo sapiens
ccatctgtctgccaa

SEQ ID NO: 4380442 - DNA, 21 bp, Homo sapiens
ccatcttgatctttgagccca

SEQ ID NO: 4380443 - DNA, 16 bp, Homo sapiens
ccatcttgctttttcc

SEQ ID NO: 4380444 - DNA, 17 bp, Homo sapiens
ccatcttggtagttctg

SEQ ID NO: 4380445 - DNA, 20 bp, Homo sapiens
ccatcttggtagttctgtgc

SEQ ID NO: 4380446 - DNA, 16 bp, Homo sapiens
ccatcttttattcttt

SEQ ID NO: 4380447 - DNA, 15 bp, Homo sapiens
ccatgaaattgaccc

SEQ ID NO: 4380448 - DNA, 13 bp, Homo sapiens
ccatgaagccttt

SEQ ID NO: 4380449 - DNA, 14 bp, Homo sapiens
ccatgaccatactg

SEQ ID NO: 4380450 - DNA, 19 bp, Homo sapiens
ccatgaccttggggtacaa

SEQ ID NO: 4380451 - DNA, 12 bp, Homo sapiens
ccatgagcaagc

SEQ ID NO: 4380452 - DNA, 23 bp, Homo sapiens
ccatgatttcccactgcactcca

SEQ ID NO: 4380453 - DNA, 16 bp, Homo sapiens
ccatgcaaattgtgaa

SEQ ID NO: 4380454 - DNA, 18 bp, Homo sapiens
ccatgcaaattgtgaaat

SEQ ID NO: 4380455 - DNA, 16 bp, Homo sapiens
ccatgcactgtaaata

SEQ ID NO: 4380456 - DNA, 14 bp, Homo sapiens
ccatgccagagagg

SEQ ID NO: 4380457 - DNA, 20 bp, Homo sapiens
ccatgccagattctgcctct

SEQ ID NO: 4380458 - DNA, 23 bp, Homo sapiens
ccatgcctgtagctttcctggtc

SEQ ID NO: 4380459 - DNA, 14 bp, Homo sapiens
ccatgcctgtccag

SEQ ID NO: 4380460 - DNA, 17 bp, Homo sapiens
ccatgcctgtccagcct

SEQ ID NO: 4380461 - DNA, 19 bp, Homo sapiens
ccatgcctgtccagcctgg

SEQ ID NO: 4380462 - DNA, 23 bp, Homo sapiens
cccaccccaactctccccagtgc

SEQ ID NO: 4380463 - DNA, 13 bp, Homo sapiens
cccaccccacact

SEQ ID NO: 4380464 - DNA, 18 bp, Homo sapiens
cccaccccatccagccag

SEQ ID NO: 4380465 - DNA, 12 bp, Homo sapiens
cccacccccagt

SEQ ID NO: 4380466 - DNA, 20 bp, Homo sapiens
cccacccccctctctttctc

SEQ ID NO: 4380467 - DNA, 22 bp, Homo sapiens
cccacccccctctctttctctg

SEQ ID NO: 4380468 - DNA, 19 bp, Homo sapiens
cccaccccctccccagggg

SEQ ID NO: 4380469 - DNA, 18 bp, Homo sapiens
cccaccccctgccctgca

SEQ ID NO: 4380470 - DNA, 16 bp, Homo sapiens
cccacccccttctctg

SEQ ID NO: 4380471 - DNA, 12 bp, Homo sapiens
cccacccctgcc

SEQ ID NO: 4380472 - DNA, 19 bp, Homo sapiens
cccacccggccacagctgc

SEQ ID NO: 4380473 - DNA, 18 bp, Homo sapiens
cccaccctccatgctcct

SEQ ID NO: 4380474 - DNA, 18 bp, Homo sapiens
cccaccctccctggagtg

SEQ ID NO: 4380475 - DNA, 19 bp, Homo sapiens
cccaccgaggttcccaggg

SEQ ID NO: 4380476 - DNA, 22 bp, Homo sapiens
cccaccggaactgggctggcgc

SEQ ID NO: 4380477 - DNA, 21 bp, Homo sapiens
cccaccgggagcctccccctc

SEQ ID NO: 4380478 - DNA, 20 bp, Homo sapiens
cccaccgtggaggaggaagg

SEQ ID NO: 4380479 - DNA, 14 bp, Homo sapiens
cccacctctcctgc

SEQ ID NO: 4380480 - DNA, 16 bp, Homo sapiens
cccacctgaagggtgg

SEQ ID NO: 4380481 - DNA, 20 bp, Homo sapiens
cccacctgcccatcacaggg

SEQ ID NO: 4380482 - DNA, 14 bp, Homo sapiens
cccacctggctctg

SEQ ID NO: 4380483 - DNA, 16 bp, Homo sapiens
cccacctgtttctgga

SEQ ID NO: 4380484 - DNA, 14 bp, Homo sapiens
cccacgagggctgg

SEQ ID NO: 4380485 - DNA, 15 bp, Homo sapiens
cccacgccaggccag

SEQ ID NO: 4380486 - DNA, 16 bp, Homo sapiens
cccacgccaggccagc

SEQ ID NO: 4380487 - DNA, 14 bp, Homo sapiens
cccacgctgaccat

SEQ ID NO: 4380488 - DNA, 15 bp, Homo sapiens
cccacggagacagag

SEQ ID NO: 4380489 - DNA, 20 bp, Homo sapiens
cccacggttcggggcttctg

SEQ ID NO: 4380490 - DNA, 22 bp, Homo sapiens
cccactcccccgtttctccttt

SEQ ID NO: 4380491 - DNA, 16 bp, Homo sapiens
cccactcctctcccac

SEQ ID NO: 4380492 - DNA, 22 bp, Homo sapiens
cccactcgggtctgcagacctg

SEQ ID NO: 4380493 - DNA, 19 bp, Homo sapiens
cccactctcattccccagg

SEQ ID NO: 4380494 - DNA, 11 bp, Homo sapiens
cccactctccc

SEQ ID NO: 4380495 - DNA, 23 bp, Homo sapiens
cccactgctcgtggactgtgctg

SEQ ID NO: 4380496 - DNA, 15 bp, Homo sapiens
cccacttcaccccca

SEQ ID NO: 4380497 - DNA, 18 bp, Homo sapiens
cccagaaagtgggggtgg

SEQ ID NO: 4380498 - DNA, 22 bp, Homo sapiens
cccagaaagtgggggtggagga

SEQ ID NO: 4380499 - DNA, 17 bp, Homo sapiens
cccagaactttgggagg

SEQ ID NO: 4380500 - DNA, 22 bp, Homo sapiens
cccagaataagttattgcagtt

SEQ ID NO: 4380501 - DNA, 14 bp, Homo sapiens
cccagaatggagcc

SEQ ID NO: 4380502 - DNA, 17 bp, Homo sapiens
cccagaatggagcctgc

SEQ ID NO: 4380503 - DNA, 19 bp, Homo sapiens
cccagaatggagcctgctc

SEQ ID NO: 4380504 - DNA, 14 bp, Homo sapiens
cccagaattttctg

SEQ ID NO: 4380505 - DNA, 17 bp, Homo sapiens
cccagacaccatgtgca

SEQ ID NO: 4380506 - DNA, 22 bp, Homo sapiens
cccagacaggccctccctgtct

SEQ ID NO: 4380507 - DNA, 15 bp, Homo sapiens
cccagaccaatggca

SEQ ID NO: 4380508 - DNA, 14 bp, Homo sapiens
cccagacccagagg

SEQ ID NO: 4380509 - DNA, 15 bp, Homo sapiens
cccagacccagaggt

SEQ ID NO: 4380510 - DNA, 18 bp, Homo sapiens
cccagacccagaggtcca

SEQ ID NO: 4380511 - DNA, 14 bp, Homo sapiens
cccagacccagtgg

SEQ ID NO: 4380512 - DNA, 14 bp, Homo sapiens
cccagaccccgccc

SEQ ID NO: 4380513 - DNA, 21 bp, Homo sapiens
cccagaccccgcccctgggga

SEQ ID NO: 4380514 - DNA, 22 bp, Homo sapiens
cccagactaaaggatccagaga

SEQ ID NO: 4380515 - DNA, 23 bp, Homo sapiens
cccagactaaaggatccagagag

SEQ ID NO: 4380516 - DNA, 13 bp, Homo sapiens
cccagactacagg

SEQ ID NO: 4380517 - DNA, 14 bp, Homo sapiens
cccagactgatgag

SEQ ID NO: 4380518 - DNA, 14 bp, Homo sapiens
cccagagaagcccc

SEQ ID NO: 4380519 - DNA, 16 bp, Homo sapiens
cccagagacaggaaaa

SEQ ID NO: 4380520 - DNA, 15 bp, Homo sapiens
cccagagacattcat

SEQ ID NO: 4380521 - DNA, 21 bp, Homo sapiens
cccagagacggagtgtgggag

SEQ ID NO: 4380522 - DNA, 15 bp, Homo sapiens
cccagagagaccctg

SEQ ID NO: 4380523 - DNA, 16 bp, Homo sapiens
cccagagagaccctgc

SEQ ID NO: 4380524 - DNA, 18 bp, Homo sapiens
cccagagagaccctgcaa

SEQ ID NO: 4380525 - DNA, 22 bp, Homo sapiens
cccagagagaccctgcaagacc

SEQ ID NO: 4380526 - DNA, 21 bp, Homo sapiens
cccagagaggaatcagacttc

SEQ ID NO: 4380527 - DNA, 13 bp, Homo sapiens
cccagagaggcac

SEQ ID NO: 4380528 - DNA, 21 bp, Homo sapiens
cccagagatgcctccaccgct

SEQ ID NO: 4380529 - DNA, 18 bp, Homo sapiens
cccagagcaccccctgct

SEQ ID NO: 4380530 - DNA, 14 bp, Homo sapiens
cccagagcatctgc

SEQ ID NO: 4380531 - DNA, 18 bp, Homo sapiens
cccagagccacctggatc

SEQ ID NO: 4380532 - DNA, 14 bp, Homo sapiens
cccagagctggcgc

SEQ ID NO: 4380533 - DNA, 22 bp, Homo sapiens
cccagagctggcgctcagcagc

SEQ ID NO: 4380534 - DNA, 21 bp, Homo sapiens
cccagagctgtttatggcctc

SEQ ID NO: 4380535 - DNA, 22 bp, Homo sapiens
cccagagctgtttatggcctca

SEQ ID NO: 4380536 - DNA, 21 bp, Homo sapiens
cccagaggaaggggccagagg

SEQ ID NO: 4380537 - DNA, 16 bp, Homo sapiens
cccagaggattgctgc

SEQ ID NO: 4380538 - DNA, 14 bp, Homo sapiens
cccagaggctccca

SEQ ID NO: 4380539 - DNA, 23 bp, Homo sapiens
cccagaggctcccaatcagcttt

SEQ ID NO: 4380540 - DNA, 23 bp, Homo sapiens
cccagaggtctcatctcccaggc

SEQ ID NO: 4380541 - DNA, 20 bp, Homo sapiens
cccagaggtgggatcctccc

SEQ ID NO: 4380542 - DNA, 21 bp, Homo sapiens
cccagaggtgggatcctccct

SEQ ID NO: 4380543 - DNA, 13 bp, Homo sapiens
cccagagtcagag

SEQ ID NO: 4380544 - DNA, 16 bp, Homo sapiens
cccagagtgtgggaag

SEQ ID NO: 4380545 - DNA, 18 bp, Homo sapiens
cccagatctggtcccttg

SEQ ID NO: 4380546 - DNA, 19 bp, Homo sapiens
cccagatctggtcccttgc

SEQ ID NO: 4380547 - DNA, 18 bp, Homo sapiens
cccagatgcagggctgca

SEQ ID NO: 4380548 - DNA, 15 bp, Homo sapiens
cccagatgtgtcccc

SEQ ID NO: 4380549 - DNA, 16 bp, Homo sapiens
cccagcaaatgggcat

SEQ ID NO: 4380550 - DNA, 14 bp, Homo sapiens
cccagcacgagcct

SEQ ID NO: 4380551 - DNA, 14 bp, Homo sapiens
cccagcactgagga

SEQ ID NO: 4380552 - DNA, 22 bp, Homo sapiens
cccagcactttgggaggcaggg

SEQ ID NO: 4380553 - DNA, 23 bp, Homo sapiens
cccagcactttgggaggccgagg

SEQ ID NO: 4380554 - DNA, 19 bp, Homo sapiens
cccagcagaggcaggctgg

SEQ ID NO: 4380555 - DNA, 21 bp, Homo sapiens
cccagcaggagagactgagca

SEQ ID NO: 4380556 - DNA, 21 bp, Homo sapiens
cccagcagtgtggagaccctg

SEQ ID NO: 4380557 - DNA, 15 bp, Homo sapiens
cccagcatccctgga

SEQ ID NO: 4380558 - DNA, 17 bp, Homo sapiens
cccagcatccctggagc

SEQ ID NO: 4380559 - DNA, 18 bp, Homo sapiens
cccagcatccctggagca

SEQ ID NO: 4380560 - DNA, 17 bp, Homo sapiens
cccagcattccagctct

SEQ ID NO: 4380561 - DNA, 21 bp, Homo sapiens
cccagcattccagctctgccc

SEQ ID NO: 4380562 - DNA, 14 bp, Homo sapiens
cccagccaccccgg

SEQ ID NO: 4380563 - DNA, 12 bp, Homo sapiens
cccagccagccc

SEQ ID NO: 4380564 - DNA, 16 bp, Homo sapiens
cccagccagcccttcc

SEQ ID NO: 4380565 - DNA, 14 bp, Homo sapiens
cccagccaggccaa

SEQ ID NO: 4380566 - DNA, 22 bp, Homo sapiens
cccagccaggccaacagcacct

SEQ ID NO: 4380567 - DNA, 15 bp, Homo sapiens
cccagcccaagcacg

SEQ ID NO: 4380568 - DNA, 12 bp, Homo sapiens
cccagcccacag

SEQ ID NO: 4380569 - DNA, 16 bp, Homo sapiens
cccagcccacagagcc

SEQ ID NO: 4380570 - DNA, 17 bp, Homo sapiens
cccagcccacagagcct

SEQ ID NO: 4380571 - DNA, 12 bp, Homo sapiens
cccagcccaccc

SEQ ID NO: 4380572 - DNA, 14 bp, Homo sapiens
cccagcccaccctc

SEQ ID NO: 4380573 - DNA, 16 bp, Homo sapiens
cccagcccaccctcct

SEQ ID NO: 4380574 - DNA, 10 bp, Homo sapiens
cccagcccag

SEQ ID NO: 4380575 - DNA, 14 bp, Homo sapiens
cccagcccagacaa

SEQ ID NO: 4380576 - DNA, 13 bp, Homo sapiens
cccagcccagagc

SEQ ID NO: 4380577 - DNA, 14 bp, Homo sapiens
cccagcccagagcc

SEQ ID NO: 4380578 - DNA, 18 bp, Homo sapiens
cccagcccatctgaacac

SEQ ID NO: 4380579 - DNA, 22 bp, Homo sapiens
cccagcccattctctctcctgt

SEQ ID NO: 4380580 - DNA, 15 bp, Homo sapiens
cccagccccagcccc

SEQ ID NO: 4380581 - DNA, 16 bp, Homo sapiens
cccagcccccacagtg

SEQ ID NO: 4380582 - DNA, 17 bp, Homo sapiens
cccagcccccacagtgc

SEQ ID NO: 4380583 - DNA, 16 bp, Homo sapiens
cccagccccctttggg

SEQ ID NO: 4380584 - DNA, 21 bp, Homo sapiens
cccagccccctttgggcccag

SEQ ID NO: 4380585 - DNA, 22 bp, Homo sapiens
cccagccccctttgggcccagg

SEQ ID NO: 4380586 - DNA, 16 bp, Homo sapiens
cccagccccgactcca

SEQ ID NO: 4380587 - DNA, 19 bp, Homo sapiens
cccagccccgactccagcc

SEQ ID NO: 4380588 - DNA, 21 bp, Homo sapiens
cccagccccgactccagccag

SEQ ID NO: 4380589 - DNA, 22 bp, Homo sapiens
cccagccccgactccagccagc

SEQ ID NO: 4380590 - DNA, 23 bp, Homo sapiens
cccagccccgactccagccagcg

SEQ ID NO: 4380591 - DNA, 18 bp, Homo sapiens
cccagcccctcctccctc

SEQ ID NO: 4380592 - DNA, 20 bp, Homo sapiens
cccagcccctcctccctcag

SEQ ID NO: 4380593 - DNA, 22 bp, Homo sapiens
cccagcccctcctccctcagac

SEQ ID NO: 4380594 - DNA, 23 bp, Homo sapiens
cccagcccctcctccctcagacc

SEQ ID NO: 4380595 - DNA, 22 bp, Homo sapiens
cccagcccctcctccctcaggc

SEQ ID NO: 4380596 - DNA, 15 bp, Homo sapiens
cccagcccctgcaga

SEQ ID NO: 4380597 - DNA, 10 bp, Homo sapiens
cccagccctg

SEQ ID NO: 4380598 - DNA, 13 bp, Homo sapiens
cccagccctggcc

SEQ ID NO: 4380599 - DNA, 20 bp, Homo sapiens
cccagccctggcccaggtgc

SEQ ID NO: 4380600 - DNA, 14 bp, Homo sapiens
cccagccgggcaca

SEQ ID NO: 4380601 - DNA, 18 bp, Homo sapiens
cccagcctacctctccac

SEQ ID NO: 4380602 - DNA, 23 bp, Homo sapiens
cccagcctctccccgctctggat

SEQ ID NO: 4380603 - DNA, 17 bp, Homo sapiens
cccagcctgctctccct

SEQ ID NO: 4380604 - DNA, 14 bp, Homo sapiens
cccagcctggatgc

SEQ ID NO: 4380605 - DNA, 18 bp, Homo sapiens
cccagcctggatgccatc

SEQ ID NO: 4380606 - DNA, 19 bp, Homo sapiens
cccagcctggatgccatcc

SEQ ID NO: 4380607 - DNA, 18 bp, Homo sapiens
cccagcctgggagcccag

SEQ ID NO: 4380608 - DNA, 13 bp, Homo sapiens
cccagcctgggcc

SEQ ID NO: 4380609 - DNA, 14 bp, Homo sapiens
cccagcctgggcca

SEQ ID NO: 4380610 - DNA, 15 bp, Homo sapiens
cccagccttagatgc

SEQ ID NO: 4380611 - DNA, 15 bp, Homo sapiens
cccagccttgcccag

SEQ ID NO: 4380612 - DNA, 17 bp, Homo sapiens
cccagccttgcccagct

SEQ ID NO: 4380613 - DNA, 18 bp, Homo sapiens
cccagccttgcccagctt

SEQ ID NO: 4380614 - DNA, 19 bp, Homo sapiens
cccagcggccccccgcaca

SEQ ID NO: 4380615 - DNA, 21 bp, Homo sapiens
cccagcgggctggcgggcctt

SEQ ID NO: 4380616 - DNA, 22 bp, Homo sapiens
cccagcgggctggcgggccttt

SEQ ID NO: 4380617 - DNA, 15 bp, Homo sapiens
cccagcgtggcctcc

SEQ ID NO: 4380618 - DNA, 14 bp, Homo sapiens
cccagctaattttt

SEQ ID NO: 4380619 - DNA, 21 bp, Homo sapiens
cccagctaatttttgtatttt

SEQ ID NO: 4380620 - DNA, 18 bp, Homo sapiens
cccagctaccaagtcaga

SEQ ID NO: 4380621 - DNA, 14 bp, Homo sapiens
cccagctactcagg

SEQ ID NO: 4380622 - DNA, 22 bp, Homo sapiens
cccagctactcaggaggctgag

SEQ ID NO: 4380623 - DNA, 13 bp, Homo sapiens
cccagctaggaag

SEQ ID NO: 4380624 - DNA, 21 bp, Homo sapiens
cccagctatggttctctcgca

SEQ ID NO: 4380625 - DNA, 15 bp, Homo sapiens
cccagctcccctctt

SEQ ID NO: 4380626 - DNA, 22 bp, Homo sapiens
cccagctcctttctcctgtgaa

SEQ ID NO: 4380627 - DNA, 13 bp, Homo sapiens
cccagctctccct

SEQ ID NO: 4380628 - DNA, 19 bp, Homo sapiens
cccagctctccctctggcc

SEQ ID NO: 4380629 - DNA, 16 bp, Homo sapiens
cccagctgctcccctg

SEQ ID NO: 4380630 - DNA, 17 bp, Homo sapiens
cccagctgctcccctgg

SEQ ID NO: 4380631 - DNA, 19 bp, Homo sapiens
cccagctggtgggaagcgt

SEQ ID NO: 4380632 - DNA, 22 bp, Homo sapiens
cccagctggtgggaagcgtctg

SEQ ID NO: 4380633 - DNA, 20 bp, Homo sapiens
cccagctgtgggcggctcct

SEQ ID NO: 4380634 - DNA, 11 bp, Homo sapiens
cccagctgttt

SEQ ID NO: 4380635 - DNA, 20 bp, Homo sapiens
cccagctttgaggaaaatgg

SEQ ID NO: 4380636 - DNA, 19 bp, Homo sapiens
cccaggaaaggcaggattg

SEQ ID NO: 4380637 - DNA, 23 bp, Homo sapiens
cccaggacgccactcatttcatc

SEQ ID NO: 4380638 - DNA, 12 bp, Homo sapiens
cccaggactggg

SEQ ID NO: 4380639 - DNA, 15 bp, Homo sapiens
cccaggactgggcca

SEQ ID NO: 4380640 - DNA, 14 bp, Homo sapiens
cccaggaggcagct

SEQ ID NO: 4380641 - DNA, 15 bp, Homo sapiens
cccaggagtccagcc

SEQ ID NO: 4380642 - DNA, 22 bp, Homo sapiens
cccaggagtggaggaggcctgg

SEQ ID NO: 4380643 - DNA, 21 bp, Homo sapiens
cccaggcattgccaagggctt

SEQ ID NO: 4380644 - DNA, 12 bp, Homo sapiens
cccaggccacag

SEQ ID NO: 4380645 - DNA, 14 bp, Homo sapiens
cccaggccacagag

SEQ ID NO: 4380646 - DNA, 23 bp, Homo sapiens
cccaggccacagccagggctcca

SEQ ID NO: 4380647 - DNA, 12 bp, Homo sapiens
cccaggccagct

SEQ ID NO: 4380648 - DNA, 24 bp, Homo sapiens
cccaggccagctgcggccaggcct

SEQ ID NO: 4380649 - DNA, 14 bp, Homo sapiens
cccaggccaggtgc

SEQ ID NO: 4380650 - DNA, 15 bp, Homo sapiens
cccaggccaggtgcc

SEQ ID NO: 4380651 - DNA, 17 bp, Homo sapiens
cccaggccaggtgccca

SEQ ID NO: 4380652 - DNA, 19 bp, Homo sapiens
cccaggccaggtgcccagg

SEQ ID NO: 4380653 - DNA, 16 bp, Homo sapiens
cccaggcccctggagg

SEQ ID NO: 4380654 - DNA, 17 bp, Homo sapiens
cccaggcccgagcgcct

SEQ ID NO: 4380655 - DNA, 14 bp, Homo sapiens
cccaggccctccct

SEQ ID NO: 4380656 - DNA, 15 bp, Homo sapiens
cccaggccctccctg

SEQ ID NO: 4380657 - DNA, 14 bp, Homo sapiens
cccaggccggccca

SEQ ID NO: 4380658 - DNA, 16 bp, Homo sapiens
cccaggccggcccaga

SEQ ID NO: 4380659 - DNA, 22 bp, Homo sapiens
cccaggcgctgcatacagggga

SEQ ID NO: 4380660 - DNA, 17 bp, Homo sapiens
cccaggctggactgcag

SEQ ID NO: 4380661 - DNA, 22 bp, Homo sapiens
cccaggctggactgcagtggcc

SEQ ID NO: 4380662 - DNA, 14 bp, Homo sapiens
cccaggctggagac

SEQ ID NO: 4380663 - DNA, 12 bp, Homo sapiens
cccaggctggga

SEQ ID NO: 4380664 - DNA, 13 bp, Homo sapiens
cccaggctgggaa

SEQ ID NO: 4380665 - DNA, 20 bp, Homo sapiens
cccagggaagcctgggtgtc

SEQ ID NO: 4380666 - DNA, 18 bp, Homo sapiens
cccagggacaccagccag

SEQ ID NO: 4380667 - DNA, 21 bp, Homo sapiens
cccagggacaccagccaggct

SEQ ID NO: 4380668 - DNA, 11 bp, Homo sapiens
cccagggacct

SEQ ID NO: 4380669 - DNA, 14 bp, Homo sapiens
cccagggagtccag

SEQ ID NO: 4380670 - DNA, 14 bp, Homo sapiens
cccagggcacccag

SEQ ID NO: 4380671 - DNA, 15 bp, Homo sapiens
cccagggcacccagg

SEQ ID NO: 4380672 - DNA, 18 bp, Homo sapiens
cccagggcacccaggcag

SEQ ID NO: 4380673 - DNA, 16 bp, Homo sapiens
cccagggcatctggga

SEQ ID NO: 4380674 - DNA, 14 bp, Homo sapiens
cccagggcctgact

SEQ ID NO: 4380675 - DNA, 17 bp, Homo sapiens
cccaggggaaggccctg

SEQ ID NO: 4380676 - DNA, 19 bp, Homo sapiens
cccaggggaaggccctgag

SEQ ID NO: 4380677 - DNA, 22 bp, Homo sapiens
cccaggggagagggtctggaga

SEQ ID NO: 4380678 - DNA, 16 bp, Homo sapiens
cccaggggcagccaca

SEQ ID NO: 4380679 - DNA, 20 bp, Homo sapiens
cccaggggtccaggccccca

SEQ ID NO: 4380680 - DNA, 19 bp, Homo sapiens
cccaggggtcccagccacc

SEQ ID NO: 4380681 - DNA, 20 bp, Homo sapiens
cccaggggtcccagccaccc

SEQ ID NO: 4380682 - DNA, 14 bp, Homo sapiens
cccaggggtctccc

SEQ ID NO: 4380683 - DNA, 16 bp, Homo sapiens
cccaggggtctccctg

SEQ ID NO: 4380684 - DNA, 16 bp, Homo sapiens
cccagggtagcccgcc

SEQ ID NO: 4380685 - DNA, 21 bp, Homo sapiens
cccagggtagcccgcctgcca

SEQ ID NO: 4380686 - DNA, 23 bp, Homo sapiens
cccagggtagcccgcctgccagt

SEQ ID NO: 4380687 - DNA, 20 bp, Homo sapiens
cccagggtcataagtgggga

SEQ ID NO: 4380688 - DNA, 14 bp, Homo sapiens
cccagggtggccac

SEQ ID NO: 4380689 - DNA, 15 bp, Homo sapiens
cccagggtggccaca

SEQ ID NO: 4380690 - DNA, 16 bp, Homo sapiens
cccaggtacacctccc

SEQ ID NO: 4380691 - DNA, 16 bp, Homo sapiens
cccaggtaccagctgc

SEQ ID NO: 4380692 - DNA, 19 bp, Homo sapiens
cccaggtaccagctgcgct

SEQ ID NO: 4380693 - DNA, 13 bp, Homo sapiens
cccaggtccttcc

SEQ ID NO: 4380694 - DNA, 23 bp, Homo sapiens
cccaggtgacacgcttctgagca

SEQ ID NO: 4380695 - DNA, 15 bp, Homo sapiens
cccaggtggcctgga

SEQ ID NO: 4380696 - DNA, 16 bp, Homo sapiens
cccaggtggctgaccc

SEQ ID NO: 4380697 - DNA, 22 bp, Homo sapiens
cccaggtggctgacccagtccc

SEQ ID NO: 4380698 - DNA, 17 bp, Homo sapiens
ccgttactctccaacct

SEQ ID NO: 4380699 - DNA, 14 bp, Homo sapiens
ccgttcacatgtgt

SEQ ID NO: 4380700 - DNA, 14 bp, Homo sapiens
ccgttttgtcactt

SEQ ID NO: 4380701 - DNA, 23 bp, Homo sapiens
cctaaaagttcataacagtgcca

SEQ ID NO: 4380702 - DNA, 14 bp, Homo sapiens
cctaaactttagac

SEQ ID NO: 4380703 - DNA, 20 bp, Homo sapiens
cctaaagaggaaaagtgcaa

SEQ ID NO: 4380704 - DNA, 20 bp, Homo sapiens
cctaaagtacagcctggacc

SEQ ID NO: 4380705 - DNA, 21 bp, Homo sapiens
cctaaagtacagcctggacca

SEQ ID NO: 4380706 - DNA, 23 bp, Homo sapiens
cctaaataaacacatagattcac

SEQ ID NO: 4380707 - DNA, 21 bp, Homo sapiens
cctaaatccactctgcaggaa

SEQ ID NO: 4380708 - DNA, 23 bp, Homo sapiens
cctaacatggtttaaaagaaaaa

SEQ ID NO: 4380709 - DNA, 12 bp, Homo sapiens
cctaaccccttt

SEQ ID NO: 4380710 - DNA, 18 bp, Homo sapiens
cctaacctcgggcctgct

SEQ ID NO: 4380711 - DNA, 20 bp, Homo sapiens
cctaacgaagtatccttcag

SEQ ID NO: 4380712 - DNA, 21 bp, Homo sapiens
cctaagatgaagctgagcttt

SEQ ID NO: 4380713 - DNA, 14 bp, Homo sapiens
cctaagcacttcta

SEQ ID NO: 4380714 - DNA, 16 bp, Homo sapiens
cctaagcacttctaga

SEQ ID NO: 4380715 - DNA, 13 bp, Homo sapiens
cctaaggaacctt

SEQ ID NO: 4380716 - DNA, 16 bp, Homo sapiens
cctaaggaaccttcct

SEQ ID NO: 4380717 - DNA, 18 bp, Homo sapiens
cctaagggatcctgcctg

SEQ ID NO: 4380718 - DNA, 15 bp, Homo sapiens
cctaaggttcttgct

SEQ ID NO: 4380719 - DNA, 13 bp, Homo sapiens
cctaataaagaga

SEQ ID NO: 4380720 - DNA, 14 bp, Homo sapiens
cctaatcatacacc

SEQ ID NO: 4380721 - DNA, 19 bp, Homo sapiens
cctaatggctatttttgaa

SEQ ID NO: 4380722 - DNA, 13 bp, Homo sapiens
cctaatgtgttta

SEQ ID NO: 4380723 - DNA, 20 bp, Homo sapiens
cctaattcaattcaaagctg

SEQ ID NO: 4380724 - DNA, 14 bp, Homo sapiens
cctaatttatgtgc

SEQ ID NO: 4380725 - DNA, 14 bp, Homo sapiens
cctaatttctcctc

SEQ ID NO: 4380726 - DNA, 16 bp, Homo sapiens
cctaatttctcctccc

SEQ ID NO: 4380727 - DNA, 14 bp, Homo sapiens
cctacaaggcctat

SEQ ID NO: 4380728 - DNA, 14 bp, Homo sapiens
cctacacctccctc

SEQ ID NO: 4380729 - DNA, 18 bp, Homo sapiens
cctacagcactactgggt

SEQ ID NO: 4380730 - DNA, 19 bp, Homo sapiens
cctacagcactactgggtg

SEQ ID NO: 4380731 - DNA, 22 bp, Homo sapiens
cctacagtatataagctttttt

SEQ ID NO: 4380732 - DNA, 17 bp, Homo sapiens
cctacagttttaactgt

SEQ ID NO: 4380733 - DNA, 20 bp, Homo sapiens
cctacagttttaactgtgga

SEQ ID NO: 4380734 - DNA, 21 bp, Homo sapiens
cctacagttttaactgtggat

SEQ ID NO: 4380735 - DNA, 15 bp, Homo sapiens
cctaccagaaggaaa

SEQ ID NO: 4380736 - DNA, 18 bp, Homo sapiens
cctaccaggacagaactt

SEQ ID NO: 4380737 - DNA, 17 bp, Homo sapiens
cctacccacacctctgc

SEQ ID NO: 4380738 - DNA, 20 bp, Homo sapiens
cctacccacacctctgccag

SEQ ID NO: 4380739 - DNA, 14 bp, Homo sapiens
cctaccccagttcc

SEQ ID NO: 4380740 - DNA, 15 bp, Homo sapiens
cctaccctaaccaag

SEQ ID NO: 4380741 - DNA, 18 bp, Homo sapiens
cctaccctaaccaagttc

SEQ ID NO: 4380742 - DNA, 15 bp, Homo sapiens
cctaccctgcctccc

SEQ ID NO: 4380743 - DNA, 14 bp, Homo sapiens
cctacctctccaca

SEQ ID NO: 4380744 - DNA, 13 bp, Homo sapiens
cctaccttgcttt

SEQ ID NO: 4380745 - DNA, 19 bp, Homo sapiens
cctacgaaatatgaagagc

SEQ ID NO: 4380746 - DNA, 22 bp, Homo sapiens
cctacgagggaggaacacctga

SEQ ID NO: 4380747 - DNA, 13 bp, Homo sapiens
cctacgtccaagg

SEQ ID NO: 4380748 - DNA, 14 bp, Homo sapiens
cctactttgacttt

SEQ ID NO: 4380749 - DNA, 22 bp, Homo sapiens
cctagaagaaccaaatacctca

SEQ ID NO: 4380750 - DNA, 21 bp, Homo sapiens
cctagaagagtgtgaaaagga

SEQ ID NO: 4380751 - DNA, 20 bp, Homo sapiens
cctagagaacgcagccctag

SEQ ID NO: 4380752 - DNA, 17 bp, Homo sapiens
cctagagaagacaggct

SEQ ID NO: 4380753 - DNA, 14 bp, Homo sapiens
cctagagcctgcct

SEQ ID NO: 4380754 - DNA, 22 bp, Homo sapiens
cctagaggctccagctctggca

SEQ ID NO: 4380755 - DNA, 19 bp, Homo sapiens
cctagaggggcaccttttc

SEQ ID NO: 4380756 - DNA, 16 bp, Homo sapiens
cctagatatgaatata

SEQ ID NO: 4380757 - DNA, 12 bp, Homo sapiens
cctagatccaga

SEQ ID NO: 4380758 - DNA, 16 bp, Homo sapiens
cctagatgcacgtggg

SEQ ID NO: 4380759 - DNA, 20 bp, Homo sapiens
cctagatgcacgtggggccc

SEQ ID NO: 4380760 - DNA, 21 bp, Homo sapiens
cctagatgcacgtggggccca

SEQ ID NO: 4380761 - DNA, 20 bp, Homo sapiens
cctagattacatctgcctta

SEQ ID NO: 4380762 - DNA, 17 bp, Homo sapiens
cctagcaatacagggag

SEQ ID NO: 4380763 - DNA, 16 bp, Homo sapiens
cctagcaccctggaga

SEQ ID NO: 4380764 - DNA, 14 bp, Homo sapiens
cctagcactgcccc

SEQ ID NO: 4380765 - DNA, 20 bp, Homo sapiens
cctagcactgccccacatgc

SEQ ID NO: 4380766 - DNA, 21 bp, Homo sapiens
cctagcactgccccacatgca

SEQ ID NO: 4380767 - DNA, 17 bp, Homo sapiens
cctagcaggctgttcca

SEQ ID NO: 4380768 - DNA, 15 bp, Homo sapiens
cctagcccagtgctt

SEQ ID NO: 4380769 - DNA, 17 bp, Homo sapiens
cctagcccagtgcttct

SEQ ID NO: 4380770 - DNA, 15 bp, Homo sapiens
cctagcccttccctg

SEQ ID NO: 4380771 - DNA, 19 bp, Homo sapiens
cctagcgatctctcctggc

SEQ ID NO: 4380772 - DNA, 16 bp, Homo sapiens
cctagcggagcccagc

SEQ ID NO: 4380773 - DNA, 22 bp, Homo sapiens
cctagctgcacagggcagctgg

SEQ ID NO: 4380774 - DNA, 23 bp, Homo sapiens
cctagctgcacagggcagctggg

SEQ ID NO: 4380775 - DNA, 14 bp, Homo sapiens
cctagctggctctg

SEQ ID NO: 4380776 - DNA, 15 bp, Homo sapiens
cctagctggctctgt

SEQ ID NO: 4380777 - DNA, 17 bp, Homo sapiens
cctagctggctctgtga

SEQ ID NO: 4380778 - DNA, 18 bp, Homo sapiens
cctagctttagaccctgg

SEQ ID NO: 4380779 - DNA, 15 bp, Homo sapiens
cctaggccactcctc

SEQ ID NO: 4380780 - DNA, 17 bp, Homo sapiens
cctaggccactcctcca

SEQ ID NO: 4380781 - DNA, 19 bp, Homo sapiens
cctaggccactcctccaaa

SEQ ID NO: 4380782 - DNA, 19 bp, Homo sapiens
cctaggctggaaataggat

SEQ ID NO: 4380783 - DNA, 17 bp, Homo sapiens
cctaggggaagagcaga

SEQ ID NO: 4380784 - DNA, 15 bp, Homo sapiens
cctagtaagtgcctt

SEQ ID NO: 4380785 - DNA, 18 bp, Homo sapiens
cctagtaagtgccttcca

SEQ ID NO: 4380786 - DNA, 18 bp, Homo sapiens
cctagtgaaggcttctct

SEQ ID NO: 4380787 - DNA, 23 bp, Homo sapiens
cctagtgaaggcttctctctgtg

SEQ ID NO: 4380788 - DNA, 18 bp, Homo sapiens
cctagtgcaaaaactgta

SEQ ID NO: 4380789 - DNA, 19 bp, Homo sapiens
cctagtggggtctccctct

SEQ ID NO: 4380790 - DNA, 24 bp, Homo sapiens
cctagtggggtctccctctcctgc

SEQ ID NO: 4380791 - DNA, 19 bp, Homo sapiens
cctagttaaagaaaggaaa

SEQ ID NO: 4380792 - DNA, 18 bp, Homo sapiens
cctagttagcatccaggc

SEQ ID NO: 4380793 - DNA, 13 bp, Homo sapiens
cctagttttccat

SEQ ID NO: 4380794 - DNA, 15 bp, Homo sapiens
cctagttttccatgc

SEQ ID NO: 4380795 - DNA, 16 bp, Homo sapiens
cctagttttctttcct

SEQ ID NO: 4380796 - DNA, 20 bp, Homo sapiens
cctagttttctttcctcctt

SEQ ID NO: 4380797 - DNA, 18 bp, Homo sapiens
cctataatccttgataat

SEQ ID NO: 4380798 - DNA, 18 bp, Homo sapiens
cctatagcactgagctca

SEQ ID NO: 4380799 - DNA, 16 bp, Homo sapiens
cctatcacctatttcc

SEQ ID NO: 4380800 - DNA, 17 bp, Homo sapiens
cctatcacctatttcca

SEQ ID NO: 4380801 - DNA, 20 bp, Homo sapiens
cctatcagagttgctgcaaa

SEQ ID NO: 4380802 - DNA, 14 bp, Homo sapiens
cctatcatgttaac

SEQ ID NO: 4380803 - DNA, 12 bp, Homo sapiens
cctatccaccca

SEQ ID NO: 4380804 - DNA, 13 bp, Homo sapiens
cctatccacccag

SEQ ID NO: 4380805 - DNA, 16 bp, Homo sapiens
cctatccacccagccc

SEQ ID NO: 4380806 - DNA, 18 bp, Homo sapiens
cctatccgctgccagcct

SEQ ID NO: 4380807 - DNA, 17 bp, Homo sapiens
cctatccttccagtggc

SEQ ID NO: 4380808 - DNA, 18 bp, Homo sapiens
cctatgagatggccatgc

SEQ ID NO: 4380809 - DNA, 20 bp, Homo sapiens
cctatgagatggccatgctc

SEQ ID NO: 4380810 - DNA, 22 bp, Homo sapiens
cctatgcactgaagagctcttg

SEQ ID NO: 4380811 - DNA, 17 bp, Homo sapiens
cctattatctgtcagct

SEQ ID NO: 4380812 - DNA, 22 bp, Homo sapiens
cctattgtgactcttctaaaaa

SEQ ID NO: 4380813 - DNA, 12 bp, Homo sapiens
cctatttaatac

SEQ ID NO: 4380814 - DNA, 17 bp, Homo sapiens
cctatttctatgtcatt

SEQ ID NO: 4380815 - DNA, 18 bp, Homo sapiens
cctatttctatgtcattt

SEQ ID NO: 4380816 - DNA, 17 bp, Homo sapiens
cctccaagcatttcatg

SEQ ID NO: 4380817 - DNA, 18 bp, Homo sapiens
cctccaagcatttcatga

SEQ ID NO: 4380818 - DNA, 18 bp, Homo sapiens
cctccaataaagtgcctt

SEQ ID NO: 4380819 - DNA, 21 bp, Homo sapiens
cctccacactgaccaagtgct

SEQ ID NO: 4380820 - DNA, 14 bp, Homo sapiens
cctccacatcctcc

SEQ ID NO: 4380821 - DNA, 16 bp, Homo sapiens
cctccacatcctccac

SEQ ID NO: 4380822 - DNA, 20 bp, Homo sapiens
cctccacatcctccacgttc

SEQ ID NO: 4380823 - DNA, 18 bp, Homo sapiens
cctccaccaaaccccact

SEQ ID NO: 4380824 - DNA, 14 bp, Homo sapiens
cctccaccccagga

SEQ ID NO: 4380825 - DNA, 14 bp, Homo sapiens
cctccaccctctga

SEQ ID NO: 4380826 - DNA, 15 bp, Homo sapiens
cctccaccctctgag

SEQ ID NO: 4380827 - DNA, 13 bp, Homo sapiens
cctccaccgctgc

SEQ ID NO: 4380828 - DNA, 14 bp, Homo sapiens
cctccacgcctcct

SEQ ID NO: 4380829 - DNA, 17 bp, Homo sapiens
cctccacgcctcctggc

SEQ ID NO: 4380830 - DNA, 20 bp, Homo sapiens
cctccacgcctcctggccag

SEQ ID NO: 4380831 - DNA, 21 bp, Homo sapiens
cctccacgcctcctggccaga

SEQ ID NO: 4380832 - DNA, 17 bp, Homo sapiens
cctccacgttctgctca

SEQ ID NO: 4380833 - DNA, 15 bp, Homo sapiens
cctccactccttcca

SEQ ID NO: 4380834 - DNA, 17 bp, Homo sapiens
cctccactctcccccac

SEQ ID NO: 4380835 - DNA, 12 bp, Homo sapiens
cctccactgctg

SEQ ID NO: 4380836 - DNA, 15 bp, Homo sapiens
cctccactgctgggg

SEQ ID NO: 4380837 - DNA, 21 bp, Homo sapiens
cctccactggggaatgctccc

SEQ ID NO: 4380838 - DNA, 12 bp, Homo sapiens
cctccagaagcc

SEQ ID NO: 4380839 - DNA, 13 bp, Homo sapiens
cctccagaagcct

SEQ ID NO: 4380840 - DNA, 18 bp, Homo sapiens
cctccagaagcctctggc

SEQ ID NO: 4380841 - DNA, 19 bp, Homo sapiens
cctccagaagcctctggct

SEQ ID NO: 4380842 - DNA, 12 bp, Homo sapiens
cctccagcagac

SEQ ID NO: 4380843 - DNA, 11 bp, Homo sapiens
cctccagcctc

SEQ ID NO: 4380844 - DNA, 12 bp, Homo sapiens
cctccagcctcc

SEQ ID NO: 4380845 - DNA, 13 bp, Homo sapiens
cctccagcctccc

SEQ ID NO: 4380846 - DNA, 14 bp, Homo sapiens
cctccagcctcccc

SEQ ID NO: 4380847 - DNA, 13 bp, Homo sapiens
cctccagcctctg

SEQ ID NO: 4380848 - DNA, 15 bp, Homo sapiens
cctccagcctctgtt

SEQ ID NO: 4380849 - DNA, 22 bp, Homo sapiens
cctccagcttgtggagccccac

SEQ ID NO: 4380850 - DNA, 19 bp, Homo sapiens
cctccaggcctgcctccca

SEQ ID NO: 4380851 - DNA, 12 bp, Homo sapiens
cctccagggcca

SEQ ID NO: 4380852 - DNA, 17 bp, Homo sapiens
cctccagggccacgtgc

SEQ ID NO: 4380853 - DNA, 18 bp, Homo sapiens
cctccagggccacgtgcc

SEQ ID NO: 4380854 - DNA, 19 bp, Homo sapiens
cctccagggccacgtgcca

SEQ ID NO: 4380855 - DNA, 13 bp, Homo sapiens
cctccagggctgg

SEQ ID NO: 4380856 - DNA, 21 bp, Homo sapiens
cctccagggctggactgaggc

SEQ ID NO: 4380857 - DNA, 23 bp, Homo sapiens
cctccagggctggactgaggcct

SEQ ID NO: 4380858 - DNA, 12 bp, Homo sapiens
cctccagggtcc

SEQ ID NO: 4380859 - DNA, 13 bp, Homo sapiens
cctccagggtcct

SEQ ID NO: 4380860 - DNA, 17 bp, Homo sapiens
cctccatcctaccccct

SEQ ID NO: 4380861 - DNA, 18 bp, Homo sapiens
cctccatgctcctcacct

SEQ ID NO: 4380862 - DNA, 22 bp, Homo sapiens
cctccatgctcctcacctgtct

SEQ ID NO: 4380863 - DNA, 11 bp, Homo sapiens
cctccatggga

SEQ ID NO: 4380864 - DNA, 18 bp, Homo sapiens
cctccattgggcacagtc

SEQ ID NO: 4380865 - DNA, 21 bp, Homo sapiens
cctccattgggcacagtccag

SEQ ID NO: 4380866 - DNA, 21 bp, Homo sapiens
cctcccaagcgttcctggcct

SEQ ID NO: 4380867 - DNA, 21 bp, Homo sapiens
cctcccaaggagaacaaatat

SEQ ID NO: 4380868 - DNA, 20 bp, Homo sapiens
cctcccaaggtcctctcagt

SEQ ID NO: 4380869 - DNA, 15 bp, Homo sapiens
cctcccaagtcccac

SEQ ID NO: 4380870 - DNA, 15 bp, Homo sapiens
cctcccaccagagcc

SEQ ID NO: 4380871 - DNA, 20 bp, Homo sapiens
cctcccacccccttctctgc

SEQ ID NO: 4380872 - DNA, 21 bp, Homo sapiens
cctcccacccccttctctgct

SEQ ID NO: 4380873 - DNA, 11 bp, Homo sapiens
cctcccacctc

SEQ ID NO: 4380874 - DNA, 19 bp, Homo sapiens
cctcccacctcagcctcct

SEQ ID NO: 4380875 - DNA, 17 bp, Homo sapiens
cctcccagacaggccct

SEQ ID NO: 4380876 - DNA, 23 bp, Homo sapiens
cctcccagacaggccctccctgt

SEQ ID NO: 4380877 - DNA, 23 bp, Homo sapiens
cctcccagaggagccaccagttc

SEQ ID NO: 4380878 - DNA, 13 bp, Homo sapiens
cctcccattctgc

SEQ ID NO: 4380879 - DNA, 23 bp, Homo sapiens
cctcccattctgcaccacacctg

SEQ ID NO: 4380880 - DNA, 16 bp, Homo sapiens
cctcccattgcccagt

SEQ ID NO: 4380881 - DNA, 23 bp, Homo sapiens
cctcccattgcccagtgagccct

SEQ ID NO: 4380882 - DNA, 13 bp, Homo sapiens
cctccccaactcc

SEQ ID NO: 4380883 - DNA, 13 bp, Homo sapiens
cctccccagaatc

SEQ ID NO: 4380884 - DNA, 14 bp, Homo sapiens
cctccccagactct

SEQ ID NO: 4380885 - DNA, 13 bp, Homo sapiens
cctccccagagct

SEQ ID NO: 4380886 - DNA, 15 bp, Homo sapiens
cctccccagagctgg

SEQ ID NO: 4380887 - DNA, 14 bp, Homo sapiens
cctccccagccagc

SEQ ID NO: 4380888 - DNA, 17 bp, Homo sapiens
cctccccagccagccct

SEQ ID NO: 4380889 - DNA, 23 bp, Homo sapiens
cctccccagccagcccttccctg

SEQ ID NO: 4380890 - DNA, 12 bp, Homo sapiens
cctccccagggg

SEQ ID NO: 4380891 - DNA, 21 bp, Homo sapiens
cctccccatctgtccagctgg

SEQ ID NO: 4380892 - DNA, 14 bp, Homo sapiens
cctccccatttccc

SEQ ID NO: 4380893 - DNA, 15 bp, Homo sapiens
cctccccatttccca

SEQ ID NO: 4380894 - DNA, 22 bp, Homo sapiens
cctccccatttcccatctgcac

SEQ ID NO: 4380895 - DNA, 23 bp, Homo sapiens
cctccccatttcccatctgcacc

SEQ ID NO: 4380896 - DNA, 22 bp, Homo sapiens
cctcccccaacccccaccccac

SEQ ID NO: 4380897 - DNA, 20 bp, Homo sapiens
cctcccccactttcaagaca

SEQ ID NO: 4380898 - DNA, 13 bp, Homo sapiens
cctccccccactg

SEQ ID NO: 4380899 - DNA, 20 bp, Homo sapiens
cctccccccactgcaggccc

SEQ ID NO: 4380900 - DNA, 14 bp, Homo sapiens
cctccccccagacc

SEQ ID NO: 4380901 - DNA, 19 bp, Homo sapiens
cctccccccagaccccgcc

SEQ ID NO: 4380902 - DNA, 22 bp, Homo sapiens
cctccccccagaccccgcccct

SEQ ID NO: 4380903 - DNA, 12 bp, Homo sapiens
cctccccctgag

SEQ ID NO: 4380904 - DNA, 12 bp, Homo sapiens
cctccccctgca

SEQ ID NO: 4380905 - DNA, 13 bp, Homo sapiens
cctccccctgcaa

SEQ ID NO: 4380906 - DNA, 14 bp, Homo sapiens
cctccccctgccag

SEQ ID NO: 4380907 - DNA, 16 bp, Homo sapiens
cctccccctgccagga

SEQ ID NO: 4380908 - DNA, 16 bp, Homo sapiens
cctccccgcccttttt

SEQ ID NO: 4380909 - DNA, 15 bp, Homo sapiens
cctccccgctgggaa

SEQ ID NO: 4380910 - DNA, 13 bp, Homo sapiens
cctcccctatcca

SEQ ID NO: 4380911 - DNA, 15 bp, Homo sapiens
cctcccctatccacc

SEQ ID NO: 4380912 - DNA, 14 bp, Homo sapiens
cctcccctcctctt

SEQ ID NO: 4380913 - DNA, 13 bp, Homo sapiens
cctcccctgcaga

SEQ ID NO: 4380914 - DNA, 15 bp, Homo sapiens
cctcccctgccctgg

SEQ ID NO: 4380915 - DNA, 16 bp, Homo sapiens
cctcccctgccctggt

SEQ ID NO: 4380916 - DNA, 13 bp, Homo sapiens
cctccccttcctg

SEQ ID NO: 4380917 - DNA, 15 bp, Homo sapiens
cctcccgaaaaatgt

SEQ ID NO: 4380918 - DNA, 20 bp, Homo sapiens
cctcccgaaaaatgtgtggt

SEQ ID NO: 4380919 - DNA, 22 bp, Homo sapiens
cctcccgccactcgccttctta

SEQ ID NO: 4380920 - DNA, 18 bp, Homo sapiens
cctcccgccccttcccac

SEQ ID NO: 4380921 - DNA, 18 bp, Homo sapiens
cctccctacctcaacctg

SEQ ID NO: 4380922 - DNA, 15 bp, Homo sapiens
cctccctactcccct

SEQ ID NO: 4380923 - DNA, 18 bp, Homo sapiens
cctccctactcccctggg

SEQ ID NO: 4380924 - DNA, 17 bp, Homo sapiens
cctccctcagactcaga

SEQ ID NO: 4380925 - DNA, 15 bp, Homo sapiens
cctccctcaggccca

SEQ ID NO: 4380926 - DNA, 23 bp, Homo sapiens
cctccctcaggcccaggagtcca

SEQ ID NO: 4380927 - DNA, 12 bp, Homo sapiens
cctccctccacc

SEQ ID NO: 4380928 - DNA, 15 bp, Homo sapiens
cctccctccacccca

SEQ ID NO: 4380929 - DNA, 16 bp, Homo sapiens
cctccctccaccccag

SEQ ID NO: 4380930 - DNA, 14 bp, Homo sapiens
cctccctccagctg

SEQ ID NO: 4380931 - DNA, 16 bp, Homo sapiens
cctccctccagctgcg

SEQ ID NO: 4380932 - DNA, 15 bp, Homo sapiens
cctccctccagggtc

SEQ ID NO: 4380933 - DNA, 23 bp, Homo sapiens
cctccctccggccatactgcctt

SEQ ID NO: 4380934 - DNA, 23 bp, Homo sapiens
cctccctctcagaggcctgctgc

SEQ ID NO: 4380935 - DNA, 14 bp, Homo sapiens
cctccctctccata

SEQ ID NO: 4380936 - DNA, 20 bp, Homo sapiens
cctccctctctcttctgctc

SEQ ID NO: 4380937 - DNA, 16 bp, Homo sapiens
cctccctgaccctgct

SEQ ID NO: 4380938 - DNA, 18 bp, Homo sapiens
cctccctgactccctgtg

SEQ ID NO: 4380939 - DNA, 11 bp, Homo sapiens
cctccctgcct

SEQ ID NO: 4380940 - DNA, 12 bp, Homo sapiens
cctccctgctag

SEQ ID NO: 4380941 - DNA, 23 bp, Homo sapiens
cctccctgctcagtgcttgggct

SEQ ID NO: 4380942 - DNA, 15 bp, Homo sapiens
cctccctgctgtgcc

SEQ ID NO: 4380943 - DNA, 23 bp, Homo sapiens
cctccctggagtgtggctgagga

SEQ ID NO: 4380944 - DNA, 12 bp, Homo sapiens
cctccctggcac

SEQ ID NO: 4380945 - DNA, 13 bp, Homo sapiens
cctccctggcaga

SEQ ID NO: 4380946 - DNA, 20 bp, Homo sapiens
cctccctggctcccatgacc

SEQ ID NO: 4380947 - DNA, 12 bp, Homo sapiens
cctccctgtcct

SEQ ID NO: 4380948 - DNA, 16 bp, Homo sapiens
cctccctgtcctcctc

SEQ ID NO: 4380949 - DNA, 16 bp, Homo sapiens
cctccctgtctccagg

SEQ ID NO: 4380950 - DNA, 18 bp, Homo sapiens
cctccctgtctccagggc

SEQ ID NO: 4380951 - DNA, 16 bp, Homo sapiens
cctcccttccttttcc

SEQ ID NO: 4380952 - DNA, 22 bp, Homo sapiens
cctcccttccttttccctgctt

SEQ ID NO: 4380953 - DNA, 14 bp, Homo sapiens
cctccctttctccc

SEQ ID NO: 4380954 - DNA, 14 bp, Homo sapiens
cctccgagagggag

SEQ ID NO: 4380955 - DNA, 19 bp, Homo sapiens
cctccgagagggagagaga

SEQ ID NO: 4380956 - DNA, 14 bp, Homo sapiens
cctccgaggccagt

SEQ ID NO: 4380957 - DNA, 14 bp, Homo sapiens
cctccgaggctccc

SEQ ID NO: 4380958 - DNA, 18 bp, Homo sapiens
cctccgaggctccccgcc

SEQ ID NO: 4380959 - DNA, 20 bp, Homo sapiens
cctccgaggctccccgcctc

SEQ ID NO: 4380960 - DNA, 13 bp, Homo sapiens
cctccgccgtgcc

SEQ ID NO: 4380961 - DNA, 16 bp, Homo sapiens
cctccgccgtgccggc

SEQ ID NO: 4380962 - DNA, 16 bp, Homo sapiens
cctccgcctccaggaa

SEQ ID NO: 4380963 - DNA, 15 bp, Homo sapiens
cctccggacatccag

SEQ ID NO: 4380964 - DNA, 19 bp, Homo sapiens
cctccggccccgtctctct

SEQ ID NO: 4380965 - DNA, 18 bp, Homo sapiens
cctccggcgggtgacagc

SEQ ID NO: 4380966 - DNA, 15 bp, Homo sapiens
cctccgtgtggagca

SEQ ID NO: 4380967 - DNA, 14 bp, Homo sapiens
cctcctaccctccc

SEQ ID NO: 4380968 - DNA, 15 bp, Homo sapiens
cctcctaccctccca

SEQ ID NO: 4380969 - DNA, 18 bp, Homo sapiens
cctcctagctctcccagt

SEQ ID NO: 4380970 - DNA, 17 bp, Homo sapiens
cctcctcacccttcccg

SEQ ID NO: 4380971 - DNA, 12 bp, Homo sapiens
cctcctcacctc

SEQ ID NO: 4380972 - DNA, 16 bp, Homo sapiens
cctcctcacctctgga

SEQ ID NO: 4380973 - DNA, 22 bp, Homo sapiens
cctcctcacctctggactggct

SEQ ID NO: 4380974 - DNA, 17 bp, Homo sapiens
cctcctcagccagcctc

SEQ ID NO: 4380975 - DNA, 19 bp, Homo sapiens
cctcctcagccagcctcct

SEQ ID NO: 4380976 - DNA, 14 bp, Homo sapiens
cctcctccctcaaa

SEQ ID NO: 4380977 - DNA, 14 bp, Homo sapiens
cctcctccctcagg

SEQ ID NO: 4380978 - DNA, 14 bp, Homo sapiens
cctcctcctcaccc

SEQ ID NO: 4380979 - DNA, 18 bp, Homo sapiens
cctcctcggagagcagca

SEQ ID NO: 4380980 - DNA, 10 bp, Homo sapiens
cctcctctga

SEQ ID NO: 4380981 - DNA, 12 bp, Homo sapiens
cctcctctgaaa

SEQ ID NO: 4380982 - DNA, 16 bp, Homo sapiens
cctcctctgaaacagc

SEQ ID NO: 4380983 - DNA, 20 bp, Homo sapiens
cctcctctgaaacagctgcc

SEQ ID NO: 4380984 - DNA, 23 bp, Homo sapiens
cctcctctgaaacagctgcctta

SEQ ID NO: 4380985 - DNA, 21 bp, Homo sapiens
cctcctctgccacctccccta

SEQ ID NO: 4380986 - DNA, 14 bp, Homo sapiens
cctcctctgcccgg

SEQ ID NO: 4380987 - DNA, 15 bp, Homo sapiens
cctcctctgcctaca

SEQ ID NO: 4380988 - DNA, 20 bp, Homo sapiens
cctcctctggacggcaggct

SEQ ID NO: 4380989 - DNA, 22 bp, Homo sapiens
cctcctctggacggcaggctca

SEQ ID NO: 4380990 - DNA, 17 bp, Homo sapiens
cctcctctgtctgccct

SEQ ID NO: 4380991 - DNA, 18 bp, Homo sapiens
cctcctgacccccatgta

SEQ ID NO: 4380992 - DNA, 19 bp, Homo sapiens
cctcctgacccccatgtaa

SEQ ID NO: 4380993 - DNA, 13 bp, Homo sapiens
cctcctgcagaca

SEQ ID NO: 4380994 - DNA, 20 bp, Homo sapiens
cctcctgcagacacctggac

SEQ ID NO: 4380995 - DNA, 21 bp, Homo sapiens
cctcctgcagacacctggact

SEQ ID NO: 4380996 - DNA, 18 bp, Homo sapiens
cctcctgcctcagccttc

SEQ ID NO: 4380997 - DNA, 11 bp, Homo sapiens
cctcctgctca

SEQ ID NO: 4380998 - DNA, 11 bp, Homo sapiens
cctcctgctgc

SEQ ID NO: 4380999 - DNA, 21 bp, Homo sapiens
cctcctgggccctctctgctc

SEQ ID NO: 4381000 - DNA, 17 bp, Homo sapiens
cctcctgtcttcccagg

SEQ ID NO: 4381001 - DNA, 18 bp, Homo sapiens
cctcctgtcttcccaggg

SEQ ID NO: 4381002 - DNA, 13 bp, Homo sapiens
cctcctgtgcctg

SEQ ID NO: 4381003 - DNA, 15 bp, Homo sapiens
cctcctgttgcaccc

SEQ ID NO: 4381004 - DNA, 21 bp, Homo sapiens
cctcctgttgcacccagccct

SEQ ID NO: 4381005 - DNA, 22 bp, Homo sapiens
cctccttagccctgtctgctag

SEQ ID NO: 4381006 - DNA, 23 bp, Homo sapiens
cctccttcatatgaaaggtgcca

SEQ ID NO: 4381007 - DNA, 16 bp, Homo sapiens
cctccttcatttcagc

SEQ ID NO: 4381008 - DNA, 14 bp, Homo sapiens
cctccttccccaga

SEQ ID NO: 4381009 - DNA, 17 bp, Homo sapiens
cctccttccccagaccc

SEQ ID NO: 4381010 - DNA, 13 bp, Homo sapiens
cctccttgcctag

SEQ ID NO: 4381011 - DNA, 17 bp, Homo sapiens
cctccttggtgcctctg

SEQ ID NO: 4381012 - DNA, 19 bp, Homo sapiens
cctcctttcctatcttcct

SEQ ID NO: 4381013 - DNA, 18 bp, Homo sapiens
cctccttttggcctgggg

SEQ ID NO: 4381014 - DNA, 21 bp, Homo sapiens
cctcctttttccatgccctaa

SEQ ID NO: 4381015 - DNA, 21 bp, Homo sapiens
cctcgaccctgtgcaggagct

SEQ ID NO: 4381016 - DNA, 13 bp, Homo sapiens
cctcgagaggcac

SEQ ID NO: 4381017 - DNA, 20 bp, Homo sapiens
cctcgagatgggtgctggtc

SEQ ID NO: 4381018 - DNA, 22 bp, Homo sapiens
cctcgagatgggtgctggtcct

SEQ ID NO: 4381019 - DNA, 14 bp, Homo sapiens
cctcgccccagcct

SEQ ID NO: 4381020 - DNA, 21 bp, Homo sapiens
cctcgccccagcctcattccc

SEQ ID NO: 4381021 - DNA, 12 bp, Homo sapiens
cctcgccctggg

SEQ ID NO: 4381022 - DNA, 13 bp, Homo sapiens
cctcgccctgggt

SEQ ID NO: 4381023 - DNA, 14 bp, Homo sapiens
cctcgccctgggtc

SEQ ID NO: 4381024 - DNA, 18 bp, Homo sapiens
cctcgccggatctgaggg

SEQ ID NO: 4381025 - DNA, 19 bp, Homo sapiens
cctcgccggatctgaggga

SEQ ID NO: 4381026 - DNA, 14 bp, Homo sapiens
cctcgcctccccac

SEQ ID NO: 4381027 - DNA, 20 bp, Homo sapiens
cctcgcctccccaccctcct

SEQ ID NO: 4381028 - DNA, 18 bp, Homo sapiens
cctcgctcaccgctggcc

SEQ ID NO: 4381029 - DNA, 19 bp, Homo sapiens
cctcgctcaccgctggccc

SEQ ID NO: 4381030 - DNA, 21 bp, Homo sapiens
cctcgctcaccgctggccctt

SEQ ID NO: 4381031 - DNA, 13 bp, Homo sapiens
cctcgctgccagc

SEQ ID NO: 4381032 - DNA, 20 bp, Homo sapiens
cctcgctgccagctctgtat

SEQ ID NO: 4381033 - DNA, 22 bp, Homo sapiens
cctcggacagagcccccctagc

SEQ ID NO: 4381034 - DNA, 22 bp, Homo sapiens
cctcggaccccactccggccct

SEQ ID NO: 4381035 - DNA, 21 bp, Homo sapiens
cctcggactgtgtgcaggttg

SEQ ID NO: 4381036 - DNA, 17 bp, Homo sapiens
cctcggatcaccgagag

SEQ ID NO: 4381037 - DNA, 22 bp, Homo sapiens
cctcggcctccgaggctccccg

SEQ ID NO: 4381038 - DNA, 13 bp, Homo sapiens
cctcgggcccagc

SEQ ID NO: 4381039 - DNA, 14 bp, Homo sapiens
cctcgggcccagcc

SEQ ID NO: 4381040 - DNA, 15 bp, Homo sapiens
cctcggggacaccag

SEQ ID NO: 4381041 - DNA, 18 bp, Homo sapiens
cctcgggtctcctcactc

SEQ ID NO: 4381042 - DNA, 21 bp, Homo sapiens
cctcggtcgccccgtgtttgc

SEQ ID NO: 4381043 - DNA, 22 bp, Homo sapiens
cctcgtagagtgacctcggaca

SEQ ID NO: 4381044 - DNA, 18 bp, Homo sapiens
cctcgtcaagagcatgca

SEQ ID NO: 4381045 - DNA, 16 bp, Homo sapiens
cctcgtcctccccctg

SEQ ID NO: 4381046 - DNA, 17 bp, Homo sapiens
cctcgtcctccccctgc

SEQ ID NO: 4381047 - DNA, 19 bp, Homo sapiens
cctcgtcctccccctgcca

SEQ ID NO: 4381048 - DNA, 12 bp, Homo sapiens
cctctaaaccta

SEQ ID NO: 4381049 - DNA, 19 bp, Homo sapiens
cctctaaccccaggccccg

SEQ ID NO: 4381050 - DNA, 14 bp, Homo sapiens
cctctaatccagca

SEQ ID NO: 4381051 - DNA, 18 bp, Homo sapiens
cctctaatccagcaaagt

SEQ ID NO: 4381052 - DNA, 20 bp, Homo sapiens
cctctacagagcttccctga

SEQ ID NO: 4381053 - DNA, 24 bp, Homo sapiens
cctctacagagcttccctgactca

SEQ ID NO: 4381054 - DNA, 21 bp, Homo sapiens
cctctttttcctcctggacac

SEQ ID NO: 4381055 - DNA, 19 bp, Homo sapiens
cctcttttttcgtttgttt

SEQ ID NO: 4381056 - DNA, 18 bp, Homo sapiens
cctgaaaacactgtgcac

SEQ ID NO: 4381057 - DNA, 19 bp, Homo sapiens
cctgaaacccgccctcagg

SEQ ID NO: 4381058 - DNA, 20 bp, Homo sapiens
cctgaaacccgccctcaggg

SEQ ID NO: 4381059 - DNA, 17 bp, Homo sapiens
cctgaaatgacatttca

SEQ ID NO: 4381060 - DNA, 18 bp, Homo sapiens
cctgaacagccctctctc

SEQ ID NO: 4381061 - DNA, 18 bp, Homo sapiens
cctgaaccccagaggcag

SEQ ID NO: 4381062 - DNA, 21 bp, Homo sapiens
cctgaaccccagaggcagagg

SEQ ID NO: 4381063 - DNA, 14 bp, Homo sapiens
cctgaactccagag

SEQ ID NO: 4381064 - DNA, 19 bp, Homo sapiens
cctgaagagaagggcaggg

SEQ ID NO: 4381065 - DNA, 15 bp, Homo sapiens
cctgaagctgctgtg

SEQ ID NO: 4381066 - DNA, 17 bp, Homo sapiens
cctgaagctgctgtgtc

SEQ ID NO: 4381067 - DNA, 17 bp, Homo sapiens
cctgaagcttcggccgc

SEQ ID NO: 4381068 - DNA, 17 bp, Homo sapiens
cctgaatccaaactaat

SEQ ID NO: 4381069 - DNA, 20 bp, Homo sapiens
cctgaatccaaactaatcca

SEQ ID NO: 4381070 - DNA, 19 bp, Homo sapiens
cctgaatcccccttgccac

SEQ ID NO: 4381071 - DNA, 19 bp, Homo sapiens
cctgaatctgtgcaaacag

SEQ ID NO: 4381072 - DNA, 14 bp, Homo sapiens
cctgaattctattt

SEQ ID NO: 4381073 - DNA, 13 bp, Homo sapiens
cctgacaaatttt

SEQ ID NO: 4381074 - DNA, 14 bp, Homo sapiens
cctgacactttaat

SEQ ID NO: 4381075 - DNA, 15 bp, Homo sapiens
cctgacactttaatt

SEQ ID NO: 4381076 - DNA, 19 bp, Homo sapiens
cctgacagatgcctggtga

SEQ ID NO: 4381077 - DNA, 13 bp, Homo sapiens
cctgacagctctg

SEQ ID NO: 4381078 - DNA, 14 bp, Homo sapiens
cctgaccagctgct

SEQ ID NO: 4381079 - DNA, 21 bp, Homo sapiens
cctgaccagctgctccgagga

SEQ ID NO: 4381080 - DNA, 22 bp, Homo sapiens
cctgaccagctgctccgaggac

SEQ ID NO: 4381081 - DNA, 17 bp, Homo sapiens
cctgaccagtcagatgg

SEQ ID NO: 4381082 - DNA, 16 bp, Homo sapiens
cctgacccctgcctgt

SEQ ID NO: 4381083 - DNA, 19 bp, Homo sapiens
cctgaccctcatctttctt

SEQ ID NO: 4381084 - DNA, 16 bp, Homo sapiens
cctgaccctgctccta

SEQ ID NO: 4381085 - DNA, 17 bp, Homo sapiens
cctgacctccgcccctg

SEQ ID NO: 4381086 - DNA, 21 bp, Homo sapiens
cctgaccttagcgttctggac

SEQ ID NO: 4381087 - DNA, 14 bp, Homo sapiens
cctgacgctcagcc

SEQ ID NO: 4381088 - DNA, 16 bp, Homo sapiens
cctgacgctcagcccc

SEQ ID NO: 4381089 - DNA, 17 bp, Homo sapiens
cctgacgttaggaccag

SEQ ID NO: 4381090 - DNA, 21 bp, Homo sapiens
cctgacgttaggaccaggaga

SEQ ID NO: 4381091 - DNA, 20 bp, Homo sapiens
cctgactaatttttgtattt

SEQ ID NO: 4381092 - DNA, 17 bp, Homo sapiens
cctgactcaattatttg

SEQ ID NO: 4381093 - DNA, 15 bp, Homo sapiens
cctgactccctgtgg

SEQ ID NO: 4381094 - DNA, 21 bp, Homo sapiens
cctgactccctgtgggggtgg

SEQ ID NO: 4381095 - DNA, 16 bp, Homo sapiens
cctgactcctctggct

SEQ ID NO: 4381096 - DNA, 13 bp, Homo sapiens
cctgactcctgga

SEQ ID NO: 4381097 - DNA, 14 bp, Homo sapiens
cctgactctcagca

SEQ ID NO: 4381098 - DNA, 16 bp, Homo sapiens
cctgactctgccccct

SEQ ID NO: 4381099 - DNA, 11 bp, Homo sapiens
cctgacttgag

SEQ ID NO: 4381100 - DNA, 12 bp, Homo sapiens
cctgacttgagc

SEQ ID NO: 4381101 - DNA, 13 bp, Homo sapiens
cctgacttgagcc

SEQ ID NO: 4381102 - DNA, 14 bp, Homo sapiens
cctgacttgagcca

SEQ ID NO: 4381103 - DNA, 15 bp, Homo sapiens
cctgacttgagccac

SEQ ID NO: 4381104 - DNA, 14 bp, Homo sapiens
cctgacttgcttta

SEQ ID NO: 4381105 - DNA, 13 bp, Homo sapiens
cctgacttttctg

SEQ ID NO: 4381106 - DNA, 19 bp, Homo sapiens
cctgagaagaagtggctgc

SEQ ID NO: 4381107 - DNA, 16 bp, Homo sapiens
cctgagaccagggtgg

SEQ ID NO: 4381108 - DNA, 17 bp, Homo sapiens
cctgagaccagggtggc

SEQ ID NO: 4381109 - DNA, 20 bp, Homo sapiens
cctgagaccagggtggccac

SEQ ID NO: 4381110 - DNA, 20 bp, Homo sapiens
cctgagaccctgggagagaa

SEQ ID NO: 4381111 - DNA, 18 bp, Homo sapiens
cctgagagatttaacatt

SEQ ID NO: 4381112 - DNA, 14 bp, Homo sapiens
cctgagagcctgtg

SEQ ID NO: 4381113 - DNA, 15 bp, Homo sapiens
cctgagaggcaggca

SEQ ID NO: 4381114 - DNA, 17 bp, Homo sapiens
cctgagaggcaggcata

SEQ ID NO: 4381115 - DNA, 15 bp, Homo sapiens
cctgagcaactcttg

SEQ ID NO: 4381116 - DNA, 15 bp, Homo sapiens
cctgagcactcctgg

SEQ ID NO: 4381117 - DNA, 15 bp, Homo sapiens
cctgagccagcaggg

SEQ ID NO: 4381118 - DNA, 16 bp, Homo sapiens
cctgagccggccccag

SEQ ID NO: 4381119 - DNA, 16 bp, Homo sapiens
cctgagcgctcctgcc

SEQ ID NO: 4381120 - DNA, 21 bp, Homo sapiens
cctgagcgctcctgccgcaga

SEQ ID NO: 4381121 - DNA, 23 bp, Homo sapiens
cctgagcgctcctgccgcagagc

SEQ ID NO: 4381122 - DNA, 11 bp, Homo sapiens
cctgagctaga

SEQ ID NO: 4381123 - DNA, 18 bp, Homo sapiens
cctgagctattttcctct

SEQ ID NO: 4381124 - DNA, 20 bp, Homo sapiens
cctgagctattttcctctgg

SEQ ID NO: 4381125 - DNA, 16 bp, Homo sapiens
cctgaggacctttctg

SEQ ID NO: 4381126 - DNA, 19 bp, Homo sapiens
cctgaggactgatttcaga

SEQ ID NO: 4381127 - DNA, 23 bp, Homo sapiens
cctgaggactgatttcagagtga

SEQ ID NO: 4381128 - DNA, 16 bp, Homo sapiens
cctgaggcaaggagtt

SEQ ID NO: 4381129 - DNA, 15 bp, Homo sapiens
cctgaggccctgggc

SEQ ID NO: 4381130 - DNA, 16 bp, Homo sapiens
cctgaggccctgggct

SEQ ID NO: 4381131 - DNA, 17 bp, Homo sapiens
cctgaggcctccaagga

SEQ ID NO: 4381132 - DNA, 12 bp, Homo sapiens
cctgaggctgtt

SEQ ID NO: 4381133 - DNA, 23 bp, Homo sapiens
cctgagggcagaaaggttctgcc

SEQ ID NO: 4381134 - DNA, 21 bp, Homo sapiens
cctgagggcagtaccctccat

SEQ ID NO: 4381135 - DNA, 19 bp, Homo sapiens
cctgaggggcatctgcccc

SEQ ID NO: 4381136 - DNA, 13 bp, Homo sapiens
cctgaggtcagga

SEQ ID NO: 4381137 - DNA, 20 bp, Homo sapiens
cctgaggtgaaagggagcta

SEQ ID NO: 4381138 - DNA, 22 bp, Homo sapiens
cctgaggtgggagaatcactta

SEQ ID NO: 4381139 - DNA, 15 bp, Homo sapiens
cctgagtcaccagga

SEQ ID NO: 4381140 - DNA, 19 bp, Homo sapiens
cctgagtcgtacagaaagc

SEQ ID NO: 4381141 - DNA, 21 bp, Homo sapiens
cctgagtcgtacagaaagctg

SEQ ID NO: 4381142 - DNA, 17 bp, Homo sapiens
cctgagtgcgggctgag

SEQ ID NO: 4381143 - DNA, 19 bp, Homo sapiens
cctgagtgcgggctgaggc

SEQ ID NO: 4381144 - DNA, 23 bp, Homo sapiens
cctgagtgcgggctgaggccaga

SEQ ID NO: 4381145 - DNA, 17 bp, Homo sapiens
cctgagttgggcagcca

SEQ ID NO: 4381146 - DNA, 18 bp, Homo sapiens
cctgagttgggcagccag

SEQ ID NO: 4381147 - DNA, 19 bp, Homo sapiens
cctgagttgggcagccagg

SEQ ID NO: 4381148 - DNA, 19 bp, Homo sapiens
cctgataaagaacatctgt

SEQ ID NO: 4381149 - DNA, 12 bp, Homo sapiens
cctgatctctgc

SEQ ID NO: 4381150 - DNA, 18 bp, Homo sapiens
cctgatcttacagaaaat

SEQ ID NO: 4381151 - DNA, 23 bp, Homo sapiens
cctgatgacgggatgctctttaa

SEQ ID NO: 4381152 - DNA, 17 bp, Homo sapiens
cctgatgagatttttaa

SEQ ID NO: 4381153 - DNA, 16 bp, Homo sapiens
cctgatggcctttgga

SEQ ID NO: 4381154 - DNA, 16 bp, Homo sapiens
cctgatggggaaggga

SEQ ID NO: 4381155 - DNA, 19 bp, Homo sapiens
cctgatgtgtcctcaggga

SEQ ID NO: 4381156 - DNA, 19 bp, Homo sapiens
cctgattgatcacacagtg

SEQ ID NO: 4381157 - DNA, 20 bp, Homo sapiens
cctgattgatcacacagtgt

SEQ ID NO: 4381158 - DNA, 13 bp, Homo sapiens
cctgattggccac

SEQ ID NO: 4381159 - DNA, 22 bp, Homo sapiens
cctgattgtattttttttttaa

SEQ ID NO: 4381160 - DNA, 14 bp, Homo sapiens
cctgcaaaaaatac

SEQ ID NO: 4381161 - DNA, 15 bp, Homo sapiens
cctgcaaaaaatact

SEQ ID NO: 4381162 - DNA, 21 bp, Homo sapiens
cctgcaaaactccaggcagga

SEQ ID NO: 4381163 - DNA, 17 bp, Homo sapiens
cctgcaaaccttcctgg

SEQ ID NO: 4381164 - DNA, 17 bp, Homo sapiens
cctgcaagaccacggag

SEQ ID NO: 4381165 - DNA, 20 bp, Homo sapiens
cctgcaagctccgcctcccg

SEQ ID NO: 4381166 - DNA, 17 bp, Homo sapiens
cctgcaagttgctctga

SEQ ID NO: 4381167 - DNA, 15 bp, Homo sapiens
cctgcacacagagtg

SEQ ID NO: 4381168 - DNA, 17 bp, Homo sapiens
cctgcacaccctgggcc

SEQ ID NO: 4381169 - DNA, 14 bp, Homo sapiens
cctgcacagcaggc

SEQ ID NO: 4381170 - DNA, 21 bp, Homo sapiens
cctgcacagcaggctgccagt

SEQ ID NO: 4381171 - DNA, 23 bp, Homo sapiens
cctgcacagcaggctgccagtgc

SEQ ID NO: 4381172 - DNA, 15 bp, Homo sapiens
cctgcggaaggaggt

SEQ ID NO: 4381173 - DNA, 21 bp, Homo sapiens
cctgcgggcgcgggcagccac

SEQ ID NO: 4381174 - DNA, 23 bp, Homo sapiens
cctgcgggcgcgggcagccaccc

SEQ ID NO: 4381175 - DNA, 19 bp, Homo sapiens
cctgcgggcttttccccgg

SEQ ID NO: 4381176 - DNA, 16 bp, Homo sapiens
cctgcgggttttaatt

SEQ ID NO: 4381177 - DNA, 15 bp, Homo sapiens
cctgcggtggaggga

SEQ ID NO: 4381178 - DNA, 19 bp, Homo sapiens
cctgcggtggagggatcag

SEQ ID NO: 4381179 - DNA, 14 bp, Homo sapiens
cctgcgtcccagcc

SEQ ID NO: 4381180 - DNA, 21 bp, Homo sapiens
cctgcgtcccagcctgcaccc

SEQ ID NO: 4381181 - DNA, 15 bp, Homo sapiens
cctgcgtcctcctca

SEQ ID NO: 4381182 - DNA, 19 bp, Homo sapiens
cctgcgtcctcctcacctc

SEQ ID NO: 4381183 - DNA, 22 bp, Homo sapiens
cctgcgtcctcctcacctcatg

SEQ ID NO: 4381184 - DNA, 12 bp, Homo sapiens
cctgcgtggggg

SEQ ID NO: 4381185 - DNA, 19 bp, Homo sapiens
cctgctagacgcaccgcct

SEQ ID NO: 4381186 - DNA, 16 bp, Homo sapiens
cctgctagcacagagg

SEQ ID NO: 4381187 - DNA, 21 bp, Homo sapiens
cctgctagcacagaggcctga

SEQ ID NO: 4381188 - DNA, 18 bp, Homo sapiens
cctgctagtcactggaaa

SEQ ID NO: 4381189 - DNA, 15 bp, Homo sapiens
cctgctcactgggcc

SEQ ID NO: 4381190 - DNA, 20 bp, Homo sapiens
cctgctcagcaattcagacc

SEQ ID NO: 4381191 - DNA, 10 bp, Homo sapiens
cctgctcagg

SEQ ID NO: 4381192 - DNA, 15 bp, Homo sapiens
cctgctcagtgcttg

SEQ ID NO: 4381193 - DNA, 20 bp, Homo sapiens
cctgctcagtgcttgggctc

SEQ ID NO: 4381194 - DNA, 19 bp, Homo sapiens
cctgctcatcacccttccg

SEQ ID NO: 4381195 - DNA, 15 bp, Homo sapiens
cctgctccaccagca

SEQ ID NO: 4381196 - DNA, 16 bp, Homo sapiens
cctgctccaccagcag

SEQ ID NO: 4381197 - DNA, 17 bp, Homo sapiens
cctgctccaccagcagc

SEQ ID NO: 4381198 - DNA, 18 bp, Homo sapiens
cctgctccaccagcagca

SEQ ID NO: 4381199 - DNA, 15 bp, Homo sapiens
cctgctcccagtcct

SEQ ID NO: 4381200 - DNA, 21 bp, Homo sapiens
cctgctcccagtcctgcctga

SEQ ID NO: 4381201 - DNA, 22 bp, Homo sapiens
cctgctcccattcctccctccg

SEQ ID NO: 4381202 - DNA, 23 bp, Homo sapiens
cctgctcccccaccccctcccca

SEQ ID NO: 4381203 - DNA, 16 bp, Homo sapiens
cctgctccctgcctcc

SEQ ID NO: 4381204 - DNA, 18 bp, Homo sapiens
cctgctccctgcctcctg

SEQ ID NO: 4381205 - DNA, 19 bp, Homo sapiens
cctgctccctgcctcctgc

SEQ ID NO: 4381206 - DNA, 20 bp, Homo sapiens
cctgctccctgcctcctgcc

SEQ ID NO: 4381207 - DNA, 14 bp, Homo sapiens
cctgctcctagcac

SEQ ID NO: 4381208 - DNA, 15 bp, Homo sapiens
cctgctcctagcacc

SEQ ID NO: 4381209 - DNA, 18 bp, Homo sapiens
cctgctcctagcaccctg

SEQ ID NO: 4381210 - DNA, 17 bp, Homo sapiens
cctgctctctatccaaa

SEQ ID NO: 4381211 - DNA, 18 bp, Homo sapiens
cctgctctgtccccaaag

SEQ ID NO: 4381212 - DNA, 20 bp, Homo sapiens
cctgctcttctctccccagc

SEQ ID NO: 4381213 - DNA, 23 bp, Homo sapiens
cctgctcttttgtgatgaacata

SEQ ID NO: 4381214 - DNA, 23 bp, Homo sapiens
cctgctgagatctgctgtcctgt

SEQ ID NO: 4381215 - DNA, 15 bp, Homo sapiens
cctgctgcagcatga

SEQ ID NO: 4381216 - DNA, 13 bp, Homo sapiens
cctgctgccagtg

SEQ ID NO: 4381217 - DNA, 16 bp, Homo sapiens
cctgctgccagtgcag

SEQ ID NO: 4381218 - DNA, 20 bp, Homo sapiens
cctgctgccagtgcagccac

SEQ ID NO: 4381219 - DNA, 15 bp, Homo sapiens
cctgctgcctgctga

SEQ ID NO: 4381220 - DNA, 16 bp, Homo sapiens
cctgctgcctgctgag

SEQ ID NO: 4381221 - DNA, 12 bp, Homo sapiens
cctgctgctcag

SEQ ID NO: 4381222 - DNA, 15 bp, Homo sapiens
cctgctgctgctact

SEQ ID NO: 4381223 - DNA, 13 bp, Homo sapiens
cctgctgctttgg

SEQ ID NO: 4381224 - DNA, 13 bp, Homo sapiens
cctgctggccgcc

SEQ ID NO: 4381225 - DNA, 14 bp, Homo sapiens
cctgctggccgcct

SEQ ID NO: 4381226 - DNA, 17 bp, Homo sapiens
cctgctggccgcctcac

SEQ ID NO: 4381227 - DNA, 17 bp, Homo sapiens
cctgctggctgcggccc

SEQ ID NO: 4381228 - DNA, 18 bp, Homo sapiens
cctgctggctgcggcccc

SEQ ID NO: 4381229 - DNA, 18 bp, Homo sapiens
cctgctgggctctccacc

SEQ ID NO: 4381230 - DNA, 18 bp, Homo sapiens
cctgctggggaagaacag

SEQ ID NO: 4381231 - DNA, 17 bp, Homo sapiens
cctgctggtcacagcct

SEQ ID NO: 4381232 - DNA, 18 bp, Homo sapiens
cctgctggtcacagcctc

SEQ ID NO: 4381233 - DNA, 20 bp, Homo sapiens
cctgctgtgattccactaca

SEQ ID NO: 4381234 - DNA, 23 bp, Homo sapiens
cctgctgtgattccactacacct

SEQ ID NO: 4381235 - DNA, 22 bp, Homo sapiens
cctgctgtgccatgctgggcca

SEQ ID NO: 4381236 - DNA, 16 bp, Homo sapiens
cctgctgtgctgctca

SEQ ID NO: 4381237 - DNA, 17 bp, Homo sapiens
cctgctttctacgccaa

SEQ ID NO: 4381238 - DNA, 18 bp, Homo sapiens
cctgctttgcatctttgt

SEQ ID NO: 4381239 - DNA, 14 bp, Homo sapiens
cctggaaaccttcc

SEQ ID NO: 4381240 - DNA, 17 bp, Homo sapiens
cctggaaaccttccacc

SEQ ID NO: 4381241 - DNA, 20 bp, Homo sapiens
cctggaaaccttccacccag

SEQ ID NO: 4381242 - DNA, 17 bp, Homo sapiens
cctggaaactgctcaga

SEQ ID NO: 4381243 - DNA, 17 bp, Homo sapiens
cctggaacatctcacct

SEQ ID NO: 4381244 - DNA, 19 bp, Homo sapiens
cctggaagatcatggacct

SEQ ID NO: 4381245 - DNA, 13 bp, Homo sapiens
cctggaagctgtg

SEQ ID NO: 4381246 - DNA, 14 bp, Homo sapiens
cctggaaggacaca

SEQ ID NO: 4381247 - DNA, 24 bp, Homo sapiens
cctggaagggctagaacctgtaga

SEQ ID NO: 4381248 - DNA, 13 bp, Homo sapiens
cctggacaggcgg

SEQ ID NO: 4381249 - DNA, 21 bp, Homo sapiens
cctggacatgaagattctttc

SEQ ID NO: 4381250 - DNA, 14 bp, Homo sapiens
cctggaccagcctc

SEQ ID NO: 4381251 - DNA, 18 bp, Homo sapiens
cctggactccggaggact

SEQ ID NO: 4381252 - DNA, 20 bp, Homo sapiens
cctggactccggaggactga

SEQ ID NO: 4381253 - DNA, 21 bp, Homo sapiens
cctggactccggaggactgag

SEQ ID NO: 4381254 - DNA, 21 bp, Homo sapiens
cctggactgagccaaggaggc

SEQ ID NO: 4381255 - DNA, 22 bp, Homo sapiens
cctggactgagggggcctggat

SEQ ID NO: 4381256 - DNA, 24 bp, Homo sapiens
cctggacttaagcatctggctcta

SEQ ID NO: 4381257 - DNA, 23 bp, Homo sapiens
cctggagaactagaacctggagg

SEQ ID NO: 4381258 - DNA, 18 bp, Homo sapiens
cctggagactgcccagct

SEQ ID NO: 4381259 - DNA, 19 bp, Homo sapiens
cctggagagctagaaccta

SEQ ID NO: 4381260 - DNA, 21 bp, Homo sapiens
cctggagagctagaacctaga

SEQ ID NO: 4381261 - DNA, 19 bp, Homo sapiens
cctggagagtgcacatgcc

SEQ ID NO: 4381262 - DNA, 15 bp, Homo sapiens
cctggagatgcagct

SEQ ID NO: 4381263 - DNA, 14 bp, Homo sapiens
cctggagcagagga

SEQ ID NO: 4381264 - DNA, 17 bp, Homo sapiens
cctggagcagaggaggg

SEQ ID NO: 4381265 - DNA, 17 bp, Homo sapiens
cctggagcaggagcccc

SEQ ID NO: 4381266 - DNA, 15 bp, Homo sapiens
cctggagcctcagaa

SEQ ID NO: 4381267 - DNA, 23 bp, Homo sapiens
cctggaggacagagggagacagg

SEQ ID NO: 4381268 - DNA, 17 bp, Homo sapiens
cctggaggctgcctccc

SEQ ID NO: 4381269 - DNA, 18 bp, Homo sapiens
cctggaggctgcctccca

SEQ ID NO: 4381270 - DNA, 14 bp, Homo sapiens
cctggagggaagga

SEQ ID NO: 4381271 - DNA, 21 bp, Homo sapiens
cctggagggaaggacagtccc

SEQ ID NO: 4381272 - DNA, 22 bp, Homo sapiens
cctggagggcaagccctgccca

SEQ ID NO: 4381273 - DNA, 20 bp, Homo sapiens
cctggagggctagaacctag

SEQ ID NO: 4381274 - DNA, 23 bp, Homo sapiens
cctggagggctagaacctggaga

SEQ ID NO: 4381275 - DNA, 17 bp, Homo sapiens
cctggatctatccctgc

SEQ ID NO: 4381276 - DNA, 20 bp, Homo sapiens
cctggatctatccctgcggc

SEQ ID NO: 4381277 - DNA, 14 bp, Homo sapiens
cctggatgccatcc

SEQ ID NO: 4381278 - DNA, 23 bp, Homo sapiens
cctggattttttatgtacaaccc

SEQ ID NO: 4381279 - DNA, 21 bp, Homo sapiens
cctggcaaatgcctgactcag

SEQ ID NO: 4381280 - DNA, 22 bp, Homo sapiens
cctggcaagctagaacctggag

SEQ ID NO: 4381281 - DNA, 15 bp, Homo sapiens
cctggcacattgccc

SEQ ID NO: 4381282 - DNA, 18 bp, Homo sapiens
cctggcacattgcccctc

SEQ ID NO: 4381283 - DNA, 13 bp, Homo sapiens
cctggcactggca

SEQ ID NO: 4381284 - DNA, 23 bp, Homo sapiens
cctggcactggcaaacagggcct

SEQ ID NO: 4381285 - DNA, 12 bp, Homo sapiens
cctggcagacac

SEQ ID NO: 4381286 - DNA, 19 bp, Homo sapiens
cctggcagacacaacccaa

SEQ ID NO: 4381287 - DNA, 14 bp, Homo sapiens
cctggcagctgctg

SEQ ID NO: 4381288 - DNA, 15 bp, Homo sapiens
cctggcagctgctgt

SEQ ID NO: 4381289 - DNA, 21 bp, Homo sapiens
cctggcagtccgtgggacggg

SEQ ID NO: 4381290 - DNA, 13 bp, Homo sapiens
cctggccaccagc

SEQ ID NO: 4381291 - DNA, 19 bp, Homo sapiens
cctggccaccagccatcct

SEQ ID NO: 4381292 - DNA, 15 bp, Homo sapiens
cctggccaggaccct

SEQ ID NO: 4381293 - DNA, 13 bp, Homo sapiens
cctggccaggagc

SEQ ID NO: 4381294 - DNA, 18 bp, Homo sapiens
cctggccaggagctcttc

SEQ ID NO: 4381295 - DNA, 22 bp, Homo sapiens
cctggccaggagctcttcaggc

SEQ ID NO: 4381296 - DNA, 23 bp, Homo sapiens
cctggccatttccaagaggctgt

SEQ ID NO: 4381297 - DNA, 21 bp, Homo sapiens
cctggcccagggcatctggga

SEQ ID NO: 4381298 - DNA, 17 bp, Homo sapiens
cctggccccagcctggg

SEQ ID NO: 4381299 - DNA, 19 bp, Homo sapiens
cctggccccagcctgggcc

SEQ ID NO: 4381300 - DNA, 19 bp, Homo sapiens
cctggccccaggccccaga

SEQ ID NO: 4381301 - DNA, 18 bp, Homo sapiens
cctggccccatggtcagc

SEQ ID NO: 4381302 - DNA, 17 bp, Homo sapiens
cctggccccatgtctct

SEQ ID NO: 4381303 - DNA, 21 bp, Homo sapiens
cctggccccatgtctctcaga

SEQ ID NO: 4381304 - DNA, 20 bp, Homo sapiens
cctggcccccaacctcaggg

SEQ ID NO: 4381305 - DNA, 16 bp, Homo sapiens
cctggcccccacagcg

SEQ ID NO: 4381306 - DNA, 19 bp, Homo sapiens
cctggcccccacagcgctc

SEQ ID NO: 4381307 - DNA, 20 bp, Homo sapiens
cctggcccccatcagccctg

SEQ ID NO: 4381308 - DNA, 21 bp, Homo sapiens
cctggcccccatcagccctgc

SEQ ID NO: 4381309 - DNA, 13 bp, Homo sapiens
cctggccctccac

SEQ ID NO: 4381310 - DNA, 12 bp, Homo sapiens
cctggccctgct

SEQ ID NO: 4381311 - DNA, 13 bp, Homo sapiens
cctggccctgctt

SEQ ID NO: 4381312 - DNA, 14 bp, Homo sapiens
cctggcctcataca

SEQ ID NO: 4381313 - DNA, 22 bp, Homo sapiens
cctggcctccggcgtcagcctc

SEQ ID NO: 4381314 - DNA, 19 bp, Homo sapiens
cctggcctgaactgaggag

SEQ ID NO: 4381315 - DNA, 20 bp, Homo sapiens
cctggcctgaactgaggaga

SEQ ID NO: 4381316 - DNA, 14 bp, Homo sapiens
cctggccttctgaa

SEQ ID NO: 4381317 - DNA, 14 bp, Homo sapiens
cctggccttttgtg

SEQ ID NO: 4381318 - DNA, 14 bp, Homo sapiens
cctggctccactct

SEQ ID NO: 4381319 - DNA, 12 bp, Homo sapiens
cctggctcccac

SEQ ID NO: 4381320 - DNA, 14 bp, Homo sapiens
cctggctcccatga

SEQ ID NO: 4381321 - DNA, 14 bp, Homo sapiens
cctggctccctcct

SEQ ID NO: 4381322 - DNA, 22 bp, Homo sapiens
cctggctccctcctccaggcct

SEQ ID NO: 4381323 - DNA, 23 bp, Homo sapiens
cctggctccctcctccaggcctg

SEQ ID NO: 4381324 - DNA, 12 bp, Homo sapiens
cctggctccctg

SEQ ID NO: 4381325 - DNA, 23 bp, Homo sapiens
cctggctcctgaggggcatctgc

SEQ ID NO: 4381326 - DNA, 18 bp, Homo sapiens
cctggctctgccccctcc

SEQ ID NO: 4381327 - DNA, 19 bp, Homo sapiens
cctggctgaggttcctctg

SEQ ID NO: 4381328 - DNA, 17 bp, Homo sapiens
cctggctgctgccccca

SEQ ID NO: 4381329 - DNA, 20 bp, Homo sapiens
cctggctgctgcccccaccc

SEQ ID NO: 4381330 - DNA, 22 bp, Homo sapiens
cctggctgctgcccccaccccg

SEQ ID NO: 4381331 - DNA, 15 bp, Homo sapiens
cctggctggctccta

SEQ ID NO: 4381332 - DNA, 13 bp, Homo sapiens
cctggcttctgtg

SEQ ID NO: 4381333 - DNA, 18 bp, Homo sapiens
cctggcttgtaactccac

SEQ ID NO: 4381334 - DNA, 17 bp, Homo sapiens
cctggctttgcctcttc

SEQ ID NO: 4381335 - DNA, 16 bp, Homo sapiens
cctgggacacagaccc

SEQ ID NO: 4381336 - DNA, 17 bp, Homo sapiens
cctgggacacagaccca

SEQ ID NO: 4381337 - DNA, 19 bp, Homo sapiens
cctgggacacagacccagg

SEQ ID NO: 4381338 - DNA, 23 bp, Homo sapiens
cctgggacagtttatcatgaagc

SEQ ID NO: 4381339 - DNA, 13 bp, Homo sapiens
cctgggacccttg

SEQ ID NO: 4381340 - DNA, 15 bp, Homo sapiens
cctgggacccttggc

SEQ ID NO: 4381341 - DNA, 19 bp, Homo sapiens
cctgggacccttggctatg

SEQ ID NO: 4381342 - DNA, 18 bp, Homo sapiens
cctgggagagtggacctg

SEQ ID NO: 4381343 - DNA, 22 bp, Homo sapiens
cctgggagagtggacctgtgct

SEQ ID NO: 4381344 - DNA, 17 bp, Homo sapiens
cctgggaggacaggcag

SEQ ID NO: 4381345 - DNA, 18 bp, Homo sapiens
cctgggaggacaggcagg

SEQ ID NO: 4381346 - DNA, 13 bp, Homo sapiens
cctgggcaaagcc

SEQ ID NO: 4381347 - DNA, 23 bp, Homo sapiens
cctgggcactccgcgccgatgcc

SEQ ID NO: 4381348 - DNA, 18 bp, Homo sapiens
cctgggcagccaggctgc

SEQ ID NO: 4381349 - DNA, 20 bp, Homo sapiens
cctgggcatcttctggcttg

SEQ ID NO: 4381350 - DNA, 19 bp, Homo sapiens
cctgggcatttggtgagag

SEQ ID NO: 4381351 - DNA, 15 bp, Homo sapiens
cctgggccccaccac

SEQ ID NO: 4381352 - DNA, 22 bp, Homo sapiens
cctgggcccctccacgcctcct

SEQ ID NO: 4381353 - DNA, 15 bp, Homo sapiens
cctgggcccctccct

SEQ ID NO: 4381354 - DNA, 22 bp, Homo sapiens
cctgggcccctccctacctcaa

SEQ ID NO: 4381355 - DNA, 18 bp, Homo sapiens
cctgggccctctctgctc

SEQ ID NO: 4381356 - DNA, 20 bp, Homo sapiens
cctgggccctgggctggcac

SEQ ID NO: 4381357 - DNA, 14 bp, Homo sapiens
cctgggcctcagtt

SEQ ID NO: 4381358 - DNA, 19 bp, Homo sapiens
cctgggcctttgcaagatg

SEQ ID NO: 4381359 - DNA, 23 bp, Homo sapiens
cctgggctcactgtgctggggca

SEQ ID NO: 4381360 - DNA, 16 bp, Homo sapiens
cctgggctcggaggct

SEQ ID NO: 4381361 - DNA, 18 bp, Homo sapiens
cctgggctcggaggctgc

SEQ ID NO: 4381362 - DNA, 12 bp, Homo sapiens
cctgggctgcca

SEQ ID NO: 4381363 - DNA, 21 bp, Homo sapiens
cctgggctggcacagcccctg

SEQ ID NO: 4381364 - DNA, 21 bp, Homo sapiens
cctgggcttggcctgctgtga

SEQ ID NO: 4381365 - DNA, 22 bp, Homo sapiens
cctggggacttcaactgcccag

SEQ ID NO: 4381366 - DNA, 13 bp, Homo sapiens
cctggggagccca

SEQ ID NO: 4381367 - DNA, 15 bp, Homo sapiens
cctggggagctcctg

SEQ ID NO: 4381368 - DNA, 16 bp, Homo sapiens
cctggggagctcctgg

SEQ ID NO: 4381369 - DNA, 19 bp, Homo sapiens
cctggggcccagcccctgt

SEQ ID NO: 4381370 - DNA, 19 bp, Homo sapiens
cctggggctgagtctccag

SEQ ID NO: 4381371 - DNA, 16 bp, Homo sapiens
cctgggggaagccctg

SEQ ID NO: 4381372 - DNA, 18 bp, Homo sapiens
cctgggggaagccctgga

SEQ ID NO: 4381373 - DNA, 16 bp, Homo sapiens
cctgggggtgccagga

SEQ ID NO: 4381374 - DNA, 22 bp, Homo sapiens
cctgggggtggcaggcacacag

SEQ ID NO: 4381375 - DNA, 15 bp, Homo sapiens
cctggggtgcatctc

SEQ ID NO: 4381376 - DNA, 17 bp, Homo sapiens
cctgggtaagaagggtg

SEQ ID NO: 4381377 - DNA, 19 bp, Homo sapiens
cctgggtaagaagggtggg

SEQ ID NO: 4381378 - DNA, 19 bp, Homo sapiens
cctgggtcaaaaaaaagaa

SEQ ID NO: 4381379 - DNA, 19 bp, Homo sapiens
cctgggtcacagagtgaga

SEQ ID NO: 4381380 - DNA, 16 bp, Homo sapiens
cctgggtcatgggcct

SEQ ID NO: 4381381 - DNA, 22 bp, Homo sapiens
cctgggtcatgggcctgtgggg

SEQ ID NO: 4381382 - DNA, 23 bp, Homo sapiens
cctgggtggggctgctcctccag

SEQ ID NO: 4381383 - DNA, 20 bp, Homo sapiens
cctgggtgtcaagtgcctgc

SEQ ID NO: 4381384 - DNA, 21 bp, Homo sapiens
cctgggtgtcaagtgcctgca

SEQ ID NO: 4381385 - DNA, 18 bp, Homo sapiens
cctggtagaggggccggc

SEQ ID NO: 4381386 - DNA, 23 bp, Homo sapiens
cctggtcaccgagactcagcctc

SEQ ID NO: 4381387 - DNA, 13 bp, Homo sapiens
cctggtccttccc

SEQ ID NO: 4381388 - DNA, 22 bp, Homo sapiens
cctggtccttccctgatggcct

SEQ ID NO: 4381389 - DNA, 22 bp, Homo sapiens
cctggtctggttgggcagccag

SEQ ID NO: 4381390 - DNA, 20 bp, Homo sapiens
cctggtgcaggtctccacct

SEQ ID NO: 4381391 - DNA, 15 bp, Homo sapiens
cctggtgcccctgct

SEQ ID NO: 4381392 - DNA, 11 bp, Homo sapiens
cctggtgctgc

SEQ ID NO: 4381393 - DNA, 12 bp, Homo sapiens
cctggtgctgcc

SEQ ID NO: 4381394 - DNA, 14 bp, Homo sapiens
cctggtgctgccga

SEQ ID NO: 4381395 - DNA, 16 bp, Homo sapiens
cctggtgctgccgagg

SEQ ID NO: 4381396 - DNA, 22 bp, Homo sapiens
cctggtgctgccgagggctggc

SEQ ID NO: 4381397 - DNA, 14 bp, Homo sapiens
cctggtggcaccag

SEQ ID NO: 4381398 - DNA, 17 bp, Homo sapiens
cctggtggcaccagatg

SEQ ID NO: 4381399 - DNA, 22 bp, Homo sapiens
cctggtgggtccaggggcccct

SEQ ID NO: 4381400 - DNA, 18 bp, Homo sapiens
cctggtggtggctcggga

SEQ ID NO: 4381401 - DNA, 19 bp, Homo sapiens
cctggtgtttctagcactg

SEQ ID NO: 4381402 - DNA, 21 bp, Homo sapiens
cctggtgtttctagcactggc

SEQ ID NO: 4381403 - DNA, 22 bp, Homo sapiens
cctggtgtttctagcactggcc

SEQ ID NO: 4381404 - DNA, 16 bp, Homo sapiens
cctggttcatatttat

SEQ ID NO: 4381405 - DNA, 20 bp, Homo sapiens
cctggttgacccaaaaatgt

SEQ ID NO: 4381406 - DNA, 21 bp, Homo sapiens
cctgttgcacccagccctggt

SEQ ID NO: 4381407 - DNA, 16 bp, Homo sapiens
cctgttggcaggccca

SEQ ID NO: 4381408 - DNA, 14 bp, Homo sapiens
cctgtttaaaaaac

SEQ ID NO: 4381409 - DNA, 16 bp, Homo sapiens
cctgtttaaaaaacca

SEQ ID NO: 4381410 - DNA, 17 bp, Homo sapiens
cctgtttattccaaatg

SEQ ID NO: 4381411 - DNA, 21 bp, Homo sapiens
cctgtttctggaagactgctc

SEQ ID NO: 4381412 - DNA, 17 bp, Homo sapiens
cctgtttgaaggggaga

SEQ ID NO: 4381413 - DNA, 19 bp, Homo sapiens
cctgtttgaggaaagcaag

SEQ ID NO: 4381414 - DNA, 22 bp, Homo sapiens
cctgttttatatattatgtgaa

SEQ ID NO: 4381415 - DNA, 13 bp, Homo sapiens
cctgtttttcaca

SEQ ID NO: 4381416 - DNA, 12 bp, Homo sapiens
ccttaaaaatgc

SEQ ID NO: 4381417 - DNA, 15 bp, Homo sapiens
ccttaaaaccaaaga

SEQ ID NO: 4381418 - DNA, 15 bp, Homo sapiens
ccttaaacacaggct

SEQ ID NO: 4381419 - DNA, 18 bp, Homo sapiens
ccttaaactctggacact

SEQ ID NO: 4381420 - DNA, 13 bp, Homo sapiens
ccttaaattaaac

SEQ ID NO: 4381421 - DNA, 18 bp, Homo sapiens
ccttaaattaaacaattt

SEQ ID NO: 4381422 - DNA, 16 bp, Homo sapiens
ccttaacagttgtatt

SEQ ID NO: 4381423 - DNA, 14 bp, Homo sapiens
ccttaacccacctc

SEQ ID NO: 4381424 - DNA, 12 bp, Homo sapiens
ccttaactgaca

SEQ ID NO: 4381425 - DNA, 16 bp, Homo sapiens
ccttaactgcatccag

SEQ ID NO: 4381426 - DNA, 15 bp, Homo sapiens
ccttaagcagcaaca

SEQ ID NO: 4381427 - DNA, 14 bp, Homo sapiens
ccttaaggtctcca

SEQ ID NO: 4381428 - DNA, 12 bp, Homo sapiens
ccttaataataa

SEQ ID NO: 4381429 - DNA, 15 bp, Homo sapiens
ccttaatatttcttc

SEQ ID NO: 4381430 - DNA, 19 bp, Homo sapiens
ccttaatctaatctaaaag

SEQ ID NO: 4381431 - DNA, 23 bp, Homo sapiens
ccttaatctaatctaaaagctct

SEQ ID NO: 4381432 - DNA, 16 bp, Homo sapiens
ccttaatgacaacact

SEQ ID NO: 4381433 - DNA, 18 bp, Homo sapiens
ccttaatgacaacactta

SEQ ID NO: 4381434 - DNA, 19 bp, Homo sapiens
ccttaatttcctttttgac

SEQ ID NO: 4381435 - DNA, 22 bp, Homo sapiens
ccttaatttcctttttgacact

SEQ ID NO: 4381436 - DNA, 22 bp, Homo sapiens
ccttacaacgccgagtgcactg

SEQ ID NO: 4381437 - DNA, 17 bp, Homo sapiens
ccttacagtaggagccc

SEQ ID NO: 4381438 - DNA, 20 bp, Homo sapiens
ccttacccctggctgtttgg

SEQ ID NO: 4381439 - DNA, 14 bp, Homo sapiens
ccttacctcctgcc

SEQ ID NO: 4381440 - DNA, 16 bp, Homo sapiens
ccttacctcctgccca

SEQ ID NO: 4381441 - DNA, 15 bp, Homo sapiens
ccttactcacctctc

SEQ ID NO: 4381442 - DNA, 17 bp, Homo sapiens
ccttactcctctttcct

SEQ ID NO: 4381443 - DNA, 17 bp, Homo sapiens
ccttactcttcttgaaa

SEQ ID NO: 4381444 - DNA, 17 bp, Homo sapiens
ccttagaaaaaaaaaga

SEQ ID NO: 4381445 - DNA, 16 bp, Homo sapiens
ccttagactcttttcc

SEQ ID NO: 4381446 - DNA, 17 bp, Homo sapiens
ccttagactcttttcct

SEQ ID NO: 4381447 - DNA, 13 bp, Homo sapiens
ccttagcctctcc

SEQ ID NO: 4381448 - DNA, 21 bp, Homo sapiens
ccttagcgttctggactctgc

SEQ ID NO: 4381449 - DNA, 22 bp, Homo sapiens
ccttaggatggggctcccagct

SEQ ID NO: 4381450 - DNA, 14 bp, Homo sapiens
ccttaggcctctga

SEQ ID NO: 4381451 - DNA, 18 bp, Homo sapiens
ccttagggaagctggcct

SEQ ID NO: 4381452 - DNA, 21 bp, Homo sapiens
ccttagggaagctggcctgag

SEQ ID NO: 4381453 - DNA, 20 bp, Homo sapiens
ccttaggggagctgaaataa

SEQ ID NO: 4381454 - DNA, 16 bp, Homo sapiens
ccttaggtttgacatg

SEQ ID NO: 4381455 - DNA, 14 bp, Homo sapiens
ccttatagttactg

SEQ ID NO: 4381456 - DNA, 19 bp, Homo sapiens
ccttatcacagaaataaaa

SEQ ID NO: 4381457 - DNA, 20 bp, Homo sapiens
ccttatcacagaaataaaat

SEQ ID NO: 4381458 - DNA, 23 bp, Homo sapiens
ccttatgcccggcgccgggcacc

SEQ ID NO: 4381459 - DNA, 17 bp, Homo sapiens
ccttatgtgttacatta

SEQ ID NO: 4381460 - DNA, 21 bp, Homo sapiens
ccttattagagtgtctttcca

SEQ ID NO: 4381461 - DNA, 16 bp, Homo sapiens
ccttatttatttttgt

SEQ ID NO: 4381462 - DNA, 14 bp, Homo sapiens
ccttatttgccttc

SEQ ID NO: 4381463 - DNA, 16 bp, Homo sapiens
ccttatttgccttcta

SEQ ID NO: 4381464 - DNA, 11 bp, Homo sapiens
ccttatttgtc

SEQ ID NO: 4381465 - DNA, 19 bp, Homo sapiens
ccttatttgtctgtaaaaa

SEQ ID NO: 4381466 - DNA, 21 bp, Homo sapiens
ccttcaaggactgtttcagtg

SEQ ID NO: 4381467 - DNA, 22 bp, Homo sapiens
ccttcaaggactgtttcagtgt

SEQ ID NO: 4381468 - DNA, 14 bp, Homo sapiens
ccttcaagtgccaa

SEQ ID NO: 4381469 - DNA, 16 bp, Homo sapiens
ccttcaagtgccaaac

SEQ ID NO: 4381470 - DNA, 14 bp, Homo sapiens
ccttcactgggcca

SEQ ID NO: 4381471 - DNA, 17 bp, Homo sapiens
ccttcagaacagaggca

SEQ ID NO: 4381472 - DNA, 14 bp, Homo sapiens
ccttcagccctcac

SEQ ID NO: 4381473 - DNA, 13 bp, Homo sapiens
ccttcagccttaa

SEQ ID NO: 4381474 - DNA, 23 bp, Homo sapiens
ccttcagctctggggcagaggaa

SEQ ID NO: 4381475 - DNA, 13 bp, Homo sapiens
ccttcaggactct

SEQ ID NO: 4381476 - DNA, 15 bp, Homo sapiens
ccttcaggactctgc

SEQ ID NO: 4381477 - DNA, 19 bp, Homo sapiens
ccttcagggagacaggcag

SEQ ID NO: 4381478 - DNA, 15 bp, Homo sapiens
ccttcagtgagcccc

SEQ ID NO: 4381479 - DNA, 17 bp, Homo sapiens
ccttcagtgagcccctc

SEQ ID NO: 4381480 - DNA, 19 bp, Homo sapiens
ccttcagtgagcccctccc

SEQ ID NO: 4381481 - DNA, 13 bp, Homo sapiens
ccttcatgggtgg

SEQ ID NO: 4381482 - DNA, 11 bp, Homo sapiens
ccttcatttaa

SEQ ID NO: 4381483 - DNA, 17 bp, Homo sapiens
ccttccaacttcctgtg

SEQ ID NO: 4381484 - DNA, 19 bp, Homo sapiens
ccttccacagctggcctgg

SEQ ID NO: 4381485 - DNA, 13 bp, Homo sapiens
ccttccacccagt

SEQ ID NO: 4381486 - DNA, 17 bp, Homo sapiens
ccttccactgagggcag

SEQ ID NO: 4381487 - DNA, 18 bp, Homo sapiens
ccttccatactgtttgcc

SEQ ID NO: 4381488 - DNA, 19 bp, Homo sapiens
ccttccatctcttccttca

SEQ ID NO: 4381489 - DNA, 17 bp, Homo sapiens
ccttccatgtgcctttc

SEQ ID NO: 4381490 - DNA, 23 bp, Homo sapiens
ccttccatgtgcctttctttgcc

SEQ ID NO: 4381491 - DNA, 20 bp, Homo sapiens
ccttcccaaggttactcagc

SEQ ID NO: 4381492 - DNA, 13 bp, Homo sapiens
ccttcccacatgc

SEQ ID NO: 4381493 - DNA, 15 bp, Homo sapiens
ccttcccacatgcct

SEQ ID NO: 4381494 - DNA, 16 bp, Homo sapiens
ccttcccacatgcctg

SEQ ID NO: 4381495 - DNA, 13 bp, Homo sapiens
ccttcccagctct

SEQ ID NO: 4381496 - DNA, 14 bp, Homo sapiens
ccttcccagctctc

SEQ ID NO: 4381497 - DNA, 18 bp, Homo sapiens
ccttcccagctctccctc

SEQ ID NO: 4381498 - DNA, 19 bp, Homo sapiens
ccttcccagctctccctct

SEQ ID NO: 4381499 - DNA, 11 bp, Homo sapiens
ccttcccaggg

SEQ ID NO: 4381500 - DNA, 14 bp, Homo sapiens
ccttcccagggcac

SEQ ID NO: 4381501 - DNA, 22 bp, Homo sapiens
ccttcccagggcacccaggcag

SEQ ID NO: 4381502 - DNA, 14 bp, Homo sapiens
ccttcccatttctt

SEQ ID NO: 4381503 - DNA, 15 bp, Homo sapiens
ccttcccatttcttc

SEQ ID NO: 4381504 - DNA, 13 bp, Homo sapiens
ccttccccagacc

SEQ ID NO: 4381505 - DNA, 17 bp, Homo sapiens
ccttccccagacccaga

SEQ ID NO: 4381506 - DNA, 21 bp, Homo sapiens
ccttcccccatccctaccact

SEQ ID NO: 4381507 - DNA, 15 bp, Homo sapiens
ccttcccctccctgt

SEQ ID NO: 4381508 - DNA, 14 bp, Homo sapiens
ccttccccttctgt

SEQ ID NO: 4381509 - DNA, 15 bp, Homo sapiens
ccttccctagcttta

SEQ ID NO: 4381510 - DNA, 14 bp, Homo sapiens
ccttccctcctttt

SEQ ID NO: 4381511 - DNA, 16 bp, Homo sapiens
ccttccctctctccct

SEQ ID NO: 4381512 - DNA, 18 bp, Homo sapiens
ccttccctctctccctgc

SEQ ID NO: 4381513 - DNA, 20 bp, Homo sapiens
ccttccctctctccctgcct

SEQ ID NO: 4381514 - DNA, 22 bp, Homo sapiens
ccttccctctctccctgcctca

SEQ ID NO: 4381515 - DNA, 23 bp, Homo sapiens
ccttccctgatggcctttggacc

SEQ ID NO: 4381516 - DNA, 12 bp, Homo sapiens
ccttccctggcc

SEQ ID NO: 4381517 - DNA, 13 bp, Homo sapiens
ccttccctggccc

SEQ ID NO: 4381518 - DNA, 23 bp, Homo sapiens
ccttccctgttctccctttctct

SEQ ID NO: 4381519 - DNA, 22 bp, Homo sapiens
ccttcccttttctgttctagtt

SEQ ID NO: 4381520 - DNA, 14 bp, Homo sapiens
ccttcctcctgcag

SEQ ID NO: 4381521 - DNA, 17 bp, Homo sapiens
ccttcctctcaagctag

SEQ ID NO: 4381522 - DNA, 14 bp, Homo sapiens
ccttcctgctgctg

SEQ ID NO: 4381523 - DNA, 16 bp, Homo sapiens
ccttcctgctgctgct

SEQ ID NO: 4381524 - DNA, 12 bp, Homo sapiens
ccttcctggcac

SEQ ID NO: 4381525 - DNA, 13 bp, Homo sapiens
cctttattttaga

SEQ ID NO: 4381526 - DNA, 15 bp, Homo sapiens
cctttcaaatttaga

SEQ ID NO: 4381527 - DNA, 21 bp, Homo sapiens
cctttcaaatttagaaactaa

SEQ ID NO: 4381528 - DNA, 19 bp, Homo sapiens
cctttcaccctcatgaaaa

SEQ ID NO: 4381529 - DNA, 14 bp, Homo sapiens
cctttcagatgtct

SEQ ID NO: 4381530 - DNA, 20 bp, Homo sapiens
cctttcagatgtcttctgcc

SEQ ID NO: 4381531 - DNA, 22 bp, Homo sapiens
cctttcagatgtcttctgcctg

SEQ ID NO: 4381532 - DNA, 15 bp, Homo sapiens
cctttccaatagaaa

SEQ ID NO: 4381533 - DNA, 13 bp, Homo sapiens
cctttcccctaga

SEQ ID NO: 4381534 - DNA, 21 bp, Homo sapiens
cctttccctcaccccctccca

SEQ ID NO: 4381535 - DNA, 16 bp, Homo sapiens
cctttccgctgtcgcc

SEQ ID NO: 4381536 - DNA, 15 bp, Homo sapiens
cctttcctgttcagc

SEQ ID NO: 4381537 - DNA, 13 bp, Homo sapiens
cctttccttcctt

SEQ ID NO: 4381538 - DNA, 11 bp, Homo sapiens
cctttctcagg

SEQ ID NO: 4381539 - DNA, 19 bp, Homo sapiens
cctttctcccctgccccca

SEQ ID NO: 4381540 - DNA, 13 bp, Homo sapiens
cctttctcctgtg

SEQ ID NO: 4381541 - DNA, 13 bp, Homo sapiens
cctttctggaagt

SEQ ID NO: 4381542 - DNA, 19 bp, Homo sapiens
cctttctggaagtttctgg

SEQ ID NO: 4381543 - DNA, 13 bp, Homo sapiens
cctttctgtccca

SEQ ID NO: 4381544 - DNA, 14 bp, Homo sapiens
cctttctgtcccac

SEQ ID NO: 4381545 - DNA, 16 bp, Homo sapiens
cctttcttcctattta

SEQ ID NO: 4381546 - DNA, 16 bp, Homo sapiens
cctttctttgcctctg

SEQ ID NO: 4381547 - DNA, 12 bp, Homo sapiens
cctttcttttcc

SEQ ID NO: 4381548 - DNA, 16 bp, Homo sapiens
cctttctttttcttct

SEQ ID NO: 4381549 - DNA, 18 bp, Homo sapiens
cctttgaatgttaatttt

SEQ ID NO: 4381550 - DNA, 22 bp, Homo sapiens
cctttgcagttggactctcagg

SEQ ID NO: 4381551 - DNA, 15 bp, Homo sapiens
cctttgccagcagag

SEQ ID NO: 4381552 - DNA, 19 bp, Homo sapiens
cctttgccagcagagccag

SEQ ID NO: 4381553 - DNA, 20 bp, Homo sapiens
cctttgccagcagagccagg

SEQ ID NO: 4381554 - DNA, 19 bp, Homo sapiens
cctttgccgtgagcatgca

SEQ ID NO: 4381555 - DNA, 13 bp, Homo sapiens
cctttggacccag

SEQ ID NO: 4381556 - DNA, 18 bp, Homo sapiens
cctttggacccagggcct

SEQ ID NO: 4381557 - DNA, 12 bp, Homo sapiens
cctttggcctgg

SEQ ID NO: 4381558 - DNA, 21 bp, Homo sapiens
cctttggcctggggtgcatct

SEQ ID NO: 4381559 - DNA, 22 bp, Homo sapiens
cctttggcctggggtgcatctc

SEQ ID NO: 4381560 - DNA, 23 bp, Homo sapiens
cctttggcctggggtgcatctcc

SEQ ID NO: 4381561 - DNA, 22 bp, Homo sapiens
cctttggctggtagcagcaggc

SEQ ID NO: 4381562 - DNA, 15 bp, Homo sapiens
cctttgtgcagcttc

SEQ ID NO: 4381563 - DNA, 12 bp, Homo sapiens
cctttgtgctgc

SEQ ID NO: 4381564 - DNA, 14 bp, Homo sapiens
cctttgtttcttgt

SEQ ID NO: 4381565 - DNA, 12 bp, Homo sapiens
ccttttaaaatg

SEQ ID NO: 4381566 - DNA, 22 bp, Homo sapiens
ccttttagtttgatcagacagc

SEQ ID NO: 4381567 - DNA, 16 bp, Homo sapiens
ccttttatgaatcaaa

SEQ ID NO: 4381568 - DNA, 22 bp, Homo sapiens
ccttttatgtagtaattgacat

SEQ ID NO: 4381569 - DNA, 23 bp, Homo sapiens
ccttttattataagtcttacata

SEQ ID NO: 4381570 - DNA, 15 bp, Homo sapiens
ccttttattgacaca

SEQ ID NO: 4381571 - DNA, 14 bp, Homo sapiens
ccttttcaggaaaa

SEQ ID NO: 4381572 - DNA, 17 bp, Homo sapiens
ccttttcctatccttat

SEQ ID NO: 4381573 - DNA, 15 bp, Homo sapiens
ccttttcgtttagaa

SEQ ID NO: 4381574 - DNA, 11 bp, Homo sapiens
ccttttgctct

SEQ ID NO: 4381575 - DNA, 14 bp, Homo sapiens
ccttttgctctctg

SEQ ID NO: 4381576 - DNA, 11 bp, Homo sapiens
ccttttggaac

SEQ ID NO: 4381577 - DNA, 13 bp, Homo sapiens
ccttttggcctgg

SEQ ID NO: 4381578 - DNA, 12 bp, Homo sapiens
ccttttggggga

SEQ ID NO: 4381579 - DNA, 13 bp, Homo sapiens
ccttttgttttct

SEQ ID NO: 4381580 - DNA, 11 bp, Homo sapiens
cctttttaagg

SEQ ID NO: 4381581 - DNA, 17 bp, Homo sapiens
cctttttattcctttta

SEQ ID NO: 4381582 - DNA, 12 bp, Homo sapiens
cctttttcaatg

SEQ ID NO: 4381583 - DNA, 13 bp, Homo sapiens
cctttttgacact

SEQ ID NO: 4381584 - DNA, 22 bp, Homo sapiens
ccttttttaggaagcaagctta

SEQ ID NO: 4381585 - DNA, 14 bp, Homo sapiens
ccttttttcaatat

SEQ ID NO: 4381586 - DNA, 22 bp, Homo sapiens
ccttttttctatatcaaaaaac

SEQ ID NO: 4381587 - DNA, 22 bp, Homo sapiens
ccttttttgttttttcaaaata

SEQ ID NO: 4381588 - DNA, 18 bp, Homo sapiens
cctttttttccatcttta

SEQ ID NO: 4381589 - DNA, 19 bp, Homo sapiens
cgaaaaaataattatttat

SEQ ID NO: 4381590 - DNA, 12 bp, Homo sapiens
cgaaaacattgt

SEQ ID NO: 4381591 - DNA, 18 bp, Homo sapiens
cgaaatccaagatgctgg

SEQ ID NO: 4381592 - DNA, 14 bp, Homo sapiens
cgaacccacctgct

SEQ ID NO: 4381593 - DNA, 17 bp, Homo sapiens
cgaagcgttgtcctcag

SEQ ID NO: 4381594 - DNA, 21 bp, Homo sapiens
cgaagcgttgtcctcagcccc

SEQ ID NO: 4381595 - DNA, 14 bp, Homo sapiens
cgaaggcataataa

SEQ ID NO: 4381596 - DNA, 22 bp, Homo sapiens
cgaagtggactggcccctgggt

SEQ ID NO: 4381597 - DNA, 13 bp, Homo sapiens
cgaataaatgttc

SEQ ID NO: 4381598 - DNA, 19 bp, Homo sapiens
cgaataaatgttcaaactg

SEQ ID NO: 4381599 - DNA, 17 bp, Homo sapiens
cgaatctactaattcca

SEQ ID NO: 4381600 - DNA, 20 bp, Homo sapiens
cgaatcttatttttcctgtc

SEQ ID NO: 4381601 - DNA, 17 bp, Homo sapiens
cgaatttggtacacatg

SEQ ID NO: 4381602 - DNA, 19 bp, Homo sapiens
cgaatttggtacacatgtg

SEQ ID NO: 4381603 - DNA, 20 bp, Homo sapiens
cgaatttggtacacatgtgt

SEQ ID NO: 4381604 - DNA, 16 bp, Homo sapiens
cgacaaaggccacagg

SEQ ID NO: 4381605 - DNA, 21 bp, Homo sapiens
cgacactgagctgtgacccag

SEQ ID NO: 4381606 - DNA, 22 bp, Homo sapiens
cgacagacatggacaaggagct

SEQ ID NO: 4381607 - DNA, 16 bp, Homo sapiens
cgaccacccctgcctc

SEQ ID NO: 4381608 - DNA, 14 bp, Homo sapiens
cgaccacttccagg

SEQ ID NO: 4381609 - DNA, 20 bp, Homo sapiens
cgacccagaatggagcctgc

SEQ ID NO: 4381610 - DNA, 22 bp, Homo sapiens
cgacccctcctgcccctctctc

SEQ ID NO: 4381611 - DNA, 16 bp, Homo sapiens
cgacctccccacccgc

SEQ ID NO: 4381612 - DNA, 23 bp, Homo sapiens
cgacctcgtcctccccctgccag

SEQ ID NO: 4381613 - DNA, 12 bp, Homo sapiens
cgactccagcca

SEQ ID NO: 4381614 - DNA, 15 bp, Homo sapiens
cgactccagccagcg

SEQ ID NO: 4381615 - DNA, 20 bp, Homo sapiens
cgactctgctgctcatggga

SEQ ID NO: 4381616 - DNA, 19 bp, Homo sapiens
cgactctttctgagtgcct

SEQ ID NO: 4381617 - DNA, 11 bp, Homo sapiens
cgactgcccag

SEQ ID NO: 4381618 - DNA, 12 bp, Homo sapiens
cgactgcccaga

SEQ ID NO: 4381619 - DNA, 13 bp, Homo sapiens
cgactgcccctgc

SEQ ID NO: 4381620 - DNA, 13 bp, Homo sapiens
cgactggactgtc

SEQ ID NO: 4381621 - DNA, 20 bp, Homo sapiens
cgactggccagggccacgct

SEQ ID NO: 4381622 - DNA, 19 bp, Homo sapiens
cgactgtcagtggggcagc

SEQ ID NO: 4381623 - DNA, 21 bp, Homo sapiens
cgacttttaactatgtaataa

SEQ ID NO: 4381624 - DNA, 19 bp, Homo sapiens
cgagaaagaggcaccagga

SEQ ID NO: 4381625 - DNA, 15 bp, Homo sapiens
cgagacaacagcaca

SEQ ID NO: 4381626 - DNA, 18 bp, Homo sapiens
cgagacaacagcacacag

SEQ ID NO: 4381627 - DNA, 13 bp, Homo sapiens
cgagacactttat

SEQ ID NO: 4381628 - DNA, 22 bp, Homo sapiens
cgagaccacccaacctcaccct

SEQ ID NO: 4381629 - DNA, 15 bp, Homo sapiens
cgagactcagcctct

SEQ ID NO: 4381630 - DNA, 20 bp, Homo sapiens
cgagactcagcctctgctgg

SEQ ID NO: 4381631 - DNA, 16 bp, Homo sapiens
cgagagatcaaagatg

SEQ ID NO: 4381632 - DNA, 19 bp, Homo sapiens
cgagagcctgctcccccac

SEQ ID NO: 4381633 - DNA, 13 bp, Homo sapiens
cgagagggagaga

SEQ ID NO: 4381634 - DNA, 20 bp, Homo sapiens
cgagagtagccgagagcctg

SEQ ID NO: 4381635 - DNA, 13 bp, Homo sapiens
cgagatcccaaca

SEQ ID NO: 4381636 - DNA, 21 bp, Homo sapiens
cgagatcccaacactgccagc

SEQ ID NO: 4381637 - DNA, 18 bp, Homo sapiens
cgagcacatagagctttt

SEQ ID NO: 4381638 - DNA, 16 bp, Homo sapiens
cgagccacaagctgca

SEQ ID NO: 4381639 - DNA, 20 bp, Homo sapiens
cgagccaccatgcttgcctg

SEQ ID NO: 4381640 - DNA, 21 bp, Homo sapiens
cgagccatttgtcccaagtgc

SEQ ID NO: 4381641 - DNA, 12 bp, Homo sapiens
cgagcccagatg

SEQ ID NO: 4381642 - DNA, 17 bp, Homo sapiens
cgagccctgactcctgg

SEQ ID NO: 4381643 - DNA, 22 bp, Homo sapiens
cgagccctgactcctggactcc

SEQ ID NO: 4381644 - DNA, 12 bp, Homo sapiens
cgagctcctggg

SEQ ID NO: 4381645 - DNA, 15 bp, Homo sapiens
cgaggaaaggatttt

SEQ ID NO: 4381646 - DNA, 12 bp, Homo sapiens
cgaggacaggaa

SEQ ID NO: 4381647 - DNA, 11 bp, Homo sapiens
cgaggagctgg

SEQ ID NO: 4381648 - DNA, 14 bp, Homo sapiens
cgaggagctgggcc

SEQ ID NO: 4381649 - DNA, 15 bp, Homo sapiens
cgaggaggaggagta

SEQ ID NO: 4381650 - DNA, 15 bp, Homo sapiens
cgaggctacagctcc

SEQ ID NO: 4381651 - DNA, 18 bp, Homo sapiens
cgaggctccccgcctcca

SEQ ID NO: 4381652 - DNA, 22 bp, Homo sapiens
cgaggctccccgcctccactct

SEQ ID NO: 4381653 - DNA, 13 bp, Homo sapiens
cgagggaagcagt

SEQ ID NO: 4381654 - DNA, 19 bp, Homo sapiens
cgagggaggaacacctgat

SEQ ID NO: 4381655 - DNA, 11 bp, Homo sapiens
cgagggctggc

SEQ ID NO: 4381656 - DNA, 14 bp, Homo sapiens
cgagggctggccgg

SEQ ID NO: 4381657 - DNA, 19 bp, Homo sapiens
cgagggctggctggcctca

SEQ ID NO: 4381658 - DNA, 22 bp, Homo sapiens
cgaggggcccagggaagcctgg

SEQ ID NO: 4381659 - DNA, 18 bp, Homo sapiens
cgagggggctgctcccac

SEQ ID NO: 4381660 - DNA, 15 bp, Homo sapiens
cgagggtcctggctc

SEQ ID NO: 4381661 - DNA, 17 bp, Homo sapiens
cgaggtcaacagagaag

SEQ ID NO: 4381662 - DNA, 23 bp, Homo sapiens
cgaggtggatcacagaggcttct

SEQ ID NO: 4381663 - DNA, 16 bp, Homo sapiens
cgagtactgtgggcaa

SEQ ID NO: 4381664 - DNA, 17 bp, Homo sapiens
cgagtactgtgggcaat

SEQ ID NO: 4381665 - DNA, 22 bp, Homo sapiens
cgagtactgtgggcaatttaga

SEQ ID NO: 4381666 - DNA, 20 bp, Homo sapiens
cgagtcaatcccctcattca

SEQ ID NO: 4381667 - DNA, 23 bp, Homo sapiens
cgataagctttcaatagtggcat

SEQ ID NO: 4381668 - DNA, 13 bp, Homo sapiens
cgatacctggagc

SEQ ID NO: 4381669 - DNA, 15 bp, Homo sapiens
cgatatactctagat

SEQ ID NO: 4381670 - DNA, 21 bp, Homo sapiens
cgatcaagttgttgactgtga

SEQ ID NO: 4381671 - DNA, 12 bp, Homo sapiens
cgatcaggagga

SEQ ID NO: 4381672 - DNA, 14 bp, Homo sapiens
cgatgccaccggcc

SEQ ID NO: 4381673 - DNA, 13 bp, Homo sapiens
cgatggacctcag

SEQ ID NO: 4381674 - DNA, 13 bp, Homo sapiens
cgatgtggccctg

SEQ ID NO: 4381675 - DNA, 15 bp, Homo sapiens
cgatgtggccctggc

SEQ ID NO: 4381676 - DNA, 18 bp, Homo sapiens
cgatgtggccctggcctg

SEQ ID NO: 4381677 - DNA, 22 bp, Homo sapiens
cgatgtggccctggcctgctgg

SEQ ID NO: 4381678 - DNA, 20 bp, Homo sapiens
cgatgttgtcaaggatggtt

SEQ ID NO: 4381679 - DNA, 21 bp, Homo sapiens
cgattgcaggagtccctgcca

SEQ ID NO: 4381680 - DNA, 13 bp, Homo sapiens
cgattttgtctac

SEQ ID NO: 4381681 - DNA, 18 bp, Homo sapiens
cgcaacgtctaactggac

SEQ ID NO: 4381682 - DNA, 20 bp, Homo sapiens
cgcaagcctgtaatcccagc

SEQ ID NO: 4381683 - DNA, 21 bp, Homo sapiens
cgcaatatgggaggaacaaag

SEQ ID NO: 4381684 - DNA, 11 bp, Homo sapiens
cgcaatgtgac

SEQ ID NO: 4381685 - DNA, 15 bp, Homo sapiens
cgcaccaatcagcac

SEQ ID NO: 4381686 - DNA, 19 bp, Homo sapiens
cgcaccaatcagcactctg

SEQ ID NO: 4381687 - DNA, 22 bp, Homo sapiens
cgcaccactgcactccagcctg

SEQ ID NO: 4381688 - DNA, 14 bp, Homo sapiens
cgcaccccacagct

SEQ ID NO: 4381689 - DNA, 15 bp, Homo sapiens
cgcaccccacagctg

SEQ ID NO: 4381690 - DNA, 16 bp, Homo sapiens
cgcaccccacagctgg

SEQ ID NO: 4381691 - DNA, 16 bp, Homo sapiens
cgcaccctgtcctgca

SEQ ID NO: 4381692 - DNA, 14 bp, Homo sapiens
cgcactggacagca

SEQ ID NO: 4381693 - DNA, 13 bp, Homo sapiens
cgcagaagccctg

SEQ ID NO: 4381694 - DNA, 18 bp, Homo sapiens
cgcagacggtctgtgtgc

SEQ ID NO: 4381695 - DNA, 13 bp, Homo sapiens
cgcagagaggctc

SEQ ID NO: 4381696 - DNA, 14 bp, Homo sapiens
cgcagagctggccg

SEQ ID NO: 4381697 - DNA, 16 bp, Homo sapiens
cgcagagcttttcaga

SEQ ID NO: 4381698 - DNA, 15 bp, Homo sapiens
cgcagcccgcctgcc

SEQ ID NO: 4381699 - DNA, 16 bp, Homo sapiens
cgcagcccgcctgccg

SEQ ID NO: 4381700 - DNA, 19 bp, Homo sapiens
cgcagcccgcctgccgtgc

SEQ ID NO: 4381701 - DNA, 20 bp, Homo sapiens
cgcagccctagagcctgcct

SEQ ID NO: 4381702 - DNA, 14 bp, Homo sapiens
cgcagcctccaggg

SEQ ID NO: 4381703 - DNA, 18 bp, Homo sapiens
cgcagggaatgcagcagg

SEQ ID NO: 4381704 - DNA, 19 bp, Homo sapiens
cgcagggaatgcagcagga

SEQ ID NO: 4381705 - DNA, 18 bp, Homo sapiens
cgcagttgtgtggcccag

SEQ ID NO: 4381706 - DNA, 21 bp, Homo sapiens
cgcagttgtgtggcccagcac

SEQ ID NO: 4381707 - DNA, 23 bp, Homo sapiens
cgcatagtgtgctcggacacagt

SEQ ID NO: 4381708 - DNA, 13 bp, Homo sapiens
cgcatcttctcca

SEQ ID NO: 4381709 - DNA, 15 bp, Homo sapiens
cgcatcttctccatc

SEQ ID NO: 4381710 - DNA, 16 bp, Homo sapiens
cgcatcttctccatct

SEQ ID NO: 4381711 - DNA, 16 bp, Homo sapiens
cgcatgatggagctga

SEQ ID NO: 4381712 - DNA, 17 bp, Homo sapiens
cgcatgatggagctgat

SEQ ID NO: 4381713 - DNA, 12 bp, Homo sapiens
cgcattccctga

SEQ ID NO: 4381714 - DNA, 18 bp, Homo sapiens
cgccaatgttatgccagc

SEQ ID NO: 4381715 - DNA, 14 bp, Homo sapiens
cgccaccgtgcctg

SEQ ID NO: 4381716 - DNA, 15 bp, Homo sapiens
cgccacgtcccagca

SEQ ID NO: 4381717 - DNA, 17 bp, Homo sapiens
cgccacgtcccagcatc

SEQ ID NO: 4381718 - DNA, 16 bp, Homo sapiens
cgccactcatttcatc

SEQ ID NO: 4381719 - DNA, 15 bp, Homo sapiens
cgccactccctggga

SEQ ID NO: 4381720 - DNA, 20 bp, Homo sapiens
cgccactccctgggacacag

SEQ ID NO: 4381721 - DNA, 18 bp, Homo sapiens
cgccagcctcctctggac

SEQ ID NO: 4381722 - DNA, 21 bp, Homo sapiens
cgccagcctcctctggacggc

SEQ ID NO: 4381723 - DNA, 19 bp, Homo sapiens
cgccagctgggagcactgg

SEQ ID NO: 4381724 - DNA, 15 bp, Homo sapiens
cgccaggaagccaga

SEQ ID NO: 4381725 - DNA, 16 bp, Homo sapiens
cgccaggaagccagag

SEQ ID NO: 4381726 - DNA, 19 bp, Homo sapiens
cgccaggaagccagagccc

SEQ ID NO: 4381727 - DNA, 21 bp, Homo sapiens
cgccaggaagccagagcccca

SEQ ID NO: 4381728 - DNA, 14 bp, Homo sapiens
cgccattctcctgc

SEQ ID NO: 4381729 - DNA, 22 bp, Homo sapiens
cgccattctcctgcctcagcct

SEQ ID NO: 4381730 - DNA, 17 bp, Homo sapiens
cgccggggacagaggcc

SEQ ID NO: 4381731 - DNA, 19 bp, Homo sapiens
cgccggggacagaggcctg

SEQ ID NO: 4381732 - DNA, 14 bp, Homo sapiens
cgccgtgtttcctc

SEQ ID NO: 4381733 - DNA, 21 bp, Homo sapiens
cgcctagtggggtctccctct

SEQ ID NO: 4381734 - DNA, 20 bp, Homo sapiens
cgcctataatcccagctact

SEQ ID NO: 4381735 - DNA, 22 bp, Homo sapiens
cgcctcaatgtggttgcaaggc

SEQ ID NO: 4381736 - DNA, 17 bp, Homo sapiens
cgcctcagccctcagtt

SEQ ID NO: 4381737 - DNA, 15 bp, Homo sapiens
cgcctccactctagt

SEQ ID NO: 4381738 - DNA, 12 bp, Homo sapiens
cgcctccccacc

SEQ ID NO: 4381739 - DNA, 22 bp, Homo sapiens
cgcctccccctcccccattccc

SEQ ID NO: 4381740 - DNA, 20 bp, Homo sapiens
cgcctccctccaccccagga

SEQ ID NO: 4381741 - DNA, 13 bp, Homo sapiens
cgcctcctggcca

SEQ ID NO: 4381742 - DNA, 22 bp, Homo sapiens
cgcctcctggccagacgctgcc

SEQ ID NO: 4381743 - DNA, 20 bp, Homo sapiens
cgcctgacaccgtgggtcat

SEQ ID NO: 4381744 - DNA, 23 bp, Homo sapiens
cgcctgcaggcagagctggagcc

SEQ ID NO: 4381745 - DNA, 12 bp, Homo sapiens
cgcctgccaccg

SEQ ID NO: 4381746 - DNA, 15 bp, Homo sapiens
cgcctgccagtccta

SEQ ID NO: 4381747 - DNA, 23 bp, Homo sapiens
cgcctgcccgtctctctcccatg

SEQ ID NO: 4381748 - DNA, 17 bp, Homo sapiens
cgcctgccgtgcatggc

SEQ ID NO: 4381749 - DNA, 23 bp, Homo sapiens
cgcctgccgtgcatggctcctgt

SEQ ID NO: 4381750 - DNA, 18 bp, Homo sapiens
cgcctgctgcctgctgag

SEQ ID NO: 4381751 - DNA, 19 bp, Homo sapiens
cgcctgggtcatgggcctg

SEQ ID NO: 4381752 - DNA, 20 bp, Homo sapiens
cgcctgggtcatgggcctgt

SEQ ID NO: 4381753 - DNA, 21 bp, Homo sapiens
cgcctgggtcatgggcctgtg

SEQ ID NO: 4381754 - DNA, 22 bp, Homo sapiens
cgcctgggtcatgggcctgtgg

SEQ ID NO: 4381755 - DNA, 18 bp, Homo sapiens
cgcctgtcacaataaagt

SEQ ID NO: 4381756 - DNA, 22 bp, Homo sapiens
cgcctgtcacaataaagtttat

SEQ ID NO: 4381757 - DNA, 14 bp, Homo sapiens
cgccttcgtgcctg

SEQ ID NO: 4381758 - DNA, 19 bp, Homo sapiens
cgccttgaccttcccaagg

SEQ ID NO: 4381759 - DNA, 15 bp, Homo sapiens
cgccttgcccagcct

SEQ ID NO: 4381760 - DNA, 14 bp, Homo sapiens
cgccttggcctccc

SEQ ID NO: 4381761 - DNA, 16 bp, Homo sapiens
cgcgacttccacaaac

SEQ ID NO: 4381762 - DNA, 14 bp, Homo sapiens
cgcgatgggtcagg

SEQ ID NO: 4381763 - DNA, 18 bp, Homo sapiens
cgcgccccccgcgcccct

SEQ ID NO: 4381764 - DNA, 18 bp, Homo sapiens
cgcgccgatgccaccggc

SEQ ID NO: 4381765 - DNA, 21 bp, Homo sapiens
cgcgcgcccaccctccggcgg

SEQ ID NO: 4381766 - DNA, 15 bp, Homo sapiens
cgcgctcgcccagca

SEQ ID NO: 4381767 - DNA, 12 bp, Homo sapiens
cgcggccagccc

SEQ ID NO: 4381768 - DNA, 14 bp, Homo sapiens
cgcgggccaggagg

SEQ ID NO: 4381769 - DNA, 13 bp, Homo sapiens
cgcgggttctaga

SEQ ID NO: 4381770 - DNA, 12 bp, Homo sapiens
cgcgtcccagct

SEQ ID NO: 4381771 - DNA, 13 bp, Homo sapiens
cgcgtcccagctc

SEQ ID NO: 4381772 - DNA, 15 bp, Homo sapiens
cgctaacccccagcc

SEQ ID NO: 4381773 - DNA, 22 bp, Homo sapiens
cgctaacccccagcccacagag

SEQ ID NO: 4381774 - DNA, 20 bp, Homo sapiens
cgctatagttactgtcctgt

SEQ ID NO: 4381775 - DNA, 22 bp, Homo sapiens
cgctcaccgctggcccttagag

SEQ ID NO: 4381776 - DNA, 14 bp, Homo sapiens
cgctcagccccagg

SEQ ID NO: 4381777 - DNA, 23 bp, Homo sapiens
cgctcagctcatccatgcctcag

SEQ ID NO: 4381778 - DNA, 19 bp, Homo sapiens
cgctcaggggctccatgct

SEQ ID NO: 4381779 - DNA, 22 bp, Homo sapiens
cgctcaggggctccatgctggg

SEQ ID NO: 4381780 - DNA, 11 bp, Homo sapiens
cgctcatctgg

SEQ ID NO: 4381781 - DNA, 20 bp, Homo sapiens
cgctcccaggttcccccagc

SEQ ID NO: 4381782 - DNA, 16 bp, Homo sapiens
cgctcccgctcccagg

SEQ ID NO: 4381783 - DNA, 14 bp, Homo sapiens
cgctcgcccagcag

SEQ ID NO: 4381784 - DNA, 20 bp, Homo sapiens
cgctcgcccagcaggagaga

SEQ ID NO: 4381785 - DNA, 24 bp, Homo sapiens
cgctcggtctccaccccagggtca

SEQ ID NO: 4381786 - DNA, 20 bp, Homo sapiens
cgctctgcatgcggcccagc

SEQ ID NO: 4381787 - DNA, 21 bp, Homo sapiens
cgctctgcatgcggcccagcc

SEQ ID NO: 4381788 - DNA, 22 bp, Homo sapiens
cgctctgcatgcggcccagccc

SEQ ID NO: 4381789 - DNA, 16 bp, Homo sapiens
cgctctggatcctgca

SEQ ID NO: 4381790 - DNA, 18 bp, Homo sapiens
cgctctggatcctgcact

SEQ ID NO: 4381791 - DNA, 12 bp, Homo sapiens
cgctgaagatgg

SEQ ID NO: 4381792 - DNA, 20 bp, Homo sapiens
cgctgagcgcccccgagccc

SEQ ID NO: 4381793 - DNA, 22 bp, Homo sapiens
cgctgagcgcccccgagccctg

SEQ ID NO: 4381794 - DNA, 23 bp, Homo sapiens
cgctgagcgcccccgagccctga

SEQ ID NO: 4381795 - DNA, 18 bp, Homo sapiens
cgctgaggggtctcggat

SEQ ID NO: 4381796 - DNA, 15 bp, Homo sapiens
cgctgattcctcgtg

SEQ ID NO: 4381797 - DNA, 22 bp, Homo sapiens
cgctgcatacaggggaggggcg

SEQ ID NO: 4381798 - DNA, 21 bp, Homo sapiens
cgctgccagccttgagccctg

SEQ ID NO: 4381799 - DNA, 21 bp, Homo sapiens
cgctgccgcaccccagagtgt

SEQ ID NO: 4381800 - DNA, 16 bp, Homo sapiens
cgctgccgctgcacca

SEQ ID NO: 4381801 - DNA, 20 bp, Homo sapiens
cgctgcctaagtggctgctg

SEQ ID NO: 4381802 - DNA, 15 bp, Homo sapiens
cgctgcgcagcctcc

SEQ ID NO: 4381803 - DNA, 21 bp, Homo sapiens
cgctgcgcagcctccagggcc

SEQ ID NO: 4381804 - DNA, 18 bp, Homo sapiens
cgctgctacatcagactc

SEQ ID NO: 4381805 - DNA, 23 bp, Homo sapiens
cgctgctacatcagactctagaa

SEQ ID NO: 4381806 - DNA, 12 bp, Homo sapiens
cgctgctgtgct

SEQ ID NO: 4381807 - DNA, 14 bp, Homo sapiens
cgctgctgtgctct

SEQ ID NO: 4381808 - DNA, 20 bp, Homo sapiens
cgctggactctcagtctctg

SEQ ID NO: 4381809 - DNA, 19 bp, Homo sapiens
cgctgtcctctcgagccca

SEQ ID NO: 4381810 - DNA, 17 bp, Homo sapiens
cgctgtcgccccaggcc

SEQ ID NO: 4381811 - DNA, 23 bp, Homo sapiens
cgctgtcgccccaggccctccct

SEQ ID NO: 4381812 - DNA, 16 bp, Homo sapiens
cgctgttctgggcatg

SEQ ID NO: 4381813 - DNA, 17 bp, Homo sapiens
cgcttaaaggtgtcttc

SEQ ID NO: 4381814 - DNA, 16 bp, Homo sapiens
cgcttctctcttttaa

SEQ ID NO: 4381815 - DNA, 14 bp, Homo sapiens
cgcttctgagcagg

SEQ ID NO: 4381816 - DNA, 21 bp, Homo sapiens
cgcttgaccatgttgcactgt

SEQ ID NO: 4381817 - DNA, 15 bp, Homo sapiens
cgcttgctcgcttgc

SEQ ID NO: 4381818 - DNA, 19 bp, Homo sapiens
cgcttgctggaacacaggg

SEQ ID NO: 4381819 - DNA, 13 bp, Homo sapiens
cgcttgcttctgc

SEQ ID NO: 4381820 - DNA, 15 bp, Homo sapiens
cgcttgcttctgcag

SEQ ID NO: 4381821 - DNA, 14 bp, Homo sapiens
cgcttggagcagag

SEQ ID NO: 4381822 - DNA, 23 bp, Homo sapiens
cgcttttgccattagccaaggat

SEQ ID NO: 4381823 - DNA, 11 bp, Homo sapiens
cgctttttgaa

SEQ ID NO: 4381824 - DNA, 16 bp, Homo sapiens
cgctttttgaaaaagc

SEQ ID NO: 4381825 - DNA, 18 bp, Homo sapiens
cggaaagaagagcgagag

SEQ ID NO: 4381826 - DNA, 18 bp, Homo sapiens
cggaaggcgggctgagga

SEQ ID NO: 4381827 - DNA, 17 bp, Homo sapiens
cggaaggggttcctcaa

SEQ ID NO: 4381828 - DNA, 13 bp, Homo sapiens
cggacaaaatatc

SEQ ID NO: 4381829 - DNA, 20 bp, Homo sapiens
cggacaagacccccagcact

SEQ ID NO: 4381830 - DNA, 16 bp, Homo sapiens
cggacactcctagaga

SEQ ID NO: 4381831 - DNA, 16 bp, Homo sapiens
cggaccactcgaggcc

SEQ ID NO: 4381832 - DNA, 19 bp, Homo sapiens
cggaccactcgaggcctgc

SEQ ID NO: 4381833 - DNA, 12 bp, Homo sapiens
cggacccacccc

SEQ ID NO: 4381834 - DNA, 17 bp, Homo sapiens
cggacccaccccaactc

SEQ ID NO: 4381835 - DNA, 20 bp, Homo sapiens
cggacccaccccaactctcc

SEQ ID NO: 4381836 - DNA, 17 bp, Homo sapiens
cggacccttctgggtcc

SEQ ID NO: 4381837 - DNA, 19 bp, Homo sapiens
cggacccttctgggtccag

SEQ ID NO: 4381838 - DNA, 12 bp, Homo sapiens
cggactctgccc

SEQ ID NO: 4381839 - DNA, 13 bp, Homo sapiens
cggactgccaaat

SEQ ID NO: 4381840 - DNA, 19 bp, Homo sapiens
cggactgcccccagaaagc

SEQ ID NO: 4381841 - DNA, 14 bp, Homo sapiens
cggagaccctgagt

SEQ ID NO: 4381842 - DNA, 15 bp, Homo sapiens
cggagaccctgagtc

SEQ ID NO: 4381843 - DNA, 15 bp, Homo sapiens
cggagagcagcagca

SEQ ID NO: 4381844 - DNA, 19 bp, Homo sapiens
cggagattggacggcctga

SEQ ID NO: 4381845 - DNA, 19 bp, Homo sapiens
cggagcaggggtctgagcc

SEQ ID NO: 4381846 - DNA, 11 bp, Homo sapiens
cggagccactc

SEQ ID NO: 4381847 - DNA, 14 bp, Homo sapiens
cggagcccagcctg

SEQ ID NO: 4381848 - DNA, 19 bp, Homo sapiens
tgcctgcgcctgctgcctg

SEQ ID NO: 4381849 - DNA, 20 bp, Homo sapiens
tgcctgcgcctgctgcctgc

SEQ ID NO: 4381850 - DNA, 11 bp, Homo sapiens
tgcctgctcct

SEQ ID NO: 4381851 - DNA, 16 bp, Homo sapiens
tgcctgctccttggca

SEQ ID NO: 4381852 - DNA, 23 bp, Homo sapiens
tgcctgctgaatgatttccaaag

SEQ ID NO: 4381853 - DNA, 23 bp, Homo sapiens
tgcctggagacaaggtgctaaca

SEQ ID NO: 4381854 - DNA, 14 bp, Homo sapiens
tgcctggccagatt

SEQ ID NO: 4381855 - DNA, 14 bp, Homo sapiens
tgcctggccaggca

SEQ ID NO: 4381856 - DNA, 19 bp, Homo sapiens
tgcctggccccagcctggg

SEQ ID NO: 4381857 - DNA, 21 bp, Homo sapiens
tgcctggccgcagggcggggc

SEQ ID NO: 4381858 - DNA, 21 bp, Homo sapiens
tgcctgggaaggcgagtctgg

SEQ ID NO: 4381859 - DNA, 11 bp, Homo sapiens
tgcctgggaga

SEQ ID NO: 4381860 - DNA, 22 bp, Homo sapiens
tgcctgggtggggctgctcctc

SEQ ID NO: 4381861 - DNA, 18 bp, Homo sapiens
tgcctggttccctcccca

SEQ ID NO: 4381862 - DNA, 17 bp, Homo sapiens
tgcctgtaatcccagaa

SEQ ID NO: 4381863 - DNA, 19 bp, Homo sapiens
tgcctgtaatcccagaact

SEQ ID NO: 4381864 - DNA, 21 bp, Homo sapiens
tgcctgtagcaatggccagag

SEQ ID NO: 4381865 - DNA, 16 bp, Homo sapiens
tgcctgtagctttcct

SEQ ID NO: 4381866 - DNA, 23 bp, Homo sapiens
tgcctgtagctttcctggtccct

SEQ ID NO: 4381867 - DNA, 20 bp, Homo sapiens
tgcctgtagtcccagctact

SEQ ID NO: 4381868 - DNA, 18 bp, Homo sapiens
tgcctgtcaagttgtaca

SEQ ID NO: 4381869 - DNA, 22 bp, Homo sapiens
tgcctgtccccaaacaggacag

SEQ ID NO: 4381870 - DNA, 22 bp, Homo sapiens
tgcctgtgcccgcatgtgtgcc

SEQ ID NO: 4381871 - DNA, 13 bp, Homo sapiens
tgcctgtggcccc

SEQ ID NO: 4381872 - DNA, 15 bp, Homo sapiens
tgcctgtggcccctc

SEQ ID NO: 4381873 - DNA, 17 bp, Homo sapiens
tgcctgttaatttataa

SEQ ID NO: 4381874 - DNA, 21 bp, Homo sapiens
tgcctgttaatttataatgta

SEQ ID NO: 4381875 - DNA, 15 bp, Homo sapiens
tgcctgttggcaggc

SEQ ID NO: 4381876 - DNA, 20 bp, Homo sapiens
tgcctgttggcaggcccact

SEQ ID NO: 4381877 - DNA, 22 bp, Homo sapiens
tgcctgttggcaggcccactcc

SEQ ID NO: 4381878 - DNA, 16 bp, Homo sapiens
tgccttaaaaccaaag

SEQ ID NO: 4381879 - DNA, 14 bp, Homo sapiens
tgccttacctcctg

SEQ ID NO: 4381880 - DNA, 18 bp, Homo sapiens
tgccttactcttcttgaa

SEQ ID NO: 4381881 - DNA, 15 bp, Homo sapiens
tgccttagagccagg

SEQ ID NO: 4381882 - DNA, 17 bp, Homo sapiens
tgccttagagccaggca

SEQ ID NO: 4381883 - DNA, 14 bp, Homo sapiens
tgccttagcttcag

SEQ ID NO: 4381884 - DNA, 15 bp, Homo sapiens
tgccttatttgtctg

SEQ ID NO: 4381885 - DNA, 20 bp, Homo sapiens
tgccttcaaggactgtttca

SEQ ID NO: 4381886 - DNA, 18 bp, Homo sapiens
tgccttcactgggccagt

SEQ ID NO: 4381887 - DNA, 20 bp, Homo sapiens
tgccttccagatcctctctg

SEQ ID NO: 4381888 - DNA, 15 bp, Homo sapiens
tgccttcctgttttt

SEQ ID NO: 4381889 - DNA, 19 bp, Homo sapiens
tgccttctcaccagctgca

SEQ ID NO: 4381890 - DNA, 13 bp, Homo sapiens
tgccttctgggct

SEQ ID NO: 4381891 - DNA, 17 bp, Homo sapiens
tgccttctgggcttttt

SEQ ID NO: 4381892 - DNA, 22 bp, Homo sapiens
tgccttctgtggggactccggc

SEQ ID NO: 4381893 - DNA, 21 bp, Homo sapiens
tgccttcttcggggaactcct

SEQ ID NO: 4381894 - DNA, 23 bp, Homo sapiens
tgccttcttcggggaactcctgg

SEQ ID NO: 4381895 - DNA, 22 bp, Homo sapiens
tgccttctttagaccctcgggc

SEQ ID NO: 4381896 - DNA, 13 bp, Homo sapiens
tgccttgccctcc

SEQ ID NO: 4381897 - DNA, 16 bp, Homo sapiens
tgccttgccctcctgg

SEQ ID NO: 4381898 - DNA, 17 bp, Homo sapiens
tgccttgccctcctggg

SEQ ID NO: 4381899 - DNA, 23 bp, Homo sapiens
tgccttggaaatagaaagaagcc

SEQ ID NO: 4381900 - DNA, 15 bp, Homo sapiens
tgccttgggctgctc

SEQ ID NO: 4381901 - DNA, 16 bp, Homo sapiens
tgccttgggctgctcc

SEQ ID NO: 4381902 - DNA, 18 bp, Homo sapiens
tgccttggggaatttcct

SEQ ID NO: 4381903 - DNA, 19 bp, Homo sapiens
tgccttggggaatttcctc

SEQ ID NO: 4381904 - DNA, 15 bp, Homo sapiens
tgccttgtcacgcca

SEQ ID NO: 4381905 - DNA, 19 bp, Homo sapiens
tgcctttaaatctgtgatg

SEQ ID NO: 4381906 - DNA, 13 bp, Homo sapiens
tgcctttaatatt

SEQ ID NO: 4381907 - DNA, 19 bp, Homo sapiens
tgcctttaatattttgtaa

SEQ ID NO: 4381908 - DNA, 16 bp, Homo sapiens
tgcctttcctgttcag

SEQ ID NO: 4381909 - DNA, 12 bp, Homo sapiens
tgcctttctttg

SEQ ID NO: 4381910 - DNA, 14 bp, Homo sapiens
tgcctttctttgcc

SEQ ID NO: 4381911 - DNA, 12 bp, Homo sapiens
tgcctttgaatg

SEQ ID NO: 4381912 - DNA, 15 bp, Homo sapiens
tgccttttaagtttg

SEQ ID NO: 4381913 - DNA, 14 bp, Homo sapiens
tgccttttttgatc

SEQ ID NO: 4381914 - DNA, 21 bp, Homo sapiens
tgcgagacgcacacagctgag

SEQ ID NO: 4381915 - DNA, 23 bp, Homo sapiens
tgcgagacgcacacagctgagca

SEQ ID NO: 4381916 - DNA, 16 bp, Homo sapiens
tgcgagtccaaggcca

SEQ ID NO: 4381917 - DNA, 19 bp, Homo sapiens
tgcgcagcctccagggccc

SEQ ID NO: 4381918 - DNA, 20 bp, Homo sapiens
tgcgcccaccccgctctgca

SEQ ID NO: 4381919 - DNA, 21 bp, Homo sapiens
tgcgccccgcacgactgcggg

SEQ ID NO: 4381920 - DNA, 17 bp, Homo sapiens
tgcgcctcagccctcag

SEQ ID NO: 4381921 - DNA, 16 bp, Homo sapiens
tgcgcctgcaggcaga

SEQ ID NO: 4381922 - DNA, 17 bp, Homo sapiens
tgcgcctgcaggcagag

SEQ ID NO: 4381923 - DNA, 15 bp, Homo sapiens
tgcgcctgctgcctg

SEQ ID NO: 4381924 - DNA, 16 bp, Homo sapiens
tgcgccttcgtgcctg

SEQ ID NO: 4381925 - DNA, 15 bp, Homo sapiens
tgcggccaggcctgc

SEQ ID NO: 4381926 - DNA, 18 bp, Homo sapiens
tgcggccaggcctgcggg

SEQ ID NO: 4381927 - DNA, 19 bp, Homo sapiens
tgcggccgcattccctgag

SEQ ID NO: 4381928 - DNA, 14 bp, Homo sapiens
tgcggctttaaact

SEQ ID NO: 4381929 - DNA, 13 bp, Homo sapiens
tgcgggagccaga

SEQ ID NO: 4381930 - DNA, 16 bp, Homo sapiens
tgcgggatacagctga

SEQ ID NO: 4381931 - DNA, 14 bp, Homo sapiens
tgcgggatatttag

SEQ ID NO: 4381932 - DNA, 21 bp, Homo sapiens
tgcgggtcaacatttccaaaa

SEQ ID NO: 4381933 - DNA, 15 bp, Homo sapiens
tgcggtgggtgctgc

SEQ ID NO: 4381934 - DNA, 16 bp, Homo sapiens
tgcggttaattttgaa

SEQ ID NO: 4381935 - DNA, 21 bp, Homo sapiens
tgcgtacttgtaatatgtata

SEQ ID NO: 4381936 - DNA, 20 bp, Homo sapiens
tgcgtatgccaccaacttac

SEQ ID NO: 4381937 - DNA, 14 bp, Homo sapiens
tgcgtccaccctga

SEQ ID NO: 4381938 - DNA, 13 bp, Homo sapiens
tgcgtcccagcct

SEQ ID NO: 4381939 - DNA, 16 bp, Homo sapiens
tgcgtcctcctcacct

SEQ ID NO: 4381940 - DNA, 14 bp, Homo sapiens
tgcgtggaaatctc

SEQ ID NO: 4381941 - DNA, 20 bp, Homo sapiens
tgcgtggggcaggaaagcat

SEQ ID NO: 4381942 - DNA, 13 bp, Homo sapiens
tgcgttcaaagag

SEQ ID NO: 4381943 - DNA, 18 bp, Homo sapiens
tgcgttcccagaccatgg

SEQ ID NO: 4381944 - DNA, 23 bp, Homo sapiens
tgctaaaaatgagcttgattaaa

SEQ ID NO: 4381945 - DNA, 18 bp, Homo sapiens
tgctaaaagcatgtatag

SEQ ID NO: 4381946 - DNA, 23 bp, Homo sapiens
tgctaaaccaagttaagtcccat

SEQ ID NO: 4381947 - DNA, 12 bp, Homo sapiens
tgctaaagacat

SEQ ID NO: 4381948 - DNA, 16 bp, Homo sapiens
tgctaaagcctgtggg

SEQ ID NO: 4381949 - DNA, 19 bp, Homo sapiens
tgctaaagcctgtgggttt

SEQ ID NO: 4381950 - DNA, 16 bp, Homo sapiens
tgctaaaggaggccat

SEQ ID NO: 4381951 - DNA, 23 bp, Homo sapiens
tgctaaataaaatttgttgcata

SEQ ID NO: 4381952 - DNA, 16 bp, Homo sapiens
tgctaaatctcctatt

SEQ ID NO: 4381953 - DNA, 15 bp, Homo sapiens
tgctaaggcagctga

SEQ ID NO: 4381954 - DNA, 16 bp, Homo sapiens
tgctaaggctcctcct

SEQ ID NO: 4381955 - DNA, 19 bp, Homo sapiens
tgctaattcccaacatttc

SEQ ID NO: 4381956 - DNA, 13 bp, Homo sapiens
tgctaatttgttt

SEQ ID NO: 4381957 - DNA, 20 bp, Homo sapiens
tgctacaaaaacacagcaag

SEQ ID NO: 4381958 - DNA, 19 bp, Homo sapiens
tgctacatcagactctaga

SEQ ID NO: 4381959 - DNA, 15 bp, Homo sapiens
tgctacctcagtgct

SEQ ID NO: 4381960 - DNA, 17 bp, Homo sapiens
tgctacctcagtgctcc

SEQ ID NO: 4381961 - DNA, 18 bp, Homo sapiens
tgctactataatcaaatg

SEQ ID NO: 4381962 - DNA, 12 bp, Homo sapiens
tgctactccatg

SEQ ID NO: 4381963 - DNA, 13 bp, Homo sapiens
tgctactccatgc

SEQ ID NO: 4381964 - DNA, 14 bp, Homo sapiens
tgctactccatgca

SEQ ID NO: 4381965 - DNA, 18 bp, Homo sapiens
tgctactccatgcagggg

SEQ ID NO: 4381966 - DNA, 16 bp, Homo sapiens
tgctactcctgtgctc

SEQ ID NO: 4381967 - DNA, 17 bp, Homo sapiens
tgctactcctgtgctct

SEQ ID NO: 4381968 - DNA, 20 bp, Homo sapiens
tgctactgcactccagcctg

SEQ ID NO: 4381969 - DNA, 15 bp, Homo sapiens
tgctactgctcagct

SEQ ID NO: 4381970 - DNA, 16 bp, Homo sapiens
tgctactgctcagctt

SEQ ID NO: 4381971 - DNA, 22 bp, Homo sapiens
tgctactgtacataaacaatga

SEQ ID NO: 4381972 - DNA, 14 bp, Homo sapiens
tgctagaaattttc

SEQ ID NO: 4381973 - DNA, 15 bp, Homo sapiens
tgctagaaattttca

SEQ ID NO: 4381974 - DNA, 14 bp, Homo sapiens
tgctagagcagaca

SEQ ID NO: 4381975 - DNA, 16 bp, Homo sapiens
tgctagagcagacagg

SEQ ID NO: 4381976 - DNA, 14 bp, Homo sapiens
tgctagcacaatat

SEQ ID NO: 4381977 - DNA, 14 bp, Homo sapiens
tgctagcacagagg

SEQ ID NO: 4381978 - DNA, 15 bp, Homo sapiens
tgctagcacagaggc

SEQ ID NO: 4381979 - DNA, 16 bp, Homo sapiens
tgctagcacagaggcc

SEQ ID NO: 4381980 - DNA, 21 bp, Homo sapiens
tgctagcacagaggcctgact

SEQ ID NO: 4381981 - DNA, 15 bp, Homo sapiens
tgctaggggatgagg

SEQ ID NO: 4381982 - DNA, 22 bp, Homo sapiens
tgctagtgggccctctctctgg

SEQ ID NO: 4381983 - DNA, 13 bp, Homo sapiens
tgctataatctgt

SEQ ID NO: 4381984 - DNA, 17 bp, Homo sapiens
tgctataatctgttttt

SEQ ID NO: 4381985 - DNA, 17 bp, Homo sapiens
tgctatacatgttggaa

SEQ ID NO: 4381986 - DNA, 13 bp, Homo sapiens
tgctatagtattt

SEQ ID NO: 4381987 - DNA, 20 bp, Homo sapiens
tgctatagtatttgattcaa

SEQ ID NO: 4381988 - DNA, 16 bp, Homo sapiens
tgctatgagctgggga

SEQ ID NO: 4381989 - DNA, 20 bp, Homo sapiens
tgctatggaacataaagttg

SEQ ID NO: 4381990 - DNA, 14 bp, Homo sapiens
tgctatggttttct

SEQ ID NO: 4381991 - DNA, 21 bp, Homo sapiens
tgctattaatatttgtttagt

SEQ ID NO: 4381992 - DNA, 16 bp, Homo sapiens
tgctattgacaataaa

SEQ ID NO: 4381993 - DNA, 22 bp, Homo sapiens
tgctattgtagagccagaggtc

SEQ ID NO: 4381994 - DNA, 18 bp, Homo sapiens
tgctattgtctgaacttg

SEQ ID NO: 4381995 - DNA, 18 bp, Homo sapiens
tgctatttaaatagataa

SEQ ID NO: 4381996 - DNA, 16 bp, Homo sapiens
tgctatttaacatttt

SEQ ID NO: 4381997 - DNA, 17 bp, Homo sapiens
tgctcaaaatctgtgac

SEQ ID NO: 4381998 - DNA, 23 bp, Homo sapiens
tgctcaacagcatatgggtggga

SEQ ID NO: 4381999 - DNA, 16 bp, Homo sapiens
tgctcaacccccctcc

SEQ ID NO: 4382000 - DNA, 18 bp, Homo sapiens
tgctcaacccccctccca

SEQ ID NO: 4382001 - DNA, 20 bp, Homo sapiens
tgctcaacccccctcccaga

SEQ ID NO: 4382002 - DNA, 15 bp, Homo sapiens
tgctcaatagcttga

SEQ ID NO: 4382003 - DNA, 14 bp, Homo sapiens
tgctcacaatgttc

SEQ ID NO: 4382004 - DNA, 13 bp, Homo sapiens
tgctcaccagccc

SEQ ID NO: 4382005 - DNA, 20 bp, Homo sapiens
tgctcaccagccctgcagcc

SEQ ID NO: 4382006 - DNA, 21 bp, Homo sapiens
tgctcacgttaccttgacaca

SEQ ID NO: 4382007 - DNA, 15 bp, Homo sapiens
tgctcagtgcttggg

SEQ ID NO: 4382008 - DNA, 18 bp, Homo sapiens
tgctcagtgcttgggctc

SEQ ID NO: 4382009 - DNA, 19 bp, Homo sapiens
tgctcagtgcttgggctcc

SEQ ID NO: 4382010 - DNA, 22 bp, Homo sapiens
tgctcagtgcttgggctccacg

SEQ ID NO: 4382011 - DNA, 19 bp, Homo sapiens
tgctcatactacattgagt

SEQ ID NO: 4382012 - DNA, 23 bp, Homo sapiens
tgctcatattgtgattctgcctt

SEQ ID NO: 4382013 - DNA, 16 bp, Homo sapiens
tgctcatgggaagaac

SEQ ID NO: 4382014 - DNA, 16 bp, Homo sapiens
tgctcattaaactgat

SEQ ID NO: 4382015 - DNA, 22 bp, Homo sapiens
tgctcattttttttttatcaga

SEQ ID NO: 4382016 - DNA, 16 bp, Homo sapiens
tgctccaatctgtcac

SEQ ID NO: 4382017 - DNA, 17 bp, Homo sapiens
tgctccaatgactgagc

SEQ ID NO: 4382018 - DNA, 15 bp, Homo sapiens
tgctccaatttcccc

SEQ ID NO: 4382019 - DNA, 15 bp, Homo sapiens
tgctccaccagcagc

SEQ ID NO: 4382020 - DNA, 17 bp, Homo sapiens
tgctccacccttggcct

SEQ ID NO: 4382021 - DNA, 19 bp, Homo sapiens
tgctccacccttggcctgt

SEQ ID NO: 4382022 - DNA, 13 bp, Homo sapiens
tgctccagcctct

SEQ ID NO: 4382023 - DNA, 17 bp, Homo sapiens
tgctccataccttttct

SEQ ID NO: 4382024 - DNA, 18 bp, Homo sapiens
tgctcccacctggctctg

SEQ ID NO: 4382025 - DNA, 17 bp, Homo sapiens
tgctcccagctgtgctg

SEQ ID NO: 4382026 - DNA, 16 bp, Homo sapiens
tgctcccagtcctgcc

SEQ ID NO: 4382027 - DNA, 17 bp, Homo sapiens
tgctcccagtcctgcct

SEQ ID NO: 4382028 - DNA, 17 bp, Homo sapiens
tgctcccattcctccct

SEQ ID NO: 4382029 - DNA, 20 bp, Homo sapiens
tgctcccattcctccctccg

SEQ ID NO: 4382030 - DNA, 11 bp, Homo sapiens
tgctccccaca

SEQ ID NO: 4382031 - DNA, 22 bp, Homo sapiens
tgctccccacagcgtccctggc

SEQ ID NO: 4382032 - DNA, 15 bp, Homo sapiens
tgctccctcacatgt

SEQ ID NO: 4382033 - DNA, 17 bp, Homo sapiens
tgctccctcccctgccc

SEQ ID NO: 4382034 - DNA, 18 bp, Homo sapiens
tgctccctgcaagctccg

SEQ ID NO: 4382035 - DNA, 21 bp, Homo sapiens
tgctccctgcaagctccgcct

SEQ ID NO: 4382036 - DNA, 17 bp, Homo sapiens
tgctccctgcctcctgc

SEQ ID NO: 4382037 - DNA, 22 bp, Homo sapiens
tgctccctgcctcctgcctatg

SEQ ID NO: 4382038 - DNA, 22 bp, Homo sapiens
tgctccctggggttctctacag

SEQ ID NO: 4382039 - DNA, 18 bp, Homo sapiens
tgctccgaggacccagga

SEQ ID NO: 4382040 - DNA, 20 bp, Homo sapiens
tgctccgaggacccaggaaa

SEQ ID NO: 4382041 - DNA, 16 bp, Homo sapiens
tgctcctagcaccctg

SEQ ID NO: 4382042 - DNA, 18 bp, Homo sapiens
tgctcctagcaccctgga

SEQ ID NO: 4382043 - DNA, 22 bp, Homo sapiens
tgctcctaggacccgtctccag

SEQ ID NO: 4382044 - DNA, 14 bp, Homo sapiens
tgctcctcacctgt

SEQ ID NO: 4382045 - DNA, 15 bp, Homo sapiens
tgctcctcacctgtc

SEQ ID NO: 4382046 - DNA, 16 bp, Homo sapiens
tgctcctcacctgtct

SEQ ID NO: 4382047 - DNA, 11 bp, Homo sapiens
tgctcctccag

SEQ ID NO: 4382048 - DNA, 15 bp, Homo sapiens
tgctccttgggccct

SEQ ID NO: 4382049 - DNA, 21 bp, Homo sapiens
tgctccttgggccctttgagt

SEQ ID NO: 4382050 - DNA, 16 bp, Homo sapiens
tgctcgcccagacacc

SEQ ID NO: 4382051 - DNA, 18 bp, Homo sapiens
tgctcgcccagacaccat

SEQ ID NO: 4382052 - DNA, 14 bp, Homo sapiens
tgctcgcttgctgg

SEQ ID NO: 4382053 - DNA, 20 bp, Homo sapiens
tgctcgcttgctggaacaca

SEQ ID NO: 4382054 - DNA, 18 bp, Homo sapiens
tgctcgcttttcctgccc

SEQ ID NO: 4382055 - DNA, 12 bp, Homo sapiens
tgctcggacaca

SEQ ID NO: 4382056 - DNA, 15 bp, Homo sapiens
tgctctatatgtaat

SEQ ID NO: 4382057 - DNA, 14 bp, Homo sapiens
tgctctcactgttt

SEQ ID NO: 4382058 - DNA, 15 bp, Homo sapiens
tgctctcagcctccc

SEQ ID NO: 4382059 - DNA, 14 bp, Homo sapiens
tgctctcccaaggg

SEQ ID NO: 4382060 - DNA, 11 bp, Homo sapiens
tgctctcctca

SEQ ID NO: 4382061 - DNA, 16 bp, Homo sapiens
tgctctcctcatctcc

SEQ ID NO: 4382062 - DNA, 13 bp, Homo sapiens
tgctctctcacct

SEQ ID NO: 4382063 - DNA, 14 bp, Homo sapiens
tgctctctgcagcc

SEQ ID NO: 4382064 - DNA, 17 bp, Homo sapiens
tgctctcttcaataaac

SEQ ID NO: 4382065 - DNA, 19 bp, Homo sapiens
tgctctcttcaataaacca

SEQ ID NO: 4382066 - DNA, 17 bp, Homo sapiens
tgctctgacctcctctg

SEQ ID NO: 4382067 - DNA, 15 bp, Homo sapiens
tgctctgaccttcca

SEQ ID NO: 4382068 - DNA, 15 bp, Homo sapiens
tgctctgagccacag

SEQ ID NO: 4382069 - DNA, 16 bp, Homo sapiens
tgctctgatccctcta

SEQ ID NO: 4382070 - DNA, 16 bp, Homo sapiens
tgctctgggaaggggc

SEQ ID NO: 4382071 - DNA, 14 bp, Homo sapiens
tgctctggggattt

SEQ ID NO: 4382072 - DNA, 18 bp, Homo sapiens
tgctctggttgtttctgt

SEQ ID NO: 4382073 - DNA, 19 bp, Homo sapiens
tgctctggttgtttctgtt

SEQ ID NO: 4382074 - DNA, 23 bp, Homo sapiens
tgctctggttgtttctgttccaa

SEQ ID NO: 4382075 - DNA, 20 bp, Homo sapiens
tgctctgtaggagctaccct

SEQ ID NO: 4382076 - DNA, 12 bp, Homo sapiens
tgctctgtcccc

SEQ ID NO: 4382077 - DNA, 18 bp, Homo sapiens
tgctctgtcccccaggct

SEQ ID NO: 4382078 - DNA, 21 bp, Homo sapiens
tgctctgtcccccaggctgga

SEQ ID NO: 4382079 - DNA, 17 bp, Homo sapiens
tgctcttagtcccaagc

SEQ ID NO: 4382080 - DNA, 14 bp, Homo sapiens
tgctcttcataata

SEQ ID NO: 4382081 - DNA, 14 bp, Homo sapiens
tgctcttctctccc

SEQ ID NO: 4382082 - DNA, 16 bp, Homo sapiens
tgctcttctctcccca

SEQ ID NO: 4382083 - DNA, 17 bp, Homo sapiens
tgctcttctctccccag

SEQ ID NO: 4382084 - DNA, 19 bp, Homo sapiens
tgctcttctctccccagcc

SEQ ID NO: 4382085 - DNA, 16 bp, Homo sapiens
tgctcttgaaatattc

SEQ ID NO: 4382086 - DNA, 14 bp, Homo sapiens
tgctctttaaataa

SEQ ID NO: 4382087 - DNA, 12 bp, Homo sapiens
tgctctttagat

SEQ ID NO: 4382088 - DNA, 16 bp, Homo sapiens
tgctctttattgcaga

SEQ ID NO: 4382089 - DNA, 15 bp, Homo sapiens
tgctcttttcctggt

SEQ ID NO: 4382090 - DNA, 14 bp, Homo sapiens
tgctcttttttctc

SEQ ID NO: 4382091 - DNA, 17 bp, Homo sapiens
tgctgaaaaatatagcc

SEQ ID NO: 4382092 - DNA, 20 bp, Homo sapiens
tgctgaactcagcacattcg

SEQ ID NO: 4382093 - DNA, 21 bp, Homo sapiens
tgctgaaggagaaaaagacag

SEQ ID NO: 4382094 - DNA, 18 bp, Homo sapiens
tgctgaatgttgggactg

SEQ ID NO: 4382095 - DNA, 13 bp, Homo sapiens
tgctgaattcctt

SEQ ID NO: 4382096 - DNA, 16 bp, Homo sapiens
tgctgaattgagaata

SEQ ID NO: 4382097 - DNA, 20 bp, Homo sapiens
tgctgaatttacagtagtta

SEQ ID NO: 4382098 - DNA, 20 bp, Homo sapiens
tgctgactatttgaccccca

SEQ ID NO: 4382099 - DNA, 21 bp, Homo sapiens
tgctgagaggcaccagtccag

SEQ ID NO: 4382100 - DNA, 14 bp, Homo sapiens
tgctgagccagctg

SEQ ID NO: 4382101 - DNA, 15 bp, Homo sapiens
tgctgagccagctgc

SEQ ID NO: 4382102 - DNA, 16 bp, Homo sapiens
tgctgagtgacagctt

SEQ ID NO: 4382103 - DNA, 15 bp, Homo sapiens
tgctgatggagcctt

SEQ ID NO: 4382104 - DNA, 15 bp, Homo sapiens
tgctgatgtcaaagt

SEQ ID NO: 4382105 - DNA, 21 bp, Homo sapiens
tgctgattcttgtaaatcttt

SEQ ID NO: 4382106 - DNA, 13 bp, Homo sapiens
tgctgattttaat

SEQ ID NO: 4382107 - DNA, 14 bp, Homo sapiens
tgctgcaaacctga

SEQ ID NO: 4382108 - DNA, 17 bp, Homo sapiens
tgctgcaacaaaatgta

SEQ ID NO: 4382109 - DNA, 14 bp, Homo sapiens
tgctgcaatacatt

SEQ ID NO: 4382110 - DNA, 16 bp, Homo sapiens
tgctgcaatacattaa

SEQ ID NO: 4382111 - DNA, 12 bp, Homo sapiens
tgctgcagagat

SEQ ID NO: 4382112 - DNA, 16 bp, Homo sapiens
tgctgcagctccctgg

SEQ ID NO: 4382113 - DNA, 15 bp, Homo sapiens
tgctgcaggtggcag

SEQ ID NO: 4382114 - DNA, 17 bp, Homo sapiens
tgctgccaccacttttg

SEQ ID NO: 4382115 - DNA, 22 bp, Homo sapiens
tgctgcccagcagcccctgaga

SEQ ID NO: 4382116 - DNA, 23 bp, Homo sapiens
tgctgcccagcagcccctgagag

SEQ ID NO: 4382117 - DNA, 14 bp, Homo sapiens
tgctgcccatgagc

SEQ ID NO: 4382118 - DNA, 23 bp, Homo sapiens
tgctgcccatgagcaagcctagg

SEQ ID NO: 4382119 - DNA, 18 bp, Homo sapiens
tgctgccccatcagtgct

SEQ ID NO: 4382120 - DNA, 22 bp, Homo sapiens
tgctgcccctgcacagcaggct

SEQ ID NO: 4382121 - DNA, 20 bp, Homo sapiens
tgctgcccctgtctggaaga

SEQ ID NO: 4382122 - DNA, 17 bp, Homo sapiens
tgctgccgagggctggc

SEQ ID NO: 4382123 - DNA, 22 bp, Homo sapiens
tgctgccgagggctggccggga

SEQ ID NO: 4382124 - DNA, 23 bp, Homo sapiens
tgctgccgagggctggccgggac

SEQ ID NO: 4382125 - DNA, 12 bp, Homo sapiens
tgctgccgccgc

SEQ ID NO: 4382126 - DNA, 15 bp, Homo sapiens
tgctgccttcaggga

SEQ ID NO: 4382127 - DNA, 20 bp, Homo sapiens
tgctgcgcctgcaggcagag

SEQ ID NO: 4382128 - DNA, 12 bp, Homo sapiens
tgctgctctcag

SEQ ID NO: 4382129 - DNA, 16 bp, Homo sapiens
tgctgctctcccaagg

SEQ ID NO: 4382130 - DNA, 13 bp, Homo sapiens
tgctgctgcccct

SEQ ID NO: 4382131 - DNA, 16 bp, Homo sapiens
tgctgctgtcagacga

SEQ ID NO: 4382132 - DNA, 14 bp, Homo sapiens
tgctgcttggattt

SEQ ID NO: 4382133 - DNA, 18 bp, Homo sapiens
tgctgctttgggctggga

SEQ ID NO: 4382134 - DNA, 17 bp, Homo sapiens
tgctggaacacaggggc

SEQ ID NO: 4382135 - DNA, 17 bp, Homo sapiens
tgctggaacctgcaaaa

SEQ ID NO: 4382136 - DNA, 19 bp, Homo sapiens
tgctggaacctgcaaaaaa

SEQ ID NO: 4382137 - DNA, 11 bp, Homo sapiens
tgctggactgt

SEQ ID NO: 4382138 - DNA, 13 bp, Homo sapiens
tgctggagaaagc

SEQ ID NO: 4382139 - DNA, 21 bp, Homo sapiens
tgctggagaaagccacgccct

SEQ ID NO: 4382140 - DNA, 23 bp, Homo sapiens
tgctggagaaagccacgccctcc

SEQ ID NO: 4382141 - DNA, 14 bp, Homo sapiens
tgctggaggggtgg

SEQ ID NO: 4382142 - DNA, 20 bp, Homo sapiens
tgctggaggggtggcccaga

SEQ ID NO: 4382143 - DNA, 24 bp, Homo sapiens
tgctggaggggtggcccagagcca

SEQ ID NO: 4382144 - DNA, 19 bp, Homo sapiens
tgctggatgacttgagatg

SEQ ID NO: 4382145 - DNA, 12 bp, Homo sapiens
tgctggccagca

SEQ ID NO: 4382146 - DNA, 13 bp, Homo sapiens
tgctggccagcac

SEQ ID NO: 4382147 - DNA, 19 bp, Homo sapiens
tgctggccagcaccctctc

SEQ ID NO: 4382148 - DNA, 14 bp, Homo sapiens
tgctggcgcctctg

SEQ ID NO: 4382149 - DNA, 14 bp, Homo sapiens
tgctggctcaggag

SEQ ID NO: 4382150 - DNA, 17 bp, Homo sapiens
tgctggctcaggaggag

SEQ ID NO: 4382151 - DNA, 14 bp, Homo sapiens
tgctggctgcggcc

SEQ ID NO: 4382152 - DNA, 16 bp, Homo sapiens
tgctgggaagggaggg

SEQ ID NO: 4382153 - DNA, 16 bp, Homo sapiens
tgctgggattacagac

SEQ ID NO: 4382154 - DNA, 14 bp, Homo sapiens
tgctgggatttcca

SEQ ID NO: 4382155 - DNA, 14 bp, Homo sapiens
tgctgggctctcca

SEQ ID NO: 4382156 - DNA, 15 bp, Homo sapiens
tgctgggctctccac

SEQ ID NO: 4382157 - DNA, 22 bp, Homo sapiens
tgctgggctctccacctcagcc

SEQ ID NO: 4382158 - DNA, 14 bp, Homo sapiens
tgctgggctgggcc

SEQ ID NO: 4382159 - DNA, 20 bp, Homo sapiens
tgctggggacggggggcccc

SEQ ID NO: 4382160 - DNA, 20 bp, Homo sapiens
tgctgggggggattgtaaaa

SEQ ID NO: 4382161 - DNA, 22 bp, Homo sapiens
tgctgggtctgaggcccctgcc

SEQ ID NO: 4382162 - DNA, 18 bp, Homo sapiens
tgctggtagagaccccca

SEQ ID NO: 4382163 - DNA, 17 bp, Homo sapiens
tgctggtcacagcctcc

SEQ ID NO: 4382164 - DNA, 19 bp, Homo sapiens
tgctggtcacagcctcctc

SEQ ID NO: 4382165 - DNA, 21 bp, Homo sapiens
tgctggtcagagagacctcat

SEQ ID NO: 4382166 - DNA, 22 bp, Homo sapiens
tgctggtgaaagccctgctctt

SEQ ID NO: 4382167 - DNA, 13 bp, Homo sapiens
tgctggtggagga

SEQ ID NO: 4382168 - DNA, 14 bp, Homo sapiens
tgctggtggaggaa

SEQ ID NO: 4382169 - DNA, 16 bp, Homo sapiens
tgctggtttttcagtt

SEQ ID NO: 4382170 - DNA, 14 bp, Homo sapiens
tgctgtaaaatttg

SEQ ID NO: 4382171 - DNA, 15 bp, Homo sapiens
tgctgtaaaatttgt

SEQ ID NO: 4382172 - DNA, 20 bp, Homo sapiens
tgctgtaaataaatgcttta

SEQ ID NO: 4382173 - DNA, 15 bp, Homo sapiens
tgctgtacatctatt

SEQ ID NO: 4382174 - DNA, 16 bp, Homo sapiens
tgctgtacatctattt

SEQ ID NO: 4382175 - DNA, 16 bp, Homo sapiens
tgctgtagatgacaac

SEQ ID NO: 4382176 - DNA, 15 bp, Homo sapiens
tgctgtatatgcaat

SEQ ID NO: 4382177 - DNA, 16 bp, Homo sapiens
tgctgtatttttacag

SEQ ID NO: 4382178 - DNA, 13 bp, Homo sapiens
tgctgtccttggg

SEQ ID NO: 4382179 - DNA, 14 bp, Homo sapiens
tgctgtctggccct

SEQ ID NO: 4382180 - DNA, 14 bp, Homo sapiens
tgctgtcttaaact

SEQ ID NO: 4382181 - DNA, 18 bp, Homo sapiens
tgctgtcttttgttctct

SEQ ID NO: 4382182 - DNA, 21 bp, Homo sapiens
tgctgtgaatttgtgtaagga

SEQ ID NO: 4382183 - DNA, 13 bp, Homo sapiens
tgctgtgctctgg

SEQ ID NO: 4382184 - DNA, 15 bp, Homo sapiens
tgctgtgctgctcaa

SEQ ID NO: 4382185 - DNA, 16 bp, Homo sapiens
tgctgtgggcagcacc

SEQ ID NO: 4382186 - DNA, 21 bp, Homo sapiens
tgctgtgggcagcaccctccc

SEQ ID NO: 4382187 - DNA, 15 bp, Homo sapiens
tgctgtggtgtgtcc

SEQ ID NO: 4382188 - DNA, 15 bp, Homo sapiens
tgctgttactgcttc

SEQ ID NO: 4382189 - DNA, 19 bp, Homo sapiens
tgctgttactgcttctctt

SEQ ID NO: 4382190 - DNA, 22 bp, Homo sapiens
tgctgttagtaaatttctgtga

SEQ ID NO: 4382191 - DNA, 19 bp, Homo sapiens
tgctgttatgttttttcat

SEQ ID NO: 4382192 - DNA, 24 bp, Homo sapiens
tgctgttctcaggacagcatccct

SEQ ID NO: 4382193 - DNA, 18 bp, Homo sapiens
tgctgttgacatatttaa

SEQ ID NO: 4382194 - DNA, 24 bp, Homo sapiens
tgctgtttaaagtcacatccctgt

SEQ ID NO: 4382195 - DNA, 21 bp, Homo sapiens
tgctgtttactcccttctgta

SEQ ID NO: 4382196 - DNA, 22 bp, Homo sapiens
tgctgtttactcccttctgtag

SEQ ID NO: 4382197 - DNA, 15 bp, Homo sapiens
tgctgtttgaaaata

SEQ ID NO: 4382198 - DNA, 19 bp, Homo sapiens
tgctgtttgtttgacaaag

SEQ ID NO: 4382199 - DNA, 17 bp, Homo sapiens
tgcttaaaaaagctaat

SEQ ID NO: 4382200 - DNA, 15 bp, Homo sapiens
tgcttaaaaaataat

SEQ ID NO: 4382201 - DNA, 16 bp, Homo sapiens
tgcttaaaaatacttc

SEQ ID NO: 4382202 - DNA, 16 bp, Homo sapiens
tgcttaaaagcatttt

SEQ ID NO: 4382203 - DNA, 15 bp, Homo sapiens
tgcttaaaatatata

SEQ ID NO: 4382204 - DNA, 16 bp, Homo sapiens
tgcttaaaatatgtga

SEQ ID NO: 4382205 - DNA, 22 bp, Homo sapiens
tgcttaaagttggtattaataa

SEQ ID NO: 4382206 - DNA, 15 bp, Homo sapiens
tgcttaaatttctta

SEQ ID NO: 4382207 - DNA, 12 bp, Homo sapiens
tgcttaatgaaa

SEQ ID NO: 4382208 - DNA, 15 bp, Homo sapiens
tgcttacctaatttc

SEQ ID NO: 4382209 - DNA, 17 bp, Homo sapiens
tgcttacctactttctt

SEQ ID NO: 4382210 - DNA, 14 bp, Homo sapiens
tgcttactgatata

SEQ ID NO: 4382211 - DNA, 21 bp, Homo sapiens
tgcttagtaagtatttccata

SEQ ID NO: 4382212 - DNA, 20 bp, Homo sapiens
tgcttagtccaattccttgc

SEQ ID NO: 4382213 - DNA, 14 bp, Homo sapiens
tgcttagtgtgaag

SEQ ID NO: 4382214 - DNA, 15 bp, Homo sapiens
tgcttagtgtgaagt

SEQ ID NO: 4382215 - DNA, 20 bp, Homo sapiens
tgcttataacattaagaaaa

SEQ ID NO: 4382216 - DNA, 19 bp, Homo sapiens
tgcttataacctagttaaa

SEQ ID NO: 4382217 - DNA, 23 bp, Homo sapiens
tgcttataacctagttaaagaaa

SEQ ID NO: 4382218 - DNA, 17 bp, Homo sapiens
tgcttattgcttagtaa

SEQ ID NO: 4382219 - DNA, 15 bp, Homo sapiens
tgcttcaatttcaaa

SEQ ID NO: 4382220 - DNA, 22 bp, Homo sapiens
tgcttcactcatgcaaactgct

SEQ ID NO: 4382221 - DNA, 23 bp, Homo sapiens
tgcttcactcatgcaaactgctt

SEQ ID NO: 4382222 - DNA, 19 bp, Homo sapiens
tgcttccaggaaactccac

SEQ ID NO: 4382223 - DNA, 20 bp, Homo sapiens
tgcttcccattgtggctcct

SEQ ID NO: 4382224 - DNA, 14 bp, Homo sapiens
tgcttccccgtgca

SEQ ID NO: 4382225 - DNA, 14 bp, Homo sapiens
tgcttcctacaaag

SEQ ID NO: 4382226 - DNA, 15 bp, Homo sapiens
tgcttcgggcccttc

SEQ ID NO: 4382227 - DNA, 12 bp, Homo sapiens
tgcttctacttt

SEQ ID NO: 4382228 - DNA, 14 bp, Homo sapiens
tgcttctagagctt

SEQ ID NO: 4382229 - DNA, 22 bp, Homo sapiens
tgcttctaggagtcaactggct

SEQ ID NO: 4382230 - DNA, 19 bp, Homo sapiens
tgcttctagttctgccagg

SEQ ID NO: 4382231 - DNA, 20 bp, Homo sapiens
tgcttctagttctgccagga

SEQ ID NO: 4382232 - DNA, 22 bp, Homo sapiens
tgcttctcagatttctgaggaa

SEQ ID NO: 4382233 - DNA, 18 bp, Homo sapiens
tgcttctcatcccaacct

SEQ ID NO: 4382234 - DNA, 14 bp, Homo sapiens
tgcttctccccaga

SEQ ID NO: 4382235 - DNA, 19 bp, Homo sapiens
tgcttctccccagaattca

SEQ ID NO: 4382236 - DNA, 15 bp, Homo sapiens
tgcttctctttgtgc

SEQ ID NO: 4382237 - DNA, 16 bp, Homo sapiens
tgcttctctttgtgca

SEQ ID NO: 4382238 - DNA, 17 bp, Homo sapiens
tgcttctctttgtgcag

SEQ ID NO: 4382239 - DNA, 18 bp, Homo sapiens
tgcttctctttgtgcagt

SEQ ID NO: 4382240 - DNA, 14 bp, Homo sapiens
tgcttctgcagcaa

SEQ ID NO: 4382241 - DNA, 16 bp, Homo sapiens
tgcttctgcagcaact

SEQ ID NO: 4382242 - DNA, 19 bp, Homo sapiens
tgcttctgcagcaactccc

SEQ ID NO: 4382243 - DNA, 20 bp, Homo sapiens
tgcttctgcagcaactccca

SEQ ID NO: 4382244 - DNA, 20 bp, Homo sapiens
tgcttctggctacctgtttg

SEQ ID NO: 4382245 - DNA, 11 bp, Homo sapiens
tgcttcttgct

SEQ ID NO: 4382246 - DNA, 18 bp, Homo sapiens
tgcttcttgctggtgaaa

SEQ ID NO: 4382247 - DNA, 20 bp, Homo sapiens
tgcttcttggagctttggaa

SEQ ID NO: 4382248 - DNA, 15 bp, Homo sapiens
tgcttctttccagaa

SEQ ID NO: 4382249 - DNA, 12 bp, Homo sapiens
tgcttgaacaca

SEQ ID NO: 4382250 - DNA, 13 bp, Homo sapiens
tgcttgaacacag

SEQ ID NO: 4382251 - DNA, 22 bp, Homo sapiens
tgcttgacatacctaccagtat

SEQ ID NO: 4382252 - DNA, 13 bp, Homo sapiens
tgcttgatacagg

SEQ ID NO: 4382253 - DNA, 13 bp, Homo sapiens
tgcttgatccaga

SEQ ID NO: 4382254 - DNA, 13 bp, Homo sapiens
tgcttgatctatc

SEQ ID NO: 4382255 - DNA, 15 bp, Homo sapiens
tgcttgatctatcta

SEQ ID NO: 4382256 - DNA, 16 bp, Homo sapiens
tgcttgcataagagct

SEQ ID NO: 4382257 - DNA, 19 bp, Homo sapiens
tgcttgcatctgcacatag

SEQ ID NO: 4382258 - DNA, 13 bp, Homo sapiens
tgcttgcccgctc

SEQ ID NO: 4382259 - DNA, 16 bp, Homo sapiens
tgcttgcttgccctcc

SEQ ID NO: 4382260 - DNA, 22 bp, Homo sapiens
tgcttggcagttgcagtgctgc

SEQ ID NO: 4382261 - DNA, 22 bp, Homo sapiens
tgcttgggaccagaagtgtttc

SEQ ID NO: 4382262 - DNA, 22 bp, Homo sapiens
tgcttgggagcctgtggccagc

SEQ ID NO: 4382263 - DNA, 21 bp, Homo sapiens
tgcttgggcctccctggcact

SEQ ID NO: 4382264 - DNA, 13 bp, Homo sapiens
tgcttgggctcca

SEQ ID NO: 4382265 - DNA, 21 bp, Homo sapiens
tgcttgtagttgaataaaaat

SEQ ID NO: 4382266 - DNA, 14 bp, Homo sapiens
tgcttgtattgtaa

SEQ ID NO: 4382267 - DNA, 16 bp, Homo sapiens
tgcttgtattgtaaat

SEQ ID NO: 4382268 - DNA, 22 bp, Homo sapiens
tgcttgttgtttgttgacagct

SEQ ID NO: 4382269 - DNA, 14 bp, Homo sapiens
tgcttgtttacagc

SEQ ID NO: 4382270 - DNA, 11 bp, Homo sapiens
tgctttaatat

SEQ ID NO: 4382271 - DNA, 20 bp, Homo sapiens
tgctttaatatgagcttcaa

SEQ ID NO: 4382272 - DNA, 23 bp, Homo sapiens
tgctttaatatgagcttcaatat

SEQ ID NO: 4382273 - DNA, 20 bp, Homo sapiens
tgctttagtacaatagtata

SEQ ID NO: 4382274 - DNA, 20 bp, Homo sapiens
tgctttataatgtatacatt

SEQ ID NO: 4382275 - DNA, 20 bp, Homo sapiens
tgctttatgtgggttatcat

SEQ ID NO: 4382276 - DNA, 14 bp, Homo sapiens
tgctttattgaatt

SEQ ID NO: 4382277 - DNA, 22 bp, Homo sapiens
tgctttattgaattagaaaatt

SEQ ID NO: 4382278 - DNA, 14 bp, Homo sapiens
tgctttcattatgt

SEQ ID NO: 4382279 - DNA, 16 bp, Homo sapiens
tgctttcctgggcctt

SEQ ID NO: 4382280 - DNA, 17 bp, Homo sapiens
tgctttctctctcatgc

SEQ ID NO: 4382281 - DNA, 18 bp, Homo sapiens
tgctttctgctctttaca

SEQ ID NO: 4382282 - DNA, 15 bp, Homo sapiens
tgctttctgttccaa

SEQ ID NO: 4382283 - DNA, 12 bp, Homo sapiens
tgctttgaaaaa

SEQ ID NO: 4382284 - DNA, 15 bp, Homo sapiens
tgctttgctttgtag

SEQ ID NO: 4382285 - DNA, 16 bp, Homo sapiens
tgctttgggaactgtg

SEQ ID NO: 4382286 - DNA, 17 bp, Homo sapiens
tgcttttaaaaaaaaat

SEQ ID NO: 4382287 - DNA, 13 bp, Homo sapiens
tgcttttagaaaa

SEQ ID NO: 4382288 - DNA, 17 bp, Homo sapiens
tgcttttatattctaat

SEQ ID NO: 4382289 - DNA, 19 bp, Homo sapiens
tgcttttatattctaatag

SEQ ID NO: 4382290 - DNA, 21 bp, Homo sapiens
tgcttttcactttctgtctag

SEQ ID NO: 4382291 - DNA, 15 bp, Homo sapiens
tgcttttgaaaaaca

SEQ ID NO: 4382292 - DNA, 16 bp, Homo sapiens
tgcttttgcttgcaat

SEQ ID NO: 4382293 - DNA, 15 bp, Homo sapiens
tgctttttataaaaa

SEQ ID NO: 4382294 - DNA, 19 bp, Homo sapiens
tgctttttatttctgcata

SEQ ID NO: 4382295 - DNA, 13 bp, Homo sapiens
tgctttttggaaa

SEQ ID NO: 4382296 - DNA, 16 bp, Homo sapiens
tgctttttgtgttttt

SEQ ID NO: 4382297 - DNA, 13 bp, Homo sapiens
tggaaaaaccttg

SEQ ID NO: 4382298 - DNA, 17 bp, Homo sapiens
tggaaaaataaaactgt

SEQ ID NO: 4382299 - DNA, 23 bp, Homo sapiens
tggaaaaatcacaatttttaatg

SEQ ID NO: 4382300 - DNA, 19 bp, Homo sapiens
tggaaaaatgccatcaaat

SEQ ID NO: 4382301 - DNA, 19 bp, Homo sapiens
tggaaaaatgggtctttta

SEQ ID NO: 4382302 - DNA, 22 bp, Homo sapiens
tggaaaaatgggtcttttatag

SEQ ID NO: 4382303 - DNA, 14 bp, Homo sapiens
tggaaaacagaaac

SEQ ID NO: 4382304 - DNA, 14 bp, Homo sapiens
tggaaaacctcctt

SEQ ID NO: 4382305 - DNA, 15 bp, Homo sapiens
tggaaaagggaaatg

SEQ ID NO: 4382306 - DNA, 16 bp, Homo sapiens
tggaaaataccagtgt

SEQ ID NO: 4382307 - DNA, 14 bp, Homo sapiens
tggaaacaaaacag

SEQ ID NO: 4382308 - DNA, 16 bp, Homo sapiens
tggaaacaaaacagaa

SEQ ID NO: 4382309 - DNA, 18 bp, Homo sapiens
tggaaacagttggcactg

SEQ ID NO: 4382310 - DNA, 15 bp, Homo sapiens
tggaaactgccaaac

SEQ ID NO: 4382311 - DNA, 22 bp, Homo sapiens
tggaaagacgtttttgtgctgt

SEQ ID NO: 4382312 - DNA, 15 bp, Homo sapiens
tggaaaggggagagc

SEQ ID NO: 4382313 - DNA, 17 bp, Homo sapiens
tggaaaggggagagcct

SEQ ID NO: 4382314 - DNA, 21 bp, Homo sapiens
tggaaaggggagagcctgctg

SEQ ID NO: 4382315 - DNA, 19 bp, Homo sapiens
tggaaaggtgtgagactgg

SEQ ID NO: 4382316 - DNA, 18 bp, Homo sapiens
tggaaataaatcttccta

SEQ ID NO: 4382317 - DNA, 20 bp, Homo sapiens
tggaaataatatcatttata

SEQ ID NO: 4382318 - DNA, 15 bp, Homo sapiens
tggaaatacagttat

SEQ ID NO: 4382319 - DNA, 16 bp, Homo sapiens
tggaaatacagttatt

SEQ ID NO: 4382320 - DNA, 14 bp, Homo sapiens
tggaaatagaaaga

SEQ ID NO: 4382321 - DNA, 19 bp, Homo sapiens
tggaaatagaaagaagcca

SEQ ID NO: 4382322 - DNA, 17 bp, Homo sapiens
tggaaatggatgcaaag

SEQ ID NO: 4382323 - DNA, 13 bp, Homo sapiens
tggaaatggtttc

SEQ ID NO: 4382324 - DNA, 14 bp, Homo sapiens
tggaaatttttacc

SEQ ID NO: 4382325 - DNA, 16 bp, Homo sapiens
tggaacacaggggcct

SEQ ID NO: 4382326 - DNA, 21 bp, Homo sapiens
tggaacataaaatacaatgtt

SEQ ID NO: 4382327 - DNA, 14 bp, Homo sapiens
tggaacattttcat

SEQ ID NO: 4382328 - DNA, 16 bp, Homo sapiens
tggaacgcagttgatt

SEQ ID NO: 4382329 - DNA, 19 bp, Homo sapiens
tggaacgcagttgattcct

SEQ ID NO: 4382330 - DNA, 22 bp, Homo sapiens
tggaactaaggactccaatgtc

SEQ ID NO: 4382331 - DNA, 17 bp, Homo sapiens
tggaactacattactgt

SEQ ID NO: 4382332 - DNA, 18 bp, Homo sapiens
tggaactcgtgtctggca

SEQ ID NO: 4382333 - DNA, 20 bp, Homo sapiens
tggaactgtgtatttattta

SEQ ID NO: 4382334 - DNA, 21 bp, Homo sapiens
tggaactgtgtatttatttaa

SEQ ID NO: 4382335 - DNA, 18 bp, Homo sapiens
tggaactgtgtttcaaat

SEQ ID NO: 4382336 - DNA, 21 bp, Homo sapiens
tggaacttagccatttttcaa

SEQ ID NO: 4382337 - DNA, 19 bp, Homo sapiens
tggaagaaatggctatgaa

SEQ ID NO: 4382338 - DNA, 23 bp, Homo sapiens
tggaagaaatggctatgaacaga

SEQ ID NO: 4382339 - DNA, 12 bp, Homo sapiens
tggaagaaccac

SEQ ID NO: 4382340 - DNA, 18 bp, Homo sapiens
tggaagaagttttttact

SEQ ID NO: 4382341 - DNA, 22 bp, Homo sapiens
tggaagaagttttttactttgg

SEQ ID NO: 4382342 - DNA, 22 bp, Homo sapiens
tggaagatttgcccatttacac

SEQ ID NO: 4382343 - DNA, 23 bp, Homo sapiens
tggaagatttgcccatttacact

SEQ ID NO: 4382344 - DNA, 13 bp, Homo sapiens
tggaagcagaggc

SEQ ID NO: 4382345 - DNA, 14 bp, Homo sapiens
tggaagcagaggcc

SEQ ID NO: 4382346 - DNA, 16 bp, Homo sapiens
tggaagcagaggccct

SEQ ID NO: 4382347 - DNA, 17 bp, Homo sapiens
tggaagcatgtaggaga

SEQ ID NO: 4382348 - DNA, 16 bp, Homo sapiens
tggaagcccctgggcc

SEQ ID NO: 4382349 - DNA, 16 bp, Homo sapiens
tggaagccctccttcc

SEQ ID NO: 4382350 - DNA, 19 bp, Homo sapiens
tggaagccctccttccacg

SEQ ID NO: 4382351 - DNA, 16 bp, Homo sapiens
tggaagctaatttgca

SEQ ID NO: 4382352 - DNA, 17 bp, Homo sapiens
tggaagctaatttgcat

SEQ ID NO: 4382353 - DNA, 20 bp, Homo sapiens
tggaagctgtttggaaaaga

SEQ ID NO: 4382354 - DNA, 23 bp, Homo sapiens
tggaagctgtttggaaaagacag

SEQ ID NO: 4382355 - DNA, 12 bp, Homo sapiens
tggaaggaacat

SEQ ID NO: 4382356 - DNA, 20 bp, Homo sapiens
tggaaggacacagtgatgaa

SEQ ID NO: 4382357 - DNA, 17 bp, Homo sapiens
tggaaggaggcctccac

SEQ ID NO: 4382358 - DNA, 21 bp, Homo sapiens
tggaaggtcttttgagggcta

SEQ ID NO: 4382359 - DNA, 22 bp, Homo sapiens
tggaagtcagtacgatcaagtt

SEQ ID NO: 4382360 - DNA, 14 bp, Homo sapiens
tggaagtcatgagc

SEQ ID NO: 4382361 - DNA, 17 bp, Homo sapiens
tggaagtccaatgtggc

SEQ ID NO: 4382362 - DNA, 13 bp, Homo sapiens
tggaataacatat

SEQ ID NO: 4382363 - DNA, 13 bp, Homo sapiens
tggaataatacat

SEQ ID NO: 4382364 - DNA, 18 bp, Homo sapiens
tggaataatacatactaa

SEQ ID NO: 4382365 - DNA, 19 bp, Homo sapiens
tggaataatacatactaat

SEQ ID NO: 4382366 - DNA, 16 bp, Homo sapiens
tggaatagtaaactaa

SEQ ID NO: 4382367 - DNA, 19 bp, Homo sapiens
tggaatagtaaactaaagt

SEQ ID NO: 4382368 - DNA, 13 bp, Homo sapiens
tggaatataaaac

SEQ ID NO: 4382369 - DNA, 14 bp, Homo sapiens
tggaatatcatctg

SEQ ID NO: 4382370 - DNA, 13 bp, Homo sapiens
tggaatattaaaa

SEQ ID NO: 4382371 - DNA, 22 bp, Homo sapiens
tggaatgggagaggcaataaat

SEQ ID NO: 4382372 - DNA, 17 bp, Homo sapiens
tggaatgtgccacagag

SEQ ID NO: 4382373 - DNA, 19 bp, Homo sapiens
tggaattacaagccctggg

SEQ ID NO: 4382374 - DNA, 16 bp, Homo sapiens
tggaattacagactca

SEQ ID NO: 4382375 - DNA, 11 bp, Homo sapiens
tggaattcagc

SEQ ID NO: 4382376 - DNA, 22 bp, Homo sapiens
tggaattcttagtcacaaaata

SEQ ID NO: 4382377 - DNA, 17 bp, Homo sapiens
tggaattgatttgcatt

SEQ ID NO: 4382378 - DNA, 22 bp, Homo sapiens
tggaattgatttgcattgaaca

SEQ ID NO: 4382379 - DNA, 21 bp, Homo sapiens
tggaatttctagtatgagact

SEQ ID NO: 4382380 - DNA, 22 bp, Homo sapiens
tggaattttctaatataatgac

SEQ ID NO: 4382381 - DNA, 23 bp, Homo sapiens
tggaattttgcaaagatttaatc

SEQ ID NO: 4382382 - DNA, 14 bp, Homo sapiens
tggacaaatgttgt

SEQ ID NO: 4382383 - DNA, 14 bp, Homo sapiens
tggacaaggagctg

SEQ ID NO: 4382384 - DNA, 16 bp, Homo sapiens
tggacaaggaggtctg

SEQ ID NO: 4382385 - DNA, 21 bp, Homo sapiens
tggacaatcttatgtttccaa

SEQ ID NO: 4382386 - DNA, 15 bp, Homo sapiens
tggacacgagccaca

SEQ ID NO: 4382387 - DNA, 22 bp, Homo sapiens
tggacacgagccacaagctgca

SEQ ID NO: 4382388 - DNA, 23 bp, Homo sapiens
tggacacgagccacaagctgcac

SEQ ID NO: 4382389 - DNA, 14 bp, Homo sapiens
tggacagaaaatgc

SEQ ID NO: 4382390 - DNA, 21 bp, Homo sapiens
tggacagacccacccccagcc

SEQ ID NO: 4382391 - DNA, 12 bp, Homo sapiens
tggacagctgat

SEQ ID NO: 4382392 - DNA, 15 bp, Homo sapiens
tggacagctgataaa

SEQ ID NO: 4382393 - DNA, 18 bp, Homo sapiens
tggacaggatgaggacag

SEQ ID NO: 4382394 - DNA, 19 bp, Homo sapiens
tggacagtacctgattgta

SEQ ID NO: 4382395 - DNA, 11 bp, Homo sapiens
tggacatttta

SEQ ID NO: 4382396 - DNA, 13 bp, Homo sapiens
tggacattttatg

SEQ ID NO: 4382397 - DNA, 17 bp, Homo sapiens
tggacattttatgtctt

SEQ ID NO: 4382398 - DNA, 17 bp, Homo sapiens
tggaccaacctgctctg

SEQ ID NO: 4382399 - DNA, 22 bp, Homo sapiens
tggaccaacctgctctgtcccc

SEQ ID NO: 4382400 - DNA, 21 bp, Homo sapiens
tggaccaatagggctgagctc

SEQ ID NO: 4382401 - DNA, 22 bp, Homo sapiens
tggaccaattattgatatatat

SEQ ID NO: 4382402 - DNA, 16 bp, Homo sapiens
tggaccagcctctcca

SEQ ID NO: 4382403 - DNA, 13 bp, Homo sapiens
tggaccaggacag

SEQ ID NO: 4382404 - DNA, 19 bp, Homo sapiens
tggaccaggacaggaccag

SEQ ID NO: 4382405 - DNA, 14 bp, Homo sapiens
tggaccaggcccat

SEQ ID NO: 4382406 - DNA, 16 bp, Homo sapiens
tggaccatgccagatt

SEQ ID NO: 4382407 - DNA, 9 bp, Homo sapiens
tggacccac

SEQ ID NO: 4382408 - DNA, 12 bp, Homo sapiens
tggacccacctg

SEQ ID NO: 4382409 - DNA, 13 bp, Homo sapiens
tggacccagggcc

SEQ ID NO: 4382410 - DNA, 14 bp, Homo sapiens
tggacccagggcct

SEQ ID NO: 4382411 - DNA, 16 bp, Homo sapiens
tggacccagggcctga

SEQ ID NO: 4382412 - DNA, 24 bp, Homo sapiens
tggacccagggcctgacttgagcc

SEQ ID NO: 4382413 - DNA, 13 bp, Homo sapiens
tggacccttccat

SEQ ID NO: 4382414 - DNA, 13 bp, Homo sapiens
tggacctcagcaa

SEQ ID NO: 4382415 - DNA, 19 bp, Homo sapiens
tggacctcagcaagctgcc

SEQ ID NO: 4382416 - DNA, 15 bp, Homo sapiens
tggacctgcatattt

SEQ ID NO: 4382417 - DNA, 23 bp, Homo sapiens
tggacctgggaacgactggactg

SEQ ID NO: 4382418 - DNA, 16 bp, Homo sapiens
tggacctggtgcccct

SEQ ID NO: 4382419 - DNA, 17 bp, Homo sapiens
tggacctggtgcccctg

SEQ ID NO: 4382420 - DNA, 23 bp, Homo sapiens
tggacggattccttggcagccgg

SEQ ID NO: 4382421 - DNA, 22 bp, Homo sapiens
tggacggcaggctcactgccag

SEQ ID NO: 4382422 - DNA, 20 bp, Homo sapiens
tggactaattattattttaa

SEQ ID NO: 4382423 - DNA, 20 bp, Homo sapiens
tggactacacaatacagtat

SEQ ID NO: 4382424 - DNA, 15 bp, Homo sapiens
tggactattgtgcca

SEQ ID NO: 4382425 - DNA, 14 bp, Homo sapiens
tggactccagcctg

SEQ ID NO: 4382426 - DNA, 20 bp, Homo sapiens
tggactccagcctgcctggc

SEQ ID NO: 4382427 - DNA, 23 bp, Homo sapiens
tggactccagcctgcctggcagg

SEQ ID NO: 4382428 - DNA, 21 bp, Homo sapiens
tggactccggaggactgagcc

SEQ ID NO: 4382429 - DNA, 16 bp, Homo sapiens
tggactcgcctgtaat

SEQ ID NO: 4382430 - DNA, 20 bp, Homo sapiens
tggactctcagtctctgagc

SEQ ID NO: 4382431 - DNA, 17 bp, Homo sapiens
tggactctctgtggtcc

SEQ ID NO: 4382432 - DNA, 14 bp, Homo sapiens
tggactctgcccca

SEQ ID NO: 4382433 - DNA, 14 bp, Homo sapiens
tggactgaggcctg

SEQ ID NO: 4382434 - DNA, 16 bp, Homo sapiens
tggactgaggcctgag

SEQ ID NO: 4382435 - DNA, 19 bp, Homo sapiens
tggactgagggggcctgga

SEQ ID NO: 4382436 - DNA, 15 bp, Homo sapiens
tggactgcgctggac

SEQ ID NO: 4382437 - DNA, 16 bp, Homo sapiens
tggactggcccctggg

SEQ ID NO: 4382438 - DNA, 20 bp, Homo sapiens
tggactggcccctgggtcag

SEQ ID NO: 4382439 - DNA, 21 bp, Homo sapiens
tggactggcgttcacctccct

SEQ ID NO: 4382440 - DNA, 17 bp, Homo sapiens
tggactgtgctggtgca

SEQ ID NO: 4382441 - DNA, 19 bp, Homo sapiens
tggacttcctgggtcgagt

SEQ ID NO: 4382442 - DNA, 14 bp, Homo sapiens
tggacttgcctctg

SEQ ID NO: 4382443 - DNA, 15 bp, Homo sapiens
tggagaaaaaaattg

SEQ ID NO: 4382444 - DNA, 14 bp, Homo sapiens
tggagaaaccctgt

SEQ ID NO: 4382445 - DNA, 16 bp, Homo sapiens
tggagaaaccctgtct

SEQ ID NO: 4382446 - DNA, 18 bp, Homo sapiens
tggagaactagaacctgg

SEQ ID NO: 4382447 - DNA, 21 bp, Homo sapiens
tggagaactagaacctggagg

SEQ ID NO: 4382448 - DNA, 13 bp, Homo sapiens
tggagaagcagtg

SEQ ID NO: 4382449 - DNA, 18 bp, Homo sapiens
tggagaagccacaggcct

SEQ ID NO: 4382450 - DNA, 21 bp, Homo sapiens
tggagaagccacaggcctgag

SEQ ID NO: 4382451 - DNA, 16 bp, Homo sapiens
tggagacaaggtgcta

SEQ ID NO: 4382452 - DNA, 20 bp, Homo sapiens
tggagacaaggtgctaacat

SEQ ID NO: 4382453 - DNA, 18 bp, Homo sapiens
tggagaccctgccacagc

SEQ ID NO: 4382454 - DNA, 19 bp, Homo sapiens
tggagaccctgccacagcc

SEQ ID NO: 4382455 - DNA, 22 bp, Homo sapiens
tggagaccctgccacagccaga

SEQ ID NO: 4382456 - DNA, 18 bp, Homo sapiens
tggagacctttctagaca

SEQ ID NO: 4382457 - DNA, 17 bp, Homo sapiens
tggagacgtggtgggac

SEQ ID NO: 4382458 - DNA, 16 bp, Homo sapiens
tggagactcctggtct

SEQ ID NO: 4382459 - DNA, 15 bp, Homo sapiens
tggagacttcctctg

SEQ ID NO: 4382460 - DNA, 12 bp, Homo sapiens
tggagagaaggc

SEQ ID NO: 4382461 - DNA, 18 bp, Homo sapiens
tggagagccagaacctgg

SEQ ID NO: 4382462 - DNA, 18 bp, Homo sapiens
tggagagctagaacctgg

SEQ ID NO: 4382463 - DNA, 19 bp, Homo sapiens
tggagagctagaacctgga

SEQ ID NO: 4382464 - DNA, 20 bp, Homo sapiens
tggagagctagaacctggag

SEQ ID NO: 4382465 - DNA, 23 bp, Homo sapiens
tggagagctagaacctggagagc

SEQ ID NO: 4382466 - DNA, 11 bp, Homo sapiens
tggagagctgg

SEQ ID NO: 4382467 - DNA, 16 bp, Homo sapiens
tggagagctggtgccc

SEQ ID NO: 4382468 - DNA, 13 bp, Homo sapiens
tggagaggacaga

SEQ ID NO: 4382469 - DNA, 21 bp, Homo sapiens
tggagaggacagagcaggggc

SEQ ID NO: 4382470 - DNA, 17 bp, Homo sapiens
tggagagtgcacatgcc

SEQ ID NO: 4382471 - DNA, 13 bp, Homo sapiens
tggagcaactgaa

SEQ ID NO: 4382472 - DNA, 19 bp, Homo sapiens
tggagcaggagccccgcca

SEQ ID NO: 4382473 - DNA, 21 bp, Homo sapiens
tggagcatttctcatcagtag

SEQ ID NO: 4382474 - DNA, 15 bp, Homo sapiens
tggagcccagaggag

SEQ ID NO: 4382475 - DNA, 15 bp, Homo sapiens
tggagccccacactg

SEQ ID NO: 4382476 - DNA, 12 bp, Homo sapiens
tggagccccagc

SEQ ID NO: 4382477 - DNA, 13 bp, Homo sapiens
tggagccccagcc

SEQ ID NO: 4382478 - DNA, 15 bp, Homo sapiens
tggagccccagcccc

SEQ ID NO: 4382479 - DNA, 17 bp, Homo sapiens
tggagccccatcggcca

SEQ ID NO: 4382480 - DNA, 15 bp, Homo sapiens
tggagcccccagcag

SEQ ID NO: 4382481 - DNA, 16 bp, Homo sapiens
tggagcccccagcaga

SEQ ID NO: 4382482 - DNA, 22 bp, Homo sapiens
tggagctacactcattgaaatg

SEQ ID NO: 4382483 - DNA, 15 bp, Homo sapiens
tggagctcttgggtc

SEQ ID NO: 4382484 - DNA, 13 bp, Homo sapiens
tggagctgactgt

SEQ ID NO: 4382485 - DNA, 16 bp, Homo sapiens
tggagctgggagacaa

SEQ ID NO: 4382486 - DNA, 23 bp, Homo sapiens
tggagctgggagacaaaggagga

SEQ ID NO: 4382487 - DNA, 21 bp, Homo sapiens
tggagctgtcacctctcagct

SEQ ID NO: 4382488 - DNA, 14 bp, Homo sapiens
tggagctgttccat

SEQ ID NO: 4382489 - DNA, 21 bp, Homo sapiens
tggagctttgtaatgggaata

SEQ ID NO: 4382490 - DNA, 19 bp, Homo sapiens
tggaggaacacttgatgga

SEQ ID NO: 4382491 - DNA, 15 bp, Homo sapiens
tggaggaagaacaac

SEQ ID NO: 4382492 - DNA, 15 bp, Homo sapiens
tggaggaagagccac

SEQ ID NO: 4382493 - DNA, 17 bp, Homo sapiens
tggaggaagagccacct

SEQ ID NO: 4382494 - DNA, 23 bp, Homo sapiens
tggaggaagagccacctgcaaga

SEQ ID NO: 4382495 - DNA, 14 bp, Homo sapiens
tggaggaagggctg

SEQ ID NO: 4382496 - DNA, 15 bp, Homo sapiens
tggaggaagggctgg

SEQ ID NO: 4382497 - DNA, 16 bp, Homo sapiens
tggaggaagggctggg

SEQ ID NO: 4382498 - DNA, 17 bp, Homo sapiens
tggaggaagggctgggc

SEQ ID NO: 4382499 - DNA, 19 bp, Homo sapiens
tggaggaagggctgggcca

SEQ ID NO: 4382500 - DNA, 20 bp, Homo sapiens
tggaggaagggctgggccac

SEQ ID NO: 4382501 - DNA, 21 bp, Homo sapiens
tggaggaatacattttattct

SEQ ID NO: 4382502 - DNA, 21 bp, Homo sapiens
tggaggacagagggagacagg

SEQ ID NO: 4382503 - DNA, 15 bp, Homo sapiens
tggaggaccgaggct

SEQ ID NO: 4382504 - DNA, 18 bp, Homo sapiens
tggaggaccgaggctaca

SEQ ID NO: 4382505 - DNA, 21 bp, Homo sapiens
tggaggactagaacctggagg

SEQ ID NO: 4382506 - DNA, 16 bp, Homo sapiens
tggaggaggaaggcaa

SEQ ID NO: 4382507 - DNA, 17 bp, Homo sapiens
tggaggaggaaggcaag

SEQ ID NO: 4382508 - DNA, 23 bp, Homo sapiens
tggaggaggcctgggggcaggga

SEQ ID NO: 4382509 - DNA, 16 bp, Homo sapiens
tggaggattctttccc

SEQ ID NO: 4382510 - DNA, 21 bp, Homo sapiens
tggaggattctttccccagag

SEQ ID NO: 4382511 - DNA, 11 bp, Homo sapiens
tggaggcagag

SEQ ID NO: 4382512 - DNA, 14 bp, Homo sapiens
tggaggcagagacc

SEQ ID NO: 4382513 - DNA, 15 bp, Homo sapiens
tggaggcagagacct

SEQ ID NO: 4382514 - DNA, 14 bp, Homo sapiens
tggaggcagggcct

SEQ ID NO: 4382515 - DNA, 12 bp, Homo sapiens
tggaggcccagg

SEQ ID NO: 4382516 - DNA, 16 bp, Homo sapiens
tggaggcttcctgcgt

SEQ ID NO: 4382517 - DNA, 20 bp, Homo sapiens
tggaggcttcctgcgtcctc

SEQ ID NO: 4382518 - DNA, 16 bp, Homo sapiens
tggagggaaggacagt

SEQ ID NO: 4382519 - DNA, 16 bp, Homo sapiens
tggagggcaagccctg

SEQ ID NO: 4382520 - DNA, 22 bp, Homo sapiens
tggagggctagaacctggagag

SEQ ID NO: 4382521 - DNA, 20 bp, Homo sapiens
tggagggctagaactggaga

SEQ ID NO: 4382522 - DNA, 22 bp, Homo sapiens
tggagggctagaatctggagag

SEQ ID NO: 4382523 - DNA, 20 bp, Homo sapiens
tggagggctcatgggtggga

SEQ ID NO: 4382524 - DNA, 16 bp, Homo sapiens
tggaggggctggggac

SEQ ID NO: 4382525 - DNA, 22 bp, Homo sapiens
tggaggggcttgggcctgcacc

SEQ ID NO: 4382526 - DNA, 14 bp, Homo sapiens
tggagggggctggg

SEQ ID NO: 4382527 - DNA, 16 bp, Homo sapiens
tggagggggctggggt

SEQ ID NO: 4382528 - DNA, 20 bp, Homo sapiens
tggaggggtggcccagagcc

SEQ ID NO: 4382529 - DNA, 11 bp, Homo sapiens
tggaggggtgt

SEQ ID NO: 4382530 - DNA, 16 bp, Homo sapiens
tggagggtcccaagct

SEQ ID NO: 4382531 - DNA, 17 bp, Homo sapiens
tggagggtcccaagctg

SEQ ID NO: 4382532 - DNA, 18 bp, Homo sapiens
tggagggtcccaagctgg

SEQ ID NO: 4382533 - DNA, 22 bp, Homo sapiens
tggagggtcccaagctgggccc

SEQ ID NO: 4382534 - DNA, 23 bp, Homo sapiens
tggaggtggaaaagcaacattca

SEQ ID NO: 4382535 - DNA, 21 bp, Homo sapiens
tggaggtgggacgatgagact

SEQ ID NO: 4382536 - DNA, 14 bp, Homo sapiens
tggaggtggggaag

SEQ ID NO: 4382537 - DNA, 16 bp, Homo sapiens
tggaggtgtcaggctg

SEQ ID NO: 4382538 - DNA, 20 bp, Homo sapiens
tggaggtgtcaggctgctgg

SEQ ID NO: 4382539 - DNA, 16 bp, Homo sapiens
tggaggttaaggcata

SEQ ID NO: 4382540 - DNA, 18 bp, Homo sapiens
tggaggttgaagccaagt

SEQ ID NO: 4382541 - DNA, 22 bp, Homo sapiens
tggaggttgaagccaagtgggg

SEQ ID NO: 4382542 - DNA, 16 bp, Homo sapiens
tggagtcaaaaagaac

SEQ ID NO: 4382543 - DNA, 22 bp, Homo sapiens
tggagtcatggtccggtgtcct

SEQ ID NO: 4382544 - DNA, 17 bp, Homo sapiens
tggagtcccaggggcag

SEQ ID NO: 4382545 - DNA, 21 bp, Homo sapiens
tggagtctgagtctgagtcct

SEQ ID NO: 4382546 - DNA, 16 bp, Homo sapiens
tggagtgccaagtttg

SEQ ID NO: 4382547 - DNA, 13 bp, Homo sapiens
tggagttaaataa

SEQ ID NO: 4382548 - DNA, 23 bp, Homo sapiens
tggagttccttatccctctcttc

SEQ ID NO: 4382549 - DNA, 18 bp, Homo sapiens
tggagtttctctagaagc

SEQ ID NO: 4382550 - DNA, 14 bp, Homo sapiens
tggagtttctctgt

SEQ ID NO: 4382551 - DNA, 17 bp, Homo sapiens
tggagtttgggctggag

SEQ ID NO: 4382552 - DNA, 17 bp, Homo sapiens
tggagttttaactgtaa

SEQ ID NO: 4382553 - DNA, 22 bp, Homo sapiens
tggagtttttgtttggagagca

SEQ ID NO: 4382554 - DNA, 19 bp, Homo sapiens
tggataagtggctgtttca

SEQ ID NO: 4382555 - DNA, 21 bp, Homo sapiens
tggataagtggctgtttcatc

SEQ ID NO: 4382556 - DNA, 13 bp, Homo sapiens
tggataagtttct

SEQ ID NO: 4382557 - DNA, 13 bp, Homo sapiens
tggatatttgtat

SEQ ID NO: 4382558 - DNA, 14 bp, Homo sapiens
tggatcaagtatta

SEQ ID NO: 4382559 - DNA, 21 bp, Homo sapiens
tggatccatcttgagccacag

SEQ ID NO: 4382560 - DNA, 15 bp, Homo sapiens
tggatcctgctgctt

SEQ ID NO: 4382561 - DNA, 22 bp, Homo sapiens
tggatcctgctgctttgggctg

SEQ ID NO: 4382562 - DNA, 16 bp, Homo sapiens
tggatctatccctgcg

SEQ ID NO: 4382563 - DNA, 18 bp, Homo sapiens
tggatctcattggaccct

SEQ ID NO: 4382564 - DNA, 14 bp, Homo sapiens
tggatctcttaaga

SEQ ID NO: 4382565 - DNA, 19 bp, Homo sapiens
tggatctgggaccctttcc

SEQ ID NO: 4382566 - DNA, 15 bp, Homo sapiens
tggatcttcagaact

SEQ ID NO: 4382567 - DNA, 15 bp, Homo sapiens
tggatgattaaattt

SEQ ID NO: 4382568 - DNA, 16 bp, Homo sapiens
tggatgattcttttcc

SEQ ID NO: 4382569 - DNA, 14 bp, Homo sapiens
tggatgcatttcaa

SEQ ID NO: 4382570 - DNA, 17 bp, Homo sapiens
tggatgcatttcaaatg

SEQ ID NO: 4382571 - DNA, 22 bp, Homo sapiens
tggatgccgatttctgtaaact

SEQ ID NO: 4382572 - DNA, 14 bp, Homo sapiens
tggatggcaggagg

SEQ ID NO: 4382573 - DNA, 12 bp, Homo sapiens
tggatgtaaata

SEQ ID NO: 4382574 - DNA, 18 bp, Homo sapiens
tggattacgatgtaaatt

SEQ ID NO: 4382575 - DNA, 14 bp, Homo sapiens
tggattcatattta

SEQ ID NO: 4382576 - DNA, 12 bp, Homo sapiens
tggattccaaac

SEQ ID NO: 4382577 - DNA, 14 bp, Homo sapiens
tggattccaaacca

SEQ ID NO: 4382578 - DNA, 19 bp, Homo sapiens
tggattgtgcctaatgtgt

SEQ ID NO: 4382579 - DNA, 13 bp, Homo sapiens
tggattgtgcttt

SEQ ID NO: 4382580 - DNA, 15 bp, Homo sapiens
tggatttgcatattt

SEQ ID NO: 4382581 - DNA, 20 bp, Homo sapiens
tggcaaaagtaatcatgttt

SEQ ID NO: 4382582 - DNA, 19 bp, Homo sapiens
tggcaaacagggcctctgc

SEQ ID NO: 4382583 - DNA, 24 bp, Homo sapiens
tggcaaacagggcctctgcggagc

SEQ ID NO: 4382584 - DNA, 17 bp, Homo sapiens
tggcaaacgctaaagag

SEQ ID NO: 4382585 - DNA, 21 bp, Homo sapiens
tggcaaaggacccttgagtaa

SEQ ID NO: 4382586 - DNA, 19 bp, Homo sapiens
tggcaaagtttaaatgtat

SEQ ID NO: 4382587 - DNA, 13 bp, Homo sapiens
tggcaacacagag

SEQ ID NO: 4382588 - DNA, 16 bp, Homo sapiens
tggcaacattcattgc

SEQ ID NO: 4382589 - DNA, 17 bp, Homo sapiens
tggcaacattggacaga

SEQ ID NO: 4382590 - DNA, 16 bp, Homo sapiens
tggcaaggaaaaacag

SEQ ID NO: 4382591 - DNA, 13 bp, Homo sapiens
tggcaaggacttt

SEQ ID NO: 4382592 - DNA, 19 bp, Homo sapiens
tggcaaggactttgtacat

SEQ ID NO: 4382593 - DNA, 21 bp, Homo sapiens
tggcaaggactttgtacattt

SEQ ID NO: 4382594 - DNA, 20 bp, Homo sapiens
tggcaatcaaacattttctg

SEQ ID NO: 4382595 - DNA, 19 bp, Homo sapiens
tggcaatctcagatgcagt

SEQ ID NO: 4382596 - DNA, 22 bp, Homo sapiens
tggcaatgaaaattttaagaag

SEQ ID NO: 4382597 - DNA, 19 bp, Homo sapiens
tggcaatgccatcatctcc

SEQ ID NO: 4382598 - DNA, 13 bp, Homo sapiens
tggcaattccaat

SEQ ID NO: 4382599 - DNA, 16 bp, Homo sapiens
tggcaatttcctggcc

SEQ ID NO: 4382600 - DNA, 17 bp, Homo sapiens
tggcacagcccctggag

SEQ ID NO: 4382601 - DNA, 24 bp, Homo sapiens
tggcacagcccctggagcctcaga

SEQ ID NO: 4382602 - DNA, 21 bp, Homo sapiens
tggcacaggagtgtcctcttc

SEQ ID NO: 4382603 - DNA, 15 bp, Homo sapiens
tggcacccccatgct

SEQ ID NO: 4382604 - DNA, 18 bp, Homo sapiens
tggcacccccatgctgcc

SEQ ID NO: 4382605 - DNA, 11 bp, Homo sapiens
tggcacctgca

SEQ ID NO: 4382606 - DNA, 14 bp, Homo sapiens
tggcacctgcagcg

SEQ ID NO: 4382607 - DNA, 14 bp, Homo sapiens
tggcacgtattgct

SEQ ID NO: 4382608 - DNA, 15 bp, Homo sapiens
tggcacgtattgctg

SEQ ID NO: 4382609 - DNA, 22 bp, Homo sapiens
tggcactggcaaacagggcctc

SEQ ID NO: 4382610 - DNA, 13 bp, Homo sapiens
tggcactggccac

SEQ ID NO: 4382611 - DNA, 20 bp, Homo sapiens
tggcactttgttttcaagat

SEQ ID NO: 4382612 - DNA, 17 bp, Homo sapiens
tggcacttttgatgaaa

SEQ ID NO: 4382613 - DNA, 23 bp, Homo sapiens
tggcagaaatacagtcttccaca

SEQ ID NO: 4382614 - DNA, 19 bp, Homo sapiens
tggcagaagggaattgctc

SEQ ID NO: 4382615 - DNA, 19 bp, Homo sapiens
tggcagagttacagttctg

SEQ ID NO: 4382616 - DNA, 15 bp, Homo sapiens
tggcagatgtcttcc

SEQ ID NO: 4382617 - DNA, 18 bp, Homo sapiens
tggcagatgtcttccctg

SEQ ID NO: 4382618 - DNA, 18 bp, Homo sapiens
tggcagctgagagccctg

SEQ ID NO: 4382619 - DNA, 12 bp, Homo sapiens
tggcagctgctg

SEQ ID NO: 4382620 - DNA, 12 bp, Homo sapiens
tggcaggcccac

SEQ ID NO: 4382621 - DNA, 20 bp, Homo sapiens
tggcagggcgtgaggaactc

SEQ ID NO: 4382622 - DNA, 24 bp, Homo sapiens
tggcaggggagacaggagcctagc

SEQ ID NO: 4382623 - DNA, 18 bp, Homo sapiens
tggcagggggccccgcca

SEQ ID NO: 4382624 - DNA, 22 bp, Homo sapiens
tggcagggggccccgccagggc

SEQ ID NO: 4382625 - DNA, 16 bp, Homo sapiens
tggcagggtgggatgg

SEQ ID NO: 4382626 - DNA, 15 bp, Homo sapiens
tggcaggtcctcccc

SEQ ID NO: 4382627 - DNA, 14 bp, Homo sapiens
tggcagtaaagaga

SEQ ID NO: 4382628 - DNA, 18 bp, Homo sapiens
tggcagtccgtgggacgg

SEQ ID NO: 4382629 - DNA, 16 bp, Homo sapiens
tggcagtctgaatttt

SEQ ID NO: 4382630 - DNA, 14 bp, Homo sapiens
tggcataattttta

SEQ ID NO: 4382631 - DNA, 14 bp, Homo sapiens
tggcatacaaaata

SEQ ID NO: 4382632 - DNA, 15 bp, Homo sapiens
tggcatagccccggc

SEQ ID NO: 4382633 - DNA, 14 bp, Homo sapiens
tggcatattttaat

SEQ ID NO: 4382634 - DNA, 22 bp, Homo sapiens
tggcatcacagaccccagctgg

SEQ ID NO: 4382635 - DNA, 22 bp, Homo sapiens
tggcatccagagtccctgcctg

SEQ ID NO: 4382636 - DNA, 23 bp, Homo sapiens
tggcatcctcttgaataggaaga

SEQ ID NO: 4382637 - DNA, 16 bp, Homo sapiens
tggcatcgcagcttcc

SEQ ID NO: 4382638 - DNA, 17 bp, Homo sapiens
tggcatcgtgtattcca

SEQ ID NO: 4382639 - DNA, 18 bp, Homo sapiens
tggcatcttaaaagctat

SEQ ID NO: 4382640 - DNA, 16 bp, Homo sapiens
tggcatctttgccttg

SEQ ID NO: 4382641 - DNA, 13 bp, Homo sapiens
tggcatgtcattt

SEQ ID NO: 4382642 - DNA, 18 bp, Homo sapiens
tggcatgtcatttgcaca

SEQ ID NO: 4382643 - DNA, 19 bp, Homo sapiens
tggcatttgtgtgttggct

SEQ ID NO: 4382644 - DNA, 15 bp, Homo sapiens
tggccaaacaacagt

SEQ ID NO: 4382645 - DNA, 13 bp, Homo sapiens
tggccaagaagca

SEQ ID NO: 4382646 - DNA, 21 bp, Homo sapiens
tggccaagaagcagtggcctt

SEQ ID NO: 4382647 - DNA, 22 bp, Homo sapiens
tggccaatgcacctaaagaaaa

SEQ ID NO: 4382648 - DNA, 14 bp, Homo sapiens
tggccaatttcacc

SEQ ID NO: 4382649 - DNA, 16 bp, Homo sapiens
tggccacacaggcagg

SEQ ID NO: 4382650 - DNA, 20 bp, Homo sapiens
tggccacacaggcagggcct

SEQ ID NO: 4382651 - DNA, 21 bp, Homo sapiens
tggccacacaggcagggcctg

SEQ ID NO: 4382652 - DNA, 17 bp, Homo sapiens
tggccacagtagtcttg

SEQ ID NO: 4382653 - DNA, 19 bp, Homo sapiens
tggccaccagccatcctcc

SEQ ID NO: 4382654 - DNA, 22 bp, Homo sapiens
tggccaccaggtgcctttcaaa

SEQ ID NO: 4382655 - DNA, 20 bp, Homo sapiens
tggccaccccagccagcagc

SEQ ID NO: 4382656 - DNA, 19 bp, Homo sapiens
tggccacccctccccagta

SEQ ID NO: 4382657 - DNA, 15 bp, Homo sapiens
tggccactcagcttc

SEQ ID NO: 4382658 - DNA, 19 bp, Homo sapiens
tggccactggatcctgctg

SEQ ID NO: 4382659 - DNA, 14 bp, Homo sapiens
tggccactggggtg

SEQ ID NO: 4382660 - DNA, 22 bp, Homo sapiens
tggccactggggtgccttcact

SEQ ID NO: 4382661 - DNA, 19 bp, Homo sapiens
tggccagacgctgccgctg

SEQ ID NO: 4382662 - DNA, 16 bp, Homo sapiens
tggccagagcctctgg

SEQ ID NO: 4382663 - DNA, 19 bp, Homo sapiens
tggccagagcctctggccc

SEQ ID NO: 4382664 - DNA, 21 bp, Homo sapiens
tggccagagcctctggcccct

SEQ ID NO: 4382665 - DNA, 22 bp, Homo sapiens
tggccagagcctctggcccctc

SEQ ID NO: 4382666 - DNA, 18 bp, Homo sapiens
tggccagcaccctctcct

SEQ ID NO: 4382667 - DNA, 20 bp, Homo sapiens
tggccagcaccctctcctgg

SEQ ID NO: 4382668 - DNA, 15 bp, Homo sapiens
tggccagcccctggg

SEQ ID NO: 4382669 - DNA, 16 bp, Homo sapiens
tggccaggagctcttc

SEQ ID NO: 4382670 - DNA, 20 bp, Homo sapiens
tggccaggcagatctgtgcc

SEQ ID NO: 4382671 - DNA, 23 bp, Homo sapiens
tggccaggcagatctgtgcccca

SEQ ID NO: 4382672 - DNA, 19 bp, Homo sapiens
tggccaggcctcttggcag

SEQ ID NO: 4382673 - DNA, 22 bp, Homo sapiens
tggccagggccacgctccagct

SEQ ID NO: 4382674 - DNA, 16 bp, Homo sapiens
tggccaggggtgctcc

SEQ ID NO: 4382675 - DNA, 18 bp, Homo sapiens
tggccaggggtgctcctg

SEQ ID NO: 4382676 - DNA, 20 bp, Homo sapiens
tggccaggggtgctcctgtg

SEQ ID NO: 4382677 - DNA, 17 bp, Homo sapiens
tggccagtctgggtctg

SEQ ID NO: 4382678 - DNA, 22 bp, Homo sapiens
tggccagtgctgcccatgagca

SEQ ID NO: 4382679 - DNA, 14 bp, Homo sapiens
tggccagtggctgg

SEQ ID NO: 4382680 - DNA, 16 bp, Homo sapiens
tggccagtggctggat

SEQ ID NO: 4382681 - DNA, 23 bp, Homo sapiens
tggccagtggctggatctgtgag

SEQ ID NO: 4382682 - DNA, 18 bp, Homo sapiens
tggccagtgtttaaaact

SEQ ID NO: 4382683 - DNA, 21 bp, Homo sapiens
tggccatatatgctgtatttc

SEQ ID NO: 4382684 - DNA, 12 bp, Homo sapiens
tggccatccctg

SEQ ID NO: 4382685 - DNA, 20 bp, Homo sapiens
tggccatccctgggcccctc

SEQ ID NO: 4382686 - DNA, 22 bp, Homo sapiens
tggccatccctgggcccctcca

SEQ ID NO: 4382687 - DNA, 15 bp, Homo sapiens
tggccatccctgtga

SEQ ID NO: 4382688 - DNA, 16 bp, Homo sapiens
tggccatccctgtgag

SEQ ID NO: 4382689 - DNA, 18 bp, Homo sapiens
tggccatctccctcccca

SEQ ID NO: 4382690 - DNA, 12 bp, Homo sapiens
tggcccagagcc

SEQ ID NO: 4382691 - DNA, 17 bp, Homo sapiens
tggcccagcacgagcct

SEQ ID NO: 4382692 - DNA, 13 bp, Homo sapiens
tggcccagccctg

SEQ ID NO: 4382693 - DNA, 14 bp, Homo sapiens
tggcccagccctgc

SEQ ID NO: 4382694 - DNA, 16 bp, Homo sapiens
tggcccagggtggcca

SEQ ID NO: 4382695 - DNA, 19 bp, Homo sapiens
tggccccaggccccagaca

SEQ ID NO: 4382696 - DNA, 21 bp, Homo sapiens
tggccccaggccccagacagg

SEQ ID NO: 4382697 - DNA, 14 bp, Homo sapiens
tggcccccaataaa

SEQ ID NO: 4382698 - DNA, 18 bp, Homo sapiens
tggcccccaataaaggca

SEQ ID NO: 4382699 - DNA, 20 bp, Homo sapiens
tggcccccaataaaggcagc

SEQ ID NO: 4382700 - DNA, 18 bp, Homo sapiens
tggcccccatcagccctg

SEQ ID NO: 4382701 - DNA, 16 bp, Homo sapiens
tggcccctcccctgca

SEQ ID NO: 4382702 - DNA, 12 bp, Homo sapiens
tggcccctgggt

SEQ ID NO: 4382703 - DNA, 18 bp, Homo sapiens
tggccctctcccttaccc

SEQ ID NO: 4382704 - DNA, 17 bp, Homo sapiens
tggccctggcctgctgg

SEQ ID NO: 4382705 - DNA, 13 bp, Homo sapiens
tggccctgtccca

SEQ ID NO: 4382706 - DNA, 14 bp, Homo sapiens
tggccctgtcccag

SEQ ID NO: 4382707 - DNA, 13 bp, Homo sapiens
tggccctttcctt

SEQ ID NO: 4382708 - DNA, 16 bp, Homo sapiens
tggccgagctcctggg

SEQ ID NO: 4382709 - DNA, 12 bp, Homo sapiens
tggccgcctcac

SEQ ID NO: 4382710 - DNA, 16 bp, Homo sapiens
tggccgcctcaccccc

SEQ ID NO: 4382711 - DNA, 21 bp, Homo sapiens
tggccgcgccaaataatgtct

SEQ ID NO: 4382712 - DNA, 14 bp, Homo sapiens
tggccgctgagcgc

SEQ ID NO: 4382713 - DNA, 15 bp, Homo sapiens
tggccggcctcctcc

SEQ ID NO: 4382714 - DNA, 16 bp, Homo sapiens
tggccggcctcctcct

SEQ ID NO: 4382715 - DNA, 21 bp, Homo sapiens
tggccggcctcctcctcaccc

SEQ ID NO: 4382716 - DNA, 14 bp, Homo sapiens
tggccggctggttg

SEQ ID NO: 4382717 - DNA, 17 bp, Homo sapiens
tggccgggactgctgct

SEQ ID NO: 4382718 - DNA, 23 bp, Homo sapiens
tggccgggcacagtggctcacgc

SEQ ID NO: 4382719 - DNA, 21 bp, Homo sapiens
tggccggtgccagctgccctt

SEQ ID NO: 4382720 - DNA, 18 bp, Homo sapiens
tggcctacaaatcagtaa

SEQ ID NO: 4382721 - DNA, 15 bp, Homo sapiens
tggcctatccgctgc

SEQ ID NO: 4382722 - DNA, 19 bp, Homo sapiens
tggcctatgtggtctaagg

SEQ ID NO: 4382723 - DNA, 21 bp, Homo sapiens
tggcctatttcagctgctttg

SEQ ID NO: 4382724 - DNA, 17 bp, Homo sapiens
tggcctcagaattcaca

SEQ ID NO: 4382725 - DNA, 18 bp, Homo sapiens
tggcctcagccctgctcc

SEQ ID NO: 4382726 - DNA, 21 bp, Homo sapiens
tggcctcagccctgctccctg

SEQ ID NO: 4382727 - DNA, 23 bp, Homo sapiens
tggcctcagccctgctccctgcc

SEQ ID NO: 4382728 - DNA, 13 bp, Homo sapiens
tggcctcagctgc

SEQ ID NO: 4382729 - DNA, 14 bp, Homo sapiens
tggcctcagctgcc

SEQ ID NO: 4382730 - DNA, 19 bp, Homo sapiens
tggcctcatctcagaccct

SEQ ID NO: 4382731 - DNA, 20 bp, Homo sapiens
tggcctccaaaatattaaca

SEQ ID NO: 4382732 - DNA, 12 bp, Homo sapiens
tggcctccctgc

SEQ ID NO: 4382733 - DNA, 13 bp, Homo sapiens
tggcctccctgct

SEQ ID NO: 4382734 - DNA, 16 bp, Homo sapiens
tggcctccgcctgggt

SEQ ID NO: 4382735 - DNA, 21 bp, Homo sapiens
tggcctccggcgtcagcctcc

SEQ ID NO: 4382736 - DNA, 13 bp, Homo sapiens
tggcctcgcctcc

SEQ ID NO: 4382737 - DNA, 12 bp, Homo sapiens
tggcctctgctt

SEQ ID NO: 4382738 - DNA, 20 bp, Homo sapiens
tggcctctttcctcagcctt

SEQ ID NO: 4382739 - DNA, 17 bp, Homo sapiens
tggcctgaactgaggag

SEQ ID NO: 4382740 - DNA, 18 bp, Homo sapiens
tggcctgaactgaggaga

SEQ ID NO: 4382741 - DNA, 19 bp, Homo sapiens
tggcctgacagctctgttt

SEQ ID NO: 4382742 - DNA, 21 bp, Homo sapiens
tggcctgcacggtgggccttg

SEQ ID NO: 4382743 - DNA, 18 bp, Homo sapiens
tggcctgcggtggaggga

SEQ ID NO: 4382744 - DNA, 20 bp, Homo sapiens
tggcctgctgggctctccac

SEQ ID NO: 4382745 - DNA, 11 bp, Homo sapiens
tggcctgctgt

SEQ ID NO: 4382746 - DNA, 12 bp, Homo sapiens
tggcctggccag

SEQ ID NO: 4382747 - DNA, 13 bp, Homo sapiens
tggcctggccagg

SEQ ID NO: 4382748 - DNA, 15 bp, Homo sapiens
tggcctggccaggag

SEQ ID NO: 4382749 - DNA, 18 bp, Homo sapiens
tggcctggccaggagctc

SEQ ID NO: 4382750 - DNA, 13 bp, Homo sapiens
tggcctggccatc

SEQ ID NO: 4382751 - DNA, 18 bp, Homo sapiens
tggcctggggtgcatctc

SEQ ID NO: 4382752 - DNA, 16 bp, Homo sapiens
tggcctgtctcatccc

SEQ ID NO: 4382753 - DNA, 13 bp, Homo sapiens
tggccttaagaac

SEQ ID NO: 4382754 - DNA, 14 bp, Homo sapiens
tggccttaagaact

SEQ ID NO: 4382755 - DNA, 23 bp, Homo sapiens
tggccttaagaactgtgtctggc

SEQ ID NO: 4382756 - DNA, 14 bp, Homo sapiens
tggcctttccttcc

SEQ ID NO: 4382757 - DNA, 18 bp, Homo sapiens
tggcctttccttccctct

SEQ ID NO: 4382758 - DNA, 22 bp, Homo sapiens
tggcctttccttccctctctga

SEQ ID NO: 4382759 - DNA, 17 bp, Homo sapiens
tggcctttggacccagg

SEQ ID NO: 4382760 - DNA, 21 bp, Homo sapiens
tggcctttggacccagggcct

SEQ ID NO: 4382761 - DNA, 23 bp, Homo sapiens
tggcctttggacccagggcctga

SEQ ID NO: 4382762 - DNA, 14 bp, Homo sapiens
tggcctttgtgctg

SEQ ID NO: 4382763 - DNA, 16 bp, Homo sapiens
tggcctttgtgctgcg

SEQ ID NO: 4382764 - DNA, 16 bp, Homo sapiens
tggcctttttcattta

SEQ ID NO: 4382765 - DNA, 19 bp, Homo sapiens
tggcgagccatttgtccca

SEQ ID NO: 4382766 - DNA, 14 bp, Homo sapiens
tggcgcaagcctgt

SEQ ID NO: 4382767 - DNA, 18 bp, Homo sapiens
tggcgcaaggtcctcttg

SEQ ID NO: 4382768 - DNA, 20 bp, Homo sapiens
tggcgcaaggtcctcttgaa

SEQ ID NO: 4382769 - DNA, 16 bp, Homo sapiens
tggcgctcagcagccc

SEQ ID NO: 4382770 - DNA, 17 bp, Homo sapiens
tggcgctcagcagccct

SEQ ID NO: 4382771 - DNA, 19 bp, Homo sapiens
tggcgctcagcagccctag

SEQ ID NO: 4382772 - DNA, 20 bp, Homo sapiens
tggcgcttggatctggggtg

SEQ ID NO: 4382773 - DNA, 19 bp, Homo sapiens
tggcggagaaggagaggaa

SEQ ID NO: 4382774 - DNA, 15 bp, Homo sapiens
tggcggctactcagc

SEQ ID NO: 4382775 - DNA, 14 bp, Homo sapiens
tggcgggcccactc

SEQ ID NO: 4382776 - DNA, 21 bp, Homo sapiens
tggcgggcctttttcctgcgt

SEQ ID NO: 4382777 - DNA, 22 bp, Homo sapiens
tggcgtagcagagttaaatctc

SEQ ID NO: 4382778 - DNA, 23 bp, Homo sapiens
tggcgttcacctccctgctcagt

SEQ ID NO: 4382779 - DNA, 14 bp, Homo sapiens
tggcgttgttgcat

SEQ ID NO: 4382780 - DNA, 14 bp, Homo sapiens
tggctaaagctcga

SEQ ID NO: 4382781 - DNA, 20 bp, Homo sapiens
tggctaacagtctagtgcaa

SEQ ID NO: 4382782 - DNA, 16 bp, Homo sapiens
tggctaatttaacacc

SEQ ID NO: 4382783 - DNA, 15 bp, Homo sapiens
tggctagagtcctca

SEQ ID NO: 4382784 - DNA, 18 bp, Homo sapiens
tggctagagtcctcactc

SEQ ID NO: 4382785 - DNA, 21 bp, Homo sapiens
tggctagagtcctcactccca

SEQ ID NO: 4382786 - DNA, 16 bp, Homo sapiens
tggctagtcagagaga

SEQ ID NO: 4382787 - DNA, 20 bp, Homo sapiens
tggctatctatacctgcctt

SEQ ID NO: 4382788 - DNA, 21 bp, Homo sapiens
tggctatgaaaatgagccctg

SEQ ID NO: 4382789 - DNA, 23 bp, Homo sapiens
tggctatgaaaatgagccctggc

SEQ ID NO: 4382790 - DNA, 15 bp, Homo sapiens
tggctatgaacagaa

SEQ ID NO: 4382791 - DNA, 22 bp, Homo sapiens
tggctatgtagacataaagaag

SEQ ID NO: 4382792 - DNA, 13 bp, Homo sapiens
tggctatgttttt

SEQ ID NO: 4382793 - DNA, 17 bp, Homo sapiens
tggctatgtttttaatg

SEQ ID NO: 4382794 - DNA, 13 bp, Homo sapiens
tggctcacactga

SEQ ID NO: 4382795 - DNA, 13 bp, Homo sapiens
tggctcacccagt

SEQ ID NO: 4382796 - DNA, 16 bp, Homo sapiens
tggctcacccagtcct

SEQ ID NO: 4382797 - DNA, 19 bp, Homo sapiens
tggctcagacccctcagcc

SEQ ID NO: 4382798 - DNA, 21 bp, Homo sapiens
tggctcaggaggaggggtgag

SEQ ID NO: 4382799 - DNA, 23 bp, Homo sapiens
tggctcagtgccacctatgcctg

SEQ ID NO: 4382800 - DNA, 19 bp, Homo sapiens
tggctccactcttgatctc

SEQ ID NO: 4382801 - DNA, 13 bp, Homo sapiens
tggctccagtctc

SEQ ID NO: 4382802 - DNA, 20 bp, Homo sapiens
tggctccattggtgttgaca

SEQ ID NO: 4382803 - DNA, 14 bp, Homo sapiens
tggctcccatgacc

SEQ ID NO: 4382804 - DNA, 18 bp, Homo sapiens
tggctccccctccccagg

SEQ ID NO: 4382805 - DNA, 20 bp, Homo sapiens
tggctcccctgcccagcctg

SEQ ID NO: 4382806 - DNA, 22 bp, Homo sapiens
tggctcccctgcccagcctgct

SEQ ID NO: 4382807 - DNA, 15 bp, Homo sapiens
tggctccctcctcca

SEQ ID NO: 4382808 - DNA, 17 bp, Homo sapiens
tggctccctcctccagg

SEQ ID NO: 4382809 - DNA, 20 bp, Homo sapiens
tggctccctcctccaggcct

SEQ ID NO: 4382810 - DNA, 15 bp, Homo sapiens
tggctcgctccctgt

SEQ ID NO: 4382811 - DNA, 16 bp, Homo sapiens
tggctcggacccaccc

SEQ ID NO: 4382812 - DNA, 19 bp, Homo sapiens
tggctcggacccaccccaa

SEQ ID NO: 4382813 - DNA, 21 bp, Homo sapiens
tggctcggacccaccccaact

SEQ ID NO: 4382814 - DNA, 16 bp, Homo sapiens
tggctctctattccct

SEQ ID NO: 4382815 - DNA, 19 bp, Homo sapiens
tggctctgccccctccccc

SEQ ID NO: 4382816 - DNA, 20 bp, Homo sapiens
tggctgacccagtccctggg

SEQ ID NO: 4382817 - DNA, 19 bp, Homo sapiens
tggctgagatatgaacata

SEQ ID NO: 4382818 - DNA, 18 bp, Homo sapiens
tggctgaggttcctctgc

SEQ ID NO: 4382819 - DNA, 14 bp, Homo sapiens
tggctgccacaccc

SEQ ID NO: 4382820 - DNA, 18 bp, Homo sapiens
tggctgccacacccaggg

SEQ ID NO: 4382821 - DNA, 19 bp, Homo sapiens
tggctgccacacccagggg

SEQ ID NO: 4382822 - DNA, 13 bp, Homo sapiens
tggctgcccagga

SEQ ID NO: 4382823 - DNA, 18 bp, Homo sapiens
tggctgcgctaaccccca

SEQ ID NO: 4382824 - DNA, 19 bp, Homo sapiens
tggctgcgctaacccccag

SEQ ID NO: 4382825 - DNA, 14 bp, Homo sapiens
tggctgctgactga

SEQ ID NO: 4382826 - DNA, 20 bp, Homo sapiens
tggctgctgcccccaccccg

SEQ ID NO: 4382827 - DNA, 23 bp, Homo sapiens
tggctggaatagtaaactaaagt

SEQ ID NO: 4382828 - DNA, 23 bp, Homo sapiens
tggctggaggagcagcagcttgg

SEQ ID NO: 4382829 - DNA, 15 bp, Homo sapiens
tggctggcctcaccc

SEQ ID NO: 4382830 - DNA, 19 bp, Homo sapiens
tggctggcctcacccaccc

SEQ ID NO: 4382831 - DNA, 13 bp, Homo sapiens
tggctggctccta

SEQ ID NO: 4382832 - DNA, 23 bp, Homo sapiens
tggctggtagcagcaggctcagg

SEQ ID NO: 4382833 - DNA, 13 bp, Homo sapiens
tggctggtgtccc

SEQ ID NO: 4382834 - DNA, 16 bp, Homo sapiens
tggctggtgtcccctt

SEQ ID NO: 4382835 - DNA, 19 bp, Homo sapiens
tggctggtgtccccttccc

SEQ ID NO: 4382836 - DNA, 14 bp, Homo sapiens
tggctgtaaaactt

SEQ ID NO: 4382837 - DNA, 22 bp, Homo sapiens
tggctgtcctaccatcagctct

SEQ ID NO: 4382838 - DNA, 23 bp, Homo sapiens
tggctgtcctaccatcagctctg

SEQ ID NO: 4382839 - DNA, 21 bp, Homo sapiens
tggctgtgaatgccaaagcca

SEQ ID NO: 4382840 - DNA, 12 bp, Homo sapiens
tggctgtgagga

SEQ ID NO: 4382841 - DNA, 16 bp, Homo sapiens
tggctgtgctgtattt

SEQ ID NO: 4382842 - DNA, 19 bp, Homo sapiens
tggctgtgtgtctgcttgt

SEQ ID NO: 4382843 - DNA, 14 bp, Homo sapiens
tggctgttccagac

SEQ ID NO: 4382844 - DNA, 15 bp, Homo sapiens
tggctgttccagact

SEQ ID NO: 4382845 - DNA, 17 bp, Homo sapiens
tggctgttccagactca

SEQ ID NO: 4382846 - DNA, 20 bp, Homo sapiens
tggctgttttccctctgctg

SEQ ID NO: 4382847 - DNA, 22 bp, Homo sapiens
tggctgttttccctctgctgct

SEQ ID NO: 4382848 - DNA, 15 bp, Homo sapiens
tggcttaatcatttt

SEQ ID NO: 4382849 - DNA, 22 bp, Homo sapiens
tggcttatgtcatcagtaaagt

SEQ ID NO: 4382850 - DNA, 19 bp, Homo sapiens
tggcttatttaatatgctt

SEQ ID NO: 4382851 - DNA, 14 bp, Homo sapiens
tggcttccccactc

SEQ ID NO: 4382852 - DNA, 15 bp, Homo sapiens
tggcttccccactcc

SEQ ID NO: 4382853 - DNA, 20 bp, Homo sapiens
tggcttctccagggaattct

SEQ ID NO: 4382854 - DNA, 19 bp, Homo sapiens
tggcttcttttctttgtat

SEQ ID NO: 4382855 - DNA, 12 bp, Homo sapiens
tggctttcaagt

SEQ ID NO: 4382856 - DNA, 13 bp, Homo sapiens
tggctttcccagg

SEQ ID NO: 4382857 - DNA, 15 bp, Homo sapiens
tggctttctaccaca

SEQ ID NO: 4382858 - DNA, 18 bp, Homo sapiens
tggctttgaaacctcagg

SEQ ID NO: 4382859 - DNA, 11 bp, Homo sapiens
tggctttgcct

SEQ ID NO: 4382860 - DNA, 13 bp, Homo sapiens
tggctttgcctct

SEQ ID NO: 4382861 - DNA, 14 bp, Homo sapiens
tggctttggcactc

SEQ ID NO: 4382862 - DNA, 18 bp, Homo sapiens
tggctttggcactctctg

SEQ ID NO: 4382863 - DNA, 17 bp, Homo sapiens
tggcttttattaatgca

SEQ ID NO: 4382864 - DNA, 14 bp, Homo sapiens
tgggaaagcattgt

SEQ ID NO: 4382865 - DNA, 16 bp, Homo sapiens
tgggaaagcattgtaa

SEQ ID NO: 4382866 - DNA, 18 bp, Homo sapiens
tgggaaagcattgtaaat

SEQ ID NO: 4382867 - DNA, 21 bp, Homo sapiens
tgggaaagcattgtaaatgtg

SEQ ID NO: 4382868 - DNA, 16 bp, Homo sapiens
tgggaaatagcggccc

SEQ ID NO: 4382869 - DNA, 21 bp, Homo sapiens
tgggaaattaaatccaataaa

SEQ ID NO: 4382870 - DNA, 18 bp, Homo sapiens
tgggaacaaggaaggaaa

SEQ ID NO: 4382871 - DNA, 20 bp, Homo sapiens
tgggaacccaagtccaagca

SEQ ID NO: 4382872 - DNA, 23 bp, Homo sapiens
tgggaacctagctacactgagca

SEQ ID NO: 4382873 - DNA, 16 bp, Homo sapiens
tgggaacgtgactgcc

SEQ ID NO: 4382874 - DNA, 18 bp, Homo sapiens
tgggaactatgaggagcc

SEQ ID NO: 4382875 - DNA, 22 bp, Homo sapiens
tgggaactatgaggagcctctg

SEQ ID NO: 4382876 - DNA, 17 bp, Homo sapiens
tgggaactgcagacctg

SEQ ID NO: 4382877 - DNA, 13 bp, Homo sapiens
tgggaactgtgtt

SEQ ID NO: 4382878 - DNA, 18 bp, Homo sapiens
tgggaagaagaagacctc

SEQ ID NO: 4382879 - DNA, 18 bp, Homo sapiens
tgggaagaattggaagtt

SEQ ID NO: 4382880 - DNA, 18 bp, Homo sapiens
tgggaaggcttgggattt

SEQ ID NO: 4382881 - DNA, 15 bp, Homo sapiens
tgggaataattgctt

SEQ ID NO: 4382882 - DNA, 14 bp, Homo sapiens
tgggaatgggagag

SEQ ID NO: 4382883 - DNA, 15 bp, Homo sapiens
tgggaatgggagagg

SEQ ID NO: 4382884 - DNA, 17 bp, Homo sapiens
tgggaattcttgctgtt

SEQ ID NO: 4382885 - DNA, 14 bp, Homo sapiens
tgggacacagaccc

SEQ ID NO: 4382886 - DNA, 16 bp, Homo sapiens
tgggacacagacccag

SEQ ID NO: 4382887 - DNA, 20 bp, Homo sapiens
tgggacacagacccaggacc

SEQ ID NO: 4382888 - DNA, 21 bp, Homo sapiens
tgggacagacggaaatgaaat

SEQ ID NO: 4382889 - DNA, 11 bp, Homo sapiens
tgggacagagg

SEQ ID NO: 4382890 - DNA, 20 bp, Homo sapiens
tgggacagtttatcatgaag

SEQ ID NO: 4382891 - DNA, 22 bp, Homo sapiens
tgggacagtttatcatgaagcc

SEQ ID NO: 4382892 - DNA, 23 bp, Homo sapiens
tgggacagtttatcatgaagcct

SEQ ID NO: 4382893 - DNA, 13 bp, Homo sapiens
tgggaccctccag

SEQ ID NO: 4382894 - DNA, 13 bp, Homo sapiens
tgggaccctttcc

SEQ ID NO: 4382895 - DNA, 17 bp, Homo sapiens
tgggacctgccaggcag

SEQ ID NO: 4382896 - DNA, 18 bp, Homo sapiens
tgggacctgccaggcagg

SEQ ID NO: 4382897 - DNA, 20 bp, Homo sapiens
tgggacctgccaggcagggg

SEQ ID NO: 4382898 - DNA, 21 bp, Homo sapiens
tgggactagaggaacgtgcca

SEQ ID NO: 4382899 - DNA, 23 bp, Homo sapiens
tgggactcagttgttctgagcac

SEQ ID NO: 4382900 - DNA, 15 bp, Homo sapiens
tgggactctcctcct

SEQ ID NO: 4382901 - DNA, 16 bp, Homo sapiens
tgggactctcctcctc

SEQ ID NO: 4382902 - DNA, 22 bp, Homo sapiens
tgggactctcctcctcccctcc

SEQ ID NO: 4382903 - DNA, 18 bp, Homo sapiens
tgggactgctaaataaaa

SEQ ID NO: 4382904 - DNA, 17 bp, Homo sapiens
tgggactgtacacactt

SEQ ID NO: 4382905 - DNA, 18 bp, Homo sapiens
tgggactgtacacacttt

SEQ ID NO: 4382906 - DNA, 14 bp, Homo sapiens
tgggactgtgcctg

SEQ ID NO: 4382907 - DNA, 15 bp, Homo sapiens
tgggactgtgcctgg

SEQ ID NO: 4382908 - DNA, 19 bp, Homo sapiens
tgggactgtgcctggctcc

SEQ ID NO: 4382909 - DNA, 21 bp, Homo sapiens
tgggacttctacccagatgga

SEQ ID NO: 4382910 - DNA, 19 bp, Homo sapiens
tgggacttgaacaaagaca

SEQ ID NO: 4382911 - DNA, 19 bp, Homo sapiens
tgggagaaatacttgaact

SEQ ID NO: 4382912 - DNA, 14 bp, Homo sapiens
tgggagatgttaga

SEQ ID NO: 4382913 - DNA, 14 bp, Homo sapiens
tgggagcccagagg

SEQ ID NO: 4382914 - DNA, 19 bp, Homo sapiens
tgggagcccagagggtggc

SEQ ID NO: 4382915 - DNA, 22 bp, Homo sapiens
tgggagcctagctcctgccaca

SEQ ID NO: 4382916 - DNA, 15 bp, Homo sapiens
tgggagctcctctcc

SEQ ID NO: 4382917 - DNA, 20 bp, Homo sapiens
tgggagctcctctcctggag

SEQ ID NO: 4382918 - DNA, 21 bp, Homo sapiens
tgggagctcctctcctggagg

SEQ ID NO: 4382919 - DNA, 23 bp, Homo sapiens
tgggagctcctctcctggaggat

SEQ ID NO: 4382920 - DNA, 18 bp, Homo sapiens
tgggagctgagcagcctc

SEQ ID NO: 4382921 - DNA, 16 bp, Homo sapiens
tgggaggaaacctgag

SEQ ID NO: 4382922 - DNA, 17 bp, Homo sapiens
tgggaggaacaaagaca

SEQ ID NO: 4382923 - DNA, 11 bp, Homo sapiens
tgggaggacag

SEQ ID NO: 4382924 - DNA, 14 bp, Homo sapiens
tgggaggacaggca

SEQ ID NO: 4382925 - DNA, 15 bp, Homo sapiens
tgggaggacaggcag

SEQ ID NO: 4382926 - DNA, 14 bp, Homo sapiens
tgggaggagggaga

SEQ ID NO: 4382927 - DNA, 19 bp, Homo sapiens
tgggaggagggagagggag

SEQ ID NO: 4382928 - DNA, 18 bp, Homo sapiens
tgggaggagggcaggcat

SEQ ID NO: 4382929 - DNA, 20 bp, Homo sapiens
tgggaggcagaggttgcagt

SEQ ID NO: 4382930 - DNA, 16 bp, Homo sapiens
tgggaggcgtgccccc

SEQ ID NO: 4382931 - DNA, 21 bp, Homo sapiens
tgggaggcgtgcccccctcct

SEQ ID NO: 4382932 - DNA, 13 bp, Homo sapiens
tgggaggctcacc

SEQ ID NO: 4382933 - DNA, 22 bp, Homo sapiens
tgggaggctcacccccttctcc

SEQ ID NO: 4382934 - DNA, 11 bp, Homo sapiens
tgggaggctga

SEQ ID NO: 4382935 - DNA, 18 bp, Homo sapiens
tgggagggaaaagggaag

SEQ ID NO: 4382936 - DNA, 13 bp, Homo sapiens
tgggaggtcgagg

SEQ ID NO: 4382937 - DNA, 11 bp, Homo sapiens
tgggaggtgga

SEQ ID NO: 4382938 - DNA, 19 bp, Homo sapiens
tgggaggtggaagaaggga

SEQ ID NO: 4382939 - DNA, 21 bp, Homo sapiens
tgggaggtggaagcagaggcc

SEQ ID NO: 4382940 - DNA, 15 bp, Homo sapiens
tgggagtcacacagt

SEQ ID NO: 4382941 - DNA, 13 bp, Homo sapiens
tgggagtctcttg

SEQ ID NO: 4382942 - DNA, 22 bp, Homo sapiens
tgggagtgaggatgtctgggcc

SEQ ID NO: 4382943 - DNA, 14 bp, Homo sapiens
tgggagtggggcct

SEQ ID NO: 4382944 - DNA, 18 bp, Homo sapiens
tgggagtggggcctttgc

SEQ ID NO: 4382945 - DNA, 18 bp, Homo sapiens
tgggataactgatttcta

SEQ ID NO: 4382946 - DNA, 19 bp, Homo sapiens
tgggataactgatttctat

SEQ ID NO: 4382947 - DNA, 18 bp, Homo sapiens
tgggatatggctgcccag

SEQ ID NO: 4382948 - DNA, 20 bp, Homo sapiens
tgggatccacgctgggccta

SEQ ID NO: 4382949 - DNA, 13 bp, Homo sapiens
tgggatcctccct

SEQ ID NO: 4382950 - DNA, 18 bp, Homo sapiens
tgggatggtgactcctga

SEQ ID NO: 4382951 - DNA, 16 bp, Homo sapiens
tgggatggtggagggc

SEQ ID NO: 4382952 - DNA, 16 bp, Homo sapiens
tgggatgtcttatttt

SEQ ID NO: 4382953 - DNA, 22 bp, Homo sapiens
tgggatgtgctgttttctgtaa

SEQ ID NO: 4382954 - DNA, 14 bp, Homo sapiens
tgggattttgcaaa

SEQ ID NO: 4382955 - DNA, 16 bp, Homo sapiens
tgggcaaaccctggtg

SEQ ID NO: 4382956 - DNA, 19 bp, Homo sapiens
tgggcaacataccaagacc

SEQ ID NO: 4382957 - DNA, 20 bp, Homo sapiens
tgggcaacgagtgaaactcc

SEQ ID NO: 4382958 - DNA, 13 bp, Homo sapiens
tgggcaatttaga

SEQ ID NO: 4382959 - DNA, 14 bp, Homo sapiens
tgggcacagtccag

SEQ ID NO: 4382960 - DNA, 18 bp, Homo sapiens
tgggcacgcctgctggcc

SEQ ID NO: 4382961 - DNA, 22 bp, Homo sapiens
tgggcactccgcgccgatgcca

SEQ ID NO: 4382962 - DNA, 23 bp, Homo sapiens
tgggcactccgcgccgatgccac

SEQ ID NO: 4382963 - DNA, 13 bp, Homo sapiens
tgggcactggggc

SEQ ID NO: 4382964 - DNA, 13 bp, Homo sapiens
tgggcagagccca

SEQ ID NO: 4382965 - DNA, 17 bp, Homo sapiens
tgggcagattttcagca

SEQ ID NO: 4382966 - DNA, 19 bp, Homo sapiens
tgggcagcaatttaaatgt

SEQ ID NO: 4382967 - DNA, 12 bp, Homo sapiens
tgggcagcaccc

SEQ ID NO: 4382968 - DNA, 14 bp, Homo sapiens
tgggcagcaccctc

SEQ ID NO: 4382969 - DNA, 18 bp, Homo sapiens
tgggcagcaccctccccc

SEQ ID NO: 4382970 - DNA, 17 bp, Homo sapiens
tgggcagcacctttcta

SEQ ID NO: 4382971 - DNA, 15 bp, Homo sapiens
tgggcagcccaacag

SEQ ID NO: 4382972 - DNA, 18 bp, Homo sapiens
tgggcaggagggaggtgc

SEQ ID NO: 4382973 - DNA, 19 bp, Homo sapiens
tgggcagtgccccagggag

SEQ ID NO: 4382974 - DNA, 20 bp, Homo sapiens
tgggcagtgccccagggagt

SEQ ID NO: 4382975 - DNA, 16 bp, Homo sapiens
tgggcagttttttgaa

SEQ ID NO: 4382976 - DNA, 15 bp, Homo sapiens
tgggcatcagaaaac

SEQ ID NO: 4382977 - DNA, 15 bp, Homo sapiens
tgggcatggcagggc

SEQ ID NO: 4382978 - DNA, 16 bp, Homo sapiens
tgggcatggcagggcc

SEQ ID NO: 4382979 - DNA, 18 bp, Homo sapiens
tgggcatggcagggccag

SEQ ID NO: 4382980 - DNA, 15 bp, Homo sapiens
tgggcatttggtgag

SEQ ID NO: 4382981 - DNA, 14 bp, Homo sapiens
tgggcattttcctc

SEQ ID NO: 4382982 - DNA, 20 bp, Homo sapiens
tgggcattttcctcctctgc

SEQ ID NO: 4382983 - DNA, 21 bp, Homo sapiens
tgggccacacccaggaaggga

SEQ ID NO: 4382984 - DNA, 17 bp, Homo sapiens
tgggccaccgccttgcc

SEQ ID NO: 4382985 - DNA, 18 bp, Homo sapiens
tgggccacgccggccaca

SEQ ID NO: 4382986 - DNA, 22 bp, Homo sapiens
tgggccacttctgggtggggca

SEQ ID NO: 4382987 - DNA, 13 bp, Homo sapiens
tgggccagagttg

SEQ ID NO: 4382988 - DNA, 20 bp, Homo sapiens
tgggccagcggggctgctca

SEQ ID NO: 4382989 - DNA, 14 bp, Homo sapiens
tgggccaggacagg

SEQ ID NO: 4382990 - DNA, 14 bp, Homo sapiens
tgggcccaaccctg

SEQ ID NO: 4382991 - DNA, 18 bp, Homo sapiens
tgggcccaaccctgtctg

SEQ ID NO: 4382992 - DNA, 12 bp, Homo sapiens
tgggcccaggga

SEQ ID NO: 4382993 - DNA, 13 bp, Homo sapiens
tgggccccacatg

SEQ ID NO: 4382994 - DNA, 23 bp, Homo sapiens
tgggccccaccacctaggccact

SEQ ID NO: 4382995 - DNA, 15 bp, Homo sapiens
tgggccccagcccac

SEQ ID NO: 4382996 - DNA, 22 bp, Homo sapiens
tgggccccagcccaccctcctg

SEQ ID NO: 4382997 - DNA, 11 bp, Homo sapiens
tgggcccctcc

SEQ ID NO: 4382998 - DNA, 18 bp, Homo sapiens
tgggcccctccacgcctc

SEQ ID NO: 4382999 - DNA, 22 bp, Homo sapiens
tgggcccctccacgcctcctgg

SEQ ID NO: 4383000 - DNA, 14 bp, Homo sapiens
tgggcccctccagg

SEQ ID NO: 4383001 - DNA, 13 bp, Homo sapiens
tgggcccctccct

SEQ ID NO: 4383002 - DNA, 14 bp, Homo sapiens
tgggcccctcccta

SEQ ID NO: 4383003 - DNA, 20 bp, Homo sapiens
tgggcccctccctacctcaa

SEQ ID NO: 4383004 - DNA, 22 bp, Homo sapiens
tgggcccgcctcggcctcccaa

SEQ ID NO: 4383005 - DNA, 23 bp, Homo sapiens
tgggcccggtccacaggtccaag

SEQ ID NO: 4383006 - DNA, 13 bp, Homo sapiens
tgggccctctctg

SEQ ID NO: 4383007 - DNA, 18 bp, Homo sapiens
tgggccctctctgctctg

SEQ ID NO: 4383008 - DNA, 11 bp, Homo sapiens
tgggccctggg

SEQ ID NO: 4383009 - DNA, 21 bp, Homo sapiens
tgggccctgggctggcacagc

SEQ ID NO: 4383010 - DNA, 20 bp, Homo sapiens
tgggcctcagttcaacctgg

SEQ ID NO: 4383011 - DNA, 18 bp, Homo sapiens
tgggcctccctggcactg

SEQ ID NO: 4383012 - DNA, 17 bp, Homo sapiens
tgggcctggccctgctt

SEQ ID NO: 4383013 - DNA, 20 bp, Homo sapiens
tgggcctggccctgctttct

SEQ ID NO: 4383014 - DNA, 21 bp, Homo sapiens
tgggcctgtggggactgaacc

SEQ ID NO: 4383015 - DNA, 21 bp, Homo sapiens
tgggcctttaagaaccttaat

SEQ ID NO: 4383016 - DNA, 14 bp, Homo sapiens
tgggcggctcctgg

SEQ ID NO: 4383017 - DNA, 15 bp, Homo sapiens
tgggcggctcctggt

SEQ ID NO: 4383018 - DNA, 17 bp, Homo sapiens
tgggcgttgggagccta

SEQ ID NO: 4383019 - DNA, 23 bp, Homo sapiens
tgggctaggtagaaaaagggtca

SEQ ID NO: 4383020 - DNA, 14 bp, Homo sapiens
tgggctcaaatgat

SEQ ID NO: 4383021 - DNA, 21 bp, Homo sapiens
tgggctcaaatgatcctccca

SEQ ID NO: 4383022 - DNA, 18 bp, Homo sapiens
tgggctcaaccagaaaag

SEQ ID NO: 4383023 - DNA, 20 bp, Homo sapiens
tgggctcaagcaatcctcct

SEQ ID NO: 4383024 - DNA, 21 bp, Homo sapiens
tgggctcaagcaatcctcctg

SEQ ID NO: 4383025 - DNA, 21 bp, Homo sapiens
tgggctcactgtgctggggca

SEQ ID NO: 4383026 - DNA, 17 bp, Homo sapiens
tgggctccacgggcagg

SEQ ID NO: 4383027 - DNA, 16 bp, Homo sapiens
tgggctccagagggca

SEQ ID NO: 4383028 - DNA, 17 bp, Homo sapiens
tgggctccagagggcac

SEQ ID NO: 4383029 - DNA, 15 bp, Homo sapiens
tgggctctccacctc

SEQ ID NO: 4383030 - DNA, 12 bp, Homo sapiens
tgggctctgtgc

SEQ ID NO: 4383031 - DNA, 18 bp, Homo sapiens
tgggctctgtgcagtcac

SEQ ID NO: 4383032 - DNA, 11 bp, Homo sapiens
tgggctgaggg

SEQ ID NO: 4383033 - DNA, 18 bp, Homo sapiens
tgggctgccaccagcccc

SEQ ID NO: 4383034 - DNA, 10 bp, Homo sapiens
tgggctggag

SEQ ID NO: 4383035 - DNA, 17 bp, Homo sapiens
tgggctggagctcctcc

SEQ ID NO: 4383036 - DNA, 22 bp, Homo sapiens
tgggctggcacagcccctggag

SEQ ID NO: 4383037 - DNA, 19 bp, Homo sapiens
tgggctggcagtcctggaa

SEQ ID NO: 4383038 - DNA, 14 bp, Homo sapiens
tgggctgggccctc

SEQ ID NO: 4383039 - DNA, 13 bp, Homo sapiens
tgggctggggcca

SEQ ID NO: 4383040 - DNA, 21 bp, Homo sapiens
tgggctggggccacctttgtg

SEQ ID NO: 4383041 - DNA, 14 bp, Homo sapiens
tgggctgtctgtca

SEQ ID NO: 4383042 - DNA, 20 bp, Homo sapiens
tgggcttatatctggcctct

SEQ ID NO: 4383043 - DNA, 21 bp, Homo sapiens
tgggcttatatctggcctctg

SEQ ID NO: 4383044 - DNA, 13 bp, Homo sapiens
tgggcttcatctg

SEQ ID NO: 4383045 - DNA, 15 bp, Homo sapiens
tgggcttccatgcct

SEQ ID NO: 4383046 - DNA, 22 bp, Homo sapiens
tgggcttccccaggtggcctgg

SEQ ID NO: 4383047 - DNA, 14 bp, Homo sapiens
tgggcttcctgccc

SEQ ID NO: 4383048 - DNA, 20 bp, Homo sapiens
tgggcttcctgcccttccct

SEQ ID NO: 4383049 - DNA, 13 bp, Homo sapiens
tgggcttgattct

SEQ ID NO: 4383050 - DNA, 14 bp, Homo sapiens
tgggcttgattctg

SEQ ID NO: 4383051 - DNA, 16 bp, Homo sapiens
tgggcttggcctgctg

SEQ ID NO: 4383052 - DNA, 21 bp, Homo sapiens
tggggaaacaacatttatatg

SEQ ID NO: 4383053 - DNA, 14 bp, Homo sapiens
tggggaacaggtcc

SEQ ID NO: 4383054 - DNA, 22 bp, Homo sapiens
tggggaagaacagccccggggc

SEQ ID NO: 4383055 - DNA, 16 bp, Homo sapiens
tggggaatttcctcta

SEQ ID NO: 4383056 - DNA, 20 bp, Homo sapiens
tggggacacacattctgcct

SEQ ID NO: 4383057 - DNA, 22 bp, Homo sapiens
tggggacacacattctgccttg

SEQ ID NO: 4383058 - DNA, 20 bp, Homo sapiens
tggggacgccaaggaggtgg

SEQ ID NO: 4383059 - DNA, 21 bp, Homo sapiens
tggggacgttgctgagccagc

SEQ ID NO: 4383060 - DNA, 23 bp, Homo sapiens
tggggactccggctgtgctggga

SEQ ID NO: 4383061 - DNA, 23 bp, Homo sapiens
tggggactgctacctctgagaag

SEQ ID NO: 4383062 - DNA, 16 bp, Homo sapiens
tggggacttgtgtctg

SEQ ID NO: 4383063 - DNA, 20 bp, Homo sapiens
tggggagatgcttctctcct

SEQ ID NO: 4383064 - DNA, 21 bp, Homo sapiens
tggggaggcccaaatgatgga

SEQ ID NO: 4383065 - DNA, 19 bp, Homo sapiens
tggggagtaaacggcccag

SEQ ID NO: 4383066 - DNA, 21 bp, Homo sapiens
tggggagtaaacggcccaggc

SEQ ID NO: 4383067 - DNA, 19 bp, Homo sapiens
tggggagtggttaggcagc

SEQ ID NO: 4383068 - DNA, 16 bp, Homo sapiens
tggggatagatgtgtg

SEQ ID NO: 4383069 - DNA, 17 bp, Homo sapiens
tggggatagatgtgtgg

SEQ ID NO: 4383070 - DNA, 16 bp, Homo sapiens
tggggattggtgggtc

SEQ ID NO: 4383071 - DNA, 16 bp, Homo sapiens
tggggcagaggaagcc

SEQ ID NO: 4383072 - DNA, 13 bp, Homo sapiens
tggggcagcctct

SEQ ID NO: 4383073 - DNA, 23 bp, Homo sapiens
tggggcaggggtgcttcctcctc

SEQ ID NO: 4383074 - DNA, 18 bp, Homo sapiens
tggggccagaggctggga

SEQ ID NO: 4383075 - DNA, 12 bp, Homo sapiens
tggggccaggaa

SEQ ID NO: 4383076 - DNA, 18 bp, Homo sapiens
tggggcccagccgatgtg

SEQ ID NO: 4383077 - DNA, 13 bp, Homo sapiens
tggggccccatct

SEQ ID NO: 4383078 - DNA, 16 bp, Homo sapiens
tggggccctgggcctc

SEQ ID NO: 4383079 - DNA, 18 bp, Homo sapiens
tggggccctgggcctcag

SEQ ID NO: 4383080 - DNA, 19 bp, Homo sapiens
tggggccctgggcctcagt

SEQ ID NO: 4383081 - DNA, 21 bp, Homo sapiens
tggggcctagcgatctctcct

SEQ ID NO: 4383082 - DNA, 22 bp, Homo sapiens
tggggcctagcgatctctcctg

SEQ ID NO: 4383083 - DNA, 14 bp, Homo sapiens
tggggcctcaggct

SEQ ID NO: 4383084 - DNA, 17 bp, Homo sapiens
tggggcctcaggctccg

SEQ ID NO: 4383085 - DNA, 13 bp, Homo sapiens
tggggcctttgcc

SEQ ID NO: 4383086 - DNA, 18 bp, Homo sapiens
tggggcctttgccagcag

SEQ ID NO: 4383087 - DNA, 22 bp, Homo sapiens
tggggcctttgccagcagagcc

SEQ ID NO: 4383088 - DNA, 23 bp, Homo sapiens
tggggcctttgccagcagagcca

SEQ ID NO: 4383089 - DNA, 13 bp, Homo sapiens
tggggcgcccacc

SEQ ID NO: 4383090 - DNA, 23 bp, Homo sapiens
tggggctcccagccaggcccttg

SEQ ID NO: 4383091 - DNA, 16 bp, Homo sapiens
tggggctcccagctcc

SEQ ID NO: 4383092 - DNA, 17 bp, Homo sapiens
tggggctcccagctcct

SEQ ID NO: 4383093 - DNA, 11 bp, Homo sapiens
tggggctgaac

SEQ ID NO: 4383094 - DNA, 15 bp, Homo sapiens
tggggctgctcctcc

SEQ ID NO: 4383095 - DNA, 17 bp, Homo sapiens
tggggctgctcctccag

SEQ ID NO: 4383096 - DNA, 19 bp, Homo sapiens
tggggctgctcctccaggg

SEQ ID NO: 4383097 - DNA, 20 bp, Homo sapiens
tggggctgtgttatgaaaat

SEQ ID NO: 4383098 - DNA, 16 bp, Homo sapiens
tgggggaagccctgga

SEQ ID NO: 4383099 - DNA, 15 bp, Homo sapiens
tgggggacagggctg

SEQ ID NO: 4383100 - DNA, 16 bp, Homo sapiens
tgggggacagggctgg

SEQ ID NO: 4383101 - DNA, 18 bp, Homo sapiens
tgggggacagggctggcc

SEQ ID NO: 4383102 - DNA, 22 bp, Homo sapiens
tgggggacagggctggcccagc

SEQ ID NO: 4383103 - DNA, 18 bp, Homo sapiens
tgggggatgggccagggt

SEQ ID NO: 4383104 - DNA, 14 bp, Homo sapiens
tgggggatgtggcc

SEQ ID NO: 4383105 - DNA, 13 bp, Homo sapiens
tgggggcagaggg

SEQ ID NO: 4383106 - DNA, 16 bp, Homo sapiens
tgggggcagtctcccc

SEQ ID NO: 4383107 - DNA, 21 bp, Homo sapiens
tgggggcatctcttccccaga

SEQ ID NO: 4383108 - DNA, 23 bp, Homo sapiens
tgggggcatctcttccccagaga

SEQ ID NO: 4383109 - DNA, 20 bp, Homo sapiens
tggggggacagagactcaga

SEQ ID NO: 4383110 - DNA, 20 bp, Homo sapiens
tggggggatggtaagagaaa

SEQ ID NO: 4383111 - DNA, 14 bp, Homo sapiens
tggggggccgggca

SEQ ID NO: 4383112 - DNA, 20 bp, Homo sapiens
tggggggccgggcaggtcct

SEQ ID NO: 4383113 - DNA, 21 bp, Homo sapiens
tgggggggccaaaaggaaaaa

SEQ ID NO: 4383114 - DNA, 20 bp, Homo sapiens
tgggggtaagaaaagctggt

SEQ ID NO: 4383115 - DNA, 14 bp, Homo sapiens
tgggggtgccagga

SEQ ID NO: 4383116 - DNA, 14 bp, Homo sapiens
tgggggtggccatc

SEQ ID NO: 4383117 - DNA, 19 bp, Homo sapiens
tgggggtggccatccctgg

SEQ ID NO: 4383118 - DNA, 13 bp, Homo sapiens
tgggggtgggtca

SEQ ID NO: 4383119 - DNA, 14 bp, Homo sapiens
tgggggtgggtcag

SEQ ID NO: 4383120 - DNA, 16 bp, Homo sapiens
tgggggttcaggcccg

SEQ ID NO: 4383121 - DNA, 12 bp, Homo sapiens
tgggggttttta

SEQ ID NO: 4383122 - DNA, 22 bp, Homo sapiens
tggggtaagccagagcctgggg

SEQ ID NO: 4383123 - DNA, 16 bp, Homo sapiens
tggggtacatttctct

SEQ ID NO: 4383124 - DNA, 19 bp, Homo sapiens
tggggtatggattctaaaa

SEQ ID NO: 4383125 - DNA, 15 bp, Homo sapiens
tggggtcacagaggc

SEQ ID NO: 4383126 - DNA, 19 bp, Homo sapiens
tggggtccctccaccccac

SEQ ID NO: 4383127 - DNA, 22 bp, Homo sapiens
tggggtctccctctcctgccta

SEQ ID NO: 4383128 - DNA, 15 bp, Homo sapiens
tggggtgcagcttca

SEQ ID NO: 4383129 - DNA, 17 bp, Homo sapiens
tggggtgccgcctgccc

SEQ ID NO: 4383130 - DNA, 17 bp, Homo sapiens
tggggtgccttcactgg

SEQ ID NO: 4383131 - DNA, 18 bp, Homo sapiens
tggggtgctgggaggagg

SEQ ID NO: 4383132 - DNA, 22 bp, Homo sapiens
tggggttcagcccctcctctgc

SEQ ID NO: 4383133 - DNA, 15 bp, Homo sapiens
tggggttgccagagg

SEQ ID NO: 4383134 - DNA, 16 bp, Homo sapiens
tggggtttcaccatat

SEQ ID NO: 4383135 - DNA, 16 bp, Homo sapiens
tggggtttgaagctga

SEQ ID NO: 4383136 - DNA, 22 bp, Homo sapiens
tgggtagaaaaattattagaac

SEQ ID NO: 4383137 - DNA, 16 bp, Homo sapiens
tgggtatattgataaa

SEQ ID NO: 4383138 - DNA, 19 bp, Homo sapiens
tgggtatattgataaattt

SEQ ID NO: 4383139 - DNA, 19 bp, Homo sapiens
tgggtcagaaccctgccat

SEQ ID NO: 4383140 - DNA, 14 bp, Homo sapiens
tgggtcagagaaaa

SEQ ID NO: 4383141 - DNA, 19 bp, Homo sapiens
tgggtcagtggccaggtgc

SEQ ID NO: 4383142 - DNA, 15 bp, Homo sapiens
tgggtcatgggcctg

SEQ ID NO: 4383143 - DNA, 12 bp, Homo sapiens
tgggtccaggga

SEQ ID NO: 4383144 - DNA, 18 bp, Homo sapiens
tgggtccatgggcagagc

SEQ ID NO: 4383145 - DNA, 18 bp, Homo sapiens
tgggtcctagcccttccc

SEQ ID NO: 4383146 - DNA, 13 bp, Homo sapiens
tgggtcctgccag

SEQ ID NO: 4383147 - DNA, 16 bp, Homo sapiens
tgggtcctgccagctg

SEQ ID NO: 4383148 - DNA, 18 bp, Homo sapiens
tgggtcctgccagctgga

SEQ ID NO: 4383149 - DNA, 22 bp, Homo sapiens
tgggtctaggacacagttcctg

SEQ ID NO: 4383150 - DNA, 21 bp, Homo sapiens
tgggtctctctcggcccctgt

SEQ ID NO: 4383151 - DNA, 22 bp, Homo sapiens
tgggtctgaggcccctgcctcc

SEQ ID NO: 4383152 - DNA, 17 bp, Homo sapiens
tgggtctggccagggct

SEQ ID NO: 4383153 - DNA, 24 bp, Homo sapiens
tgggtctgggatatggctgcccag

SEQ ID NO: 4383154 - DNA, 13 bp, Homo sapiens
tgggtctgtgtgt

SEQ ID NO: 4383155 - DNA, 14 bp, Homo sapiens
tgggtcttcagctt

SEQ ID NO: 4383156 - DNA, 21 bp, Homo sapiens
tgggtcttttataggaaaaaa

SEQ ID NO: 4383157 - DNA, 13 bp, Homo sapiens
tgggtgagctctc

SEQ ID NO: 4383158 - DNA, 14 bp, Homo sapiens
tgggtgagctctca

SEQ ID NO: 4383159 - DNA, 18 bp, Homo sapiens
tgggtgctgatccttgca

SEQ ID NO: 4383160 - DNA, 12 bp, Homo sapiens
tgggtgggagga

SEQ ID NO: 4383161 - DNA, 18 bp, Homo sapiens
tgggtgggcctggccctg

SEQ ID NO: 4383162 - DNA, 16 bp, Homo sapiens
tgggtgggctctgtgc

SEQ ID NO: 4383163 - DNA, 19 bp, Homo sapiens
tgggtgggctctgtgcagt

SEQ ID NO: 4383164 - DNA, 16 bp, Homo sapiens
tgggtggggctcctgg

SEQ ID NO: 4383165 - DNA, 17 bp, Homo sapiens
tgggtggggctcctggg

SEQ ID NO: 4383166 - DNA, 18 bp, Homo sapiens
tgggtggggctcctggga

SEQ ID NO: 4383167 - DNA, 13 bp, Homo sapiens
tgggtggggctgc

SEQ ID NO: 4383168 - DNA, 22 bp, Homo sapiens
tgggtgtagatttctgacatca

SEQ ID NO: 4383169 - DNA, 21 bp, Homo sapiens
tgggtgtcaagtgcctgcacc

SEQ ID NO: 4383170 - DNA, 20 bp, Homo sapiens
tgggtgtcatttcattccat

SEQ ID NO: 4383171 - DNA, 16 bp, Homo sapiens
tgggtgttctttcctg

SEQ ID NO: 4383172 - DNA, 20 bp, Homo sapiens
tgggttatcatggaagaaaa

SEQ ID NO: 4383173 - DNA, 16 bp, Homo sapiens
tgggttattctggagt

SEQ ID NO: 4383174 - DNA, 16 bp, Homo sapiens
tgggttcatgatgcag

SEQ ID NO: 4383175 - DNA, 15 bp, Homo sapiens
tgggttgtcaccaag

SEQ ID NO: 4383176 - DNA, 22 bp, Homo sapiens
tgggttttgttggctttttgaa

SEQ ID NO: 4383177 - DNA, 19 bp, Homo sapiens
tgggtttttcctctgttaa

SEQ ID NO: 4383178 - DNA, 18 bp, Homo sapiens
tggtaaaaatgctgctct

SEQ ID NO: 4383179 - DNA, 20 bp, Homo sapiens
tggtaaaatgtgaaaaacta

SEQ ID NO: 4383180 - DNA, 21 bp, Homo sapiens
tggtaaacattcctccagcct

SEQ ID NO: 4383181 - DNA, 24 bp, Homo sapiens
tggtaaacattcctccagcctccc

SEQ ID NO: 4383182 - DNA, 17 bp, Homo sapiens
tggtaaagactggcttt

SEQ ID NO: 4383183 - DNA, 14 bp, Homo sapiens
tggtaactgctttc

SEQ ID NO: 4383184 - DNA, 14 bp, Homo sapiens
tggtaagattgtta

SEQ ID NO: 4383185 - DNA, 18 bp, Homo sapiens
tggtaagattgttattaa

SEQ ID NO: 4383186 - DNA, 19 bp, Homo sapiens
tggtaagattgttattaaa

SEQ ID NO: 4383187 - DNA, 20 bp, Homo sapiens
tggtaagattgttattaaat

SEQ ID NO: 4383188 - DNA, 17 bp, Homo sapiens
tggtaagctatgtccca

SEQ ID NO: 4383189 - DNA, 18 bp, Homo sapiens
tggtaagtgaatttatga

SEQ ID NO: 4383190 - DNA, 23 bp, Homo sapiens
tggtaatctacaccaatgaaaac

SEQ ID NO: 4383191 - DNA, 22 bp, Homo sapiens
tggtaatctttacctgtataca

SEQ ID NO: 4383192 - DNA, 23 bp, Homo sapiens
tggtaatctttacctgtatacag

SEQ ID NO: 4383193 - DNA, 23 bp, Homo sapiens
tggtaatttatagtttatacagt

SEQ ID NO: 4383194 - DNA, 19 bp, Homo sapiens
tggtacaaaaataaattta

SEQ ID NO: 4383195 - DNA, 21 bp, Homo sapiens
tggtacaaaaataaatttata

SEQ ID NO: 4383196 - DNA, 12 bp, Homo sapiens
tggtacacatgt

SEQ ID NO: 4383197 - DNA, 22 bp, Homo sapiens
tggtacacatgtgttatctacc

SEQ ID NO: 4383198 - DNA, 14 bp, Homo sapiens
tggtacatctacct

SEQ ID NO: 4383199 - DNA, 15 bp, Homo sapiens
tggtacatggtgttt

SEQ ID NO: 4383200 - DNA, 14 bp, Homo sapiens
tggtacttcctctg

SEQ ID NO: 4383201 - DNA, 15 bp, Homo sapiens
tggtacttcctctgt

SEQ ID NO: 4383202 - DNA, 23 bp, Homo sapiens
tggtagaagctgaagagcacggt

SEQ ID NO: 4383203 - DNA, 14 bp, Homo sapiens
tggtagagaaggag

SEQ ID NO: 4383204 - DNA, 15 bp, Homo sapiens
tggtagatgacaaat

SEQ ID NO: 4383205 - DNA, 17 bp, Homo sapiens
tggtaggactgtagaaa

SEQ ID NO: 4383206 - DNA, 14 bp, Homo sapiens
tggtatagaaatgc

SEQ ID NO: 4383207 - DNA, 16 bp, Homo sapiens
tggtatagaaatgctg

SEQ ID NO: 4383208 - DNA, 16 bp, Homo sapiens
tggtatatccaaaagc

SEQ ID NO: 4383209 - DNA, 19 bp, Homo sapiens
tggtatatccaaaagcttt

SEQ ID NO: 4383210 - DNA, 22 bp, Homo sapiens
tggtatatccaaaagcttttta

SEQ ID NO: 4383211 - DNA, 18 bp, Homo sapiens
tggtatgcattctttata

SEQ ID NO: 4383212 - DNA, 14 bp, Homo sapiens
tggtatgctggcca

SEQ ID NO: 4383213 - DNA, 21 bp, Homo sapiens
tggtatgctggccagcaccct

SEQ ID NO: 4383214 - DNA, 22 bp, Homo sapiens
tggtatgctggccagcaccctc

SEQ ID NO: 4383215 - DNA, 17 bp, Homo sapiens
tggtatgtgggtgaccc

SEQ ID NO: 4383216 - DNA, 18 bp, Homo sapiens
tggtattttccagcactt

SEQ ID NO: 4383217 - DNA, 22 bp, Homo sapiens
tggtcaacatagtgagacactg

SEQ ID NO: 4383218 - DNA, 14 bp, Homo sapiens
tggtcacacactga

SEQ ID NO: 4383219 - DNA, 16 bp, Homo sapiens
tggtcacacactgatg

SEQ ID NO: 4383220 - DNA, 17 bp, Homo sapiens
tggtcacagcctcctct

SEQ ID NO: 4383221 - DNA, 18 bp, Homo sapiens
tggtcacagcctcctctg

SEQ ID NO: 4383222 - DNA, 13 bp, Homo sapiens
tggtcacagctgt

SEQ ID NO: 4383223 - DNA, 22 bp, Homo sapiens
tggtcacaggaagtagaggagg

SEQ ID NO: 4383224 - DNA, 15 bp, Homo sapiens
tggtcaccgagactc

SEQ ID NO: 4383225 - DNA, 22 bp, Homo sapiens
tggtcaccgagactcagcctct

SEQ ID NO: 4383226 - DNA, 20 bp, Homo sapiens
tggtcacgtttggtgcttct

SEQ ID NO: 4383227 - DNA, 22 bp, Homo sapiens
tggtcagagagacctcatcctg

SEQ ID NO: 4383228 - DNA, 19 bp, Homo sapiens
tggtcagccctagggtgga

SEQ ID NO: 4383229 - DNA, 23 bp, Homo sapiens
tggtcaggagggtcaccctggcc

SEQ ID NO: 4383230 - DNA, 15 bp, Homo sapiens
tggtcatatacatat

SEQ ID NO: 4383231 - DNA, 16 bp, Homo sapiens
tggtcatatacatatt

SEQ ID NO: 4383232 - DNA, 23 bp, Homo sapiens
tggtccagtggggaacaggtccc

SEQ ID NO: 4383233 - DNA, 12 bp, Homo sapiens
tggtcctggtgc

SEQ ID NO: 4383234 - DNA, 13 bp, Homo sapiens
tggtcctggtgct

SEQ ID NO: 4383235 - DNA, 12 bp, Homo sapiens
tggtccttattt

SEQ ID NO: 4383236 - DNA, 13 bp, Homo sapiens
tggtccttattta

SEQ ID NO: 4383237 - DNA, 16 bp, Homo sapiens
tggtccttatttattt

SEQ ID NO: 4383238 - DNA, 18 bp, Homo sapiens
tggtccttccctgatggc

SEQ ID NO: 4383239 - DNA, 16 bp, Homo sapiens
tggtcggatctcacag

SEQ ID NO: 4383240 - DNA, 22 bp, Homo sapiens
tggtcggatctcacaggctgag

SEQ ID NO: 4383241 - DNA, 21 bp, Homo sapiens
tggtctaatgattcaaatgtt

SEQ ID NO: 4383242 - DNA, 16 bp, Homo sapiens
tggtctcaaactcctg

SEQ ID NO: 4383243 - DNA, 21 bp, Homo sapiens
tggtctcaaacttgtggcctc

SEQ ID NO: 4383244 - DNA, 22 bp, Homo sapiens
tggtctccccaattctcccctc

SEQ ID NO: 4383245 - DNA, 23 bp, Homo sapiens
tggtctccccaattctcccctcc

SEQ ID NO: 4383246 - DNA, 16 bp, Homo sapiens
tggtctcgatctcctg

SEQ ID NO: 4383247 - DNA, 17 bp, Homo sapiens
tggtctggttcctgtgt

SEQ ID NO: 4383248 - DNA, 16 bp, Homo sapiens
tggtctggttgggcag

SEQ ID NO: 4383249 - DNA, 17 bp, Homo sapiens
tggtctggttgggcagc

SEQ ID NO: 4383250 - DNA, 19 bp, Homo sapiens
tggtctgtagcaagctgag

SEQ ID NO: 4383251 - DNA, 15 bp, Homo sapiens
tggtcttacagcagg

SEQ ID NO: 4383252 - DNA, 20 bp, Homo sapiens
tggtcttacagcaggcagta

SEQ ID NO: 4383253 - DNA, 15 bp, Homo sapiens
tggtctttcattgct

SEQ ID NO: 4383254 - DNA, 14 bp, Homo sapiens
tggtctttctgtgc

SEQ ID NO: 4383255 - DNA, 21 bp, Homo sapiens
tggtgaaatcccatctctaca

SEQ ID NO: 4383256 - DNA, 19 bp, Homo sapiens
tggtgaaattgactgatga

SEQ ID NO: 4383257 - DNA, 21 bp, Homo sapiens
tggtgaactgagctgggcagg

SEQ ID NO: 4383258 - DNA, 21 bp, Homo sapiens
tggtgaagtgtggctggtgtc

SEQ ID NO: 4383259 - DNA, 14 bp, Homo sapiens
tggtgacacctccc

SEQ ID NO: 4383260 - DNA, 17 bp, Homo sapiens
tggtgaccagtttctta

SEQ ID NO: 4383261 - DNA, 20 bp, Homo sapiens
tggtgactcctgaaacctct

SEQ ID NO: 4383262 - DNA, 16 bp, Homo sapiens
tggtgagagtcaaagc

SEQ ID NO: 4383263 - DNA, 15 bp, Homo sapiens
tggtgcactttgtaa

SEQ ID NO: 4383264 - DNA, 18 bp, Homo sapiens
tggtgcagccttcccctc

SEQ ID NO: 4383265 - DNA, 15 bp, Homo sapiens
tggtgccaatttcaa

SEQ ID NO: 4383266 - DNA, 22 bp, Homo sapiens
tggtgcccctgctcactgggcc

SEQ ID NO: 4383267 - DNA, 23 bp, Homo sapiens
tggtgcccctgctcactgggccc

SEQ ID NO: 4383268 - DNA, 19 bp, Homo sapiens
tggtgccgatgttgaactt

SEQ ID NO: 4383269 - DNA, 22 bp, Homo sapiens
tggtgcctaaagtttaaccaaa

SEQ ID NO: 4383270 - DNA, 14 bp, Homo sapiens
tggtgcctcctcaa

SEQ ID NO: 4383271 - DNA, 13 bp, Homo sapiens
tggtgcctgagag

SEQ ID NO: 4383272 - DNA, 13 bp, Homo sapiens
tggtgcctttcct

SEQ ID NO: 4383273 - DNA, 15 bp, Homo sapiens
tggtgcctttcctgt

SEQ ID NO: 4383274 - DNA, 22 bp, Homo sapiens
tggtgcctttcctgttcagcat

SEQ ID NO: 4383275 - DNA, 18 bp, Homo sapiens
tggtgctcatttaaatat

SEQ ID NO: 4383276 - DNA, 16 bp, Homo sapiens
tggtgctcttttttct

SEQ ID NO: 4383277 - DNA, 14 bp, Homo sapiens
tggtgctgccgagg

SEQ ID NO: 4383278 - DNA, 20 bp, Homo sapiens
tggtgctttccttcatctcc

SEQ ID NO: 4383279 - DNA, 21 bp, Homo sapiens
tggtggaggaagggctgggcc

SEQ ID NO: 4383280 - DNA, 13 bp, Homo sapiens
tggtggagggcca

SEQ ID NO: 4383281 - DNA, 15 bp, Homo sapiens
tggtggcatcacaga

SEQ ID NO: 4383282 - DNA, 19 bp, Homo sapiens
tggtggcctatttcagctg

SEQ ID NO: 4383283 - DNA, 16 bp, Homo sapiens
tggtggcgcaagcctg

SEQ ID NO: 4383284 - DNA, 21 bp, Homo sapiens
tggtgggaagcgtctgtccgt

SEQ ID NO: 4383285 - DNA, 13 bp, Homo sapiens
tggtgggatccac

SEQ ID NO: 4383286 - DNA, 13 bp, Homo sapiens
tggtggggggcag

SEQ ID NO: 4383287 - DNA, 22 bp, Homo sapiens
tggtgggtctatgttccccagg

SEQ ID NO: 4383288 - DNA, 21 bp, Homo sapiens
tggtgggttcaggggactcag

SEQ ID NO: 4383289 - DNA, 13 bp, Homo sapiens
tggtggtgctaaa

SEQ ID NO: 4383290 - DNA, 15 bp, Homo sapiens
tggtgtaatttgaag

SEQ ID NO: 4383291 - DNA, 11 bp, Homo sapiens
tggtgtatttt

SEQ ID NO: 4383292 - DNA, 19 bp, Homo sapiens
tggtgtcagccccacagga

SEQ ID NO: 4383293 - DNA, 13 bp, Homo sapiens
tggtgtcatttag

SEQ ID NO: 4383294 - DNA, 15 bp, Homo sapiens
tggtgtcatttagta

SEQ ID NO: 4383295 - DNA, 17 bp, Homo sapiens
tggtgtcattttcttga

SEQ ID NO: 4383296 - DNA, 17 bp, Homo sapiens
tggtgtccacctggccc

SEQ ID NO: 4383297 - DNA, 20 bp, Homo sapiens
tggtgtccccttcccctgct

SEQ ID NO: 4383298 - DNA, 13 bp, Homo sapiens
tggtgtcctgagg

SEQ ID NO: 4383299 - DNA, 20 bp, Homo sapiens
tggtgtctattatagtgaaa

SEQ ID NO: 4383300 - DNA, 19 bp, Homo sapiens
tggtgtctccaacccccca

SEQ ID NO: 4383301 - DNA, 20 bp, Homo sapiens
tggtgtctccaaccccccag

SEQ ID NO: 4383302 - DNA, 13 bp, Homo sapiens
tggtgtctgcggg

SEQ ID NO: 4383303 - DNA, 16 bp, Homo sapiens
tggtgtgacctgaggg

SEQ ID NO: 4383304 - DNA, 18 bp, Homo sapiens
tggtgtgatcgtctgact

SEQ ID NO: 4383305 - DNA, 12 bp, Homo sapiens
tggtgtgatctt

SEQ ID NO: 4383306 - DNA, 22 bp, Homo sapiens
tggtgtgatcttaatatatttg

SEQ ID NO: 4383307 - DNA, 23 bp, Homo sapiens
tggtgttacacagcccaagagga

SEQ ID NO: 4383308 - DNA, 16 bp, Homo sapiens
tggtgttgtatgcctt

SEQ ID NO: 4383309 - DNA, 16 bp, Homo sapiens
tggttaatgtagtatg

SEQ ID NO: 4383310 - DNA, 23 bp, Homo sapiens
tggttacactgttagaacactat

SEQ ID NO: 4383311 - DNA, 18 bp, Homo sapiens
tggttacttcttctctta

SEQ ID NO: 4383312 - DNA, 16 bp, Homo sapiens
tggttactttcaaaat

SEQ ID NO: 4383313 - DNA, 20 bp, Homo sapiens
tggttagaagggttacatgg

SEQ ID NO: 4383314 - DNA, 17 bp, Homo sapiens
tggttatttcagccccc

SEQ ID NO: 4383315 - DNA, 24 bp, Homo sapiens
tggttatttttctcttgtaccata

SEQ ID NO: 4383316 - DNA, 23 bp, Homo sapiens
tggttcagtttttttttttccag

SEQ ID NO: 4383317 - DNA, 19 bp, Homo sapiens
tggttcatatttatacttt

SEQ ID NO: 4383318 - DNA, 14 bp, Homo sapiens
tggttcccttccta

SEQ ID NO: 4383319 - DNA, 13 bp, Homo sapiens
tggttcctctgct

SEQ ID NO: 4383320 - DNA, 14 bp, Homo sapiens
tggttctcatcttt

SEQ ID NO: 4383321 - DNA, 15 bp, Homo sapiens
tggttctctgccttt

SEQ ID NO: 4383322 - DNA, 14 bp, Homo sapiens
tggttctgcctcct

SEQ ID NO: 4383323 - DNA, 15 bp, Homo sapiens
tggttctgcctcctg

SEQ ID NO: 4383324 - DNA, 12 bp, Homo sapiens
tggttggataag

SEQ ID NO: 4383325 - DNA, 21 bp, Homo sapiens
tggttggtcacagaatgactg

SEQ ID NO: 4383326 - DNA, 15 bp, Homo sapiens
tggttgtgttgaggt

SEQ ID NO: 4383327 - DNA, 22 bp, Homo sapiens
tggttgttgcaccatctgcttg

SEQ ID NO: 4383328 - DNA, 16 bp, Homo sapiens
tggtttaaagaaagtg

SEQ ID NO: 4383329 - DNA, 21 bp, Homo sapiens
tggtttacgcctataatccca

SEQ ID NO: 4383330 - DNA, 21 bp, Homo sapiens
tggtttagttataaaaggctt

SEQ ID NO: 4383331 - DNA, 17 bp, Homo sapiens
tggtttcccaagagcta

SEQ ID NO: 4383332 - DNA, 18 bp, Homo sapiens
tggtttcccaagagctac

SEQ ID NO: 4383333 - DNA, 15 bp, Homo sapiens
tggtttcgaactcct

SEQ ID NO: 4383334 - DNA, 17 bp, Homo sapiens
tggtttctcattaaact

SEQ ID NO: 4383335 - DNA, 17 bp, Homo sapiens
tggtttctcctggtaga

SEQ ID NO: 4383336 - DNA, 20 bp, Homo sapiens
tggtttggaatattaaaaaa

SEQ ID NO: 4383337 - DNA, 18 bp, Homo sapiens
tggtttggggagacaggt

SEQ ID NO: 4383338 - DNA, 22 bp, Homo sapiens
tggtttggtgctttttataaaa

SEQ ID NO: 4383339 - DNA, 17 bp, Homo sapiens
tggtttgtacatatcaa

SEQ ID NO: 4383340 - DNA, 16 bp, Homo sapiens
tggttttacacagaga

SEQ ID NO: 4383341 - DNA, 12 bp, Homo sapiens
tggttttcttgt

SEQ ID NO: 4383342 - DNA, 18 bp, Homo sapiens
tggttttgaaatgtttcc

SEQ ID NO: 4383343 - DNA, 17 bp, Homo sapiens
tggttttgttcccctcc

SEQ ID NO: 4383344 - DNA, 20 bp, Homo sapiens
tggttttgttcccctcctcc

SEQ ID NO: 4383345 - DNA, 20 bp, Homo sapiens
tggtttttaaattttgtaat

SEQ ID NO: 4383346 - DNA, 16 bp, Homo sapiens
tggtttttacttaact

SEQ ID NO: 4383347 - DNA, 14 bp, Homo sapiens
tggtttttcctcat

SEQ ID NO: 4383348 - DNA, 22 bp, Homo sapiens
tggttttttaggtggagagaca

SEQ ID NO: 4383349 - DNA, 14 bp, Homo sapiens
tgtaaaaaagaaaa

SEQ ID NO: 4383350 - DNA, 12 bp, Homo sapiens
tgtaaaaaatgg

SEQ ID NO: 4383351 - DNA, 17 bp, Homo sapiens
tgtaaaaaatgtgtgta

SEQ ID NO: 4383352 - DNA, 14 bp, Homo sapiens
tgtaaaacaaaatt

SEQ ID NO: 4383353 - DNA, 14 bp, Homo sapiens
tgtaaaacaggtag

SEQ ID NO: 4383354 - DNA, 19 bp, Homo sapiens
tgtaaaacatttattttga

SEQ ID NO: 4383355 - DNA, 13 bp, Homo sapiens
tgtaaaactttat

SEQ ID NO: 4383356 - DNA, 16 bp, Homo sapiens
tgtaaaactttatttt

SEQ ID NO: 4383357 - DNA, 23 bp, Homo sapiens
tgtaaaactttattttatataat

SEQ ID NO: 4383358 - DNA, 16 bp, Homo sapiens
tgtaaaataattctga

SEQ ID NO: 4383359 - DNA, 13 bp, Homo sapiens
tgtaaaatgtatt

SEQ ID NO: 4383360 - DNA, 15 bp, Homo sapiens
tgtaaaattaatgta

SEQ ID NO: 4383361 - DNA, 20 bp, Homo sapiens
tgtaaaattaatgtaataaa

SEQ ID NO: 4383362 - DNA, 13 bp, Homo sapiens
tgtaaaatttgtg

SEQ ID NO: 4383363 - DNA, 14 bp, Homo sapiens
tgtaaacagtgcct

SEQ ID NO: 4383364 - DNA, 16 bp, Homo sapiens
tgtaaacagtgcctgc

SEQ ID NO: 4383365 - DNA, 17 bp, Homo sapiens
tgtaaactctcttctct

SEQ ID NO: 4383366 - DNA, 20 bp, Homo sapiens
tgtaaactggaattaaaagg

SEQ ID NO: 4383367 - DNA, 19 bp, Homo sapiens
tgtaaactgtactagtctg

SEQ ID NO: 4383368 - DNA, 21 bp, Homo sapiens
tgtaaactgtactagtctgtg

SEQ ID NO: 4383369 - DNA, 14 bp, Homo sapiens
tgtaaactgtgtat

SEQ ID NO: 4383370 - DNA, 18 bp, Homo sapiens
tgtaaacttggaatcaag

SEQ ID NO: 4383371 - DNA, 22 bp, Homo sapiens
tgtaaagaagggatattaagaa

SEQ ID NO: 4383372 - DNA, 18 bp, Homo sapiens
tgtaaagactgagcagaa

SEQ ID NO: 4383373 - DNA, 21 bp, Homo sapiens
tgtaaagactgagcagaactg

SEQ ID NO: 4383374 - DNA, 12 bp, Homo sapiens
tgtaaagactgg

SEQ ID NO: 4383375 - DNA, 11 bp, Homo sapiens
tgtaaagatgt

SEQ ID NO: 4383376 - DNA, 14 bp, Homo sapiens
tgtaaagatttata

SEQ ID NO: 4383377 - DNA, 16 bp, Homo sapiens
tgtaaaggagtcaaaa

SEQ ID NO: 4383378 - DNA, 19 bp, Homo sapiens
tgtaaagtatgtattattt

SEQ ID NO: 4383379 - DNA, 20 bp, Homo sapiens
tgtaaagtatttgatgtaca

SEQ ID NO: 4383380 - DNA, 20 bp, Homo sapiens
tgtaaagttatgtatttaaa

SEQ ID NO: 4383381 - DNA, 14 bp, Homo sapiens
tgtaaataaaacat

SEQ ID NO: 4383382 - DNA, 17 bp, Homo sapiens
tgtaaataggattttta

SEQ ID NO: 4383383 - DNA, 16 bp, Homo sapiens
tgtaaatattgctaaa

SEQ ID NO: 4383384 - DNA, 19 bp, Homo sapiens
tgtaaatctaacattatta

SEQ ID NO: 4383385 - DNA, 15 bp, Homo sapiens
tgtaaatctacacac

SEQ ID NO: 4383386 - DNA, 17 bp, Homo sapiens
tgtaaatgcatattaaa

SEQ ID NO: 4383387 - DNA, 23 bp, Homo sapiens
tgtaaatgcatattaaataataa

SEQ ID NO: 4383388 - DNA, 19 bp, Homo sapiens
tgtaaatgttcttggtgtt

SEQ ID NO: 4383389 - DNA, 13 bp, Homo sapiens
tgtaaattatatt

SEQ ID NO: 4383390 - DNA, 15 bp, Homo sapiens
tgtaaattcatattt

SEQ ID NO: 4383391 - DNA, 12 bp, Homo sapiens
tgtaaatttgta

SEQ ID NO: 4383392 - DNA, 13 bp, Homo sapiens
tgtaaccactgca

SEQ ID NO: 4383393 - DNA, 19 bp, Homo sapiens
tgtaacctcttcagaggcc

SEQ ID NO: 4383394 - DNA, 16 bp, Homo sapiens
tgtaactactttataa

SEQ ID NO: 4383395 - DNA, 18 bp, Homo sapiens
tgtaactaggctcagaga

SEQ ID NO: 4383396 - DNA, 16 bp, Homo sapiens
tgtaactgagagaaag

SEQ ID NO: 4383397 - DNA, 21 bp, Homo sapiens
tgtaactgtcttctagcagtg

SEQ ID NO: 4383398 - DNA, 15 bp, Homo sapiens
tgtaactgttacagt

SEQ ID NO: 4383399 - DNA, 12 bp, Homo sapiens
tgtaacttcaaa

SEQ ID NO: 4383400 - DNA, 20 bp, Homo sapiens
tgtaacttgcttaaatttct

SEQ ID NO: 4383401 - DNA, 19 bp, Homo sapiens
tgtaactttcataccactt

SEQ ID NO: 4383402 - DNA, 19 bp, Homo sapiens
tgtaagaacacattttaaa

SEQ ID NO: 4383403 - DNA, 14 bp, Homo sapiens
tgtaagaactgtac

SEQ ID NO: 4383404 - DNA, 19 bp, Homo sapiens
tgtaagaactgtacattgt

SEQ ID NO: 4383405 - DNA, 22 bp, Homo sapiens
tgtaagatatttgcagtttttc

SEQ ID NO: 4383406 - DNA, 15 bp, Homo sapiens
tgtaagcaacttgct

SEQ ID NO: 4383407 - DNA, 16 bp, Homo sapiens
tgtaagcaacttgctt

SEQ ID NO: 4383408 - DNA, 17 bp, Homo sapiens
tgtaagcaacttgcttc

SEQ ID NO: 4383409 - DNA, 18 bp, Homo sapiens
tgtaagcaacttgcttct

SEQ ID NO: 4383410 - DNA, 22 bp, Homo sapiens
tgtaagcatactttgtaaatag

SEQ ID NO: 4383411 - DNA, 21 bp, Homo sapiens
tgtaaggatccggaaagaaga

SEQ ID NO: 4383412 - DNA, 20 bp, Homo sapiens
tgtaaggatgattttaatat

SEQ ID NO: 4383413 - DNA, 13 bp, Homo sapiens
tgtaagggaaact

SEQ ID NO: 4383414 - DNA, 18 bp, Homo sapiens
tgtaagggaaactgccag

SEQ ID NO: 4383415 - DNA, 16 bp, Homo sapiens
tgtaagttgaagcaaa

SEQ ID NO: 4383416 - DNA, 18 bp, Homo sapiens
tgtaagttgagaaaaatt

SEQ ID NO: 4383417 - DNA, 22 bp, Homo sapiens
tgtaataaacaggtttttagtt

SEQ ID NO: 4383418 - DNA, 18 bp, Homo sapiens
tgtaatataatgtatttt

SEQ ID NO: 4383419 - DNA, 22 bp, Homo sapiens
tgtaatatggaaatcttttaca

SEQ ID NO: 4383420 - DNA, 15 bp, Homo sapiens
tgtaatcacagctac

SEQ ID NO: 4383421 - DNA, 14 bp, Homo sapiens
tgtaatcatttgtt

SEQ ID NO: 4383422 - DNA, 20 bp, Homo sapiens
tgtaatccaggggtgtagat

SEQ ID NO: 4383423 - DNA, 15 bp, Homo sapiens
tgtaatcccagaact

SEQ ID NO: 4383424 - DNA, 13 bp, Homo sapiens
tgtaatcccagca

SEQ ID NO: 4383425 - DNA, 23 bp, Homo sapiens
tgtaatcccagctactcaggagg

SEQ ID NO: 4383426 - DNA, 16 bp, Homo sapiens
tgtaatccgaatctct

SEQ ID NO: 4383427 - DNA, 24 bp, Homo sapiens
tgtaatctaagtatatgtgagaaa

SEQ ID NO: 4383428 - DNA, 14 bp, Homo sapiens
tgtaatcttgttga

SEQ ID NO: 4383429 - DNA, 19 bp, Homo sapiens
tgtaatgaattcctagaat

SEQ ID NO: 4383430 - DNA, 20 bp, Homo sapiens
tgtaatggtatcttaaagtg

SEQ ID NO: 4383431 - DNA, 19 bp, Homo sapiens
tgtaatgtcaccaccttcc

SEQ ID NO: 4383432 - DNA, 20 bp, Homo sapiens
tgtaatgtcaccaccttccc

SEQ ID NO: 4383433 - DNA, 19 bp, Homo sapiens
tgtaattaaaagcaaatca

SEQ ID NO: 4383434 - DNA, 20 bp, Homo sapiens
tgtaattaaaagcaaatcat

SEQ ID NO: 4383435 - DNA, 22 bp, Homo sapiens
tgtaattaaactagtttaaggg

SEQ ID NO: 4383436 - DNA, 19 bp, Homo sapiens
tgtaattcaggtttttcct

SEQ ID NO: 4383437 - DNA, 16 bp, Homo sapiens
tgtaattgtgtggatt

SEQ ID NO: 4383438 - DNA, 20 bp, Homo sapiens
tgtaattgtgtggattcttt

SEQ ID NO: 4383439 - DNA, 21 bp, Homo sapiens
tgtaattgtgtggattcttta

SEQ ID NO: 4383440 - DNA, 18 bp, Homo sapiens
tgtaatttaaaattgtga

SEQ ID NO: 4383441 - DNA, 15 bp, Homo sapiens
tgtaatttcgcctta

SEQ ID NO: 4383442 - DNA, 16 bp, Homo sapiens
tgtaatttcgccttaa

SEQ ID NO: 4383443 - DNA, 18 bp, Homo sapiens
tgtaatttcgccttaaac

SEQ ID NO: 4383444 - DNA, 21 bp, Homo sapiens
tgtaatttgaatgagttttta

SEQ ID NO: 4383445 - DNA, 19 bp, Homo sapiens
tgtaatttgatgaggtatt

SEQ ID NO: 4383446 - DNA, 20 bp, Homo sapiens
tgtaatttgtgtaataaagt

SEQ ID NO: 4383447 - DNA, 14 bp, Homo sapiens
tgtacaaacatgtt

SEQ ID NO: 4383448 - DNA, 14 bp, Homo sapiens
tgtacaaatcctct

SEQ ID NO: 4383449 - DNA, 14 bp, Homo sapiens
tgtacaacttttta

SEQ ID NO: 4383450 - DNA, 19 bp, Homo sapiens
tgtacaatacaatgtacaa

SEQ ID NO: 4383451 - DNA, 20 bp, Homo sapiens
tgtacaatacaatgtacaat

SEQ ID NO: 4383452 - DNA, 14 bp, Homo sapiens
tgtacaattatgtc

SEQ ID NO: 4383453 - DNA, 16 bp, Homo sapiens
tgtacaattatgtctc

SEQ ID NO: 4383454 - DNA, 21 bp, Homo sapiens
tgtacaattatgtctcttgag

SEQ ID NO: 4383455 - DNA, 16 bp, Homo sapiens
tgtacaattttaaagt

SEQ ID NO: 4383456 - DNA, 14 bp, Homo sapiens
tgtacacactttat

SEQ ID NO: 4383457 - DNA, 23 bp, Homo sapiens
tgtacacatgccaacacttaatc

SEQ ID NO: 4383458 - DNA, 19 bp, Homo sapiens
tgtacaccacatgctattg

SEQ ID NO: 4383459 - DNA, 19 bp, Homo sapiens
tgtacactttttacagcag

SEQ ID NO: 4383460 - DNA, 14 bp, Homo sapiens
tgtacagacatatt

SEQ ID NO: 4383461 - DNA, 19 bp, Homo sapiens
tgtacagagtgcttttctg

SEQ ID NO: 4383462 - DNA, 17 bp, Homo sapiens
tgtacagatatcgagag

SEQ ID NO: 4383463 - DNA, 21 bp, Homo sapiens
tgtacagcaagatgtttcttg

SEQ ID NO: 4383464 - DNA, 15 bp, Homo sapiens
tgtacagtctgtcat

SEQ ID NO: 4383465 - DNA, 19 bp, Homo sapiens
tgtacagttgagctcaggt

SEQ ID NO: 4383466 - DNA, 14 bp, Homo sapiens
tgtacataaacaat

SEQ ID NO: 4383467 - DNA, 19 bp, Homo sapiens
tgtacataaacaatgatgc

SEQ ID NO: 4383468 - DNA, 13 bp, Homo sapiens
tgtacataactga

SEQ ID NO: 4383469 - DNA, 14 bp, Homo sapiens
tgtacataactgaa

SEQ ID NO: 4383470 - DNA, 17 bp, Homo sapiens
tgtacataactgaaaat

SEQ ID NO: 4383471 - DNA, 14 bp, Homo sapiens
tgtacatctatttt

SEQ ID NO: 4383472 - DNA, 16 bp, Homo sapiens
tgtacatgagaaggaa

SEQ ID NO: 4383473 - DNA, 12 bp, Homo sapiens
tgtacatgataa

SEQ ID NO: 4383474 - DNA, 15 bp, Homo sapiens
tgtacattctaaaat

SEQ ID NO: 4383475 - DNA, 14 bp, Homo sapiens
tgtacatttaataa

SEQ ID NO: 4383476 - DNA, 17 bp, Homo sapiens
tgtaccaaaattttaaa

SEQ ID NO: 4383477 - DNA, 16 bp, Homo sapiens
tgtaccagtgaatttt

SEQ ID NO: 4383478 - DNA, 15 bp, Homo sapiens
tgtaccagttaattt

SEQ ID NO: 4383479 - DNA, 14 bp, Homo sapiens
tgtaccatttgcct

SEQ ID NO: 4383480 - DNA, 15 bp, Homo sapiens
tgtaccgcaatgtga

SEQ ID NO: 4383481 - DNA, 14 bp, Homo sapiens
tgtacctctgcctc

SEQ ID NO: 4383482 - DNA, 21 bp, Homo sapiens
tgtaccttttttgttttttca

SEQ ID NO: 4383483 - DNA, 17 bp, Homo sapiens
tgtacgttatatattgt

SEQ ID NO: 4383484 - DNA, 20 bp, Homo sapiens
tgtactaaacctcgtgcttg

SEQ ID NO: 4383485 - DNA, 19 bp, Homo sapiens
tgtactacagctatatttg

SEQ ID NO: 4383486 - DNA, 20 bp, Homo sapiens
tgtactacagctatatttga

SEQ ID NO: 4383487 - DNA, 15 bp, Homo sapiens
tgtactatgtctgaa

SEQ ID NO: 4383488 - DNA, 14 bp, Homo sapiens
tgtactccagcctg

SEQ ID NO: 4383489 - DNA, 18 bp, Homo sapiens
tgtactccagcctgggca

SEQ ID NO: 4383490 - DNA, 14 bp, Homo sapiens
tgtactgaattctt

SEQ ID NO: 4383491 - DNA, 17 bp, Homo sapiens
tgtactgaattctttat

SEQ ID NO: 4383492 - DNA, 20 bp, Homo sapiens
tgtactgaatttttttgtaa

SEQ ID NO: 4383493 - DNA, 19 bp, Homo sapiens
tgtactggagcctgcatta

SEQ ID NO: 4383494 - DNA, 12 bp, Homo sapiens
tgtactggttca

SEQ ID NO: 4383495 - DNA, 22 bp, Homo sapiens
tgtactgtataacattaagaaa

SEQ ID NO: 4383496 - DNA, 18 bp, Homo sapiens
tgtactgtatctattctt

SEQ ID NO: 4383497 - DNA, 10 bp, Homo sapiens
tgtactgtgt

SEQ ID NO: 4383498 - DNA, 15 bp, Homo sapiens
tgtactgttgaaaaa

SEQ ID NO: 4383499 - DNA, 18 bp, Homo sapiens
tgtactgttgaaaaagat

SEQ ID NO: 4383500 - DNA, 13 bp, Homo sapiens
tgtacttaaatga

SEQ ID NO: 4383501 - DNA, 20 bp, Homo sapiens
tgtacttaaatgagttactt

SEQ ID NO: 4383502 - DNA, 21 bp, Homo sapiens
tgtacttaaatgagttactta

SEQ ID NO: 4383503 - DNA, 15 bp, Homo sapiens
tgtacttcttcatcc

SEQ ID NO: 4383504 - DNA, 13 bp, Homo sapiens
tgtacttgaaaaa

SEQ ID NO: 4383505 - DNA, 18 bp, Homo sapiens
tgtacttgtgatgagaga

SEQ ID NO: 4383506 - DNA, 18 bp, Homo sapiens
tgtacttgtttgaatatt

SEQ ID NO: 4383507 - DNA, 12 bp, Homo sapiens
tgtacttttcat

SEQ ID NO: 4383508 - DNA, 17 bp, Homo sapiens
tgtacttttcattctct

SEQ ID NO: 4383509 - DNA, 18 bp, Homo sapiens
tgtacttttcattctctt

SEQ ID NO: 4383510 - DNA, 21 bp, Homo sapiens
tgtactttttagtaatttctt

SEQ ID NO: 4383511 - DNA, 18 bp, Homo sapiens
tgtagaaaagggaactga

SEQ ID NO: 4383512 - DNA, 20 bp, Homo sapiens
tgtagaaaatgaggaaatgc

SEQ ID NO: 4383513 - DNA, 13 bp, Homo sapiens
tgtagaaagtgag

SEQ ID NO: 4383514 - DNA, 18 bp, Homo sapiens
tgtagaaataaattactt

SEQ ID NO: 4383515 - DNA, 21 bp, Homo sapiens
tgtagaaatgatgatgtggaa

SEQ ID NO: 4383516 - DNA, 17 bp, Homo sapiens
tgtagaacctaattcaa

SEQ ID NO: 4383517 - DNA, 12 bp, Homo sapiens
tgtagaaggagt

SEQ ID NO: 4383518 - DNA, 14 bp, Homo sapiens
tgtagaataaatga

SEQ ID NO: 4383519 - DNA, 17 bp, Homo sapiens
tgtagaataaatgaaga

SEQ ID NO: 4383520 - DNA, 22 bp, Homo sapiens
tgtagaataaatggtttctcat

SEQ ID NO: 4383521 - DNA, 16 bp, Homo sapiens
tgtagaataggcaggg

SEQ ID NO: 4383522 - DNA, 21 bp, Homo sapiens
tgtagaatctcttcatgcttg

SEQ ID NO: 4383523 - DNA, 16 bp, Homo sapiens
tgtagacaaagtacat

SEQ ID NO: 4383524 - DNA, 19 bp, Homo sapiens
tgtagacaaagtacattct

SEQ ID NO: 4383525 - DNA, 21 bp, Homo sapiens
tgtagacatgcccaaaactta

SEQ ID NO: 4383526 - DNA, 20 bp, Homo sapiens
tgtagagagcagcattccca

SEQ ID NO: 4383527 - DNA, 18 bp, Homo sapiens
tgtagaggagaaactgga

SEQ ID NO: 4383528 - DNA, 20 bp, Homo sapiens
tgtagatgggggaactgtga

SEQ ID NO: 4383529 - DNA, 21 bp, Homo sapiens
tgtagatgggggaactgtgaa

SEQ ID NO: 4383530 - DNA, 14 bp, Homo sapiens
tgtagatttctgac

SEQ ID NO: 4383531 - DNA, 15 bp, Homo sapiens
tgtagatttgaaaat

SEQ ID NO: 4383532 - DNA, 17 bp, Homo sapiens
tgtagatttgaaaattg

SEQ ID NO: 4383533 - DNA, 17 bp, Homo sapiens
tgtagattttatagtgt

SEQ ID NO: 4383534 - DNA, 11 bp, Homo sapiens
tgtagcaatgg

SEQ ID NO: 4383535 - DNA, 12 bp, Homo sapiens
tgtagcacttac

SEQ ID NO: 4383536 - DNA, 21 bp, Homo sapiens
tgtagcacttacgtaaaacat

SEQ ID NO: 4383537 - DNA, 15 bp, Homo sapiens
tgtagcatataaatg

SEQ ID NO: 4383538 - DNA, 19 bp, Homo sapiens
tgtagccacagctgctgtt

SEQ ID NO: 4383539 - DNA, 15 bp, Homo sapiens
tgtagcctcagatga

SEQ ID NO: 4383540 - DNA, 21 bp, Homo sapiens
tgtagcttatctgcccctccc

SEQ ID NO: 4383541 - DNA, 19 bp, Homo sapiens
tgtaggatgacaggctctc

SEQ ID NO: 4383542 - DNA, 23 bp, Homo sapiens
tgtaggatgacaggctctcctgg

SEQ ID NO: 4383543 - DNA, 22 bp, Homo sapiens
tgtaggcacttttattttcatt

SEQ ID NO: 4383544 - DNA, 20 bp, Homo sapiens
tgtaggctaaaaggcttcca

SEQ ID NO: 4383545 - DNA, 23 bp, Homo sapiens
tgtaggctaaaaggcttccaggc

SEQ ID NO: 4383546 - DNA, 15 bp, Homo sapiens
tgtaggggttaactt

SEQ ID NO: 4383547 - DNA, 18 bp, Homo sapiens
tgtagggttctgctttta

SEQ ID NO: 4383548 - DNA, 21 bp, Homo sapiens
tgtagggttctgcttttaagt

SEQ ID NO: 4383549 - DNA, 21 bp, Homo sapiens
tgtagtaaactattcttaata

SEQ ID NO: 4383550 - DNA, 20 bp, Homo sapiens
tgtagtaacactaatatatt

SEQ ID NO: 4383551 - DNA, 16 bp, Homo sapiens
tgtagtaattgacatg

SEQ ID NO: 4383552 - DNA, 14 bp, Homo sapiens
tgtagtaatttatt

SEQ ID NO: 4383553 - DNA, 21 bp, Homo sapiens
tgtagtagcgttttttaaatg

SEQ ID NO: 4383554 - DNA, 22 bp, Homo sapiens
tgtagtagcgttttttaaatgt

SEQ ID NO: 4383555 - DNA, 22 bp, Homo sapiens
tgtagtatggcctgacagctct

SEQ ID NO: 4383556 - DNA, 20 bp, Homo sapiens
tgtagtattttttgtataat

SEQ ID NO: 4383557 - DNA, 14 bp, Homo sapiens
tgtagtgagccaag

SEQ ID NO: 4383558 - DNA, 21 bp, Homo sapiens
tgtagtgatttttatgccacc

SEQ ID NO: 4383559 - DNA, 17 bp, Homo sapiens
tgtagtttttaattaaa

SEQ ID NO: 4383560 - DNA, 20 bp, Homo sapiens
tgtagtttttatatgttgta

SEQ ID NO: 4383561 - DNA, 23 bp, Homo sapiens
tgtataaaaattatcaaaaagct

SEQ ID NO: 4383562 - DNA, 21 bp, Homo sapiens
tgtataaaagtgtgaaataaa

SEQ ID NO: 4383563 - DNA, 20 bp, Homo sapiens
tgtataaactgtattttgaa

SEQ ID NO: 4383564 - DNA, 15 bp, Homo sapiens
tgtataaattgtctt

SEQ ID NO: 4383565 - DNA, 17 bp, Homo sapiens
tgtataacattaagaaa

SEQ ID NO: 4383566 - DNA, 19 bp, Homo sapiens
tgtataagacactttgcca

SEQ ID NO: 4383567 - DNA, 17 bp, Homo sapiens
tgtataatactttgtat

SEQ ID NO: 4383568 - DNA, 22 bp, Homo sapiens
tgtataatactttgtatacaag

SEQ ID NO: 4383569 - DNA, 14 bp, Homo sapiens
tgtataatcacagt

SEQ ID NO: 4383570 - DNA, 13 bp, Homo sapiens
tgtataatcccac

SEQ ID NO: 4383571 - DNA, 21 bp, Homo sapiens
tgtataatgacttttaaaatt

SEQ ID NO: 4383572 - DNA, 17 bp, Homo sapiens
tgtataattaatgctta

SEQ ID NO: 4383573 - DNA, 14 bp, Homo sapiens
tgtataattggatt

SEQ ID NO: 4383574 - DNA, 21 bp, Homo sapiens
tgtataattggatttcctaat

SEQ ID NO: 4383575 - DNA, 13 bp, Homo sapiens
tgtatacatacat

SEQ ID NO: 4383576 - DNA, 14 bp, Homo sapiens
tgtatacatacatg

SEQ ID NO: 4383577 - DNA, 15 bp, Homo sapiens
tgtataccaatgtgt

SEQ ID NO: 4383578 - DNA, 16 bp, Homo sapiens
tgtataccaatgtgtt

SEQ ID NO: 4383579 - DNA, 20 bp, Homo sapiens
tgtataccagcctactgtac

SEQ ID NO: 4383580 - DNA, 15 bp, Homo sapiens
tgtatactcctgtca

SEQ ID NO: 4383581 - DNA, 17 bp, Homo sapiens
tgtatactcctgtcacc

SEQ ID NO: 4383582 - DNA, 14 bp, Homo sapiens
tgtatactttaaat

SEQ ID NO: 4383583 - DNA, 15 bp, Homo sapiens
tgtatactttaaata

SEQ ID NO: 4383584 - DNA, 16 bp, Homo sapiens
tgtatactttaaataa

SEQ ID NO: 4383585 - DNA, 17 bp, Homo sapiens
tgtatactttaaataat

SEQ ID NO: 4383586 - DNA, 21 bp, Homo sapiens
tgtatagcttttatctgcggc

SEQ ID NO: 4383587 - DNA, 12 bp, Homo sapiens
tgtataggaatt

SEQ ID NO: 4383588 - DNA, 17 bp, Homo sapiens
tgtataggaatttgtat

SEQ ID NO: 4383589 - DNA, 14 bp, Homo sapiens
tgtatagtgttcac

SEQ ID NO: 4383590 - DNA, 19 bp, Homo sapiens
tgtatagtgttcacaaact

SEQ ID NO: 4383591 - DNA, 23 bp, Homo sapiens
tgtatagtgttcacaaactgtga

SEQ ID NO: 4383592 - DNA, 13 bp, Homo sapiens
tgtatagttagaa

SEQ ID NO: 4383593 - DNA, 13 bp, Homo sapiens
tgtatagttgctt

SEQ ID NO: 4383594 - DNA, 16 bp, Homo sapiens
tgtatataaaaatggc

SEQ ID NO: 4383595 - DNA, 12 bp, Homo sapiens
tgtatatacttt

SEQ ID NO: 4383596 - DNA, 21 bp, Homo sapiens
tgtatatatcttataactgtt

SEQ ID NO: 4383597 - DNA, 21 bp, Homo sapiens
tgtatatatgtgtgccctgga

SEQ ID NO: 4383598 - DNA, 14 bp, Homo sapiens
tgtatatattatta

SEQ ID NO: 4383599 - DNA, 21 bp, Homo sapiens
tgtatatctcttggaaaataa

SEQ ID NO: 4383600 - DNA, 14 bp, Homo sapiens
tgtatatgtaaatt

SEQ ID NO: 4383601 - DNA, 19 bp, Homo sapiens
tgtatattacaatgatcac

SEQ ID NO: 4383602 - DNA, 16 bp, Homo sapiens
tgtatattacaccaat

SEQ ID NO: 4383603 - DNA, 15 bp, Homo sapiens
tgtatatttgtatga

SEQ ID NO: 4383604 - DNA, 19 bp, Homo sapiens
tgtatatttgtatgatatt

SEQ ID NO: 4383605 - DNA, 20 bp, Homo sapiens
tgtatcaataaaattctgta

SEQ ID NO: 4383606 - DNA, 21 bp, Homo sapiens
tgtatcaataaaattctgtaa

SEQ ID NO: 4383607 - DNA, 22 bp, Homo sapiens
tgtatcaataaaattctgtaat

SEQ ID NO: 4383608 - DNA, 18 bp, Homo sapiens
tgtatcacaaatcttaac

SEQ ID NO: 4383609 - DNA, 14 bp, Homo sapiens
tgtatcagtgtcct

SEQ ID NO: 4383610 - DNA, 20 bp, Homo sapiens
tgtatcagtgtcctttccag

SEQ ID NO: 4383611 - DNA, 15 bp, Homo sapiens
tgtatcagtgtttat

SEQ ID NO: 4383612 - DNA, 22 bp, Homo sapiens
tgtatccatccatggggctgat

SEQ ID NO: 4383613 - DNA, 22 bp, Homo sapiens
tgtatcctccctggcagacaca

SEQ ID NO: 4383614 - DNA, 20 bp, Homo sapiens
tgtatctaagaataataaaa

SEQ ID NO: 4383615 - DNA, 21 bp, Homo sapiens
tgtatctaagaataataaaat

SEQ ID NO: 4383616 - DNA, 16 bp, Homo sapiens
tgtatctatttgtaca

SEQ ID NO: 4383617 - DNA, 18 bp, Homo sapiens
tgtatctatttgtacaat

SEQ ID NO: 4383618 - DNA, 22 bp, Homo sapiens
tgtatctgtgcttctaatatta

SEQ ID NO: 4383619 - DNA, 22 bp, Homo sapiens
tgtatcttacctagtgtttact

SEQ ID NO: 4383620 - DNA, 21 bp, Homo sapiens
tgtatcttgggggacagggct

SEQ ID NO: 4383621 - DNA, 23 bp, Homo sapiens
tgtatgaataatgaaaataaaac

SEQ ID NO: 4383622 - DNA, 23 bp, Homo sapiens
tgtatgacagtgaagcagcactg

SEQ ID NO: 4383623 - DNA, 13 bp, Homo sapiens
tgtatgattactg

SEQ ID NO: 4383624 - DNA, 18 bp, Homo sapiens
tgtatggagttaaataaa

SEQ ID NO: 4383625 - DNA, 17 bp, Homo sapiens
tgtatggatatatttga

SEQ ID NO: 4383626 - DNA, 13 bp, Homo sapiens
tgtatggggaggc

SEQ ID NO: 4383627 - DNA, 19 bp, Homo sapiens
tgtatgtaagctgagattt

SEQ ID NO: 4383628 - DNA, 15 bp, Homo sapiens
tgtatgtacaataca

SEQ ID NO: 4383629 - DNA, 12 bp, Homo sapiens
tgtatgtataca

SEQ ID NO: 4383630 - DNA, 15 bp, Homo sapiens
tgtatgtcaaagctt

SEQ ID NO: 4383631 - DNA, 17 bp, Homo sapiens
tgtatgtcaaagctttg

SEQ ID NO: 4383632 - DNA, 16 bp, Homo sapiens
tgtatgtgtgcttgag

SEQ ID NO: 4383633 - DNA, 19 bp, Homo sapiens
tgtatgtgtgtttctgtcc

SEQ ID NO: 4383634 - DNA, 15 bp, Homo sapiens
tgtatgtgtgttttt

SEQ ID NO: 4383635 - DNA, 14 bp, Homo sapiens
tgtattaacatgca

SEQ ID NO: 4383636 - DNA, 16 bp, Homo sapiens
tgtattaacatgcaat

SEQ ID NO: 4383637 - DNA, 20 bp, Homo sapiens
tgtattaacatgcaataaca

SEQ ID NO: 4383638 - DNA, 22 bp, Homo sapiens
tgtattaagcccacagtatatt

SEQ ID NO: 4383639 - DNA, 21 bp, Homo sapiens
tgtattatttacatttaatag

SEQ ID NO: 4383640 - DNA, 13 bp, Homo sapiens
tgtattccaagac

SEQ ID NO: 4383641 - DNA, 20 bp, Homo sapiens
tgtattccaagacatgtctg

SEQ ID NO: 4383642 - DNA, 20 bp, Homo sapiens
tgtattctctgagctgtgca

SEQ ID NO: 4383643 - DNA, 16 bp, Homo sapiens
tgtattctctgcaatt

SEQ ID NO: 4383644 - DNA, 21 bp, Homo sapiens
tgtattctctgcaattttact

SEQ ID NO: 4383645 - DNA, 20 bp, Homo sapiens
tgtattcttaaaatgcaata

SEQ ID NO: 4383646 - DNA, 12 bp, Homo sapiens
tgtattcttcat

SEQ ID NO: 4383647 - DNA, 18 bp, Homo sapiens
tgtattcttcatgaaatg

SEQ ID NO: 4383648 - DNA, 15 bp, Homo sapiens
tgtattgtaaatgtg

SEQ ID NO: 4383649 - DNA, 18 bp, Homo sapiens
tgtattgtatattacaat

SEQ ID NO: 4383650 - DNA, 16 bp, Homo sapiens
tgtattgttagatgtt

SEQ ID NO: 4383651 - DNA, 18 bp, Homo sapiens
tgtattgttgaaaaagtt

SEQ ID NO: 4383652 - DNA, 20 bp, Homo sapiens
tgtattgttgaaaaagtttg

SEQ ID NO: 4383653 - DNA, 17 bp, Homo sapiens
tgtatttaaaaacattt

SEQ ID NO: 4383654 - DNA, 14 bp, Homo sapiens
tgtatttaaagttg

SEQ ID NO: 4383655 - DNA, 21 bp, Homo sapiens
tgtatttaacaaaaagtgctt

SEQ ID NO: 4383656 - DNA, 13 bp, Homo sapiens
tgtatttaagcaa

SEQ ID NO: 4383657 - DNA, 19 bp, Homo sapiens
tgtatttaagcaaatactt

SEQ ID NO: 4383658 - DNA, 23 bp, Homo sapiens
tgtatttaattgtaaactgtact

SEQ ID NO: 4383659 - DNA, 19 bp, Homo sapiens
tgtatttatataagtctgt

SEQ ID NO: 4383660 - DNA, 13 bp, Homo sapiens
tgtatttatgtaa

SEQ ID NO: 4383661 - DNA, 16 bp, Homo sapiens
tgtatttatgtgtgag

SEQ ID NO: 4383662 - DNA, 18 bp, Homo sapiens
tgtatttatttaaaactc

SEQ ID NO: 4383663 - DNA, 21 bp, Homo sapiens
tgtatttatttaaaactctgg

SEQ ID NO: 4383664 - DNA, 14 bp, Homo sapiens
tgtatttgaaaatt

SEQ ID NO: 4383665 - DNA, 12 bp, Homo sapiens
tgtatttgctaa

SEQ ID NO: 4383666 - DNA, 16 bp, Homo sapiens
tgtatttgtattctct

SEQ ID NO: 4383667 - DNA, 21 bp, Homo sapiens
tgtatttgttatatataataa

SEQ ID NO: 4383668 - DNA, 14 bp, Homo sapiens
tgtattttaaaata

SEQ ID NO: 4383669 - DNA, 22 bp, Homo sapiens
tgtattttaagatccagaaata

SEQ ID NO: 4383670 - DNA, 16 bp, Homo sapiens
tgtattttagcagaga

SEQ ID NO: 4383671 - DNA, 22 bp, Homo sapiens
tgtattttatttagacaagaga

SEQ ID NO: 4383672 - DNA, 12 bp, Homo sapiens
tgtattttcata

SEQ ID NO: 4383673 - DNA, 14 bp, Homo sapiens
tgtattttcatagt

SEQ ID NO: 4383674 - DNA, 13 bp, Homo sapiens
tgtattttgatat

SEQ ID NO: 4383675 - DNA, 19 bp, Homo sapiens
tgtatttttagtagagatg

SEQ ID NO: 4383676 - DNA, 16 bp, Homo sapiens
tgtatttttatataat

SEQ ID NO: 4383677 - DNA, 13 bp, Homo sapiens
tgtatttttcaga

SEQ ID NO: 4383678 - DNA, 14 bp, Homo sapiens
tgtatttttctaca

SEQ ID NO: 4383679 - DNA, 19 bp, Homo sapiens
tgtatttttctacattatt

SEQ ID NO: 4383680 - DNA, 12 bp, Homo sapiens
tgtatttttgtc

SEQ ID NO: 4383681 - DNA, 22 bp, Homo sapiens
tgtatttttttttctaagagaa

SEQ ID NO: 4383682 - DNA, 19 bp, Homo sapiens
tgtcaaaactactgacagg

SEQ ID NO: 4383683 - DNA, 23 bp, Homo sapiens
tgtcaaaataaagattctcacat

SEQ ID NO: 4383684 - DNA, 20 bp, Homo sapiens
tgtcaaaggtcgggacagct

SEQ ID NO: 4383685 - DNA, 17 bp, Homo sapiens
tgtcaacatttggaggc

SEQ ID NO: 4383686 - DNA, 15 bp, Homo sapiens
tgtcaactctttgtt

SEQ ID NO: 4383687 - DNA, 21 bp, Homo sapiens
tgtcaacttcagttgaaaaga

SEQ ID NO: 4383688 - DNA, 15 bp, Homo sapiens
tgtcaagacatttct

SEQ ID NO: 4383689 - DNA, 17 bp, Homo sapiens
tgtcaagcctgtgcaaa

SEQ ID NO: 4383690 - DNA, 20 bp, Homo sapiens
tgtcaagcctgtgcaaaaaa

SEQ ID NO: 4383691 - DNA, 16 bp, Homo sapiens
tgtcaagctggtgcta

SEQ ID NO: 4383692 - DNA, 14 bp, Homo sapiens
tgtcaagcttctct

SEQ ID NO: 4383693 - DNA, 16 bp, Homo sapiens
tgtcaaggaagacttt

SEQ ID NO: 4383694 - DNA, 19 bp, Homo sapiens
tgtcaaggaagacttttgg

SEQ ID NO: 4383695 - DNA, 18 bp, Homo sapiens
tgtcaagggcagaatgaa

SEQ ID NO: 4383696 - DNA, 15 bp, Homo sapiens
tgtcaagttgtacat

SEQ ID NO: 4383697 - DNA, 17 bp, Homo sapiens
tgtcaagttgtgcttgt

SEQ ID NO: 4383698 - DNA, 17 bp, Homo sapiens
tgtcaataaagctgtgc

SEQ ID NO: 4383699 - DNA, 18 bp, Homo sapiens
tgtcaattcataaaaaca

SEQ ID NO: 4383700 - DNA, 19 bp, Homo sapiens
tgtcacaataaagtttatt

SEQ ID NO: 4383701 - DNA, 16 bp, Homo sapiens
tgtcacaatgagattg

SEQ ID NO: 4383702 - DNA, 16 bp, Homo sapiens
tgtcacacccatggcc

SEQ ID NO: 4383703 - DNA, 22 bp, Homo sapiens
tgtcacagacgtgaaagccaga

SEQ ID NO: 4383704 - DNA, 17 bp, Homo sapiens
tgtcacagtaaaaataa

SEQ ID NO: 4383705 - DNA, 18 bp, Homo sapiens
tgtcacagtaaaaataaa

SEQ ID NO: 4383706 - DNA, 23 bp, Homo sapiens
tgtcacagtaaaaataaaatact

SEQ ID NO: 4383707 - DNA, 16 bp, Homo sapiens
tgtcaccaccttccca

SEQ ID NO: 4383708 - DNA, 15 bp, Homo sapiens
tgtcaccagctatct

SEQ ID NO: 4383709 - DNA, 19 bp, Homo sapiens
tgtcaccagctatctgtca

SEQ ID NO: 4383710 - DNA, 14 bp, Homo sapiens
tgtcacctctcagc

SEQ ID NO: 4383711 - DNA, 18 bp, Homo sapiens
tgtcacctctcagctgct

SEQ ID NO: 4383712 - DNA, 21 bp, Homo sapiens
tgtcacctctcagctgctgga

SEQ ID NO: 4383713 - DNA, 16 bp, Homo sapiens
tgtcacctcttccgac

SEQ ID NO: 4383714 - DNA, 14 bp, Homo sapiens
tgtcacctgtgctt

SEQ ID NO: 4383715 - DNA, 22 bp, Homo sapiens
tgtcactgaatatcaactctga

SEQ ID NO: 4383716 - DNA, 19 bp, Homo sapiens
tgtcacttgccacatggtg

SEQ ID NO: 4383717 - DNA, 16 bp, Homo sapiens
tgtcactttttctgat

SEQ ID NO: 4383718 - DNA, 21 bp, Homo sapiens
tgtcagaactagaatttgatt

SEQ ID NO: 4383719 - DNA, 16 bp, Homo sapiens
tgtcagagcccagccc

SEQ ID NO: 4383720 - DNA, 17 bp, Homo sapiens
tgtcagagcccagccca

SEQ ID NO: 4383721 - DNA, 10 bp, Homo sapiens
tgtcagatgc

SEQ ID NO: 4383722 - DNA, 14 bp, Homo sapiens
tgtcagattaaatt

SEQ ID NO: 4383723 - DNA, 11 bp, Homo sapiens
tgtcagattcc

SEQ ID NO: 4383724 - DNA, 23 bp, Homo sapiens
tgtcagcacacacttacagagca

SEQ ID NO: 4383725 - DNA, 11 bp, Homo sapiens
tgtcagccagc

SEQ ID NO: 4383726 - DNA, 13 bp, Homo sapiens
tgtcagccagccg

SEQ ID NO: 4383727 - DNA, 18 bp, Homo sapiens
tgtcagccagccgccctg

SEQ ID NO: 4383728 - DNA, 20 bp, Homo sapiens
tgtcagccagccgccctggg

SEQ ID NO: 4383729 - DNA, 22 bp, Homo sapiens
tgtcagccagccgccctgggct

SEQ ID NO: 4383730 - DNA, 21 bp, Homo sapiens
tgtcagccatcgtcctgggac

SEQ ID NO: 4383731 - DNA, 11 bp, Homo sapiens
tgtcagcctga

SEQ ID NO: 4383732 - DNA, 18 bp, Homo sapiens
tgtcaggctacaaggtag

SEQ ID NO: 4383733 - DNA, 16 bp, Homo sapiens
tgtcaggctgctggcg

SEQ ID NO: 4383734 - DNA, 19 bp, Homo sapiens
tgtcaggctgctggcgcct

SEQ ID NO: 4383735 - DNA, 20 bp, Homo sapiens
tgtcaggctgctggcgcctc

SEQ ID NO: 4383736 - DNA, 22 bp, Homo sapiens
tgtcaggctgctggcgcctctg

SEQ ID NO: 4383737 - DNA, 14 bp, Homo sapiens
tgtcaggggcttgg

SEQ ID NO: 4383738 - DNA, 15 bp, Homo sapiens
tgtcagtatccaggc

SEQ ID NO: 4383739 - DNA, 14 bp, Homo sapiens
tgtcagtcactaaa

SEQ ID NO: 4383740 - DNA, 19 bp, Homo sapiens
tgtcagtggggcagcctct

SEQ ID NO: 4383741 - DNA, 17 bp, Homo sapiens
tgtcagtgtcaccttgg

SEQ ID NO: 4383742 - DNA, 20 bp, Homo sapiens
tgtcagttctctgggaagtg

SEQ ID NO: 4383743 - DNA, 18 bp, Homo sapiens
tgtcagttgttatttatt

SEQ ID NO: 4383744 - DNA, 16 bp, Homo sapiens
tgtcagttttgtacat

SEQ ID NO: 4383745 - DNA, 21 bp, Homo sapiens
tgtcataaacagatgaataaa

SEQ ID NO: 4383746 - DNA, 18 bp, Homo sapiens
tgtcataaagtgagaaaa

SEQ ID NO: 4383747 - DNA, 15 bp, Homo sapiens
tgtcatacaaattta

SEQ ID NO: 4383748 - DNA, 20 bp, Homo sapiens
tgtcatactgtgcaggcctg

SEQ ID NO: 4383749 - DNA, 11 bp, Homo sapiens
tgtcatcactc

SEQ ID NO: 4383750 - DNA, 23 bp, Homo sapiens
tgtcatcctcaaagaaagtgtat

SEQ ID NO: 4383751 - DNA, 14 bp, Homo sapiens
tgtcatcctcacag

SEQ ID NO: 4383752 - DNA, 22 bp, Homo sapiens
tgtcatctctctggggccctgg

SEQ ID NO: 4383753 - DNA, 23 bp, Homo sapiens
tgtcatctctctggggccctggg

SEQ ID NO: 4383754 - DNA, 16 bp, Homo sapiens
tgtcatctttttctag

SEQ ID NO: 4383755 - DNA, 12 bp, Homo sapiens
tgtcatgaacat

SEQ ID NO: 4383756 - DNA, 16 bp, Homo sapiens
tgtcatgctgggattt

SEQ ID NO: 4383757 - DNA, 12 bp, Homo sapiens
tgtcatggtcct

SEQ ID NO: 4383758 - DNA, 14 bp, Homo sapiens
tgtcatgtgcagat

SEQ ID NO: 4383759 - DNA, 17 bp, Homo sapiens
tgtcatgtgttcccttt

SEQ ID NO: 4383760 - DNA, 19 bp, Homo sapiens
tgtcatgtgttccctttgt

SEQ ID NO: 4383761 - DNA, 13 bp, Homo sapiens
tgtcattatattc

SEQ ID NO: 4383762 - DNA, 16 bp, Homo sapiens
tgtcattatattctaa

SEQ ID NO: 4383763 - DNA, 18 bp, Homo sapiens
tgtcattatattctaatt

SEQ ID NO: 4383764 - DNA, 23 bp, Homo sapiens
tgtcattatttttgttagcaaag

SEQ ID NO: 4383765 - DNA, 16 bp, Homo sapiens
tgtcattgaaaaacta

SEQ ID NO: 4383766 - DNA, 13 bp, Homo sapiens
tgtcattgtctac

SEQ ID NO: 4383767 - DNA, 20 bp, Homo sapiens
tgtcatttagttcagcatcc

SEQ ID NO: 4383768 - DNA, 15 bp, Homo sapiens
tgtcatttcagaagt

SEQ ID NO: 4383769 - DNA, 15 bp, Homo sapiens
tgtcatttcattcca

SEQ ID NO: 4383770 - DNA, 17 bp, Homo sapiens
tgtcattttgaactgta

SEQ ID NO: 4383771 - DNA, 18 bp, Homo sapiens
tgtccaaaagcgccctca

SEQ ID NO: 4383772 - DNA, 11 bp, Homo sapiens
tgtccaaagag

SEQ ID NO: 4383773 - DNA, 19 bp, Homo sapiens
tgtccaaagaggctgcccc

SEQ ID NO: 4383774 - DNA, 15 bp, Homo sapiens
tgtccaacctaaccc

SEQ ID NO: 4383775 - DNA, 15 bp, Homo sapiens
tgtccacacccagct

SEQ ID NO: 4383776 - DNA, 18 bp, Homo sapiens
tgtccacacccagctcag

SEQ ID NO: 4383777 - DNA, 21 bp, Homo sapiens
tgtccacccacctatgtgcca

SEQ ID NO: 4383778 - DNA, 15 bp, Homo sapiens
tgtccacctggcccc

SEQ ID NO: 4383779 - DNA, 18 bp, Homo sapiens
tgtccactgttctgttct

SEQ ID NO: 4383780 - DNA, 23 bp, Homo sapiens
tgtccagcctgggcagccaggct

SEQ ID NO: 4383781 - DNA, 14 bp, Homo sapiens
tgtccagcgcctag

SEQ ID NO: 4383782 - DNA, 16 bp, Homo sapiens
tgtccaggaaagaaac

SEQ ID NO: 4383783 - DNA, 21 bp, Homo sapiens
tgtccaggagctaatctgacc

SEQ ID NO: 4383784 - DNA, 20 bp, Homo sapiens
tgtccagggaaacagcctct

SEQ ID NO: 4383785 - DNA, 13 bp, Homo sapiens
tgtccatacactt

SEQ ID NO: 4383786 - DNA, 14 bp, Homo sapiens
tgtcccaagtgcca

SEQ ID NO: 4383787 - DNA, 19 bp, Homo sapiens
tgtcccaattctgcccgct

SEQ ID NO: 4383788 - DNA, 16 bp, Homo sapiens
tgtcccagaattttct

SEQ ID NO: 4383789 - DNA, 12 bp, Homo sapiens
tgtcccagcccc

SEQ ID NO: 4383790 - DNA, 14 bp, Homo sapiens
tgtcccagctacca

SEQ ID NO: 4383791 - DNA, 13 bp, Homo sapiens
tgtcccaggccgg

SEQ ID NO: 4383792 - DNA, 18 bp, Homo sapiens
tgtcccaggccggcccag

SEQ ID NO: 4383793 - DNA, 13 bp, Homo sapiens
tgtcccagtgctc

SEQ ID NO: 4383794 - DNA, 18 bp, Homo sapiens
tgtcccagttgtggcaac

SEQ ID NO: 4383795 - DNA, 19 bp, Homo sapiens
tgtcccatctggtcatttg

SEQ ID NO: 4383796 - DNA, 23 bp, Homo sapiens
tgtcccattctagatcctgcacc

SEQ ID NO: 4383797 - DNA, 18 bp, Homo sapiens
tgtccccaaacaggacag

SEQ ID NO: 4383798 - DNA, 18 bp, Homo sapiens
tgtccccaacgtcccctc

SEQ ID NO: 4383799 - DNA, 22 bp, Homo sapiens
tgtccccaacgtcccctccgcc

SEQ ID NO: 4383800 - DNA, 20 bp, Homo sapiens
tgtccccagcctacctctcc

SEQ ID NO: 4383801 - DNA, 19 bp, Homo sapiens
tgtccccagtttgcagaaa

SEQ ID NO: 4383802 - DNA, 14 bp, Homo sapiens
tgtcccccaggctg

SEQ ID NO: 4383803 - DNA, 16 bp, Homo sapiens
tgtcccccatcatgtg

SEQ ID NO: 4383804 - DNA, 15 bp, Homo sapiens
tgtcccctcactctg

SEQ ID NO: 4383805 - DNA, 13 bp, Homo sapiens
tgtcccctgggtc

SEQ ID NO: 4383806 - DNA, 14 bp, Homo sapiens
tgtccccttcccct

SEQ ID NO: 4383807 - DNA, 16 bp, Homo sapiens
tgtcccggtaccttcc

SEQ ID NO: 4383808 - DNA, 22 bp, Homo sapiens
tgtccctctagtgccttcttta

SEQ ID NO: 4383809 - DNA, 15 bp, Homo sapiens
tgtccctgaaaccta

SEQ ID NO: 4383810 - DNA, 14 bp, Homo sapiens
tgtcccttgcctct

SEQ ID NO: 4383811 - DNA, 15 bp, Homo sapiens
tgtcccttgcctctg

SEQ ID NO: 4383812 - DNA, 19 bp, Homo sapiens
tgtccgatggtatctgggt

SEQ ID NO: 4383813 - DNA, 18 bp, Homo sapiens
tgtccgcaaggggtgatg

SEQ ID NO: 4383814 - DNA, 19 bp, Homo sapiens
tgtccggcccagtgccact

SEQ ID NO: 4383815 - DNA, 16 bp, Homo sapiens
tgtcctaaggaacctt

SEQ ID NO: 4383816 - DNA, 19 bp, Homo sapiens
tgtcctaaggaaccttcct

SEQ ID NO: 4383817 - DNA, 19 bp, Homo sapiens
tgtcctaccatcagctctg

SEQ ID NO: 4383818 - DNA, 14 bp, Homo sapiens
tgtcctatgcaata

SEQ ID NO: 4383819 - DNA, 16 bp, Homo sapiens
tgtcctatgcaataaa

SEQ ID NO: 4383820 - DNA, 16 bp, Homo sapiens
tgtcctccagaagcct

SEQ ID NO: 4383821 - DNA, 20 bp, Homo sapiens
tgtcctccagaagcctctgg

SEQ ID NO: 4383822 - DNA, 21 bp, Homo sapiens
tgtcctccagaagcctctggc

SEQ ID NO: 4383823 - DNA, 12 bp, Homo sapiens
tgtcctcctggt

SEQ ID NO: 4383824 - DNA, 16 bp, Homo sapiens
tgtcctctcgagccca

SEQ ID NO: 4383825 - DNA, 13 bp, Homo sapiens
tgtcctcttccct

SEQ ID NO: 4383826 - DNA, 16 bp, Homo sapiens
tgtcctcttccctctc

SEQ ID NO: 4383827 - DNA, 23 bp, Homo sapiens
tgtcctcttctgctcttttcctg

SEQ ID NO: 4383828 - DNA, 14 bp, Homo sapiens
tgtcctgagcacca

SEQ ID NO: 4383829 - DNA, 11 bp, Homo sapiens
tgtcctgaggc

SEQ ID NO: 4383830 - DNA, 18 bp, Homo sapiens
tgtcctgcacaccctggg

SEQ ID NO: 4383831 - DNA, 15 bp, Homo sapiens
tgtcctgtaaaggtt

SEQ ID NO: 4383832 - DNA, 19 bp, Homo sapiens
tgtcctgttgattaatttc

SEQ ID NO: 4383833 - DNA, 17 bp, Homo sapiens
tgtccttaacccacctc

SEQ ID NO: 4383834 - DNA, 18 bp, Homo sapiens
tgtccttaacccacctct

SEQ ID NO: 4383835 - DNA, 20 bp, Homo sapiens
tgtccttaacccacctctcc

SEQ ID NO: 4383836 - DNA, 23 bp, Homo sapiens
tgtccttaacccacctctcctgc

SEQ ID NO: 4383837 - DNA, 16 bp, Homo sapiens
tgtccttgaatgccat

SEQ ID NO: 4383838 - DNA, 13 bp, Homo sapiens
tgtccttgcacct

SEQ ID NO: 4383839 - DNA, 16 bp, Homo sapiens
tgtccttgcacctgca

SEQ ID NO: 4383840 - DNA, 14 bp, Homo sapiens
tgtcctttctcaga

SEQ ID NO: 4383841 - DNA, 18 bp, Homo sapiens
tgtccttttctcccattt

SEQ ID NO: 4383842 - DNA, 19 bp, Homo sapiens
tgtcgccccaggccctccc

SEQ ID NO: 4383843 - DNA, 20 bp, Homo sapiens
tgtcgtggacacacacagac

SEQ ID NO: 4383844 - DNA, 12 bp, Homo sapiens
tgtctaaaaaca

SEQ ID NO: 4383845 - DNA, 14 bp, Homo sapiens
tgtctaaaatgtca

SEQ ID NO: 4383846 - DNA, 15 bp, Homo sapiens
tgtctactcctagaa

SEQ ID NO: 4383847 - DNA, 17 bp, Homo sapiens
tgtctactcctagaaga

SEQ ID NO: 4383848 - DNA, 18 bp, Homo sapiens
tgtctactcctagaagaa

SEQ ID NO: 4383849 - DNA, 20 bp, Homo sapiens
tgtctaggtctcctcagggt

SEQ ID NO: 4383850 - DNA, 18 bp, Homo sapiens
tgtctatactacagtagt

SEQ ID NO: 4383851 - DNA, 14 bp, Homo sapiens
tgtctattctccag

SEQ ID NO: 4383852 - DNA, 15 bp, Homo sapiens
tgtctatttgtctct

SEQ ID NO: 4383853 - DNA, 19 bp, Homo sapiens
tgtctcaaaaaaaaaaaga

SEQ ID NO: 4383854 - DNA, 19 bp, Homo sapiens
tgtctcaacgcctccccct

SEQ ID NO: 4383855 - DNA, 20 bp, Homo sapiens
tgtctcactttactttcaag

SEQ ID NO: 4383856 - DNA, 13 bp, Homo sapiens
tgtctcagcctct

SEQ ID NO: 4383857 - DNA, 17 bp, Homo sapiens
tgtctcaggctcaagtt

SEQ ID NO: 4383858 - DNA, 21 bp, Homo sapiens
tgtctcaggctcaagttttta

SEQ ID NO: 4383859 - DNA, 13 bp, Homo sapiens
tgtctcatcccca

SEQ ID NO: 4383860 - DNA, 19 bp, Homo sapiens
tgtctccaaccccccagca

SEQ ID NO: 4383861 - DNA, 23 bp, Homo sapiens
tgtctccaaccccccagcactga

SEQ ID NO: 4383862 - DNA, 18 bp, Homo sapiens
tgtctccagggcccccac

SEQ ID NO: 4383863 - DNA, 15 bp, Homo sapiens
tgtctccatggccct

SEQ ID NO: 4383864 - DNA, 21 bp, Homo sapiens
tgtctcgtggtaggactgtag

SEQ ID NO: 4383865 - DNA, 22 bp, Homo sapiens
tgtctctaccaaaaaaaggaag

SEQ ID NO: 4383866 - DNA, 18 bp, Homo sapiens
tgtctctcttcagactct

SEQ ID NO: 4383867 - DNA, 13 bp, Homo sapiens
tgtctctgaggac

SEQ ID NO: 4383868 - DNA, 16 bp, Homo sapiens
tgtctcttctgagcta

SEQ ID NO: 4383869 - DNA, 23 bp, Homo sapiens
tgtctcttgagcatcaatcttgt

SEQ ID NO: 4383870 - DNA, 19 bp, Homo sapiens
tgtctgaaacatttcataa

SEQ ID NO: 4383871 - DNA, 18 bp, Homo sapiens
tgtctgaagtacaaacat

SEQ ID NO: 4383872 - DNA, 16 bp, Homo sapiens
tgtctgacttttgtta

SEQ ID NO: 4383873 - DNA, 20 bp, Homo sapiens
tgtctgagtagtggccactg

SEQ ID NO: 4383874 - DNA, 15 bp, Homo sapiens
tgtctgatctgtgct

SEQ ID NO: 4383875 - DNA, 20 bp, Homo sapiens
tgtctgccaaaatgcaacat

SEQ ID NO: 4383876 - DNA, 19 bp, Homo sapiens
tgtctgcccaatgaataat

SEQ ID NO: 4383877 - DNA, 11 bp, Homo sapiens
tgtctgccctt

SEQ ID NO: 4383878 - DNA, 15 bp, Homo sapiens
tgtctgcctttaaat

SEQ ID NO: 4383879 - DNA, 13 bp, Homo sapiens
tgtctgctttggt

SEQ ID NO: 4383880 - DNA, 15 bp, Homo sapiens
tgtctggatcagtaa

SEQ ID NO: 4383881 - DNA, 14 bp, Homo sapiens
tgtctggcaaggac

SEQ ID NO: 4383882 - DNA, 17 bp, Homo sapiens
tgtctggcacagcctgg

SEQ ID NO: 4383883 - DNA, 15 bp, Homo sapiens
tgtctggccaggcct

SEQ ID NO: 4383884 - DNA, 23 bp, Homo sapiens
tgtctggcgttctcaagaatcta

SEQ ID NO: 4383885 - DNA, 22 bp, Homo sapiens
tgtctggctcggacccacccca

SEQ ID NO: 4383886 - DNA, 19 bp, Homo sapiens
tgtctggctttggcactct

SEQ ID NO: 4383887 - DNA, 23 bp, Homo sapiens
tgtctggggacgttgctgagcca

SEQ ID NO: 4383888 - DNA, 21 bp, Homo sapiens
tgtctgtaaaaaatggagctc

SEQ ID NO: 4383889 - DNA, 20 bp, Homo sapiens
tgtctgtagagggccctggt

SEQ ID NO: 4383890 - DNA, 18 bp, Homo sapiens
tgtctgtgatctctgctg

SEQ ID NO: 4383891 - DNA, 11 bp, Homo sapiens
tgtctgtgcac

SEQ ID NO: 4383892 - DNA, 15 bp, Homo sapiens
tgtctgtgcacatgc

SEQ ID NO: 4383893 - DNA, 19 bp, Homo sapiens
tgtctgtgccctccaaaga

SEQ ID NO: 4383894 - DNA, 15 bp, Homo sapiens
tgtctgtggattttt

SEQ ID NO: 4383895 - DNA, 14 bp, Homo sapiens
tgtctgttcccagc

SEQ ID NO: 4383896 - DNA, 18 bp, Homo sapiens
tgtctgttcccagcccct

SEQ ID NO: 4383897 - DNA, 15 bp, Homo sapiens
tgtctgttctacata

SEQ ID NO: 4383898 - DNA, 17 bp, Homo sapiens
tgtcttaacctcaggga

SEQ ID NO: 4383899 - DNA, 14 bp, Homo sapiens
tgtcttaattaaaa

SEQ ID NO: 4383900 - DNA, 13 bp, Homo sapiens
tgtcttagttgat

SEQ ID NO: 4383901 - DNA, 17 bp, Homo sapiens
tgtcttatttttagatg

SEQ ID NO: 4383902 - DNA, 15 bp, Homo sapiens
tgtcttcatttttta

SEQ ID NO: 4383903 - DNA, 15 bp, Homo sapiens
tgtcttccctgcctg

SEQ ID NO: 4383904 - DNA, 11 bp, Homo sapiens
tgtcttcctca

SEQ ID NO: 4383905 - DNA, 22 bp, Homo sapiens
tgtcttcctcaaaataaagaag

SEQ ID NO: 4383906 - DNA, 12 bp, Homo sapiens
tgtcttctgcct

SEQ ID NO: 4383907 - DNA, 15 bp, Homo sapiens
tgtcttctgcctgtt

SEQ ID NO: 4383908 - DNA, 18 bp, Homo sapiens
tgtcttgactttttaaaa

SEQ ID NO: 4383909 - DNA, 22 bp, Homo sapiens
tgtcttgtatttaaaaacattt

SEQ ID NO: 4383910 - DNA, 15 bp, Homo sapiens
tgtcttgtccccacc

SEQ ID NO: 4383911 - DNA, 15 bp, Homo sapiens
tgtcttgttcctgtg

SEQ ID NO: 4383912 - DNA, 22 bp, Homo sapiens
tgtctttaaaaactgttttaga

SEQ ID NO: 4383913 - DNA, 11 bp, Homo sapiens
tgtctttcaaa

SEQ ID NO: 4383914 - DNA, 13 bp, Homo sapiens
tgtctttcaaact

SEQ ID NO: 4383915 - DNA, 15 bp, Homo sapiens
tgtctttctaagaaa

SEQ ID NO: 4383916 - DNA, 17 bp, Homo sapiens
tgtctttctaagaaatc

SEQ ID NO: 4383917 - DNA, 14 bp, Homo sapiens
tgtctttctttggt

SEQ ID NO: 4383918 - DNA, 15 bp, Homo sapiens
tgtctttctttggtg

SEQ ID NO: 4383919 - DNA, 20 bp, Homo sapiens
tgtctttgtaatattttcca

SEQ ID NO: 4383920 - DNA, 15 bp, Homo sapiens
tgtcttttaaaatgc

SEQ ID NO: 4383921 - DNA, 19 bp, Homo sapiens
tgtcttttatttaacaaaa

SEQ ID NO: 4383922 - DNA, 18 bp, Homo sapiens
tgtcttttcaatcttcta

SEQ ID NO: 4383923 - DNA, 20 bp, Homo sapiens
tgtcttttcaatcttctact

SEQ ID NO: 4383924 - DNA, 23 bp, Homo sapiens
tgtcttttcagaagcaagccaga

SEQ ID NO: 4383925 - DNA, 14 bp, Homo sapiens
tgtcttttttctct

SEQ ID NO: 4383926 - DNA, 15 bp, Homo sapiens
tgtgaaaatagtgta

SEQ ID NO: 4383927 - DNA, 18 bp, Homo sapiens
tgtgaaaatatctgctca

SEQ ID NO: 4383928 - DNA, 23 bp, Homo sapiens
tgtgaaataccacaagcctgaga

SEQ ID NO: 4383929 - DNA, 12 bp, Homo sapiens
tgtgaaatgctt

SEQ ID NO: 4383930 - DNA, 18 bp, Homo sapiens
tgtgaacaactgtttgtc

SEQ ID NO: 4383931 - DNA, 19 bp, Homo sapiens
tgtgaacagctttgtatgt

SEQ ID NO: 4383932 - DNA, 18 bp, Homo sapiens
tgtgaacctacctgcctt

SEQ ID NO: 4383933 - DNA, 14 bp, Homo sapiens
tgtgaactcaccct

SEQ ID NO: 4383934 - DNA, 14 bp, Homo sapiens
tgtgaactttgaat

SEQ ID NO: 4383935 - DNA, 14 bp, Homo sapiens
tgtgaagaatttag

SEQ ID NO: 4383936 - DNA, 23 bp, Homo sapiens
tgtgaagccatgagttccagaaa

SEQ ID NO: 4383937 - DNA, 23 bp, Homo sapiens
tgtgaaggattatggaaaaataa

SEQ ID NO: 4383938 - DNA, 20 bp, Homo sapiens
tgtgaagtttaattgtctca

SEQ ID NO: 4383939 - DNA, 12 bp, Homo sapiens
tgtgaataaatt

SEQ ID NO: 4383940 - DNA, 21 bp, Homo sapiens
tgtgaatacctgctcacgtca

SEQ ID NO: 4383941 - DNA, 16 bp, Homo sapiens
tgtgaatagcctggcc

SEQ ID NO: 4383942 - DNA, 18 bp, Homo sapiens
tgtgaatataaatgtgtg

SEQ ID NO: 4383943 - DNA, 13 bp, Homo sapiens
tgtgaatattcct

SEQ ID NO: 4383944 - DNA, 18 bp, Homo sapiens
tgtgaatcagaccctacc

SEQ ID NO: 4383945 - DNA, 22 bp, Homo sapiens
tgtgaatctgcttttcctctgc

SEQ ID NO: 4383946 - DNA, 14 bp, Homo sapiens
tgtgaatgaacact

SEQ ID NO: 4383947 - DNA, 14 bp, Homo sapiens
tgtgaatggaggca

SEQ ID NO: 4383948 - DNA, 16 bp, Homo sapiens
tgtgaattattgacac

SEQ ID NO: 4383949 - DNA, 19 bp, Homo sapiens
tgtgaatttgtttgtgaca

SEQ ID NO: 4383950 - DNA, 14 bp, Homo sapiens
tgtgaatttttaag

SEQ ID NO: 4383951 - DNA, 22 bp, Homo sapiens
tgtgacaactaaacaaggcatt

SEQ ID NO: 4383952 - DNA, 15 bp, Homo sapiens
tgtgacaattctgtt

SEQ ID NO: 4383953 - DNA, 19 bp, Homo sapiens
tgtgacaattctgttttta

SEQ ID NO: 4383954 - DNA, 18 bp, Homo sapiens
tgtgacaggaaagccctc

SEQ ID NO: 4383955 - DNA, 17 bp, Homo sapiens
tgtgacatggtgcctga

SEQ ID NO: 4383956 - DNA, 18 bp, Homo sapiens
tgtgacatggtgcctgag

SEQ ID NO: 4383957 - DNA, 14 bp, Homo sapiens
tgtgacattccttc

SEQ ID NO: 4383958 - DNA, 15 bp, Homo sapiens
tgtgaccacaacatg

SEQ ID NO: 4383959 - DNA, 20 bp, Homo sapiens
tgtgaccagaaagcttcatc

SEQ ID NO: 4383960 - DNA, 14 bp, Homo sapiens
tgtgacctgagggc

SEQ ID NO: 4383961 - DNA, 16 bp, Homo sapiens
tgtgacctgtcagaat

SEQ ID NO: 4383962 - DNA, 18 bp, Homo sapiens
tgtgacctgtcagaataa

SEQ ID NO: 4383963 - DNA, 19 bp, Homo sapiens
tgtgacctgtcagaataaa

SEQ ID NO: 4383964 - DNA, 13 bp, Homo sapiens
tgtgactcttact

SEQ ID NO: 4383965 - DNA, 12 bp, Homo sapiens
tgtgactcttct

SEQ ID NO: 4383966 - DNA, 22 bp, Homo sapiens
tgtgactgccaggataaagctt

SEQ ID NO: 4383967 - DNA, 14 bp, Homo sapiens
tgtgacttacaatt

SEQ ID NO: 4383968 - DNA, 15 bp, Homo sapiens
tgtgacttacaattt

SEQ ID NO: 4383969 - DNA, 15 bp, Homo sapiens
tgtgacttcactgta

SEQ ID NO: 4383970 - DNA, 16 bp, Homo sapiens
tgtgacttcactgtat

SEQ ID NO: 4383971 - DNA, 19 bp, Homo sapiens
tgtgacttcactgtatata

SEQ ID NO: 4383972 - DNA, 13 bp, Homo sapiens
tgtgactttcagg

SEQ ID NO: 4383973 - DNA, 15 bp, Homo sapiens
tgtgagacccccaca

SEQ ID NO: 4383974 - DNA, 15 bp, Homo sapiens
tgtgagactactaag

SEQ ID NO: 4383975 - DNA, 15 bp, Homo sapiens
tgtgagacttctgtt

SEQ ID NO: 4383976 - DNA, 13 bp, Homo sapiens
tgtgagagcccat

SEQ ID NO: 4383977 - DNA, 20 bp, Homo sapiens
tgtgagcagtggacacgtga

SEQ ID NO: 4383978 - DNA, 20 bp, Homo sapiens
tgtgagcatggggccaggaa

SEQ ID NO: 4383979 - DNA, 14 bp, Homo sapiens
tgtgagcgagcaag

SEQ ID NO: 4383980 - DNA, 20 bp, Homo sapiens
tgtgaggagctgctggcttg

SEQ ID NO: 4383981 - DNA, 13 bp, Homo sapiens
tgtgaggcagggg

SEQ ID NO: 4383982 - DNA, 18 bp, Homo sapiens
tgtgaggcaggggcggag

SEQ ID NO: 4383983 - DNA, 14 bp, Homo sapiens
tgtgaggccagggc

SEQ ID NO: 4383984 - DNA, 22 bp, Homo sapiens
tgtgaggccagggcagagtgag

SEQ ID NO: 4383985 - DNA, 22 bp, Homo sapiens
tgtgagggaggggaaaagcatt

SEQ ID NO: 4383986 - DNA, 18 bp, Homo sapiens
tgtgaggggctctctcat

SEQ ID NO: 4383987 - DNA, 23 bp, Homo sapiens
tgtgagtataaaataaagcaaat

SEQ ID NO: 4383988 - DNA, 20 bp, Homo sapiens
tgtgagtgtgaatataaatg

SEQ ID NO: 4383989 - DNA, 22 bp, Homo sapiens
tgtgagtgtttttatcttttta

SEQ ID NO: 4383990 - DNA, 14 bp, Homo sapiens
tgtgatacagtttt

SEQ ID NO: 4383991 - DNA, 16 bp, Homo sapiens
tgtgatccggtttctt

SEQ ID NO: 4383992 - DNA, 22 bp, Homo sapiens
tgtgatccggtttctttttgct

SEQ ID NO: 4383993 - DNA, 16 bp, Homo sapiens
tgtgatcttaaaataa

SEQ ID NO: 4383994 - DNA, 18 bp, Homo sapiens
tgtgatgaacatattcat

SEQ ID NO: 4383995 - DNA, 22 bp, Homo sapiens
tgtgatgaacatattcatgaaa

SEQ ID NO: 4383996 - DNA, 18 bp, Homo sapiens
tgtgatgaatactgtatt

SEQ ID NO: 4383997 - DNA, 19 bp, Homo sapiens
tgtgatggggtcatcaaat

SEQ ID NO: 4383998 - DNA, 21 bp, Homo sapiens
tgtgatgtcagcggtgcagcg

SEQ ID NO: 4383999 - DNA, 19 bp, Homo sapiens
tgtgattagatcacatctt

SEQ ID NO: 4384000 - DNA, 23 bp, Homo sapiens
tgtgattagatcacatcttaaat

SEQ ID NO: 4384001 - DNA, 14 bp, Homo sapiens
tgtgattcaatctg

SEQ ID NO: 4384002 - DNA, 16 bp, Homo sapiens
tgtgattcaatctgta

SEQ ID NO: 4384003 - DNA, 20 bp, Homo sapiens
tgtgattcaatctgtaaact

SEQ ID NO: 4384004 - DNA, 15 bp, Homo sapiens
tgtgattcttctaaa

SEQ ID NO: 4384005 - DNA, 19 bp, Homo sapiens
tgtgattcttctaaagcac

SEQ ID NO: 4384006 - DNA, 17 bp, Homo sapiens
tgtgattgtggaatgga

SEQ ID NO: 4384007 - DNA, 14 bp, Homo sapiens
tgtgatttctttaa

SEQ ID NO: 4384008 - DNA, 13 bp, Homo sapiens
tgtgattttaaga

SEQ ID NO: 4384009 - DNA, 17 bp, Homo sapiens
tgtgatttttcttcagg

SEQ ID NO: 4384010 - DNA, 17 bp, Homo sapiens
tgtgcaaaaaaattaaa

SEQ ID NO: 4384011 - DNA, 23 bp, Homo sapiens
tgtgcaaaatgtgtttcagccgt

SEQ ID NO: 4384012 - DNA, 13 bp, Homo sapiens
tgtgcaaacatgg

SEQ ID NO: 4384013 - DNA, 14 bp, Homo sapiens
tgtgcaaacatgga

SEQ ID NO: 4384014 - DNA, 17 bp, Homo sapiens
tgtgcaaaggataaatt

SEQ ID NO: 4384015 - DNA, 19 bp, Homo sapiens
tgtgcaaaggataaatttt

SEQ ID NO: 4384016 - DNA, 13 bp, Homo sapiens
tgtgcaacttttt

SEQ ID NO: 4384017 - DNA, 16 bp, Homo sapiens
tgtgcaatttctgtac

SEQ ID NO: 4384018 - DNA, 21 bp, Homo sapiens
tgtgcacatctacatgccatg

SEQ ID NO: 4384019 - DNA, 22 bp, Homo sapiens
tgtgcacatctacatgccatgc

SEQ ID NO: 4384020 - DNA, 17 bp, Homo sapiens
tgtgcacatctgtgtct

SEQ ID NO: 4384021 - DNA, 13 bp, Homo sapiens
tgtgcaccagggt

SEQ ID NO: 4384022 - DNA, 19 bp, Homo sapiens
tgtgcagaaaatatttaat

SEQ ID NO: 4384023 - DNA, 22 bp, Homo sapiens
tgtgcaggctgcagtggctccc

SEQ ID NO: 4384024 - DNA, 15 bp, Homo sapiens
tgtgcagggatattg

SEQ ID NO: 4384025 - DNA, 18 bp, Homo sapiens
tgtgcagtcactggaggt

SEQ ID NO: 4384026 - DNA, 20 bp, Homo sapiens
tgtgcagtcagcttttttcc

SEQ ID NO: 4384027 - DNA, 18 bp, Homo sapiens
tgtgcagtgttagtattc

SEQ ID NO: 4384028 - DNA, 19 bp, Homo sapiens
tgtgcataatgctttggaa

SEQ ID NO: 4384029 - DNA, 21 bp, Homo sapiens
tgtgcatccgcctgaaagtgt

SEQ ID NO: 4384030 - DNA, 22 bp, Homo sapiens
tgtgcatccgcctgaaagtgtt

SEQ ID NO: 4384031 - DNA, 15 bp, Homo sapiens
tgtgcattctggatt

SEQ ID NO: 4384032 - DNA, 21 bp, Homo sapiens
tgtgccaactgccaggctgcc

SEQ ID NO: 4384033 - DNA, 15 bp, Homo sapiens
tgtgccaagccctgg

SEQ ID NO: 4384034 - DNA, 17 bp, Homo sapiens
tgtgccaagccctggcc

SEQ ID NO: 4384035 - DNA, 13 bp, Homo sapiens
tgtgccacagagg

SEQ ID NO: 4384036 - DNA, 16 bp, Homo sapiens
tgtgccacagaggccc

SEQ ID NO: 4384037 - DNA, 14 bp, Homo sapiens
tgtgccccatgcct

SEQ ID NO: 4384038 - DNA, 19 bp, Homo sapiens
tgtgccccatgcctgtcca

SEQ ID NO: 4384039 - DNA, 12 bp, Homo sapiens
tgtgccctggac

SEQ ID NO: 4384040 - DNA, 14 bp, Homo sapiens
tgtgccctggactg

SEQ ID NO: 4384041 - DNA, 15 bp, Homo sapiens
tgtgccctggactgt

SEQ ID NO: 4384042 - DNA, 20 bp, Homo sapiens
tgtgccgctgccacccgccc

SEQ ID NO: 4384043 - DNA, 22 bp, Homo sapiens
tgtgccgggaggcagccacagg

SEQ ID NO: 4384044 - DNA, 14 bp, Homo sapiens
tgtgcctaatgtgt

SEQ ID NO: 4384045 - DNA, 18 bp, Homo sapiens
tgtgcctatagtcccact

SEQ ID NO: 4384046 - DNA, 16 bp, Homo sapiens
tgtgcctccccccaga

SEQ ID NO: 4384047 - DNA, 17 bp, Homo sapiens
tgtgcctggccccagcc

SEQ ID NO: 4384048 - DNA, 14 bp, Homo sapiens
tgtgcctggctccc

SEQ ID NO: 4384049 - DNA, 16 bp, Homo sapiens
tgtgcctggctccctg

SEQ ID NO: 4384050 - DNA, 17 bp, Homo sapiens
tgtgcctggctccctga

SEQ ID NO: 4384051 - DNA, 15 bp, Homo sapiens
tgtgccttatgttga

SEQ ID NO: 4384052 - DNA, 17 bp, Homo sapiens
tgtgccttgtcacgcca

SEQ ID NO: 4384053 - DNA, 15 bp, Homo sapiens
tgtgccttgtttttt

SEQ ID NO: 4384054 - DNA, 14 bp, Homo sapiens
tgtgcctttcctat

SEQ ID NO: 4384055 - DNA, 15 bp, Homo sapiens
tgtgcctttctttgc

SEQ ID NO: 4384056 - DNA, 20 bp, Homo sapiens
tgtgcgtatgcagtgtagat

SEQ ID NO: 4384057 - DNA, 16 bp, Homo sapiens
tgtgcgtgcgtgtgtg

SEQ ID NO: 4384058 - DNA, 17 bp, Homo sapiens
tgtgctagaaattttca

SEQ ID NO: 4384059 - DNA, 21 bp, Homo sapiens
tgtgctatactgcatactttt

SEQ ID NO: 4384060 - DNA, 13 bp, Homo sapiens
tgtgctatagtat

SEQ ID NO: 4384061 - DNA, 14 bp, Homo sapiens
tgtgctatgaattt

SEQ ID NO: 4384062 - DNA, 15 bp, Homo sapiens
tgtgctatgaatttt

SEQ ID NO: 4384063 - DNA, 20 bp, Homo sapiens
tgtgctcagccaaatttcct

SEQ ID NO: 4384064 - DNA, 13 bp, Homo sapiens
tgtgctctgggga

SEQ ID NO: 4384065 - DNA, 16 bp, Homo sapiens
tgtgctctgtacctgt

SEQ ID NO: 4384066 - DNA, 14 bp, Homo sapiens
tgtgctgaccctcc

SEQ ID NO: 4384067 - DNA, 22 bp, Homo sapiens
tgtgctgccctgttgccgagcc

SEQ ID NO: 4384068 - DNA, 18 bp, Homo sapiens
tgtgctgggagaaatact

SEQ ID NO: 4384069 - DNA, 17 bp, Homo sapiens
tgtgctgtggaagcaac

SEQ ID NO: 4384070 - DNA, 21 bp, Homo sapiens
tgtgctgtggagagaagctga

SEQ ID NO: 4384071 - DNA, 12 bp, Homo sapiens
tgtgctgtgggc

SEQ ID NO: 4384072 - DNA, 13 bp, Homo sapiens
tgtgctgtgggca

SEQ ID NO: 4384073 - DNA, 17 bp, Homo sapiens
tgtgctgtgggcagcac

SEQ ID NO: 4384074 - DNA, 22 bp, Homo sapiens
tgtgctgtgggcagcaccctcc

SEQ ID NO: 4384075 - DNA, 18 bp, Homo sapiens
tgtgctgttttctgtaaa

SEQ ID NO: 4384076 - DNA, 19 bp, Homo sapiens
tgtgcttcgggcccttccc

SEQ ID NO: 4384077 - DNA, 12 bp, Homo sapiens
tgtgcttctccc

SEQ ID NO: 4384078 - DNA, 18 bp, Homo sapiens
tgtgcttctccccagaat

SEQ ID NO: 4384079 - DNA, 19 bp, Homo sapiens
tgtgcttgagccaggaggc

SEQ ID NO: 4384080 - DNA, 22 bp, Homo sapiens
tgtgcttggatttgcatattta

SEQ ID NO: 4384081 - DNA, 14 bp, Homo sapiens
tgtgcttgtttaca

SEQ ID NO: 4384082 - DNA, 17 bp, Homo sapiens
tgtgctttctattgtac

SEQ ID NO: 4384083 - DNA, 14 bp, Homo sapiens
tgtgctttggttaa

SEQ ID NO: 4384084 - DNA, 21 bp, Homo sapiens
tgtgctttttaagaatatttt

SEQ ID NO: 4384085 - DNA, 17 bp, Homo sapiens
tgtggaaacgcagttgt

SEQ ID NO: 4384086 - DNA, 16 bp, Homo sapiens
tgtggaacataaaaag

SEQ ID NO: 4384087 - DNA, 20 bp, Homo sapiens
tgtggaagtcagtacgatca

SEQ ID NO: 4384088 - DNA, 15 bp, Homo sapiens
tgtggaagtgtgggt

SEQ ID NO: 4384089 - DNA, 15 bp, Homo sapiens
tgtggaataatacat

SEQ ID NO: 4384090 - DNA, 17 bp, Homo sapiens
tgtggaatgttggataa

SEQ ID NO: 4384091 - DNA, 15 bp, Homo sapiens
tgtggaccaattatt

SEQ ID NO: 4384092 - DNA, 22 bp, Homo sapiens
tgtggagaccctgccacagcca

SEQ ID NO: 4384093 - DNA, 17 bp, Homo sapiens
tgtggaggaagagccac

SEQ ID NO: 4384094 - DNA, 18 bp, Homo sapiens
tgtggaggaagagccacc

SEQ ID NO: 4384095 - DNA, 23 bp, Homo sapiens
tgtggaggagaggggtggaggct

SEQ ID NO: 4384096 - DNA, 22 bp, Homo sapiens
tgtggagggagtgagccagcag

SEQ ID NO: 4384097 - DNA, 22 bp, Homo sapiens
tgtggaggggcttgggcctgca

SEQ ID NO: 4384098 - DNA, 20 bp, Homo sapiens
tgtggatcaaccatcgcttt

SEQ ID NO: 4384099 - DNA, 17 bp, Homo sapiens
tgtggcaaggaaaaaca

SEQ ID NO: 4384100 - DNA, 19 bp, Homo sapiens
tgtggcactggggcagggg

SEQ ID NO: 4384101 - DNA, 20 bp, Homo sapiens
tgtggcagggggccccgcca

SEQ ID NO: 4384102 - DNA, 21 bp, Homo sapiens
tgtggcagtaaagagaaactt

SEQ ID NO: 4384103 - DNA, 22 bp, Homo sapiens
tgtggcagtaaagagaaacttt

SEQ ID NO: 4384104 - DNA, 15 bp, Homo sapiens
tgtggcagtggtttt

SEQ ID NO: 4384105 - DNA, 23 bp, Homo sapiens
tgtggccatatatgctgtatttc

SEQ ID NO: 4384106 - DNA, 17 bp, Homo sapiens
tgtggcccctcccctgc

SEQ ID NO: 4384107 - DNA, 17 bp, Homo sapiens
tgtggccctggcctgct

SEQ ID NO: 4384108 - DNA, 21 bp, Homo sapiens
tgtggccggcctcctcctcac

SEQ ID NO: 4384109 - DNA, 15 bp, Homo sapiens
tgtggccggtgccag

SEQ ID NO: 4384110 - DNA, 22 bp, Homo sapiens
tgtggcctcaagcaatccacct

SEQ ID NO: 4384111 - DNA, 14 bp, Homo sapiens
tgtggcctgctcat

SEQ ID NO: 4384112 - DNA, 22 bp, Homo sapiens
tgtggcctggttcaaagtaaag

SEQ ID NO: 4384113 - DNA, 13 bp, Homo sapiens
tgtggcggtgcct

SEQ ID NO: 4384114 - DNA, 18 bp, Homo sapiens
tgtggctcctatctgtgt

SEQ ID NO: 4384115 - DNA, 13 bp, Homo sapiens
tgtggctgaggag

SEQ ID NO: 4384116 - DNA, 17 bp, Homo sapiens
tgtggctggctctacct

SEQ ID NO: 4384117 - DNA, 22 bp, Homo sapiens
tgtggctggctctaccttcctg

SEQ ID NO: 4384118 - DNA, 16 bp, Homo sapiens
tgtggctggtgtcccc

SEQ ID NO: 4384119 - DNA, 20 bp, Homo sapiens
tgtggctggtgtccccttcc

SEQ ID NO: 4384120 - DNA, 12 bp, Homo sapiens
tgtggctgtgca

SEQ ID NO: 4384121 - DNA, 17 bp, Homo sapiens
tgtggctttttgttcag

SEQ ID NO: 4384122 - DNA, 20 bp, Homo sapiens
tgtggctttttgttcagaat

SEQ ID NO: 4384123 - DNA, 21 bp, Homo sapiens
tgtggctttttgttcagaatt

SEQ ID NO: 4384124 - DNA, 21 bp, Homo sapiens
tgtgggactgtacacacttta

SEQ ID NO: 4384125 - DNA, 18 bp, Homo sapiens
tgtgggagccgcagagcc

SEQ ID NO: 4384126 - DNA, 18 bp, Homo sapiens
tgtgggagtgcagagaaa

SEQ ID NO: 4384127 - DNA, 16 bp, Homo sapiens
tgtgggcactgtgcca

SEQ ID NO: 4384128 - DNA, 14 bp, Homo sapiens
tgtgggcagtcatc

SEQ ID NO: 4384129 - DNA, 13 bp, Homo sapiens
tgtgggcggctcc

SEQ ID NO: 4384130 - DNA, 20 bp, Homo sapiens
tgtgggcggctcctggtgct

SEQ ID NO: 4384131 - DNA, 12 bp, Homo sapiens
tgtggggcccct

SEQ ID NO: 4384132 - DNA, 18 bp, Homo sapiens
tgtggggcctcaggctcc

SEQ ID NO: 4384133 - DNA, 22 bp, Homo sapiens
tgtggggggtaatccctgcttt

SEQ ID NO: 4384134 - DNA, 14 bp, Homo sapiens
tgtggggggtcctt

SEQ ID NO: 4384135 - DNA, 17 bp, Homo sapiens
tgtgggggtggccatcc

SEQ ID NO: 4384136 - DNA, 14 bp, Homo sapiens
tgtgggtcccgcac

SEQ ID NO: 4384137 - DNA, 12 bp, Homo sapiens
tgtgggtctctg

SEQ ID NO: 4384138 - DNA, 16 bp, Homo sapiens
tgtgggtgccttccat

SEQ ID NO: 4384139 - DNA, 18 bp, Homo sapiens
tgtgggtgttctttcctg

SEQ ID NO: 4384140 - DNA, 14 bp, Homo sapiens
tgtggtaatctaca

SEQ ID NO: 4384141 - DNA, 15 bp, Homo sapiens
tgtggtagctccagc

SEQ ID NO: 4384142 - DNA, 16 bp, Homo sapiens
tgtggtagctccagcg

SEQ ID NO: 4384143 - DNA, 15 bp, Homo sapiens
tgtggtcacagctgt

SEQ ID NO: 4384144 - DNA, 16 bp, Homo sapiens
tgtggtcgtcaacttt

SEQ ID NO: 4384145 - DNA, 21 bp, Homo sapiens
tgtggtcgtcaactttcctca

SEQ ID NO: 4384146 - DNA, 17 bp, Homo sapiens
tgtggtctattgtcgct

SEQ ID NO: 4384147 - DNA, 19 bp, Homo sapiens
tgtggtgaagtgtggctgg

SEQ ID NO: 4384148 - DNA, 15 bp, Homo sapiens
tgtggtgaatatgca

SEQ ID NO: 4384149 - DNA, 23 bp, Homo sapiens
tgtggtgtgtccccctctgtcca

SEQ ID NO: 4384150 - DNA, 13 bp, Homo sapiens
tgtggttcctctg

SEQ ID NO: 4384151 - DNA, 22 bp, Homo sapiens
tgtggtttcatgttagttacct

SEQ ID NO: 4384152 - DNA, 14 bp, Homo sapiens
tgtgtaaaattaat

SEQ ID NO: 4384153 - DNA, 15 bp, Homo sapiens
tgtgtaaaattaatg

SEQ ID NO: 4384154 - DNA, 19 bp, Homo sapiens
tgtgtaaaattaatgtaat

SEQ ID NO: 4384155 - DNA, 21 bp, Homo sapiens
tgtgtaaaattaatgtaataa

SEQ ID NO: 4384156 - DNA, 20 bp, Homo sapiens
tgtgtaaagactgagcagaa

SEQ ID NO: 4384157 - DNA, 14 bp, Homo sapiens
tgtgtaaagattta

SEQ ID NO: 4384158 - DNA, 19 bp, Homo sapiens
tgtgtaaagatttatacag

SEQ ID NO: 4384159 - DNA, 14 bp, Homo sapiens
tgtgtaataaagtg

SEQ ID NO: 4384160 - DNA, 17 bp, Homo sapiens
tgtgtaataaagtgttt

SEQ ID NO: 4384161 - DNA, 19 bp, Homo sapiens
tgtgtaataaagtgttttc

SEQ ID NO: 4384162 - DNA, 21 bp, Homo sapiens
tgtgtaataaagtgttttcag

SEQ ID NO: 4384163 - DNA, 19 bp, Homo sapiens
tgtgtaatctaagtatatg

SEQ ID NO: 4384164 - DNA, 11 bp, Homo sapiens
tgtgtaattta

SEQ ID NO: 4384165 - DNA, 19 bp, Homo sapiens
tgtgtaatttaaaattgtg

SEQ ID NO: 4384166 - DNA, 23 bp, Homo sapiens
tgtgtaatttaaaattgtgatgt

SEQ ID NO: 4384167 - DNA, 19 bp, Homo sapiens
tgtgtacctcactgtccaa

SEQ ID NO: 4384168 - DNA, 14 bp, Homo sapiens
tgtgtacctgtggc

SEQ ID NO: 4384169 - DNA, 17 bp, Homo sapiens
tgtgtaccttaagatat

SEQ ID NO: 4384170 - DNA, 23 bp, Homo sapiens
tgtgtataaaacattaattgcta

SEQ ID NO: 4384171 - DNA, 16 bp, Homo sapiens
tgtgtataaattgtct

SEQ ID NO: 4384172 - DNA, 22 bp, Homo sapiens
tgtgtatacagccctgacgcaa

SEQ ID NO: 4384173 - DNA, 22 bp, Homo sapiens
tgtgtataggaatttgtatttt

SEQ ID NO: 4384174 - DNA, 12 bp, Homo sapiens
tgtgtatatatc

SEQ ID NO: 4384175 - DNA, 22 bp, Homo sapiens
tgtgtatatatgtgtgccctgg

SEQ ID NO: 4384176 - DNA, 23 bp, Homo sapiens
tgtgtatatatgtgtgccctgga

SEQ ID NO: 4384177 - DNA, 13 bp, Homo sapiens
tgtgtatatctct

SEQ ID NO: 4384178 - DNA, 16 bp, Homo sapiens
tgtgtatattacacca

SEQ ID NO: 4384179 - DNA, 13 bp, Homo sapiens
tgtgtatgagaga

SEQ ID NO: 4384180 - DNA, 12 bp, Homo sapiens
tgtgtatgtggg

SEQ ID NO: 4384181 - DNA, 13 bp, Homo sapiens
tgtgtatgtgggg

SEQ ID NO: 4384182 - DNA, 14 bp, Homo sapiens
tgtgtatgtggggg

SEQ ID NO: 4384183 - DNA, 23 bp, Homo sapiens
tgtgtatgtgggggtctgtgtgt

SEQ ID NO: 4384184 - DNA, 15 bp, Homo sapiens
tgtgtattagatatc

SEQ ID NO: 4384185 - DNA, 14 bp, Homo sapiens
tgtgtattcttaaa

SEQ ID NO: 4384186 - DNA, 20 bp, Homo sapiens
tgtgtattgagtcttaactg

SEQ ID NO: 4384187 - DNA, 20 bp, Homo sapiens
tgtgtatttaattgtaaact

SEQ ID NO: 4384188 - DNA, 22 bp, Homo sapiens
tgtgtatttaattgtaaactgt

SEQ ID NO: 4384189 - DNA, 23 bp, Homo sapiens
tgtgtatttaattgtaaactgta

SEQ ID NO: 4384190 - DNA, 21 bp, Homo sapiens
tgtgtatttatttaaaactct

SEQ ID NO: 4384191 - DNA, 23 bp, Homo sapiens
tgtgtatttatttaaaactctgg

SEQ ID NO: 4384192 - DNA, 15 bp, Homo sapiens
tgtgtatttgctaat

SEQ ID NO: 4384193 - DNA, 17 bp, Homo sapiens
tgtgtcaagacatttct

SEQ ID NO: 4384194 - DNA, 20 bp, Homo sapiens
tgtgtcagagcccagcccag

SEQ ID NO: 4384195 - DNA, 20 bp, Homo sapiens
tgtgtcatcaatagtgtcct

SEQ ID NO: 4384196 - DNA, 19 bp, Homo sapiens
tgtgtccacgactgtctcc

SEQ ID NO: 4384197 - DNA, 12 bp, Homo sapiens
tgtgtcccctca

SEQ ID NO: 4384198 - DNA, 18 bp, Homo sapiens
tgtgtcccctcactctgt

SEQ ID NO: 4384199 - DNA, 18 bp, Homo sapiens
tgtgtccttgcacctgca

SEQ ID NO: 4384200 - DNA, 15 bp, Homo sapiens
tgtgtctcaggctca

SEQ ID NO: 4384201 - DNA, 16 bp, Homo sapiens
tgtgtctcctctcaga

SEQ ID NO: 4384202 - DNA, 18 bp, Homo sapiens
tgtgtctttataaagctg

SEQ ID NO: 4384203 - DNA, 12 bp, Homo sapiens
tgtgtctttcta

SEQ ID NO: 4384204 - DNA, 17 bp, Homo sapiens
tgtgtgaaactttcatt

SEQ ID NO: 4384205 - DNA, 20 bp, Homo sapiens
tgtgtgaaccactgtgtact

SEQ ID NO: 4384206 - DNA, 16 bp, Homo sapiens
tgtgtgaatgaacact

SEQ ID NO: 4384207 - DNA, 16 bp, Homo sapiens
tgtgtgagactactaa

SEQ ID NO: 4384208 - DNA, 23 bp, Homo sapiens
tgtgtgcacatctacatgccatg

SEQ ID NO: 4384209 - DNA, 15 bp, Homo sapiens
tgtgtgcatggaagt

SEQ ID NO: 4384210 - DNA, 20 bp, Homo sapiens
tgtgtgcctggccgcagggc

SEQ ID NO: 4384211 - DNA, 21 bp, Homo sapiens
tgtgtgcgtgtttgggttttt

SEQ ID NO: 4384212 - DNA, 12 bp, Homo sapiens
tgtgtgctgttt

SEQ ID NO: 4384213 - DNA, 17 bp, Homo sapiens
tgtgtggaagaaggaaa

SEQ ID NO: 4384214 - DNA, 12 bp, Homo sapiens
tgtgtggcaggg

SEQ ID NO: 4384215 - DNA, 15 bp, Homo sapiens
tgtgtggcagggggc

SEQ ID NO: 4384216 - DNA, 12 bp, Homo sapiens
tgtgtggcccag

SEQ ID NO: 4384217 - DNA, 13 bp, Homo sapiens
tgtgtggcccagc

SEQ ID NO: 4384218 - DNA, 14 bp, Homo sapiens
tgtgtggcccagca

SEQ ID NO: 4384219 - DNA, 22 bp, Homo sapiens
tgtgtggcccagcacgagcctg

SEQ ID NO: 4384220 - DNA, 16 bp, Homo sapiens
tgtgtgggactgtaca

SEQ ID NO: 4384221 - DNA, 18 bp, Homo sapiens
tgtgtgggactgtacaca

SEQ ID NO: 4384222 - DNA, 12 bp, Homo sapiens
tgtgtgtatgtg

SEQ ID NO: 4384223 - DNA, 22 bp, Homo sapiens
tgtgtgtctaggcaggacctgt

SEQ ID NO: 4384224 - DNA, 16 bp, Homo sapiens
tgtgtgtgaatgaaca

SEQ ID NO: 4384225 - DNA, 20 bp, Homo sapiens
tgtgtgtgaatgaacactct

SEQ ID NO: 4384226 - DNA, 12 bp, Homo sapiens
tgtgtgtgggag

SEQ ID NO: 4384227 - DNA, 12 bp, Homo sapiens
tgtgtgtttcaa

SEQ ID NO: 4384228 - DNA, 18 bp, Homo sapiens
tgtgtgtttgtgtgtttc

SEQ ID NO: 4384229 - DNA, 19 bp, Homo sapiens
tgtgttataaaataatgta

SEQ ID NO: 4384230 - DNA, 20 bp, Homo sapiens
tgtgttatttccccagccac

SEQ ID NO: 4384231 - DNA, 17 bp, Homo sapiens
tgtgttcccatttcagc

SEQ ID NO: 4384232 - DNA, 21 bp, Homo sapiens
tgtgttccctttgtctttcaa

SEQ ID NO: 4384233 - DNA, 22 bp, Homo sapiens
tgtgttcctttttgcagcaatt

SEQ ID NO: 4384234 - DNA, 13 bp, Homo sapiens
tgtgttcttcgta

SEQ ID NO: 4384235 - DNA, 13 bp, Homo sapiens
tgtgttgaaaacc

SEQ ID NO: 4384236 - DNA, 13 bp, Homo sapiens
tgtgttgtgcttt

SEQ ID NO: 4384237 - DNA, 14 bp, Homo sapiens
tgtgttgtgtgtgg

SEQ ID NO: 4384238 - DNA, 12 bp, Homo sapiens
tgtgtttatatg

SEQ ID NO: 4384239 - DNA, 13 bp, Homo sapiens
tgtgtttatgaaa

SEQ ID NO: 4384240 - DNA, 15 bp, Homo sapiens
tgtgtttcaaatgga

SEQ ID NO: 4384241 - DNA, 17 bp, Homo sapiens
tgtgtttcaaggtcaga

SEQ ID NO: 4384242 - DNA, 10 bp, Homo sapiens
tgtgtttgcc

SEQ ID NO: 4384243 - DNA, 19 bp, Homo sapiens
tgtgttttcagactgcctg

SEQ ID NO: 4384244 - DNA, 16 bp, Homo sapiens
tgtgttttctgtagac

SEQ ID NO: 4384245 - DNA, 16 bp, Homo sapiens
tgtgtttttgggaaga

SEQ ID NO: 4384246 - DNA, 20 bp, Homo sapiens
tgtgtttttgggaagaagaa

SEQ ID NO: 4384247 - DNA, 19 bp, Homo sapiens
tgttaaaaaaataagaaga

SEQ ID NO: 4384248 - DNA, 23 bp, Homo sapiens
tgttaaaaaaataagaagaatgc

SEQ ID NO: 4384249 - DNA, 14 bp, Homo sapiens
tgttaaaagaaaat

SEQ ID NO: 4384250 - DNA, 13 bp, Homo sapiens
tgttaaaataaat

SEQ ID NO: 4384251 - DNA, 12 bp, Homo sapiens
tgttaaagactt

SEQ ID NO: 4384252 - DNA, 18 bp, Homo sapiens
tgttaaatacaggaaaca

SEQ ID NO: 4384253 - DNA, 14 bp, Homo sapiens
tgttaacagtattt

SEQ ID NO: 4384254 - DNA, 14 bp, Homo sapiens
tgttaactgttctt

SEQ ID NO: 4384255 - DNA, 20 bp, Homo sapiens
tgttaaggacttctgcagct

SEQ ID NO: 4384256 - DNA, 22 bp, Homo sapiens
tgttaagtcctccctgactttt

SEQ ID NO: 4384257 - DNA, 18 bp, Homo sapiens
tgttaataaaagtacatg

SEQ ID NO: 4384258 - DNA, 15 bp, Homo sapiens
tgttaatacatcaca

SEQ ID NO: 4384259 - DNA, 20 bp, Homo sapiens
tgttaatacatcacatctta

SEQ ID NO: 4384260 - DNA, 13 bp, Homo sapiens
tgttaatagtact

SEQ ID NO: 4384261 - DNA, 20 bp, Homo sapiens
tgttaatataccccaaattg

SEQ ID NO: 4384262 - DNA, 13 bp, Homo sapiens
tgttaatatcact

SEQ ID NO: 4384263 - DNA, 17 bp, Homo sapiens
tgttaatatcactcatt

SEQ ID NO: 4384264 - DNA, 19 bp, Homo sapiens
tgttaatatcactcattaa

SEQ ID NO: 4384265 - DNA, 22 bp, Homo sapiens
tgttaatatcactcattaatta

SEQ ID NO: 4384266 - DNA, 16 bp, Homo sapiens
tgttaatatttgaatt

SEQ ID NO: 4384267 - DNA, 20 bp, Homo sapiens
tgttaatgcattgttgtaaa

SEQ ID NO: 4384268 - DNA, 23 bp, Homo sapiens
tgttaatgcattgttgtaaagta

SEQ ID NO: 4384269 - DNA, 14 bp, Homo sapiens
tgttaattaaatat

SEQ ID NO: 4384270 - DNA, 18 bp, Homo sapiens
tgttaattaaatatttct

SEQ ID NO: 4384271 - DNA, 15 bp, Homo sapiens
tgttaatttagaaaa

SEQ ID NO: 4384272 - DNA, 17 bp, Homo sapiens
tgttaatttagaaaact

SEQ ID NO: 4384273 - DNA, 18 bp, Homo sapiens
tgttaatttagaaaactt

SEQ ID NO: 4384274 - DNA, 19 bp, Homo sapiens
tgttaatttataatgtatt

SEQ ID NO: 4384275 - DNA, 13 bp, Homo sapiens
tgttaatttcagt

SEQ ID NO: 4384276 - DNA, 20 bp, Homo sapiens
tgttaatttgtgtgttttta

SEQ ID NO: 4384277 - DNA, 21 bp, Homo sapiens
tgttaattttaccttgtttga

SEQ ID NO: 4384278 - DNA, 15 bp, Homo sapiens
tgttacaagaggcca

SEQ ID NO: 4384279 - DNA, 20 bp, Homo sapiens
tgttacacagcccaagagga

SEQ ID NO: 4384280 - DNA, 20 bp, Homo sapiens
tgttacataaggatgacttt

SEQ ID NO: 4384281 - DNA, 12 bp, Homo sapiens
tgttacattatt

SEQ ID NO: 4384282 - DNA, 15 bp, Homo sapiens
tgttacattattcca

SEQ ID NO: 4384283 - DNA, 23 bp, Homo sapiens
tgttacctgaaaacactgtgcac

SEQ ID NO: 4384284 - DNA, 21 bp, Homo sapiens
tgttacgtttgaagtctgaca

SEQ ID NO: 4384285 - DNA, 18 bp, Homo sapiens
tgttactgctgattcttg

SEQ ID NO: 4384286 - DNA, 21 bp, Homo sapiens
tgttactgctgattcttgtaa

SEQ ID NO: 4384287 - DNA, 20 bp, Homo sapiens
tgttactggataaattgttt

SEQ ID NO: 4384288 - DNA, 12 bp, Homo sapiens
tgttactgtaat

SEQ ID NO: 4384289 - DNA, 17 bp, Homo sapiens
tgttactgtcattccca

SEQ ID NO: 4384290 - DNA, 17 bp, Homo sapiens
tgttactttacttttgc

SEQ ID NO: 4384291 - DNA, 23 bp, Homo sapiens
tgttactttggcaatttcctggc

SEQ ID NO: 4384292 - DNA, 15 bp, Homo sapiens
tgttagaacactatt

SEQ ID NO: 4384293 - DNA, 18 bp, Homo sapiens
tgttagaacactattttc

SEQ ID NO: 4384294 - DNA, 23 bp, Homo sapiens
tgttagaacactattttcagaat

SEQ ID NO: 4384295 - DNA, 18 bp, Homo sapiens
tgttagacttgctccctc

SEQ ID NO: 4384296 - DNA, 19 bp, Homo sapiens
tgttagacttgctccctct

SEQ ID NO: 4384297 - DNA, 14 bp, Homo sapiens
tgttagacttgtgt

SEQ ID NO: 4384298 - DNA, 16 bp, Homo sapiens
tgttagagagaaagag

SEQ ID NO: 4384299 - DNA, 22 bp, Homo sapiens
tgttaggacagcaaagcagcag

SEQ ID NO: 4384300 - DNA, 18 bp, Homo sapiens
tgttaggcatgtcccacc

SEQ ID NO: 4384301 - DNA, 18 bp, Homo sapiens
tgttaggggccaataaaa

SEQ ID NO: 4384302 - DNA, 23 bp, Homo sapiens
tgttaggggccaataaaatgtat

SEQ ID NO: 4384303 - DNA, 16 bp, Homo sapiens
tgttagtgctggtcag

SEQ ID NO: 4384304 - DNA, 17 bp, Homo sapiens
tgttagtgctggtcaga

SEQ ID NO: 4384305 - DNA, 21 bp, Homo sapiens
tgttagtgctggtcagagaga

SEQ ID NO: 4384306 - DNA, 20 bp, Homo sapiens
tgttagttaccttatagtta

SEQ ID NO: 4384307 - DNA, 14 bp, Homo sapiens
tgttagttataaaa

SEQ ID NO: 4384308 - DNA, 14 bp, Homo sapiens
tgttataaataaaa

SEQ ID NO: 4384309 - DNA, 15 bp, Homo sapiens
tgttataaataaaat

SEQ ID NO: 4384310 - DNA, 23 bp, Homo sapiens
tgttataactctgcactactcct

SEQ ID NO: 4384311 - DNA, 17 bp, Homo sapiens
tgttatacaaccttcat

SEQ ID NO: 4384312 - DNA, 20 bp, Homo sapiens
tgttatacaaccttcattta

SEQ ID NO: 4384313 - DNA, 20 bp, Homo sapiens
tgttatagattgtcttaatg

SEQ ID NO: 4384314 - DNA, 18 bp, Homo sapiens
tgttatatataataaata

SEQ ID NO: 4384315 - DNA, 19 bp, Homo sapiens
tgttatatataataaatac

SEQ ID NO: 4384316 - DNA, 15 bp, Homo sapiens
tgttatatcagcaga

SEQ ID NO: 4384317 - DNA, 17 bp, Homo sapiens
tgttatattgcttcctg

SEQ ID NO: 4384318 - DNA, 16 bp, Homo sapiens
tgttatctcaggtgag

SEQ ID NO: 4384319 - DNA, 19 bp, Homo sapiens
tgttatcttatactgtaca

SEQ ID NO: 4384320 - DNA, 13 bp, Homo sapiens
tgttatgaacatc

SEQ ID NO: 4384321 - DNA, 16 bp, Homo sapiens
tgttatgactatgtaa

SEQ ID NO: 4384322 - DNA, 14 bp, Homo sapiens
tgttatgccagctc

SEQ ID NO: 4384323 - DNA, 13 bp, Homo sapiens
tgttatgtatttc

SEQ ID NO: 4384324 - DNA, 14 bp, Homo sapiens
tgttatgtatttcc

SEQ ID NO: 4384325 - DNA, 21 bp, Homo sapiens
tgttattagagattacctcct

SEQ ID NO: 4384326 - DNA, 14 bp, Homo sapiens
tgttattataacat

SEQ ID NO: 4384327 - DNA, 15 bp, Homo sapiens
tgttattataacata

SEQ ID NO: 4384328 - DNA, 16 bp, Homo sapiens
tgttatttattattaa

SEQ ID NO: 4384329 - DNA, 15 bp, Homo sapiens
tgttatttattgaaa

SEQ ID NO: 4384330 - DNA, 17 bp, Homo sapiens
tgttatttattgaaatg

SEQ ID NO: 4384331 - DNA, 17 bp, Homo sapiens
tgttatttgtaatagat

SEQ ID NO: 4384332 - DNA, 18 bp, Homo sapiens
tgttgtcctgttaattta

SEQ ID NO: 4384333 - DNA, 14 bp, Homo sapiens
tgttgtggaagcat

SEQ ID NO: 4384334 - DNA, 15 bp, Homo sapiens
tgttgtgtgtgggag

SEQ ID NO: 4384335 - DNA, 23 bp, Homo sapiens
tgttgttcaaatgcattttgggg

SEQ ID NO: 4384336 - DNA, 19 bp, Homo sapiens
tgttgttgaaaggtttttt

SEQ ID NO: 4384337 - DNA, 18 bp, Homo sapiens
tgttgttgaactaatata

SEQ ID NO: 4384338 - DNA, 23 bp, Homo sapiens
tgttgttgaactaatatatgaaa

SEQ ID NO: 4384339 - DNA, 17 bp, Homo sapiens
tgttgttgtgtgtatat

SEQ ID NO: 4384340 - DNA, 23 bp, Homo sapiens
tgttgtttcaaaatgaacagcga

SEQ ID NO: 4384341 - DNA, 21 bp, Homo sapiens
tgttgtttcttaaataagaaa

SEQ ID NO: 4384342 - DNA, 12 bp, Homo sapiens
tgtttaaaactt

SEQ ID NO: 4384343 - DNA, 18 bp, Homo sapiens
tgtttaaaacttcagttt

SEQ ID NO: 4384344 - DNA, 14 bp, Homo sapiens
tgtttaaaataaaa

SEQ ID NO: 4384345 - DNA, 21 bp, Homo sapiens
tgtttaaaataaaatgaaaat

SEQ ID NO: 4384346 - DNA, 14 bp, Homo sapiens
tgtttaaaatcatt

SEQ ID NO: 4384347 - DNA, 19 bp, Homo sapiens
tgtttaaacaatctttcat

SEQ ID NO: 4384348 - DNA, 22 bp, Homo sapiens
tgtttaaacaatctttcatgtc

SEQ ID NO: 4384349 - DNA, 23 bp, Homo sapiens
tgtttaaacacttatcttctgga

SEQ ID NO: 4384350 - DNA, 15 bp, Homo sapiens
tgtttaaatgccaaa

SEQ ID NO: 4384351 - DNA, 16 bp, Homo sapiens
tgtttaatattgagaa

SEQ ID NO: 4384352 - DNA, 20 bp, Homo sapiens
tgtttaatattgagaaagaa

SEQ ID NO: 4384353 - DNA, 22 bp, Homo sapiens
tgtttaatctacattataataa

SEQ ID NO: 4384354 - DNA, 21 bp, Homo sapiens
tgtttaatttttatttcttcc

SEQ ID NO: 4384355 - DNA, 12 bp, Homo sapiens
tgtttacaataa

SEQ ID NO: 4384356 - DNA, 16 bp, Homo sapiens
tgtttacaataaagaa

SEQ ID NO: 4384357 - DNA, 20 bp, Homo sapiens
tgtttacagcactactctgt

SEQ ID NO: 4384358 - DNA, 12 bp, Homo sapiens
tgtttacatgag

SEQ ID NO: 4384359 - DNA, 15 bp, Homo sapiens
tgtttactatataga

SEQ ID NO: 4384360 - DNA, 22 bp, Homo sapiens
tgtttactatatagaatttcct

SEQ ID NO: 4384361 - DNA, 16 bp, Homo sapiens
tgtttactctcttcat

SEQ ID NO: 4384362 - DNA, 12 bp, Homo sapiens
tgtttactgaaa

SEQ ID NO: 4384363 - DNA, 19 bp, Homo sapiens
tgtttacttgaatagtatt

SEQ ID NO: 4384364 - DNA, 12 bp, Homo sapiens
tgtttagaaaaa

SEQ ID NO: 4384365 - DNA, 22 bp, Homo sapiens
tgtttagaaaaaaaactgaaga

SEQ ID NO: 4384366 - DNA, 20 bp, Homo sapiens
tgtttagctacctttttata

SEQ ID NO: 4384367 - DNA, 15 bp, Homo sapiens
tgtttatacttgaga

SEQ ID NO: 4384368 - DNA, 19 bp, Homo sapiens
tgtttatagctcatttgta

SEQ ID NO: 4384369 - DNA, 16 bp, Homo sapiens
tgtttatatattgaaa

SEQ ID NO: 4384370 - DNA, 14 bp, Homo sapiens
tgtttatatgtgtt

SEQ ID NO: 4384371 - DNA, 15 bp, Homo sapiens
tgtttatatgtgttg

SEQ ID NO: 4384372 - DNA, 22 bp, Homo sapiens
tgtttatgatatttcttgcttt

SEQ ID NO: 4384373 - DNA, 15 bp, Homo sapiens
tgtttatggcctcag

SEQ ID NO: 4384374 - DNA, 19 bp, Homo sapiens
tgtttatgtgttatgaaca

SEQ ID NO: 4384375 - DNA, 21 bp, Homo sapiens
tgtttatgtgttatgaacatc

SEQ ID NO: 4384376 - DNA, 14 bp, Homo sapiens
tgtttattgagttt

SEQ ID NO: 4384377 - DNA, 15 bp, Homo sapiens
tgtttatttcatgtg

SEQ ID NO: 4384378 - DNA, 23 bp, Homo sapiens
tgtttatttttcttgtctttatt

SEQ ID NO: 4384379 - DNA, 23 bp, Homo sapiens
tgtttatttttgtacatttgagc

SEQ ID NO: 4384380 - DNA, 22 bp, Homo sapiens
tgtttcaaaatagacaagtttt

SEQ ID NO: 4384381 - DNA, 19 bp, Homo sapiens
tgtttcagaaaacataata

SEQ ID NO: 4384382 - DNA, 17 bp, Homo sapiens
tgtttcagtgtgagtca

SEQ ID NO: 4384383 - DNA, 20 bp, Homo sapiens
tgtttcatattgatgtgtgt

SEQ ID NO: 4384384 - DNA, 21 bp, Homo sapiens
tgtttcctaatatcaaatgca

SEQ ID NO: 4384385 - DNA, 16 bp, Homo sapiens
tgtttcctagctgtgt

SEQ ID NO: 4384386 - DNA, 20 bp, Homo sapiens
tgtttcctatttaatacagc

SEQ ID NO: 4384387 - DNA, 13 bp, Homo sapiens
tgtttcctctaaa

SEQ ID NO: 4384388 - DNA, 16 bp, Homo sapiens
tgtttcctttttcaga

SEQ ID NO: 4384389 - DNA, 18 bp, Homo sapiens
tgtttcctttttcagata

SEQ ID NO: 4384390 - DNA, 13 bp, Homo sapiens
tgtttcctttttt

SEQ ID NO: 4384391 - DNA, 16 bp, Homo sapiens
tgtttccttttttccc

SEQ ID NO: 4384392 - DNA, 21 bp, Homo sapiens
tgtttctacacattgctacct

SEQ ID NO: 4384393 - DNA, 16 bp, Homo sapiens
tgtttctattttttga

SEQ ID NO: 4384394 - DNA, 22 bp, Homo sapiens
tgtttctattttttgaaaagca

SEQ ID NO: 4384395 - DNA, 17 bp, Homo sapiens
tgtttctgatttctgaa

SEQ ID NO: 4384396 - DNA, 23 bp, Homo sapiens
tgtttctggaagactgctcccgg

SEQ ID NO: 4384397 - DNA, 22 bp, Homo sapiens
tgtttctgtcctgtaactgtta

SEQ ID NO: 4384398 - DNA, 13 bp, Homo sapiens
tgtttctgttcca

SEQ ID NO: 4384399 - DNA, 15 bp, Homo sapiens
tgtttcttcatttct

SEQ ID NO: 4384400 - DNA, 17 bp, Homo sapiens
tgtttcttcatttctct

SEQ ID NO: 4384401 - DNA, 19 bp, Homo sapiens
tgtttcttcatttctctgc

SEQ ID NO: 4384402 - DNA, 14 bp, Homo sapiens
tgtttcttctccaa

SEQ ID NO: 4384403 - DNA, 12 bp, Homo sapiens
tgtttctttgtg

SEQ ID NO: 4384404 - DNA, 14 bp, Homo sapiens
tgtttctttgtgtt

SEQ ID NO: 4384405 - DNA, 23 bp, Homo sapiens
tgtttcttttttttttttttaca

SEQ ID NO: 4384406 - DNA, 18 bp, Homo sapiens
tgtttgaaatatcatgtt

SEQ ID NO: 4384407 - DNA, 21 bp, Homo sapiens
tgtttgaaatgaggtctgttt

SEQ ID NO: 4384408 - DNA, 21 bp, Homo sapiens
tgtttgacaaagaaacccaag

SEQ ID NO: 4384409 - DNA, 15 bp, Homo sapiens
tgtttgactgtaatg

SEQ ID NO: 4384410 - DNA, 18 bp, Homo sapiens
tgtttgagattctcaaag

SEQ ID NO: 4384411 - DNA, 11 bp, Homo sapiens
tgtttgagcac

SEQ ID NO: 4384412 - DNA, 22 bp, Homo sapiens
tgtttgagcatcgcttaggaga

SEQ ID NO: 4384413 - DNA, 19 bp, Homo sapiens
tgtttgagttatcagggaa

SEQ ID NO: 4384414 - DNA, 22 bp, Homo sapiens
tgtttgagtttttcctcccagt

SEQ ID NO: 4384415 - DNA, 23 bp, Homo sapiens
tgtttgagtttttcctcccagtg

SEQ ID NO: 4384416 - DNA, 21 bp, Homo sapiens
tgtttgatataccaaattaaa

SEQ ID NO: 4384417 - DNA, 13 bp, Homo sapiens
tgtttgatgtttt

SEQ ID NO: 4384418 - DNA, 14 bp, Homo sapiens
tgtttgatgttttt

SEQ ID NO: 4384419 - DNA, 22 bp, Homo sapiens
tgtttgcgcttgaccatgttgc

SEQ ID NO: 4384420 - DNA, 15 bp, Homo sapiens
tgtttgctgttgggt

SEQ ID NO: 4384421 - DNA, 15 bp, Homo sapiens
tgtttgcttaaaata

SEQ ID NO: 4384422 - DNA, 12 bp, Homo sapiens
tgtttgcttctt

SEQ ID NO: 4384423 - DNA, 17 bp, Homo sapiens
tgtttgcttcttgccat

SEQ ID NO: 4384424 - DNA, 17 bp, Homo sapiens
tgtttggaaaagacagt

SEQ ID NO: 4384425 - DNA, 12 bp, Homo sapiens
tgtttggaaata

SEQ ID NO: 4384426 - DNA, 18 bp, Homo sapiens
tgtttggaatattgtcca

SEQ ID NO: 4384427 - DNA, 15 bp, Homo sapiens
tgtttggacagctga

SEQ ID NO: 4384428 - DNA, 15 bp, Homo sapiens
tgtttggattgatat

SEQ ID NO: 4384429 - DNA, 19 bp, Homo sapiens
tgtttgggatgtctgagat

SEQ ID NO: 4384430 - DNA, 13 bp, Homo sapiens
tgtttggtataaa

SEQ ID NO: 4384431 - DNA, 20 bp, Homo sapiens
tgtttggtgtttgtctgtgt

SEQ ID NO: 4384432 - DNA, 14 bp, Homo sapiens
tgtttgtaaatgcc

SEQ ID NO: 4384433 - DNA, 16 bp, Homo sapiens
tgtttgtaaatgcctc

SEQ ID NO: 4384434 - DNA, 16 bp, Homo sapiens
tgtttgtagtgaaata

SEQ ID NO: 4384435 - DNA, 13 bp, Homo sapiens
tgtttgtgctgtg

SEQ ID NO: 4384436 - DNA, 12 bp, Homo sapiens
tgtttgtggcct

SEQ ID NO: 4384437 - DNA, 14 bp, Homo sapiens
tgtttgtgtattta

SEQ ID NO: 4384438 - DNA, 14 bp, Homo sapiens
tgtttgttactgca

SEQ ID NO: 4384439 - DNA, 16 bp, Homo sapiens
tgtttgttgacagctt

SEQ ID NO: 4384440 - DNA, 13 bp, Homo sapiens
tgtttgtttaatt

SEQ ID NO: 4384441 - DNA, 14 bp, Homo sapiens
tgtttgtttaattt

SEQ ID NO: 4384442 - DNA, 17 bp, Homo sapiens
tgttttaaaatctataa

SEQ ID NO: 4384443 - DNA, 13 bp, Homo sapiens
tgttttaattgta

SEQ ID NO: 4384444 - DNA, 16 bp, Homo sapiens
tgttttactgtcagat

SEQ ID NO: 4384445 - DNA, 20 bp, Homo sapiens
tgttttactgtcagattaaa

SEQ ID NO: 4384446 - DNA, 14 bp, Homo sapiens
tgttttagttcttg

SEQ ID NO: 4384447 - DNA, 12 bp, Homo sapiens
tgttttatatat

SEQ ID NO: 4384448 - DNA, 14 bp, Homo sapiens
tgttttatgacatt

SEQ ID NO: 4384449 - DNA, 22 bp, Homo sapiens
tgttttattggggaattaaata

SEQ ID NO: 4384450 - DNA, 21 bp, Homo sapiens
ttaaacccatacaatgtatgt

SEQ ID NO: 4384451 - DNA, 16 bp, Homo sapiens
ttaaaccgctaaaaga

SEQ ID NO: 4384452 - DNA, 19 bp, Homo sapiens
ttaaaccgctaaaagaaac

SEQ ID NO: 4384453 - DNA, 14 bp, Homo sapiens
ttaaaccttttttg

SEQ ID NO: 4384454 - DNA, 17 bp, Homo sapiens
ttaaacgtagcatgtgg

SEQ ID NO: 4384455 - DNA, 19 bp, Homo sapiens
ttaaacgtagcatgtggca

SEQ ID NO: 4384456 - DNA, 20 bp, Homo sapiens
ttaaacgtagcatgtggcat

SEQ ID NO: 4384457 - DNA, 17 bp, Homo sapiens
ttaaactacagaatatt

SEQ ID NO: 4384458 - DNA, 23 bp, Homo sapiens
ttaaactactatttttctttcca

SEQ ID NO: 4384459 - DNA, 17 bp, Homo sapiens
ttaaactattttgagca

SEQ ID NO: 4384460 - DNA, 20 bp, Homo sapiens
ttaaactgattagtattcag

SEQ ID NO: 4384461 - DNA, 12 bp, Homo sapiens
ttaaacttcagc

SEQ ID NO: 4384462 - DNA, 13 bp, Homo sapiens
ttaaacttcagca

SEQ ID NO: 4384463 - DNA, 15 bp, Homo sapiens
ttaaacttcagcaac

SEQ ID NO: 4384464 - DNA, 12 bp, Homo sapiens
ttaaacttgaaa

SEQ ID NO: 4384465 - DNA, 15 bp, Homo sapiens
ttaaacttgaaatat

SEQ ID NO: 4384466 - DNA, 13 bp, Homo sapiens
ttaaactttcaat

SEQ ID NO: 4384467 - DNA, 18 bp, Homo sapiens
ttaaactttcaatatttt

SEQ ID NO: 4384468 - DNA, 14 bp, Homo sapiens
ttaaactttgtcac

SEQ ID NO: 4384469 - DNA, 14 bp, Homo sapiens
ttaaagaaaggaaa

SEQ ID NO: 4384470 - DNA, 12 bp, Homo sapiens
ttaaagaaagtg

SEQ ID NO: 4384471 - DNA, 14 bp, Homo sapiens
ttaaagaaatttta

SEQ ID NO: 4384472 - DNA, 20 bp, Homo sapiens
ttaaagaatatgacttttta

SEQ ID NO: 4384473 - DNA, 15 bp, Homo sapiens
ttaaagactacaata

SEQ ID NO: 4384474 - DNA, 16 bp, Homo sapiens
ttaaagagatagcttc

SEQ ID NO: 4384475 - DNA, 18 bp, Homo sapiens
ttaaagagatagcttctc

SEQ ID NO: 4384476 - DNA, 18 bp, Homo sapiens
ttaaagataagtctacat

SEQ ID NO: 4384477 - DNA, 17 bp, Homo sapiens
ttaaagatgctatggaa

SEQ ID NO: 4384478 - DNA, 23 bp, Homo sapiens
ttaaagatgctatggaacataaa

SEQ ID NO: 4384479 - DNA, 20 bp, Homo sapiens
ttaaagcatcaccactcatt

SEQ ID NO: 4384480 - DNA, 22 bp, Homo sapiens
ttaaagcctgttccataggaag

SEQ ID NO: 4384481 - DNA, 21 bp, Homo sapiens
ttaaagccttaagcacaatta

SEQ ID NO: 4384482 - DNA, 20 bp, Homo sapiens
ttaaagcttgatttgatctt

SEQ ID NO: 4384483 - DNA, 16 bp, Homo sapiens
ttaaaggccgtcattt

SEQ ID NO: 4384484 - DNA, 17 bp, Homo sapiens
ttaaagggcccaatgaa

SEQ ID NO: 4384485 - DNA, 17 bp, Homo sapiens
ttaaaggtttttgaaat

SEQ ID NO: 4384486 - DNA, 20 bp, Homo sapiens
ttaaaggtttttgaaatcca

SEQ ID NO: 4384487 - DNA, 19 bp, Homo sapiens
ttaaagtaaacttgtgtat

SEQ ID NO: 4384488 - DNA, 13 bp, Homo sapiens
ttaaagtatttct

SEQ ID NO: 4384489 - DNA, 20 bp, Homo sapiens
ttaaagtcacacatttctat

SEQ ID NO: 4384490 - DNA, 17 bp, Homo sapiens
ttaaagtggcaatctca

SEQ ID NO: 4384491 - DNA, 19 bp, Homo sapiens
ttaaagttctgtgtattta

SEQ ID NO: 4384492 - DNA, 15 bp, Homo sapiens
ttaaagttcttattt

SEQ ID NO: 4384493 - DNA, 17 bp, Homo sapiens
ttaaagttgtttcccac

SEQ ID NO: 4384494 - DNA, 16 bp, Homo sapiens
ttaaataaaagcacaa

SEQ ID NO: 4384495 - DNA, 19 bp, Homo sapiens
ttaaataaaagcacaagta

SEQ ID NO: 4384496 - DNA, 14 bp, Homo sapiens
ttaaataaattatg

SEQ ID NO: 4384497 - DNA, 13 bp, Homo sapiens
ttaaataaatttg

SEQ ID NO: 4384498 - DNA, 16 bp, Homo sapiens
ttaaataaatttgact

SEQ ID NO: 4384499 - DNA, 15 bp, Homo sapiens
ttaaataagaaactt

SEQ ID NO: 4384500 - DNA, 17 bp, Homo sapiens
ttaaataagaaactttt

SEQ ID NO: 4384501 - DNA, 13 bp, Homo sapiens
ttaaataatttaa

SEQ ID NO: 4384502 - DNA, 14 bp, Homo sapiens
ttaaatacaggaaa

SEQ ID NO: 4384503 - DNA, 17 bp, Homo sapiens
ttaaatacaggaaacag

SEQ ID NO: 4384504 - DNA, 13 bp, Homo sapiens
ttaaatacagtct

SEQ ID NO: 4384505 - DNA, 23 bp, Homo sapiens
ttaaatagataaccaattttcag

SEQ ID NO: 4384506 - DNA, 20 bp, Homo sapiens
ttaaatatccatttatcttt

SEQ ID NO: 4384507 - DNA, 22 bp, Homo sapiens
ttaaatatctgaacatttacta

SEQ ID NO: 4384508 - DNA, 17 bp, Homo sapiens
ttaaatatttattttct

SEQ ID NO: 4384509 - DNA, 16 bp, Homo sapiens
ttaaatatttcttaag

SEQ ID NO: 4384510 - DNA, 13 bp, Homo sapiens
ttaaatcatttta

SEQ ID NO: 4384511 - DNA, 22 bp, Homo sapiens
ttaaatcccaaatcctatttaa

SEQ ID NO: 4384512 - DNA, 22 bp, Homo sapiens
ttaaatgccaaaatgtacttaa

SEQ ID NO: 4384513 - DNA, 23 bp, Homo sapiens
ttaaatgtaatataatgtatttt

SEQ ID NO: 4384514 - DNA, 19 bp, Homo sapiens
ttaaatgtagcttcagtca

SEQ ID NO: 4384515 - DNA, 22 bp, Homo sapiens
ttaaatgtagcttcagtcatta

SEQ ID NO: 4384516 - DNA, 18 bp, Homo sapiens
ttaaatgtgtacaatgta

SEQ ID NO: 4384517 - DNA, 21 bp, Homo sapiens
ttaaatgtgtatttcttaaga

SEQ ID NO: 4384518 - DNA, 20 bp, Homo sapiens
ttaaatgttatgactatgta

SEQ ID NO: 4384519 - DNA, 13 bp, Homo sapiens
ttaaatgttatta

SEQ ID NO: 4384520 - DNA, 17 bp, Homo sapiens
ttaaatgtttcaaaata

SEQ ID NO: 4384521 - DNA, 21 bp, Homo sapiens
ttaaatgtttcaaaatagaca

SEQ ID NO: 4384522 - DNA, 19 bp, Homo sapiens
ttaaattaaacaatttatt

SEQ ID NO: 4384523 - DNA, 14 bp, Homo sapiens
ttaaattacagctt

SEQ ID NO: 4384524 - DNA, 16 bp, Homo sapiens
ttaaattacagctttt

SEQ ID NO: 4384525 - DNA, 17 bp, Homo sapiens
ttaaattacagctttta

SEQ ID NO: 4384526 - DNA, 22 bp, Homo sapiens
ttaaattacctttacatatata

SEQ ID NO: 4384527 - DNA, 14 bp, Homo sapiens
ttaaattagaaaat

SEQ ID NO: 4384528 - DNA, 12 bp, Homo sapiens
ttaaattataag

SEQ ID NO: 4384529 - DNA, 18 bp, Homo sapiens
ttaaattataaggactgc

SEQ ID NO: 4384530 - DNA, 19 bp, Homo sapiens
ttaaattataaggactgca

SEQ ID NO: 4384531 - DNA, 13 bp, Homo sapiens
ttaaattatatga

SEQ ID NO: 4384532 - DNA, 22 bp, Homo sapiens
ttaaattcatttctagactcaa

SEQ ID NO: 4384533 - DNA, 22 bp, Homo sapiens
ttaaattcttttttaaattttc

SEQ ID NO: 4384534 - DNA, 18 bp, Homo sapiens
ttaaatttcttatgtgac

SEQ ID NO: 4384535 - DNA, 20 bp, Homo sapiens
ttaaatttgatggttgaata

SEQ ID NO: 4384536 - DNA, 16 bp, Homo sapiens
ttaaattttgtaatga

SEQ ID NO: 4384537 - DNA, 19 bp, Homo sapiens
ttaaattttttttacattt

SEQ ID NO: 4384538 - DNA, 20 bp, Homo sapiens
ttaaattttttttacatttt

SEQ ID NO: 4384539 - DNA, 14 bp, Homo sapiens
ttaacaaaaaatgt

SEQ ID NO: 4384540 - DNA, 21 bp, Homo sapiens
ttaacaaaaaatgtaattaac

SEQ ID NO: 4384541 - DNA, 19 bp, Homo sapiens
ttaacaaaaagtgcttcat

SEQ ID NO: 4384542 - DNA, 17 bp, Homo sapiens
ttaacaaagcaaccttt

SEQ ID NO: 4384543 - DNA, 14 bp, Homo sapiens
ttaacaagaacttt

SEQ ID NO: 4384544 - DNA, 20 bp, Homo sapiens
ttaacaagatgtttcatttt

SEQ ID NO: 4384545 - DNA, 17 bp, Homo sapiens
ttaacaataataaaaag

SEQ ID NO: 4384546 - DNA, 17 bp, Homo sapiens
ttaacaatctaacaata

SEQ ID NO: 4384547 - DNA, 15 bp, Homo sapiens
ttaacaatgcctatt

SEQ ID NO: 4384548 - DNA, 19 bp, Homo sapiens
ttaacaatgcctattgtaa

SEQ ID NO: 4384549 - DNA, 13 bp, Homo sapiens
ttaacagttgtat

SEQ ID NO: 4384550 - DNA, 15 bp, Homo sapiens
ttaacagttgtattt

SEQ ID NO: 4384551 - DNA, 20 bp, Homo sapiens
ttaacatagtaagttcagca

SEQ ID NO: 4384552 - DNA, 22 bp, Homo sapiens
ttaacattcctaaaatgcttca

SEQ ID NO: 4384553 - DNA, 14 bp, Homo sapiens
ttaacatttcatgt

SEQ ID NO: 4384554 - DNA, 18 bp, Homo sapiens
ttaacatttcattgtaca

SEQ ID NO: 4384555 - DNA, 22 bp, Homo sapiens
ttaacattttacagtaaatgtt

SEQ ID NO: 4384556 - DNA, 16 bp, Homo sapiens
ttaacccacctctcct

SEQ ID NO: 4384557 - DNA, 12 bp, Homo sapiens
ttaacccctcca

SEQ ID NO: 4384558 - DNA, 21 bp, Homo sapiens
ttaaccttactaattatacta

SEQ ID NO: 4384559 - DNA, 14 bp, Homo sapiens
ttaacctttgctat

SEQ ID NO: 4384560 - DNA, 18 bp, Homo sapiens
ttaacgatgtccaacccg

SEQ ID NO: 4384561 - DNA, 18 bp, Homo sapiens
ttaactatttttttcaaa

SEQ ID NO: 4384562 - DNA, 15 bp, Homo sapiens
ttaactccactgctt

SEQ ID NO: 4384563 - DNA, 21 bp, Homo sapiens
ttaactgacaagccatcttga

SEQ ID NO: 4384564 - DNA, 20 bp, Homo sapiens
ttaactggtgcactttgtaa

SEQ ID NO: 4384565 - DNA, 21 bp, Homo sapiens
ttaactggtgcactttgtaaa

SEQ ID NO: 4384566 - DNA, 22 bp, Homo sapiens
ttaactgtccgtaagcagtata

SEQ ID NO: 4384567 - DNA, 18 bp, Homo sapiens
ttaactgtgaaatgtacg

SEQ ID NO: 4384568 - DNA, 21 bp, Homo sapiens
ttaatttagagcgtttggtta

SEQ ID NO: 4384569 - DNA, 19 bp, Homo sapiens
ttaatttagtaaatgttat

SEQ ID NO: 4384570 - DNA, 19 bp, Homo sapiens
ttaatttataatgtatttg

SEQ ID NO: 4384571 - DNA, 15 bp, Homo sapiens
ttaatttatttagtt

SEQ ID NO: 4384572 - DNA, 13 bp, Homo sapiens
ttaatttatttca

SEQ ID NO: 4384573 - DNA, 14 bp, Homo sapiens
ttaatttcaggaaa

SEQ ID NO: 4384574 - DNA, 17 bp, Homo sapiens
ttaatttcagtcctgta

SEQ ID NO: 4384575 - DNA, 12 bp, Homo sapiens
ttaatttccttt

SEQ ID NO: 4384576 - DNA, 16 bp, Homo sapiens
ttaatttcctttttga

SEQ ID NO: 4384577 - DNA, 18 bp, Homo sapiens
ttaatttcctttttgaca

SEQ ID NO: 4384578 - DNA, 21 bp, Homo sapiens
ttaatttcctttttgacactg

SEQ ID NO: 4384579 - DNA, 15 bp, Homo sapiens
ttaatttctgaagaa

SEQ ID NO: 4384580 - DNA, 15 bp, Homo sapiens
ttaatttgaaatcta

SEQ ID NO: 4384581 - DNA, 21 bp, Homo sapiens
ttaatttgggaatttgttgtg

SEQ ID NO: 4384582 - DNA, 18 bp, Homo sapiens
ttaatttggtagatgaca

SEQ ID NO: 4384583 - DNA, 21 bp, Homo sapiens
ttaattttaaagagtgtgtta

SEQ ID NO: 4384584 - DNA, 15 bp, Homo sapiens
ttaattttaactgat

SEQ ID NO: 4384585 - DNA, 17 bp, Homo sapiens
ttaattttagtttttca

SEQ ID NO: 4384586 - DNA, 21 bp, Homo sapiens
ttaattttagtttttcattaa

SEQ ID NO: 4384587 - DNA, 14 bp, Homo sapiens
ttaattttcaggtc

SEQ ID NO: 4384588 - DNA, 19 bp, Homo sapiens
ttaattttgacactgaaat

SEQ ID NO: 4384589 - DNA, 17 bp, Homo sapiens
ttaattttttggtacaa

SEQ ID NO: 4384590 - DNA, 19 bp, Homo sapiens
ttacaaaaacacttcgttc

SEQ ID NO: 4384591 - DNA, 18 bp, Homo sapiens
ttacaaaactacatgaga

SEQ ID NO: 4384592 - DNA, 16 bp, Homo sapiens
ttacaaaattttaaca

SEQ ID NO: 4384593 - DNA, 18 bp, Homo sapiens
ttacaaagcccttttata

SEQ ID NO: 4384594 - DNA, 19 bp, Homo sapiens
ttacaaatattgtcatctt

SEQ ID NO: 4384595 - DNA, 21 bp, Homo sapiens
ttacaaatgcaaatttctata

SEQ ID NO: 4384596 - DNA, 18 bp, Homo sapiens
ttacaaatggggcaaaca

SEQ ID NO: 4384597 - DNA, 17 bp, Homo sapiens
ttacaaatgtggctgta

SEQ ID NO: 4384598 - DNA, 17 bp, Homo sapiens
ttacaactttctaagag

SEQ ID NO: 4384599 - DNA, 15 bp, Homo sapiens
ttacaagatattatt

SEQ ID NO: 4384600 - DNA, 17 bp, Homo sapiens
ttacaagcttaaagctt

SEQ ID NO: 4384601 - DNA, 18 bp, Homo sapiens
ttacaagcttaaagcttg

SEQ ID NO: 4384602 - DNA, 21 bp, Homo sapiens
ttacaagcttaaagcttgatt

SEQ ID NO: 4384603 - DNA, 16 bp, Homo sapiens
ttacaagtataacagt

SEQ ID NO: 4384604 - DNA, 15 bp, Homo sapiens
ttacaatgtatcttt

SEQ ID NO: 4384605 - DNA, 16 bp, Homo sapiens
ttacaatgtatcttta

SEQ ID NO: 4384606 - DNA, 19 bp, Homo sapiens
ttacaatgtatctttatta

SEQ ID NO: 4384607 - DNA, 18 bp, Homo sapiens
ttacaatttgcacaatat

SEQ ID NO: 4384608 - DNA, 18 bp, Homo sapiens
ttacacaatggtttttaa

SEQ ID NO: 4384609 - DNA, 23 bp, Homo sapiens
ttacacagagaaatacaaaataa

SEQ ID NO: 4384610 - DNA, 20 bp, Homo sapiens
ttacacagtgagactgtaca

SEQ ID NO: 4384611 - DNA, 21 bp, Homo sapiens
ttacacagtgagactgtacat

SEQ ID NO: 4384612 - DNA, 23 bp, Homo sapiens
ttacacatttttcagatataaaa

SEQ ID NO: 4384613 - DNA, 19 bp, Homo sapiens
ttacactcctctatcatgc

SEQ ID NO: 4384614 - DNA, 16 bp, Homo sapiens
ttacagactgaaaggt

SEQ ID NO: 4384615 - DNA, 15 bp, Homo sapiens
ttacagaggacagta

SEQ ID NO: 4384616 - DNA, 16 bp, Homo sapiens
ttacagcttttatgga

SEQ ID NO: 4384617 - DNA, 19 bp, Homo sapiens
ttacagcttttatggatga

SEQ ID NO: 4384618 - DNA, 22 bp, Homo sapiens
ttacaggaatgaagaactgttg

SEQ ID NO: 4384619 - DNA, 17 bp, Homo sapiens
ttacagggtgactcaca

SEQ ID NO: 4384620 - DNA, 17 bp, Homo sapiens
ttacagtaatgtcataa

SEQ ID NO: 4384621 - DNA, 18 bp, Homo sapiens
ttacagtaatgtcataaa

SEQ ID NO: 4384622 - DNA, 22 bp, Homo sapiens
ttacagtaatgtcataaagtga

SEQ ID NO: 4384623 - DNA, 11 bp, Homo sapiens
ttacagttctg

SEQ ID NO: 4384624 - DNA, 13 bp, Homo sapiens
ttacagttctgtg

SEQ ID NO: 4384625 - DNA, 22 bp, Homo sapiens
ttacagttctgtggtttcatgt

SEQ ID NO: 4384626 - DNA, 13 bp, Homo sapiens
ttacagttgatgt

SEQ ID NO: 4384627 - DNA, 19 bp, Homo sapiens
ttacataacggaaagtttt

SEQ ID NO: 4384628 - DNA, 17 bp, Homo sapiens
ttacataagagaaagag

SEQ ID NO: 4384629 - DNA, 19 bp, Homo sapiens
ttacatacatatttttcta

SEQ ID NO: 4384630 - DNA, 16 bp, Homo sapiens
ttacatactttatcaa

SEQ ID NO: 4384631 - DNA, 18 bp, Homo sapiens
ttacatagtctgaagtga

SEQ ID NO: 4384632 - DNA, 23 bp, Homo sapiens
ttacatccgtaggacaagtttta

SEQ ID NO: 4384633 - DNA, 20 bp, Homo sapiens
ttacatgatttaaagactac

SEQ ID NO: 4384634 - DNA, 20 bp, Homo sapiens
ttacatgtaatttgatgagg

SEQ ID NO: 4384635 - DNA, 15 bp, Homo sapiens
ttacatgtatgcctg

SEQ ID NO: 4384636 - DNA, 16 bp, Homo sapiens
ttacatgtttataaat

SEQ ID NO: 4384637 - DNA, 14 bp, Homo sapiens
ttacatgttttttc

SEQ ID NO: 4384638 - DNA, 14 bp, Homo sapiens
ttacattcagaaat

SEQ ID NO: 4384639 - DNA, 14 bp, Homo sapiens
ttacattgcagaac

SEQ ID NO: 4384640 - DNA, 10 bp, Homo sapiens
ttacatttca

SEQ ID NO: 4384641 - DNA, 11 bp, Homo sapiens
ttacattttaa

SEQ ID NO: 4384642 - DNA, 16 bp, Homo sapiens
ttaccaaaaattttgt

SEQ ID NO: 4384643 - DNA, 20 bp, Homo sapiens
ttaccaaagcatcaatacaa

SEQ ID NO: 4384644 - DNA, 22 bp, Homo sapiens
ttaccaagtatgaagtataaat

SEQ ID NO: 4384645 - DNA, 12 bp, Homo sapiens
ttaccactcagg

SEQ ID NO: 4384646 - DNA, 23 bp, Homo sapiens
ttaccaggcaccaaaagaagtaa

SEQ ID NO: 4384647 - DNA, 18 bp, Homo sapiens
ttaccagtcctatttttc

SEQ ID NO: 4384648 - DNA, 14 bp, Homo sapiens
ttaccattaacatt

SEQ ID NO: 4384649 - DNA, 16 bp, Homo sapiens
ttaccattttaacgct

SEQ ID NO: 4384650 - DNA, 20 bp, Homo sapiens
ttaccattttaacgctgcct

SEQ ID NO: 4384651 - DNA, 14 bp, Homo sapiens
ttaccatttttcat

SEQ ID NO: 4384652 - DNA, 21 bp, Homo sapiens
ttacccatcagttccagcctt

SEQ ID NO: 4384653 - DNA, 20 bp, Homo sapiens
ttacccccagctttgaggaa

SEQ ID NO: 4384654 - DNA, 12 bp, Homo sapiens
ttaccctgggaa

SEQ ID NO: 4384655 - DNA, 22 bp, Homo sapiens
ttacccttttcccccttcccat

SEQ ID NO: 4384656 - DNA, 15 bp, Homo sapiens
ttacctaatttcatt

SEQ ID NO: 4384657 - DNA, 17 bp, Homo sapiens
ttacctactattggccc

SEQ ID NO: 4384658 - DNA, 22 bp, Homo sapiens
ttacctagtgcaaaaactgtaa

SEQ ID NO: 4384659 - DNA, 13 bp, Homo sapiens
ttacctagtgttt

SEQ ID NO: 4384660 - DNA, 12 bp, Homo sapiens
ttacctcctgcc

SEQ ID NO: 4384661 - DNA, 13 bp, Homo sapiens
ttacctcctgccc

SEQ ID NO: 4384662 - DNA, 15 bp, Homo sapiens
ttacctcctgcccag

SEQ ID NO: 4384663 - DNA, 19 bp, Homo sapiens
ttacctcctgcccaggaga

SEQ ID NO: 4384664 - DNA, 18 bp, Homo sapiens
ttacctgaaaacactgtg

SEQ ID NO: 4384665 - DNA, 20 bp, Homo sapiens
ttacctgccaattgctaccg

SEQ ID NO: 4384666 - DNA, 15 bp, Homo sapiens
ttacctggatgttct

SEQ ID NO: 4384667 - DNA, 21 bp, Homo sapiens
ttacctggcttatttaatatg

SEQ ID NO: 4384668 - DNA, 13 bp, Homo sapiens
ttacctgtacctg

SEQ ID NO: 4384669 - DNA, 20 bp, Homo sapiens
ttacctgtggatatttgtat

SEQ ID NO: 4384670 - DNA, 23 bp, Homo sapiens
ttaccttcacatgtcctattact

SEQ ID NO: 4384671 - DNA, 16 bp, Homo sapiens
ttacctttacatatat

SEQ ID NO: 4384672 - DNA, 19 bp, Homo sapiens
ttacctttatctttcacct

SEQ ID NO: 4384673 - DNA, 18 bp, Homo sapiens
ttacctttttatttgcat

SEQ ID NO: 4384674 - DNA, 13 bp, Homo sapiens
ttacgctttgatt

SEQ ID NO: 4384675 - DNA, 13 bp, Homo sapiens
ttacgtataatgc

SEQ ID NO: 4384676 - DNA, 16 bp, Homo sapiens
ttacgtttttctggtg

SEQ ID NO: 4384677 - DNA, 17 bp, Homo sapiens
ttactaaaatttacaca

SEQ ID NO: 4384678 - DNA, 17 bp, Homo sapiens
ttactaatgaggtacgc

SEQ ID NO: 4384679 - DNA, 16 bp, Homo sapiens
ttactacttaatgctt

SEQ ID NO: 4384680 - DNA, 16 bp, Homo sapiens
ttactagggatccctc

SEQ ID NO: 4384681 - DNA, 23 bp, Homo sapiens
ttactagggatccctcatctgtc

SEQ ID NO: 4384682 - DNA, 17 bp, Homo sapiens
ttactagtttcccttgc

SEQ ID NO: 4384683 - DNA, 17 bp, Homo sapiens
ttactatagcaaagtag

SEQ ID NO: 4384684 - DNA, 19 bp, Homo sapiens
ttactatatagaatttcct

SEQ ID NO: 4384685 - DNA, 21 bp, Homo sapiens
ttactatatagaatttcctgt

SEQ ID NO: 4384686 - DNA, 20 bp, Homo sapiens
ttaggtcgttttccaaagag

SEQ ID NO: 4384687 - DNA, 21 bp, Homo sapiens
ttaggttaaacgtagcatgtg

SEQ ID NO: 4384688 - DNA, 13 bp, Homo sapiens
ttagtaaggattt

SEQ ID NO: 4384689 - DNA, 14 bp, Homo sapiens
ttagtaaggatttt

SEQ ID NO: 4384690 - DNA, 17 bp, Homo sapiens
ttagtaatttctttttt

SEQ ID NO: 4384691 - DNA, 19 bp, Homo sapiens
ttagtacaatagtatacat

SEQ ID NO: 4384692 - DNA, 21 bp, Homo sapiens
ttagtacaatagtatacattt

SEQ ID NO: 4384693 - DNA, 22 bp, Homo sapiens
ttagtacaatagtatacatttt

SEQ ID NO: 4384694 - DNA, 15 bp, Homo sapiens
ttagtacaatttcaa

SEQ ID NO: 4384695 - DNA, 12 bp, Homo sapiens
ttagtacatttt

SEQ ID NO: 4384696 - DNA, 17 bp, Homo sapiens
ttagtagtcaaaaacaa

SEQ ID NO: 4384697 - DNA, 23 bp, Homo sapiens
ttagtagtcaaaaacaaagctga

SEQ ID NO: 4384698 - DNA, 23 bp, Homo sapiens
ttagtataaatgtacatcagttt

SEQ ID NO: 4384699 - DNA, 20 bp, Homo sapiens
ttagtatagtagaaagacat

SEQ ID NO: 4384700 - DNA, 14 bp, Homo sapiens
ttagtatttttact

SEQ ID NO: 4384701 - DNA, 22 bp, Homo sapiens
ttagtcccacctcttacttcct

SEQ ID NO: 4384702 - DNA, 22 bp, Homo sapiens
ttagtctagacacaatttcatt

SEQ ID NO: 4384703 - DNA, 18 bp, Homo sapiens
ttagtctgaaactggctt

SEQ ID NO: 4384704 - DNA, 19 bp, Homo sapiens
ttagtctgaaactggcttc

SEQ ID NO: 4384705 - DNA, 20 bp, Homo sapiens
ttagtgaaccaaaaatagaa

SEQ ID NO: 4384706 - DNA, 17 bp, Homo sapiens
ttagtgaccattattca

SEQ ID NO: 4384707 - DNA, 20 bp, Homo sapiens
ttagtgatactggctcagaa

SEQ ID NO: 4384708 - DNA, 19 bp, Homo sapiens
ttagtgccacttaatgtat

SEQ ID NO: 4384709 - DNA, 16 bp, Homo sapiens
ttagtggctcaacatt

SEQ ID NO: 4384710 - DNA, 19 bp, Homo sapiens
ttagtggtttatcagcaaa

SEQ ID NO: 4384711 - DNA, 13 bp, Homo sapiens
ttagtgtgtaaaa

SEQ ID NO: 4384712 - DNA, 18 bp, Homo sapiens
ttagtgtgtaaaattaat

SEQ ID NO: 4384713 - DNA, 18 bp, Homo sapiens
ttagtgttaatgactctt

SEQ ID NO: 4384714 - DNA, 16 bp, Homo sapiens
ttagttaccttatagt

SEQ ID NO: 4384715 - DNA, 18 bp, Homo sapiens
ttagttacgtataatgct

SEQ ID NO: 4384716 - DNA, 21 bp, Homo sapiens
ttagttgatattcaaggcttt

SEQ ID NO: 4384717 - DNA, 21 bp, Homo sapiens
ttagtttaacttccactgtta

SEQ ID NO: 4384718 - DNA, 16 bp, Homo sapiens
ttagtttgcctgcagt

SEQ ID NO: 4384719 - DNA, 22 bp, Homo sapiens
ttagtttgtatgccaagtgaga

SEQ ID NO: 4384720 - DNA, 15 bp, Homo sapiens
ttagtttgtttttgt

SEQ ID NO: 4384721 - DNA, 13 bp, Homo sapiens
ttagtttttcatt

SEQ ID NO: 4384722 - DNA, 16 bp, Homo sapiens
ttagtttttcattaaa

SEQ ID NO: 4384723 - DNA, 20 bp, Homo sapiens
ttataaaaaattaacttagt

SEQ ID NO: 4384724 - DNA, 19 bp, Homo sapiens
ttataaaaaggtgttttga

SEQ ID NO: 4384725 - DNA, 18 bp, Homo sapiens
ttataaaaatataaattg

SEQ ID NO: 4384726 - DNA, 21 bp, Homo sapiens
ttataaaaatattaagacaat

SEQ ID NO: 4384727 - DNA, 13 bp, Homo sapiens
ttataaaatggct

SEQ ID NO: 4384728 - DNA, 19 bp, Homo sapiens
ttataaactataaacttaa

SEQ ID NO: 4384729 - DNA, 20 bp, Homo sapiens
ttataaactatttttttctt

SEQ ID NO: 4384730 - DNA, 12 bp, Homo sapiens
ttataaagttca

SEQ ID NO: 4384731 - DNA, 17 bp, Homo sapiens
ttataaatatatataaa

SEQ ID NO: 4384732 - DNA, 23 bp, Homo sapiens
ttataaatgtaccagagagagtt

SEQ ID NO: 4384733 - DNA, 19 bp, Homo sapiens
ttataacagatgtgaaaat

SEQ ID NO: 4384734 - DNA, 15 bp, Homo sapiens
ttataactaacatgt

SEQ ID NO: 4384735 - DNA, 19 bp, Homo sapiens
ttataactctgcactactc

SEQ ID NO: 4384736 - DNA, 20 bp, Homo sapiens
ttataactgttttagaaatt

SEQ ID NO: 4384737 - DNA, 22 bp, Homo sapiens
ttataaggactgcatggtaatt

SEQ ID NO: 4384738 - DNA, 14 bp, Homo sapiens
ttataagttgacct

SEQ ID NO: 4384739 - DNA, 13 bp, Homo sapiens
ttataatactgtt

SEQ ID NO: 4384740 - DNA, 22 bp, Homo sapiens
ttataatactgttttaaaatgt

SEQ ID NO: 4384741 - DNA, 16 bp, Homo sapiens
ttataatcagaatgga

SEQ ID NO: 4384742 - DNA, 18 bp, Homo sapiens
ttataatcttataattgt

SEQ ID NO: 4384743 - DNA, 14 bp, Homo sapiens
ttataatgtatttg

SEQ ID NO: 4384744 - DNA, 17 bp, Homo sapiens
ttataattctcattaaa

SEQ ID NO: 4384745 - DNA, 14 bp, Homo sapiens
ttataattttccta

SEQ ID NO: 4384746 - DNA, 20 bp, Homo sapiens
ttataattttttttaaaata

SEQ ID NO: 4384747 - DNA, 18 bp, Homo sapiens
ttatacaatggaataaat

SEQ ID NO: 4384748 - DNA, 20 bp, Homo sapiens
ttatacagttgaaaacttgt

SEQ ID NO: 4384749 - DNA, 12 bp, Homo sapiens
ttatacatttgg

SEQ ID NO: 4384750 - DNA, 19 bp, Homo sapiens
ttataccatgtgtgctaat

SEQ ID NO: 4384751 - DNA, 21 bp, Homo sapiens
ttatacgctggcaacacagag

SEQ ID NO: 4384752 - DNA, 23 bp, Homo sapiens
ttatactactttgttaggatttt

SEQ ID NO: 4384753 - DNA, 21 bp, Homo sapiens
ttatactgacaataaaaatgt

SEQ ID NO: 4384754 - DNA, 18 bp, Homo sapiens
ttatactgagcttttgag

SEQ ID NO: 4384755 - DNA, 22 bp, Homo sapiens
ttatactgagcttttgagtgtt

SEQ ID NO: 4384756 - DNA, 14 bp, Homo sapiens
ttatactgtacaat

SEQ ID NO: 4384757 - DNA, 17 bp, Homo sapiens
ttatactgtacaataaa

SEQ ID NO: 4384758 - DNA, 18 bp, Homo sapiens
ttatactgtacaataaaa

SEQ ID NO: 4384759 - DNA, 23 bp, Homo sapiens
ttatactttatatctgtaatgat

SEQ ID NO: 4384760 - DNA, 13 bp, Homo sapiens
ttatactttattg

SEQ ID NO: 4384761 - DNA, 14 bp, Homo sapiens
ttatactttattga

SEQ ID NO: 4384762 - DNA, 21 bp, Homo sapiens
ttatactttgcaatccaaata

SEQ ID NO: 4384763 - DNA, 11 bp, Homo sapiens
ttatagaaaat

SEQ ID NO: 4384764 - DNA, 16 bp, Homo sapiens
ttatagacaaaagaat

SEQ ID NO: 4384765 - DNA, 20 bp, Homo sapiens
ttatagcaacaacaattggt

SEQ ID NO: 4384766 - DNA, 13 bp, Homo sapiens
ttataggaaaaaa

SEQ ID NO: 4384767 - DNA, 18 bp, Homo sapiens
ttataggaaaaaaactgg

SEQ ID NO: 4384768 - DNA, 23 bp, Homo sapiens
ttataggaatttgcgtaactaac

SEQ ID NO: 4384769 - DNA, 24 bp, Homo sapiens
ttataggatttatttaaaatagca

SEQ ID NO: 4384770 - DNA, 15 bp, Homo sapiens
ttataggcgtttttt

SEQ ID NO: 4384771 - DNA, 18 bp, Homo sapiens
ttataggggatacttgaa

SEQ ID NO: 4384772 - DNA, 14 bp, Homo sapiens
ttatagtaactata

SEQ ID NO: 4384773 - DNA, 15 bp, Homo sapiens
ttatagtaactataa

SEQ ID NO: 4384774 - DNA, 17 bp, Homo sapiens
ttatagtacatgataaa

SEQ ID NO: 4384775 - DNA, 17 bp, Homo sapiens
ttatagtactagagata

SEQ ID NO: 4384776 - DNA, 20 bp, Homo sapiens
ttatagtgagttgcatgttt

SEQ ID NO: 4384777 - DNA, 21 bp, Homo sapiens
ttatagtgtttggacagctga

SEQ ID NO: 4384778 - DNA, 15 bp, Homo sapiens
ttatagttactgtgt

SEQ ID NO: 4384779 - DNA, 13 bp, Homo sapiens
ttatagttattaa

SEQ ID NO: 4384780 - DNA, 15 bp, Homo sapiens
ttatagttattaaat

SEQ ID NO: 4384781 - DNA, 15 bp, Homo sapiens
ttatagtttatacag

SEQ ID NO: 4384782 - DNA, 17 bp, Homo sapiens
ttatagtttatacagtt

SEQ ID NO: 4384783 - DNA, 14 bp, Homo sapiens
ttatataaagtatt

SEQ ID NO: 4384784 - DNA, 16 bp, Homo sapiens
ttatataaagtattct

SEQ ID NO: 4384785 - DNA, 12 bp, Homo sapiens
ttatataacaaa

SEQ ID NO: 4384786 - DNA, 14 bp, Homo sapiens
ttatataacaaaaa

SEQ ID NO: 4384787 - DNA, 22 bp, Homo sapiens
ttatataactgtatttgaaata

SEQ ID NO: 4384788 - DNA, 19 bp, Homo sapiens
ttatataagtctgttattt

SEQ ID NO: 4384789 - DNA, 23 bp, Homo sapiens
ttatataagtctgttatttatta

SEQ ID NO: 4384790 - DNA, 20 bp, Homo sapiens
ttatataatatctaaagtta

SEQ ID NO: 4384791 - DNA, 18 bp, Homo sapiens
ttatatagtggatgatat

SEQ ID NO: 4384792 - DNA, 15 bp, Homo sapiens
ttatatataataaat

SEQ ID NO: 4384793 - DNA, 13 bp, Homo sapiens
ttatatattataa

SEQ ID NO: 4384794 - DNA, 23 bp, Homo sapiens
ttatatattataagttgaccttt

SEQ ID NO: 4384795 - DNA, 14 bp, Homo sapiens
ttatatattatgtg

SEQ ID NO: 4384796 - DNA, 15 bp, Homo sapiens
ttatatcacacaata

SEQ ID NO: 4384797 - DNA, 20 bp, Homo sapiens
ttatatcatgcaaaatatgt

SEQ ID NO: 4384798 - DNA, 21 bp, Homo sapiens
ttatatcgaaatagttacagg

SEQ ID NO: 4384799 - DNA, 16 bp, Homo sapiens
ttatatctggcctctg

SEQ ID NO: 4384800 - DNA, 15 bp, Homo sapiens
ttatatctgtaatga

SEQ ID NO: 4384801 - DNA, 14 bp, Homo sapiens
ttatatcttgttta

SEQ ID NO: 4384802 - DNA, 13 bp, Homo sapiens
ttatatgaacata

SEQ ID NO: 4384803 - DNA, 19 bp, Homo sapiens
ttatatgaagaaaatcact

SEQ ID NO: 4384804 - DNA, 17 bp, Homo sapiens
ttatgtgaatttttaag

SEQ ID NO: 4384805 - DNA, 14 bp, Homo sapiens
ttatgtgacatttt

SEQ ID NO: 4384806 - DNA, 13 bp, Homo sapiens
ttatgtgagagaa

SEQ ID NO: 4384807 - DNA, 15 bp, Homo sapiens
ttatgtgctattaat

SEQ ID NO: 4384808 - DNA, 21 bp, Homo sapiens
ttatgtgctattaatatttgt

SEQ ID NO: 4384809 - DNA, 15 bp, Homo sapiens
ttatgtggaataata

SEQ ID NO: 4384810 - DNA, 22 bp, Homo sapiens
ttatgtgtagttgtctctcttc

SEQ ID NO: 4384811 - DNA, 12 bp, Homo sapiens
ttatgtgtgtgt

SEQ ID NO: 4384812 - DNA, 12 bp, Homo sapiens
ttatgtgttaca

SEQ ID NO: 4384813 - DNA, 15 bp, Homo sapiens
ttatgtgttatgaac

SEQ ID NO: 4384814 - DNA, 22 bp, Homo sapiens
ttatgttaagggaagaattcca

SEQ ID NO: 4384815 - DNA, 14 bp, Homo sapiens
ttatgttagtttaa

SEQ ID NO: 4384816 - DNA, 23 bp, Homo sapiens
ttatgttagtttaaaaggtcaat

SEQ ID NO: 4384817 - DNA, 19 bp, Homo sapiens
ttatgttgggtcaagtgtt

SEQ ID NO: 4384818 - DNA, 16 bp, Homo sapiens
ttatgttttctttctc

SEQ ID NO: 4384819 - DNA, 15 bp, Homo sapiens
ttattaaaacaaaag

SEQ ID NO: 4384820 - DNA, 16 bp, Homo sapiens
ttattaaacaaataat

SEQ ID NO: 4384821 - DNA, 17 bp, Homo sapiens
ttattaaatgcttcatt

SEQ ID NO: 4384822 - DNA, 12 bp, Homo sapiens
ttattaaatgta

SEQ ID NO: 4384823 - DNA, 17 bp, Homo sapiens
ttattaaattgtaaaac

SEQ ID NO: 4384824 - DNA, 15 bp, Homo sapiens
ttattaagctttttg

SEQ ID NO: 4384825 - DNA, 13 bp, Homo sapiens
ttattaatctact

SEQ ID NO: 4384826 - DNA, 17 bp, Homo sapiens
ttattaatcttagtgta

SEQ ID NO: 4384827 - DNA, 18 bp, Homo sapiens
ttattaatgcactttcta

SEQ ID NO: 4384828 - DNA, 13 bp, Homo sapiens
ttattaattttta

SEQ ID NO: 4384829 - DNA, 22 bp, Homo sapiens
ttattacaaatattgtcatctt

SEQ ID NO: 4384830 - DNA, 12 bp, Homo sapiens
ttattacaatgt

SEQ ID NO: 4384831 - DNA, 16 bp, Homo sapiens
ttattacaatgtatct

SEQ ID NO: 4384832 - DNA, 18 bp, Homo sapiens
ttattacatgtaatttga

SEQ ID NO: 4384833 - DNA, 10 bp, Homo sapiens
ttattagaac

SEQ ID NO: 4384834 - DNA, 19 bp, Homo sapiens
ttattagaacattcacttt

SEQ ID NO: 4384835 - DNA, 17 bp, Homo sapiens
ttattagagtgtctttc

SEQ ID NO: 4384836 - DNA, 12 bp, Homo sapiens
ttattataaact

SEQ ID NO: 4384837 - DNA, 21 bp, Homo sapiens
ttattataaactataaactta

SEQ ID NO: 4384838 - DNA, 22 bp, Homo sapiens
ttattatatatttacagaagaa

SEQ ID NO: 4384839 - DNA, 23 bp, Homo sapiens
ttattatatatttacagaagaaa

SEQ ID NO: 4384840 - DNA, 13 bp, Homo sapiens
ttattattactgt

SEQ ID NO: 4384841 - DNA, 16 bp, Homo sapiens
ttattattatttttta

SEQ ID NO: 4384842 - DNA, 13 bp, Homo sapiens
ttattattgtact

SEQ ID NO: 4384843 - DNA, 14 bp, Homo sapiens
ttattcaaagagaa

SEQ ID NO: 4384844 - DNA, 15 bp, Homo sapiens
ttattcaaatgaagg

SEQ ID NO: 4384845 - DNA, 18 bp, Homo sapiens
ttattcattagttttgaa

SEQ ID NO: 4384846 - DNA, 21 bp, Homo sapiens
ttattcattagttttgaagat

SEQ ID NO: 4384847 - DNA, 18 bp, Homo sapiens
ttattcattatttgtcaa

SEQ ID NO: 4384848 - DNA, 18 bp, Homo sapiens
ttattcccgacgacacat

SEQ ID NO: 4384849 - DNA, 17 bp, Homo sapiens
ttattccttctgtagtg

SEQ ID NO: 4384850 - DNA, 13 bp, Homo sapiens
ttattctggagtt

SEQ ID NO: 4384851 - DNA, 23 bp, Homo sapiens
ttattctgggcaccacaaaatat

SEQ ID NO: 4384852 - DNA, 12 bp, Homo sapiens
ttattctgttcc

SEQ ID NO: 4384853 - DNA, 14 bp, Homo sapiens
ttattgacacagaa

SEQ ID NO: 4384854 - DNA, 19 bp, Homo sapiens
ttattgacacagaaaatgt

SEQ ID NO: 4384855 - DNA, 19 bp, Homo sapiens
ttattgagttccagttgaa

SEQ ID NO: 4384856 - DNA, 15 bp, Homo sapiens
ttattgatgttttca

SEQ ID NO: 4384857 - DNA, 23 bp, Homo sapiens
ttattgcaccattttcaatttgg

SEQ ID NO: 4384858 - DNA, 14 bp, Homo sapiens
ttattgcagaatgt

SEQ ID NO: 4384859 - DNA, 14 bp, Homo sapiens
ttattgcagtttat

SEQ ID NO: 4384860 - DNA, 21 bp, Homo sapiens
ttattgcagtttatcattcaa

SEQ ID NO: 4384861 - DNA, 22 bp, Homo sapiens
ttattgcagtttatcattcaag

SEQ ID NO: 4384862 - DNA, 19 bp, Homo sapiens
ttattgccaggaaaggaga

SEQ ID NO: 4384863 - DNA, 23 bp, Homo sapiens
ttattgccttctcaccagctgca

SEQ ID NO: 4384864 - DNA, 15 bp, Homo sapiens
ttattgcttagtaaa

SEQ ID NO: 4384865 - DNA, 20 bp, Homo sapiens
ttattgcttattgcttagta

SEQ ID NO: 4384866 - DNA, 13 bp, Homo sapiens
ttattggcaaagt

SEQ ID NO: 4384867 - DNA, 16 bp, Homo sapiens
ttattggctgagatat

SEQ ID NO: 4384868 - DNA, 18 bp, Homo sapiens
ttattggttttgcagaag

SEQ ID NO: 4384869 - DNA, 14 bp, Homo sapiens
ttattgtagacatg

SEQ ID NO: 4384870 - DNA, 23 bp, Homo sapiens
ttattgtattcctcatgtcatca

SEQ ID NO: 4384871 - DNA, 13 bp, Homo sapiens
ttattgtctgtaa

SEQ ID NO: 4384872 - DNA, 14 bp, Homo sapiens
ttattgtctgtcta

SEQ ID NO: 4384873 - DNA, 19 bp, Homo sapiens
ttattgtgacttcactgta

SEQ ID NO: 4384874 - DNA, 22 bp, Homo sapiens
ttattgtgtatagatatttcct

SEQ ID NO: 4384875 - DNA, 17 bp, Homo sapiens
ttatttaaaaaactaaa

SEQ ID NO: 4384876 - DNA, 13 bp, Homo sapiens
ttatttaaaactc

SEQ ID NO: 4384877 - DNA, 18 bp, Homo sapiens
ttatttaacaaaaaatgt

SEQ ID NO: 4384878 - DNA, 13 bp, Homo sapiens
ttatttaagattt

SEQ ID NO: 4384879 - DNA, 22 bp, Homo sapiens
ttatttacagataacttcttta

SEQ ID NO: 4384880 - DNA, 13 bp, Homo sapiens
ttatttacattta

SEQ ID NO: 4384881 - DNA, 15 bp, Homo sapiens
ttatttacatttaat

SEQ ID NO: 4384882 - DNA, 15 bp, Homo sapiens
ttatttagacaagag

SEQ ID NO: 4384883 - DNA, 15 bp, Homo sapiens
ttatttattaaactt

SEQ ID NO: 4384884 - DNA, 11 bp, Homo sapiens
ttatttattga

SEQ ID NO: 4384885 - DNA, 14 bp, Homo sapiens
ttatttcaataaat

SEQ ID NO: 4384886 - DNA, 18 bp, Homo sapiens
ttatttcaataaatcttt

SEQ ID NO: 4384887 - DNA, 20 bp, Homo sapiens
ttatttcaataaatctttca

SEQ ID NO: 4384888 - DNA, 12 bp, Homo sapiens
ttatttcaatgt

SEQ ID NO: 4384889 - DNA, 16 bp, Homo sapiens
ttatttcaatgtaatt

SEQ ID NO: 4384890 - DNA, 13 bp, Homo sapiens
ttatttctatgaa

SEQ ID NO: 4384891 - DNA, 11 bp, Homo sapiens
ttatttctcat

SEQ ID NO: 4384892 - DNA, 19 bp, Homo sapiens
ttatttctcgggtgcattt

SEQ ID NO: 4384893 - DNA, 19 bp, Homo sapiens
ttatttctctggcaaactt

SEQ ID NO: 4384894 - DNA, 21 bp, Homo sapiens
ttatttctctggcaaactttt

SEQ ID NO: 4384895 - DNA, 12 bp, Homo sapiens
ttatttctgcat

SEQ ID NO: 4384896 - DNA, 22 bp, Homo sapiens
ttatttctgcatatgttgaata

SEQ ID NO: 4384897 - DNA, 16 bp, Homo sapiens
ttatttctgctctgga

SEQ ID NO: 4384898 - DNA, 12 bp, Homo sapiens
ttatttcttccc

SEQ ID NO: 4384899 - DNA, 15 bp, Homo sapiens
ttatttcttttactt

SEQ ID NO: 4384900 - DNA, 12 bp, Homo sapiens
ttatttgtaata

SEQ ID NO: 4384901 - DNA, 16 bp, Homo sapiens
ttatttgtaatagatg

SEQ ID NO: 4384902 - DNA, 18 bp, Homo sapiens
ttatttgtaatagatgtt

SEQ ID NO: 4384903 - DNA, 23 bp, Homo sapiens
ttatttgtctgtaaaaaatggag

SEQ ID NO: 4384904 - DNA, 18 bp, Homo sapiens
ttattttaaaatatatga

SEQ ID NO: 4384905 - DNA, 13 bp, Homo sapiens
ttattttaaatta

SEQ ID NO: 4384906 - DNA, 14 bp, Homo sapiens
ttattttaaattat

SEQ ID NO: 4384907 - DNA, 20 bp, Homo sapiens
ttattttacagctcattaaa

SEQ ID NO: 4384908 - DNA, 13 bp, Homo sapiens
ttattttagcaaa

SEQ ID NO: 4384909 - DNA, 15 bp, Homo sapiens
ttattttagcaaatc

SEQ ID NO: 4384910 - DNA, 21 bp, Homo sapiens
ttattttagcaaatcagtata

SEQ ID NO: 4384911 - DNA, 21 bp, Homo sapiens
ttattttagcagttctgcaaa

SEQ ID NO: 4384912 - DNA, 18 bp, Homo sapiens
ttattttagtgtgtaaaa

SEQ ID NO: 4384913 - DNA, 20 bp, Homo sapiens
ttattttagtgtgtaaaatt

SEQ ID NO: 4384914 - DNA, 17 bp, Homo sapiens
ttattttatatcataca

SEQ ID NO: 4384915 - DNA, 18 bp, Homo sapiens
ttattttatgtttagata

SEQ ID NO: 4384916 - DNA, 11 bp, Homo sapiens
ttattttgatg

SEQ ID NO: 4384917 - DNA, 12 bp, Homo sapiens
ttattttgcaac

SEQ ID NO: 4384918 - DNA, 13 bp, Homo sapiens
ttatttttagatg

SEQ ID NO: 4384919 - DNA, 22 bp, Homo sapiens
ttatttttcaagataaggagaa

SEQ ID NO: 4384920 - DNA, 13 bp, Homo sapiens
ttatttttcctgt

SEQ ID NO: 4384921 - DNA, 15 bp, Homo sapiens
ttatttttcctgtcc

SEQ ID NO: 4384922 - DNA, 16 bp, Homo sapiens
ttatttttgtacattt

SEQ ID NO: 4384923 - DNA, 18 bp, Homo sapiens
ttattttttttttttgaa

SEQ ID NO: 4384924 - DNA, 17 bp, Homo sapiens
ttcagaattaagcagaa

SEQ ID NO: 4384925 - DNA, 19 bp, Homo sapiens
ttcagacaaaatggataca

SEQ ID NO: 4384926 - DNA, 16 bp, Homo sapiens
ttcagacatagaatta

SEQ ID NO: 4384927 - DNA, 13 bp, Homo sapiens
ttcagaccccagc

SEQ ID NO: 4384928 - DNA, 18 bp, Homo sapiens
ttcagacccctgcctgga

SEQ ID NO: 4384929 - DNA, 19 bp, Homo sapiens
ttcagactttgcttcccat

SEQ ID NO: 4384930 - DNA, 23 bp, Homo sapiens
ttcagaggccctcgctgccagct

SEQ ID NO: 4384931 - DNA, 13 bp, Homo sapiens
ttcagaggtcact

SEQ ID NO: 4384932 - DNA, 14 bp, Homo sapiens
ttcagatataaaag

SEQ ID NO: 4384933 - DNA, 21 bp, Homo sapiens
ttcagatcttaatataaattc

SEQ ID NO: 4384934 - DNA, 23 bp, Homo sapiens
ttcagatgtcttctgcctgttat

SEQ ID NO: 4384935 - DNA, 20 bp, Homo sapiens
ttcagattgtggaatgttgg

SEQ ID NO: 4384936 - DNA, 22 bp, Homo sapiens
ttcagattgtggaatgttggat

SEQ ID NO: 4384937 - DNA, 23 bp, Homo sapiens
ttcagattttgataactgtttat

SEQ ID NO: 4384938 - DNA, 17 bp, Homo sapiens
ttcagattttttaaaat

SEQ ID NO: 4384939 - DNA, 23 bp, Homo sapiens
ttcagcaaccctacagtatataa

SEQ ID NO: 4384940 - DNA, 22 bp, Homo sapiens
ttcagcaatgataatgagcaga

SEQ ID NO: 4384941 - DNA, 16 bp, Homo sapiens
ttcagcaccaccctag

SEQ ID NO: 4384942 - DNA, 13 bp, Homo sapiens
ttcagcacttgtc

SEQ ID NO: 4384943 - DNA, 17 bp, Homo sapiens
ttcagcacttgtctcat

SEQ ID NO: 4384944 - DNA, 20 bp, Homo sapiens
ttcagcacttgtctcatttt

SEQ ID NO: 4384945 - DNA, 17 bp, Homo sapiens
ttcagcagtttctgaca

SEQ ID NO: 4384946 - DNA, 12 bp, Homo sapiens
ttcagcatgcaa

SEQ ID NO: 4384947 - DNA, 13 bp, Homo sapiens
ttcagcattctta

SEQ ID NO: 4384948 - DNA, 17 bp, Homo sapiens
ttcagcccctcctctgc

SEQ ID NO: 4384949 - DNA, 20 bp, Homo sapiens
ttcagcccctcctctgccac

SEQ ID NO: 4384950 - DNA, 11 bp, Homo sapiens
ttcagctctga

SEQ ID NO: 4384951 - DNA, 13 bp, Homo sapiens
ttcaggaaaattg

SEQ ID NO: 4384952 - DNA, 11 bp, Homo sapiens
ttcaggaacct

SEQ ID NO: 4384953 - DNA, 21 bp, Homo sapiens
ttcaggaacctcgagtactgt

SEQ ID NO: 4384954 - DNA, 13 bp, Homo sapiens
ttcaggagacttt

SEQ ID NO: 4384955 - DNA, 15 bp, Homo sapiens
ttcaggcagcactga

SEQ ID NO: 4384956 - DNA, 14 bp, Homo sapiens
ttcaggccagccca

SEQ ID NO: 4384957 - DNA, 16 bp, Homo sapiens
ttcaggccagcccagc

SEQ ID NO: 4384958 - DNA, 20 bp, Homo sapiens
ttcaggccagcccagccagg

SEQ ID NO: 4384959 - DNA, 18 bp, Homo sapiens
ttcaggctcaaccttcca

SEQ ID NO: 4384960 - DNA, 13 bp, Homo sapiens
ttcaggctgcttg

SEQ ID NO: 4384961 - DNA, 22 bp, Homo sapiens
ttcagggagaatgttgttgtct

SEQ ID NO: 4384962 - DNA, 20 bp, Homo sapiens
ttcaggggaagagaagacaa

SEQ ID NO: 4384963 - DNA, 19 bp, Homo sapiens
ttcaggggactcagccctg

SEQ ID NO: 4384964 - DNA, 21 bp, Homo sapiens
ttcaggtggagagcactagaa

SEQ ID NO: 4384965 - DNA, 13 bp, Homo sapiens
ttcaggtttttcc

SEQ ID NO: 4384966 - DNA, 23 bp, Homo sapiens
ttcagtaagtctcataggttaaa

SEQ ID NO: 4384967 - DNA, 20 bp, Homo sapiens
ttcagtaataaactgtgttt

SEQ ID NO: 4384968 - DNA, 19 bp, Homo sapiens
ttcagtacttttttaaata

SEQ ID NO: 4384969 - DNA, 14 bp, Homo sapiens
ttcagtattttcca

SEQ ID NO: 4384970 - DNA, 15 bp, Homo sapiens
ttcagtattttccag

SEQ ID NO: 4384971 - DNA, 16 bp, Homo sapiens
ttcagtcctgtagttt

SEQ ID NO: 4384972 - DNA, 17 bp, Homo sapiens
ttcagtctctgaataca

SEQ ID NO: 4384973 - DNA, 18 bp, Homo sapiens
ttcagtgatcttcactgt

SEQ ID NO: 4384974 - DNA, 21 bp, Homo sapiens
ttcagtgcagtttcttttcac

SEQ ID NO: 4384975 - DNA, 23 bp, Homo sapiens
ttcagtggaccgaaatctgtatt

SEQ ID NO: 4384976 - DNA, 18 bp, Homo sapiens
ttcagtggtgaaatcttg

SEQ ID NO: 4384977 - DNA, 19 bp, Homo sapiens
ttcagtgtgagtcagaatg

SEQ ID NO: 4384978 - DNA, 23 bp, Homo sapiens
ttcagtgttcccaaagtgaactc

SEQ ID NO: 4384979 - DNA, 15 bp, Homo sapiens
ttcagtgttgcatgt

SEQ ID NO: 4384980 - DNA, 17 bp, Homo sapiens
ttcagttattaaatgat

SEQ ID NO: 4384981 - DNA, 13 bp, Homo sapiens
ttcagtttcataa

SEQ ID NO: 4384982 - DNA, 16 bp, Homo sapiens
ttcagtttcataaaag

SEQ ID NO: 4384983 - DNA, 12 bp, Homo sapiens
ttcagttttcag

SEQ ID NO: 4384984 - DNA, 16 bp, Homo sapiens
ttcagtttttcacttc

SEQ ID NO: 4384985 - DNA, 15 bp, Homo sapiens
ttcataacagtgcca

SEQ ID NO: 4384986 - DNA, 22 bp, Homo sapiens
ttcataacagtgccattgtctt

SEQ ID NO: 4384987 - DNA, 13 bp, Homo sapiens
ttcataacggaaa

SEQ ID NO: 4384988 - DNA, 17 bp, Homo sapiens
ttcataagtatttcaaa

SEQ ID NO: 4384989 - DNA, 13 bp, Homo sapiens
ttcataataaatt

SEQ ID NO: 4384990 - DNA, 16 bp, Homo sapiens
ttcataattctgaaac

SEQ ID NO: 4384991 - DNA, 12 bp, Homo sapiens
ttcatactgtac

SEQ ID NO: 4384992 - DNA, 21 bp, Homo sapiens
ttcatactgtacacatttctt

SEQ ID NO: 4384993 - DNA, 14 bp, Homo sapiens
ttcatacttaaaaa

SEQ ID NO: 4384994 - DNA, 21 bp, Homo sapiens
ttcatagatttgaaaaacttt

SEQ ID NO: 4384995 - DNA, 13 bp, Homo sapiens
ttcatagcactgc

SEQ ID NO: 4384996 - DNA, 18 bp, Homo sapiens
ttcatagctgtacttctt

SEQ ID NO: 4384997 - DNA, 17 bp, Homo sapiens
ttcatagtaacttctta

SEQ ID NO: 4384998 - DNA, 14 bp, Homo sapiens
ttcatagttcagaa

SEQ ID NO: 4384999 - DNA, 20 bp, Homo sapiens
ttcatagttcagaatttagt

SEQ ID NO: 4385000 - DNA, 14 bp, Homo sapiens
ttcatataaagtat

SEQ ID NO: 4385001 - DNA, 16 bp, Homo sapiens
ttcatataaagtatca

SEQ ID NO: 4385002 - DNA, 11 bp, Homo sapiens
ttcatatcatt

SEQ ID NO: 4385003 - DNA, 21 bp, Homo sapiens
ttcatattaatataagtttct

SEQ ID NO: 4385004 - DNA, 14 bp, Homo sapiens
ttcatcatttcagc

SEQ ID NO: 4385005 - DNA, 17 bp, Homo sapiens
ttcatcatttcagccaa

SEQ ID NO: 4385006 - DNA, 23 bp, Homo sapiens
ttcatccagtttgttctccgggt

SEQ ID NO: 4385007 - DNA, 16 bp, Homo sapiens
ttcatccatagacaca

SEQ ID NO: 4385008 - DNA, 18 bp, Homo sapiens
ttcatccatagacacagt

SEQ ID NO: 4385009 - DNA, 18 bp, Homo sapiens
ttcatcccgtatcacagt

SEQ ID NO: 4385010 - DNA, 16 bp, Homo sapiens
ttcatccgttgtgact

SEQ ID NO: 4385011 - DNA, 17 bp, Homo sapiens
ttcatctaccttttctg

SEQ ID NO: 4385012 - DNA, 23 bp, Homo sapiens
ttcatctatttttggcagtctga

SEQ ID NO: 4385013 - DNA, 18 bp, Homo sapiens
ttcatctctaacatatga

SEQ ID NO: 4385014 - DNA, 13 bp, Homo sapiens
ttcatctgctctc

SEQ ID NO: 4385015 - DNA, 16 bp, Homo sapiens
ttcatctgctctcctt

SEQ ID NO: 4385016 - DNA, 18 bp, Homo sapiens
ttcatctgtgggatgctg

SEQ ID NO: 4385017 - DNA, 20 bp, Homo sapiens
ttcatctgtgggatgctgaa

SEQ ID NO: 4385018 - DNA, 23 bp, Homo sapiens
ttcatcttgtacaaactttgttt

SEQ ID NO: 4385019 - DNA, 23 bp, Homo sapiens
ttcatgaatattttcaagttttt

SEQ ID NO: 4385020 - DNA, 12 bp, Homo sapiens
ttcatgataatg

SEQ ID NO: 4385021 - DNA, 16 bp, Homo sapiens
ttcatgatagaaagaa

SEQ ID NO: 4385022 - DNA, 19 bp, Homo sapiens
ttcatgatagaaagaataa

SEQ ID NO: 4385023 - DNA, 12 bp, Homo sapiens
ttcatgatgcag

SEQ ID NO: 4385024 - DNA, 23 bp, Homo sapiens
ttcatgattagaaattacctgtg

SEQ ID NO: 4385025 - DNA, 13 bp, Homo sapiens
ttcatgcagctgt

SEQ ID NO: 4385026 - DNA, 23 bp, Homo sapiens
ttcatgcccttctgattcccctc

SEQ ID NO: 4385027 - DNA, 15 bp, Homo sapiens
ttcatgcttgacata

SEQ ID NO: 4385028 - DNA, 19 bp, Homo sapiens
ttcatgcttgacataccta

SEQ ID NO: 4385029 - DNA, 13 bp, Homo sapiens
ttcatggatcaga

SEQ ID NO: 4385030 - DNA, 16 bp, Homo sapiens
ttcatggatcagatct

SEQ ID NO: 4385031 - DNA, 19 bp, Homo sapiens
ttcatggcaatgaaaattt

SEQ ID NO: 4385032 - DNA, 12 bp, Homo sapiens
ttcatgggtggt

SEQ ID NO: 4385033 - DNA, 15 bp, Homo sapiens
ttcatggtctctgca

SEQ ID NO: 4385034 - DNA, 18 bp, Homo sapiens
ttcatgtaaactgtgcac

SEQ ID NO: 4385035 - DNA, 19 bp, Homo sapiens
ttcatgtaaactgtgcacc

SEQ ID NO: 4385036 - DNA, 17 bp, Homo sapiens
ttcatgtacaagatgaa

SEQ ID NO: 4385037 - DNA, 16 bp, Homo sapiens
ttcatgtcccagaact

SEQ ID NO: 4385038 - DNA, 20 bp, Homo sapiens
ttcatgtggtgaatatgcaa

SEQ ID NO: 4385039 - DNA, 13 bp, Homo sapiens
ttcatgttagtta

SEQ ID NO: 4385040 - DNA, 16 bp, Homo sapiens
ttcatgttagttacct

SEQ ID NO: 4385041 - DNA, 22 bp, Homo sapiens
ttcatgttagttaccttatagt

SEQ ID NO: 4385042 - DNA, 19 bp, Homo sapiens
ttgctgaaattttatatgc

SEQ ID NO: 4385043 - DNA, 14 bp, Homo sapiens
ttgctgaaggagaa

SEQ ID NO: 4385044 - DNA, 16 bp, Homo sapiens
ttgctgattttaatgg

SEQ ID NO: 4385045 - DNA, 19 bp, Homo sapiens
ttgctgattttaatggatt

SEQ ID NO: 4385046 - DNA, 19 bp, Homo sapiens
ttgctgcactcttgcacat

SEQ ID NO: 4385047 - DNA, 22 bp, Homo sapiens
ttgctgcattcctttttcttca

SEQ ID NO: 4385048 - DNA, 19 bp, Homo sapiens
ttgctgccccatcagtgct

SEQ ID NO: 4385049 - DNA, 15 bp, Homo sapiens
ttgctgcccctgtct

SEQ ID NO: 4385050 - DNA, 21 bp, Homo sapiens
ttgctgcccctgtctggaaga

SEQ ID NO: 4385051 - DNA, 12 bp, Homo sapiens
ttgctgcttgga

SEQ ID NO: 4385052 - DNA, 23 bp, Homo sapiens
ttgctggtagagacccccaggcc

SEQ ID NO: 4385053 - DNA, 13 bp, Homo sapiens
ttgctgtaaaatt

SEQ ID NO: 4385054 - DNA, 23 bp, Homo sapiens
ttgctgtgtctcctctcagagtg

SEQ ID NO: 4385055 - DNA, 14 bp, Homo sapiens
ttgctgttaccaaa

SEQ ID NO: 4385056 - DNA, 12 bp, Homo sapiens
ttgctgttgaca

SEQ ID NO: 4385057 - DNA, 15 bp, Homo sapiens
ttgctgtttatactt

SEQ ID NO: 4385058 - DNA, 13 bp, Homo sapiens
ttgcttaaaagca

SEQ ID NO: 4385059 - DNA, 14 bp, Homo sapiens
ttgcttaaaatatg

SEQ ID NO: 4385060 - DNA, 15 bp, Homo sapiens
ttgcttaaaatatgt

SEQ ID NO: 4385061 - DNA, 14 bp, Homo sapiens
ttgcttaaatttct

SEQ ID NO: 4385062 - DNA, 12 bp, Homo sapiens
ttgcttagtaaa

SEQ ID NO: 4385063 - DNA, 14 bp, Homo sapiens
ttgcttagtaaaat

SEQ ID NO: 4385064 - DNA, 15 bp, Homo sapiens
ttgcttagtaaaatt

SEQ ID NO: 4385065 - DNA, 16 bp, Homo sapiens
ttgcttattgtgtgtt

SEQ ID NO: 4385066 - DNA, 18 bp, Homo sapiens
ttgcttcaaattggtctg

SEQ ID NO: 4385067 - DNA, 18 bp, Homo sapiens
ttgcttcctgtgtaacat

SEQ ID NO: 4385068 - DNA, 23 bp, Homo sapiens
ttgcttcctgtgtaacatctgcc

SEQ ID NO: 4385069 - DNA, 19 bp, Homo sapiens
ttgcttctactttcatctt

SEQ ID NO: 4385070 - DNA, 21 bp, Homo sapiens
ttgcttctaggagtcaactgg

SEQ ID NO: 4385071 - DNA, 14 bp, Homo sapiens
ttgcttctgcagca

SEQ ID NO: 4385072 - DNA, 15 bp, Homo sapiens
ttgcttgaacacagt

SEQ ID NO: 4385073 - DNA, 14 bp, Homo sapiens
ttgcttgagcttgg

SEQ ID NO: 4385074 - DNA, 18 bp, Homo sapiens
ttgcttttgaaggaatac

SEQ ID NO: 4385075 - DNA, 21 bp, Homo sapiens
ttgcttttgaaggaatacaat

SEQ ID NO: 4385076 - DNA, 23 bp, Homo sapiens
ttgcttttgaaggaatacaatat

SEQ ID NO: 4385077 - DNA, 19 bp, Homo sapiens
ttgctttttcacagtcact

SEQ ID NO: 4385078 - DNA, 22 bp, Homo sapiens
ttgctttttccccattggaact

SEQ ID NO: 4385079 - DNA, 15 bp, Homo sapiens
ttggaaaaaatttgt

SEQ ID NO: 4385080 - DNA, 13 bp, Homo sapiens
ttggaaaaatggg

SEQ ID NO: 4385081 - DNA, 20 bp, Homo sapiens
ttggaaaatgacattttact

SEQ ID NO: 4385082 - DNA, 22 bp, Homo sapiens
ttggaaacattttttaaaacaa

SEQ ID NO: 4385083 - DNA, 19 bp, Homo sapiens
ttggaaagggaagatctta

SEQ ID NO: 4385084 - DNA, 17 bp, Homo sapiens
ttggaaagtacactctg

SEQ ID NO: 4385085 - DNA, 22 bp, Homo sapiens
ttggaaagtacactctgctgtt

SEQ ID NO: 4385086 - DNA, 18 bp, Homo sapiens
ttggaaataaaagataaa

SEQ ID NO: 4385087 - DNA, 13 bp, Homo sapiens
ttggaaataaagt

SEQ ID NO: 4385088 - DNA, 23 bp, Homo sapiens
ttggaaatagaaagaagccatat

SEQ ID NO: 4385089 - DNA, 16 bp, Homo sapiens
ttggaaatgtgttttt

SEQ ID NO: 4385090 - DNA, 16 bp, Homo sapiens
ttggaactctgcttga

SEQ ID NO: 4385091 - DNA, 22 bp, Homo sapiens
ttggaactgtgtttcaaatgga

SEQ ID NO: 4385092 - DNA, 20 bp, Homo sapiens
ttggaagaagttttttactt

SEQ ID NO: 4385093 - DNA, 18 bp, Homo sapiens
ttggaagctgtttggaaa

SEQ ID NO: 4385094 - DNA, 16 bp, Homo sapiens
ttggaatattaaaaaa

SEQ ID NO: 4385095 - DNA, 13 bp, Homo sapiens
ttggaatatttta

SEQ ID NO: 4385096 - DNA, 23 bp, Homo sapiens
ttggaatattttatcctgtattc

SEQ ID NO: 4385097 - DNA, 18 bp, Homo sapiens
ttggaattctactggaaa

SEQ ID NO: 4385098 - DNA, 19 bp, Homo sapiens
ttggaattctactggaaaa

SEQ ID NO: 4385099 - DNA, 14 bp, Homo sapiens
ttggacaaatcaca

SEQ ID NO: 4385100 - DNA, 16 bp, Homo sapiens
ttggacagaaaatgca

SEQ ID NO: 4385101 - DNA, 20 bp, Homo sapiens
ttggacagaaaatgcaatga

SEQ ID NO: 4385102 - DNA, 13 bp, Homo sapiens
ttggacagaccca

SEQ ID NO: 4385103 - DNA, 10 bp, Homo sapiens
ttggacccac

SEQ ID NO: 4385104 - DNA, 16 bp, Homo sapiens
ttggacccagggcctg

SEQ ID NO: 4385105 - DNA, 16 bp, Homo sapiens
ttggacccttccatgg

SEQ ID NO: 4385106 - DNA, 15 bp, Homo sapiens
ttggacccttggaaa

SEQ ID NO: 4385107 - DNA, 18 bp, Homo sapiens
ttggactctctgtggtcc

SEQ ID NO: 4385108 - DNA, 19 bp, Homo sapiens
ttggactctctgtggtccc

SEQ ID NO: 4385109 - DNA, 20 bp, Homo sapiens
ttggactctctgtggtccct

SEQ ID NO: 4385110 - DNA, 22 bp, Homo sapiens
ttggacttcagtcttgcctagg

SEQ ID NO: 4385111 - DNA, 22 bp, Homo sapiens
ttggagaaccagggctcttctc

SEQ ID NO: 4385112 - DNA, 14 bp, Homo sapiens
ttggagcaatcaga

SEQ ID NO: 4385113 - DNA, 24 bp, Homo sapiens
ttggagcattaactaaatgctcat

SEQ ID NO: 4385114 - DNA, 11 bp, Homo sapiens
ttggagctgac

SEQ ID NO: 4385115 - DNA, 21 bp, Homo sapiens
ttggagctgactgttcttggt

SEQ ID NO: 4385116 - DNA, 21 bp, Homo sapiens
ttggagggtcccaagctgggc

SEQ ID NO: 4385117 - DNA, 23 bp, Homo sapiens
ttggagggtcccaagctgggccc

SEQ ID NO: 4385118 - DNA, 17 bp, Homo sapiens
ttggagtcgtgttgtca

SEQ ID NO: 4385119 - DNA, 16 bp, Homo sapiens
ttggagtgccaagttt

SEQ ID NO: 4385120 - DNA, 18 bp, Homo sapiens
ttggagtgttatgtattt

SEQ ID NO: 4385121 - DNA, 19 bp, Homo sapiens
ttggagtgttccccttcca

SEQ ID NO: 4385122 - DNA, 22 bp, Homo sapiens
ttggagtgttccccttccactg

SEQ ID NO: 4385123 - DNA, 22 bp, Homo sapiens
ttggataatgctgttgcctcat

SEQ ID NO: 4385124 - DNA, 19 bp, Homo sapiens
ttggatacttggatttagt

SEQ ID NO: 4385125 - DNA, 19 bp, Homo sapiens
ttggatattttttacttta

SEQ ID NO: 4385126 - DNA, 19 bp, Homo sapiens
ttggatctattgatttgaa

SEQ ID NO: 4385127 - DNA, 21 bp, Homo sapiens
ttggatctattgatttgaaaa

SEQ ID NO: 4385128 - DNA, 14 bp, Homo sapiens
ttggatgagcatgg

SEQ ID NO: 4385129 - DNA, 18 bp, Homo sapiens
ttggattgtatattgtgt

SEQ ID NO: 4385130 - DNA, 20 bp, Homo sapiens
ttggatttagagcaggtctt

SEQ ID NO: 4385131 - DNA, 12 bp, Homo sapiens
ttggatttccta

SEQ ID NO: 4385132 - DNA, 14 bp, Homo sapiens
ttggatttcctaat

SEQ ID NO: 4385133 - DNA, 21 bp, Homo sapiens
ttggatttcctaatactgtca

SEQ ID NO: 4385134 - DNA, 22 bp, Homo sapiens
ttggatttgacattgcgtttga

SEQ ID NO: 4385135 - DNA, 12 bp, Homo sapiens
ttggattttcac

SEQ ID NO: 4385136 - DNA, 16 bp, Homo sapiens
ttggcacatgccacct

SEQ ID NO: 4385137 - DNA, 21 bp, Homo sapiens
ttggcacccccatgctgcctt

SEQ ID NO: 4385138 - DNA, 20 bp, Homo sapiens
ttggcactttgttttcaaga

SEQ ID NO: 4385139 - DNA, 19 bp, Homo sapiens
ttggcaggcccactcccca

SEQ ID NO: 4385140 - DNA, 19 bp, Homo sapiens
ttggcagtggactcagaaa

SEQ ID NO: 4385141 - DNA, 14 bp, Homo sapiens
ttggcatacaaaat

SEQ ID NO: 4385142 - DNA, 16 bp, Homo sapiens
ttggcatacaaaatat

SEQ ID NO: 4385143 - DNA, 16 bp, Homo sapiens
ttggcatagctctggg

SEQ ID NO: 4385144 - DNA, 22 bp, Homo sapiens
ttggcatctctccccatatata

SEQ ID NO: 4385145 - DNA, 17 bp, Homo sapiens
ttggcattggaattcta

SEQ ID NO: 4385146 - DNA, 20 bp, Homo sapiens
ttggccactggatcctgctg

SEQ ID NO: 4385147 - DNA, 21 bp, Homo sapiens
ttggccactggatcctgctgc

SEQ ID NO: 4385148 - DNA, 11 bp, Homo sapiens
ttggcccagcg

SEQ ID NO: 4385149 - DNA, 16 bp, Homo sapiens
ttggccgagctcctgg

SEQ ID NO: 4385150 - DNA, 12 bp, Homo sapiens
ttggcctggggg

SEQ ID NO: 4385151 - DNA, 19 bp, Homo sapiens
ttggcgtagcagagttaaa

SEQ ID NO: 4385152 - DNA, 22 bp, Homo sapiens
ttggcgtagcagagttaaatct

SEQ ID NO: 4385153 - DNA, 21 bp, Homo sapiens
ttggctatgaaaatgagccct

SEQ ID NO: 4385154 - DNA, 23 bp, Homo sapiens
ttggctatgaaaatgagccctgg

SEQ ID NO: 4385155 - DNA, 17 bp, Homo sapiens
ttggctcacactgagaa

SEQ ID NO: 4385156 - DNA, 16 bp, Homo sapiens
ttggctggtagcagca

SEQ ID NO: 4385157 - DNA, 19 bp, Homo sapiens
ttggctggtagcagcaggc

SEQ ID NO: 4385158 - DNA, 23 bp, Homo sapiens
ttggctggtagcagcaggctcag

SEQ ID NO: 4385159 - DNA, 16 bp, Homo sapiens
ttgtatctacagtaat

SEQ ID NO: 4385160 - DNA, 20 bp, Homo sapiens
ttgtatctacagtaatgaaa

SEQ ID NO: 4385161 - DNA, 12 bp, Homo sapiens
ttgtatgccttt

SEQ ID NO: 4385162 - DNA, 20 bp, Homo sapiens
ttgtatgcctttaaatctgt

SEQ ID NO: 4385163 - DNA, 16 bp, Homo sapiens
ttgtatgttgaggatc

SEQ ID NO: 4385164 - DNA, 14 bp, Homo sapiens
ttgtattctctgag

SEQ ID NO: 4385165 - DNA, 15 bp, Homo sapiens
ttgtattctctgagc

SEQ ID NO: 4385166 - DNA, 15 bp, Homo sapiens
ttgtattgctgtcct

SEQ ID NO: 4385167 - DNA, 17 bp, Homo sapiens
ttgtattgtaaatgtgg

SEQ ID NO: 4385168 - DNA, 19 bp, Homo sapiens
ttgtattgtatattacaat

SEQ ID NO: 4385169 - DNA, 18 bp, Homo sapiens
ttgtattgttagatgttt

SEQ ID NO: 4385170 - DNA, 18 bp, Homo sapiens
ttgtattgttgaaaaagt

SEQ ID NO: 4385171 - DNA, 19 bp, Homo sapiens
ttgtattgtttctacaata

SEQ ID NO: 4385172 - DNA, 17 bp, Homo sapiens
ttgtatttaacagaaat

SEQ ID NO: 4385173 - DNA, 22 bp, Homo sapiens
ttgtatttaacagaaattgtat

SEQ ID NO: 4385174 - DNA, 18 bp, Homo sapiens
ttgtatttcaaatatcta

SEQ ID NO: 4385175 - DNA, 15 bp, Homo sapiens
ttgtatttgtattct

SEQ ID NO: 4385176 - DNA, 14 bp, Homo sapiens
ttgtattttaagat

SEQ ID NO: 4385177 - DNA, 20 bp, Homo sapiens
ttgtcaaagaagcttccaca

SEQ ID NO: 4385178 - DNA, 21 bp, Homo sapiens
ttgtcaacaaagtgctttttc

SEQ ID NO: 4385179 - DNA, 19 bp, Homo sapiens
ttgtcaatagtattaacta

SEQ ID NO: 4385180 - DNA, 16 bp, Homo sapiens
ttgtcacaacaattaa

SEQ ID NO: 4385181 - DNA, 13 bp, Homo sapiens
ttgtcacttctgc

SEQ ID NO: 4385182 - DNA, 14 bp, Homo sapiens
ttgtcacttctgct

SEQ ID NO: 4385183 - DNA, 14 bp, Homo sapiens
ttgtcactttttct

SEQ ID NO: 4385184 - DNA, 17 bp, Homo sapiens
ttgtcacttttttataa

SEQ ID NO: 4385185 - DNA, 21 bp, Homo sapiens
ttgtcagccatcgtcctggga

SEQ ID NO: 4385186 - DNA, 17 bp, Homo sapiens
ttgtcagtttatcttaa

SEQ ID NO: 4385187 - DNA, 13 bp, Homo sapiens
ttgtcatatgtag

SEQ ID NO: 4385188 - DNA, 21 bp, Homo sapiens
ttgtccaaagttacctggaat

SEQ ID NO: 4385189 - DNA, 22 bp, Homo sapiens
ttgtccaccatgctctctcacc

SEQ ID NO: 4385190 - DNA, 17 bp, Homo sapiens
ttgtcccagaattttct

SEQ ID NO: 4385191 - DNA, 15 bp, Homo sapiens
ttgtccccagagaca

SEQ ID NO: 4385192 - DNA, 21 bp, Homo sapiens
ttgtcggccccaccagtgcct

SEQ ID NO: 4385193 - DNA, 17 bp, Homo sapiens
ttgtcgtaaagatttgg

SEQ ID NO: 4385194 - DNA, 22 bp, Homo sapiens
ttgtctacgggggcacttggag

SEQ ID NO: 4385195 - DNA, 19 bp, Homo sapiens
ttgtctactcctagaagaa

SEQ ID NO: 4385196 - DNA, 18 bp, Homo sapiens
ttgtctcaacgcctcccc

SEQ ID NO: 4385197 - DNA, 18 bp, Homo sapiens
ttgtctcattttaatgta

SEQ ID NO: 4385198 - DNA, 15 bp, Homo sapiens
ttgtctctcttcaga

SEQ ID NO: 4385199 - DNA, 17 bp, Homo sapiens
ttgtctgaaacatttca

SEQ ID NO: 4385200 - DNA, 21 bp, Homo sapiens
ttgtctgtgatctctgctggg

SEQ ID NO: 4385201 - DNA, 17 bp, Homo sapiens
ttgtcttaaaaaatgtg

SEQ ID NO: 4385202 - DNA, 17 bp, Homo sapiens
ttgtcttgaaaactgtg

SEQ ID NO: 4385203 - DNA, 13 bp, Homo sapiens
ttgtctttatatg

SEQ ID NO: 4385204 - DNA, 13 bp, Homo sapiens
ttgtctttcctta

SEQ ID NO: 4385205 - DNA, 22 bp, Homo sapiens
ttgtctttttttattactagtg

SEQ ID NO: 4385206 - DNA, 23 bp, Homo sapiens
ttgtgaaaatgaatatcatgcaa

SEQ ID NO: 4385207 - DNA, 17 bp, Homo sapiens
ttgtgaaagtgtaatgt

SEQ ID NO: 4385208 - DNA, 19 bp, Homo sapiens
ttgtgaactggaagaaagc

SEQ ID NO: 4385209 - DNA, 22 bp, Homo sapiens
ttgtgaagccatgagttccaga

SEQ ID NO: 4385210 - DNA, 17 bp, Homo sapiens
ttgtgaatatttggaat

SEQ ID NO: 4385211 - DNA, 19 bp, Homo sapiens
ttgtgaattaggctgtaac

SEQ ID NO: 4385212 - DNA, 23 bp, Homo sapiens
ttgtgaattaggctgtaactact

SEQ ID NO: 4385213 - DNA, 21 bp, Homo sapiens
ttgtgacaggaaagccctccc

SEQ ID NO: 4385214 - DNA, 15 bp, Homo sapiens
ttgtgacttacaatt

SEQ ID NO: 4385215 - DNA, 15 bp, Homo sapiens
ttgtgacttcactgt

SEQ ID NO: 4385216 - DNA, 17 bp, Homo sapiens
ttgtgagcatcagaggg

SEQ ID NO: 4385217 - DNA, 20 bp, Homo sapiens
ttgtgaggcttctaataaag

SEQ ID NO: 4385218 - DNA, 21 bp, Homo sapiens
ttgtgcaaaatatttgactat

SEQ ID NO: 4385219 - DNA, 19 bp, Homo sapiens
ttgtgcaaaatgtgtttca

SEQ ID NO: 4385220 - DNA, 19 bp, Homo sapiens
ttgtgcaaaggataaattt

SEQ ID NO: 4385221 - DNA, 18 bp, Homo sapiens
ttgtgcaatgtaaatatt

SEQ ID NO: 4385222 - DNA, 18 bp, Homo sapiens
ttgtgcacatttatttcc

SEQ ID NO: 4385223 - DNA, 14 bp, Homo sapiens
ttgtgcataatgct

SEQ ID NO: 4385224 - DNA, 16 bp, Homo sapiens
ttgtgccaactgccag

SEQ ID NO: 4385225 - DNA, 22 bp, Homo sapiens
ttgtgccaactgccaggctgcc

SEQ ID NO: 4385226 - DNA, 12 bp, Homo sapiens
ttgtgcccctgc

SEQ ID NO: 4385227 - DNA, 10 bp, Homo sapiens
ttgtgccttt

SEQ ID NO: 4385228 - DNA, 14 bp, Homo sapiens
ttgtgcctttggcc

SEQ ID NO: 4385229 - DNA, 14 bp, Homo sapiens
ttgtgctatagtat

SEQ ID NO: 4385230 - DNA, 17 bp, Homo sapiens
ttgtgctgtgggcagca

SEQ ID NO: 4385231 - DNA, 21 bp, Homo sapiens
ttgtgctgtgggcagcaccct

SEQ ID NO: 4385232 - DNA, 11 bp, Homo sapiens
ttgtgcttctc

SEQ ID NO: 4385233 - DNA, 12 bp, Homo sapiens
ttgtgcttctcc

SEQ ID NO: 4385234 - DNA, 17 bp, Homo sapiens
ttgtgcttctccccaga

SEQ ID NO: 4385235 - DNA, 18 bp, Homo sapiens
ttgtgcttctccccagaa

SEQ ID NO: 4385236 - DNA, 13 bp, Homo sapiens
ttgtgcttcttca

SEQ ID NO: 4385237 - DNA, 14 bp, Homo sapiens
ttgtgcttgtttac

SEQ ID NO: 4385238 - DNA, 15 bp, Homo sapiens
ttgtgctttttctcc

SEQ ID NO: 4385239 - DNA, 21 bp, Homo sapiens
ttgtggaagcatgtagactgt

SEQ ID NO: 4385240 - DNA, 18 bp, Homo sapiens
ttgtggaatgttggataa

SEQ ID NO: 4385241 - DNA, 13 bp, Homo sapiens
ttgtggcctcaga

SEQ ID NO: 4385242 - DNA, 19 bp, Homo sapiens
ttgtggctcctatctgtgt

SEQ ID NO: 4385243 - DNA, 14 bp, Homo sapiens
ttgtggtggtgcta

SEQ ID NO: 4385244 - DNA, 24 bp, Homo sapiens
ttgtggtggtgctaaaggaggcca

SEQ ID NO: 4385245 - DNA, 14 bp, Homo sapiens
ttgtgtaataaagt

SEQ ID NO: 4385246 - DNA, 22 bp, Homo sapiens
ttgtgtaataaagtgttttcag

SEQ ID NO: 4385247 - DNA, 18 bp, Homo sapiens
ttgtgtagatttgaaaat

SEQ ID NO: 4385248 - DNA, 14 bp, Homo sapiens
ttgtgtatatatct

SEQ ID NO: 4385249 - DNA, 15 bp, Homo sapiens
ttgtgtatatatctt

SEQ ID NO: 4385250 - DNA, 24 bp, Homo sapiens
ttgtgtatatatcttataactgtt

SEQ ID NO: 4385251 - DNA, 16 bp, Homo sapiens
ttgtgtatattacacc

SEQ ID NO: 4385252 - DNA, 12 bp, Homo sapiens
ttgtgtatctgt

SEQ ID NO: 4385253 - DNA, 17 bp, Homo sapiens
ttgtgtattaaatggtt

SEQ ID NO: 4385254 - DNA, 11 bp, Homo sapiens
ttgtgtattga

SEQ ID NO: 4385255 - DNA, 19 bp, Homo sapiens
ttgtgtatttacgctttga

SEQ ID NO: 4385256 - DNA, 16 bp, Homo sapiens
ttgtgtccctaatgtg

SEQ ID NO: 4385257 - DNA, 23 bp, Homo sapiens
ttgtgtccctggaaccttctaga

SEQ ID NO: 4385258 - DNA, 14 bp, Homo sapiens
ttgtgtggcccagc

SEQ ID NO: 4385259 - DNA, 15 bp, Homo sapiens
ttgtgtggtattcaa

SEQ ID NO: 4385260 - DNA, 16 bp, Homo sapiens
ttgtgtgtatatgtat

SEQ ID NO: 4385261 - DNA, 12 bp, Homo sapiens
ttgtgtgtttca

SEQ ID NO: 4385262 - DNA, 14 bp, Homo sapiens
ttgtgttccttttt

SEQ ID NO: 4385263 - DNA, 17 bp, Homo sapiens
ttgtgttgaaggaactt

SEQ ID NO: 4385264 - DNA, 17 bp, Homo sapiens
ttgtgttgcactgaaca

SEQ ID NO: 4385265 - DNA, 18 bp, Homo sapiens
ttgtgtttagctaccttt

SEQ ID NO: 4385266 - DNA, 13 bp, Homo sapiens
ttgtgtttatgaa

SEQ ID NO: 4385267 - DNA, 17 bp, Homo sapiens
ttgtgttttactgtcag

SEQ ID NO: 4385268 - DNA, 21 bp, Homo sapiens
ttgtgttttactgtcagatta

SEQ ID NO: 4385269 - DNA, 17 bp, Homo sapiens
ttgtgttttttaagata

SEQ ID NO: 4385270 - DNA, 21 bp, Homo sapiens
ttgtgttttttaagatagtgt

SEQ ID NO: 4385271 - DNA, 23 bp, Homo sapiens
ttgttaaaaaaaaaaagattgta

SEQ ID NO: 4385272 - DNA, 15 bp, Homo sapiens
ttgttaaaaatgtca

SEQ ID NO: 4385273 - DNA, 19 bp, Homo sapiens
ttgttaacagtatttctct

SEQ ID NO: 4385274 - DNA, 19 bp, Homo sapiens
ttgttaataaaagtacatg

SEQ ID NO: 4385275 - DNA, 18 bp, Homo sapiens
ttgttaatatcactcatt

SEQ ID NO: 4385276 - DNA, 14 bp, Homo sapiens
ttgttaatgcattg

SEQ ID NO: 4385277 - DNA, 16 bp, Homo sapiens
ttgttaatgcattgtt

SEQ ID NO: 4385278 - DNA, 20 bp, Homo sapiens
tttaaatgactgaagtgcta

SEQ ID NO: 4385279 - DNA, 13 bp, Homo sapiens
tttaaatgccaaa

SEQ ID NO: 4385280 - DNA, 12 bp, Homo sapiens
tttaaatgtata

SEQ ID NO: 4385281 - DNA, 16 bp, Homo sapiens
tttaaatgtattttac

SEQ ID NO: 4385282 - DNA, 20 bp, Homo sapiens
tttaaattaatatctttctg

SEQ ID NO: 4385283 - DNA, 22 bp, Homo sapiens
tttaaattacctttacatatat

SEQ ID NO: 4385284 - DNA, 16 bp, Homo sapiens
tttaaattataaggac

SEQ ID NO: 4385285 - DNA, 17 bp, Homo sapiens
tttaaattataaggact

SEQ ID NO: 4385286 - DNA, 18 bp, Homo sapiens
tttaaattataaggactg

SEQ ID NO: 4385287 - DNA, 12 bp, Homo sapiens
tttaaattatat

SEQ ID NO: 4385288 - DNA, 12 bp, Homo sapiens
tttaaattgtgt

SEQ ID NO: 4385289 - DNA, 14 bp, Homo sapiens
tttaaatttaagta

SEQ ID NO: 4385290 - DNA, 13 bp, Homo sapiens
tttaaatttcttt

SEQ ID NO: 4385291 - DNA, 11 bp, Homo sapiens
tttaaatttgg

SEQ ID NO: 4385292 - DNA, 22 bp, Homo sapiens
tttaaattttatgtcatagaaa

SEQ ID NO: 4385293 - DNA, 16 bp, Homo sapiens
tttaacaaaaaatgta

SEQ ID NO: 4385294 - DNA, 16 bp, Homo sapiens
tttaacaatctaacaa

SEQ ID NO: 4385295 - DNA, 19 bp, Homo sapiens
tttaacactttttgtgaat

SEQ ID NO: 4385296 - DNA, 22 bp, Homo sapiens
tttaacagtatccccttctcat

SEQ ID NO: 4385297 - DNA, 14 bp, Homo sapiens
tttaacattttaca

SEQ ID NO: 4385298 - DNA, 20 bp, Homo sapiens
tttaacattttacagtaaat

SEQ ID NO: 4385299 - DNA, 15 bp, Homo sapiens
tttaaccatctgata

SEQ ID NO: 4385300 - DNA, 15 bp, Homo sapiens
tttaacctatgataa

SEQ ID NO: 4385301 - DNA, 14 bp, Homo sapiens
tttaaccttaaaat

SEQ ID NO: 4385302 - DNA, 17 bp, Homo sapiens
tttaactaaattttaaa

SEQ ID NO: 4385303 - DNA, 17 bp, Homo sapiens
tttaactacatctgcct

SEQ ID NO: 4385304 - DNA, 17 bp, Homo sapiens
tttaactacccttaatt

SEQ ID NO: 4385305 - DNA, 17 bp, Homo sapiens
tttaactctactgtgta

SEQ ID NO: 4385306 - DNA, 20 bp, Homo sapiens
tttaactgatttaacacttt

SEQ ID NO: 4385307 - DNA, 17 bp, Homo sapiens
tttaactggcatgtcat

SEQ ID NO: 4385308 - DNA, 19 bp, Homo sapiens
tttaactggcatgtcattt

SEQ ID NO: 4385309 - DNA, 22 bp, Homo sapiens
tttaactggcatgtcatttgca

SEQ ID NO: 4385310 - DNA, 22 bp, Homo sapiens
tttaactggtgcactttgtaaa

SEQ ID NO: 4385311 - DNA, 12 bp, Homo sapiens
tttaactgtgga

SEQ ID NO: 4385312 - DNA, 13 bp, Homo sapiens
tttaactgtggat

SEQ ID NO: 4385313 - DNA, 15 bp, Homo sapiens
tttaactgtggatat

SEQ ID NO: 4385314 - DNA, 14 bp, Homo sapiens
tttaactttaccat

SEQ ID NO: 4385315 - DNA, 23 bp, Homo sapiens
tttaactttaccatgctcaatga

SEQ ID NO: 4385316 - DNA, 17 bp, Homo sapiens
tttaacttttttttctc

SEQ ID NO: 4385317 - DNA, 12 bp, Homo sapiens
tttaagcaaata

SEQ ID NO: 4385318 - DNA, 18 bp, Homo sapiens
tttaagcataatctgaaa

SEQ ID NO: 4385319 - DNA, 17 bp, Homo sapiens
tttaagcttaacatttc

SEQ ID NO: 4385320 - DNA, 17 bp, Homo sapiens
tttaaggaaagtagcaa

SEQ ID NO: 4385321 - DNA, 23 bp, Homo sapiens
tttaagtagtgggcatttcatag

SEQ ID NO: 4385322 - DNA, 23 bp, Homo sapiens
tttaagtatacaggaggatgtga

SEQ ID NO: 4385323 - DNA, 17 bp, Homo sapiens
tttaagtatcttgtgct

SEQ ID NO: 4385324 - DNA, 13 bp, Homo sapiens
tttaagtcatttt

SEQ ID NO: 4385325 - DNA, 17 bp, Homo sapiens
tttaagtgaaaatggtc

SEQ ID NO: 4385326 - DNA, 21 bp, Homo sapiens
tttaagtgacataattgtcca

SEQ ID NO: 4385327 - DNA, 22 bp, Homo sapiens
tttaagttgagcgtgcgcactg

SEQ ID NO: 4385328 - DNA, 20 bp, Homo sapiens
tttaagttgtcaaagaagct

SEQ ID NO: 4385329 - DNA, 13 bp, Homo sapiens
tttaataaaccat

SEQ ID NO: 4385330 - DNA, 14 bp, Homo sapiens
tttaataaactact

SEQ ID NO: 4385331 - DNA, 20 bp, Homo sapiens
tttaataaactactctttga

SEQ ID NO: 4385332 - DNA, 13 bp, Homo sapiens
tttaataagtaat

SEQ ID NO: 4385333 - DNA, 17 bp, Homo sapiens
tttaatacaggaaattg

SEQ ID NO: 4385334 - DNA, 20 bp, Homo sapiens
tttaataccacaaacactgt

SEQ ID NO: 4385335 - DNA, 22 bp, Homo sapiens
tttaataccacaaacactgtgg

SEQ ID NO: 4385336 - DNA, 17 bp, Homo sapiens
tttaatagaaccatgtt

SEQ ID NO: 4385337 - DNA, 12 bp, Homo sapiens
tttaatagcact

SEQ ID NO: 4385338 - DNA, 12 bp, Homo sapiens
tttaatataaac

SEQ ID NO: 4385339 - DNA, 17 bp, Homo sapiens
tttaatatgagcttcaa

SEQ ID NO: 4385340 - DNA, 12 bp, Homo sapiens
tttaatcactta

SEQ ID NO: 4385341 - DNA, 21 bp, Homo sapiens
tttaatcacttaacattccta

SEQ ID NO: 4385342 - DNA, 16 bp, Homo sapiens
tttaatccttctttgt

SEQ ID NO: 4385343 - DNA, 17 bp, Homo sapiens
tttaatcgtttttgttt

SEQ ID NO: 4385344 - DNA, 17 bp, Homo sapiens
tttaatctttgtgacag

SEQ ID NO: 4385345 - DNA, 17 bp, Homo sapiens
tttaatggattgttaat

SEQ ID NO: 4385346 - DNA, 20 bp, Homo sapiens
tttaatggattgttaatttc

SEQ ID NO: 4385347 - DNA, 23 bp, Homo sapiens
tttaatggattgttaatttcagt

SEQ ID NO: 4385348 - DNA, 19 bp, Homo sapiens
tttaatggcagcagaaaac

SEQ ID NO: 4385349 - DNA, 21 bp, Homo sapiens
tttaatggcagcagaaaactt

SEQ ID NO: 4385350 - DNA, 15 bp, Homo sapiens
tttaatgtaaagatt

SEQ ID NO: 4385351 - DNA, 18 bp, Homo sapiens
tttaatgtatagtaaatc

SEQ ID NO: 4385352 - DNA, 20 bp, Homo sapiens
tttaatgtatagtaaatcac

SEQ ID NO: 4385353 - DNA, 15 bp, Homo sapiens
tttaatgtgctctgt

SEQ ID NO: 4385354 - DNA, 15 bp, Homo sapiens
tttaatgttttaaat

SEQ ID NO: 4385355 - DNA, 14 bp, Homo sapiens
tttaattataaaaa

SEQ ID NO: 4385356 - DNA, 23 bp, Homo sapiens
tttaattataaaaaattaactta

SEQ ID NO: 4385357 - DNA, 18 bp, Homo sapiens
tttaattatttaagattt

SEQ ID NO: 4385358 - DNA, 16 bp, Homo sapiens
tttaattgcatttaaa

SEQ ID NO: 4385359 - DNA, 14 bp, Homo sapiens
tttaattgctttga

SEQ ID NO: 4385360 - DNA, 12 bp, Homo sapiens
tttaatttcatg

SEQ ID NO: 4385361 - DNA, 14 bp, Homo sapiens
tttaattttaaaga

SEQ ID NO: 4385362 - DNA, 15 bp, Homo sapiens
tttaattttgacact

SEQ ID NO: 4385363 - DNA, 14 bp, Homo sapiens
tttaattttttact

SEQ ID NO: 4385364 - DNA, 22 bp, Homo sapiens
tttacaagaaaacaatggggct

SEQ ID NO: 4385365 - DNA, 14 bp, Homo sapiens
tttacaataaagaa

SEQ ID NO: 4385366 - DNA, 15 bp, Homo sapiens
tttacaataaagaat

SEQ ID NO: 4385367 - DNA, 15 bp, Homo sapiens
tttacaatgtattaa

SEQ ID NO: 4385368 - DNA, 19 bp, Homo sapiens
tttacaattttttatcatg

SEQ ID NO: 4385369 - DNA, 21 bp, Homo sapiens
tttacacagtgagactgtaca

SEQ ID NO: 4385370 - DNA, 23 bp, Homo sapiens
tttacacagtgagactgtacata

SEQ ID NO: 4385371 - DNA, 23 bp, Homo sapiens
tttacaccaatttggtaaaaatg

SEQ ID NO: 4385372 - DNA, 19 bp, Homo sapiens
tttacactctgtattgaaa

SEQ ID NO: 4385373 - DNA, 15 bp, Homo sapiens
tttacacttttgaga

SEQ ID NO: 4385374 - DNA, 22 bp, Homo sapiens
tttacagccagtgggagatgtt

SEQ ID NO: 4385375 - DNA, 23 bp, Homo sapiens
tttacagccagtgggagatgtta

SEQ ID NO: 4385376 - DNA, 23 bp, Homo sapiens
tttacagctgcctttcgtgatct

SEQ ID NO: 4385377 - DNA, 16 bp, Homo sapiens
tttacagtaaatgtta

SEQ ID NO: 4385378 - DNA, 20 bp, Homo sapiens
tttacagtgaagaaagcctg

SEQ ID NO: 4385379 - DNA, 17 bp, Homo sapiens
tttacatctaagaattt

SEQ ID NO: 4385380 - DNA, 12 bp, Homo sapiens
tttacatgtttt

SEQ ID NO: 4385381 - DNA, 12 bp, Homo sapiens
tttacattttaa

SEQ ID NO: 4385382 - DNA, 13 bp, Homo sapiens
tttaccaaagcat

SEQ ID NO: 4385383 - DNA, 14 bp, Homo sapiens
tttaccaaagcatc

SEQ ID NO: 4385384 - DNA, 16 bp, Homo sapiens
tttaccacttgctgca

SEQ ID NO: 4385385 - DNA, 19 bp, Homo sapiens
tttaccagcttttaaccat

SEQ ID NO: 4385386 - DNA, 14 bp, Homo sapiens
tttaccatctgaaa

SEQ ID NO: 4385387 - DNA, 17 bp, Homo sapiens
tttacccagtgggacag

SEQ ID NO: 4385388 - DNA, 22 bp, Homo sapiens
tttacccagtgggacagaggag

SEQ ID NO: 4385389 - DNA, 13 bp, Homo sapiens
tttacccttttcc

SEQ ID NO: 4385390 - DNA, 18 bp, Homo sapiens
tttacccttttccccctt

SEQ ID NO: 4385391 - DNA, 22 bp, Homo sapiens
tttacccttttcccccttccca

SEQ ID NO: 4385392 - DNA, 15 bp, Homo sapiens
tttacctaagattac

SEQ ID NO: 4385393 - DNA, 13 bp, Homo sapiens
tttacctataaaa

SEQ ID NO: 4385394 - DNA, 19 bp, Homo sapiens
tttacctctctgtcatgtg

SEQ ID NO: 4385395 - DNA, 16 bp, Homo sapiens
tttaccttcaaacttt

SEQ ID NO: 4385396 - DNA, 14 bp, Homo sapiens
tttacgttcatcac

SEQ ID NO: 4385397 - DNA, 15 bp, Homo sapiens
tttatctttgtattc

SEQ ID NO: 4385398 - DNA, 12 bp, Homo sapiens
tttatcttttta

SEQ ID NO: 4385399 - DNA, 16 bp, Homo sapiens
tttatctttttacctt

SEQ ID NO: 4385400 - DNA, 15 bp, Homo sapiens
tttatgaacattgta

SEQ ID NO: 4385401 - DNA, 13 bp, Homo sapiens
tttatgaagtttt

SEQ ID NO: 4385402 - DNA, 17 bp, Homo sapiens
tttatgagtctttgaga

SEQ ID NO: 4385403 - DNA, 15 bp, Homo sapiens
tttatgatgatacag

SEQ ID NO: 4385404 - DNA, 20 bp, Homo sapiens
tttatgatggagcaactgaa

SEQ ID NO: 4385405 - DNA, 14 bp, Homo sapiens
tttatgattttcat

SEQ ID NO: 4385406 - DNA, 14 bp, Homo sapiens
tttatgcagcaaat

SEQ ID NO: 4385407 - DNA, 14 bp, Homo sapiens
tttatgccacctga

SEQ ID NO: 4385408 - DNA, 23 bp, Homo sapiens
tttatgctcttgaaatattcaga

SEQ ID NO: 4385409 - DNA, 13 bp, Homo sapiens
tttatggcctcag

SEQ ID NO: 4385410 - DNA, 22 bp, Homo sapiens
tttatggcctcagctgcctcac

SEQ ID NO: 4385411 - DNA, 12 bp, Homo sapiens
tttatgggagaa

SEQ ID NO: 4385412 - DNA, 21 bp, Homo sapiens
tttatggtaactgctttctgt

SEQ ID NO: 4385413 - DNA, 21 bp, Homo sapiens
tttatggtcctaaaagcaaaa

SEQ ID NO: 4385414 - DNA, 20 bp, Homo sapiens
tttatggtgatgtcactcac

SEQ ID NO: 4385415 - DNA, 17 bp, Homo sapiens
tttatggttaatactat

SEQ ID NO: 4385416 - DNA, 12 bp, Homo sapiens
tttatgtaatag

SEQ ID NO: 4385417 - DNA, 13 bp, Homo sapiens
tttatgtaatgaa

SEQ ID NO: 4385418 - DNA, 20 bp, Homo sapiens
tttatgtaatgaagtaaagc

SEQ ID NO: 4385419 - DNA, 14 bp, Homo sapiens
tttatgtaatttct

SEQ ID NO: 4385420 - DNA, 18 bp, Homo sapiens
tttatgtattttaaaata

SEQ ID NO: 4385421 - DNA, 17 bp, Homo sapiens
tttatgtcatagaaata

SEQ ID NO: 4385422 - DNA, 22 bp, Homo sapiens
tttatgtgaaatgctttctgta

SEQ ID NO: 4385423 - DNA, 13 bp, Homo sapiens
tttatgtgctata

SEQ ID NO: 4385424 - DNA, 17 bp, Homo sapiens
tttatgtgtagttgtct

SEQ ID NO: 4385425 - DNA, 13 bp, Homo sapiens
tttatgtgtgtgt

SEQ ID NO: 4385426 - DNA, 12 bp, Homo sapiens
tttatgttcctt

SEQ ID NO: 4385427 - DNA, 18 bp, Homo sapiens
tttattaaacttcagcaa

SEQ ID NO: 4385428 - DNA, 13 bp, Homo sapiens
tttattaaagatg

SEQ ID NO: 4385429 - DNA, 12 bp, Homo sapiens
tttattaatata

SEQ ID NO: 4385430 - DNA, 17 bp, Homo sapiens
tttattaatgcactttc

SEQ ID NO: 4385431 - DNA, 15 bp, Homo sapiens
tttattacaaatgca

SEQ ID NO: 4385432 - DNA, 11 bp, Homo sapiens
tttattacaat

SEQ ID NO: 4385433 - DNA, 23 bp, Homo sapiens
tttattacaatgtatctttatta

SEQ ID NO: 4385434 - DNA, 12 bp, Homo sapiens
tttattaccagt

SEQ ID NO: 4385435 - DNA, 14 bp, Homo sapiens
tttattactagtgt

SEQ ID NO: 4385436 - DNA, 21 bp, Homo sapiens
tttattagtggtgtatatggt

SEQ ID NO: 4385437 - DNA, 14 bp, Homo sapiens
tttattataaaatg

SEQ ID NO: 4385438 - DNA, 20 bp, Homo sapiens
tttattatatatttacagaa

SEQ ID NO: 4385439 - DNA, 17 bp, Homo sapiens
tttattatgcattatat

SEQ ID NO: 4385440 - DNA, 20 bp, Homo sapiens
tttattcagctagaatttct

SEQ ID NO: 4385441 - DNA, 22 bp, Homo sapiens
tttattccctgcccaaaccctt

SEQ ID NO: 4385442 - DNA, 18 bp, Homo sapiens
tttattctatgtatgtta

SEQ ID NO: 4385443 - DNA, 20 bp, Homo sapiens
tttattctcaggtaatcatt

SEQ ID NO: 4385444 - DNA, 21 bp, Homo sapiens
tttattctcaggtaatcattt

SEQ ID NO: 4385445 - DNA, 22 bp, Homo sapiens
tttattgaatactgtctgtatc

SEQ ID NO: 4385446 - DNA, 14 bp, Homo sapiens
tttattgacacaga

SEQ ID NO: 4385447 - DNA, 14 bp, Homo sapiens
tttattgagcatct

SEQ ID NO: 4385448 - DNA, 21 bp, Homo sapiens
tttattgatgcagtgtgtctt

SEQ ID NO: 4385449 - DNA, 19 bp, Homo sapiens
tttattgattaaaaatgtg

SEQ ID NO: 4385450 - DNA, 13 bp, Homo sapiens
tttattgccttct

SEQ ID NO: 4385451 - DNA, 22 bp, Homo sapiens
tttattgccttctcaccagctg

SEQ ID NO: 4385452 - DNA, 16 bp, Homo sapiens
tttattggctgagata

SEQ ID NO: 4385453 - DNA, 15 bp, Homo sapiens
tttattggttttgca

SEQ ID NO: 4385454 - DNA, 14 bp, Homo sapiens
tttattgtctgtaa

SEQ ID NO: 4385455 - DNA, 19 bp, Homo sapiens
tttattgtctgtctacatt

SEQ ID NO: 4385456 - DNA, 19 bp, Homo sapiens
tttatttaaattacaattt

SEQ ID NO: 4385457 - DNA, 12 bp, Homo sapiens
tttatttacttc

SEQ ID NO: 4385458 - DNA, 19 bp, Homo sapiens
tttatttagtttttaacaa

SEQ ID NO: 4385459 - DNA, 14 bp, Homo sapiens
tttatttatatctt

SEQ ID NO: 4385460 - DNA, 12 bp, Homo sapiens
tttatttccact

SEQ ID NO: 4385461 - DNA, 11 bp, Homo sapiens
tttatttctgt

SEQ ID NO: 4385462 - DNA, 19 bp, Homo sapiens
tttatttcttttagaaaag

SEQ ID NO: 4385463 - DNA, 12 bp, Homo sapiens
tttatttgcaaa

SEQ ID NO: 4385464 - DNA, 11 bp, Homo sapiens
tttatttgcat

SEQ ID NO: 4385465 - DNA, 13 bp, Homo sapiens
tttattttagcaa

SEQ ID NO: 4385466 - DNA, 23 bp, Homo sapiens
tttattttagcagttctgcaaat

SEQ ID NO: 4385467 - DNA, 19 bp, Homo sapiens
tttattttcattctgccaa

SEQ ID NO: 4385468 - DNA, 17 bp, Homo sapiens
tttatttttcatttagt

SEQ ID NO: 4385469 - DNA, 15 bp, Homo sapiens
tttatttttctgtta

SEQ ID NO: 4385470 - DNA, 15 bp, Homo sapiens
tttatttttgtgtag

SEQ ID NO: 4385471 - DNA, 14 bp, Homo sapiens
tttcaaaagcaaac

SEQ ID NO: 4385472 - DNA, 21 bp, Homo sapiens
tttcaaaagccttaccttgaa

SEQ ID NO: 4385473 - DNA, 19 bp, Homo sapiens
tttcaaaatagaaaagtta

SEQ ID NO: 4385474 - DNA, 12 bp, Homo sapiens
tttcaaaatgct

SEQ ID NO: 4385475 - DNA, 13 bp, Homo sapiens
tttcaaaatgctt

SEQ ID NO: 4385476 - DNA, 16 bp, Homo sapiens
tttcaaacaagaaaca

SEQ ID NO: 4385477 - DNA, 22 bp, Homo sapiens
tttcaaactccaaggttccctt

SEQ ID NO: 4385478 - DNA, 16 bp, Homo sapiens
tttcaaacttttgaaa

SEQ ID NO: 4385479 - DNA, 22 bp, Homo sapiens
tttcaaacttttgaaagatgta

SEQ ID NO: 4385480 - DNA, 23 bp, Homo sapiens
tttcaaataatgcttttctaatt

SEQ ID NO: 4385481 - DNA, 19 bp, Homo sapiens
tttcaaatagggtctaact

SEQ ID NO: 4385482 - DNA, 12 bp, Homo sapiens
tttcaaatcctt

SEQ ID NO: 4385483 - DNA, 14 bp, Homo sapiens
tttcaaatccttat

SEQ ID NO: 4385484 - DNA, 15 bp, Homo sapiens
tttcaaatctgtaat

SEQ ID NO: 4385485 - DNA, 21 bp, Homo sapiens
tttcaaatctgtaattaccat

SEQ ID NO: 4385486 - DNA, 12 bp, Homo sapiens
tttcaaatgtgc

SEQ ID NO: 4385487 - DNA, 17 bp, Homo sapiens
tttcaaatgtgcaattt

SEQ ID NO: 4385488 - DNA, 14 bp, Homo sapiens
tttcaaatttagaa

SEQ ID NO: 4385489 - DNA, 21 bp, Homo sapiens
tttcaacatttttttttctcc

SEQ ID NO: 4385490 - DNA, 13 bp, Homo sapiens
tttcaagaatatg

SEQ ID NO: 4385491 - DNA, 16 bp, Homo sapiens
tttcaagacagatgag

SEQ ID NO: 4385492 - DNA, 20 bp, Homo sapiens
tttcaagcagcatcttctgg

SEQ ID NO: 4385493 - DNA, 13 bp, Homo sapiens
tttcaagtgccta

SEQ ID NO: 4385494 - DNA, 15 bp, Homo sapiens
tttcaagtgcctaga

SEQ ID NO: 4385495 - DNA, 19 bp, Homo sapiens
tttcaagtgcctagactgt

SEQ ID NO: 4385496 - DNA, 22 bp, Homo sapiens
tttcaagtgcctagactgttac

SEQ ID NO: 4385497 - DNA, 23 bp, Homo sapiens
tttcaagtgcctagactgttact

SEQ ID NO: 4385498 - DNA, 22 bp, Homo sapiens
tttcaagttccaagttgctaat

SEQ ID NO: 4385499 - DNA, 14 bp, Homo sapiens
tttcaagtttttca

SEQ ID NO: 4385500 - DNA, 19 bp, Homo sapiens
tttcaagtttttcatactg

SEQ ID NO: 4385501 - DNA, 15 bp, Homo sapiens
tttcaataaatcttt

SEQ ID NO: 4385502 - DNA, 20 bp, Homo sapiens
tttcaatagcgtgtgtagat

SEQ ID NO: 4385503 - DNA, 22 bp, Homo sapiens
tttcaatagtggcataccaaat

SEQ ID NO: 4385504 - DNA, 17 bp, Homo sapiens
tttcaatatattgaact

SEQ ID NO: 4385505 - DNA, 19 bp, Homo sapiens
tttcaatatattgaacttt

SEQ ID NO: 4385506 - DNA, 13 bp, Homo sapiens
tttcaatatgcaa

SEQ ID NO: 4385507 - DNA, 20 bp, Homo sapiens
tttcaatgtaattaaactgt

SEQ ID NO: 4385508 - DNA, 19 bp, Homo sapiens
tttcaatgtctaaaaacat

SEQ ID NO: 4385509 - DNA, 14 bp, Homo sapiens
tttcaatgtgtata

SEQ ID NO: 4385510 - DNA, 19 bp, Homo sapiens
tttcaatgtgtataaattg

SEQ ID NO: 4385511 - DNA, 21 bp, Homo sapiens
tttcaatttggagcattaact

SEQ ID NO: 4385512 - DNA, 23 bp, Homo sapiens
tttcacaacagcctgacaacatt

SEQ ID NO: 4385513 - DNA, 23 bp, Homo sapiens
tttcacacaatgcccaacttact

SEQ ID NO: 4385514 - DNA, 17 bp, Homo sapiens
tttcacagaaaataagg

SEQ ID NO: 4385515 - DNA, 17 bp, Homo sapiens
tttcacattaggctgtt

SEQ ID NO: 4385516 - DNA, 22 bp, Homo sapiens
tttcaccatttgattatgtagc

SEQ ID NO: 4385517 - DNA, 22 bp, Homo sapiens
tttcacccctccctttctcccc

SEQ ID NO: 4385518 - DNA, 16 bp, Homo sapiens
tttcaccctcatgaaa

SEQ ID NO: 4385519 - DNA, 13 bp, Homo sapiens
tttcacctgtaaa

SEQ ID NO: 4385520 - DNA, 21 bp, Homo sapiens
tttcaccttttcaggaaaata

SEQ ID NO: 4385521 - DNA, 16 bp, Homo sapiens
tttcacgattcatttt

SEQ ID NO: 4385522 - DNA, 21 bp, Homo sapiens
tttcactgtctttaattctgt

SEQ ID NO: 4385523 - DNA, 13 bp, Homo sapiens
tttcagaaaacat

SEQ ID NO: 4385524 - DNA, 23 bp, Homo sapiens
tttcagaaaacataatatagctt

SEQ ID NO: 4385525 - DNA, 16 bp, Homo sapiens
tttcagaagaaataaa

SEQ ID NO: 4385526 - DNA, 16 bp, Homo sapiens
tttcagaagcaagcca

SEQ ID NO: 4385527 - DNA, 18 bp, Homo sapiens
tttcagaagcaagccaga

SEQ ID NO: 4385528 - DNA, 22 bp, Homo sapiens
tttcagaagcaagccagaccta

SEQ ID NO: 4385529 - DNA, 22 bp, Homo sapiens
tttcagaagttagtttgtatat

SEQ ID NO: 4385530 - DNA, 23 bp, Homo sapiens
tttcagaagttagtttgtatata

SEQ ID NO: 4385531 - DNA, 11 bp, Homo sapiens
tttcagaatct

SEQ ID NO: 4385532 - DNA, 14 bp, Homo sapiens
tttcagaatctgaa

SEQ ID NO: 4385533 - DNA, 20 bp, Homo sapiens
tttcagaatctgaatgtaat

SEQ ID NO: 4385534 - DNA, 23 bp, Homo sapiens
tttcagaatctgaatgtaatttg

SEQ ID NO: 4385535 - DNA, 16 bp, Homo sapiens
tttcagacaaattact

SEQ ID NO: 4385536 - DNA, 19 bp, Homo sapiens
tttcagactgcctgtctgc

SEQ ID NO: 4385537 - DNA, 20 bp, Homo sapiens
tttcagactgcctgtctgct

SEQ ID NO: 4385538 - DNA, 22 bp, Homo sapiens
tttcagactgcctgtctgcttg

SEQ ID NO: 4385539 - DNA, 12 bp, Homo sapiens
tttcagatgagg

SEQ ID NO: 4385540 - DNA, 13 bp, Homo sapiens
tttcagatgaggt

SEQ ID NO: 4385541 - DNA, 15 bp, Homo sapiens
tttcagatgtaatgt

SEQ ID NO: 4385542 - DNA, 12 bp, Homo sapiens
tttcagatgtct

SEQ ID NO: 4385543 - DNA, 16 bp, Homo sapiens
tttcagattttttaaa

SEQ ID NO: 4385544 - DNA, 18 bp, Homo sapiens
tttcagattttttaaaat

SEQ ID NO: 4385545 - DNA, 17 bp, Homo sapiens
tttcagccaaagtccta

SEQ ID NO: 4385546 - DNA, 12 bp, Homo sapiens
tttcagccacat

SEQ ID NO: 4385547 - DNA, 16 bp, Homo sapiens
tttcagctatgcagaa

SEQ ID NO: 4385548 - DNA, 17 bp, Homo sapiens
tttcagctatgcagaaa

SEQ ID NO: 4385549 - DNA, 23 bp, Homo sapiens
tttcaggctactgttcttgacaa

SEQ ID NO: 4385550 - DNA, 16 bp, Homo sapiens
tttcagtactttttta

SEQ ID NO: 4385551 - DNA, 16 bp, Homo sapiens
tttcagtcaaaacttt

SEQ ID NO: 4385552 - DNA, 15 bp, Homo sapiens
tttcataaaaggaga

SEQ ID NO: 4385553 - DNA, 18 bp, Homo sapiens
tttcataaatcatgttgt

SEQ ID NO: 4385554 - DNA, 20 bp, Homo sapiens
tttcataacttattgctgat

SEQ ID NO: 4385555 - DNA, 18 bp, Homo sapiens
tttcataagtatttcaaa

SEQ ID NO: 4385556 - DNA, 14 bp, Homo sapiens
tttcatacacttat

SEQ ID NO: 4385557 - DNA, 15 bp, Homo sapiens
tttcatactgtacac

SEQ ID NO: 4385558 - DNA, 17 bp, Homo sapiens
tttcatactgtacacat

SEQ ID NO: 4385559 - DNA, 19 bp, Homo sapiens
tttcatactgtacacattt

SEQ ID NO: 4385560 - DNA, 23 bp, Homo sapiens
tttcatactgtacacatttctta

SEQ ID NO: 4385561 - DNA, 20 bp, Homo sapiens
tttcatagatttgaaaaact

SEQ ID NO: 4385562 - DNA, 14 bp, Homo sapiens
tttcataggaagac

SEQ ID NO: 4385563 - DNA, 20 bp, Homo sapiens
tttcatagtgacctgtgttt

SEQ ID NO: 4385564 - DNA, 15 bp, Homo sapiens
tttcatagttcagaa

SEQ ID NO: 4385565 - DNA, 18 bp, Homo sapiens
tttcatatctaactttgt

SEQ ID NO: 4385566 - DNA, 21 bp, Homo sapiens
tttcatattattttagtgtgt

SEQ ID NO: 4385567 - DNA, 15 bp, Homo sapiens
tttcatcaagagttt

SEQ ID NO: 4385568 - DNA, 20 bp, Homo sapiens
tttcatcagtaagcagcctt

SEQ ID NO: 4385569 - DNA, 17 bp, Homo sapiens
tttcatcatttcagcca

SEQ ID NO: 4385570 - DNA, 21 bp, Homo sapiens
tttcatcccgtatcacagtgt

SEQ ID NO: 4385571 - DNA, 13 bp, Homo sapiens
tttcatctaaatg

SEQ ID NO: 4385572 - DNA, 17 bp, Homo sapiens
tttcatctaccttttct

SEQ ID NO: 4385573 - DNA, 15 bp, Homo sapiens
tttcatctgctctcc

SEQ ID NO: 4385574 - DNA, 19 bp, Homo sapiens
tttcatctgctctccttcc

SEQ ID NO: 4385575 - DNA, 14 bp, Homo sapiens
tttcatcttaaact

SEQ ID NO: 4385576 - DNA, 19 bp, Homo sapiens
tttcatgtaaactgtgcac

SEQ ID NO: 4385577 - DNA, 18 bp, Homo sapiens
tttcatgtacaagatgaa

SEQ ID NO: 4385578 - DNA, 14 bp, Homo sapiens
tttcatgtatgtat

SEQ ID NO: 4385579 - DNA, 17 bp, Homo sapiens
tttcatgtcttgtcata

SEQ ID NO: 4385580 - DNA, 17 bp, Homo sapiens
tttcattacttgaatgt

SEQ ID NO: 4385581 - DNA, 16 bp, Homo sapiens
tttcattatgctttga

SEQ ID NO: 4385582 - DNA, 12 bp, Homo sapiens
tttcattcacaa

SEQ ID NO: 4385583 - DNA, 12 bp, Homo sapiens
tttcattcatga

SEQ ID NO: 4385584 - DNA, 11 bp, Homo sapiens
tttcattccat

SEQ ID NO: 4385585 - DNA, 16 bp, Homo sapiens
tttcattccattgcct

SEQ ID NO: 4385586 - DNA, 20 bp, Homo sapiens
tttcatttaaatatctgtta

SEQ ID NO: 4385587 - DNA, 13 bp, Homo sapiens
tttcatttacaaa

SEQ ID NO: 4385588 - DNA, 19 bp, Homo sapiens
tttcatttacaaaagattt

SEQ ID NO: 4385589 - DNA, 20 bp, Homo sapiens
tttcatttatctataattta

SEQ ID NO: 4385590 - DNA, 16 bp, Homo sapiens
tttcatttcaaaatgc

SEQ ID NO: 4385591 - DNA, 11 bp, Homo sapiens
tttcatttctt

SEQ ID NO: 4385592 - DNA, 20 bp, Homo sapiens
tttcatttgctgttcatctt

SEQ ID NO: 4385593 - DNA, 14 bp, Homo sapiens
tttcatttgtaaaa

SEQ ID NO: 4385594 - DNA, 13 bp, Homo sapiens
tttcattttactg

SEQ ID NO: 4385595 - DNA, 15 bp, Homo sapiens
tttcatttttttcca

SEQ ID NO: 4385596 - DNA, 20 bp, Homo sapiens
tttcatttttttccaggctg

SEQ ID NO: 4385597 - DNA, 12 bp, Homo sapiens
tttccaaaacat

SEQ ID NO: 4385598 - DNA, 22 bp, Homo sapiens
tttccaaaataatctatattaa

SEQ ID NO: 4385599 - DNA, 16 bp, Homo sapiens
tttccaaactgactca

SEQ ID NO: 4385600 - DNA, 14 bp, Homo sapiens
tttccaaattattt

SEQ ID NO: 4385601 - DNA, 22 bp, Homo sapiens
tttccaaattatttcttaatta

SEQ ID NO: 4385602 - DNA, 13 bp, Homo sapiens
tttccaatagaaa

SEQ ID NO: 4385603 - DNA, 15 bp, Homo sapiens
tttccaatagaaaga

SEQ ID NO: 4385604 - DNA, 14 bp, Homo sapiens
tttccaatgtgttc

SEQ ID NO: 4385605 - DNA, 22 bp, Homo sapiens
tttccacagatttttttgtaag

SEQ ID NO: 4385606 - DNA, 22 bp, Homo sapiens
tttccacataaattttaattca

SEQ ID NO: 4385607 - DNA, 17 bp, Homo sapiens
tttccagcactttgtat

SEQ ID NO: 4385608 - DNA, 22 bp, Homo sapiens
tttccagcatttttataaacta

SEQ ID NO: 4385609 - DNA, 18 bp, Homo sapiens
tttccaggcaccctcagg

SEQ ID NO: 4385610 - DNA, 21 bp, Homo sapiens
tttccagtaaggaatgatatt

SEQ ID NO: 4385611 - DNA, 18 bp, Homo sapiens
tttccagtgttctatttg

SEQ ID NO: 4385612 - DNA, 22 bp, Homo sapiens
tttccataaatttggactgtct

SEQ ID NO: 4385613 - DNA, 14 bp, Homo sapiens
tttccatcaactcc

SEQ ID NO: 4385614 - DNA, 16 bp, Homo sapiens
tttccatcataattct

SEQ ID NO: 4385615 - DNA, 14 bp, Homo sapiens
tttccatcatgtct

SEQ ID NO: 4385616 - DNA, 20 bp, Homo sapiens
tttccatcatgtctgtatac

SEQ ID NO: 4385617 - DNA, 23 bp, Homo sapiens
tttccatgttatgtttctacaca

SEQ ID NO: 4385618 - DNA, 15 bp, Homo sapiens
tttccattagaacaa

SEQ ID NO: 4385619 - DNA, 14 bp, Homo sapiens
tttccatttggcac

SEQ ID NO: 4385620 - DNA, 13 bp, Homo sapiens
tttcccaaaacaa

SEQ ID NO: 4385621 - DNA, 12 bp, Homo sapiens
tttcccaattca

SEQ ID NO: 4385622 - DNA, 15 bp, Homo sapiens
tttcccaattcacat

SEQ ID NO: 4385623 - DNA, 21 bp, Homo sapiens
tttcccactgtttaaggagtt

SEQ ID NO: 4385624 - DNA, 16 bp, Homo sapiens
tttcccagttaaagat

SEQ ID NO: 4385625 - DNA, 16 bp, Homo sapiens
tttcccatcaccagaa

SEQ ID NO: 4385626 - DNA, 16 bp, Homo sapiens
tttcccatgtatttgt

SEQ ID NO: 4385627 - DNA, 19 bp, Homo sapiens
tttccccactaataaagtg

SEQ ID NO: 4385628 - DNA, 22 bp, Homo sapiens
tttccccagaggctcccaatca

SEQ ID NO: 4385629 - DNA, 18 bp, Homo sapiens
tttccccagccacaggcc

SEQ ID NO: 4385630 - DNA, 19 bp, Homo sapiens
tttccccagccacaggcca

SEQ ID NO: 4385631 - DNA, 21 bp, Homo sapiens
tttcccccacagttttaataa

SEQ ID NO: 4385632 - DNA, 23 bp, Homo sapiens
tttccccttggtcccaagcctga

SEQ ID NO: 4385633 - DNA, 13 bp, Homo sapiens
tttccctccccag

SEQ ID NO: 4385634 - DNA, 16 bp, Homo sapiens
tttctggcgcccctgc

SEQ ID NO: 4385635 - DNA, 17 bp, Homo sapiens
tttctggtgccatttct

SEQ ID NO: 4385636 - DNA, 16 bp, Homo sapiens
tttctgtaatgtaaat

SEQ ID NO: 4385637 - DNA, 22 bp, Homo sapiens
tttctgtaatgtaaataaacta

SEQ ID NO: 4385638 - DNA, 19 bp, Homo sapiens
tttctgtaattcaggtttt

SEQ ID NO: 4385639 - DNA, 23 bp, Homo sapiens
tttctgtaattcaggtttttcct

SEQ ID NO: 4385640 - DNA, 14 bp, Homo sapiens
tttctgtaccagtt

SEQ ID NO: 4385641 - DNA, 20 bp, Homo sapiens
tttctgtagactctaagata

SEQ ID NO: 4385642 - DNA, 16 bp, Homo sapiens
tttctgtagttcaatt

SEQ ID NO: 4385643 - DNA, 17 bp, Homo sapiens
tttctgtcagtaaaact

SEQ ID NO: 4385644 - DNA, 14 bp, Homo sapiens
tttctgtcctgtaa

SEQ ID NO: 4385645 - DNA, 12 bp, Homo sapiens
tttctgtgaaag

SEQ ID NO: 4385646 - DNA, 17 bp, Homo sapiens
tttctgtgcctgaatat

SEQ ID NO: 4385647 - DNA, 16 bp, Homo sapiens
tttctgtgcttggatt

SEQ ID NO: 4385648 - DNA, 9 bp, Homo sapiens
tttctgttc

SEQ ID NO: 4385649 - DNA, 14 bp, Homo sapiens
tttctgttccaaat

SEQ ID NO: 4385650 - DNA, 15 bp, Homo sapiens
tttctgttccaaatt

SEQ ID NO: 4385651 - DNA, 22 bp, Homo sapiens
tttctgttccaaattcagtttc

SEQ ID NO: 4385652 - DNA, 12 bp, Homo sapiens
tttctgttttgt

SEQ ID NO: 4385653 - DNA, 12 bp, Homo sapiens
tttcttaaataa

SEQ ID NO: 4385654 - DNA, 21 bp, Homo sapiens
tttcttaaataagaaactttt

SEQ ID NO: 4385655 - DNA, 14 bp, Homo sapiens
tttcttaacttctt

SEQ ID NO: 4385656 - DNA, 21 bp, Homo sapiens
tttcttaattattataaaaat

SEQ ID NO: 4385657 - DNA, 15 bp, Homo sapiens
tttcttatgtgacat

SEQ ID NO: 4385658 - DNA, 14 bp, Homo sapiens
tttcttcaccaagt

SEQ ID NO: 4385659 - DNA, 11 bp, Homo sapiens
tttcttcagca

SEQ ID NO: 4385660 - DNA, 12 bp, Homo sapiens
tttcttcatgag

SEQ ID NO: 4385661 - DNA, 16 bp, Homo sapiens
tttcttcattgtaatc

SEQ ID NO: 4385662 - DNA, 12 bp, Homo sapiens
tttcttcttccc

SEQ ID NO: 4385663 - DNA, 18 bp, Homo sapiens
tttcttgcctctgtcccc

SEQ ID NO: 4385664 - DNA, 14 bp, Homo sapiens
tttcttgccttttg

SEQ ID NO: 4385665 - DNA, 14 bp, Homo sapiens
tttcttgtatctgg

SEQ ID NO: 4385666 - DNA, 19 bp, Homo sapiens
tttctttaaatgtgtattt

SEQ ID NO: 4385667 - DNA, 14 bp, Homo sapiens
tttctttactttct

SEQ ID NO: 4385668 - DNA, 21 bp, Homo sapiens
tttctttagtttttgtgaagt

SEQ ID NO: 4385669 - DNA, 18 bp, Homo sapiens
tttctttatcattgctaa

SEQ ID NO: 4385670 - DNA, 14 bp, Homo sapiens
tttctttccaaaac

SEQ ID NO: 4385671 - DNA, 19 bp, Homo sapiens
tttctttcccatgtatttg

SEQ ID NO: 4385672 - DNA, 14 bp, Homo sapiens
tttctttcttcctc

SEQ ID NO: 4385673 - DNA, 14 bp, Homo sapiens
tttctttgcaaagt

SEQ ID NO: 4385674 - DNA, 20 bp, Homo sapiens
tttctttgcaccaaagacat

SEQ ID NO: 4385675 - DNA, 13 bp, Homo sapiens
tttctttgcctct

SEQ ID NO: 4385676 - DNA, 16 bp, Homo sapiens
tttctttggtgccttt

SEQ ID NO: 4385677 - DNA, 18 bp, Homo sapiens
tttctttgtagaataaat

SEQ ID NO: 4385678 - DNA, 9 bp, Homo sapiens
tttcttttc

SEQ ID NO: 4385679 - DNA, 18 bp, Homo sapiens
tttcttttgaatcaatct

SEQ ID NO: 4385680 - DNA, 21 bp, Homo sapiens
tttcttttgttgtactttata

SEQ ID NO: 4385681 - DNA, 14 bp, Homo sapiens
tttctttttccagt

SEQ ID NO: 4385682 - DNA, 19 bp, Homo sapiens
tttctttttcttcttccct

SEQ ID NO: 4385683 - DNA, 15 bp, Homo sapiens
tttcttttttaaagt

SEQ ID NO: 4385684 - DNA, 18 bp, Homo sapiens
tttcttttttaaattaat

SEQ ID NO: 4385685 - DNA, 14 bp, Homo sapiens
tttctttttttcct

SEQ ID NO: 4385686 - DNA, 17 bp, Homo sapiens
tttctttttttttaagt

SEQ ID NO: 4385687 - DNA, 15 bp, Homo sapiens
tttgaaaaaagctca

SEQ ID NO: 4385688 - DNA, 15 bp, Homo sapiens
tttgaaaaagcgaaa

SEQ ID NO: 4385689 - DNA, 20 bp, Homo sapiens
tttgaaaaagcgaaaaaatc

SEQ ID NO: 4385690 - DNA, 17 bp, Homo sapiens
tttgaaaacatgtttat

SEQ ID NO: 4385691 - DNA, 14 bp, Homo sapiens
tttgaaaagaattt

SEQ ID NO: 4385692 - DNA, 13 bp, Homo sapiens
tttgaaaagcaga

SEQ ID NO: 4385693 - DNA, 18 bp, Homo sapiens
tttgaaaatatgtactgt

SEQ ID NO: 4385694 - DNA, 16 bp, Homo sapiens
tttgaaactaactcat

SEQ ID NO: 4385695 - DNA, 21 bp, Homo sapiens
tttgaaagatgtatggatttc

SEQ ID NO: 4385696 - DNA, 17 bp, Homo sapiens
tttgaaagttgtacatg

SEQ ID NO: 4385697 - DNA, 20 bp, Homo sapiens
tttgaaagttgtacatgata

SEQ ID NO: 4385698 - DNA, 20 bp, Homo sapiens
tttgaaagtttaacaaatga

SEQ ID NO: 4385699 - DNA, 20 bp, Homo sapiens
tttgaaatagtctgtgtgaa

SEQ ID NO: 4385700 - DNA, 20 bp, Homo sapiens
tttgaaatgaggtctgttta

SEQ ID NO: 4385701 - DNA, 15 bp, Homo sapiens
tttgaaattatgtga

SEQ ID NO: 4385702 - DNA, 11 bp, Homo sapiens
tttgaaattct

SEQ ID NO: 4385703 - DNA, 15 bp, Homo sapiens
tttgaaattctgaat

SEQ ID NO: 4385704 - DNA, 17 bp, Homo sapiens
tttgaaattctgaattt

SEQ ID NO: 4385705 - DNA, 20 bp, Homo sapiens
tttgaaattctgaatttgca

SEQ ID NO: 4385706 - DNA, 19 bp, Homo sapiens
tttgaacacgaaagaaatg

SEQ ID NO: 4385707 - DNA, 21 bp, Homo sapiens
tttgaacacgaaagaaatgta

SEQ ID NO: 4385708 - DNA, 15 bp, Homo sapiens
tttgaactcagatct

SEQ ID NO: 4385709 - DNA, 16 bp, Homo sapiens
tttgaactcagatctg

SEQ ID NO: 4385710 - DNA, 13 bp, Homo sapiens
tttgaactttcat

SEQ ID NO: 4385711 - DNA, 17 bp, Homo sapiens
tttgaagaacatgtgag

SEQ ID NO: 4385712 - DNA, 19 bp, Homo sapiens
tttgaagcacaactccctt

SEQ ID NO: 4385713 - DNA, 16 bp, Homo sapiens
tttgaagctactgtgt

SEQ ID NO: 4385714 - DNA, 21 bp, Homo sapiens
tttgaaggaatacaatatata

SEQ ID NO: 4385715 - DNA, 21 bp, Homo sapiens
tttgaaggtagaatgttttca

SEQ ID NO: 4385716 - DNA, 16 bp, Homo sapiens
tttgaagtgctgttta

SEQ ID NO: 4385717 - DNA, 18 bp, Homo sapiens
tttgaataaagaatactt

SEQ ID NO: 4385718 - DNA, 17 bp, Homo sapiens
tttgaataaattatgag

SEQ ID NO: 4385719 - DNA, 21 bp, Homo sapiens
tttgaatatttgttttaatac

SEQ ID NO: 4385720 - DNA, 16 bp, Homo sapiens
tttgaatattttttga

SEQ ID NO: 4385721 - DNA, 19 bp, Homo sapiens
tttgaatcaataatatatt

SEQ ID NO: 4385722 - DNA, 19 bp, Homo sapiens
tttgaatcaatctggcttc

SEQ ID NO: 4385723 - DNA, 12 bp, Homo sapiens
tttgaatgctta

SEQ ID NO: 4385724 - DNA, 19 bp, Homo sapiens
tttgaatgttaattttttg

SEQ ID NO: 4385725 - DNA, 16 bp, Homo sapiens
tttgaattatcagcaa

SEQ ID NO: 4385726 - DNA, 16 bp, Homo sapiens
tttgacaaacacaatt

SEQ ID NO: 4385727 - DNA, 21 bp, Homo sapiens
tttgacacttatagattgaaa

SEQ ID NO: 4385728 - DNA, 14 bp, Homo sapiens
tttgacacttccca

SEQ ID NO: 4385729 - DNA, 16 bp, Homo sapiens
tttgacatggaaatga

SEQ ID NO: 4385730 - DNA, 13 bp, Homo sapiens
tttgaccttttat

SEQ ID NO: 4385731 - DNA, 19 bp, Homo sapiens
tttgaccttttatgtagta

SEQ ID NO: 4385732 - DNA, 17 bp, Homo sapiens
tttgactaattttacat

SEQ ID NO: 4385733 - DNA, 21 bp, Homo sapiens
tttgactaattttacatgttt

SEQ ID NO: 4385734 - DNA, 16 bp, Homo sapiens
tttgactattctgtat

SEQ ID NO: 4385735 - DNA, 20 bp, Homo sapiens
tttgactctggggtgcagct

SEQ ID NO: 4385736 - DNA, 15 bp, Homo sapiens
tttgactgtcagcaa

SEQ ID NO: 4385737 - DNA, 16 bp, Homo sapiens
tttgacttttctgtaa

SEQ ID NO: 4385738 - DNA, 21 bp, Homo sapiens
tttgactttttggaattcagc

SEQ ID NO: 4385739 - DNA, 14 bp, Homo sapiens
tttgagaaaaatag

SEQ ID NO: 4385740 - DNA, 16 bp, Homo sapiens
tttgagaccaggctgg

SEQ ID NO: 4385741 - DNA, 19 bp, Homo sapiens
tttgagaccaggctgggca

SEQ ID NO: 4385742 - DNA, 20 bp, Homo sapiens
tttgagctactggattctta

SEQ ID NO: 4385743 - DNA, 22 bp, Homo sapiens
tttgagctcagccccaactctt

SEQ ID NO: 4385744 - DNA, 21 bp, Homo sapiens
tttgaggaagtggctgtccct

SEQ ID NO: 4385745 - DNA, 15 bp, Homo sapiens
tttgaggtaaagata

SEQ ID NO: 4385746 - DNA, 19 bp, Homo sapiens
tttgagtaaaaagacattt

SEQ ID NO: 4385747 - DNA, 23 bp, Homo sapiens
tttgagtaattcaagcctctaaa

SEQ ID NO: 4385748 - DNA, 18 bp, Homo sapiens
tttgagtcattgacttca

SEQ ID NO: 4385749 - DNA, 20 bp, Homo sapiens
tttgagtcctaggacttaaa

SEQ ID NO: 4385750 - DNA, 21 bp, Homo sapiens
tttgagtcctaggacttaaaa

SEQ ID NO: 4385751 - DNA, 21 bp, Homo sapiens
tttgagtttttcctcccagtg

SEQ ID NO: 4385752 - DNA, 22 bp, Homo sapiens
tttgataactgtttatatgtgt

SEQ ID NO: 4385753 - DNA, 22 bp, Homo sapiens
tttgtaactgtttagatgaatg

SEQ ID NO: 4385754 - DNA, 11 bp, Homo sapiens
tttgtaacttc

SEQ ID NO: 4385755 - DNA, 20 bp, Homo sapiens
tttgtaagaaggcaatatta

SEQ ID NO: 4385756 - DNA, 17 bp, Homo sapiens
tttgtaagcaacttgct

SEQ ID NO: 4385757 - DNA, 20 bp, Homo sapiens
tttgtaatgaattcctagaa

SEQ ID NO: 4385758 - DNA, 23 bp, Homo sapiens
tttgtaatgtcaccaccttccca

SEQ ID NO: 4385759 - DNA, 22 bp, Homo sapiens
tttgtaattaaaagcaaatcat

SEQ ID NO: 4385760 - DNA, 23 bp, Homo sapiens
tttgtaattaaaagcaaatcatt

SEQ ID NO: 4385761 - DNA, 18 bp, Homo sapiens
tttgtacatatcaaatag

SEQ ID NO: 4385762 - DNA, 18 bp, Homo sapiens
tttgtacatttgggagtt

SEQ ID NO: 4385763 - DNA, 17 bp, Homo sapiens
tttgtaccagtgaattt

SEQ ID NO: 4385764 - DNA, 19 bp, Homo sapiens
tttgtacgttatatattgt

SEQ ID NO: 4385765 - DNA, 16 bp, Homo sapiens
tttgtactgaattttt

SEQ ID NO: 4385766 - DNA, 17 bp, Homo sapiens
tttgtactggttcattg

SEQ ID NO: 4385767 - DNA, 16 bp, Homo sapiens
tttgtagaatctcttc

SEQ ID NO: 4385768 - DNA, 14 bp, Homo sapiens
tttgtaggtaaaat

SEQ ID NO: 4385769 - DNA, 16 bp, Homo sapiens
tttgtagtgaaataat

SEQ ID NO: 4385770 - DNA, 22 bp, Homo sapiens
tttgtagtgatttttatgccac

SEQ ID NO: 4385771 - DNA, 13 bp, Homo sapiens
tttgtagttgttg

SEQ ID NO: 4385772 - DNA, 14 bp, Homo sapiens
tttgtatactttaa

SEQ ID NO: 4385773 - DNA, 14 bp, Homo sapiens
tttgtatcttttat

SEQ ID NO: 4385774 - DNA, 16 bp, Homo sapiens
tttgtattctctgcaa

SEQ ID NO: 4385775 - DNA, 20 bp, Homo sapiens
tttgtattcttcatgaaatg

SEQ ID NO: 4385776 - DNA, 14 bp, Homo sapiens
tttgtattgtatat

SEQ ID NO: 4385777 - DNA, 22 bp, Homo sapiens
tttgtattttggaggtgcttga

SEQ ID NO: 4385778 - DNA, 17 bp, Homo sapiens
tttgtcaatgacagttt

SEQ ID NO: 4385779 - DNA, 13 bp, Homo sapiens
tttgtcacttgcc

SEQ ID NO: 4385780 - DNA, 19 bp, Homo sapiens
tttgtcacttgccacatgg

SEQ ID NO: 4385781 - DNA, 15 bp, Homo sapiens
tttgtcactttttct

SEQ ID NO: 4385782 - DNA, 20 bp, Homo sapiens
tttgtcagaactagaatttg

SEQ ID NO: 4385783 - DNA, 18 bp, Homo sapiens
tttgtcagtttatcttaa

SEQ ID NO: 4385784 - DNA, 15 bp, Homo sapiens
tttgtccaaataaat

SEQ ID NO: 4385785 - DNA, 13 bp, Homo sapiens
tttgtccacttca

SEQ ID NO: 4385786 - DNA, 15 bp, Homo sapiens
tttgtccacttgtaa

SEQ ID NO: 4385787 - DNA, 19 bp, Homo sapiens
tttgtcccagaattttctg

SEQ ID NO: 4385788 - DNA, 18 bp, Homo sapiens
tttgtctctgagaagcat

SEQ ID NO: 4385789 - DNA, 17 bp, Homo sapiens
tttgtctgtttttactc

SEQ ID NO: 4385790 - DNA, 18 bp, Homo sapiens
tttgtcttaaaaaatgtg

SEQ ID NO: 4385791 - DNA, 22 bp, Homo sapiens
tttgtcttaaaaaatgtgaaat

SEQ ID NO: 4385792 - DNA, 15 bp, Homo sapiens
tttgtgacattcctt

SEQ ID NO: 4385793 - DNA, 22 bp, Homo sapiens
tttgtgagcatgggtgtgccct

SEQ ID NO: 4385794 - DNA, 15 bp, Homo sapiens
tttgtgcctttggcc

SEQ ID NO: 4385795 - DNA, 17 bp, Homo sapiens
tttgtgcctttggcctg

SEQ ID NO: 4385796 - DNA, 20 bp, Homo sapiens
tttgtgctagaaattttcaa

SEQ ID NO: 4385797 - DNA, 21 bp, Homo sapiens
tttgtgctagaaattttcaag

SEQ ID NO: 4385798 - DNA, 22 bp, Homo sapiens
tttgtgctgaatgttgggactg

SEQ ID NO: 4385799 - DNA, 14 bp, Homo sapiens
tttgtgctgtgggc

SEQ ID NO: 4385800 - DNA, 17 bp, Homo sapiens
tttgtggtaatctacac

SEQ ID NO: 4385801 - DNA, 20 bp, Homo sapiens
tttgtgtagaagtccacaga

SEQ ID NO: 4385802 - DNA, 14 bp, Homo sapiens
tttgtgtattaaat

SEQ ID NO: 4385803 - DNA, 14 bp, Homo sapiens
tttgttaaagcctg

SEQ ID NO: 4385804 - DNA, 19 bp, Homo sapiens
tttgttaaattcagtaatg

SEQ ID NO: 4385805 - DNA, 22 bp, Homo sapiens
tttgttaatttagaaaacttta

SEQ ID NO: 4385806 - DNA, 21 bp, Homo sapiens
tttgttactctcttccacatg

SEQ ID NO: 4385807 - DNA, 19 bp, Homo sapiens
tttgttactgtcattccca

SEQ ID NO: 4385808 - DNA, 19 bp, Homo sapiens
tttgttatatataataaat

SEQ ID NO: 4385809 - DNA, 15 bp, Homo sapiens
tttgttattttgcaa

SEQ ID NO: 4385810 - DNA, 16 bp, Homo sapiens
tttgttattttgcaac

SEQ ID NO: 4385811 - DNA, 18 bp, Homo sapiens
tttgtttcaacccaactg

SEQ ID NO: 4385812 - DNA, 10 bp, Homo sapiens
tttgtttctt

SEQ ID NO: 4385813 - DNA, 20 bp, Homo sapiens
tttgttttaaggaaaaaaga

SEQ ID NO: 4385814 - DNA, 14 bp, Homo sapiens
tttgttttgttgga

SEQ ID NO: 4385815 - DNA, 12 bp, Homo sapiens
tttgtttttcat

SEQ ID NO: 4385816 - DNA, 17 bp, Homo sapiens
ttttaaaaaagcttaaa

SEQ ID NO: 4385817 - DNA, 16 bp, Homo sapiens
ttttaaaaaatggtca

SEQ ID NO: 4385818 - DNA, 17 bp, Homo sapiens
ttttaaaaaatggtcac

SEQ ID NO: 4385819 - DNA, 18 bp, Homo sapiens
ttttaaaaagagtaattt

SEQ ID NO: 4385820 - DNA, 14 bp, Homo sapiens
ttttaaaaataact

SEQ ID NO: 4385821 - DNA, 14 bp, Homo sapiens
ttttaaaacaaaag

SEQ ID NO: 4385822 - DNA, 16 bp, Homo sapiens
ttttaaaatagaaatt

SEQ ID NO: 4385823 - DNA, 18 bp, Homo sapiens
ttttaaaatagaaatttt

SEQ ID NO: 4385824 - DNA, 21 bp, Homo sapiens
ttttaaaatagaaattttgta

SEQ ID NO: 4385825 - DNA, 19 bp, Homo sapiens
ttttaaaatcactaacatt

SEQ ID NO: 4385826 - DNA, 18 bp, Homo sapiens
ttttaaaatccagacttt

SEQ ID NO: 4385827 - DNA, 23 bp, Homo sapiens
ttttaaaatgaatcttatgcaaa

SEQ ID NO: 4385828 - DNA, 17 bp, Homo sapiens
ttttaaacaaaatttca

SEQ ID NO: 4385829 - DNA, 13 bp, Homo sapiens
ttttaaactgtgt

SEQ ID NO: 4385830 - DNA, 13 bp, Homo sapiens
ttttaaacttgaa

SEQ ID NO: 4385831 - DNA, 15 bp, Homo sapiens
ttttaaacttgaaat

SEQ ID NO: 4385832 - DNA, 19 bp, Homo sapiens
ttttaaagagatagcttct

SEQ ID NO: 4385833 - DNA, 17 bp, Homo sapiens
ttttaaagtaaacttgt

SEQ ID NO: 4385834 - DNA, 18 bp, Homo sapiens
ttttaaagttcattgcaa

SEQ ID NO: 4385835 - DNA, 15 bp, Homo sapiens
ttttaaatattttct

SEQ ID NO: 4385836 - DNA, 12 bp, Homo sapiens
ttttaaatgtat

SEQ ID NO: 4385837 - DNA, 13 bp, Homo sapiens
ttttaaattccac

SEQ ID NO: 4385838 - DNA, 19 bp, Homo sapiens
ttttaaattccactgaaaa

SEQ ID NO: 4385839 - DNA, 21 bp, Homo sapiens
ttttaaattccactgaaaatt

SEQ ID NO: 4385840 - DNA, 20 bp, Homo sapiens
ttttaaattcccgttttgtc

SEQ ID NO: 4385841 - DNA, 15 bp, Homo sapiens
ttttaaattttgtaa

SEQ ID NO: 4385842 - DNA, 18 bp, Homo sapiens
ttttaaattttgtaatga

SEQ ID NO: 4385843 - DNA, 20 bp, Homo sapiens
ttttaactgatttaacactt

SEQ ID NO: 4385844 - DNA, 15 bp, Homo sapiens
ttttaactggcatgt

SEQ ID NO: 4385845 - DNA, 23 bp, Homo sapiens
ttttaactttaccaaatgaaatg

SEQ ID NO: 4385846 - DNA, 12 bp, Homo sapiens
ttttaactttct

SEQ ID NO: 4385847 - DNA, 12 bp, Homo sapiens
ttttaacttttt

SEQ ID NO: 4385848 - DNA, 17 bp, Homo sapiens
ttttaagaaaaaaagca

SEQ ID NO: 4385849 - DNA, 15 bp, Homo sapiens
ttttaagatagtgta

SEQ ID NO: 4385850 - DNA, 16 bp, Homo sapiens
ttttaagatagtgtaa

SEQ ID NO: 4385851 - DNA, 18 bp, Homo sapiens
ttttaagatttctctaat

SEQ ID NO: 4385852 - DNA, 15 bp, Homo sapiens
ttttaagatttgtgt

SEQ ID NO: 4385853 - DNA, 21 bp, Homo sapiens
ttttaaggtctttcagtactt

SEQ ID NO: 4385854 - DNA, 18 bp, Homo sapiens
ttttaagttaatagattt

SEQ ID NO: 4385855 - DNA, 23 bp, Homo sapiens
ttttaagttaatagattttttca

SEQ ID NO: 4385856 - DNA, 12 bp, Homo sapiens
ttttaagttctt

SEQ ID NO: 4385857 - DNA, 23 bp, Homo sapiens
ttttaagttgtcaaagaagcttc

SEQ ID NO: 4385858 - DNA, 13 bp, Homo sapiens
ttttaataaacta

SEQ ID NO: 4385859 - DNA, 18 bp, Homo sapiens
ttttaataaccacaaaca

SEQ ID NO: 4385860 - DNA, 13 bp, Homo sapiens
ttttaataagaac

SEQ ID NO: 4385861 - DNA, 12 bp, Homo sapiens
ttttaatagaac

SEQ ID NO: 4385862 - DNA, 18 bp, Homo sapiens
ttttaatatataatttaa

SEQ ID NO: 4385863 - DNA, 23 bp, Homo sapiens
ttttaatatataatttaatgtaa

SEQ ID NO: 4385864 - DNA, 22 bp, Homo sapiens
ttttaatcgtttttgttttaag

SEQ ID NO: 4385865 - DNA, 19 bp, Homo sapiens
ttttaatgaaaaggaatca

SEQ ID NO: 4385866 - DNA, 17 bp, Homo sapiens
ttttaatggattgttaa

SEQ ID NO: 4385867 - DNA, 21 bp, Homo sapiens
ttttaatggcagcagaaaact

SEQ ID NO: 4385868 - DNA, 12 bp, Homo sapiens
ttttaatgtaaa

SEQ ID NO: 4385869 - DNA, 20 bp, Homo sapiens
ttttaatgtacttgaaaaat

SEQ ID NO: 4385870 - DNA, 13 bp, Homo sapiens
ttttaatgtatct

SEQ ID NO: 4385871 - DNA, 13 bp, Homo sapiens
ttttcattttaat

SEQ ID NO: 4385872 - DNA, 20 bp, Homo sapiens
ttttccacataaattttaat

SEQ ID NO: 4385873 - DNA, 11 bp, Homo sapiens
ttttccatgac

SEQ ID NO: 4385874 - DNA, 12 bp, Homo sapiens
ttttcccacgag

SEQ ID NO: 4385875 - DNA, 15 bp, Homo sapiens
ttttcccataagaca

SEQ ID NO: 4385876 - DNA, 20 bp, Homo sapiens
ttttccccaaaccataaaac

SEQ ID NO: 4385877 - DNA, 18 bp, Homo sapiens
ttttccccccactctccc

SEQ ID NO: 4385878 - DNA, 19 bp, Homo sapiens
ttttccccccactctcccc

SEQ ID NO: 4385879 - DNA, 16 bp, Homo sapiens
ttttcccccttcccat

SEQ ID NO: 4385880 - DNA, 22 bp, Homo sapiens
ttttccccgtgacattcactgg

SEQ ID NO: 4385881 - DNA, 18 bp, Homo sapiens
ttttccctggaactcctg

SEQ ID NO: 4385882 - DNA, 22 bp, Homo sapiens
ttttccctggaactcctggcct

SEQ ID NO: 4385883 - DNA, 16 bp, Homo sapiens
ttttcctaagacattt

SEQ ID NO: 4385884 - DNA, 17 bp, Homo sapiens
ttttcctacaggcagtc

SEQ ID NO: 4385885 - DNA, 13 bp, Homo sapiens
ttttcctcagctc

SEQ ID NO: 4385886 - DNA, 14 bp, Homo sapiens
ttttcctcagctct

SEQ ID NO: 4385887 - DNA, 15 bp, Homo sapiens
ttttcctcagctcta

SEQ ID NO: 4385888 - DNA, 17 bp, Homo sapiens
ttttcctcctctgccta

SEQ ID NO: 4385889 - DNA, 14 bp, Homo sapiens
ttttcctcttgtga

SEQ ID NO: 4385890 - DNA, 14 bp, Homo sapiens
ttttcctgtggaat

SEQ ID NO: 4385891 - DNA, 13 bp, Homo sapiens
ttttcctttgtgg

SEQ ID NO: 4385892 - DNA, 11 bp, Homo sapiens
ttttctaaaag

SEQ ID NO: 4385893 - DNA, 21 bp, Homo sapiens
ttttctaatgaggagagaaaa

SEQ ID NO: 4385894 - DNA, 14 bp, Homo sapiens
ttttctacagtggt

SEQ ID NO: 4385895 - DNA, 18 bp, Homo sapiens
ttttctacagtggtttta

SEQ ID NO: 4385896 - DNA, 19 bp, Homo sapiens
ttttctagatacaataaat

SEQ ID NO: 4385897 - DNA, 16 bp, Homo sapiens
ttttctagtttgctca

SEQ ID NO: 4385898 - DNA, 23 bp, Homo sapiens
ttttctagtttgctcatactaca

SEQ ID NO: 4385899 - DNA, 17 bp, Homo sapiens
ttttctatatcaaaaaa

SEQ ID NO: 4385900 - DNA, 23 bp, Homo sapiens
ttttctattatggaaaactgtgt

SEQ ID NO: 4385901 - DNA, 21 bp, Homo sapiens
ttttctcaggagcttcaatga

SEQ ID NO: 4385902 - DNA, 12 bp, Homo sapiens
ttttctcccaag

SEQ ID NO: 4385903 - DNA, 20 bp, Homo sapiens
ttttctcccatttcttgcta

SEQ ID NO: 4385904 - DNA, 17 bp, Homo sapiens
ttttctcctgcaaattt

SEQ ID NO: 4385905 - DNA, 14 bp, Homo sapiens
ttttctcggtgggg

SEQ ID NO: 4385906 - DNA, 13 bp, Homo sapiens
ttttctcttgtac

SEQ ID NO: 4385907 - DNA, 12 bp, Homo sapiens
ttttctctttct

SEQ ID NO: 4385908 - DNA, 15 bp, Homo sapiens
ttttctgagaaagac

SEQ ID NO: 4385909 - DNA, 11 bp, Homo sapiens
ttttctgattc

SEQ ID NO: 4385910 - DNA, 12 bp, Homo sapiens
ttttctgccctg

SEQ ID NO: 4385911 - DNA, 16 bp, Homo sapiens
ttttctgccctggctg

SEQ ID NO: 4385912 - DNA, 22 bp, Homo sapiens
ttttctgggttttgttggcttt

SEQ ID NO: 4385913 - DNA, 20 bp, Homo sapiens
ttttctgtaaattcatattt

SEQ ID NO: 4385914 - DNA, 22 bp, Homo sapiens
ttttctgtaatcttttatttaa

SEQ ID NO: 4385915 - DNA, 14 bp, Homo sapiens
ttttctgtaccagt

SEQ ID NO: 4385916 - DNA, 21 bp, Homo sapiens
ttttctgtaccagttaatttt

SEQ ID NO: 4385917 - DNA, 11 bp, Homo sapiens
ttttctgtact

SEQ ID NO: 4385918 - DNA, 11 bp, Homo sapiens
ttttctgtatt

SEQ ID NO: 4385919 - DNA, 12 bp, Homo sapiens
ttttctgtattt

SEQ ID NO: 4385920 - DNA, 17 bp, Homo sapiens
ttttctgtgcctgaata

SEQ ID NO: 4385921 - DNA, 13 bp, Homo sapiens
ttttcttatttca

SEQ ID NO: 4385922 - DNA, 15 bp, Homo sapiens
ttttcttctcagtct

SEQ ID NO: 4385923 - DNA, 11 bp, Homo sapiens
ttttcttctga

SEQ ID NO: 4385924 - DNA, 15 bp, Homo sapiens
ttttcttcttccctc

SEQ ID NO: 4385925 - DNA, 23 bp, Homo sapiens
ttttcttgggaattgaaaaaaat

SEQ ID NO: 4385926 - DNA, 14 bp, Homo sapiens
ttttctttaactgc

SEQ ID NO: 4385927 - DNA, 19 bp, Homo sapiens
ttttctttcccatgtattt

SEQ ID NO: 4385928 - DNA, 15 bp, Homo sapiens
ttttctttgtatcat

SEQ ID NO: 4385929 - DNA, 15 bp, Homo sapiens
ttttctttttccagt

SEQ ID NO: 4385930 - DNA, 21 bp, Homo sapiens
ttttcttttttttaatgtttc

SEQ ID NO: 4385931 - DNA, 15 bp, Homo sapiens
ttttgaaactgcatt

SEQ ID NO: 4385932 - DNA, 12 bp, Homo sapiens
ttttgaaagaat

SEQ ID NO: 4385933 - DNA, 13 bp, Homo sapiens
ttttgaaggcaaa

SEQ ID NO: 4385934 - DNA, 20 bp, Homo sapiens
ttttgaatcaatctggcttc

SEQ ID NO: 4385935 - DNA, 14 bp, Homo sapiens
ttttgaattgttac

SEQ ID NO: 4385936 - DNA, 16 bp, Homo sapiens
ttttgacactgaaata

SEQ ID NO: 4385937 - DNA, 19 bp, Homo sapiens
ttttgacagactatttgct

SEQ ID NO: 4385938 - DNA, 15 bp, Homo sapiens
ttttgacatggaaat

SEQ ID NO: 4385939 - DNA, 22 bp, Homo sapiens
ttttgactaagtttttatacca

SEQ ID NO: 4385940 - DNA, 18 bp, Homo sapiens
ttttgactgtagccacag

SEQ ID NO: 4385941 - DNA, 13 bp, Homo sapiens
ttttgagaaactg

SEQ ID NO: 4385942 - DNA, 15 bp, Homo sapiens
ttttgagacagtctt

SEQ ID NO: 4385943 - DNA, 19 bp, Homo sapiens
ttttgagcgacatctctga

SEQ ID NO: 4385944 - DNA, 21 bp, Homo sapiens
ttttgagctactggattctta

SEQ ID NO: 4385945 - DNA, 23 bp, Homo sapiens
ttttgaggtaaagatatggagaa

SEQ ID NO: 4385946 - DNA, 15 bp, Homo sapiens
ttttgagtaattcaa

SEQ ID NO: 4385947 - DNA, 20 bp, Homo sapiens
ttttgatagctgtcccatct

SEQ ID NO: 4385948 - DNA, 21 bp, Homo sapiens
ttttgatataattgtactgtg

SEQ ID NO: 4385949 - DNA, 15 bp, Homo sapiens
ttttgatgcagcatt

SEQ ID NO: 4385950 - DNA, 17 bp, Homo sapiens
ttttgatgcagcatttg

SEQ ID NO: 4385951 - DNA, 20 bp, Homo sapiens
ttttgatgcagcatttgata

SEQ ID NO: 4385952 - DNA, 21 bp, Homo sapiens
ttttgatgtatatatctatta

SEQ ID NO: 4385953 - DNA, 17 bp, Homo sapiens
ttttgcaaagatttaat

SEQ ID NO: 4385954 - DNA, 13 bp, Homo sapiens
ttttgcatattct

SEQ ID NO: 4385955 - DNA, 23 bp, Homo sapiens
ttttgcatattctctattttact

SEQ ID NO: 4385956 - DNA, 17 bp, Homo sapiens
ttttgccagttttccct

SEQ ID NO: 4385957 - DNA, 21 bp, Homo sapiens
ttttgcggttcaggaaaattg

SEQ ID NO: 4385958 - DNA, 13 bp, Homo sapiens
ttttgctggaata

SEQ ID NO: 4385959 - DNA, 14 bp, Homo sapiens
ttttgctgtagaag

SEQ ID NO: 4385960 - DNA, 18 bp, Homo sapiens
ttttggaattcagcagtt

SEQ ID NO: 4385961 - DNA, 13 bp, Homo sapiens
ttttggaatttgc

SEQ ID NO: 4385962 - DNA, 15 bp, Homo sapiens
ttttggactctctgt

SEQ ID NO: 4385963 - DNA, 18 bp, Homo sapiens
ttttggactctctgtggt

SEQ ID NO: 4385964 - DNA, 20 bp, Homo sapiens
ttttggagtgttatgtattt

SEQ ID NO: 4385965 - DNA, 11 bp, Homo sapiens
ttttggatgag

SEQ ID NO: 4385966 - DNA, 17 bp, Homo sapiens
ttttggctgttttccct

SEQ ID NO: 4385967 - DNA, 23 bp, Homo sapiens
ttttggggattttcaaaagataa

SEQ ID NO: 4385968 - DNA, 14 bp, Homo sapiens
ttttggtggatgta

SEQ ID NO: 4385969 - DNA, 22 bp, Homo sapiens
ttttggttaagttggcttctgt

SEQ ID NO: 4385970 - DNA, 16 bp, Homo sapiens
ttttgtaaaatgtatt

SEQ ID NO: 4385971 - DNA, 18 bp, Homo sapiens
ttttgtaaaatgtattat

SEQ ID NO: 4385972 - DNA, 20 bp, Homo sapiens
ttttgtaaatgttcttggtg

SEQ ID NO: 4385973 - DNA, 11 bp, Homo sapiens
ttttgtaactt

SEQ ID NO: 4385974 - DNA, 16 bp, Homo sapiens
ttttgtaacttcaaat

SEQ ID NO: 4385975 - DNA, 16 bp, Homo sapiens
ttttgtaataagcaat

SEQ ID NO: 4385976 - DNA, 19 bp, Homo sapiens
ttttgtaatattctgtttt

SEQ ID NO: 4385977 - DNA, 11 bp, Homo sapiens
ttttgtaccag

SEQ ID NO: 4385978 - DNA, 16 bp, Homo sapiens
ttttgtataattggat

SEQ ID NO: 4385979 - DNA, 13 bp, Homo sapiens
ttttgtatacaga

SEQ ID NO: 4385980 - DNA, 21 bp, Homo sapiens
ttttgtatgaaatattaaaca

SEQ ID NO: 4385981 - DNA, 20 bp, Homo sapiens
ttttgtctaggagatgcttt

SEQ ID NO: 4385982 - DNA, 21 bp, Homo sapiens
ttttgtgaagtttaattgact

SEQ ID NO: 4385983 - DNA, 12 bp, Homo sapiens
ttttgtgatgaa

SEQ ID NO: 4385984 - DNA, 15 bp, Homo sapiens
ttttgtgctgcttct

SEQ ID NO: 4385985 - DNA, 10 bp, Homo sapiens
ttttgtgtag

SEQ ID NO: 4385986 - DNA, 13 bp, Homo sapiens
ttttgtgtagaaa

SEQ ID NO: 4385987 - DNA, 22 bp, Homo sapiens
ttttgtgtgcctggtagaaact

SEQ ID NO: 4385988 - DNA, 17 bp, Homo sapiens
ttttgtgtgtatttgct

SEQ ID NO: 4385989 - DNA, 14 bp, Homo sapiens
ttttgtgttccttt

SEQ ID NO: 4385990 - DNA, 16 bp, Homo sapiens
ttttgttaacagtatt

SEQ ID NO: 4385991 - DNA, 23 bp, Homo sapiens
tttttgtaaactggaattaaaag

SEQ ID NO: 4385992 - DNA, 15 bp, Homo sapiens
tttttgtgtgtattt

SEQ ID NO: 4385993 - DNA, 21 bp, Homo sapiens
tttttgtgtgttctttaaata

SEQ ID NO: 4385994 - DNA, 15 bp, Homo sapiens
tttttgttagcaaag

SEQ ID NO: 4385995 - DNA, 16 bp, Homo sapiens
tttttgttattaaaca

SEQ ID NO: 4385996 - DNA, 15 bp, Homo sapiens
tttttgtttgtactg

SEQ ID NO: 4385997 - DNA, 15 bp, Homo sapiens
tttttgtttgtttgt

SEQ ID NO: 4385998 - DNA, 14 bp, Homo sapiens
ttttttaaaataga

SEQ ID NO: 4385999 - DNA, 16 bp, Homo sapiens
ttttttaaaatccaga

SEQ ID NO: 4386000 - DNA, 12 bp, Homo sapiens
ttttttaaagta

SEQ ID NO: 4386001 - DNA, 12 bp, Homo sapiens
ttttttaagtga

SEQ ID NO: 4386002 - DNA, 16 bp, Homo sapiens
ttttttaatttctgaa

SEQ ID NO: 4386003 - DNA, 11 bp, Homo sapiens
ttttttacatt

SEQ ID NO: 4386004 - DNA, 23 bp, Homo sapiens
ttttttagtaagttaatgtatat

SEQ ID NO: 4386005 - DNA, 13 bp, Homo sapiens
ttttttatacatt

SEQ ID NO: 4386006 - DNA, 18 bp, Homo sapiens
ttttttcaaaatagaaaa

SEQ ID NO: 4386007 - DNA, 16 bp, Homo sapiens
ttttttccagagttgt

SEQ ID NO: 4386008 - DNA, 12 bp, Homo sapiens
ttttttctaaga

SEQ ID NO: 4386009 - DNA, 15 bp, Homo sapiens
ttttttctaagagaa

SEQ ID NO: 4386010 - DNA, 19 bp, Homo sapiens
ttttttgaacctccaaatg

SEQ ID NO: 4386011 - DNA, 13 bp, Homo sapiens
ttttttgaaggtt

SEQ ID NO: 4386012 - DNA, 17 bp, Homo sapiens
ttttttgagagagagtc

SEQ ID NO: 4386013 - DNA, 13 bp, Homo sapiens
ttttttgatatat

SEQ ID NO: 4386014 - DNA, 16 bp, Homo sapiens
ttttttgggcagcaat

SEQ ID NO: 4386015 - DNA, 13 bp, Homo sapiens
ttttttgtaataa

SEQ ID NO: 4386016 - DNA, 13 bp, Homo sapiens
ttttttgtatgtg

SEQ ID NO: 4386017 - DNA, 12 bp, Homo sapiens
ttttttgtttca

SEQ ID NO: 4386018 - DNA, 12 bp, Homo sapiens
tttttttcagtt

SEQ ID NO: 4386019 - DNA, 12 bp, Homo sapiens
tttttttccgtg

SEQ ID NO: 4386020 - DNA, 12 bp, Homo sapiens
tttttttcctaa

SEQ ID NO: 4386021 - DNA, 12 bp, Homo sapiens
tttttttctacc

SEQ ID NO: 4386022 - DNA, 12 bp, Homo sapiens
tttttttctgtc

SEQ ID NO: 4386023 - DNA, 13 bp, Homo sapiens
tttttttgtaata

SEQ ID NO: 4386024 - DNA, 12 bp, Homo sapiens
ttttttttaagt

SEQ ID NO: 4386025 - DNA, 13 bp, Homo sapiens
aaaaaaaaagtca

SEQ ID NO: 4386026 - DNA, 12 bp, Homo sapiens
aaaaaaaacaaa

SEQ ID NO: 4386027 - DNA, 11 bp, Homo sapiens
aaaaaaaagct

SEQ ID NO: 4386028 - DNA, 13 bp, Homo sapiens
aaaaaaaagcttc

SEQ ID NO: 4386029 - DNA, 14 bp, Homo sapiens
aaaaaaaagcttta

SEQ ID NO: 4386030 - DNA, 11 bp, Homo sapiens
aaaaaaacaaa

SEQ ID NO: 4386031 - DNA, 13 bp, Homo sapiens
aaaaaaactttta

SEQ ID NO: 4386032 - DNA, 10 bp, Homo sapiens
aaaaaaagat

SEQ ID NO: 4386033 - DNA, 18 bp, Homo sapiens
aaaaaaccgaggccctca

SEQ ID NO: 4386034 - DNA, 12 bp, Homo sapiens
aaaaaagcaaaa

SEQ ID NO: 4386035 - DNA, 11 bp, Homo sapiens
aaaaaagcttt

SEQ ID NO: 4386036 - DNA, 13 bp, Homo sapiens
aaaaaagctttat

SEQ ID NO: 4386037 - DNA, 19 bp, Homo sapiens
aaaaaagctttatgatttt

SEQ ID NO: 4386038 - DNA, 16 bp, Homo sapiens
aaaaaagtcaccaaat

SEQ ID NO: 4386039 - DNA, 20 bp, Homo sapiens
aaaaaatagatgtcttttat

SEQ ID NO: 4386040 - DNA, 12 bp, Homo sapiens
aaaaaatatttt

SEQ ID NO: 4386041 - DNA, 13 bp, Homo sapiens
aaaaaatcatatt

SEQ ID NO: 4386042 - DNA, 12 bp, Homo sapiens
aaaaaatcatct

SEQ ID NO: 4386043 - DNA, 11 bp, Homo sapiens
aaaaaatgttg

SEQ ID NO: 4386044 - DNA, 12 bp, Homo sapiens
aaaaaatttgtt

SEQ ID NO: 4386045 - DNA, 15 bp, Homo sapiens
aaaaacaaatgttag

SEQ ID NO: 4386046 - DNA, 17 bp, Homo sapiens
aaaaacagcgtcttcct

SEQ ID NO: 4386047 - DNA, 15 bp, Homo sapiens
aaaaacatctgaaga

SEQ ID NO: 4386048 - DNA, 11 bp, Homo sapiens
aaaaacattta

SEQ ID NO: 4386049 - DNA, 14 bp, Homo sapiens
aaaaacctgtatct

SEQ ID NO: 4386050 - DNA, 13 bp, Homo sapiens
aaaaactaatgtg

SEQ ID NO: 4386051 - DNA, 15 bp, Homo sapiens
aaaaactaatgtgtc

SEQ ID NO: 4386052 - DNA, 20 bp, Homo sapiens
aaaaactgggataactgatt

SEQ ID NO: 4386053 - DNA, 23 bp, Homo sapiens
aaaaactgggataactgatttct

SEQ ID NO: 4386054 - DNA, 12 bp, Homo sapiens
aaaaactgtaaa

SEQ ID NO: 4386055 - DNA, 16 bp, Homo sapiens
aaaaactgtaaaagtg

SEQ ID NO: 4386056 - DNA, 21 bp, Homo sapiens
aaaaacttttaggttgttacc

SEQ ID NO: 4386057 - DNA, 12 bp, Homo sapiens
aaaaagaaaact

SEQ ID NO: 4386058 - DNA, 15 bp, Homo sapiens
aaaaagaaaatatta

SEQ ID NO: 4386059 - DNA, 20 bp, Homo sapiens
aaaaagaacatgcagtttga

SEQ ID NO: 4386060 - DNA, 12 bp, Homo sapiens
aaaaagacattt

SEQ ID NO: 4386061 - DNA, 18 bp, Homo sapiens
aaaaagattgtattgctg

SEQ ID NO: 4386062 - DNA, 12 bp, Homo sapiens
aaaaagattttt

SEQ ID NO: 4386063 - DNA, 13 bp, Homo sapiens
aaaaagatttttt

SEQ ID NO: 4386064 - DNA, 18 bp, Homo sapiens
aaaaagcgaaaaaatcag

SEQ ID NO: 4386065 - DNA, 22 bp, Homo sapiens
aaaaagctaatccctaaaatag

SEQ ID NO: 4386066 - DNA, 22 bp, Homo sapiens
aaaaagctaatgtgcagggata

SEQ ID NO: 4386067 - DNA, 9 bp, Homo sapiens
aaaaagctc

SEQ ID NO: 4386068 - DNA, 17 bp, Homo sapiens
aaaaagctcatttcatg

SEQ ID NO: 4386069 - DNA, 14 bp, Homo sapiens
aaaaagctctgaaa

SEQ ID NO: 4386070 - DNA, 15 bp, Homo sapiens
aaaaagctctgaaaa

SEQ ID NO: 4386071 - DNA, 15 bp, Homo sapiens
aaaaagcttaaaact

SEQ ID NO: 4386072 - DNA, 19 bp, Homo sapiens
aaaaagcttccatgattct

SEQ ID NO: 4386073 - DNA, 12 bp, Homo sapiens
aaaaagctttat

SEQ ID NO: 4386074 - DNA, 11 bp, Homo sapiens
aaaaagggtca

SEQ ID NO: 4386075 - DNA, 17 bp, Homo sapiens
aaaaagtctctatttaa

SEQ ID NO: 4386076 - DNA, 18 bp, Homo sapiens
aaaaagtgcttcattctt

SEQ ID NO: 4386077 - DNA, 10 bp, Homo sapiens
aaaaagtgtt

SEQ ID NO: 4386078 - DNA, 18 bp, Homo sapiens
aaaaagtttgccagaagt

SEQ ID NO: 4386079 - DNA, 12 bp, Homo sapiens
aaaaataaaata

SEQ ID NO: 4386080 - DNA, 18 bp, Homo sapiens
aaaaataaatatatctac

SEQ ID NO: 4386081 - DNA, 21 bp, Homo sapiens
aaaaataactgagatattatt

SEQ ID NO: 4386082 - DNA, 16 bp, Homo sapiens
aaaaataataataatg

SEQ ID NO: 4386083 - DNA, 21 bp, Homo sapiens
aaaaatactttttctaatgag

SEQ ID NO: 4386084 - DNA, 13 bp, Homo sapiens
aaaaatagaaatt

SEQ ID NO: 4386085 - DNA, 15 bp, Homo sapiens
aaaaatagaaattag

SEQ ID NO: 4386086 - DNA, 18 bp, Homo sapiens
aaaaatagtcttccacaa

SEQ ID NO: 4386087 - DNA, 14 bp, Homo sapiens
aaaaatagtttgga

SEQ ID NO: 4386088 - DNA, 12 bp, Homo sapiens
aaaaatatatat

SEQ ID NO: 4386089 - DNA, 17 bp, Homo sapiens
aaaaatatatgtatata

SEQ ID NO: 4386090 - DNA, 10 bp, Homo sapiens
aaaaatatta

SEQ ID NO: 4386091 - DNA, 11 bp, Homo sapiens
aaaaatattta

SEQ ID NO: 4386092 - DNA, 13 bp, Homo sapiens
aaaaatattttct

SEQ ID NO: 4386093 - DNA, 20 bp, Homo sapiens
aaaaatcatgccagtatttt

SEQ ID NO: 4386094 - DNA, 18 bp, Homo sapiens
aaaaatcatttagatgca

SEQ ID NO: 4386095 - DNA, 23 bp, Homo sapiens
aaaagtcaccaaatagtgtgaaa

SEQ ID NO: 4386096 - DNA, 16 bp, Homo sapiens
aaaagtcattattcct

SEQ ID NO: 4386097 - DNA, 18 bp, Homo sapiens
aaaagtccaattttaatt

SEQ ID NO: 4386098 - DNA, 21 bp, Homo sapiens
aaaagtccctccctgcctgag

SEQ ID NO: 4386099 - DNA, 15 bp, Homo sapiens
aaaagtcgttttcca

SEQ ID NO: 4386100 - DNA, 15 bp, Homo sapiens
aaaagtctacctgtg

SEQ ID NO: 4386101 - DNA, 18 bp, Homo sapiens
aaaagtctacctgtgttt

SEQ ID NO: 4386102 - DNA, 13 bp, Homo sapiens
aaaagtctccaaa

SEQ ID NO: 4386103 - DNA, 19 bp, Homo sapiens
aaaagtctctatttaaatt

SEQ ID NO: 4386104 - DNA, 23 bp, Homo sapiens
aaaagtctctatttaaattcttt

SEQ ID NO: 4386105 - DNA, 18 bp, Homo sapiens
aaaagtctgtctttcctg

SEQ ID NO: 4386106 - DNA, 18 bp, Homo sapiens
aaaagtgatgtattttca

SEQ ID NO: 4386107 - DNA, 20 bp, Homo sapiens
aaaagtgatgtattttcata

SEQ ID NO: 4386108 - DNA, 22 bp, Homo sapiens
aaaagtgatgtattttcatagt

SEQ ID NO: 4386109 - DNA, 23 bp, Homo sapiens
aaaagtgatgtattttcatagtg

SEQ ID NO: 4386110 - DNA, 15 bp, Homo sapiens
aaaagtgcttcattc

SEQ ID NO: 4386111 - DNA, 17 bp, Homo sapiens
aaaagtgggcttgattc

SEQ ID NO: 4386112 - DNA, 15 bp, Homo sapiens
aaaagtggggcagag

SEQ ID NO: 4386113 - DNA, 22 bp, Homo sapiens
aaaagttcataacagtgccatt

SEQ ID NO: 4386114 - DNA, 13 bp, Homo sapiens
aaaagttctttca

SEQ ID NO: 4386115 - DNA, 16 bp, Homo sapiens
aaaagtttgccagaag

SEQ ID NO: 4386116 - DNA, 12 bp, Homo sapiens
aaaagtttgttt

SEQ ID NO: 4386117 - DNA, 20 bp, Homo sapiens
aaaagttttgaaggaaacct

SEQ ID NO: 4386118 - DNA, 16 bp, Homo sapiens
aaaataaaaactattc

SEQ ID NO: 4386119 - DNA, 18 bp, Homo sapiens
aaaataaaaactattcga

SEQ ID NO: 4386120 - DNA, 20 bp, Homo sapiens
aaaataaaaagatcactttc

SEQ ID NO: 4386121 - DNA, 17 bp, Homo sapiens
aaaataaaatactttga

SEQ ID NO: 4386122 - DNA, 14 bp, Homo sapiens
aaaataaaatgcct

SEQ ID NO: 4386123 - DNA, 14 bp, Homo sapiens
aaaataaagaagta

SEQ ID NO: 4386124 - DNA, 14 bp, Homo sapiens
aaaataaatatatc

SEQ ID NO: 4386125 - DNA, 22 bp, Homo sapiens
aaaataactgagatattatttt

SEQ ID NO: 4386126 - DNA, 16 bp, Homo sapiens
aaaataagtcaacagt

SEQ ID NO: 4386127 - DNA, 18 bp, Homo sapiens
aaaataagtcaacagtaa

SEQ ID NO: 4386128 - DNA, 12 bp, Homo sapiens
aaaataagttct

SEQ ID NO: 4386129 - DNA, 22 bp, Homo sapiens
aaaataatctatattaaatgag

SEQ ID NO: 4386130 - DNA, 16 bp, Homo sapiens
aaaatacaatttttat

SEQ ID NO: 4386131 - DNA, 18 bp, Homo sapiens
aaaatacacgtttatctt

SEQ ID NO: 4386132 - DNA, 21 bp, Homo sapiens
aaaatacacgtttatcttaca

SEQ ID NO: 4386133 - DNA, 22 bp, Homo sapiens
aaaataccagagccttcaagtg

SEQ ID NO: 4386134 - DNA, 20 bp, Homo sapiens
aaaatacctcaggaaagaat

SEQ ID NO: 4386135 - DNA, 21 bp, Homo sapiens
aaaatactatgcagtatctct

SEQ ID NO: 4386136 - DNA, 21 bp, Homo sapiens
aaaatacttctttttcattat

SEQ ID NO: 4386137 - DNA, 18 bp, Homo sapiens
aaaatactttgagttttg

SEQ ID NO: 4386138 - DNA, 12 bp, Homo sapiens
aaaatagaaaag

SEQ ID NO: 4386139 - DNA, 15 bp, Homo sapiens
aaaatagaaaagtta

SEQ ID NO: 4386140 - DNA, 17 bp, Homo sapiens
aaaatagaaattttgta

SEQ ID NO: 4386141 - DNA, 13 bp, Homo sapiens
aaaatagccctgc

SEQ ID NO: 4386142 - DNA, 13 bp, Homo sapiens
aaaatagtgtaag

SEQ ID NO: 4386143 - DNA, 15 bp, Homo sapiens
aaaatagtgtaagaa

SEQ ID NO: 4386144 - DNA, 23 bp, Homo sapiens
aaaatagttaagacatgatttcc

SEQ ID NO: 4386145 - DNA, 13 bp, Homo sapiens
aaaatagtttgga

SEQ ID NO: 4386146 - DNA, 19 bp, Homo sapiens
aaaatagtttggatatgta

SEQ ID NO: 4386147 - DNA, 20 bp, Homo sapiens
aaaatagtttggatatgtaa

SEQ ID NO: 4386148 - DNA, 12 bp, Homo sapiens
aaaatataagta

SEQ ID NO: 4386149 - DNA, 11 bp, Homo sapiens
aaaatatatac

SEQ ID NO: 4386150 - DNA, 14 bp, Homo sapiens
aaaatatatactaa

SEQ ID NO: 4386151 - DNA, 14 bp, Homo sapiens
aaaatatatatcta

SEQ ID NO: 4386152 - DNA, 21 bp, Homo sapiens
aaaatatatattatatacata

SEQ ID NO: 4386153 - DNA, 12 bp, Homo sapiens
aaaatatatgaa

SEQ ID NO: 4386154 - DNA, 12 bp, Homo sapiens
aaaatatatgta

SEQ ID NO: 4386155 - DNA, 13 bp, Homo sapiens
aaaatatatgtat

SEQ ID NO: 4386156 - DNA, 20 bp, Homo sapiens
aaaatatgtaagaacacatt

SEQ ID NO: 4386157 - DNA, 21 bp, Homo sapiens
aaaatatgtaagaacacattt

SEQ ID NO: 4386158 - DNA, 16 bp, Homo sapiens
aaaatatgtgaagttt

SEQ ID NO: 4386159 - DNA, 18 bp, Homo sapiens
aaaatatgtgaagttttc

SEQ ID NO: 4386160 - DNA, 17 bp, Homo sapiens
aaaatattaacattctt

SEQ ID NO: 4386161 - DNA, 14 bp, Homo sapiens
aaaatattctctat

SEQ ID NO: 4386162 - DNA, 22 bp, Homo sapiens
aaaatattgaaatgctgtattt

SEQ ID NO: 4386163 - DNA, 22 bp, Homo sapiens
aaaatattgtttctgcattcat

SEQ ID NO: 4386164 - DNA, 19 bp, Homo sapiens
aaaatattgttttacaata

SEQ ID NO: 4386165 - DNA, 20 bp, Homo sapiens
aaaatattgttttacaatag

SEQ ID NO: 4386166 - DNA, 21 bp, Homo sapiens
aaaatatttgactattctgta

SEQ ID NO: 4386167 - DNA, 12 bp, Homo sapiens
aaaatattttga

SEQ ID NO: 4386168 - DNA, 22 bp, Homo sapiens
aaaatattttgttaacttttgt

SEQ ID NO: 4386169 - DNA, 20 bp, Homo sapiens
aaaatattttgttgccttca

SEQ ID NO: 4386170 - DNA, 14 bp, Homo sapiens
aaaatcaacatgac

SEQ ID NO: 4386171 - DNA, 23 bp, Homo sapiens
aaaatcaactttttattgccttc

SEQ ID NO: 4386172 - DNA, 10 bp, Homo sapiens
aaaatcaaga

SEQ ID NO: 4386173 - DNA, 12 bp, Homo sapiens
aaaatcaagagt

SEQ ID NO: 4386174 - DNA, 24 bp, Homo sapiens
aaaatcaagagtgagatgtagaaa

SEQ ID NO: 4386175 - DNA, 20 bp, Homo sapiens
aaaatcacaatttttaatgg

SEQ ID NO: 4386176 - DNA, 16 bp, Homo sapiens
aaaatcactaacatta

SEQ ID NO: 4386177 - DNA, 17 bp, Homo sapiens
aaaatcactttcataat

SEQ ID NO: 4386178 - DNA, 14 bp, Homo sapiens
aaaatcatattcta

SEQ ID NO: 4386179 - DNA, 13 bp, Homo sapiens
aaaatcatcagaa

SEQ ID NO: 4386180 - DNA, 16 bp, Homo sapiens
aaaatcatctattttg

SEQ ID NO: 4386181 - DNA, 17 bp, Homo sapiens
aaaatcatgccagtatt

SEQ ID NO: 4386182 - DNA, 19 bp, Homo sapiens
aaaatcatgccagtatttt

SEQ ID NO: 4386183 - DNA, 11 bp, Homo sapiens
aaaatcatttc

SEQ ID NO: 4386184 - DNA, 21 bp, Homo sapiens
aaaatcatttctgcatcagct

SEQ ID NO: 4386185 - DNA, 18 bp, Homo sapiens
aaaatccaaaaagctctg

SEQ ID NO: 4386186 - DNA, 17 bp, Homo sapiens
aaaatccagactttctt

SEQ ID NO: 4386187 - DNA, 19 bp, Homo sapiens
aaaatccagactttctttt

SEQ ID NO: 4386188 - DNA, 22 bp, Homo sapiens
aaaatccagactttctttttct

SEQ ID NO: 4386189 - DNA, 15 bp, Homo sapiens
aaaatcctcaggaaa

SEQ ID NO: 4386190 - DNA, 14 bp, Homo sapiens
aaacacagcaaggg

SEQ ID NO: 4386191 - DNA, 13 bp, Homo sapiens
aaacacatgatac

SEQ ID NO: 4386192 - DNA, 21 bp, Homo sapiens
aaacacattataaagttcaga

SEQ ID NO: 4386193 - DNA, 19 bp, Homo sapiens
aaacaccaacataaaaatg

SEQ ID NO: 4386194 - DNA, 15 bp, Homo sapiens
aaacactacacattt

SEQ ID NO: 4386195 - DNA, 21 bp, Homo sapiens
aaacactgataatcacactgc

SEQ ID NO: 4386196 - DNA, 15 bp, Homo sapiens
aaacactgtgtaagc

SEQ ID NO: 4386197 - DNA, 19 bp, Homo sapiens
aaacacttatcttctggat

SEQ ID NO: 4386198 - DNA, 16 bp, Homo sapiens
aaacacttccagtctg

SEQ ID NO: 4386199 - DNA, 15 bp, Homo sapiens
aaacagagtggcctc

SEQ ID NO: 4386200 - DNA, 20 bp, Homo sapiens
aaacagattcaggccagccc

SEQ ID NO: 4386201 - DNA, 15 bp, Homo sapiens
aaacagcctcacaga

SEQ ID NO: 4386202 - DNA, 21 bp, Homo sapiens
aaacagcctctctcttttcta

SEQ ID NO: 4386203 - DNA, 21 bp, Homo sapiens
aaacagctattatatcagctt

SEQ ID NO: 4386204 - DNA, 19 bp, Homo sapiens
aaacagctgccttagcttc

SEQ ID NO: 4386205 - DNA, 21 bp, Homo sapiens
aaacagctgccttagcttcag

SEQ ID NO: 4386206 - DNA, 14 bp, Homo sapiens
aaacaggaaaaaaa

SEQ ID NO: 4386207 - DNA, 16 bp, Homo sapiens
aaacaggaaaaaaact

SEQ ID NO: 4386208 - DNA, 19 bp, Homo sapiens
aaacaggcaaagttttaca

SEQ ID NO: 4386209 - DNA, 23 bp, Homo sapiens
aaacaggcaaagttttacagaga

SEQ ID NO: 4386210 - DNA, 18 bp, Homo sapiens
aaacagggacaaagaaat

SEQ ID NO: 4386211 - DNA, 11 bp, Homo sapiens
aaacagggcct

SEQ ID NO: 4386212 - DNA, 14 bp, Homo sapiens
aaacagtagtgata

SEQ ID NO: 4386213 - DNA, 22 bp, Homo sapiens
aaacagtatttctggtgtatat

SEQ ID NO: 4386214 - DNA, 20 bp, Homo sapiens
aaacagtctcaggaaatcaa

SEQ ID NO: 4386215 - DNA, 12 bp, Homo sapiens
aaacagtgcctg

SEQ ID NO: 4386216 - DNA, 23 bp, Homo sapiens
aaacagtggatcacaaagtggaa

SEQ ID NO: 4386217 - DNA, 19 bp, Homo sapiens
aaacagttgcatgtagtaa

SEQ ID NO: 4386218 - DNA, 19 bp, Homo sapiens
aaacagttggtaacttttg

SEQ ID NO: 4386219 - DNA, 14 bp, Homo sapiens
aaagcagaggccaa

SEQ ID NO: 4386220 - DNA, 22 bp, Homo sapiens
aaagcagatacctcaccctgct

SEQ ID NO: 4386221 - DNA, 23 bp, Homo sapiens
aaagcaggacatatgagaaaact

SEQ ID NO: 4386222 - DNA, 17 bp, Homo sapiens
aaagcatattgactttt

SEQ ID NO: 4386223 - DNA, 24 bp, Homo sapiens
aaagcatccctcacccatcctaga

SEQ ID NO: 4386224 - DNA, 22 bp, Homo sapiens
aaagcatgcatatcattaaaca

SEQ ID NO: 4386225 - DNA, 23 bp, Homo sapiens
aaagcatgcatatcattaaacaa

SEQ ID NO: 4386226 - DNA, 15 bp, Homo sapiens
aaagcatggacattt

SEQ ID NO: 4386227 - DNA, 20 bp, Homo sapiens
aaagcatgtggtcttatagt

SEQ ID NO: 4386228 - DNA, 16 bp, Homo sapiens
aaagcattattttttg

SEQ ID NO: 4386229 - DNA, 15 bp, Homo sapiens
aaagcattgtaaatg

SEQ ID NO: 4386230 - DNA, 20 bp, Homo sapiens
aaagcattgtaaatgtgctt

SEQ ID NO: 4386231 - DNA, 17 bp, Homo sapiens
aaagcatttcaggccag

SEQ ID NO: 4386232 - DNA, 19 bp, Homo sapiens
aaagcatttcttttctctt

SEQ ID NO: 4386233 - DNA, 17 bp, Homo sapiens
aaagccaccttgttaca

SEQ ID NO: 4386234 - DNA, 18 bp, Homo sapiens
aaagccacgttccttact

SEQ ID NO: 4386235 - DNA, 21 bp, Homo sapiens
aaagccagcgtcctcctctgt

SEQ ID NO: 4386236 - DNA, 13 bp, Homo sapiens
aaagccaggagca

SEQ ID NO: 4386237 - DNA, 14 bp, Homo sapiens
aaagccccccagct

SEQ ID NO: 4386238 - DNA, 15 bp, Homo sapiens
aaagccccccagctc

SEQ ID NO: 4386239 - DNA, 21 bp, Homo sapiens
aaagcctcctgccccctgcca

SEQ ID NO: 4386240 - DNA, 18 bp, Homo sapiens
aaagcctttgatgcacaa

SEQ ID NO: 4386241 - DNA, 16 bp, Homo sapiens
aaagcctttgtatctt

SEQ ID NO: 4386242 - DNA, 16 bp, Homo sapiens
aaagcgaaaaaatcag

SEQ ID NO: 4386243 - DNA, 16 bp, Homo sapiens
aaagcgcgttgtgtat

SEQ ID NO: 4386244 - DNA, 15 bp, Homo sapiens
aaagcgggcagcccc

SEQ ID NO: 4386245 - DNA, 15 bp, Homo sapiens
aaagctaaaaatatt

SEQ ID NO: 4386246 - DNA, 12 bp, Homo sapiens
aaagctaaaata

SEQ ID NO: 4386247 - DNA, 18 bp, Homo sapiens
aaagctaaaatatataat

SEQ ID NO: 4386248 - DNA, 15 bp, Homo sapiens
aaagctaatgtgcag

SEQ ID NO: 4386249 - DNA, 16 bp, Homo sapiens
aaagctaatgtgcagg

SEQ ID NO: 4386250 - DNA, 13 bp, Homo sapiens
aaagctagaaatg

SEQ ID NO: 4386251 - DNA, 13 bp, Homo sapiens
aaagctagaattg

SEQ ID NO: 4386252 - DNA, 18 bp, Homo sapiens
aaagctatcttcatgtaa

SEQ ID NO: 4386253 - DNA, 17 bp, Homo sapiens
aaagctattggagattt

SEQ ID NO: 4386254 - DNA, 14 bp, Homo sapiens
aaagctcaaatgaa

SEQ ID NO: 4386255 - DNA, 20 bp, Homo sapiens
aaagctcatttcatgctctg

SEQ ID NO: 4386256 - DNA, 18 bp, Homo sapiens
aaagctgctaaatctcct

SEQ ID NO: 4386257 - DNA, 15 bp, Homo sapiens
aaagctggtttaatg

SEQ ID NO: 4386258 - DNA, 16 bp, Homo sapiens
aaagctggtttaatgt

SEQ ID NO: 4386259 - DNA, 12 bp, Homo sapiens
aaagctgttctt

SEQ ID NO: 4386260 - DNA, 15 bp, Homo sapiens
aaagcttaaaacttt

SEQ ID NO: 4386261 - DNA, 15 bp, Homo sapiens
aaagcttaatatatt

SEQ ID NO: 4386262 - DNA, 16 bp, Homo sapiens
aaagcttaatgattct

SEQ ID NO: 4386263 - DNA, 13 bp, Homo sapiens
aaagcttattaaa

SEQ ID NO: 4386264 - DNA, 16 bp, Homo sapiens
aaagcttcaaagttta

SEQ ID NO: 4386265 - DNA, 16 bp, Homo sapiens
aaagcttcacagtacc

SEQ ID NO: 4386266 - DNA, 14 bp, Homo sapiens
aaagcttcagggaa

SEQ ID NO: 4386267 - DNA, 20 bp, Homo sapiens
aaagcttgatttgatctttg

SEQ ID NO: 4386268 - DNA, 21 bp, Homo sapiens
aaagcttgatttgatctttgt

SEQ ID NO: 4386269 - DNA, 16 bp, Homo sapiens
aaagctttatctttgt

SEQ ID NO: 4386270 - DNA, 13 bp, Homo sapiens
aaagctttatgat

SEQ ID NO: 4386271 - DNA, 20 bp, Homo sapiens
aaagctttatgattttcata

SEQ ID NO: 4386272 - DNA, 18 bp, Homo sapiens
aaagctttattaccagtg

SEQ ID NO: 4386273 - DNA, 18 bp, Homo sapiens
aaagctttcttttctaac

SEQ ID NO: 4386274 - DNA, 15 bp, Homo sapiens
aaagcttttattcct

SEQ ID NO: 4386275 - DNA, 19 bp, Homo sapiens
aaagctttttattcctcct

SEQ ID NO: 4386276 - DNA, 18 bp, Homo sapiens
aaaggaaaatagtaatgt

SEQ ID NO: 4386277 - DNA, 13 bp, Homo sapiens
aaaggaaaccttt

SEQ ID NO: 4386278 - DNA, 15 bp, Homo sapiens
aaaggaaagctgtgt

SEQ ID NO: 4386279 - DNA, 19 bp, Homo sapiens
aaaggaagagctaataaat

SEQ ID NO: 4386280 - DNA, 17 bp, Homo sapiens
aaaggaagcattgtaaa

SEQ ID NO: 4386281 - DNA, 13 bp, Homo sapiens
aaaggaatataag

SEQ ID NO: 4386282 - DNA, 16 bp, Homo sapiens
aaaggacaaataaaac

SEQ ID NO: 4386283 - DNA, 18 bp, Homo sapiens
aaaggacaaataaaacat

SEQ ID NO: 4386284 - DNA, 21 bp, Homo sapiens
aaaggacaaataaaacatggc

SEQ ID NO: 4386285 - DNA, 15 bp, Homo sapiens
aaaggacagagccag

SEQ ID NO: 4386286 - DNA, 15 bp, Homo sapiens
aaaggacatcagcaa

SEQ ID NO: 4386287 - DNA, 21 bp, Homo sapiens
aaaggacccttgagtaagtga

SEQ ID NO: 4386288 - DNA, 22 bp, Homo sapiens
aaaggacccttgagtaagtgaa

SEQ ID NO: 4386289 - DNA, 19 bp, Homo sapiens
aaaggacgcctgcaggaga

SEQ ID NO: 4386290 - DNA, 22 bp, Homo sapiens
aaaggagagactcccatgaagc

SEQ ID NO: 4386291 - DNA, 23 bp, Homo sapiens
aaaggagagactcccatgaagcc

SEQ ID NO: 4386292 - DNA, 14 bp, Homo sapiens
aaaggaggctggca

SEQ ID NO: 4386293 - DNA, 13 bp, Homo sapiens
aaaggaggtgaaa

SEQ ID NO: 4386294 - DNA, 14 bp, Homo sapiens
aaaggataaatttt

SEQ ID NO: 4386295 - DNA, 20 bp, Homo sapiens
aaaggatgatcaaaaataat

SEQ ID NO: 4386296 - DNA, 13 bp, Homo sapiens
aaaggatgtgatt

SEQ ID NO: 4386297 - DNA, 18 bp, Homo sapiens
aaaggattttaccaaagc

SEQ ID NO: 4386298 - DNA, 15 bp, Homo sapiens
aaaaatttaaaagta

SEQ ID NO: 4386299 - DNA, 23 bp, Homo sapiens
aaaaattttgtgacattccttct

SEQ ID NO: 4386300 - DNA, 11 bp, Homo sapiens
aaaacaaaaag

SEQ ID NO: 4386301 - DNA, 10 bp, Homo sapiens
aaaacaaaac

SEQ ID NO: 4386302 - DNA, 14 bp, Homo sapiens
aaaacaaaacaaaa

SEQ ID NO: 4386303 - DNA, 20 bp, Homo sapiens
aaaacaaaactatacttgaa

SEQ ID NO: 4386304 - DNA, 19 bp, Homo sapiens
aaaacaaaagggtgtatag

SEQ ID NO: 4386305 - DNA, 16 bp, Homo sapiens
aaaacaaataaatatg

SEQ ID NO: 4386306 - DNA, 22 bp, Homo sapiens
aaaacaactatggatcagaata

SEQ ID NO: 4386307 - DNA, 20 bp, Homo sapiens
aaaacaagtcatttttgtat

SEQ ID NO: 4386308 - DNA, 19 bp, Homo sapiens
aaaacaagtctataatgtg

SEQ ID NO: 4386309 - DNA, 16 bp, Homo sapiens
aaaacaatattacttt

SEQ ID NO: 4386310 - DNA, 19 bp, Homo sapiens
aaaacaatggtaacatttt

SEQ ID NO: 4386311 - DNA, 20 bp, Homo sapiens
aaaacaattttctgtaatct

SEQ ID NO: 4386312 - DNA, 16 bp, Homo sapiens
aaaacacacctcgtgg

SEQ ID NO: 4386313 - DNA, 13 bp, Homo sapiens
aaaacacatgata

SEQ ID NO: 4386314 - DNA, 11 bp, Homo sapiens
aaaacagaaaa

SEQ ID NO: 4386315 - DNA, 13 bp, Homo sapiens
aaaacagaagcaa

SEQ ID NO: 4386316 - DNA, 17 bp, Homo sapiens
aaaacagacactggcat

SEQ ID NO: 4386317 - DNA, 17 bp, Homo sapiens
aaaacagggtccaggaa

SEQ ID NO: 4386318 - DNA, 19 bp, Homo sapiens
aaaacagggtccaggaatg

SEQ ID NO: 4386319 - DNA, 20 bp, Homo sapiens
aaaacagggtccaggaatgg

SEQ ID NO: 4386320 - DNA, 14 bp, Homo sapiens
aaaacagtacagaa

SEQ ID NO: 4386321 - DNA, 19 bp, Homo sapiens
aaaacagtggatcacaaag

SEQ ID NO: 4386322 - DNA, 12 bp, Homo sapiens
aaaacatcacta

SEQ ID NO: 4386323 - DNA, 15 bp, Homo sapiens
aaaacattaattgct

SEQ ID NO: 4386324 - DNA, 13 bp, Homo sapiens
aaaacatttattt

SEQ ID NO: 4386325 - DNA, 11 bp, Homo sapiens
aaaacatttct

SEQ ID NO: 4386326 - DNA, 17 bp, Homo sapiens
aaaacatttctaagact

SEQ ID NO: 4386327 - DNA, 22 bp, Homo sapiens
aaaacatttgattaataaaata

SEQ ID NO: 4386328 - DNA, 16 bp, Homo sapiens
aaaacatttgtttccc

SEQ ID NO: 4386329 - DNA, 16 bp, Homo sapiens
aaaacattttaaatga

SEQ ID NO: 4386330 - DNA, 17 bp, Homo sapiens
aaaacattttaaatgaa

SEQ ID NO: 4386331 - DNA, 18 bp, Homo sapiens
aaaacattttaaatgaaa

SEQ ID NO: 4386332 - DNA, 20 bp, Homo sapiens
aaaacattttttatacattt

SEQ ID NO: 4386333 - DNA, 12 bp, Homo sapiens
aaaaccacagca

SEQ ID NO: 4386334 - DNA, 14 bp, Homo sapiens
aaaaccacagcagt

SEQ ID NO: 4386335 - DNA, 20 bp, Homo sapiens
aaaaccacatggcacagaga

SEQ ID NO: 4386336 - DNA, 14 bp, Homo sapiens
aaaaccattctaaa

SEQ ID NO: 4386337 - DNA, 12 bp, Homo sapiens
aaaacctaccag

SEQ ID NO: 4386338 - DNA, 21 bp, Homo sapiens
aaaacctgattggccactgga

SEQ ID NO: 4386339 - DNA, 14 bp, Homo sapiens
aaaaccttttgaaa

SEQ ID NO: 4386340 - DNA, 12 bp, Homo sapiens
aaaactactttt

SEQ ID NO: 4386341 - DNA, 14 bp, Homo sapiens
aaaactagcaactc

SEQ ID NO: 4386342 - DNA, 22 bp, Homo sapiens
aaaactagggctcattttcctg

SEQ ID NO: 4386343 - DNA, 14 bp, Homo sapiens
aaaactataacatt

SEQ ID NO: 4386344 - DNA, 20 bp, Homo sapiens
aaaactatacttgaacaaaa

SEQ ID NO: 4386345 - DNA, 15 bp, Homo sapiens
aaaactatttgtata

SEQ ID NO: 4386346 - DNA, 23 bp, Homo sapiens
aaaactcaagcaagatgagctgt

SEQ ID NO: 4386347 - DNA, 18 bp, Homo sapiens
aaaactcatacaatgata

SEQ ID NO: 4386348 - DNA, 15 bp, Homo sapiens
aaaactctctcccag

SEQ ID NO: 4386349 - DNA, 18 bp, Homo sapiens
aaaactgcgaggacatca

SEQ ID NO: 4386350 - DNA, 16 bp, Homo sapiens
aaaactgggataactg

SEQ ID NO: 4386351 - DNA, 20 bp, Homo sapiens
aaaactgggataactgattt

SEQ ID NO: 4386352 - DNA, 17 bp, Homo sapiens
aaaactgtgaccaagta

SEQ ID NO: 4386353 - DNA, 19 bp, Homo sapiens
aaaactgtgaccaagtata

SEQ ID NO: 4386354 - DNA, 17 bp, Homo sapiens
aaaactgtgttgccaca

SEQ ID NO: 4386355 - DNA, 18 bp, Homo sapiens
aaaacttaaaaattaata

SEQ ID NO: 4386356 - DNA, 21 bp, Homo sapiens
aaaacttatgctgatttattt

SEQ ID NO: 4386357 - DNA, 14 bp, Homo sapiens
aaaactttaaagat

SEQ ID NO: 4386358 - DNA, 13 bp, Homo sapiens
aaaactttaaagc

SEQ ID NO: 4386359 - DNA, 19 bp, Homo sapiens
aaaactttattttatataa

SEQ ID NO: 4386360 - DNA, 18 bp, Homo sapiens
aaaactttctaaatgcat

SEQ ID NO: 4386361 - DNA, 22 bp, Homo sapiens
aaaactttttgaccagtttctt

SEQ ID NO: 4386362 - DNA, 23 bp, Homo sapiens
aaaactttttgaccagtttcttt

SEQ ID NO: 4386363 - DNA, 12 bp, Homo sapiens
aaaagaaaataa

SEQ ID NO: 4386364 - DNA, 13 bp, Homo sapiens
aaaagaaaatatt

SEQ ID NO: 4386365 - DNA, 12 bp, Homo sapiens
aaaagaaatgca

SEQ ID NO: 4386366 - DNA, 13 bp, Homo sapiens
aaaagaaatgcaa

SEQ ID NO: 4386367 - DNA, 17 bp, Homo sapiens
aaaagaacatgcagttt

SEQ ID NO: 4386368 - DNA, 12 bp, Homo sapiens
aaaagaagaaga

SEQ ID NO: 4386369 - DNA, 12 bp, Homo sapiens
aaaagaatattt

SEQ ID NO: 4386370 - DNA, 21 bp, Homo sapiens
aaaagacaattttttttcaaa

SEQ ID NO: 4386371 - DNA, 13 bp, Homo sapiens
aaaagagtaattt

SEQ ID NO: 4386372 - DNA, 12 bp, Homo sapiens
aaaagataaaga

SEQ ID NO: 4386373 - DNA, 21 bp, Homo sapiens
aaaagatggcttatgtcatca

SEQ ID NO: 4386374 - DNA, 18 bp, Homo sapiens
aaaagattgctgaaattt

SEQ ID NO: 4386375 - DNA, 15 bp, Homo sapiens
aaaagattgtattgc

SEQ ID NO: 4386376 - DNA, 14 bp, Homo sapiens
aaaagcaacattca

SEQ ID NO: 4386377 - DNA, 12 bp, Homo sapiens
aaaagcaattct

SEQ ID NO: 4386378 - DNA, 19 bp, Homo sapiens
aaaagcacaagtacttttg

SEQ ID NO: 4386379 - DNA, 22 bp, Homo sapiens
aaaagcacagaggatttcttta

SEQ ID NO: 4386380 - DNA, 21 bp, Homo sapiens
aaaagcatttttcaatatatt

SEQ ID NO: 4386381 - DNA, 19 bp, Homo sapiens
aaaagccccagtctcacct

SEQ ID NO: 4386382 - DNA, 18 bp, Homo sapiens
aaaagccttccagttttg

SEQ ID NO: 4386383 - DNA, 20 bp, Homo sapiens
aaaagcgcgttgtgtatatt

SEQ ID NO: 4386384 - DNA, 21 bp, Homo sapiens
aaaagcgcgttgtgtatatta

SEQ ID NO: 4386385 - DNA, 16 bp, Homo sapiens
aaaagctatcttcatg

SEQ ID NO: 4386386 - DNA, 20 bp, Homo sapiens
aaaagctatttaaagcatct

SEQ ID NO: 4386387 - DNA, 17 bp, Homo sapiens
aaaagctcatttcatgc

SEQ ID NO: 4386388 - DNA, 14 bp, Homo sapiens
aaaagctctgaaaa

SEQ ID NO: 4386389 - DNA, 23 bp, Homo sapiens
aaaagctctgttccatgcaactg

SEQ ID NO: 4386390 - DNA, 18 bp, Homo sapiens
aaaagcttaatgattctg

SEQ ID NO: 4386391 - DNA, 14 bp, Homo sapiens
aaaagcttccatga

SEQ ID NO: 4386392 - DNA, 18 bp, Homo sapiens
aaaagctttatgattttc

SEQ ID NO: 4386393 - DNA, 13 bp, Homo sapiens
aaaaggaaagctg

SEQ ID NO: 4386394 - DNA, 16 bp, Homo sapiens
aaaaggaacaaataaa

SEQ ID NO: 4386395 - DNA, 17 bp, Homo sapiens
aaaaggacatcagcaaa

SEQ ID NO: 4386396 - DNA, 16 bp, Homo sapiens
aaaaggatagtatttt

SEQ ID NO: 4386397 - DNA, 22 bp, Homo sapiens
aaaaggatagtatttttatcca

SEQ ID NO: 4386398 - DNA, 14 bp, Homo sapiens
aaaaggcaaatatt

SEQ ID NO: 4386399 - DNA, 20 bp, Homo sapiens
aaacttcattggtaagattg

SEQ ID NO: 4386400 - DNA, 17 bp, Homo sapiens
aaacttccaaagaaagt

SEQ ID NO: 4386401 - DNA, 12 bp, Homo sapiens
aaacttgaaata

SEQ ID NO: 4386402 - DNA, 13 bp, Homo sapiens
aaacttgaaatat

SEQ ID NO: 4386403 - DNA, 20 bp, Homo sapiens
aaacttggatacttggattt

SEQ ID NO: 4386404 - DNA, 23 bp, Homo sapiens
aaacttgtgttcaatctgtgaag

SEQ ID NO: 4386405 - DNA, 22 bp, Homo sapiens
aaactttaaacctgtagaatca

SEQ ID NO: 4386406 - DNA, 12 bp, Homo sapiens
aaactttatgct

SEQ ID NO: 4386407 - DNA, 19 bp, Homo sapiens
aaacttttaagatttctct

SEQ ID NO: 4386408 - DNA, 16 bp, Homo sapiens
aaacttttaggttgtt

SEQ ID NO: 4386409 - DNA, 14 bp, Homo sapiens
aaacttttataaat

SEQ ID NO: 4386410 - DNA, 16 bp, Homo sapiens
aaacttttataaatta

SEQ ID NO: 4386411 - DNA, 17 bp, Homo sapiens
aaacttttataaattaa

SEQ ID NO: 4386412 - DNA, 18 bp, Homo sapiens
aaacttttataaattaaa

SEQ ID NO: 4386413 - DNA, 19 bp, Homo sapiens
aaacttttataaattaaat

SEQ ID NO: 4386414 - DNA, 13 bp, Homo sapiens
aaacttttgaaag

SEQ ID NO: 4386415 - DNA, 15 bp, Homo sapiens
aaacttttgaaagat

SEQ ID NO: 4386416 - DNA, 18 bp, Homo sapiens
aaactttttaaaatactt

SEQ ID NO: 4386417 - DNA, 23 bp, Homo sapiens
aaactttttttctgtaccagtta

SEQ ID NO: 4386418 - DNA, 21 bp, Homo sapiens
aaagaaaaaaaaaaaagccag

SEQ ID NO: 4386419 - DNA, 17 bp, Homo sapiens
aaagaaaaaattttatt

SEQ ID NO: 4386420 - DNA, 19 bp, Homo sapiens
aaagaaaacaaaaaacgaa

SEQ ID NO: 4386421 - DNA, 12 bp, Homo sapiens
aaagaaaatatt

SEQ ID NO: 4386422 - DNA, 13 bp, Homo sapiens
aaagaaagggaaa

SEQ ID NO: 4386423 - DNA, 12 bp, Homo sapiens
aaagaaagtgta

SEQ ID NO: 4386424 - DNA, 13 bp, Homo sapiens
aaagaaagtgtat

SEQ ID NO: 4386425 - DNA, 18 bp, Homo sapiens
aaagaaatcatgtccata

SEQ ID NO: 4386426 - DNA, 23 bp, Homo sapiens
aaagaaatccccccttcagaaca

SEQ ID NO: 4386427 - DNA, 16 bp, Homo sapiens
aaagaaatgaacattc

SEQ ID NO: 4386428 - DNA, 19 bp, Homo sapiens
aaagaacatgcagtttgaa

SEQ ID NO: 4386429 - DNA, 23 bp, Homo sapiens
aaagaacgtggtcagagtagaac

SEQ ID NO: 4386430 - DNA, 18 bp, Homo sapiens
aaagaagaaacttgtaaa

SEQ ID NO: 4386431 - DNA, 22 bp, Homo sapiens
aaagaagaaacttgtaaatatc

SEQ ID NO: 4386432 - DNA, 21 bp, Homo sapiens
aaagaagaagaagaaggagag

SEQ ID NO: 4386433 - DNA, 12 bp, Homo sapiens
aaagaagccaca

SEQ ID NO: 4386434 - DNA, 13 bp, Homo sapiens
aaagaagccacag

SEQ ID NO: 4386435 - DNA, 19 bp, Homo sapiens
aaagaagctactattttgg

SEQ ID NO: 4386436 - DNA, 22 bp, Homo sapiens
aaagaagcttaacagtaagaaa

SEQ ID NO: 4386437 - DNA, 17 bp, Homo sapiens
aaagaatacttgaactt

SEQ ID NO: 4386438 - DNA, 13 bp, Homo sapiens
aaagaatattttg

SEQ ID NO: 4386439 - DNA, 20 bp, Homo sapiens
aaagaatgccatttctcacg

SEQ ID NO: 4386440 - DNA, 18 bp, Homo sapiens
aaagaattccaaagcaaa

SEQ ID NO: 4386441 - DNA, 18 bp, Homo sapiens
aaagacaaaagtctgtct

SEQ ID NO: 4386442 - DNA, 18 bp, Homo sapiens
aaagacagcgataagctt

SEQ ID NO: 4386443 - DNA, 20 bp, Homo sapiens
aaagacatctgcctgtaatt

SEQ ID NO: 4386444 - DNA, 16 bp, Homo sapiens
aaagacatgaagccac

SEQ ID NO: 4386445 - DNA, 18 bp, Homo sapiens
aaagacattatttctcat

SEQ ID NO: 4386446 - DNA, 22 bp, Homo sapiens
aaagacattgtttttaaaaaaa

SEQ ID NO: 4386447 - DNA, 15 bp, Homo sapiens
aaagacatttaaaga

SEQ ID NO: 4386448 - DNA, 17 bp, Homo sapiens
aaagaccaaatctcagt

SEQ ID NO: 4386449 - DNA, 13 bp, Homo sapiens
aaagaccagacta

SEQ ID NO: 4386450 - DNA, 14 bp, Homo sapiens
aaagaccaggccaa

SEQ ID NO: 4386451 - DNA, 15 bp, Homo sapiens
aaagacccaggggga

SEQ ID NO: 4386452 - DNA, 16 bp, Homo sapiens
aaagacccagggggag

SEQ ID NO: 4386453 - DNA, 23 bp, Homo sapiens
aaagacgctaataaaaatttatt

SEQ ID NO: 4386454 - DNA, 17 bp, Homo sapiens
aaagactattcaaacag

SEQ ID NO: 4386455 - DNA, 23 bp, Homo sapiens
aaagactattcaaacagtctcag

SEQ ID NO: 4386456 - DNA, 17 bp, Homo sapiens
aaagactcaagagaatt

SEQ ID NO: 4386457 - DNA, 21 bp, Homo sapiens
aaagactccaaagaaatgtaa

SEQ ID NO: 4386458 - DNA, 12 bp, Homo sapiens
aaagactggctt

SEQ ID NO: 4386459 - DNA, 13 bp, Homo sapiens
aaagacttaaagg

SEQ ID NO: 4386460 - DNA, 18 bp, Homo sapiens
aaagacttttatgtgaga

SEQ ID NO: 4386461 - DNA, 18 bp, Homo sapiens
aaagagaaaaaaagtttg

SEQ ID NO: 4386462 - DNA, 11 bp, Homo sapiens
aaagagaaact

SEQ ID NO: 4386463 - DNA, 15 bp, Homo sapiens
aaagagacagtgata

SEQ ID NO: 4386464 - DNA, 16 bp, Homo sapiens
aaagagacatttcaaa

SEQ ID NO: 4386465 - DNA, 23 bp, Homo sapiens
aaagagagtttttaatagaacca

SEQ ID NO: 4386466 - DNA, 17 bp, Homo sapiens
aaagagatagcttctct

SEQ ID NO: 4386467 - DNA, 14 bp, Homo sapiens
aaagagcagtcaga

SEQ ID NO: 4386468 - DNA, 19 bp, Homo sapiens
aaagagcatggatgcattt

SEQ ID NO: 4386469 - DNA, 18 bp, Homo sapiens
aaagagcccttgcctccc

SEQ ID NO: 4386470 - DNA, 18 bp, Homo sapiens
aaagagccttcagaatgc

SEQ ID NO: 4386471 - DNA, 15 bp, Homo sapiens
aaagaggaatgaagt

SEQ ID NO: 4386472 - DNA, 20 bp, Homo sapiens
aaagaggatgatttcagaag

SEQ ID NO: 4386473 - DNA, 20 bp, Homo sapiens
aaagaggcagcttgaaactg

SEQ ID NO: 4386474 - DNA, 14 bp, Homo sapiens
aaagaggctgcccc

SEQ ID NO: 4386475 - DNA, 15 bp, Homo sapiens
aaagagggcttcctc

SEQ ID NO: 4386476 - DNA, 19 bp, Homo sapiens
aaagagggcttcctctaga

SEQ ID NO: 4386477 - DNA, 23 bp, Homo sapiens
aaagagtaatttcatttaaatat

SEQ ID NO: 4386478 - DNA, 14 bp, Homo sapiens
aaagagtacactca

SEQ ID NO: 4386479 - DNA, 16 bp, Homo sapiens
aaagagtacactcagc

SEQ ID NO: 4386480 - DNA, 18 bp, Homo sapiens
aaagagtacactcagcca

SEQ ID NO: 4386481 - DNA, 20 bp, Homo sapiens
aaagagtacactcagccact

SEQ ID NO: 4386482 - DNA, 14 bp, Homo sapiens
agaacctaattcaa

SEQ ID NO: 4386483 - DNA, 23 bp, Homo sapiens
agaacctacagactccatctctt

SEQ ID NO: 4386484 - DNA, 21 bp, Homo sapiens
agaacctcagattcttcattg

SEQ ID NO: 4386485 - DNA, 13 bp, Homo sapiens
agaacctcttccc

SEQ ID NO: 4386486 - DNA, 14 bp, Homo sapiens
agaacctcttcccc

SEQ ID NO: 4386487 - DNA, 23 bp, Homo sapiens
agaacctgagctattttcctctg

SEQ ID NO: 4386488 - DNA, 21 bp, Homo sapiens
agaacctgagttcccgggagc

SEQ ID NO: 4386489 - DNA, 14 bp, Homo sapiens
agaacctttgtcaa

SEQ ID NO: 4386490 - DNA, 17 bp, Homo sapiens
agaacgaggtttatatt

SEQ ID NO: 4386491 - DNA, 20 bp, Homo sapiens
acttaaaaaaaaaaaaaagc

SEQ ID NO: 4386492 - DNA, 15 bp, Homo sapiens
acttaaaaaactgca

SEQ ID NO: 4386493 - DNA, 14 bp, Homo sapiens
acttaaaaatggtt

SEQ ID NO: 4386494 - DNA, 17 bp, Homo sapiens
acttaaaattagtcttt

SEQ ID NO: 4386495 - DNA, 18 bp, Homo sapiens
acttaaaattagtctttt

SEQ ID NO: 4386496 - DNA, 18 bp, Homo sapiens
acttaaaggcacaaatag

SEQ ID NO: 4386497 - DNA, 18 bp, Homo sapiens
acttaaatgttattatct

SEQ ID NO: 4386498 - DNA, 21 bp, Homo sapiens
acttaacattcctaaaatgct

SEQ ID NO: 4386499 - DNA, 14 bp, Homo sapiens
acttaaccttgaaa

SEQ ID NO: 4386500 - DNA, 22 bp, Homo sapiens
acttaacgttctataaatgaat

SEQ ID NO: 4386501 - DNA, 12 bp, Homo sapiens
acttaactgttt

SEQ ID NO: 4386502 - DNA, 14 bp, Homo sapiens
acttaactgtttca

SEQ ID NO: 4386503 - DNA, 20 bp, Homo sapiens
acttaagcatctggctctaa

SEQ ID NO: 4386504 - DNA, 18 bp, Homo sapiens
acttaagggttgcttgct

SEQ ID NO: 4386505 - DNA, 19 bp, Homo sapiens
acttaagggttgcttgctt

SEQ ID NO: 4386506 - DNA, 15 bp, Homo sapiens
acttaagtgttcatt

SEQ ID NO: 4386507 - DNA, 16 bp, Homo sapiens
acttaagtgttcattt

SEQ ID NO: 4386508 - DNA, 17 bp, Homo sapiens
acttaagtgttcatttt

SEQ ID NO: 4386509 - DNA, 21 bp, Homo sapiens
acttaagtttgtaagacagtg

SEQ ID NO: 4386510 - DNA, 13 bp, Homo sapiens
acttaataactgt

SEQ ID NO: 4386511 - DNA, 15 bp, Homo sapiens
acttaataactgtgt

SEQ ID NO: 4386512 - DNA, 14 bp, Homo sapiens
acttaatcatttta

SEQ ID NO: 4386513 - DNA, 16 bp, Homo sapiens
acttaatgaccatgtt

SEQ ID NO: 4386514 - DNA, 20 bp, Homo sapiens
acttaatgaccatgttatat

SEQ ID NO: 4386515 - DNA, 13 bp, Homo sapiens
acttaatgtttct

SEQ ID NO: 4386516 - DNA, 19 bp, Homo sapiens
acttaattgctacatctaa

SEQ ID NO: 4386517 - DNA, 14 bp, Homo sapiens
acttaatttactta

SEQ ID NO: 4386518 - DNA, 13 bp, Homo sapiens
acttaatttgaaa

SEQ ID NO: 4386519 - DNA, 17 bp, Homo sapiens
acttaatttgaaatcta

SEQ ID NO: 4386520 - DNA, 12 bp, Homo sapiens
acttacaagaaa

SEQ ID NO: 4386521 - DNA, 14 bp, Homo sapiens
acttacagcttttt

SEQ ID NO: 4386522 - DNA, 23 bp, Homo sapiens
acttacccaggtgggtcccggct

SEQ ID NO: 4386523 - DNA, 16 bp, Homo sapiens
acttacgtaaaacatt

SEQ ID NO: 4386524 - DNA, 17 bp, Homo sapiens
acttacgtaaaacattt

SEQ ID NO: 4386525 - DNA, 12 bp, Homo sapiens
acttagaaactg

SEQ ID NO: 4386526 - DNA, 13 bp, Homo sapiens
acttagaatgcca

SEQ ID NO: 4386527 - DNA, 17 bp, Homo sapiens
acttagacctgccagcc

SEQ ID NO: 4386528 - DNA, 17 bp, Homo sapiens
acttagagtttctgttt

SEQ ID NO: 4386529 - DNA, 18 bp, Homo sapiens
acttagatctccaggaga

SEQ ID NO: 4386530 - DNA, 14 bp, Homo sapiens
acttagcaggcacc

SEQ ID NO: 4386531 - DNA, 22 bp, Homo sapiens
acttagccatttttcaaagcaa

SEQ ID NO: 4386532 - DNA, 22 bp, Homo sapiens
acttagcccaagaggtctgagc

SEQ ID NO: 4386533 - DNA, 15 bp, Homo sapiens
acttagcctgagtca

SEQ ID NO: 4386534 - DNA, 18 bp, Homo sapiens
acttagcgtcaagacatt

SEQ ID NO: 4386535 - DNA, 19 bp, Homo sapiens
acttaggtaaaataaaaga

SEQ ID NO: 4386536 - DNA, 23 bp, Homo sapiens
acttaggtaaaataaaagactat

SEQ ID NO: 4386537 - DNA, 15 bp, Homo sapiens
acttatagattgaaa

SEQ ID NO: 4386538 - DNA, 22 bp, Homo sapiens
acttatatgctgaattgaacat

SEQ ID NO: 4386539 - DNA, 16 bp, Homo sapiens
acttatattaatagta

SEQ ID NO: 4386540 - DNA, 13 bp, Homo sapiens
acttatattttat

SEQ ID NO: 4386541 - DNA, 22 bp, Homo sapiens
acttatattttatgaacattgt

SEQ ID NO: 4386542 - DNA, 20 bp, Homo sapiens
acttatctctaaaccatcta

SEQ ID NO: 4386543 - DNA, 18 bp, Homo sapiens
acttatctctcaaaacaa

SEQ ID NO: 4386544 - DNA, 17 bp, Homo sapiens
acttatcttctggatta

SEQ ID NO: 4386545 - DNA, 17 bp, Homo sapiens
acttatgcatagatata

SEQ ID NO: 4386546 - DNA, 22 bp, Homo sapiens
acttattaatctgtatgaagat

SEQ ID NO: 4386547 - DNA, 19 bp, Homo sapiens
acttattagctgtagagtc

SEQ ID NO: 4386548 - DNA, 13 bp, Homo sapiens
acttattcaaaga

SEQ ID NO: 4386549 - DNA, 13 bp, Homo sapiens
acttatttaatgc

SEQ ID NO: 4386550 - DNA, 15 bp, Homo sapiens
acttatttatataaa

SEQ ID NO: 4386551 - DNA, 11 bp, Homo sapiens
acttatttctg

SEQ ID NO: 4386552 - DNA, 21 bp, Homo sapiens
acttcaaaaataaaaaatctg

SEQ ID NO: 4386553 - DNA, 23 bp, Homo sapiens
acttcaaaaatgttaaaccctta

SEQ ID NO: 4386554 - DNA, 15 bp, Homo sapiens
acttcaaaatattga

SEQ ID NO: 4386555 - DNA, 15 bp, Homo sapiens
acttcaaatatagag

SEQ ID NO: 4386556 - DNA, 15 bp, Homo sapiens
acttcaactgcccag

SEQ ID NO: 4386557 - DNA, 16 bp, Homo sapiens
acttcaactgcccagc

SEQ ID NO: 4386558 - DNA, 22 bp, Homo sapiens
acttcaagtgcatgctctctgc

SEQ ID NO: 4386559 - DNA, 13 bp, Homo sapiens
acttcacactgca

SEQ ID NO: 4386560 - DNA, 21 bp, Homo sapiens
acttcaccaccccctgtccca

SEQ ID NO: 4386561 - DNA, 16 bp, Homo sapiens
acttcactgtatataa

SEQ ID NO: 4386562 - DNA, 21 bp, Homo sapiens
acttcactgtatataaacata

SEQ ID NO: 4386563 - DNA, 22 bp, Homo sapiens
acttcagagagaatgagcagag

SEQ ID NO: 4386564 - DNA, 9 bp, Homo sapiens
acttcagca

SEQ ID NO: 4386565 - DNA, 15 bp, Homo sapiens
acttcagctttgtgt

SEQ ID NO: 4386566 - DNA, 20 bp, Homo sapiens
acttcaggtgtgactctagc

SEQ ID NO: 4386567 - DNA, 21 bp, Homo sapiens
acttcaggtgtgactctagca

SEQ ID NO: 4386568 - DNA, 18 bp, Homo sapiens
acttcagtcttgcctagg

SEQ ID NO: 4386569 - DNA, 12 bp, Homo sapiens
acttcattgttt

SEQ ID NO: 4386570 - DNA, 22 bp, Homo sapiens
acttcattttgtataatcacag

SEQ ID NO: 4386571 - DNA, 21 bp, Homo sapiens
acttccaaatcccctaagcag

SEQ ID NO: 4386572 - DNA, 15 bp, Homo sapiens
acttccaaatcctgg

SEQ ID NO: 4386573 - DNA, 21 bp, Homo sapiens
acttccaagctccaaatccaa

SEQ ID NO: 4386574 - DNA, 13 bp, Homo sapiens
acttccagtctgg

SEQ ID NO: 4386575 - DNA, 20 bp, Homo sapiens
acttcccaggatctgctcca

SEQ ID NO: 4386576 - DNA, 24 bp, Homo sapiens
acttcccaggatctgctccaacag

SEQ ID NO: 4386577 - DNA, 15 bp, Homo sapiens
acttcccatctggct

SEQ ID NO: 4386578 - DNA, 22 bp, Homo sapiens
acttcccattaaaaatgagatt

SEQ ID NO: 4386579 - DNA, 22 bp, Homo sapiens
acttccgctgaggggtctcgga

SEQ ID NO: 4386580 - DNA, 20 bp, Homo sapiens
acttcctgtgcctttcctat

SEQ ID NO: 4386581 - DNA, 17 bp, Homo sapiens
acttcctgtggcctgaa

SEQ ID NO: 4386582 - DNA, 16 bp, Homo sapiens
acttcgaatatatctg

SEQ ID NO: 4386583 - DNA, 21 bp, Homo sapiens
acttcgaatatatctgtaaag

SEQ ID NO: 4386584 - DNA, 15 bp, Homo sapiens
acttcgcacacaccc

SEQ ID NO: 4386585 - DNA, 16 bp, Homo sapiens
acttcgctagaaaaaa

SEQ ID NO: 4386586 - DNA, 13 bp, Homo sapiens
acttctaagtaaa

SEQ ID NO: 4386587 - DNA, 18 bp, Homo sapiens
acttctaagtaaaaccac

SEQ ID NO: 4386588 - DNA, 19 bp, Homo sapiens
acttctaagtaaaaccaca

SEQ ID NO: 4386589 - DNA, 19 bp, Homo sapiens
acttctacctacatatttg

SEQ ID NO: 4386590 - DNA, 14 bp, Homo sapiens
acttctacctgccc

SEQ ID NO: 4386591 - DNA, 16 bp, Homo sapiens
acttctacctgccctc

SEQ ID NO: 4386592 - DNA, 18 bp, Homo sapiens
acttctagatctcagcca

SEQ ID NO: 4386593 - DNA, 23 bp, Homo sapiens
acttctatcatttttgagcaact

SEQ ID NO: 4386594 - DNA, 10 bp, Homo sapiens
acttctccca

SEQ ID NO: 4386595 - DNA, 12 bp, Homo sapiens
acttctccccag

SEQ ID NO: 4386596 - DNA, 16 bp, Homo sapiens
acttctccccgcagcc

SEQ ID NO: 4386597 - DNA, 23 bp, Homo sapiens
acttctctataaaaaatatgtat

SEQ ID NO: 4386598 - DNA, 20 bp, Homo sapiens
acttctcttaaacttgtgaa

SEQ ID NO: 4386599 - DNA, 14 bp, Homo sapiens
acttctcttgcttt

SEQ ID NO: 4386600 - DNA, 21 bp, Homo sapiens
acttctcttgttaggtaattt

SEQ ID NO: 4386601 - DNA, 19 bp, Homo sapiens
acttctgatgtttattaaa

SEQ ID NO: 4386602 - DNA, 14 bp, Homo sapiens
acttctgctggcat

SEQ ID NO: 4386603 - DNA, 18 bp, Homo sapiens
acttctggcctaggaccc

SEQ ID NO: 4386604 - DNA, 12 bp, Homo sapiens
actgtaaatcat

SEQ ID NO: 4386605 - DNA, 14 bp, Homo sapiens
actgtaactgtcag

SEQ ID NO: 4386606 - DNA, 14 bp, Homo sapiens
actgtaagaataat

SEQ ID NO: 4386607 - DNA, 20 bp, Homo sapiens
actgtaagaataatttatag

SEQ ID NO: 4386608 - DNA, 21 bp, Homo sapiens
actgtaatacgtagctctctt

SEQ ID NO: 4386609 - DNA, 22 bp, Homo sapiens
actgtaatacgtagctctctta

SEQ ID NO: 4386610 - DNA, 11 bp, Homo sapiens
actgtacaata

SEQ ID NO: 4386611 - DNA, 18 bp, Homo sapiens
actgtacaataaaaacat

SEQ ID NO: 4386612 - DNA, 13 bp, Homo sapiens
actgtacacactt

SEQ ID NO: 4386613 - DNA, 15 bp, Homo sapiens
actgtacacacttta

SEQ ID NO: 4386614 - DNA, 22 bp, Homo sapiens
actgtacacactttatttactt

SEQ ID NO: 4386615 - DNA, 14 bp, Homo sapiens
actgtacacatttc

SEQ ID NO: 4386616 - DNA, 17 bp, Homo sapiens
actgtacataattgcat

SEQ ID NO: 4386617 - DNA, 18 bp, Homo sapiens
actgtacataattgcatg

SEQ ID NO: 4386618 - DNA, 19 bp, Homo sapiens
actgtacataattgcatga

SEQ ID NO: 4386619 - DNA, 14 bp, Homo sapiens
actgtacattgtga

SEQ ID NO: 4386620 - DNA, 15 bp, Homo sapiens
actgtacattgtgag

SEQ ID NO: 4386621 - DNA, 17 bp, Homo sapiens
actgtacattgtgagct

SEQ ID NO: 4386622 - DNA, 19 bp, Homo sapiens
actgtacattgtgagctct

SEQ ID NO: 4386623 - DNA, 19 bp, Homo sapiens
actgtaccatggtttgata

SEQ ID NO: 4386624 - DNA, 20 bp, Homo sapiens
actgtagagtcctatttcag

SEQ ID NO: 4386625 - DNA, 15 bp, Homo sapiens
actgtagcaggggaa

SEQ ID NO: 4386626 - DNA, 15 bp, Homo sapiens
actgtagccacagct

SEQ ID NO: 4386627 - DNA, 18 bp, Homo sapiens
actgtagccacagctgct

SEQ ID NO: 4386628 - DNA, 21 bp, Homo sapiens
actgtaggtatgatctcttct

SEQ ID NO: 4386629 - DNA, 15 bp, Homo sapiens
actgtaggtcatttt

SEQ ID NO: 4386630 - DNA, 19 bp, Homo sapiens
actgtataacattaagaaa

SEQ ID NO: 4386631 - DNA, 20 bp, Homo sapiens
actgtatataaacatatttt

SEQ ID NO: 4386632 - DNA, 15 bp, Homo sapiens
actgtatattgctaa

SEQ ID NO: 4386633 - DNA, 19 bp, Homo sapiens
actgtatatttgtatgata

SEQ ID NO: 4386634 - DNA, 14 bp, Homo sapiens
actgtatattttgt

SEQ ID NO: 4386635 - DNA, 21 bp, Homo sapiens
actgtatcaatttctaatgtt

SEQ ID NO: 4386636 - DNA, 20 bp, Homo sapiens
actgtatctaggcatttcat

SEQ ID NO: 4386637 - DNA, 16 bp, Homo sapiens
actgtatgttatagaa

SEQ ID NO: 4386638 - DNA, 20 bp, Homo sapiens
actgtatgtttttactgaat

SEQ ID NO: 4386639 - DNA, 17 bp, Homo sapiens
actgtatttcagtattt

SEQ ID NO: 4386640 - DNA, 23 bp, Homo sapiens
actgtatttgaaataagaattca

SEQ ID NO: 4386641 - DNA, 19 bp, Homo sapiens
actgtatttttgaagacta

SEQ ID NO: 4386642 - DNA, 14 bp, Homo sapiens
actgtcacaggcat

SEQ ID NO: 4386643 - DNA, 15 bp, Homo sapiens
actgtcacaggcata

SEQ ID NO: 4386644 - DNA, 21 bp, Homo sapiens
actgtcagattaaattacagc

SEQ ID NO: 4386645 - DNA, 21 bp, Homo sapiens
actgtcatcctcaaagaaagt

SEQ ID NO: 4386646 - DNA, 20 bp, Homo sapiens
actgtcattcccattccttt

SEQ ID NO: 4386647 - DNA, 14 bp, Homo sapiens
actgtccaggagct

SEQ ID NO: 4386648 - DNA, 12 bp, Homo sapiens
actgtccaggga

SEQ ID NO: 4386649 - DNA, 21 bp, Homo sapiens
actgtccagggaaacagcctc

SEQ ID NO: 4386650 - DNA, 23 bp, Homo sapiens
actgtccagggaaacagcctctc

SEQ ID NO: 4386651 - DNA, 12 bp, Homo sapiens
actgtcccagct

SEQ ID NO: 4386652 - DNA, 16 bp, Homo sapiens
actgtcctattatatt

SEQ ID NO: 4386653 - DNA, 18 bp, Homo sapiens
actgtcctattatattca

SEQ ID NO: 4386654 - DNA, 22 bp, Homo sapiens
actgtcctgttgattaatttct

SEQ ID NO: 4386655 - DNA, 18 bp, Homo sapiens
actgtctagagcaacttt

SEQ ID NO: 4386656 - DNA, 15 bp, Homo sapiens
actgtctatttaagt

SEQ ID NO: 4386657 - DNA, 19 bp, Homo sapiens
actgtctatttaagtgcaa

SEQ ID NO: 4386658 - DNA, 19 bp, Homo sapiens
actgtctcaactactcagc

SEQ ID NO: 4386659 - DNA, 14 bp, Homo sapiens
actgtctgtatctt

SEQ ID NO: 4386660 - DNA, 14 bp, Homo sapiens
actgtcttcctcaa

SEQ ID NO: 4386661 - DNA, 20 bp, Homo sapiens
actgtgaaaaaaaatttgtt

SEQ ID NO: 4386662 - DNA, 16 bp, Homo sapiens
actgtgaaaatagtgt

SEQ ID NO: 4386663 - DNA, 21 bp, Homo sapiens
actgtgaaaatagtgtaagaa

SEQ ID NO: 4386664 - DNA, 20 bp, Homo sapiens
actgtgatgtatattgtgtt

SEQ ID NO: 4386665 - DNA, 19 bp, Homo sapiens
actgtgattactctttgct

SEQ ID NO: 4386666 - DNA, 15 bp, Homo sapiens
actgtgattagatca

SEQ ID NO: 4386667 - DNA, 19 bp, Homo sapiens
actgtgattagatcacatc

SEQ ID NO: 4386668 - DNA, 20 bp, Homo sapiens
actgtgattagatcacatct

SEQ ID NO: 4386669 - DNA, 15 bp, Homo sapiens
actgtgcacatctgt

SEQ ID NO: 4386670 - DNA, 17 bp, Homo sapiens
actgtgcctggctccct

SEQ ID NO: 4386671 - DNA, 20 bp, Homo sapiens
actgtgctgtcctttaacat

SEQ ID NO: 4386672 - DNA, 12 bp, Homo sapiens
actgtgctttct

SEQ ID NO: 4386673 - DNA, 14 bp, Homo sapiens
actgtgctttctat

SEQ ID NO: 4386674 - DNA, 20 bp, Homo sapiens
actgtgggaaggccagctgc

SEQ ID NO: 4386675 - DNA, 20 bp, Homo sapiens
actgtgggcaatttagaaaa

SEQ ID NO: 4386676 - DNA, 21 bp, Homo sapiens
actgtggtgacttctgctgct

SEQ ID NO: 4386677 - DNA, 15 bp, Homo sapiens
actgtgtaatataaa

SEQ ID NO: 4386678 - DNA, 22 bp, Homo sapiens
actgtgtaatataaaagatctt

SEQ ID NO: 4386679 - DNA, 16 bp, Homo sapiens
actgtgtataggaatt

SEQ ID NO: 4386680 - DNA, 17 bp, Homo sapiens
actgtgtataggaattt

SEQ ID NO: 4386681 - DNA, 15 bp, Homo sapiens
actgtgtattccaag

SEQ ID NO: 4386682 - DNA, 16 bp, Homo sapiens
actgtgtattccaaga

SEQ ID NO: 4386683 - DNA, 23 bp, Homo sapiens
actgtgtatttatttaaaactct

SEQ ID NO: 4386684 - DNA, 23 bp, Homo sapiens
actgtgtctggcgttctcaagaa

SEQ ID NO: 4386685 - DNA, 20 bp, Homo sapiens
actgtgtgggggacggcttc

SEQ ID NO: 4386686 - DNA, 16 bp, Homo sapiens
actgttaatagtacta

SEQ ID NO: 4386687 - DNA, 21 bp, Homo sapiens
actgttacaacttgtatttcc

SEQ ID NO: 4386688 - DNA, 22 bp, Homo sapiens
actgttacaacttgtatttcca

SEQ ID NO: 4386689 - DNA, 17 bp, Homo sapiens
actgttacaagaggcca

SEQ ID NO: 4386690 - DNA, 12 bp, Homo sapiens
actgttacagac

SEQ ID NO: 4386691 - DNA, 18 bp, Homo sapiens
actgttacagactgaaag

SEQ ID NO: 4386692 - DNA, 20 bp, Homo sapiens
actgttacagtaatgtcata

SEQ ID NO: 4386693 - DNA, 17 bp, Homo sapiens
actgttactttggcaat

SEQ ID NO: 4386694 - DNA, 22 bp, Homo sapiens
actgttactttggcaatttcct

SEQ ID NO: 4386695 - DNA, 19 bp, Homo sapiens
actgttagaacactatttt

SEQ ID NO: 4386696 - DNA, 17 bp, Homo sapiens
actgttagtattaacta

SEQ ID NO: 4386697 - DNA, 13 bp, Homo sapiens
actgttattatgc

SEQ ID NO: 4386698 - DNA, 15 bp, Homo sapiens
actgttccccctgtg

SEQ ID NO: 4386699 - DNA, 16 bp, Homo sapiens
actgttccccctgtgc

SEQ ID NO: 4386700 - DNA, 19 bp, Homo sapiens
actgttctcaacatactgt

SEQ ID NO: 4386701 - DNA, 15 bp, Homo sapiens
actgttctgaaagga

SEQ ID NO: 4386702 - DNA, 19 bp, Homo sapiens
actgttgaaaaagataaag

SEQ ID NO: 4386703 - DNA, 19 bp, Homo sapiens
actgttgcctaattggaaa

SEQ ID NO: 4386704 - DNA, 21 bp, Homo sapiens
actgttgcctaattggaaagt

SEQ ID NO: 4386705 - DNA, 17 bp, Homo sapiens
actgttgctttaatatg

SEQ ID NO: 4386706 - DNA, 21 bp, Homo sapiens
actgttgctttaatatgagct

SEQ ID NO: 4386707 - DNA, 22 bp, Homo sapiens
actgttgctttgaaaaatctca

SEQ ID NO: 4386708 - DNA, 22 bp, Homo sapiens
actgttggtggcaaaattgcca

SEQ ID NO: 4386709 - DNA, 14 bp, Homo sapiens
actgtttaattgaa

SEQ ID NO: 4386710 - DNA, 20 bp, Homo sapiens
actgtttcaagccctcctcc

SEQ ID NO: 4386711 - DNA, 23 bp, Homo sapiens
actgtttcaagccctcctcccca

SEQ ID NO: 4386712 - DNA, 14 bp, Homo sapiens
actccatacagcct

SEQ ID NO: 4386713 - DNA, 17 bp, Homo sapiens
actccatacagcctcta

SEQ ID NO: 4386714 - DNA, 16 bp, Homo sapiens
actccatctctttaaa

SEQ ID NO: 4386715 - DNA, 14 bp, Homo sapiens
actccatcttcaat

SEQ ID NO: 4386716 - DNA, 19 bp, Homo sapiens
actccatgctccttgagag

SEQ ID NO: 4386717 - DNA, 20 bp, Homo sapiens
actccatggggttcgagact

SEQ ID NO: 4386718 - DNA, 20 bp, Homo sapiens
actccatgtttggtgtttgt

SEQ ID NO: 4386719 - DNA, 16 bp, Homo sapiens
actcccacagcagccc

SEQ ID NO: 4386720 - DNA, 20 bp, Homo sapiens
actcccacagcagccccagg

SEQ ID NO: 4386721 - DNA, 15 bp, Homo sapiens
actcccatgaagcct

SEQ ID NO: 4386722 - DNA, 17 bp, Homo sapiens
actcccatgaagccttt

SEQ ID NO: 4386723 - DNA, 23 bp, Homo sapiens
actcccatgagggagatgccatg

SEQ ID NO: 4386724 - DNA, 17 bp, Homo sapiens
actcccctctcctcccc

SEQ ID NO: 4386725 - DNA, 21 bp, Homo sapiens
actccctccatagcgacaccc

SEQ ID NO: 4386726 - DNA, 15 bp, Homo sapiens
actccctcctcacct

SEQ ID NO: 4386727 - DNA, 21 bp, Homo sapiens
actccctgggacacagaccca

SEQ ID NO: 4386728 - DNA, 20 bp, Homo sapiens
actcccttctacctgccact

SEQ ID NO: 4386729 - DNA, 21 bp, Homo sapiens
actcccttctacctgccactc

SEQ ID NO: 4386730 - DNA, 20 bp, Homo sapiens
actcccttctcgtgtttgct

SEQ ID NO: 4386731 - DNA, 14 bp, Homo sapiens
actcccttgggctc

SEQ ID NO: 4386732 - DNA, 18 bp, Homo sapiens
actccgagtgaactggtc

SEQ ID NO: 4386733 - DNA, 16 bp, Homo sapiens
actccgcgccgatgcc

SEQ ID NO: 4386734 - DNA, 23 bp, Homo sapiens
actccgcggagtgatcatggaaa

SEQ ID NO: 4386735 - DNA, 16 bp, Homo sapiens
actccggaggactgag

SEQ ID NO: 4386736 - DNA, 18 bp, Homo sapiens
actccggaggactgagcc

SEQ ID NO: 4386737 - DNA, 17 bp, Homo sapiens
actctttctgagtgcct

SEQ ID NO: 4386738 - DNA, 20 bp, Homo sapiens
actctttctgagtgccttct

SEQ ID NO: 4386739 - DNA, 14 bp, Homo sapiens
actctttctgtata

SEQ ID NO: 4386740 - DNA, 21 bp, Homo sapiens
actctttctgtatatactttt

SEQ ID NO: 4386741 - DNA, 23 bp, Homo sapiens
actctttctttgcaacagcagtg

SEQ ID NO: 4386742 - DNA, 14 bp, Homo sapiens
actcttttaagtgc

SEQ ID NO: 4386743 - DNA, 15 bp, Homo sapiens
actcttttaagtgcc

SEQ ID NO: 4386744 - DNA, 22 bp, Homo sapiens
actgaaaaaaaaaaagaagaag

SEQ ID NO: 4386745 - DNA, 20 bp, Homo sapiens
actgaaagccttagggaagc

SEQ ID NO: 4386746 - DNA, 17 bp, Homo sapiens
actgaaatctgtcaaga

SEQ ID NO: 4386747 - DNA, 22 bp, Homo sapiens
actgaacaccattgaaggctta

SEQ ID NO: 4386748 - DNA, 10 bp, Homo sapiens
actgaacagg

SEQ ID NO: 4386749 - DNA, 13 bp, Homo sapiens
actgaacattcca

SEQ ID NO: 4386750 - DNA, 16 bp, Homo sapiens
actgaacattccagag

SEQ ID NO: 4386751 - DNA, 19 bp, Homo sapiens
actgaacgatccttcaaag

SEQ ID NO: 4386752 - DNA, 21 bp, Homo sapiens
actgaactattttaaataaaa

SEQ ID NO: 4386753 - DNA, 15 bp, Homo sapiens
actgaactgctttta

SEQ ID NO: 4386754 - DNA, 13 bp, Homo sapiens
actgaactgtaac

SEQ ID NO: 4386755 - DNA, 13 bp, Homo sapiens
actgaagagctct

SEQ ID NO: 4386756 - DNA, 15 bp, Homo sapiens
actgaagagctcttg

SEQ ID NO: 4386757 - DNA, 18 bp, Homo sapiens
actgaagagctcttggcc

SEQ ID NO: 4386758 - DNA, 15 bp, Homo sapiens
actgaagatggcttt

SEQ ID NO: 4386759 - DNA, 20 bp, Homo sapiens
actgaaggaaaaacacaagc

SEQ ID NO: 4386760 - DNA, 23 bp, Homo sapiens
actgaaggcagcatgtatagttg

SEQ ID NO: 4386761 - DNA, 20 bp, Homo sapiens
actgaatgaagcagtatttt

SEQ ID NO: 4386762 - DNA, 15 bp, Homo sapiens
actgaatgatctatt

SEQ ID NO: 4386763 - DNA, 11 bp, Homo sapiens
actgaatgtta

SEQ ID NO: 4386764 - DNA, 18 bp, Homo sapiens
actgaattggcttccaga

SEQ ID NO: 4386765 - DNA, 19 bp, Homo sapiens
actgaattggcttccagat

SEQ ID NO: 4386766 - DNA, 14 bp, Homo sapiens
actgaattgtatca

SEQ ID NO: 4386767 - DNA, 18 bp, Homo sapiens
actgaattttgggacttc

SEQ ID NO: 4386768 - DNA, 20 bp, Homo sapiens
actgaattttgggacttcta

SEQ ID NO: 4386769 - DNA, 15 bp, Homo sapiens
actgaatttttttgt

SEQ ID NO: 4386770 - DNA, 21 bp, Homo sapiens
actgaccaatattgtacagtt

SEQ ID NO: 4386771 - DNA, 17 bp, Homo sapiens
actgaccttaaaactca

SEQ ID NO: 4386772 - DNA, 15 bp, Homo sapiens
actgacgtcctccct

SEQ ID NO: 4386773 - DNA, 14 bp, Homo sapiens
actgactaagaaga

SEQ ID NO: 4386774 - DNA, 14 bp, Homo sapiens
actgactctgttat

SEQ ID NO: 4386775 - DNA, 16 bp, Homo sapiens
actgactggaggaggc

SEQ ID NO: 4386776 - DNA, 23 bp, Homo sapiens
actgactggatggtccagtgtca

SEQ ID NO: 4386777 - DNA, 21 bp, Homo sapiens
actgacttaatgctcttcaaa

SEQ ID NO: 4386778 - DNA, 16 bp, Homo sapiens
actgacttctaagtaa

SEQ ID NO: 4386779 - DNA, 20 bp, Homo sapiens
actgacttggatcccaaagc

SEQ ID NO: 4386780 - DNA, 16 bp, Homo sapiens
actgagaaatgaatgc

SEQ ID NO: 4386781 - DNA, 15 bp, Homo sapiens
actgagaatatacaa

SEQ ID NO: 4386782 - DNA, 20 bp, Homo sapiens
actgagaatgtaagaactac

SEQ ID NO: 4386783 - DNA, 19 bp, Homo sapiens
actgagataccagcgagga

SEQ ID NO: 4386784 - DNA, 17 bp, Homo sapiens
actgagatgtgaacaca

SEQ ID NO: 4386785 - DNA, 22 bp, Homo sapiens
actgagatgtgaacacatcagc

SEQ ID NO: 4386786 - DNA, 15 bp, Homo sapiens
actgagcagccgcca

SEQ ID NO: 4386787 - DNA, 13 bp, Homo sapiens
actgagcccccac

SEQ ID NO: 4386788 - DNA, 14 bp, Homo sapiens
actgagcccccacc

SEQ ID NO: 4386789 - DNA, 20 bp, Homo sapiens
actgagctgtccagtggagg

SEQ ID NO: 4386790 - DNA, 22 bp, Homo sapiens
actgaggagatgaccagggatg

SEQ ID NO: 4386791 - DNA, 13 bp, Homo sapiens
actgaggcctgag

SEQ ID NO: 4386792 - DNA, 17 bp, Homo sapiens
actgagggactctgaag

SEQ ID NO: 4386793 - DNA, 12 bp, Homo sapiens
actgagggcagt

SEQ ID NO: 4386794 - DNA, 19 bp, Homo sapiens
actgagggctctgtttgtg

SEQ ID NO: 4386795 - DNA, 19 bp, Homo sapiens
actgagggggcctggatgc

SEQ ID NO: 4386796 - DNA, 15 bp, Homo sapiens
actgagtgggaagcc

SEQ ID NO: 4386797 - DNA, 14 bp, Homo sapiens
actgagttgcacat

SEQ ID NO: 4386798 - DNA, 15 bp, Homo sapiens
actgagttgcacata

SEQ ID NO: 4386799 - DNA, 17 bp, Homo sapiens
actgatatattttacaa

SEQ ID NO: 4386800 - DNA, 20 bp, Homo sapiens
actgatgagcacatctctct

SEQ ID NO: 4386801 - DNA, 15 bp, Homo sapiens
actgatgcttagatg

SEQ ID NO: 4386802 - DNA, 14 bp, Homo sapiens
actgatgggaataa

SEQ ID NO: 4386803 - DNA, 18 bp, Homo sapiens
actgatgtacaattaaaa

SEQ ID NO: 4386804 - DNA, 18 bp, Homo sapiens
actgatgttgtgttttta

SEQ ID NO: 4386805 - DNA, 17 bp, Homo sapiens
actgattaaaaatacct

SEQ ID NO: 4386806 - DNA, 16 bp, Homo sapiens
actgattacctgccaa

SEQ ID NO: 4386807 - DNA, 17 bp, Homo sapiens
actgattagtattcagg

SEQ ID NO: 4386808 - DNA, 16 bp, Homo sapiens
actgatttaacacttt

SEQ ID NO: 4386809 - DNA, 15 bp, Homo sapiens
actgatttcagtaag

SEQ ID NO: 4386810 - DNA, 12 bp, Homo sapiens
actgatttctat

SEQ ID NO: 4386811 - DNA, 13 bp, Homo sapiens
actgatttctatg

SEQ ID NO: 4386812 - DNA, 18 bp, Homo sapiens
actgatttctatggcttt

SEQ ID NO: 4386813 - DNA, 22 bp, Homo sapiens
actgatttctatggctttcaaa

SEQ ID NO: 4386814 - DNA, 21 bp, Homo sapiens
actgcaaatcaggcttttgtt

SEQ ID NO: 4386815 - DNA, 14 bp, Homo sapiens
actgcaaattttaa

SEQ ID NO: 4386816 - DNA, 17 bp, Homo sapiens
actgcaagcatttttcc

SEQ ID NO: 4386817 - DNA, 19 bp, Homo sapiens
actgcaagcatttttccat

SEQ ID NO: 4386818 - DNA, 15 bp, Homo sapiens
actgcaatgtgatct

SEQ ID NO: 4386819 - DNA, 17 bp, Homo sapiens
actgcactccagcctga

SEQ ID NO: 4386820 - DNA, 20 bp, Homo sapiens
actgcactccagcctgggtc

SEQ ID NO: 4386821 - DNA, 14 bp, Homo sapiens
actgcactttgttt

SEQ ID NO: 4386822 - DNA, 18 bp, Homo sapiens
actgcactttgtttagaa

SEQ ID NO: 4386823 - DNA, 17 bp, Homo sapiens
actgcacttttttattg

SEQ ID NO: 4386824 - DNA, 22 bp, Homo sapiens
actgcagaaacctttaaaaaaa

SEQ ID NO: 4386825 - DNA, 16 bp, Homo sapiens
actgcagacctgtcct

SEQ ID NO: 4386826 - DNA, 18 bp, Homo sapiens
actgcagacctgtcctcc

SEQ ID NO: 4386827 - DNA, 15 bp, Homo sapiens
actgcagaggggaaa

SEQ ID NO: 4386828 - DNA, 12 bp, Homo sapiens
actgcaggcccc

SEQ ID NO: 4386829 - DNA, 15 bp, Homo sapiens
actgcaggccccgct

SEQ ID NO: 4386830 - DNA, 23 bp, Homo sapiens
actgcaggccccgcttgtccagc

SEQ ID NO: 4386831 - DNA, 20 bp, Homo sapiens
actgcatactttttaaatgt

SEQ ID NO: 4386832 - DNA, 23 bp, Homo sapiens
actgcatactttttaaatgtaaa

SEQ ID NO: 4386833 - DNA, 20 bp, Homo sapiens
actgcatcatctgtttgtaa

SEQ ID NO: 4386834 - DNA, 14 bp, Homo sapiens
actgcatccagcct

SEQ ID NO: 4386835 - DNA, 20 bp, Homo sapiens
actgcatcccacgttctgtt

SEQ ID NO: 4386836 - DNA, 14 bp, Homo sapiens
actgcatctggatt

SEQ ID NO: 4386837 - DNA, 13 bp, Homo sapiens
accagctgcaaag

SEQ ID NO: 4386838 - DNA, 17 bp, Homo sapiens
accagctgcaaagtgtt

SEQ ID NO: 4386839 - DNA, 19 bp, Homo sapiens
accagctgcgcttgctttt

SEQ ID NO: 4386840 - DNA, 22 bp, Homo sapiens
accagctgctccgaggacccag

SEQ ID NO: 4386841 - DNA, 20 bp, Homo sapiens
accagcttagccaacatagt

SEQ ID NO: 4386842 - DNA, 13 bp, Homo sapiens
accagcttttaac

SEQ ID NO: 4386843 - DNA, 19 bp, Homo sapiens
accagcttttaaccatctg

SEQ ID NO: 4386844 - DNA, 13 bp, Homo sapiens
accaggaacagca

SEQ ID NO: 4386845 - DNA, 20 bp, Homo sapiens
accaggagaaccactacatg

SEQ ID NO: 4386846 - DNA, 19 bp, Homo sapiens
accaggcaccaaaagaagt

SEQ ID NO: 4386847 - DNA, 20 bp, Homo sapiens
accaggcaccaaaagaagta

SEQ ID NO: 4386848 - DNA, 23 bp, Homo sapiens
accaggcacgaacccacctgctg

SEQ ID NO: 4386849 - DNA, 13 bp, Homo sapiens
accaggccagctc

SEQ ID NO: 4386850 - DNA, 15 bp, Homo sapiens
accaggccagctcag

SEQ ID NO: 4386851 - DNA, 13 bp, Homo sapiens
accaggccccagc

SEQ ID NO: 4386852 - DNA, 17 bp, Homo sapiens
accaggccgtgccttgt

SEQ ID NO: 4386853 - DNA, 18 bp, Homo sapiens
accaggctggagtgcagt

SEQ ID NO: 4386854 - DNA, 21 bp, Homo sapiens
accagggatcacagaccacag

SEQ ID NO: 4386855 - DNA, 14 bp, Homo sapiens
accagggatgctgg

SEQ ID NO: 4386856 - DNA, 18 bp, Homo sapiens
accagggatgctgggctg

SEQ ID NO: 4386857 - DNA, 23 bp, Homo sapiens
accagggatgctgggctgggccc

SEQ ID NO: 4386858 - DNA, 14 bp, Homo sapiens
accagggctccagg

SEQ ID NO: 4386859 - DNA, 16 bp, Homo sapiens
accagggtggccacac

SEQ ID NO: 4386860 - DNA, 21 bp, Homo sapiens
accagggttgaccccagagga

SEQ ID NO: 4386861 - DNA, 17 bp, Homo sapiens
accaggtgcctttcaaa

SEQ ID NO: 4386862 - DNA, 19 bp, Homo sapiens
accagtaaggaaatattaa

SEQ ID NO: 4386863 - DNA, 14 bp, Homo sapiens
accagtatttagaa

SEQ ID NO: 4386864 - DNA, 18 bp, Homo sapiens
accagtatttagaagcca

SEQ ID NO: 4386865 - DNA, 23 bp, Homo sapiens
accagtatttttgctgcttctga

SEQ ID NO: 4386866 - DNA, 15 bp, Homo sapiens
accagtcccatgctg

SEQ ID NO: 4386867 - DNA, 22 bp, Homo sapiens
accagtcccatgctggctgaag

SEQ ID NO: 4386868 - DNA, 19 bp, Homo sapiens
accagtctcctcactctgt

SEQ ID NO: 4386869 - DNA, 13 bp, Homo sapiens
accagtgaatttt

SEQ ID NO: 4386870 - DNA, 17 bp, Homo sapiens
accagtgaatttttgca

SEQ ID NO: 4386871 - DNA, 22 bp, Homo sapiens
accagtgaatttttgcaataat

SEQ ID NO: 4386872 - DNA, 13 bp, Homo sapiens
accagtgcctctc

SEQ ID NO: 4386873 - DNA, 14 bp, Homo sapiens
accagtgcctgtga

SEQ ID NO: 4386874 - DNA, 21 bp, Homo sapiens
accagtggcgttgttgcatgt

SEQ ID NO: 4386875 - DNA, 22 bp, Homo sapiens
accagtggcgttgttgcatgtt

SEQ ID NO: 4386876 - DNA, 14 bp, Homo sapiens
accagtgttgggtt

SEQ ID NO: 4386877 - DNA, 16 bp, Homo sapiens
accagttggccatgat

SEQ ID NO: 4386878 - DNA, 17 bp, Homo sapiens
accagtttcttaaactg

SEQ ID NO: 4386879 - DNA, 14 bp, Homo sapiens
accagttttcttta

SEQ ID NO: 4386880 - DNA, 13 bp, Homo sapiens
accataaaaagag

SEQ ID NO: 4386881 - DNA, 22 bp, Homo sapiens
accataatgtactgatttcagt

SEQ ID NO: 4386882 - DNA, 22 bp, Homo sapiens
accatagcacaggctaattttt

SEQ ID NO: 4386883 - DNA, 21 bp, Homo sapiens
accatatagattttattatgt

SEQ ID NO: 4386884 - DNA, 22 bp, Homo sapiens
accatcaaaggaatataagaaa

SEQ ID NO: 4386885 - DNA, 15 bp, Homo sapiens
accatcagctctgcc

SEQ ID NO: 4386886 - DNA, 18 bp, Homo sapiens
accatcagctctgccttg

SEQ ID NO: 4386887 - DNA, 22 bp, Homo sapiens
accatcagctctgccttgcact

SEQ ID NO: 4386888 - DNA, 17 bp, Homo sapiens
accatccccaccccacc

SEQ ID NO: 4386889 - DNA, 21 bp, Homo sapiens
accatctatgtgaatatttgt

SEQ ID NO: 4386890 - DNA, 14 bp, Homo sapiens
accatctctttacc

SEQ ID NO: 4386891 - DNA, 22 bp, Homo sapiens
accatctgaaagtggtacttga

SEQ ID NO: 4386892 - DNA, 18 bp, Homo sapiens
accatctggggcacctgc

SEQ ID NO: 4386893 - DNA, 19 bp, Homo sapiens
acgtttgcagtcacacaca

SEQ ID NO: 4386894 - DNA, 17 bp, Homo sapiens
acgttttagaaaatttt

SEQ ID NO: 4386895 - DNA, 17 bp, Homo sapiens
actaaaaagttgaacca

SEQ ID NO: 4386896 - DNA, 18 bp, Homo sapiens
actaaaaagttgaaccat

SEQ ID NO: 4386897 - DNA, 13 bp, Homo sapiens
actaaaaatattg

SEQ ID NO: 4386898 - DNA, 15 bp, Homo sapiens
actaaaaatattgtt

SEQ ID NO: 4386899 - DNA, 12 bp, Homo sapiens
actaaaaatgca

SEQ ID NO: 4386900 - DNA, 15 bp, Homo sapiens
actaaacagaaaact

SEQ ID NO: 4386901 - DNA, 17 bp, Homo sapiens
actaaaccaactctaat

SEQ ID NO: 4386902 - DNA, 17 bp, Homo sapiens
actaaactacattataa

SEQ ID NO: 4386903 - DNA, 18 bp, Homo sapiens
actaaactttttttctgt

SEQ ID NO: 4386904 - DNA, 20 bp, Homo sapiens
actaaactttttttctgtac

SEQ ID NO: 4386905 - DNA, 16 bp, Homo sapiens
actaaataaacacgat

SEQ ID NO: 4386906 - DNA, 15 bp, Homo sapiens
actaaatcttttata

SEQ ID NO: 4386907 - DNA, 19 bp, Homo sapiens
actaaatgatctctgaaag

SEQ ID NO: 4386908 - DNA, 17 bp, Homo sapiens
actaaatttttcataga

SEQ ID NO: 4386909 - DNA, 21 bp, Homo sapiens
actaacagctacaaactttta

SEQ ID NO: 4386910 - DNA, 18 bp, Homo sapiens
actaacaggccaaagagt

SEQ ID NO: 4386911 - DNA, 19 bp, Homo sapiens
actaaccatccccaactcc

SEQ ID NO: 4386912 - DNA, 13 bp, Homo sapiens
actaactggcagg

SEQ ID NO: 4386913 - DNA, 17 bp, Homo sapiens
actaagagaagttgtaa

SEQ ID NO: 4386914 - DNA, 15 bp, Homo sapiens
actaagccaggcctg

SEQ ID NO: 4386915 - DNA, 16 bp, Homo sapiens
actaagccaggcctgg

SEQ ID NO: 4386916 - DNA, 21 bp, Homo sapiens
actaagccaggcctggctgga

SEQ ID NO: 4386917 - DNA, 12 bp, Homo sapiens
actaagcctttg

SEQ ID NO: 4386918 - DNA, 21 bp, Homo sapiens
actaaggatttttcaagagat

SEQ ID NO: 4386919 - DNA, 18 bp, Homo sapiens
actaagtagcccataagg

SEQ ID NO: 4386920 - DNA, 14 bp, Homo sapiens
actaatagaacttg

SEQ ID NO: 4386921 - DNA, 17 bp, Homo sapiens
actaatatatgaaataa

SEQ ID NO: 4386922 - DNA, 18 bp, Homo sapiens
actaatatatttaaaaat

SEQ ID NO: 4386923 - DNA, 20 bp, Homo sapiens
actaatatatttaaaaataa

SEQ ID NO: 4386924 - DNA, 18 bp, Homo sapiens
actaatcacaaactgaat

SEQ ID NO: 4386925 - DNA, 21 bp, Homo sapiens
actaatgaagtattacatgat

SEQ ID NO: 4386926 - DNA, 22 bp, Homo sapiens
actaatgaagtattacatgatt

SEQ ID NO: 4386927 - DNA, 24 bp, Homo sapiens
actaatgccttactcttcttgaaa

SEQ ID NO: 4386928 - DNA, 18 bp, Homo sapiens
actaatgcttacaacttt

SEQ ID NO: 4386929 - DNA, 12 bp, Homo sapiens
actaatgtgatg

SEQ ID NO: 4386930 - DNA, 11 bp, Homo sapiens
actaatgtgtc

SEQ ID NO: 4386931 - DNA, 22 bp, Homo sapiens
actaattggctacatgttgcaa

SEQ ID NO: 4386932 - DNA, 17 bp, Homo sapiens
actaatttatactttaa

SEQ ID NO: 4386933 - DNA, 18 bp, Homo sapiens
actaatttttgtattatt

SEQ ID NO: 4386934 - DNA, 18 bp, Homo sapiens
actacaaacaaaatttct

SEQ ID NO: 4386935 - DNA, 20 bp, Homo sapiens
actacaaacaaaatttctat

SEQ ID NO: 4386936 - DNA, 21 bp, Homo sapiens
actacaaacaaaatttctatt

SEQ ID NO: 4386937 - DNA, 11 bp, Homo sapiens
actacaaatca

SEQ ID NO: 4386938 - DNA, 13 bp, Homo sapiens
actacaaatcaag

SEQ ID NO: 4386939 - DNA, 16 bp, Homo sapiens
actacagctatatttg

SEQ ID NO: 4386940 - DNA, 17 bp, Homo sapiens
actacagcttcagtgat

SEQ ID NO: 4386941 - DNA, 15 bp, Homo sapiens
actacagtcaggaaa

SEQ ID NO: 4386942 - DNA, 16 bp, Homo sapiens
actacagtctaaagct

SEQ ID NO: 4386943 - DNA, 17 bp, Homo sapiens
actacagtctaaagctg

SEQ ID NO: 4386944 - DNA, 18 bp, Homo sapiens
actacagtgattcatgta

SEQ ID NO: 4386945 - DNA, 13 bp, Homo sapiens
actacatctgcct

SEQ ID NO: 4386946 - DNA, 22 bp, Homo sapiens
actacattgagtagacacattt

SEQ ID NO: 4386947 - DNA, 23 bp, Homo sapiens
actacatttctactatgatcaga

SEQ ID NO: 4386948 - DNA, 16 bp, Homo sapiens
actaccaatcccaact

SEQ ID NO: 4386949 - DNA, 13 bp, Homo sapiens
actaccagccagc

SEQ ID NO: 4386950 - DNA, 14 bp, Homo sapiens
actaccagccagcc

SEQ ID NO: 4386951 - DNA, 14 bp, Homo sapiens
actacgtgccagct

SEQ ID NO: 4386952 - DNA, 14 bp, Homo sapiens
actactaaggcctt

SEQ ID NO: 4386953 - DNA, 14 bp, Homo sapiens
actactatttttct

SEQ ID NO: 4386954 - DNA, 19 bp, Homo sapiens
actactcctctgcagtgcc

SEQ ID NO: 4386955 - DNA, 15 bp, Homo sapiens
actactctttgattt

SEQ ID NO: 4386956 - DNA, 15 bp, Homo sapiens
actactgacagggag

SEQ ID NO: 4386957 - DNA, 20 bp, Homo sapiens
actactgacagggagcagcc

SEQ ID NO: 4386958 - DNA, 22 bp, Homo sapiens
actactgcctttagaaaatata

SEQ ID NO: 4386959 - DNA, 16 bp, Homo sapiens
actactgggtgtcatt

SEQ ID NO: 4386960 - DNA, 21 bp, Homo sapiens
actactgggtgtcatttcatt

SEQ ID NO: 4386961 - DNA, 23 bp, Homo sapiens
actacttgtggggctaaggcagg

SEQ ID NO: 4386962 - DNA, 16 bp, Homo sapiens
actagaaattgggcag

SEQ ID NO: 4386963 - DNA, 23 bp, Homo sapiens
actagaacctggagggctagaac

SEQ ID NO: 4386964 - DNA, 23 bp, Homo sapiens
actagaagggccagtcctgcctg

SEQ ID NO: 4386965 - DNA, 12 bp, Homo sapiens
actagagaatgc

SEQ ID NO: 4386966 - DNA, 12 bp, Homo sapiens
actagatgtagt

SEQ ID NO: 4386967 - DNA, 13 bp, Homo sapiens
actagatgtagta

SEQ ID NO: 4386968 - DNA, 16 bp, Homo sapiens
actagcattacattat

SEQ ID NO: 4386969 - DNA, 20 bp, Homo sapiens
actagcattacattattaaa

SEQ ID NO: 4386970 - DNA, 21 bp, Homo sapiens
actagctgggactacaggtgc

SEQ ID NO: 4386971 - DNA, 20 bp, Homo sapiens
actagctttgctctttagat

SEQ ID NO: 4386972 - DNA, 23 bp, Homo sapiens
actaggctgagcaatctgaccct

SEQ ID NO: 4386973 - DNA, 13 bp, Homo sapiens
actaggtgtcccc

SEQ ID NO: 4386974 - DNA, 15 bp, Homo sapiens
actaggtgtccccaa

SEQ ID NO: 4386975 - DNA, 14 bp, Homo sapiens
actataagatacaa

SEQ ID NO: 4386976 - DNA, 20 bp, Homo sapiens
actataagcaagaaggcaaa

SEQ ID NO: 4386977 - DNA, 14 bp, Homo sapiens
actataatcaaatg

SEQ ID NO: 4386978 - DNA, 14 bp, Homo sapiens
actatacttgaaca

SEQ ID NO: 4386979 - DNA, 21 bp, Homo sapiens
actatataatttatttccact

SEQ ID NO: 4386980 - DNA, 14 bp, Homo sapiens
acattttgtaaaat

SEQ ID NO: 4386981 - DNA, 14 bp, Homo sapiens
acattttgtatgga

SEQ ID NO: 4386982 - DNA, 22 bp, Homo sapiens
acattttgtatggagttaaata

SEQ ID NO: 4386983 - DNA, 23 bp, Homo sapiens
acattttgtttttactgtatgtt

SEQ ID NO: 4386984 - DNA, 16 bp, Homo sapiens
acatttttaaatgtaa

SEQ ID NO: 4386985 - DNA, 16 bp, Homo sapiens
acatttttaagatgca

SEQ ID NO: 4386986 - DNA, 21 bp, Homo sapiens
acatttttcagatataaaaga

SEQ ID NO: 4386987 - DNA, 13 bp, Homo sapiens
acatttttcattc

SEQ ID NO: 4386988 - DNA, 17 bp, Homo sapiens
acatttttcattcatga

SEQ ID NO: 4386989 - DNA, 19 bp, Homo sapiens
acatttttcattcatgaat

SEQ ID NO: 4386990 - DNA, 23 bp, Homo sapiens
acatttttggatttctgtgaagt

SEQ ID NO: 4386991 - DNA, 17 bp, Homo sapiens
acattttttaactttct

SEQ ID NO: 4386992 - DNA, 16 bp, Homo sapiens
acattttttatacatt

SEQ ID NO: 4386993 - DNA, 15 bp, Homo sapiens
accaaaaaaaggaag

SEQ ID NO: 4386994 - DNA, 16 bp, Homo sapiens
accaaaaaaaggaagg

SEQ ID NO: 4386995 - DNA, 13 bp, Homo sapiens
accaaaaacattt

SEQ ID NO: 4386996 - DNA, 14 bp, Homo sapiens
accaaaaacatttg

SEQ ID NO: 4386997 - DNA, 16 bp, Homo sapiens
accaaaaatagaaatt

SEQ ID NO: 4386998 - DNA, 13 bp, Homo sapiens
accaaaagaagta

SEQ ID NO: 4386999 - DNA, 21 bp, Homo sapiens
accaaacccaggttcatgaat

SEQ ID NO: 4387000 - DNA, 14 bp, Homo sapiens
accaaactcacgga

SEQ ID NO: 4387001 - DNA, 21 bp, Homo sapiens
accaaactcctatttcaatga

SEQ ID NO: 4387002 - DNA, 20 bp, Homo sapiens
accaaactgggtcttcagct

SEQ ID NO: 4387003 - DNA, 21 bp, Homo sapiens
accaaactgggtcttcagctt

SEQ ID NO: 4387004 - DNA, 17 bp, Homo sapiens
accaaagacatcagtct

SEQ ID NO: 4387005 - DNA, 14 bp, Homo sapiens
accaaatacctcaa

SEQ ID NO: 4387006 - DNA, 15 bp, Homo sapiens
accaaatacctcaat

SEQ ID NO: 4387007 - DNA, 13 bp, Homo sapiens
accaaatctcagt

SEQ ID NO: 4387008 - DNA, 16 bp, Homo sapiens
accaaatgaaatgcca

SEQ ID NO: 4387009 - DNA, 13 bp, Homo sapiens
accaaatgtagtt

SEQ ID NO: 4387010 - DNA, 15 bp, Homo sapiens
accaaattaaaaaaa

SEQ ID NO: 4387011 - DNA, 14 bp, Homo sapiens
accaaattgcttct

SEQ ID NO: 4387012 - DNA, 16 bp, Homo sapiens
accaaattgcttctag

SEQ ID NO: 4387013 - DNA, 19 bp, Homo sapiens
accaacacgagcaggctac

SEQ ID NO: 4387014 - DNA, 15 bp, Homo sapiens
accaacctgctctgt

SEQ ID NO: 4387015 - DNA, 21 bp, Homo sapiens
accaactctaatattgcttct

SEQ ID NO: 4387016 - DNA, 23 bp, Homo sapiens
accaactgaaggctaaaaagcaa

SEQ ID NO: 4387017 - DNA, 16 bp, Homo sapiens
accaactgccccaggg

SEQ ID NO: 4387018 - DNA, 17 bp, Homo sapiens
accaactgccccagggg

SEQ ID NO: 4387019 - DNA, 18 bp, Homo sapiens
accaagctcacagttcct

SEQ ID NO: 4387020 - DNA, 19 bp, Homo sapiens
accaagctcacagttcctc

SEQ ID NO: 4387021 - DNA, 20 bp, Homo sapiens
accaaggacggaaaatgctt

SEQ ID NO: 4387022 - DNA, 20 bp, Homo sapiens
accaaggctgattaaaccaa

SEQ ID NO: 4387023 - DNA, 19 bp, Homo sapiens
accaaggggtggccgggca

SEQ ID NO: 4387024 - DNA, 21 bp, Homo sapiens
accaaggggtggccgggcaca

SEQ ID NO: 4387025 - DNA, 17 bp, Homo sapiens
accaagggtacagatcc

SEQ ID NO: 4387026 - DNA, 16 bp, Homo sapiens
accaagtgctggccca

SEQ ID NO: 4387027 - DNA, 11 bp, Homo sapiens
accaatatata

SEQ ID NO: 4387028 - DNA, 13 bp, Homo sapiens
accaatcagcact

SEQ ID NO: 4387029 - DNA, 14 bp, Homo sapiens
accaatgaaaaaat

SEQ ID NO: 4387030 - DNA, 17 bp, Homo sapiens
accaatgaaaacatgta

SEQ ID NO: 4387031 - DNA, 22 bp, Homo sapiens
accaatgcctttttagatgtat

SEQ ID NO: 4387032 - DNA, 13 bp, Homo sapiens
accaatgtcttga

SEQ ID NO: 4387033 - DNA, 22 bp, Homo sapiens
accaatttggtaaaaatgctgc

SEQ ID NO: 4387034 - DNA, 18 bp, Homo sapiens
accacaaaaaaatacctc

SEQ ID NO: 4387035 - DNA, 16 bp, Homo sapiens
accacaaatgcataaa

SEQ ID NO: 4387036 - DNA, 20 bp, Homo sapiens
accacaactaacaatgcctt

SEQ ID NO: 4387037 - DNA, 20 bp, Homo sapiens
accacaagacatttctttct

SEQ ID NO: 4387038 - DNA, 23 bp, Homo sapiens
accacaagacatttctttctgtt

SEQ ID NO: 4387039 - DNA, 13 bp, Homo sapiens
accacaagcatct

SEQ ID NO: 4387040 - DNA, 15 bp, Homo sapiens
acatgcagcccatgc

SEQ ID NO: 4387041 - DNA, 22 bp, Homo sapiens
acatgcagcccatgcccacctg

SEQ ID NO: 4387042 - DNA, 18 bp, Homo sapiens
acatgcagtttgaaattc

SEQ ID NO: 4387043 - DNA, 19 bp, Homo sapiens
acatgcatgtctgcctatg

SEQ ID NO: 4387044 - DNA, 20 bp, Homo sapiens
acatgcatgtctgcctatgc

SEQ ID NO: 4387045 - DNA, 21 bp, Homo sapiens
acatgccaacacttaatcatt

SEQ ID NO: 4387046 - DNA, 22 bp, Homo sapiens
acatgcctatatgagaagaata

SEQ ID NO: 4387047 - DNA, 17 bp, Homo sapiens
acatgctaagagaagta

SEQ ID NO: 4387048 - DNA, 18 bp, Homo sapiens
acatgctaagagaagtag

SEQ ID NO: 4387049 - DNA, 16 bp, Homo sapiens
acatgctattgtctga

SEQ ID NO: 4387050 - DNA, 17 bp, Homo sapiens
acatgctgtctggccct

SEQ ID NO: 4387051 - DNA, 14 bp, Homo sapiens
acatggaaaagaag

SEQ ID NO: 4387052 - DNA, 15 bp, Homo sapiens
acatggaaagggaga

SEQ ID NO: 4387053 - DNA, 19 bp, Homo sapiens
acatggagccccctctgcc

SEQ ID NO: 4387054 - DNA, 14 bp, Homo sapiens
acatggattcagtt

SEQ ID NO: 4387055 - DNA, 13 bp, Homo sapiens
acatggcacagag

SEQ ID NO: 4387056 - DNA, 22 bp, Homo sapiens
acatggcctgagcatccagacc

SEQ ID NO: 4387057 - DNA, 12 bp, Homo sapiens
acatgggactgg

SEQ ID NO: 4387058 - DNA, 15 bp, Homo sapiens
acatgggagggatca

SEQ ID NO: 4387059 - DNA, 17 bp, Homo sapiens
acatgggagggatcagc

SEQ ID NO: 4387060 - DNA, 22 bp, Homo sapiens
acatgggccgcgggtaaactag

SEQ ID NO: 4387061 - DNA, 21 bp, Homo sapiens
acatggggaggttgtggggcc

SEQ ID NO: 4387062 - DNA, 15 bp, Homo sapiens
acatggtagatgctt

SEQ ID NO: 4387063 - DNA, 20 bp, Homo sapiens
acatggtagatgcttgattg

SEQ ID NO: 4387064 - DNA, 20 bp, Homo sapiens
acatggtgaaacccccatct

SEQ ID NO: 4387065 - DNA, 23 bp, Homo sapiens
acatggtgagtctatttttaatg

SEQ ID NO: 4387066 - DNA, 19 bp, Homo sapiens
acatggtgcctgagaggca

SEQ ID NO: 4387067 - DNA, 18 bp, Homo sapiens
acatggtgggtccatggg

SEQ ID NO: 4387068 - DNA, 16 bp, Homo sapiens
acatgtaagaaaatgt

SEQ ID NO: 4387069 - DNA, 13 bp, Homo sapiens
acatgtactacag

SEQ ID NO: 4387070 - DNA, 15 bp, Homo sapiens
acatgtatttatgta

SEQ ID NO: 4387071 - DNA, 18 bp, Homo sapiens
acatgtatttatgtaatg

SEQ ID NO: 4387072 - DNA, 18 bp, Homo sapiens
acatgtcagtaccttcaa

SEQ ID NO: 4387073 - DNA, 21 bp, Homo sapiens
acatgtcagtaccttcaaact

SEQ ID NO: 4387074 - DNA, 15 bp, Homo sapiens
acatgtcagttttat

SEQ ID NO: 4387075 - DNA, 18 bp, Homo sapiens
acatgtctgttctacata

SEQ ID NO: 4387076 - DNA, 16 bp, Homo sapiens
acatgtgagatagttt

SEQ ID NO: 4387077 - DNA, 14 bp, Homo sapiens
acatgtgccactgt

SEQ ID NO: 4387078 - DNA, 20 bp, Homo sapiens
acatgtgttttcatcatttc

SEQ ID NO: 4387079 - DNA, 13 bp, Homo sapiens
acatgttacaaca

SEQ ID NO: 4387080 - DNA, 22 bp, Homo sapiens
acatgttgtttgttttatttgg

SEQ ID NO: 4387081 - DNA, 21 bp, Homo sapiens
acatgtttaataaataaaaat

SEQ ID NO: 4387082 - DNA, 12 bp, Homo sapiens
acatgtttcaga

SEQ ID NO: 4387083 - DNA, 16 bp, Homo sapiens
acatgttttaaagaaa

SEQ ID NO: 4387084 - DNA, 20 bp, Homo sapiens
acattaaaatatagagacag

SEQ ID NO: 4387085 - DNA, 22 bp, Homo sapiens
acattaatccacatgtttcaga

SEQ ID NO: 4387086 - DNA, 14 bp, Homo sapiens
acattagaaatatt

SEQ ID NO: 4387087 - DNA, 17 bp, Homo sapiens
acattagtatcccacta

SEQ ID NO: 4387088 - DNA, 14 bp, Homo sapiens
acattatataacaa

SEQ ID NO: 4387089 - DNA, 16 bp, Homo sapiens
acattatataacaaaa

SEQ ID NO: 4387090 - DNA, 22 bp, Homo sapiens
acattatataacaaaaaaggtt

SEQ ID NO: 4387091 - DNA, 12 bp, Homo sapiens
acattattactt

SEQ ID NO: 4387092 - DNA, 19 bp, Homo sapiens
acattattttttatttctg

SEQ ID NO: 4387093 - DNA, 23 bp, Homo sapiens
acattcaaaaaactctctcccag

SEQ ID NO: 4387094 - DNA, 21 bp, Homo sapiens
acattcacctgtatatttctt

SEQ ID NO: 4387095 - DNA, 15 bp, Homo sapiens
acattcacttttgtt

SEQ ID NO: 4387096 - DNA, 15 bp, Homo sapiens
acattcagctgaggt

SEQ ID NO: 4387097 - DNA, 20 bp, Homo sapiens
acattcagctgaggttcatt

SEQ ID NO: 4387098 - DNA, 22 bp, Homo sapiens
acattcagctgaggttcattac

SEQ ID NO: 4387099 - DNA, 15 bp, Homo sapiens
acattcctttgaata

SEQ ID NO: 4387100 - DNA, 14 bp, Homo sapiens
acattctatctact

SEQ ID NO: 4387101 - DNA, 22 bp, Homo sapiens
acattctgttggagttccctca

SEQ ID NO: 4387102 - DNA, 21 bp, Homo sapiens
acattcttcagtttttcactt

SEQ ID NO: 4387103 - DNA, 12 bp, Homo sapiens
acagcctctatc

SEQ ID NO: 4387104 - DNA, 17 bp, Homo sapiens
acagcctgacaacattt

SEQ ID NO: 4387105 - DNA, 20 bp, Homo sapiens
acagcctgacaacatttcta

SEQ ID NO: 4387106 - DNA, 12 bp, Homo sapiens
acagcctggctg

SEQ ID NO: 4387107 - DNA, 21 bp, Homo sapiens
acagcctgtttctatcctgtt

SEQ ID NO: 4387108 - DNA, 17 bp, Homo sapiens
acagccttgcagcggct

SEQ ID NO: 4387109 - DNA, 15 bp, Homo sapiens
acagcgtccctggcg

SEQ ID NO: 4387110 - DNA, 14 bp, Homo sapiens
acagctactctccc

SEQ ID NO: 4387111 - DNA, 23 bp, Homo sapiens
acagctactctccccacgagggc

SEQ ID NO: 4387112 - DNA, 17 bp, Homo sapiens
acagctatatttgatta

SEQ ID NO: 4387113 - DNA, 17 bp, Homo sapiens
acagctatgggagcccc

SEQ ID NO: 4387114 - DNA, 21 bp, Homo sapiens
acagctatgggagccccaggg

SEQ ID NO: 4387115 - DNA, 18 bp, Homo sapiens
acagctattatatcagct

SEQ ID NO: 4387116 - DNA, 21 bp, Homo sapiens
acagctattggcaagttttaa

SEQ ID NO: 4387117 - DNA, 18 bp, Homo sapiens
acagctccacacgccccg

SEQ ID NO: 4387118 - DNA, 20 bp, Homo sapiens
acagctccacacgccccggt

SEQ ID NO: 4387119 - DNA, 15 bp, Homo sapiens
acagctcccacccca

SEQ ID NO: 4387120 - DNA, 19 bp, Homo sapiens
acagctcctggaccaggcc

SEQ ID NO: 4387121 - DNA, 15 bp, Homo sapiens
acagctcgatccaaa

SEQ ID NO: 4387122 - DNA, 16 bp, Homo sapiens
acagctgagcacttag

SEQ ID NO: 4387123 - DNA, 15 bp, Homo sapiens
acagctgccttagct

SEQ ID NO: 4387124 - DNA, 16 bp, Homo sapiens
acagctgccttagctt

SEQ ID NO: 4387125 - DNA, 21 bp, Homo sapiens
acagctgccttagcttcagga

SEQ ID NO: 4387126 - DNA, 11 bp, Homo sapiens
acagctgctgg

SEQ ID NO: 4387127 - DNA, 21 bp, Homo sapiens
acagctggaggaatacatttt

SEQ ID NO: 4387128 - DNA, 12 bp, Homo sapiens
acagctggggcc

SEQ ID NO: 4387129 - DNA, 15 bp, Homo sapiens
acagctggggccggt

SEQ ID NO: 4387130 - DNA, 15 bp, Homo sapiens
acagctgtatttata

SEQ ID NO: 4387131 - DNA, 20 bp, Homo sapiens
acagctgtgccgggaggcag

SEQ ID NO: 4387132 - DNA, 11 bp, Homo sapiens
acagcttctct

SEQ ID NO: 4387133 - DNA, 22 bp, Homo sapiens
acagcttgccagggatgggcag

SEQ ID NO: 4387134 - DNA, 14 bp, Homo sapiens
acagcttttatgga

SEQ ID NO: 4387135 - DNA, 17 bp, Homo sapiens
acagcttttcccaggag

SEQ ID NO: 4387136 - DNA, 22 bp, Homo sapiens
acaggaaaaaaacttttataaa

SEQ ID NO: 4387137 - DNA, 18 bp, Homo sapiens
acaggaaacaaaccttgc

SEQ ID NO: 4387138 - DNA, 20 bp, Homo sapiens
acaggaaactcctgtgacca

SEQ ID NO: 4387139 - DNA, 22 bp, Homo sapiens
acaggaaactcctgtgaccaca

SEQ ID NO: 4387140 - DNA, 22 bp, Homo sapiens
acaggaacccttgcatccattg

SEQ ID NO: 4387141 - DNA, 19 bp, Homo sapiens
acaggaacggctctggggg

SEQ ID NO: 4387142 - DNA, 19 bp, Homo sapiens
acaggaagatgggaggtgg

SEQ ID NO: 4387143 - DNA, 14 bp, Homo sapiens
acaggaaggagggg

SEQ ID NO: 4387144 - DNA, 22 bp, Homo sapiens
acaggaaggaggggagagacag

SEQ ID NO: 4387145 - DNA, 11 bp, Homo sapiens
acaggagaaat

SEQ ID NO: 4387146 - DNA, 16 bp, Homo sapiens
acaggagggcagcccg

SEQ ID NO: 4387147 - DNA, 17 bp, Homo sapiens
acaggatgaggacagag

SEQ ID NO: 4387148 - DNA, 20 bp, Homo sapiens
acaggatttgaactcagatc

SEQ ID NO: 4387149 - DNA, 13 bp, Homo sapiens
acaggcacgtgcc

SEQ ID NO: 4387150 - DNA, 14 bp, Homo sapiens
acaggcagcccagc

SEQ ID NO: 4387151 - DNA, 20 bp, Homo sapiens
acaggcaggccagatggccc

SEQ ID NO: 4387152 - DNA, 14 bp, Homo sapiens
acaggcagggcctg

SEQ ID NO: 4387153 - DNA, 20 bp, Homo sapiens
acaggcagggcctggctcca

SEQ ID NO: 4387154 - DNA, 15 bp, Homo sapiens
acaggcaggtcacag

SEQ ID NO: 4387155 - DNA, 20 bp, Homo sapiens
acaggcagtctctctcttcc

SEQ ID NO: 4387156 - DNA, 12 bp, Homo sapiens
acaggccctccc

SEQ ID NO: 4387157 - DNA, 15 bp, Homo sapiens
acaggcctgaagata

SEQ ID NO: 4387158 - DNA, 20 bp, Homo sapiens
acaggcctgaagatattact

SEQ ID NO: 4387159 - DNA, 15 bp, Homo sapiens
acaggcctgagattt

SEQ ID NO: 4387160 - DNA, 14 bp, Homo sapiens
acaggcgggctcgg

SEQ ID NO: 4387161 - DNA, 17 bp, Homo sapiens
acaggcgggctcggagg

SEQ ID NO: 4387162 - DNA, 18 bp, Homo sapiens
acaggcgggctcggaggc

SEQ ID NO: 4387163 - DNA, 23 bp, Homo sapiens
acagggaagaaactttctggtgc

SEQ ID NO: 4387164 - DNA, 15 bp, Homo sapiens
acagggacaaagaaa

SEQ ID NO: 4387165 - DNA, 19 bp, Homo sapiens
acagggactacgtattttt

SEQ ID NO: 4387166 - DNA, 18 bp, Homo sapiens
acagggagaagtagctag

SEQ ID NO: 4387167 - DNA, 20 bp, Homo sapiens
acagggaggctcccggggcc

SEQ ID NO: 4387168 - DNA, 20 bp, Homo sapiens
acagggccatgtgctgccct

SEQ ID NO: 4387169 - DNA, 21 bp, Homo sapiens
acagggccatgtgctgccctg

SEQ ID NO: 4387170 - DNA, 13 bp, Homo sapiens
acagggcctctgc

SEQ ID NO: 4387171 - DNA, 14 bp, Homo sapiens
acagggctgctccc

SEQ ID NO: 4387172 - DNA, 13 bp, Homo sapiens
acagggctggccc

SEQ ID NO: 4387173 - DNA, 14 bp, Homo sapiens
acagggctggccca

SEQ ID NO: 4387174 - DNA, 15 bp, Homo sapiens
acagggctggcccag

SEQ ID NO: 4387175 - DNA, 19 bp, Homo sapiens
acagggctggcccagccct

SEQ ID NO: 4387176 - DNA, 15 bp, Homo sapiens
acaggggaggggcgc

SEQ ID NO: 4387177 - DNA, 23 bp, Homo sapiens
acagggtccaggaatggtgcttt

SEQ ID NO: 4387178 - DNA, 21 bp, Homo sapiens
acagggtggcccaaatagaac

SEQ ID NO: 4387179 - DNA, 12 bp, Homo sapiens
acagggtgggag

SEQ ID NO: 4387180 - DNA, 13 bp, Homo sapiens
acagggtgggagg

SEQ ID NO: 4387181 - DNA, 15 bp, Homo sapiens
acagggtgggaggga

SEQ ID NO: 4387182 - DNA, 18 bp, Homo sapiens
acagggtgggcttcctgc

SEQ ID NO: 4387183 - DNA, 15 bp, Homo sapiens
acaggtaaaacaggg

SEQ ID NO: 4387184 - DNA, 15 bp, Homo sapiens
acaggtaatataaaa

SEQ ID NO: 4387185 - DNA, 22 bp, Homo sapiens
acaggtagcacagattttgaat

SEQ ID NO: 4387186 - DNA, 20 bp, Homo sapiens
acaggtagtgggctcacaac

SEQ ID NO: 4387187 - DNA, 19 bp, Homo sapiens
acaggtatttttttaaatc

SEQ ID NO: 4387188 - DNA, 20 bp, Homo sapiens
acaggtatttttttaaatca

SEQ ID NO: 4387189 - DNA, 23 bp, Homo sapiens
acaggtcagtagtcacaaactga

SEQ ID NO: 4387190 - DNA, 13 bp, Homo sapiens
acaggtccaagga

SEQ ID NO: 4387191 - DNA, 14 bp, Homo sapiens
acaggtccaaggac

SEQ ID NO: 4387192 - DNA, 22 bp, Homo sapiens
acaggtccgtttccttacacat

SEQ ID NO: 4387193 - DNA, 16 bp, Homo sapiens
acaggtcttcatcgaa

SEQ ID NO: 4387194 - DNA, 14 bp, Homo sapiens
acaggtcttttcaa

SEQ ID NO: 4387195 - DNA, 13 bp, Homo sapiens
acaggtgaattgg

SEQ ID NO: 4387196 - DNA, 16 bp, Homo sapiens
acaggtgacagtggct

SEQ ID NO: 4387197 - DNA, 18 bp, Homo sapiens
acaggtgctaatttgttt

SEQ ID NO: 4387198 - DNA, 15 bp, Homo sapiens
acaggttataacagt

SEQ ID NO: 4387199 - DNA, 16 bp, Homo sapiens
acagtaaaccactgaa

SEQ ID NO: 4387200 - DNA, 19 bp, Homo sapiens
acagtaaaccactgaaaaa

SEQ ID NO: 4387201 - DNA, 21 bp, Homo sapiens
acagtaaaccactgaaaaaat

SEQ ID NO: 4387202 - DNA, 17 bp, Homo sapiens
acagtaatattggcata

SEQ ID NO: 4387203 - DNA, 12 bp, Homo sapiens
acagtaatgaaa

SEQ ID NO: 4387204 - DNA, 19 bp, Homo sapiens
acagtaatgaaatgtttac

SEQ ID NO: 4387205 - DNA, 19 bp, Homo sapiens
acagtacggatttgtccaa

SEQ ID NO: 4387206 - DNA, 19 bp, Homo sapiens
acagtactggttactttca

SEQ ID NO: 4387207 - DNA, 22 bp, Homo sapiens
acagtactggttactttcaaaa

SEQ ID NO: 4387208 - DNA, 13 bp, Homo sapiens
acagtagaactgt

SEQ ID NO: 4387209 - DNA, 23 bp, Homo sapiens
acagtagaggggtctcatgtctc

SEQ ID NO: 4387210 - DNA, 13 bp, Homo sapiens
acagtaggagccc

SEQ ID NO: 4387211 - DNA, 14 bp, Homo sapiens
acagtagtttccct

SEQ ID NO: 4387212 - DNA, 17 bp, Homo sapiens
acagtatattttatttc

SEQ ID NO: 4387213 - DNA, 21 bp, Homo sapiens
acagtatattttatttcaatg

SEQ ID NO: 4387214 - DNA, 16 bp, Homo sapiens
acagtattgggcagga

SEQ ID NO: 4387215 - DNA, 16 bp, Homo sapiens
acagtcaagatagaaa

SEQ ID NO: 4387216 - DNA, 13 bp, Homo sapiens
acagtcacctcac

SEQ ID NO: 4387217 - DNA, 16 bp, Homo sapiens
acagtcactgcatttg

SEQ ID NO: 4387218 - DNA, 13 bp, Homo sapiens
acagtcactggat

SEQ ID NO: 4387219 - DNA, 21 bp, Homo sapiens
acagtcagaaggacggcagga

SEQ ID NO: 4387220 - DNA, 19 bp, Homo sapiens
acagtcataaatactgtca

SEQ ID NO: 4387221 - DNA, 17 bp, Homo sapiens
acagtcatcgctcgtgt

SEQ ID NO: 4387222 - DNA, 16 bp, Homo sapiens
acaattatgtctcttg

SEQ ID NO: 4387223 - DNA, 20 bp, Homo sapiens
acaattatgtctcttgagca

SEQ ID NO: 4387224 - DNA, 14 bp, Homo sapiens
acaattattggcaa

SEQ ID NO: 4387225 - DNA, 20 bp, Homo sapiens
acaattcccttctttttcat

SEQ ID NO: 4387226 - DNA, 14 bp, Homo sapiens
acaattctaaaatg

SEQ ID NO: 4387227 - DNA, 24 bp, Homo sapiens
acaattctaaaatgattgtagtaa

SEQ ID NO: 4387228 - DNA, 17 bp, Homo sapiens
acaattctgtttttaat

SEQ ID NO: 4387229 - DNA, 15 bp, Homo sapiens
acaattggtgtcatt

SEQ ID NO: 4387230 - DNA, 19 bp, Homo sapiens
acaattggtgtcattttct

SEQ ID NO: 4387231 - DNA, 18 bp, Homo sapiens
acaatttatgaattgaat

SEQ ID NO: 4387232 - DNA, 14 bp, Homo sapiens
acaatttattttat

SEQ ID NO: 4387233 - DNA, 20 bp, Homo sapiens
acaatttattttattttagc

SEQ ID NO: 4387234 - DNA, 15 bp, Homo sapiens
acaatttcatcctcc

SEQ ID NO: 4387235 - DNA, 16 bp, Homo sapiens
acaatttcatcctcct

SEQ ID NO: 4387236 - DNA, 16 bp, Homo sapiens
acaatttcatttccag

SEQ ID NO: 4387237 - DNA, 18 bp, Homo sapiens
acaatttgtttttgcatt

SEQ ID NO: 4387238 - DNA, 21 bp, Homo sapiens
acaatttgtttttgcattttt

SEQ ID NO: 4387239 - DNA, 17 bp, Homo sapiens
acaattttaaagttctt

SEQ ID NO: 4387240 - DNA, 20 bp, Homo sapiens
acaattttctgtaatctttt

SEQ ID NO: 4387241 - DNA, 21 bp, Homo sapiens
acaattttctgtaatctttta

SEQ ID NO: 4387242 - DNA, 15 bp, Homo sapiens
acaattttgtacaaa

SEQ ID NO: 4387243 - DNA, 18 bp, Homo sapiens
acaattttttttcaaatg

SEQ ID NO: 4387244 - DNA, 14 bp, Homo sapiens
acacaaactgtaaa

SEQ ID NO: 4387245 - DNA, 19 bp, Homo sapiens
acacaaactgtaaataaaa

SEQ ID NO: 4387246 - DNA, 17 bp, Homo sapiens
acacaaagagatattta

SEQ ID NO: 4387247 - DNA, 13 bp, Homo sapiens
acacaaattcagt

SEQ ID NO: 4387248 - DNA, 18 bp, Homo sapiens
acacaaattcagtctctg

SEQ ID NO: 4387249 - DNA, 17 bp, Homo sapiens
acacaacaagaaactgt

SEQ ID NO: 4387250 - DNA, 22 bp, Homo sapiens
acacaaccagaggtggcaggag

SEQ ID NO: 4387251 - DNA, 23 bp, Homo sapiens
acacaacgattatagtaactata

SEQ ID NO: 4387252 - DNA, 21 bp, Homo sapiens
acacaaggacccttcaggtgt

SEQ ID NO: 4387253 - DNA, 18 bp, Homo sapiens
acacaaggtgatttcaga

SEQ ID NO: 4387254 - DNA, 13 bp, Homo sapiens
acacaataagcaa

SEQ ID NO: 4387255 - DNA, 14 bp, Homo sapiens
acacaataagcaaa

SEQ ID NO: 4387256 - DNA, 14 bp, Homo sapiens
acacaatacagtat

SEQ ID NO: 4387257 - DNA, 15 bp, Homo sapiens
acacaattagatttc

SEQ ID NO: 4387258 - DNA, 19 bp, Homo sapiens
acacacaaaaaatgcacaa

SEQ ID NO: 4387259 - DNA, 14 bp, Homo sapiens
acacacagccccta

SEQ ID NO: 4387260 - DNA, 12 bp, Homo sapiens
acacacagtacg

SEQ ID NO: 4387261 - DNA, 16 bp, Homo sapiens
acacaccttaaaacat

SEQ ID NO: 4387262 - DNA, 12 bp, Homo sapiens
acacactcagcc

SEQ ID NO: 4387263 - DNA, 13 bp, Homo sapiens
acacactcagcca

SEQ ID NO: 4387264 - DNA, 15 bp, Homo sapiens
acacactcagccaca

SEQ ID NO: 4387265 - DNA, 19 bp, Homo sapiens
acacactccccacttcact

SEQ ID NO: 4387266 - DNA, 17 bp, Homo sapiens
acacactgatgcttaga

SEQ ID NO: 4387267 - DNA, 22 bp, Homo sapiens
acacactgtgtgggggacggct

SEQ ID NO: 4387268 - DNA, 15 bp, Homo sapiens
acacacttacagagc

SEQ ID NO: 4387269 - DNA, 13 bp, Homo sapiens
acacactttattt

SEQ ID NO: 4387270 - DNA, 18 bp, Homo sapiens
acacagaaaatgttgaga

SEQ ID NO: 4387271 - DNA, 23 bp, Homo sapiens
acacagaattatagatgtctgag

SEQ ID NO: 4387272 - DNA, 14 bp, Homo sapiens
acacagacccagga

SEQ ID NO: 4387273 - DNA, 22 bp, Homo sapiens
acacagacctcgagtttctggt

SEQ ID NO: 4387274 - DNA, 17 bp, Homo sapiens
acacagcattgtatatg

SEQ ID NO: 4387275 - DNA, 20 bp, Homo sapiens
acacagcccagttcccgtga

SEQ ID NO: 4387276 - DNA, 23 bp, Homo sapiens
acacagcctaaagctaaaaatat

SEQ ID NO: 4387277 - DNA, 17 bp, Homo sapiens
acacagctactctcccc

SEQ ID NO: 4387278 - DNA, 15 bp, Homo sapiens
acacaggcagccagc

SEQ ID NO: 4387279 - DNA, 16 bp, Homo sapiens
acacaggcagccagcc

SEQ ID NO: 4387280 - DNA, 17 bp, Homo sapiens
acacaggcagccagccg

SEQ ID NO: 4387281 - DNA, 12 bp, Homo sapiens
acacaggcaggg

SEQ ID NO: 4387282 - DNA, 16 bp, Homo sapiens
acacagtaattgtgac

SEQ ID NO: 4387283 - DNA, 14 bp, Homo sapiens
acacagtacttcct

SEQ ID NO: 4387284 - DNA, 21 bp, Homo sapiens
acacagtacttcctcccagca

SEQ ID NO: 4387285 - DNA, 14 bp, Homo sapiens
acacagtattcaga

SEQ ID NO: 4387286 - DNA, 13 bp, Homo sapiens
acacagtattttc

SEQ ID NO: 4387287 - DNA, 15 bp, Homo sapiens
acacagttcctggga

SEQ ID NO: 4387288 - DNA, 19 bp, Homo sapiens
acacatactcatttttcat

SEQ ID NO: 4387289 - DNA, 17 bp, Homo sapiens
acacatagattcacctg

SEQ ID NO: 4387290 - DNA, 21 bp, Homo sapiens
acacatagttctgtaataaaa

SEQ ID NO: 4387291 - DNA, 16 bp, Homo sapiens
acacatatacatatga

SEQ ID NO: 4387292 - DNA, 19 bp, Homo sapiens
acacatatacatatgagaa

SEQ ID NO: 4387293 - DNA, 23 bp, Homo sapiens
acacatatatataacaaataata

SEQ ID NO: 4387294 - DNA, 22 bp, Homo sapiens
acacatcagcttgccctgttaa

SEQ ID NO: 4387295 - DNA, 15 bp, Homo sapiens
acacatcttattgaa

SEQ ID NO: 4387296 - DNA, 19 bp, Homo sapiens
acacatgaaggtaaataaa

SEQ ID NO: 4387297 - DNA, 16 bp, Homo sapiens
acacatgcagaataat

SEQ ID NO: 4387298 - DNA, 18 bp, Homo sapiens
acacatgcatacttacag

SEQ ID NO: 4387299 - DNA, 17 bp, Homo sapiens
acacatgccaacactta

SEQ ID NO: 4387300 - DNA, 21 bp, Homo sapiens
acacatgccaacacttaatca

SEQ ID NO: 4387301 - DNA, 22 bp, Homo sapiens
acacatgccaacacttaatcat

SEQ ID NO: 4387302 - DNA, 17 bp, Homo sapiens
acacttttcatatcatt

SEQ ID NO: 4387303 - DNA, 17 bp, Homo sapiens
acacttttggaaccatg

SEQ ID NO: 4387304 - DNA, 13 bp, Homo sapiens
acagaaaatttaa

SEQ ID NO: 4387305 - DNA, 14 bp, Homo sapiens
acagaaactacatt

SEQ ID NO: 4387306 - DNA, 20 bp, Homo sapiens
acagaaagagactccgtctc

SEQ ID NO: 4387307 - DNA, 13 bp, Homo sapiens
acagaaagctgcc

SEQ ID NO: 4387308 - DNA, 22 bp, Homo sapiens
acagaaaggcaggtttcatttc

SEQ ID NO: 4387309 - DNA, 22 bp, Homo sapiens
acagaaatgactgtggtgtgga

SEQ ID NO: 4387310 - DNA, 23 bp, Homo sapiens
acagaaattgtatattgtaattt

SEQ ID NO: 4387311 - DNA, 13 bp, Homo sapiens
acagaacaaccca

SEQ ID NO: 4387312 - DNA, 16 bp, Homo sapiens
acagaacaacccacca

SEQ ID NO: 4387313 - DNA, 18 bp, Homo sapiens
acagaaccttcaacccag

SEQ ID NO: 4387314 - DNA, 20 bp, Homo sapiens
acagaactctttcaaaacct

SEQ ID NO: 4387315 - DNA, 12 bp, Homo sapiens
acagaagcaaat

SEQ ID NO: 4387316 - DNA, 12 bp, Homo sapiens
acagaaggcaaa

SEQ ID NO: 4387317 - DNA, 16 bp, Homo sapiens
acagaatagtttacac

SEQ ID NO: 4387318 - DNA, 21 bp, Homo sapiens
acagaatagtttacacactgt

SEQ ID NO: 4387319 - DNA, 16 bp, Homo sapiens
acagaatgactgacaa

SEQ ID NO: 4387320 - DNA, 18 bp, Homo sapiens
acagacaaaaacagcctc

SEQ ID NO: 4387321 - DNA, 18 bp, Homo sapiens
acagacaaagcataatca

SEQ ID NO: 4387322 - DNA, 14 bp, Homo sapiens
acagacactggcat

SEQ ID NO: 4387323 - DNA, 11 bp, Homo sapiens
acagacaggag

SEQ ID NO: 4387324 - DNA, 14 bp, Homo sapiens
acagacaggagaaa

SEQ ID NO: 4387325 - DNA, 22 bp, Homo sapiens
acagacatggagatgtaaaatg

SEQ ID NO: 4387326 - DNA, 20 bp, Homo sapiens
acagaccatattacctggat

SEQ ID NO: 4387327 - DNA, 13 bp, Homo sapiens
acagacccaggac

SEQ ID NO: 4387328 - DNA, 16 bp, Homo sapiens
acagacctcagtttta

SEQ ID NO: 4387329 - DNA, 16 bp, Homo sapiens
acagacggaaatgaaa

SEQ ID NO: 4387330 - DNA, 23 bp, Homo sapiens
acagactatttttagattttctt

SEQ ID NO: 4387331 - DNA, 12 bp, Homo sapiens
acagactctgat

SEQ ID NO: 4387332 - DNA, 12 bp, Homo sapiens
acagactgaaag

SEQ ID NO: 4387333 - DNA, 15 bp, Homo sapiens
acagagaaggcagga

SEQ ID NO: 4387334 - DNA, 18 bp, Homo sapiens
acagagacaagtaatttc

SEQ ID NO: 4387335 - DNA, 21 bp, Homo sapiens
acagagacacctgcacctccc

SEQ ID NO: 4387336 - DNA, 18 bp, Homo sapiens
acagagacagtgaaagtt

SEQ ID NO: 4387337 - DNA, 18 bp, Homo sapiens
acagagaggatacattta

SEQ ID NO: 4387338 - DNA, 12 bp, Homo sapiens
acagagcacttg

SEQ ID NO: 4387339 - DNA, 17 bp, Homo sapiens
acagagcaggggctcca

SEQ ID NO: 4387340 - DNA, 18 bp, Homo sapiens
acagagcaggggctccag

SEQ ID NO: 4387341 - DNA, 22 bp, Homo sapiens
acagagccagcggctccaactc

SEQ ID NO: 4387342 - DNA, 19 bp, Homo sapiens
acagagcccccctagcaat

SEQ ID NO: 4387343 - DNA, 16 bp, Homo sapiens
acagagcttccctgac

SEQ ID NO: 4387344 - DNA, 23 bp, Homo sapiens
acagaggacagtatttgtgggga

SEQ ID NO: 4387345 - DNA, 20 bp, Homo sapiens
acaatagtatttctcctttg

SEQ ID NO: 4387346 - DNA, 14 bp, Homo sapiens
acaatatagttttt

SEQ ID NO: 4387347 - DNA, 15 bp, Homo sapiens
acaatatagtttttt

SEQ ID NO: 4387348 - DNA, 22 bp, Homo sapiens
acaatatgtgccaatcaatagc

SEQ ID NO: 4387349 - DNA, 16 bp, Homo sapiens
acaatatttcttttgt

SEQ ID NO: 4387350 - DNA, 20 bp, Homo sapiens
acaatatttcttttgttgta

SEQ ID NO: 4387351 - DNA, 22 bp, Homo sapiens
acaatcagctccttcctggaga

SEQ ID NO: 4387352 - DNA, 16 bp, Homo sapiens
acaatcattgttttga

SEQ ID NO: 4387353 - DNA, 17 bp, Homo sapiens
acaatcattgttttgaa

SEQ ID NO: 4387354 - DNA, 20 bp, Homo sapiens
acaatcattgttttgaatat

SEQ ID NO: 4387355 - DNA, 21 bp, Homo sapiens
acaatctaacaataatatttc

SEQ ID NO: 4387356 - DNA, 14 bp, Homo sapiens
acaatctatttaaa

SEQ ID NO: 4387357 - DNA, 18 bp, Homo sapiens
acaatctatttaaaaaac

SEQ ID NO: 4387358 - DNA, 17 bp, Homo sapiens
acaatctcccctcaacc

SEQ ID NO: 4387359 - DNA, 12 bp, Homo sapiens
acaatctcttaa

SEQ ID NO: 4387360 - DNA, 15 bp, Homo sapiens
acaatctttcatgtc

SEQ ID NO: 4387361 - DNA, 18 bp, Homo sapiens
acaatgaaaactctttgc

SEQ ID NO: 4387362 - DNA, 14 bp, Homo sapiens
acaatgaagggaaa

SEQ ID NO: 4387363 - DNA, 18 bp, Homo sapiens
acaatgaagggaaattgt

SEQ ID NO: 4387364 - DNA, 21 bp, Homo sapiens
acaatgacatacgcttttaat

SEQ ID NO: 4387365 - DNA, 17 bp, Homo sapiens
acaatgagtttgggcat

SEQ ID NO: 4387366 - DNA, 21 bp, Homo sapiens
acaatgatcaccgactgaaaa

SEQ ID NO: 4387367 - DNA, 20 bp, Homo sapiens
acaatgatgccctgctccag

SEQ ID NO: 4387368 - DNA, 22 bp, Homo sapiens
acaatgatgtataattaatgct

SEQ ID NO: 4387369 - DNA, 18 bp, Homo sapiens
acaatgcacttttatgaa

SEQ ID NO: 4387370 - DNA, 13 bp, Homo sapiens
acaatggaataaa

SEQ ID NO: 4387371 - DNA, 23 bp, Homo sapiens
acaatggggctggttttgcttcc

SEQ ID NO: 4387372 - DNA, 18 bp, Homo sapiens
acaatggtttttaaattt

SEQ ID NO: 4387373 - DNA, 17 bp, Homo sapiens
acaatgtacaattatgt

SEQ ID NO: 4387374 - DNA, 14 bp, Homo sapiens
acaatgtatacaat

SEQ ID NO: 4387375 - DNA, 19 bp, Homo sapiens
acaatgtatacaatgcact

SEQ ID NO: 4387376 - DNA, 15 bp, Homo sapiens
acaatgtatctttat

SEQ ID NO: 4387377 - DNA, 21 bp, Homo sapiens
acaatgtatgtacaatacaat

SEQ ID NO: 4387378 - DNA, 19 bp, Homo sapiens
acaatgttccttttttgta

SEQ ID NO: 4387379 - DNA, 23 bp, Homo sapiens
acaatgttccttttttgtatatt

SEQ ID NO: 4387380 - DNA, 22 bp, Homo sapiens
acaatgtttcttcatttctctg

SEQ ID NO: 4387381 - DNA, 19 bp, Homo sapiens
aatgagcttgattaaatca

SEQ ID NO: 4387382 - DNA, 15 bp, Homo sapiens
aatgagggtttctga

SEQ ID NO: 4387383 - DNA, 16 bp, Homo sapiens
aatgagggtttctgat

SEQ ID NO: 4387384 - DNA, 23 bp, Homo sapiens
aatgagggtttctgatctgtact

SEQ ID NO: 4387385 - DNA, 14 bp, Homo sapiens
aatgaggtctgttt

SEQ ID NO: 4387386 - DNA, 15 bp, Homo sapiens
aatgaggtctgttta

SEQ ID NO: 4387387 - DNA, 16 bp, Homo sapiens
aatgaggtctgtttaa

SEQ ID NO: 4387388 - DNA, 22 bp, Homo sapiens
aatgagtcatttgtttaaacaa

SEQ ID NO: 4387389 - DNA, 14 bp, Homo sapiens
aatgagtttaaaaa

SEQ ID NO: 4387390 - DNA, 21 bp, Homo sapiens
aatgagtttaaaaatcaactt

SEQ ID NO: 4387391 - DNA, 15 bp, Homo sapiens
aatgagtttgtatta

SEQ ID NO: 4387392 - DNA, 17 bp, Homo sapiens
aatgagtttgtattatt

SEQ ID NO: 4387393 - DNA, 18 bp, Homo sapiens
aatgagtttttaatagtc

SEQ ID NO: 4387394 - DNA, 13 bp, Homo sapiens
aatgataaaacac

SEQ ID NO: 4387395 - DNA, 17 bp, Homo sapiens
aatgatactgattatga

SEQ ID NO: 4387396 - DNA, 18 bp, Homo sapiens
aatgatagataatgcctt

SEQ ID NO: 4387397 - DNA, 14 bp, Homo sapiens
aatgatatcaaaga

SEQ ID NO: 4387398 - DNA, 22 bp, Homo sapiens
aatgatcacatctaaagcttta

SEQ ID NO: 4387399 - DNA, 17 bp, Homo sapiens
aatgatcgaaaaaataa

SEQ ID NO: 4387400 - DNA, 21 bp, Homo sapiens
aatgatcgaaaaaataattat

SEQ ID NO: 4387401 - DNA, 23 bp, Homo sapiens
aatgatcgaaaaaataattattt

SEQ ID NO: 4387402 - DNA, 11 bp, Homo sapiens
aatgatctatt

SEQ ID NO: 4387403 - DNA, 21 bp, Homo sapiens
aatgatgatgtggaagaactt

SEQ ID NO: 4387404 - DNA, 18 bp, Homo sapiens
aatgatgccctgctccag

SEQ ID NO: 4387405 - DNA, 18 bp, Homo sapiens
aatgattaaattatgaag

SEQ ID NO: 4387406 - DNA, 22 bp, Homo sapiens
aatgattaagggacatttctat

SEQ ID NO: 4387407 - DNA, 19 bp, Homo sapiens
aatgattcaaattgctgct

SEQ ID NO: 4387408 - DNA, 21 bp, Homo sapiens
aatgattcagtgttaaatgtg

SEQ ID NO: 4387409 - DNA, 23 bp, Homo sapiens
aatgattcagtgttaaatgtgat

SEQ ID NO: 4387410 - DNA, 21 bp, Homo sapiens
aatgattggttaaaatgtgat

SEQ ID NO: 4387411 - DNA, 14 bp, Homo sapiens
aatgatttaaattt

SEQ ID NO: 4387412 - DNA, 14 bp, Homo sapiens
aatgatttagtgtt

SEQ ID NO: 4387413 - DNA, 20 bp, Homo sapiens
aatgatttcatattgatctt

SEQ ID NO: 4387414 - DNA, 16 bp, Homo sapiens
aatgatttcattcaat

SEQ ID NO: 4387415 - DNA, 17 bp, Homo sapiens
aatgcaaaaactctttg

SEQ ID NO: 4387416 - DNA, 22 bp, Homo sapiens
aatgcaacatacgggaagttta

SEQ ID NO: 4387417 - DNA, 18 bp, Homo sapiens
aatgcaataactctggga

SEQ ID NO: 4387418 - DNA, 14 bp, Homo sapiens
aatgcaataagatt

SEQ ID NO: 4387419 - DNA, 23 bp, Homo sapiens
aatgcaataagattgcgcctgag

SEQ ID NO: 4387420 - DNA, 14 bp, Homo sapiens
aatgcaatatttgt

SEQ ID NO: 4387421 - DNA, 18 bp, Homo sapiens
aatgcacagatatacttt

SEQ ID NO: 4387422 - DNA, 16 bp, Homo sapiens
aatgcacctaaagaaa

SEQ ID NO: 4387423 - DNA, 21 bp, Homo sapiens
aatgcactctgggtctggcca

SEQ ID NO: 4387424 - DNA, 21 bp, Homo sapiens
aatgcacttttatgaagtttt

SEQ ID NO: 4387425 - DNA, 17 bp, Homo sapiens
aatgcagattacactga

SEQ ID NO: 4387426 - DNA, 14 bp, Homo sapiens
aatgcagtatggta

SEQ ID NO: 4387427 - DNA, 23 bp, Homo sapiens
aatgcatccattcctcagggaca

SEQ ID NO: 4387428 - DNA, 14 bp, Homo sapiens
aatgcattcttctc

SEQ ID NO: 4387429 - DNA, 14 bp, Homo sapiens
aatgcattgttgta

SEQ ID NO: 4387430 - DNA, 12 bp, Homo sapiens
aatgcatttact

SEQ ID NO: 4387431 - DNA, 18 bp, Homo sapiens
aatgccaaaggaagtttt

SEQ ID NO: 4387432 - DNA, 19 bp, Homo sapiens
aatgccaggcggacaaagt

SEQ ID NO: 4387433 - DNA, 17 bp, Homo sapiens
aatgccataaaattgca

SEQ ID NO: 4387434 - DNA, 15 bp, Homo sapiens
aatgccatcatctcc

SEQ ID NO: 4387435 - DNA, 19 bp, Homo sapiens
aatgccatttctcacgccc

SEQ ID NO: 4387436 - DNA, 22 bp, Homo sapiens
aatgcccaacttactgtcttct

SEQ ID NO: 4387437 - DNA, 17 bp, Homo sapiens
aatgccgatatcttcag

SEQ ID NO: 4387438 - DNA, 18 bp, Homo sapiens
aatgcctataaaatgccc

SEQ ID NO: 4387439 - DNA, 15 bp, Homo sapiens
aatgcctattgtaat

SEQ ID NO: 4387440 - DNA, 23 bp, Homo sapiens
aatgcctcttaaattatatattt

SEQ ID NO: 4387441 - DNA, 13 bp, Homo sapiens
aatgcctgctttt

SEQ ID NO: 4387442 - DNA, 13 bp, Homo sapiens
aatgcctttgtaa

SEQ ID NO: 4387443 - DNA, 22 bp, Homo sapiens
aatgctagcacaatattcctat

SEQ ID NO: 4387444 - DNA, 17 bp, Homo sapiens
aatgctaggtctcggac

SEQ ID NO: 4387445 - DNA, 16 bp, Homo sapiens
aatgctcaatttcagc

SEQ ID NO: 4387446 - DNA, 16 bp, Homo sapiens
aatgctcatacacagt

SEQ ID NO: 4387447 - DNA, 19 bp, Homo sapiens
aatgctgtatttttacagc

SEQ ID NO: 4387448 - DNA, 18 bp, Homo sapiens
aatgcttaaaaaataata

SEQ ID NO: 4387449 - DNA, 14 bp, Homo sapiens
aatgcttaatcaga

SEQ ID NO: 4387450 - DNA, 17 bp, Homo sapiens
aatgcttacctaatttc

SEQ ID NO: 4387451 - DNA, 18 bp, Homo sapiens
aatgcttacctaatttca

SEQ ID NO: 4387452 - DNA, 23 bp, Homo sapiens
aatgcttacctaatttcatttta

SEQ ID NO: 4387453 - DNA, 15 bp, Homo sapiens
aatgcttagaaattc

SEQ ID NO: 4387454 - DNA, 18 bp, Homo sapiens
aatgcttcactgtacgta

SEQ ID NO: 4387455 - DNA, 13 bp, Homo sapiens
aatgctttggaaa

SEQ ID NO: 4387456 - DNA, 18 bp, Homo sapiens
aatgctttggaaaaatgg

SEQ ID NO: 4387457 - DNA, 16 bp, Homo sapiens
aatgcttttagtgtgt

SEQ ID NO: 4387458 - DNA, 15 bp, Homo sapiens
aatgcttttatattc

SEQ ID NO: 4387459 - DNA, 17 bp, Homo sapiens
aatgcttttatattcta

SEQ ID NO: 4387460 - DNA, 16 bp, Homo sapiens
aatgcttttctaatta

SEQ ID NO: 4387461 - DNA, 19 bp, Homo sapiens
aatgcttttctaattaata

SEQ ID NO: 4387462 - DNA, 19 bp, Homo sapiens
aatgctttttatttctgca

SEQ ID NO: 4387463 - DNA, 16 bp, Homo sapiens
aatggaaatttataat

SEQ ID NO: 4387464 - DNA, 15 bp, Homo sapiens
aatggaaattttgct

SEQ ID NO: 4387465 - DNA, 15 bp, Homo sapiens
aatggaagatttgcc

SEQ ID NO: 4387466 - DNA, 23 bp, Homo sapiens
aatggaagatttgcccatttaca

SEQ ID NO: 4387467 - DNA, 20 bp, Homo sapiens
aatggaataacatatcaaat

SEQ ID NO: 4387468 - DNA, 13 bp, Homo sapiens
aatggaataatta

SEQ ID NO: 4387469 - DNA, 18 bp, Homo sapiens
aatggactgaccttaaaa

SEQ ID NO: 4387470 - DNA, 17 bp, Homo sapiens
aatggactggtttgaga

SEQ ID NO: 4387471 - DNA, 23 bp, Homo sapiens
aatggaggaagaacaacaaagac

SEQ ID NO: 4387472 - DNA, 18 bp, Homo sapiens
aatggatacataaagact

SEQ ID NO: 4387473 - DNA, 14 bp, Homo sapiens
aatggatagctcat

SEQ ID NO: 4387474 - DNA, 12 bp, Homo sapiens
aatggattgtta

SEQ ID NO: 4387475 - DNA, 16 bp, Homo sapiens
aatggcagcagaaaac

SEQ ID NO: 4387476 - DNA, 13 bp, Homo sapiens
aatggcagctagt

SEQ ID NO: 4387477 - DNA, 18 bp, Homo sapiens
aatggcagctagtgcctt

SEQ ID NO: 4387478 - DNA, 22 bp, Homo sapiens
aatggcattattaggtcttaaa

SEQ ID NO: 4387479 - DNA, 16 bp, Homo sapiens
aatggccagagcctct

SEQ ID NO: 4387480 - DNA, 20 bp, Homo sapiens
aatggccagagcctctggcc

SEQ ID NO: 4387481 - DNA, 16 bp, Homo sapiens
aatggctatttttgaa

SEQ ID NO: 4387482 - DNA, 15 bp, Homo sapiens
aatggcttgtctttg

SEQ ID NO: 4387483 - DNA, 15 bp, Homo sapiens
aatgggaaaaaactt

SEQ ID NO: 4387484 - DNA, 15 bp, Homo sapiens
aatgggaagactcag

SEQ ID NO: 4387485 - DNA, 18 bp, Homo sapiens
aatgggagacagcctctt

SEQ ID NO: 4387486 - DNA, 12 bp, Homo sapiens
aatgggagctga

SEQ ID NO: 4387487 - DNA, 15 bp, Homo sapiens
aatgggcattttaca

SEQ ID NO: 4387488 - DNA, 16 bp, Homo sapiens
aatgggcattttacaa

SEQ ID NO: 4387489 - DNA, 16 bp, Homo sapiens
aatgggctcaaccaga

SEQ ID NO: 4387490 - DNA, 16 bp, Homo sapiens
aatgggtaagggaggg

SEQ ID NO: 4387491 - DNA, 23 bp, Homo sapiens
aatgggtaagggagggaagggga

SEQ ID NO: 4387492 - DNA, 16 bp, Homo sapiens
aatgggtatattgata

SEQ ID NO: 4387493 - DNA, 20 bp, Homo sapiens
aatggtaaaataaaatgcct

SEQ ID NO: 4387494 - DNA, 23 bp, Homo sapiens
aatggtaaaataaaatgcctcag

SEQ ID NO: 4387495 - DNA, 14 bp, Homo sapiens
aatggtagttttac

SEQ ID NO: 4387496 - DNA, 22 bp, Homo sapiens
aatggtcacgtttggtgcttct

SEQ ID NO: 4387497 - DNA, 23 bp, Homo sapiens
aatggtctcttccctttgtgtat

SEQ ID NO: 4387498 - DNA, 19 bp, Homo sapiens
aatggtgcattgtatagat

SEQ ID NO: 4387499 - DNA, 23 bp, Homo sapiens
aatggtggcttcttttctttgta

SEQ ID NO: 4387500 - DNA, 20 bp, Homo sapiens
aatggtgtcagtatccaggc

SEQ ID NO: 4387501 - DNA, 17 bp, Homo sapiens
aatgagcaagactgggc

SEQ ID NO: 4387502 - DNA, 23 bp, Homo sapiens
aatgagcagagagcaaaggagaa

SEQ ID NO: 4387503 - DNA, 14 bp, Homo sapiens
aatgagcagatgag

SEQ ID NO: 4387504 - DNA, 11 bp, Homo sapiens
aatgagccctg

SEQ ID NO: 4387505 - DNA, 23 bp, Homo sapiens
aatgagccctggctcccacctgt

SEQ ID NO: 4387506 - DNA, 23 bp, Homo sapiens
aatgagctattaaaactcagcct

SEQ ID NO: 4387507 - DNA, 17 bp, Homo sapiens
aaagtacactctgctgt

SEQ ID NO: 4387508 - DNA, 12 bp, Homo sapiens
aaagtactgtaa

SEQ ID NO: 4387509 - DNA, 20 bp, Homo sapiens
aaagtagacaatcattgttt

SEQ ID NO: 4387510 - DNA, 18 bp, Homo sapiens
aaagtagcaaatgtttac

SEQ ID NO: 4387511 - DNA, 18 bp, Homo sapiens
aaagtagggaagttttat

SEQ ID NO: 4387512 - DNA, 16 bp, Homo sapiens
aaagtagttattttat

SEQ ID NO: 4387513 - DNA, 13 bp, Homo sapiens
aaagtataatgtt

SEQ ID NO: 4387514 - DNA, 17 bp, Homo sapiens
aaagtatagagagaagt

SEQ ID NO: 4387515 - DNA, 19 bp, Homo sapiens
aaagtatgcattattaaat

SEQ ID NO: 4387516 - DNA, 16 bp, Homo sapiens
aaagtattccacctta

SEQ ID NO: 4387517 - DNA, 15 bp, Homo sapiens
aaagtattctttttc

SEQ ID NO: 4387518 - DNA, 16 bp, Homo sapiens
aaagtattctttttct

SEQ ID NO: 4387519 - DNA, 18 bp, Homo sapiens
aaagtattctttttcttt

SEQ ID NO: 4387520 - DNA, 14 bp, Homo sapiens
aaagtattgtaaat

SEQ ID NO: 4387521 - DNA, 15 bp, Homo sapiens
aaagtattgtaaatt

SEQ ID NO: 4387522 - DNA, 23 bp, Homo sapiens
aaagtattgtaaattatatttgt

SEQ ID NO: 4387523 - DNA, 19 bp, Homo sapiens
aaagtatttataaaaatat

SEQ ID NO: 4387524 - DNA, 23 bp, Homo sapiens
aaagtatttataaaaatataaat

SEQ ID NO: 4387525 - DNA, 19 bp, Homo sapiens
aaagtatttgatgtacatt

SEQ ID NO: 4387526 - DNA, 22 bp, Homo sapiens
aaagtatttgatgtacattaca

SEQ ID NO: 4387527 - DNA, 17 bp, Homo sapiens
aaagtcacacatttcta

SEQ ID NO: 4387528 - DNA, 23 bp, Homo sapiens
aaagtcacagccgtttgaatata

SEQ ID NO: 4387529 - DNA, 12 bp, Homo sapiens
aaagtcattatt

SEQ ID NO: 4387530 - DNA, 12 bp, Homo sapiens
aaagtcatttaa

SEQ ID NO: 4387531 - DNA, 13 bp, Homo sapiens
aaagtcatttaaa

SEQ ID NO: 4387532 - DNA, 20 bp, Homo sapiens
aaagtccccctcctcagcca

SEQ ID NO: 4387533 - DNA, 13 bp, Homo sapiens
aaagtccctccct

SEQ ID NO: 4387534 - DNA, 20 bp, Homo sapiens
aaagtccctccctgcctgag

SEQ ID NO: 4387535 - DNA, 15 bp, Homo sapiens
aaagtcctgctttcc

SEQ ID NO: 4387536 - DNA, 16 bp, Homo sapiens
aaagtcctttttttcc

SEQ ID NO: 4387537 - DNA, 15 bp, Homo sapiens
aaagtctcatagctt

SEQ ID NO: 4387538 - DNA, 13 bp, Homo sapiens
aaagtctctattt

SEQ ID NO: 4387539 - DNA, 17 bp, Homo sapiens
aaagtctctatttaaat

SEQ ID NO: 4387540 - DNA, 12 bp, Homo sapiens
aaagtctcttgt

SEQ ID NO: 4387541 - DNA, 20 bp, Homo sapiens
aaagtgacagtatctttttt

SEQ ID NO: 4387542 - DNA, 19 bp, Homo sapiens
aaagtgagaaaactgtgac

SEQ ID NO: 4387543 - DNA, 15 bp, Homo sapiens
aaagtgatgacatat

SEQ ID NO: 4387544 - DNA, 16 bp, Homo sapiens
aaagtgatgacatatt

SEQ ID NO: 4387545 - DNA, 19 bp, Homo sapiens
aaagtgatgtattttcata

SEQ ID NO: 4387546 - DNA, 15 bp, Homo sapiens
aaagtgattgtgaag

SEQ ID NO: 4387547 - DNA, 15 bp, Homo sapiens
aaagtgcaatgcgtg

SEQ ID NO: 4387548 - DNA, 12 bp, Homo sapiens
aaagtgccttct

SEQ ID NO: 4387549 - DNA, 13 bp, Homo sapiens
aaagtgctttttc

SEQ ID NO: 4387550 - DNA, 14 bp, Homo sapiens
aaagtgggggtgga

SEQ ID NO: 4387551 - DNA, 18 bp, Homo sapiens
aaagtggttctctgcctt

SEQ ID NO: 4387552 - DNA, 18 bp, Homo sapiens
aaagtgtcaactctttgt

SEQ ID NO: 4387553 - DNA, 21 bp, Homo sapiens
aaagtgtgaaataaatttttt

SEQ ID NO: 4387554 - DNA, 18 bp, Homo sapiens
aaagtgtgagcaaactaa

SEQ ID NO: 4387555 - DNA, 13 bp, Homo sapiens
aaagtgtgtaaat

SEQ ID NO: 4387556 - DNA, 16 bp, Homo sapiens
aaagtgttttcagagc

SEQ ID NO: 4387557 - DNA, 14 bp, Homo sapiens
aaagtgttttgaat

SEQ ID NO: 4387558 - DNA, 17 bp, Homo sapiens
aaagtgttttgtaccag

SEQ ID NO: 4387559 - DNA, 20 bp, Homo sapiens
aaagttaaggcttgatacca

SEQ ID NO: 4387560 - DNA, 18 bp, Homo sapiens
aaagttagtatcttttga

SEQ ID NO: 4387561 - DNA, 14 bp, Homo sapiens
aaagttatatttca

SEQ ID NO: 4387562 - DNA, 24 bp, Homo sapiens
aaagttatatttcagatgtaatgt

SEQ ID NO: 4387563 - DNA, 17 bp, Homo sapiens
aaagttcagatgtttca

SEQ ID NO: 4387564 - DNA, 20 bp, Homo sapiens
aaagttcagatgtttcatca

SEQ ID NO: 4387565 - DNA, 19 bp, Homo sapiens
aaagttcataacagtgcca

SEQ ID NO: 4387566 - DNA, 15 bp, Homo sapiens
aaagttctcagagct

SEQ ID NO: 4387567 - DNA, 16 bp, Homo sapiens
aaagttcttattttag

SEQ ID NO: 4387568 - DNA, 14 bp, Homo sapiens
aaagttctttcaac

SEQ ID NO: 4387569 - DNA, 21 bp, Homo sapiens
aaagttgaaccattatacttt

SEQ ID NO: 4387570 - DNA, 22 bp, Homo sapiens
aaagttgaaccattatacttta

SEQ ID NO: 4387571 - DNA, 19 bp, Homo sapiens
aaagttgaatattatatat

SEQ ID NO: 4387572 - DNA, 23 bp, Homo sapiens
aaagttgataaagattttttaat

SEQ ID NO: 4387573 - DNA, 13 bp, Homo sapiens
aaagttgcagatg

SEQ ID NO: 4387574 - DNA, 14 bp, Homo sapiens
aaagttgcttttat

SEQ ID NO: 4387575 - DNA, 14 bp, Homo sapiens
aaagttgtacatga

SEQ ID NO: 4387576 - DNA, 16 bp, Homo sapiens
aaagttgtacatgata

SEQ ID NO: 4387577 - DNA, 23 bp, Homo sapiens
aaagtttaaatgtattttacata

SEQ ID NO: 4387578 - DNA, 12 bp, Homo sapiens
aaagtttaataa

SEQ ID NO: 4387579 - DNA, 15 bp, Homo sapiens
aaagtttaatcagag

SEQ ID NO: 4387580 - DNA, 13 bp, Homo sapiens
aaagtttgccaga

SEQ ID NO: 4387581 - DNA, 17 bp, Homo sapiens
aaagtttttaatttgat

SEQ ID NO: 4387582 - DNA, 14 bp, Homo sapiens
aaagtttttagaat

SEQ ID NO: 4387583 - DNA, 20 bp, Homo sapiens
aagcaatcctcctgcctcag

SEQ ID NO: 4387584 - DNA, 23 bp, Homo sapiens
aagcaattagtctgaaactggct

SEQ ID NO: 4387585 - DNA, 16 bp, Homo sapiens
aagcaattctgactgt

SEQ ID NO: 4387586 - DNA, 19 bp, Homo sapiens
aagcacacacaataaagaa

SEQ ID NO: 4387587 - DNA, 16 bp, Homo sapiens
aagcacagaatatttt

SEQ ID NO: 4387588 - DNA, 16 bp, Homo sapiens
aagcacatattgagca

SEQ ID NO: 4387589 - DNA, 20 bp, Homo sapiens
aagcaccagtgggactgtgg

SEQ ID NO: 4387590 - DNA, 15 bp, Homo sapiens
aagcacccatttcaa

SEQ ID NO: 4387591 - DNA, 21 bp, Homo sapiens
aagcaccgaggttgcattcta

SEQ ID NO: 4387592 - DNA, 13 bp, Homo sapiens
aagcacctgccga

SEQ ID NO: 4387593 - DNA, 17 bp, Homo sapiens
aagcacctgccgacctc

SEQ ID NO: 4387594 - DNA, 22 bp, Homo sapiens
aagcacggggctggcagggcgt

SEQ ID NO: 4387595 - DNA, 20 bp, Homo sapiens
aagcactagagaatgcacag

SEQ ID NO: 4387596 - DNA, 17 bp, Homo sapiens
aagcactgacttctaag

SEQ ID NO: 4387597 - DNA, 16 bp, Homo sapiens
aagcacttcccaggat

SEQ ID NO: 4387598 - DNA, 12 bp, Homo sapiens
aagcacttctag

SEQ ID NO: 4387599 - DNA, 14 bp, Homo sapiens
aagcacttctagaa

SEQ ID NO: 4387600 - DNA, 17 bp, Homo sapiens
aagcagaacatactgtt

SEQ ID NO: 4387601 - DNA, 16 bp, Homo sapiens
aagcagacattttaaa

SEQ ID NO: 4387602 - DNA, 21 bp, Homo sapiens
aagcagaccactgataaaacc

SEQ ID NO: 4387603 - DNA, 23 bp, Homo sapiens
aagcagaccattggggctcccag

SEQ ID NO: 4387604 - DNA, 13 bp, Homo sapiens
aagcagaggccct

SEQ ID NO: 4387605 - DNA, 14 bp, Homo sapiens
aagcagaggccctg

SEQ ID NO: 4387606 - DNA, 16 bp, Homo sapiens
aagcagaggccctgcc

SEQ ID NO: 4387607 - DNA, 17 bp, Homo sapiens
aagcagaggccctgccc

SEQ ID NO: 4387608 - DNA, 15 bp, Homo sapiens
aagcagcactgtgag

SEQ ID NO: 4387609 - DNA, 14 bp, Homo sapiens
aagcagcagtgtcc

SEQ ID NO: 4387610 - DNA, 16 bp, Homo sapiens
aagcagcatcttctgg

SEQ ID NO: 4387611 - DNA, 12 bp, Homo sapiens
aatatatataaa

SEQ ID NO: 4387612 - DNA, 22 bp, Homo sapiens
aatatatataaagaatatatat

SEQ ID NO: 4387613 - DNA, 17 bp, Homo sapiens
aatatatatctgctgtc

SEQ ID NO: 4387614 - DNA, 19 bp, Homo sapiens
aatatatattatatacata

SEQ ID NO: 4387615 - DNA, 20 bp, Homo sapiens
aatatatctaccccagacta

SEQ ID NO: 4387616 - DNA, 16 bp, Homo sapiens
aatatatctgtaaaga

SEQ ID NO: 4387617 - DNA, 21 bp, Homo sapiens
aatatatgaagacaataattc

SEQ ID NO: 4387618 - DNA, 13 bp, Homo sapiens
aatatatggcatt

SEQ ID NO: 4387619 - DNA, 16 bp, Homo sapiens
aatatatggcatttgc

SEQ ID NO: 4387620 - DNA, 17 bp, Homo sapiens
aatatatggcatttgca

SEQ ID NO: 4387621 - DNA, 18 bp, Homo sapiens
aatatatggcatttgcag

SEQ ID NO: 4387622 - DNA, 23 bp, Homo sapiens
aatatatgggggaaaattatttt

SEQ ID NO: 4387623 - DNA, 12 bp, Homo sapiens
aatatatgtatg

SEQ ID NO: 4387624 - DNA, 14 bp, Homo sapiens
aatatatgtatgta

SEQ ID NO: 4387625 - DNA, 13 bp, Homo sapiens
aatatatgtattt

SEQ ID NO: 4387626 - DNA, 14 bp, Homo sapiens
aatatattgaacac

SEQ ID NO: 4387627 - DNA, 13 bp, Homo sapiens
aatatattgaact

SEQ ID NO: 4387628 - DNA, 20 bp, Homo sapiens
aatatattgaacttttgtac

SEQ ID NO: 4387629 - DNA, 23 bp, Homo sapiens
aatatattgaacttttgtactga

SEQ ID NO: 4387630 - DNA, 16 bp, Homo sapiens
aatatatttaaaaata

SEQ ID NO: 4387631 - DNA, 23 bp, Homo sapiens
aatatatttatatactttttcat

SEQ ID NO: 4387632 - DNA, 21 bp, Homo sapiens
aatatattttctgttttcttt

SEQ ID NO: 4387633 - DNA, 17 bp, Homo sapiens
aatatattttctttcta

SEQ ID NO: 4387634 - DNA, 19 bp, Homo sapiens
aatatattttgtttacaaa

SEQ ID NO: 4387635 - DNA, 14 bp, Homo sapiens
aatatcaaagcatt

SEQ ID NO: 4387636 - DNA, 22 bp, Homo sapiens
aatatcaaatgcagtatatttc

SEQ ID NO: 4387637 - DNA, 17 bp, Homo sapiens
aatatcactgtaatgag

SEQ ID NO: 4387638 - DNA, 19 bp, Homo sapiens
aatatcagtattctgacat

SEQ ID NO: 4387639 - DNA, 20 bp, Homo sapiens
aatatcagtattctgacatg

SEQ ID NO: 4387640 - DNA, 22 bp, Homo sapiens
aatatcagtattctgacatgta

SEQ ID NO: 4387641 - DNA, 23 bp, Homo sapiens
aatatcagtattctgacatgtaa

SEQ ID NO: 4387642 - DNA, 18 bp, Homo sapiens
aatatcatctgtcattat

SEQ ID NO: 4387643 - DNA, 19 bp, Homo sapiens
aatatcatttataaaggga

SEQ ID NO: 4387644 - DNA, 16 bp, Homo sapiens
aatatcctaaacatca

SEQ ID NO: 4387645 - DNA, 16 bp, Homo sapiens
aatatcgttagggtga

SEQ ID NO: 4387646 - DNA, 12 bp, Homo sapiens
aatatctaaagt

SEQ ID NO: 4387647 - DNA, 18 bp, Homo sapiens
aatatctaagcaagtgaa

SEQ ID NO: 4387648 - DNA, 14 bp, Homo sapiens
aatatctatttgaa

SEQ ID NO: 4387649 - DNA, 15 bp, Homo sapiens
aatatctgaacattt

SEQ ID NO: 4387650 - DNA, 22 bp, Homo sapiens
aatatctgttcccagcccctcc

SEQ ID NO: 4387651 - DNA, 18 bp, Homo sapiens
aatatcttcgttagtaat

SEQ ID NO: 4387652 - DNA, 15 bp, Homo sapiens
aatatcttggcctaa

SEQ ID NO: 4387653 - DNA, 20 bp, Homo sapiens
aatatgagcttcaatataag

SEQ ID NO: 4387654 - DNA, 20 bp, Homo sapiens
aatatgatccctaatgtgtt

SEQ ID NO: 4387655 - DNA, 17 bp, Homo sapiens
aatatgcaaagcactga

SEQ ID NO: 4387656 - DNA, 18 bp, Homo sapiens
aatatgcaagcagctttt

SEQ ID NO: 4387657 - DNA, 14 bp, Homo sapiens
aatatggaaatctt

SEQ ID NO: 4387658 - DNA, 18 bp, Homo sapiens
aatatggaaccttccctc

SEQ ID NO: 4387659 - DNA, 15 bp, Homo sapiens
aatatgtttaaaata

SEQ ID NO: 4387660 - DNA, 20 bp, Homo sapiens
aatatgtttaaaataaaatg

SEQ ID NO: 4387661 - DNA, 15 bp, Homo sapiens
aatatgtttagtttt

SEQ ID NO: 4387662 - DNA, 22 bp, Homo sapiens
aatatgtttagttttacatttt

SEQ ID NO: 4387663 - DNA, 13 bp, Homo sapiens
aatattaaatctg

SEQ ID NO: 4387664 - DNA, 13 bp, Homo sapiens
aatattaacattc

SEQ ID NO: 4387665 - DNA, 14 bp, Homo sapiens
aatattaagaacat

SEQ ID NO: 4387666 - DNA, 16 bp, Homo sapiens
aatattaagaacattt

SEQ ID NO: 4387667 - DNA, 17 bp, Homo sapiens
aatattactcctatttt

SEQ ID NO: 4387668 - DNA, 18 bp, Homo sapiens
aatattactctagtttat

SEQ ID NO: 4387669 - DNA, 19 bp, Homo sapiens
aatattatttgtgtttcct

SEQ ID NO: 4387670 - DNA, 16 bp, Homo sapiens
aatattcactgggcca

SEQ ID NO: 4387671 - DNA, 21 bp, Homo sapiens
aatattcagccagcttaaacc

SEQ ID NO: 4387672 - DNA, 18 bp, Homo sapiens
aatattcatagtttaatt

SEQ ID NO: 4387673 - DNA, 20 bp, Homo sapiens
aatattcatattggaaaaat

SEQ ID NO: 4387674 - DNA, 18 bp, Homo sapiens
aatattctctatttgaat

SEQ ID NO: 4387675 - DNA, 20 bp, Homo sapiens
aatattgaaaattgaaaagt

SEQ ID NO: 4387676 - DNA, 16 bp, Homo sapiens
aatattgaaatgctgt

SEQ ID NO: 4387677 - DNA, 17 bp, Homo sapiens
aatattgaagttgttta

SEQ ID NO: 4387678 - DNA, 24 bp, Homo sapiens
aatattgaagttgtttatcaactt

SEQ ID NO: 4387679 - DNA, 19 bp, Homo sapiens
aatattgcccaaataatat

SEQ ID NO: 4387680 - DNA, 16 bp, Homo sapiens
aatattgctaaaagca

SEQ ID NO: 4387681 - DNA, 16 bp, Homo sapiens
aatattgcttcaattt

SEQ ID NO: 4387682 - DNA, 20 bp, Homo sapiens
aatattggtgctatttaaca

SEQ ID NO: 4387683 - DNA, 23 bp, Homo sapiens
aatattggtgctatttaacattt

SEQ ID NO: 4387684 - DNA, 14 bp, Homo sapiens
aatattggttagta

SEQ ID NO: 4387685 - DNA, 17 bp, Homo sapiens
aatattggttagtattt

SEQ ID NO: 4387686 - DNA, 14 bp, Homo sapiens
aatattgtacagtt

SEQ ID NO: 4387687 - DNA, 15 bp, Homo sapiens
aatattgtacagttt

SEQ ID NO: 4387688 - DNA, 17 bp, Homo sapiens
aatattgtacagttttt

SEQ ID NO: 4387689 - DNA, 22 bp, Homo sapiens
aatattgtattgttagatgttt

SEQ ID NO: 4387690 - DNA, 16 bp, Homo sapiens
aatattgtctgtctct

SEQ ID NO: 4387691 - DNA, 17 bp, Homo sapiens
aatattgttttacaata

SEQ ID NO: 4387692 - DNA, 15 bp, Homo sapiens
aatatttaaaaatgt

SEQ ID NO: 4387693 - DNA, 13 bp, Homo sapiens
aatatttaagtga

SEQ ID NO: 4387694 - DNA, 17 bp, Homo sapiens
aatatttaagtgaagga

SEQ ID NO: 4387695 - DNA, 16 bp, Homo sapiens
aatatttacaatgtat

SEQ ID NO: 4387696 - DNA, 14 bp, Homo sapiens
aatatttattcatt

SEQ ID NO: 4387697 - DNA, 20 bp, Homo sapiens
aatatttattcattatttgt

SEQ ID NO: 4387698 - DNA, 13 bp, Homo sapiens
aatatttcaagtg

SEQ ID NO: 4387699 - DNA, 18 bp, Homo sapiens
aatatttcaagtgcctag

SEQ ID NO: 4387700 - DNA, 19 bp, Homo sapiens
aatatttcttaagtataaa

SEQ ID NO: 4387701 - DNA, 14 bp, Homo sapiens
aatatttcttcaaa

SEQ ID NO: 4387702 - DNA, 20 bp, Homo sapiens
aatatttcttcaaatatctc

SEQ ID NO: 4387703 - DNA, 21 bp, Homo sapiens
aatatttcttttgttgtactt

SEQ ID NO: 4387704 - DNA, 18 bp, Homo sapiens
aatatttgactattctgt

SEQ ID NO: 4387705 - DNA, 13 bp, Homo sapiens
aatatttggaatt

SEQ ID NO: 4387706 - DNA, 16 bp, Homo sapiens
aatattttaaaatcag

SEQ ID NO: 4387707 - DNA, 13 bp, Homo sapiens
aatattttaaaga

SEQ ID NO: 4387708 - DNA, 15 bp, Homo sapiens
aatattttaaagaat

SEQ ID NO: 4387709 - DNA, 22 bp, Homo sapiens
aatattttaataaagtagttat

SEQ ID NO: 4387710 - DNA, 22 bp, Homo sapiens
aatattttatcctgtattcttg

SEQ ID NO: 4387711 - DNA, 13 bp, Homo sapiens
aatattttctatt

SEQ ID NO: 4387712 - DNA, 22 bp, Homo sapiens
aatattttctctgtacttttca

SEQ ID NO: 4387713 - DNA, 13 bp, Homo sapiens
aatattttgaatc

SEQ ID NO: 4387714 - DNA, 14 bp, Homo sapiens
aatattttgaatca

SEQ ID NO: 4387715 - DNA, 14 bp, Homo sapiens
aatattttgataat

SEQ ID NO: 4387716 - DNA, 18 bp, Homo sapiens
aatattttgataataata

SEQ ID NO: 4387717 - DNA, 14 bp, Homo sapiens
aatattttgccttt

SEQ ID NO: 4387718 - DNA, 22 bp, Homo sapiens
aatattttgctaaaaaagcata

SEQ ID NO: 4387719 - DNA, 14 bp, Homo sapiens
aatattttgtaata

SEQ ID NO: 4387720 - DNA, 20 bp, Homo sapiens
aatattttgtaatattctgt

SEQ ID NO: 4387721 - DNA, 21 bp, Homo sapiens
aatattttgtatattatgttt

SEQ ID NO: 4387722 - DNA, 15 bp, Homo sapiens
aatatttttatatca

SEQ ID NO: 4387723 - DNA, 23 bp, Homo sapiens
aatatttttatatcatgcaaaat

SEQ ID NO: 4387724 - DNA, 21 bp, Homo sapiens
aatatttttatatttccttta

SEQ ID NO: 4387725 - DNA, 22 bp, Homo sapiens
aatattttttgctctaatctct

SEQ ID NO: 4387726 - DNA, 16 bp, Homo sapiens
aatcaaacattttctg

SEQ ID NO: 4387727 - DNA, 17 bp, Homo sapiens
aatcaaacattttctgg

SEQ ID NO: 4387728 - DNA, 15 bp, Homo sapiens
aatcaaatatgcaaa

SEQ ID NO: 4387729 - DNA, 20 bp, Homo sapiens
aatctatggctttaaataaa

SEQ ID NO: 4387730 - DNA, 14 bp, Homo sapiens
aatctattagattt

SEQ ID NO: 4387731 - DNA, 20 bp, Homo sapiens
aatctatttaaaaaactgta

SEQ ID NO: 4387732 - DNA, 17 bp, Homo sapiens
aacttcgaatatatctg

SEQ ID NO: 4387733 - DNA, 21 bp, Homo sapiens
aacttctccttagacactttg

SEQ ID NO: 4387734 - DNA, 16 bp, Homo sapiens
aacttcttatggaatt

SEQ ID NO: 4387735 - DNA, 18 bp, Homo sapiens
aacttcttcctgtgaagt

SEQ ID NO: 4387736 - DNA, 12 bp, Homo sapiens
aacttcttgctt

SEQ ID NO: 4387737 - DNA, 18 bp, Homo sapiens
aacttcttgcttctttct

SEQ ID NO: 4387738 - DNA, 16 bp, Homo sapiens
aacttgaaatatataa

SEQ ID NO: 4387739 - DNA, 14 bp, Homo sapiens
aacttgaagctaac

SEQ ID NO: 4387740 - DNA, 22 bp, Homo sapiens
aacttgcattctggcataattt

SEQ ID NO: 4387741 - DNA, 19 bp, Homo sapiens
aacttgcttaaatttctta

SEQ ID NO: 4387742 - DNA, 21 bp, Homo sapiens
aacttggaaatcagtagaaag

SEQ ID NO: 4387743 - DNA, 14 bp, Homo sapiens
aacttggtcagagc

SEQ ID NO: 4387744 - DNA, 20 bp, Homo sapiens
aacttggtgcttattgatat

SEQ ID NO: 4387745 - DNA, 16 bp, Homo sapiens
aacttggttttgctac

SEQ ID NO: 4387746 - DNA, 17 bp, Homo sapiens
aacttgtattttgtcac

SEQ ID NO: 4387747 - DNA, 13 bp, Homo sapiens
aacttgtctggct

SEQ ID NO: 4387748 - DNA, 14 bp, Homo sapiens
aacttgtctggctt

SEQ ID NO: 4387749 - DNA, 20 bp, Homo sapiens
aacttgtctggctttggcac

SEQ ID NO: 4387750 - DNA, 12 bp, Homo sapiens
aacttgtgaatg

SEQ ID NO: 4387751 - DNA, 17 bp, Homo sapiens
aacttgtgaatgcttct

SEQ ID NO: 4387752 - DNA, 16 bp, Homo sapiens
aacttgtgagcatcag

SEQ ID NO: 4387753 - DNA, 20 bp, Homo sapiens
aacttgtttgctgtgaacaa

SEQ ID NO: 4387754 - DNA, 21 bp, Homo sapiens
aactttaaacctgtagaatca

SEQ ID NO: 4387755 - DNA, 15 bp, Homo sapiens
aactttagaaataaa

SEQ ID NO: 4387756 - DNA, 21 bp, Homo sapiens
aactttagtttgcctgcagtt

SEQ ID NO: 4387757 - DNA, 20 bp, Homo sapiens
aactttatgctaagtgaaat

SEQ ID NO: 4387758 - DNA, 21 bp, Homo sapiens
aactttatgctaagtgaaata

SEQ ID NO: 4387759 - DNA, 17 bp, Homo sapiens
aactttcaatattttaa

SEQ ID NO: 4387760 - DNA, 17 bp, Homo sapiens
aactttcatttttttcc

SEQ ID NO: 4387761 - DNA, 16 bp, Homo sapiens
aactttccaaacacca

SEQ ID NO: 4387762 - DNA, 21 bp, Homo sapiens
aactttcgaccgactttcccc

SEQ ID NO: 4387763 - DNA, 13 bp, Homo sapiens
aactttctccctc

SEQ ID NO: 4387764 - DNA, 17 bp, Homo sapiens
aactttctctgtgaaag

SEQ ID NO: 4387765 - DNA, 15 bp, Homo sapiens
aactttggcctttgt

SEQ ID NO: 4387766 - DNA, 20 bp, Homo sapiens
aactttgtcacttctgctgt

SEQ ID NO: 4387767 - DNA, 18 bp, Homo sapiens
aacttttaggttgttacc

SEQ ID NO: 4387768 - DNA, 16 bp, Homo sapiens
aacttttataaattaa

SEQ ID NO: 4387769 - DNA, 17 bp, Homo sapiens
aacttttcaatgtgatt

SEQ ID NO: 4387770 - DNA, 22 bp, Homo sapiens
aacttttcaatgtgattcttct

SEQ ID NO: 4387771 - DNA, 13 bp, Homo sapiens
aacttttgggagc

SEQ ID NO: 4387772 - DNA, 17 bp, Homo sapiens
aagacagatgccccaga

SEQ ID NO: 4387773 - DNA, 15 bp, Homo sapiens
aagacagcagcagcc

SEQ ID NO: 4387774 - DNA, 21 bp, Homo sapiens
aagacagcagcagcctgcacc

SEQ ID NO: 4387775 - DNA, 12 bp, Homo sapiens
aagacagcttcc

SEQ ID NO: 4387776 - DNA, 22 bp, Homo sapiens
aagacaggagagattatttaca

SEQ ID NO: 4387777 - DNA, 14 bp, Homo sapiens
aagacatctgcctg

SEQ ID NO: 4387778 - DNA, 15 bp, Homo sapiens
aagacatgatttcct

SEQ ID NO: 4387779 - DNA, 19 bp, Homo sapiens
aagacatgcatttttaaaa

SEQ ID NO: 4387780 - DNA, 16 bp, Homo sapiens
aagacatgctttccat

SEQ ID NO: 4387781 - DNA, 13 bp, Homo sapiens
aagacatgtctgt

SEQ ID NO: 4387782 - DNA, 13 bp, Homo sapiens
aagacatttgctg

SEQ ID NO: 4387783 - DNA, 18 bp, Homo sapiens
aagacatttgctgaactc

SEQ ID NO: 4387784 - DNA, 14 bp, Homo sapiens
aagacatttttcat

SEQ ID NO: 4387785 - DNA, 16 bp, Homo sapiens
aagacatttttcattc

SEQ ID NO: 4387786 - DNA, 15 bp, Homo sapiens
aagacattttttaaa

SEQ ID NO: 4387787 - DNA, 16 bp, Homo sapiens
aagacattttttaaaa

SEQ ID NO: 4387788 - DNA, 20 bp, Homo sapiens
aagacattttttaaaagcct

SEQ ID NO: 4387789 - DNA, 20 bp, Homo sapiens
aagaccaatttatgggagaa

SEQ ID NO: 4387790 - DNA, 12 bp, Homo sapiens
aagaccagacta

SEQ ID NO: 4387791 - DNA, 16 bp, Homo sapiens
aagaccccaagaggaa

SEQ ID NO: 4387792 - DNA, 13 bp, Homo sapiens
aagacccccagca

SEQ ID NO: 4387793 - DNA, 15 bp, Homo sapiens
aagacccccagcact

SEQ ID NO: 4387794 - DNA, 16 bp, Homo sapiens
aagaccctcttgccca

SEQ ID NO: 4387795 - DNA, 18 bp, Homo sapiens
aagaccttggcctctcct

SEQ ID NO: 4387796 - DNA, 22 bp, Homo sapiens
aagacgtaaagaattttcatcc

SEQ ID NO: 4387797 - DNA, 19 bp, Homo sapiens
aagacgtggctctgggtga

SEQ ID NO: 4387798 - DNA, 22 bp, Homo sapiens
aagactagagcaaaataatgca

SEQ ID NO: 4387799 - DNA, 19 bp, Homo sapiens
aagactaggatattgaatg

SEQ ID NO: 4387800 - DNA, 17 bp, Homo sapiens
aagactatctacaaaaa

SEQ ID NO: 4387801 - DNA, 13 bp, Homo sapiens
aagactattcaaa

SEQ ID NO: 4387802 - DNA, 14 bp, Homo sapiens
aagactattcaaac

SEQ ID NO: 4387803 - DNA, 14 bp, Homo sapiens
aagactcagatgat

SEQ ID NO: 4387804 - DNA, 15 bp, Homo sapiens
aagactcaggagtct

SEQ ID NO: 4387805 - DNA, 21 bp, Homo sapiens
aagactcaggagtctgccact

SEQ ID NO: 4387806 - DNA, 14 bp, Homo sapiens
aagactccaaagaa

SEQ ID NO: 4387807 - DNA, 20 bp, Homo sapiens
aagactcgcggcaggttctc

SEQ ID NO: 4387808 - DNA, 16 bp, Homo sapiens
aagactctgtgtggct

SEQ ID NO: 4387809 - DNA, 22 bp, Homo sapiens
aagactgcctcaaaaaaaaaac

SEQ ID NO: 4387810 - DNA, 15 bp, Homo sapiens
aagactgctcccggc

SEQ ID NO: 4387811 - DNA, 15 bp, Homo sapiens
aagactgctgcagtc

SEQ ID NO: 4387812 - DNA, 12 bp, Homo sapiens
aagactgctggt

SEQ ID NO: 4387813 - DNA, 11 bp, Homo sapiens
aagactggctt

SEQ ID NO: 4387814 - DNA, 17 bp, Homo sapiens
aagactgggccccacat

SEQ ID NO: 4387815 - DNA, 23 bp, Homo sapiens
aagactgggccccacatggctta

SEQ ID NO: 4387816 - DNA, 20 bp, Homo sapiens
aagactgtgctgtcctttaa

SEQ ID NO: 4387817 - DNA, 22 bp, Homo sapiens
aagacttaaagggcccaatgaa

SEQ ID NO: 4387818 - DNA, 12 bp, Homo sapiens
aagacttcaaaa

SEQ ID NO: 4387819 - DNA, 14 bp, Homo sapiens
aagacttgctttaa

SEQ ID NO: 4387820 - DNA, 18 bp, Homo sapiens
aagagaaaacatctcatc

SEQ ID NO: 4387821 - DNA, 20 bp, Homo sapiens
aagagaaacagttggtaact

SEQ ID NO: 4387822 - DNA, 11 bp, Homo sapiens
aagagaaactt

SEQ ID NO: 4387823 - DNA, 12 bp, Homo sapiens
aagagaaacttt

SEQ ID NO: 4387824 - DNA, 15 bp, Homo sapiens
aagagaaagaggcca

SEQ ID NO: 4387825 - DNA, 14 bp, Homo sapiens
aagagaagacaaaa

SEQ ID NO: 4387826 - DNA, 23 bp, Homo sapiens
aagagaagatgcctgttaattta

SEQ ID NO: 4387827 - DNA, 14 bp, Homo sapiens
aagagaagttattt

SEQ ID NO: 4387828 - DNA, 21 bp, Homo sapiens
aagagaagttattttctacag

SEQ ID NO: 4387829 - DNA, 13 bp, Homo sapiens
aagagacaaactg

SEQ ID NO: 4387830 - DNA, 15 bp, Homo sapiens
aagagacagcccagg

SEQ ID NO: 4387831 - DNA, 20 bp, Homo sapiens
aagagagaaagcatattgac

SEQ ID NO: 4387832 - DNA, 15 bp, Homo sapiens
aagagagatgagaaa

SEQ ID NO: 4387833 - DNA, 11 bp, Homo sapiens
aagagagtttt

SEQ ID NO: 4387834 - DNA, 18 bp, Homo sapiens
aagagatagcttctcttc

SEQ ID NO: 4387835 - DNA, 17 bp, Homo sapiens
aagagatgaaataattt

SEQ ID NO: 4387836 - DNA, 17 bp, Homo sapiens
aagagatgagaaatgat

SEQ ID NO: 4387837 - DNA, 16 bp, Homo sapiens
aagagatggaaaaaaa

SEQ ID NO: 4387838 - DNA, 19 bp, Homo sapiens
aagagattaagaatattgc

SEQ ID NO: 4387839 - DNA, 20 bp, Homo sapiens
aagagattgtggtggtgcta

SEQ ID NO: 4387840 - DNA, 17 bp, Homo sapiens
aagagcagcctgtggca

SEQ ID NO: 4387841 - DNA, 19 bp, Homo sapiens
aagagcatggatgcatttc

SEQ ID NO: 4387842 - DNA, 12 bp, Homo sapiens
aagagccacctg

SEQ ID NO: 4387843 - DNA, 13 bp, Homo sapiens
aagagccacctgc

SEQ ID NO: 4387844 - DNA, 15 bp, Homo sapiens
aagagccacctgcaa

SEQ ID NO: 4387845 - DNA, 16 bp, Homo sapiens
aagagccacctgcaag

SEQ ID NO: 4387846 - DNA, 19 bp, Homo sapiens
aagagccacctgcaagatg

SEQ ID NO: 4387847 - DNA, 17 bp, Homo sapiens
aagagccattttggtaa

SEQ ID NO: 4387848 - DNA, 13 bp, Homo sapiens
aagagcccttgcc

SEQ ID NO: 4387849 - DNA, 17 bp, Homo sapiens
aagagccggtggtgccc

SEQ ID NO: 4387850 - DNA, 13 bp, Homo sapiens
aagagcctcccac

SEQ ID NO: 4387851 - DNA, 20 bp, Homo sapiens
aagagccttggtgtccacct

SEQ ID NO: 4387852 - DNA, 21 bp, Homo sapiens
aagagcgatacacaaagcttt

SEQ ID NO: 4387853 - DNA, 15 bp, Homo sapiens
aagagctaataaatc

SEQ ID NO: 4387854 - DNA, 16 bp, Homo sapiens
aagagctacataattt

SEQ ID NO: 4387855 - DNA, 23 bp, Homo sapiens
aagagctattttagaaagctaaa

SEQ ID NO: 4387856 - DNA, 12 bp, Homo sapiens
aagagctcttgg

SEQ ID NO: 4387857 - DNA, 15 bp, Homo sapiens
aagagctcttggccc

SEQ ID NO: 4387858 - DNA, 15 bp, Homo sapiens
aacctcaccttcctg

SEQ ID NO: 4387859 - DNA, 19 bp, Homo sapiens
aacctcagggctgtcccag

SEQ ID NO: 4387860 - DNA, 23 bp, Homo sapiens
aacctcagggctgtcccagcccc

SEQ ID NO: 4387861 - DNA, 16 bp, Homo sapiens
aacctcgagtactgtg

SEQ ID NO: 4387862 - DNA, 17 bp, Homo sapiens
aacctcgagtactgtgg

SEQ ID NO: 4387863 - DNA, 14 bp, Homo sapiens
aacctcgctggact

SEQ ID NO: 4387864 - DNA, 20 bp, Homo sapiens
aacctctgatttattttgta

SEQ ID NO: 4387865 - DNA, 18 bp, Homo sapiens
aacctcttcagaggccct

SEQ ID NO: 4387866 - DNA, 15 bp, Homo sapiens
aacctctttttcctc

SEQ ID NO: 4387867 - DNA, 17 bp, Homo sapiens
aacctctttttcctcct

SEQ ID NO: 4387868 - DNA, 18 bp, Homo sapiens
aacctctttttcctcctg

SEQ ID NO: 4387869 - DNA, 16 bp, Homo sapiens
aacctgacccctgctc

SEQ ID NO: 4387870 - DNA, 17 bp, Homo sapiens
aacctgacccctgctca

SEQ ID NO: 4387871 - DNA, 20 bp, Homo sapiens
aacctgaccgtgggcggggc

SEQ ID NO: 4387872 - DNA, 20 bp, Homo sapiens
aacctgactcaattatttgc

SEQ ID NO: 4387873 - DNA, 22 bp, Homo sapiens
aacctgactcaattatttgcat

SEQ ID NO: 4387874 - DNA, 18 bp, Homo sapiens
aacctgagccccaaaagg

SEQ ID NO: 4387875 - DNA, 17 bp, Homo sapiens
aacctgattggccactg

SEQ ID NO: 4387876 - DNA, 14 bp, Homo sapiens
aacctgcaaaaaat

SEQ ID NO: 4387877 - DNA, 19 bp, Homo sapiens
aacctgcctgacatttgga

SEQ ID NO: 4387878 - DNA, 17 bp, Homo sapiens
aacctggaacatctcac

SEQ ID NO: 4387879 - DNA, 19 bp, Homo sapiens
aacctggaacatctcacct

SEQ ID NO: 4387880 - DNA, 20 bp, Homo sapiens
aacctggaagatcatggacc

SEQ ID NO: 4387881 - DNA, 23 bp, Homo sapiens
aacctggaagatcatggacctgg

SEQ ID NO: 4387882 - DNA, 17 bp, Homo sapiens
aacctggagatgcagct

SEQ ID NO: 4387883 - DNA, 19 bp, Homo sapiens
aacctggaggtcaatgtta

SEQ ID NO: 4387884 - DNA, 23 bp, Homo sapiens
aacctggattttttatgtacaac

SEQ ID NO: 4387885 - DNA, 19 bp, Homo sapiens
aacctggcaagctagaacc

SEQ ID NO: 4387886 - DNA, 12 bp, Homo sapiens
aacctggggggc

SEQ ID NO: 4387887 - DNA, 20 bp, Homo sapiens
aacctggtctctacataaaa

SEQ ID NO: 4387888 - DNA, 16 bp, Homo sapiens
aacctggtggcaccag

SEQ ID NO: 4387889 - DNA, 21 bp, Homo sapiens
aacctggtggcaccagatgca

SEQ ID NO: 4387890 - DNA, 15 bp, Homo sapiens
aacctgtaaattatt

SEQ ID NO: 4387891 - DNA, 17 bp, Homo sapiens
aacctgtaaattatttt

SEQ ID NO: 4387892 - DNA, 18 bp, Homo sapiens
aacctgtagaatcaattt

SEQ ID NO: 4387893 - DNA, 22 bp, Homo sapiens
aacctgtagaatcaatttaagt

SEQ ID NO: 4387894 - DNA, 15 bp, Homo sapiens
aacctgtcctaagga

SEQ ID NO: 4387895 - DNA, 21 bp, Homo sapiens
aacctgttcttccttttttaa

SEQ ID NO: 4387896 - DNA, 13 bp, Homo sapiens
aaccttaagatac

SEQ ID NO: 4387897 - DNA, 18 bp, Homo sapiens
aaccttaatgacaacact

SEQ ID NO: 4387898 - DNA, 19 bp, Homo sapiens
aaccttatcctgcattgtt

SEQ ID NO: 4387899 - DNA, 18 bp, Homo sapiens
aaccttccaacttcctgt

SEQ ID NO: 4387900 - DNA, 13 bp, Homo sapiens
aaccttccaccca

SEQ ID NO: 4387901 - DNA, 14 bp, Homo sapiens
aaccttccctccaa

SEQ ID NO: 4387902 - DNA, 19 bp, Homo sapiens
aaccttcctgggaggacag

SEQ ID NO: 4387903 - DNA, 15 bp, Homo sapiens
aaccttgctactgtt

SEQ ID NO: 4387904 - DNA, 17 bp, Homo sapiens
aacctttaaaaatgtat

SEQ ID NO: 4387905 - DNA, 12 bp, Homo sapiens
aactgagctggg

SEQ ID NO: 4387906 - DNA, 19 bp, Homo sapiens
aactgaggagatgaccagg

SEQ ID NO: 4387907 - DNA, 22 bp, Homo sapiens
aactgaggagatgaccagggat

SEQ ID NO: 4387908 - DNA, 23 bp, Homo sapiens
aactgatgagtaaactgaggccc

SEQ ID NO: 4387909 - DNA, 13 bp, Homo sapiens
aactgattaaaaa

SEQ ID NO: 4387910 - DNA, 16 bp, Homo sapiens
aactgattaaaaatac

SEQ ID NO: 4387911 - DNA, 17 bp, Homo sapiens
aactgattacctgccaa

SEQ ID NO: 4387912 - DNA, 18 bp, Homo sapiens
aactgatttaacactttt

SEQ ID NO: 4387913 - DNA, 18 bp, Homo sapiens
aactgcaaccttgtttat

SEQ ID NO: 4387914 - DNA, 18 bp, Homo sapiens
aactgcagacctgtcctc

SEQ ID NO: 4387915 - DNA, 19 bp, Homo sapiens
aactgcagacctgtcctcc

SEQ ID NO: 4387916 - DNA, 12 bp, Homo sapiens
aactgcagcaat

SEQ ID NO: 4387917 - DNA, 13 bp, Homo sapiens
aactgcatctgga

SEQ ID NO: 4387918 - DNA, 13 bp, Homo sapiens
aactgcccagcaa

SEQ ID NO: 4387919 - DNA, 14 bp, Homo sapiens
aactgcccagcaac

SEQ ID NO: 4387920 - DNA, 17 bp, Homo sapiens
aactgccgtaatttaac

SEQ ID NO: 4387921 - DNA, 21 bp, Homo sapiens
aactgccttccccagggtgtc

SEQ ID NO: 4387922 - DNA, 18 bp, Homo sapiens
aactgcgaggacatcaaa

SEQ ID NO: 4387923 - DNA, 20 bp, Homo sapiens
aactgcgaggacatcaaagt

SEQ ID NO: 4387924 - DNA, 16 bp, Homo sapiens
aactgctccagcctct

SEQ ID NO: 4387925 - DNA, 17 bp, Homo sapiens
aactgctccagcctctg

SEQ ID NO: 4387926 - DNA, 19 bp, Homo sapiens
aactgctccagcctctgcc

SEQ ID NO: 4387927 - DNA, 11 bp, Homo sapiens
aactgctttat

SEQ ID NO: 4387928 - DNA, 20 bp, Homo sapiens
aactgctttctgttccaaat

SEQ ID NO: 4387929 - DNA, 18 bp, Homo sapiens
aactggaaacaaaacaga

SEQ ID NO: 4387930 - DNA, 20 bp, Homo sapiens
aactggaagcatgtaggaga

SEQ ID NO: 4387931 - DNA, 16 bp, Homo sapiens
aactggagttccttat

SEQ ID NO: 4387932 - DNA, 15 bp, Homo sapiens
aactggcatgtcatt

SEQ ID NO: 4387933 - DNA, 15 bp, Homo sapiens
aactggccttttgat

SEQ ID NO: 4387934 - DNA, 16 bp, Homo sapiens
aactggccttttgata

SEQ ID NO: 4387935 - DNA, 20 bp, Homo sapiens
aactgggataactgatttct

SEQ ID NO: 4387936 - DNA, 18 bp, Homo sapiens
aactgggtaatgaaacaa

SEQ ID NO: 4387937 - DNA, 17 bp, Homo sapiens
aactgggtcttcagctt

SEQ ID NO: 4387938 - DNA, 15 bp, Homo sapiens
aactgggtttctcat

SEQ ID NO: 4387939 - DNA, 18 bp, Homo sapiens
aactgggtttctcattaa

SEQ ID NO: 4387940 - DNA, 21 bp, Homo sapiens
aactggtgcactttgtaaatt

SEQ ID NO: 4387941 - DNA, 15 bp, Homo sapiens
aactggttcaggctc

SEQ ID NO: 4387942 - DNA, 14 bp, Homo sapiens
aactgtaaagatgt

SEQ ID NO: 4387943 - DNA, 13 bp, Homo sapiens
aactgtacattgt

SEQ ID NO: 4387944 - DNA, 16 bp, Homo sapiens
aactgtagaaatgatg

SEQ ID NO: 4387945 - DNA, 19 bp, Homo sapiens
aactgtaggtatgatctct

SEQ ID NO: 4387946 - DNA, 14 bp, Homo sapiens
aactgtatatttgt

SEQ ID NO: 4387947 - DNA, 12 bp, Homo sapiens
aactgtatttca

SEQ ID NO: 4387948 - DNA, 20 bp, Homo sapiens
aactgtatttgaaataagaa

SEQ ID NO: 4387949 - DNA, 22 bp, Homo sapiens
aactgtcagtgtacacgtctgg

SEQ ID NO: 4387950 - DNA, 14 bp, Homo sapiens
aactgtcccagcta

SEQ ID NO: 4387951 - DNA, 19 bp, Homo sapiens
aactgtccgtaagcagtat

SEQ ID NO: 4387952 - DNA, 14 bp, Homo sapiens
aactgtcttcctca

SEQ ID NO: 4387953 - DNA, 16 bp, Homo sapiens
aactgtcttcctcaaa

SEQ ID NO: 4387954 - DNA, 12 bp, Homo sapiens
aactgtcttgtt

SEQ ID NO: 4387955 - DNA, 15 bp, Homo sapiens
aactgtgaaatacca

SEQ ID NO: 4387956 - DNA, 13 bp, Homo sapiens
aactgtgaaatgt

SEQ ID NO: 4387957 - DNA, 17 bp, Homo sapiens
aactgtggtagctccag

SEQ ID NO: 4387958 - DNA, 19 bp, Homo sapiens
aactgtggtagctccagcg

SEQ ID NO: 4387959 - DNA, 23 bp, Homo sapiens
aactgtgtacataactgaaaatg

SEQ ID NO: 4387960 - DNA, 14 bp, Homo sapiens
aactgtgtactgtt

SEQ ID NO: 4387961 - DNA, 22 bp, Homo sapiens
aactgtgtatttatttaaaact

SEQ ID NO: 4387962 - DNA, 17 bp, Homo sapiens
aactgtgtgtgaatctg

SEQ ID NO: 4387963 - DNA, 14 bp, Homo sapiens
aactgttacagtaa

SEQ ID NO: 4387964 - DNA, 16 bp, Homo sapiens
aactgtttatatgtgt

SEQ ID NO: 4387965 - DNA, 19 bp, Homo sapiens
aactgtttatatgtgttga

SEQ ID NO: 4387966 - DNA, 17 bp, Homo sapiens
aactgtttcaagccctc

SEQ ID NO: 4387967 - DNA, 22 bp, Homo sapiens
aacttagccatttttcaaagca

SEQ ID NO: 4387968 - DNA, 22 bp, Homo sapiens
aacttattacctcaggtgccaa

SEQ ID NO: 4387969 - DNA, 13 bp, Homo sapiens
aacttcaaatttt

SEQ ID NO: 4387970 - DNA, 22 bp, Homo sapiens
aacttcaagtgcatgctctctg

SEQ ID NO: 4387971 - DNA, 21 bp, Homo sapiens
aacttcaccaccccctgtccc

SEQ ID NO: 4387972 - DNA, 22 bp, Homo sapiens
aacttcagcaaccctacagtat

SEQ ID NO: 4387973 - DNA, 22 bp, Homo sapiens
aacttcaggtgtgactctagca

SEQ ID NO: 4387974 - DNA, 12 bp, Homo sapiens
aacttcatggat

SEQ ID NO: 4387975 - DNA, 22 bp, Homo sapiens
aacttcattgtttggacctgca

SEQ ID NO: 4387976 - DNA, 15 bp, Homo sapiens
aacttccaaagaaag

SEQ ID NO: 4387977 - DNA, 17 bp, Homo sapiens
aacttccaaagaaagtt

SEQ ID NO: 4387978 - DNA, 19 bp, Homo sapiens
aacttccaggtgttactgt

SEQ ID NO: 4387979 - DNA, 18 bp, Homo sapiens
aacttccccatcttctaa

SEQ ID NO: 4387980 - DNA, 16 bp, Homo sapiens
aacttcctgtggcctg

SEQ ID NO: 4387981 - DNA, 15 bp, Homo sapiens
aacttcgaatatatc

SEQ ID NO: 4387982 - DNA, 19 bp, Homo sapiens
aacatgcagtttgaaattc

SEQ ID NO: 4387983 - DNA, 16 bp, Homo sapiens
aacatgcttataacat

SEQ ID NO: 4387984 - DNA, 19 bp, Homo sapiens
aacatggagaaaccctgtc

SEQ ID NO: 4387985 - DNA, 16 bp, Homo sapiens
aacatggagaaatcta

SEQ ID NO: 4387986 - DNA, 17 bp, Homo sapiens
aacatggagctgtcatc

SEQ ID NO: 4387987 - DNA, 21 bp, Homo sapiens
aacatgggagggatcagcccc

SEQ ID NO: 4387988 - DNA, 20 bp, Homo sapiens
aacatgtactacagctatat

SEQ ID NO: 4387989 - DNA, 19 bp, Homo sapiens
aacatgtcctgcctattat

SEQ ID NO: 4387990 - DNA, 22 bp, Homo sapiens
aacatgtgttttcatcatttca

SEQ ID NO: 4387991 - DNA, 14 bp, Homo sapiens
aacatgtttctgtt

SEQ ID NO: 4387992 - DNA, 18 bp, Homo sapiens
aacattaagaaaatattt

SEQ ID NO: 4387993 - DNA, 23 bp, Homo sapiens
aacattaatgcctgctttttgga

SEQ ID NO: 4387994 - DNA, 16 bp, Homo sapiens
aacattatataacaaa

SEQ ID NO: 4387995 - DNA, 23 bp, Homo sapiens
aacattatataacaaaaaaggtt

SEQ ID NO: 4387996 - DNA, 17 bp, Homo sapiens
aacattattacttttcc

SEQ ID NO: 4387997 - DNA, 14 bp, Homo sapiens
aacattcacttttg

SEQ ID NO: 4387998 - DNA, 14 bp, Homo sapiens
aacattcccctccc

SEQ ID NO: 4387999 - DNA, 23 bp, Homo sapiens
aacattcccctccccactcctct

SEQ ID NO: 4388000 - DNA, 17 bp, Homo sapiens
aacattcctaaaatgct

SEQ ID NO: 4388001 - DNA, 19 bp, Homo sapiens
aacattcctccagcctccc

SEQ ID NO: 4388002 - DNA, 20 bp, Homo sapiens
aacattcctccagcctcccc

SEQ ID NO: 4388003 - DNA, 16 bp, Homo sapiens
aacattcgaatctctg

SEQ ID NO: 4388004 - DNA, 18 bp, Homo sapiens
aacattcgtgagctgggg

SEQ ID NO: 4388005 - DNA, 14 bp, Homo sapiens
aacattctttttct

SEQ ID NO: 4388006 - DNA, 19 bp, Homo sapiens
aacattctttttctgttga

SEQ ID NO: 4388007 - DNA, 22 bp, Homo sapiens
aacattgatctgttttacagga

SEQ ID NO: 4388008 - DNA, 23 bp, Homo sapiens
aacattgatctgttttacaggaa

SEQ ID NO: 4388009 - DNA, 17 bp, Homo sapiens
aacattggacagaaaat

SEQ ID NO: 4388010 - DNA, 20 bp, Homo sapiens
aacattggacagaaaatgca

SEQ ID NO: 4388011 - DNA, 19 bp, Homo sapiens
aacattggagctgactgtt

SEQ ID NO: 4388012 - DNA, 18 bp, Homo sapiens
aacattgtactgttgctt

SEQ ID NO: 4388013 - DNA, 13 bp, Homo sapiens
aacattgtgttcc

SEQ ID NO: 4388014 - DNA, 23 bp, Homo sapiens
aacattgtgttcccatttcagct

SEQ ID NO: 4388015 - DNA, 17 bp, Homo sapiens
aacatttaaacttttta

SEQ ID NO: 4388016 - DNA, 13 bp, Homo sapiens
aacatttactaca

SEQ ID NO: 4388017 - DNA, 15 bp, Homo sapiens
aacatttatatgtag

SEQ ID NO: 4388018 - DNA, 22 bp, Homo sapiens
aacatttcatgtagtaagattt

SEQ ID NO: 4388019 - DNA, 22 bp, Homo sapiens
aacatttctatagccaaaaata

SEQ ID NO: 4388020 - DNA, 22 bp, Homo sapiens
aacatttcttacattgcagaac

SEQ ID NO: 4388021 - DNA, 16 bp, Homo sapiens
aacatttgctgtcagc

SEQ ID NO: 4388022 - DNA, 12 bp, Homo sapiens
aacattttctgg

SEQ ID NO: 4388023 - DNA, 16 bp, Homo sapiens
aacattttgatttcct

SEQ ID NO: 4388024 - DNA, 13 bp, Homo sapiens
aacattttttata

SEQ ID NO: 4388025 - DNA, 16 bp, Homo sapiens
aacattttttatacat

SEQ ID NO: 4388026 - DNA, 21 bp, Homo sapiens
aacatttttttttctccataa

SEQ ID NO: 4388027 - DNA, 16 bp, Homo sapiens
aaccaaaaatagaaat

SEQ ID NO: 4388028 - DNA, 14 bp, Homo sapiens
aaccaaaacatata

SEQ ID NO: 4388029 - DNA, 17 bp, Homo sapiens
aaccaaaatgacatctt

SEQ ID NO: 4388030 - DNA, 19 bp, Homo sapiens
aaccaaactgggtcttcag

SEQ ID NO: 4388031 - DNA, 20 bp, Homo sapiens
aaccaaactgggtcttcagc

SEQ ID NO: 4388032 - DNA, 13 bp, Homo sapiens
aaccaaatacctc

SEQ ID NO: 4388033 - DNA, 14 bp, Homo sapiens
aaccaaatacctca

SEQ ID NO: 4388034 - DNA, 20 bp, Homo sapiens
aaccaacccccatctcccta

SEQ ID NO: 4388035 - DNA, 15 bp, Homo sapiens
aaccaactctaatat

SEQ ID NO: 4388036 - DNA, 18 bp, Homo sapiens
aaccaagggtacagatcc

SEQ ID NO: 4388037 - DNA, 19 bp, Homo sapiens
aaccaagggtacagatccc

SEQ ID NO: 4388038 - DNA, 22 bp, Homo sapiens
aaccaatgcctttttagatgta

SEQ ID NO: 4388039 - DNA, 15 bp, Homo sapiens
aaccacaagcatctc

SEQ ID NO: 4388040 - DNA, 16 bp, Homo sapiens
aaccacaatgtttctt

SEQ ID NO: 4388041 - DNA, 15 bp, Homo sapiens
aaccacgcctcttga

SEQ ID NO: 4388042 - DNA, 13 bp, Homo sapiens
aaccactgaaaaa

SEQ ID NO: 4388043 - DNA, 21 bp, Homo sapiens
aaccactgggatcagctggtg

SEQ ID NO: 4388044 - DNA, 20 bp, Homo sapiens
aaccactgtgtactggagcc

SEQ ID NO: 4388045 - DNA, 15 bp, Homo sapiens
aaccagaaaagcaat

SEQ ID NO: 4388046 - DNA, 16 bp, Homo sapiens
aaccagaacagtatga

SEQ ID NO: 4388047 - DNA, 12 bp, Homo sapiens
aaccagaaccca

SEQ ID NO: 4388048 - DNA, 18 bp, Homo sapiens
aaccagaacgtggtttgc

SEQ ID NO: 4388049 - DNA, 23 bp, Homo sapiens
aaccagcacagcttagatttcat

SEQ ID NO: 4388050 - DNA, 17 bp, Homo sapiens
aaccaggccccagcctc

SEQ ID NO: 4388051 - DNA, 19 bp, Homo sapiens
aaccaggtcagtctgtctc

SEQ ID NO: 4388052 - DNA, 23 bp, Homo sapiens
aaccagtatttttgctgcttctg

SEQ ID NO: 4388053 - DNA, 15 bp, Homo sapiens
aaccagtctcctcac

SEQ ID NO: 4388054 - DNA, 12 bp, Homo sapiens
aaccagtgtgaa

SEQ ID NO: 4388055 - DNA, 13 bp, Homo sapiens
aaccagtgtgaac

SEQ ID NO: 4388056 - DNA, 16 bp, Homo sapiens
aaccatccccaactcc

SEQ ID NO: 4388057 - DNA, 20 bp, Homo sapiens
aaccatctgtccctgcctca

SEQ ID NO: 4388058 - DNA, 19 bp, Homo sapiens
aaccatgcaaattgtgaaa

SEQ ID NO: 4388059 - DNA, 13 bp, Homo sapiens
aaccattaaagtc

SEQ ID NO: 4388060 - DNA, 14 bp, Homo sapiens
aaccattacctgta

SEQ ID NO: 4388061 - DNA, 14 bp, Homo sapiens
aaccattatacttt

SEQ ID NO: 4388062 - DNA, 17 bp, Homo sapiens
aaccatttaaagaaaga

SEQ ID NO: 4388063 - DNA, 21 bp, Homo sapiens
aaccatttaaagaaagaatgc

SEQ ID NO: 4388064 - DNA, 18 bp, Homo sapiens
aacccaaatgttcatcaa

SEQ ID NO: 4388065 - DNA, 14 bp, Homo sapiens
aacccaagtgctgc

SEQ ID NO: 4388066 - DNA, 16 bp, Homo sapiens
aacccaagtgggggca

SEQ ID NO: 4388067 - DNA, 14 bp, Homo sapiens
aacccaatccaaat

SEQ ID NO: 4388068 - DNA, 15 bp, Homo sapiens
aacccacctctcctg

SEQ ID NO: 4388069 - DNA, 16 bp, Homo sapiens
aacccacctctcctgc

SEQ ID NO: 4388070 - DNA, 23 bp, Homo sapiens
aacccactttaaaatatctacat

SEQ ID NO: 4388071 - DNA, 11 bp, Homo sapiens
aacccaggagg

SEQ ID NO: 4388072 - DNA, 12 bp, Homo sapiens
aacccaggaggt

SEQ ID NO: 4388073 - DNA, 18 bp, Homo sapiens
aacccaggttcatgaata

SEQ ID NO: 4388074 - DNA, 23 bp, Homo sapiens
aacccagttaacttactctttaa

SEQ ID NO: 4388075 - DNA, 15 bp, Homo sapiens
aacccatacaatgta

SEQ ID NO: 4388076 - DNA, 21 bp, Homo sapiens
aacccatacaatgtatgtaca

SEQ ID NO: 4388077 - DNA, 23 bp, Homo sapiens
aacccatacaatgtatgtacaat

SEQ ID NO: 4388078 - DNA, 21 bp, Homo sapiens
aacccatattgtaaaacaggt

SEQ ID NO: 4388079 - DNA, 19 bp, Homo sapiens
aacccatattttaaattct

SEQ ID NO: 4388080 - DNA, 15 bp, Homo sapiens
aacccatcagaagga

SEQ ID NO: 4388081 - DNA, 17 bp, Homo sapiens
aacccattcactacagg

SEQ ID NO: 4388082 - DNA, 18 bp, Homo sapiens
aaccccagaggcagaggt

SEQ ID NO: 4388083 - DNA, 11 bp, Homo sapiens
aaccccagccc

SEQ ID NO: 4388084 - DNA, 14 bp, Homo sapiens
aaccccaggccccg

SEQ ID NO: 4388085 - DNA, 16 bp, Homo sapiens
aacccccaaatttaat

SEQ ID NO: 4388086 - DNA, 10 bp, Homo sapiens
aacccccacc

SEQ ID NO: 4388087 - DNA, 20 bp, Homo sapiens
aacccctccctcttctgccc

SEQ ID NO: 4388088 - DNA, 15 bp, Homo sapiens
aacccgtctggccca

SEQ ID NO: 4388089 - DNA, 15 bp, Homo sapiens
aaccctacagtatat

SEQ ID NO: 4388090 - DNA, 19 bp, Homo sapiens
aaccctacagtatataagc

SEQ ID NO: 4388091 - DNA, 20 bp, Homo sapiens
aaccctagaaatatatcctg

SEQ ID NO: 4388092 - DNA, 21 bp, Homo sapiens
aaccctccttggtgcctctgg

SEQ ID NO: 4388093 - DNA, 19 bp, Homo sapiens
aaccctgggctattgctgc

SEQ ID NO: 4388094 - DNA, 13 bp, Homo sapiens
aaccgaggccctc

SEQ ID NO: 4388095 - DNA, 16 bp, Homo sapiens
aaccgcatgtgatctc

SEQ ID NO: 4388096 - DNA, 16 bp, Homo sapiens
aaccgtctgttatgct

SEQ ID NO: 4388097 - DNA, 15 bp, Homo sapiens
aacctaacccctttc

SEQ ID NO: 4388098 - DNA, 14 bp, Homo sapiens
aacctaattaatat

SEQ ID NO: 4388099 - DNA, 23 bp, Homo sapiens
aacctacgagggaggaacacctg

SEQ ID NO: 4388100 - DNA, 17 bp, Homo sapiens
aacctagctacactgag

SEQ ID NO: 4388101 - DNA, 14 bp, Homo sapiens
aacctatccttcca

SEQ ID NO: 4388102 - DNA, 14 bp, Homo sapiens
aacctcaccttcct

SEQ ID NO: 4388103 - DNA, 22 bp, Homo sapiens
aacacctgccttctaccctctg

SEQ ID NO: 4388104 - DNA, 14 bp, Homo sapiens
aacaccttaatatg

SEQ ID NO: 4388105 - DNA, 19 bp, Homo sapiens
aacaccttcctcctgcaga

SEQ ID NO: 4388106 - DNA, 11 bp, Homo sapiens
aacactaacct

SEQ ID NO: 4388107 - DNA, 13 bp, Homo sapiens
aacactaataata

SEQ ID NO: 4388108 - DNA, 20 bp, Homo sapiens
aacactaatatatttaaaaa

SEQ ID NO: 4388109 - DNA, 23 bp, Homo sapiens
aacactaatatatttaaaaataa

SEQ ID NO: 4388110 - DNA, 19 bp, Homo sapiens
aacactaatcacaaactga

SEQ ID NO: 4388111 - DNA, 15 bp, Homo sapiens
aacactattttcaga

SEQ ID NO: 4388112 - DNA, 17 bp, Homo sapiens
aacactattttcagaat

SEQ ID NO: 4388113 - DNA, 12 bp, Homo sapiens
aacactcttttg

SEQ ID NO: 4388114 - DNA, 19 bp, Homo sapiens
aacactcttttgctttatt

SEQ ID NO: 4388115 - DNA, 18 bp, Homo sapiens
aacactgtgattactctt

SEQ ID NO: 4388116 - DNA, 20 bp, Homo sapiens
aacactgtgcacatctgtgt

SEQ ID NO: 4388117 - DNA, 22 bp, Homo sapiens
aacacttaggactagaagatta

SEQ ID NO: 4388118 - DNA, 21 bp, Homo sapiens
aacacttggcatacaaaatat

SEQ ID NO: 4388119 - DNA, 21 bp, Homo sapiens
aacactttagttatattcact

SEQ ID NO: 4388120 - DNA, 20 bp, Homo sapiens
aacagaaactacatttctac

SEQ ID NO: 4388121 - DNA, 18 bp, Homo sapiens
aacagaacatagacagaa

SEQ ID NO: 4388122 - DNA, 16 bp, Homo sapiens
aacagaacccacagta

SEQ ID NO: 4388123 - DNA, 14 bp, Homo sapiens
aacagaagcagagg

SEQ ID NO: 4388124 - DNA, 13 bp, Homo sapiens
aacagaatggatt

SEQ ID NO: 4388125 - DNA, 21 bp, Homo sapiens
aacagacaggaatttagaaaa

SEQ ID NO: 4388126 - DNA, 15 bp, Homo sapiens
aacagacaggagaaa

SEQ ID NO: 4388127 - DNA, 14 bp, Homo sapiens
aacagactctcaca

SEQ ID NO: 4388128 - DNA, 13 bp, Homo sapiens
aacagagaaggca

SEQ ID NO: 4388129 - DNA, 16 bp, Homo sapiens
aacagagaaggcagga

SEQ ID NO: 4388130 - DNA, 19 bp, Homo sapiens
aacagagactgaatagata

SEQ ID NO: 4388131 - DNA, 23 bp, Homo sapiens
aacagagggaccaaattgcttct

SEQ ID NO: 4388132 - DNA, 15 bp, Homo sapiens
aacagagtggcctcc

SEQ ID NO: 4388133 - DNA, 21 bp, Homo sapiens
aacagagtggcctccctgctg

SEQ ID NO: 4388134 - DNA, 14 bp, Homo sapiens
aacagatcagtaaa

SEQ ID NO: 4388135 - DNA, 16 bp, Homo sapiens
aacagatgaataaact

SEQ ID NO: 4388136 - DNA, 12 bp, Homo sapiens
aacagatgtgaa

SEQ ID NO: 4388137 - DNA, 20 bp, Homo sapiens
aacagatgtgaaaatatact

SEQ ID NO: 4388138 - DNA, 16 bp, Homo sapiens
aacagatgtttgtttt

SEQ ID NO: 4388139 - DNA, 13 bp, Homo sapiens
aacagatttcaaa

SEQ ID NO: 4388140 - DNA, 20 bp, Homo sapiens
aacagcaaatgcaaaaactc

SEQ ID NO: 4388141 - DNA, 21 bp, Homo sapiens
aacagcaaccttgaaaaaata

SEQ ID NO: 4388142 - DNA, 22 bp, Homo sapiens
aacagcatgtacggattttcag

SEQ ID NO: 4388143 - DNA, 19 bp, Homo sapiens
aacagccatttatttttta

SEQ ID NO: 4388144 - DNA, 16 bp, Homo sapiens
aacagccccggggccc

SEQ ID NO: 4388145 - DNA, 23 bp, Homo sapiens
aacagccccggggccccctggtc

SEQ ID NO: 4388146 - DNA, 21 bp, Homo sapiens
aacagcctactgaaaatgcat

SEQ ID NO: 4388147 - DNA, 18 bp, Homo sapiens
aacagcctgacaacattt

SEQ ID NO: 4388148 - DNA, 24 bp, Homo sapiens
aacagctcgatccaaattgtgctt

SEQ ID NO: 4388149 - DNA, 10 bp, Homo sapiens
aacagctgcc

SEQ ID NO: 4388150 - DNA, 14 bp, Homo sapiens
aacagctgccttag

SEQ ID NO: 4388151 - DNA, 15 bp, Homo sapiens
aacagctgccttagc

SEQ ID NO: 4388152 - DNA, 19 bp, Homo sapiens
aacagctgccttagcttca

SEQ ID NO: 4388153 - DNA, 19 bp, Homo sapiens
aacagctggaggaatacat

SEQ ID NO: 4388154 - DNA, 20 bp, Homo sapiens
aacagctggaggaatacatt

SEQ ID NO: 4388155 - DNA, 15 bp, Homo sapiens
aacagcttgccaggg

SEQ ID NO: 4388156 - DNA, 15 bp, Homo sapiens
aacagctttgtatgt

SEQ ID NO: 4388157 - DNA, 16 bp, Homo sapiens
aacaggaaaaaaactt

SEQ ID NO: 4388158 - DNA, 10 bp, Homo sapiens
aacaggaagc

SEQ ID NO: 4388159 - DNA, 20 bp, Homo sapiens
aacaggaatcaagagctgcc

SEQ ID NO: 4388160 - DNA, 13 bp, Homo sapiens
aacaggacagcac

SEQ ID NO: 4388161 - DNA, 17 bp, Homo sapiens
aacaggagacaggtcag

SEQ ID NO: 4388162 - DNA, 17 bp, Homo sapiens
aacagggacaaagaaat

SEQ ID NO: 4388163 - DNA, 20 bp, Homo sapiens
aacagggccacatagatgct

SEQ ID NO: 4388164 - DNA, 14 bp, Homo sapiens
aacagggcctctgc

SEQ ID NO: 4388165 - DNA, 18 bp, Homo sapiens
aacaggtaatataaaaag

SEQ ID NO: 4388166 - DNA, 22 bp, Homo sapiens
aacaggtatttttttaaatcaa

SEQ ID NO: 4388167 - DNA, 19 bp, Homo sapiens
aacaggttataacagtgtt

SEQ ID NO: 4388168 - DNA, 13 bp, Homo sapiens
aacaggttttttt

SEQ ID NO: 4388169 - DNA, 13 bp, Homo sapiens
aacagtaaaccac

SEQ ID NO: 4388170 - DNA, 19 bp, Homo sapiens
aacagtaaaccactgaaaa

SEQ ID NO: 4388171 - DNA, 20 bp, Homo sapiens
aacagtactggttactttca

SEQ ID NO: 4388172 - DNA, 21 bp, Homo sapiens
aacagtactggttactttcaa

SEQ ID NO: 4388173 - DNA, 22 bp, Homo sapiens
aacagtactggttactttcaaa

SEQ ID NO: 4388174 - DNA, 22 bp, Homo sapiens
aacagtagtgatagttgtaccg

SEQ ID NO: 4388175 - DNA, 18 bp, Homo sapiens
aacagtattgggcaggag

SEQ ID NO: 4388176 - DNA, 19 bp, Homo sapiens
aacagtattgggcaggagg

SEQ ID NO: 4388177 - DNA, 19 bp, Homo sapiens
aacagtctcaggaaatcaa

SEQ ID NO: 4388178 - DNA, 17 bp, Homo sapiens
aacagtgaacttgtctg

SEQ ID NO: 4388179 - DNA, 15 bp, Homo sapiens
aacagtgattaccag

SEQ ID NO: 4388180 - DNA, 17 bp, Homo sapiens
aacagtgcaacactggt

SEQ ID NO: 4388181 - DNA, 11 bp, Homo sapiens
aacagtgcatg

SEQ ID NO: 4388182 - DNA, 19 bp, Homo sapiens
aacagtgccattgtcttta

SEQ ID NO: 4388183 - DNA, 12 bp, Homo sapiens
aacagtgcctgc

SEQ ID NO: 4388184 - DNA, 14 bp, Homo sapiens
aacagttgccacat

SEQ ID NO: 4388185 - DNA, 14 bp, Homo sapiens
aacagttggcactg

SEQ ID NO: 4388186 - DNA, 14 bp, Homo sapiens
aacagttggtaact

SEQ ID NO: 4388187 - DNA, 20 bp, Homo sapiens
aacagttgtatttaacagaa

SEQ ID NO: 4388188 - DNA, 15 bp, Homo sapiens
aacataaaaactgat

SEQ ID NO: 4388189 - DNA, 20 bp, Homo sapiens
aacataaaaaggacatcagc

SEQ ID NO: 4388190 - DNA, 14 bp, Homo sapiens
aacataaaatacaa

SEQ ID NO: 4388191 - DNA, 14 bp, Homo sapiens
aacataaagttgta

SEQ ID NO: 4388192 - DNA, 21 bp, Homo sapiens
aacataaagttgtattgcatg

SEQ ID NO: 4388193 - DNA, 21 bp, Homo sapiens
aacataccccttacaaatgaa

SEQ ID NO: 4388194 - DNA, 18 bp, Homo sapiens
aacatacgggaagtttat

SEQ ID NO: 4388195 - DNA, 20 bp, Homo sapiens
aacatacgggaagtttattt

SEQ ID NO: 4388196 - DNA, 16 bp, Homo sapiens
aacatagacagaagaa

SEQ ID NO: 4388197 - DNA, 21 bp, Homo sapiens
aacatagcagatctgttttgt

SEQ ID NO: 4388198 - DNA, 16 bp, Homo sapiens
aacatagctttcttcc

SEQ ID NO: 4388199 - DNA, 20 bp, Homo sapiens
aacatagtaagttcagcact

SEQ ID NO: 4388200 - DNA, 16 bp, Homo sapiens
aacatagtgagacact

SEQ ID NO: 4388201 - DNA, 14 bp, Homo sapiens
aacatagtttttca

SEQ ID NO: 4388202 - DNA, 17 bp, Homo sapiens
aacatatgaaaatacaa

SEQ ID NO: 4388203 - DNA, 13 bp, Homo sapiens
aacatatgatact

SEQ ID NO: 4388204 - DNA, 22 bp, Homo sapiens
aacatatgtcacgaacttgaaa

SEQ ID NO: 4388205 - DNA, 19 bp, Homo sapiens
aacatattcatgaaatgtg

SEQ ID NO: 4388206 - DNA, 13 bp, Homo sapiens
aacatatttttat

SEQ ID NO: 4388207 - DNA, 21 bp, Homo sapiens
aacatatttttatactttatt

SEQ ID NO: 4388208 - DNA, 15 bp, Homo sapiens
aacatcatttcaatc

SEQ ID NO: 4388209 - DNA, 22 bp, Homo sapiens
aacatccaagtctttcttcttt

SEQ ID NO: 4388210 - DNA, 17 bp, Homo sapiens
aacatccctttttcaat

SEQ ID NO: 4388211 - DNA, 18 bp, Homo sapiens
aacatcgcaatagttttt

SEQ ID NO: 4388212 - DNA, 15 bp, Homo sapiens
aacatcgtggatgta

SEQ ID NO: 4388213 - DNA, 18 bp, Homo sapiens
aacatctcatcatgtcta

SEQ ID NO: 4388214 - DNA, 16 bp, Homo sapiens
aacatctgaaagccac

SEQ ID NO: 4388215 - DNA, 21 bp, Homo sapiens
aacatcttgaatactctgccc

SEQ ID NO: 4388216 - DNA, 19 bp, Homo sapiens
aacatctttattgaaattc

SEQ ID NO: 4388217 - DNA, 15 bp, Homo sapiens
aacatcttttcttgc

SEQ ID NO: 4388218 - DNA, 14 bp, Homo sapiens
aacatgaaaaacaa

SEQ ID NO: 4388219 - DNA, 18 bp, Homo sapiens
aacatgaggccactggag

SEQ ID NO: 4388220 - DNA, 15 bp, Homo sapiens
aacatgcaataacaa

SEQ ID NO: 4388221 - DNA, 19 bp, Homo sapiens
aacatgcactgatgttgtg

SEQ ID NO: 4388222 - DNA, 23 bp, Homo sapiens
aacatgcagctcttcaacatgac

SEQ ID NO: 4388223 - DNA, 22 bp, Homo sapiens
cattgttagcactaggcaccca

SEQ ID NO: 4388224 - DNA, 20 bp, Homo sapiens
cattgttgagctattgctgt

SEQ ID NO: 4388225 - DNA, 22 bp, Homo sapiens
cattgttttgaatattactcct

SEQ ID NO: 4388226 - DNA, 13 bp, Homo sapiens
cattgtttttgta

SEQ ID NO: 4388227 - DNA, 20 bp, Homo sapiens
catttaaaaatatatagctt

SEQ ID NO: 4388228 - DNA, 18 bp, Homo sapiens
catttaaaacagacactg

SEQ ID NO: 4388229 - DNA, 23 bp, Homo sapiens
catttaaaacagacactggcatg

SEQ ID NO: 4388230 - DNA, 22 bp, Homo sapiens
catttaaaatggaaaagagaga

SEQ ID NO: 4388231 - DNA, 17 bp, Homo sapiens
catttaaacatgcagaa

SEQ ID NO: 4388232 - DNA, 14 bp, Homo sapiens
catttaaacttttt

SEQ ID NO: 4388233 - DNA, 20 bp, Homo sapiens
catttaaactttttaaaata

SEQ ID NO: 4388234 - DNA, 21 bp, Homo sapiens
catttaaactttttaaaatac

SEQ ID NO: 4388235 - DNA, 18 bp, Homo sapiens
catttaaattttttggca

SEQ ID NO: 4388236 - DNA, 20 bp, Homo sapiens
catttaacattgtttttgta

SEQ ID NO: 4388237 - DNA, 18 bp, Homo sapiens
catttaagaattgccagt

SEQ ID NO: 4388238 - DNA, 18 bp, Homo sapiens
catttaagggaaaaatat

SEQ ID NO: 4388239 - DNA, 15 bp, Homo sapiens
catttaagtatcttg

SEQ ID NO: 4388240 - DNA, 20 bp, Homo sapiens
catttaagtatcttgtgctt

SEQ ID NO: 4388241 - DNA, 14 bp, Homo sapiens
catttaagtgacct

SEQ ID NO: 4388242 - DNA, 13 bp, Homo sapiens
catttaataaaac

SEQ ID NO: 4388243 - DNA, 21 bp, Homo sapiens
catttaataaaactgcgagga

SEQ ID NO: 4388244 - DNA, 12 bp, Homo sapiens
catttaataata

SEQ ID NO: 4388245 - DNA, 13 bp, Homo sapiens
catttaataatat

SEQ ID NO: 4388246 - DNA, 18 bp, Homo sapiens
catttaatcaatatttaa

SEQ ID NO: 4388247 - DNA, 20 bp, Homo sapiens
catccgactgcccctgctgt

SEQ ID NO: 4388248 - DNA, 14 bp, Homo sapiens
catccgcaggtgct

SEQ ID NO: 4388249 - DNA, 20 bp, Homo sapiens
catccgcaggtgctggtccc

SEQ ID NO: 4388250 - DNA, 18 bp, Homo sapiens
catccgtagttccctgaa

SEQ ID NO: 4388251 - DNA, 19 bp, Homo sapiens
catccgtcccacatcaggg

SEQ ID NO: 4388252 - DNA, 15 bp, Homo sapiens
catcctaccccctgt

SEQ ID NO: 4388253 - DNA, 15 bp, Homo sapiens
catcctaccgtcttt

SEQ ID NO: 4388254 - DNA, 22 bp, Homo sapiens
catcctcaaacgacagaggagc

SEQ ID NO: 4388255 - DNA, 13 bp, Homo sapiens
catcctcatccct

SEQ ID NO: 4388256 - DNA, 15 bp, Homo sapiens
catcctcatccctga

SEQ ID NO: 4388257 - DNA, 20 bp, Homo sapiens
catcctcatccctgactggc

SEQ ID NO: 4388258 - DNA, 20 bp, Homo sapiens
catcctccacgttctgctca

SEQ ID NO: 4388259 - DNA, 15 bp, Homo sapiens
catcctcccattgcc

SEQ ID NO: 4388260 - DNA, 24 bp, Homo sapiens
catcctcccattgcccagtgagcc

SEQ ID NO: 4388261 - DNA, 20 bp, Homo sapiens
catcctccctccacctcaag

SEQ ID NO: 4388262 - DNA, 19 bp, Homo sapiens
catcctccctgaccctgct

SEQ ID NO: 4388263 - DNA, 20 bp, Homo sapiens
catcctctgcctcccgggtt

SEQ ID NO: 4388264 - DNA, 13 bp, Homo sapiens
catcctctttctc

SEQ ID NO: 4388265 - DNA, 20 bp, Homo sapiens
catcctctttctcttttcta

SEQ ID NO: 4388266 - DNA, 19 bp, Homo sapiens
catcctgaccagctgctcc

SEQ ID NO: 4388267 - DNA, 16 bp, Homo sapiens
catcctgactctgccc

SEQ ID NO: 4388268 - DNA, 22 bp, Homo sapiens
catcctgccttagagccaggca

SEQ ID NO: 4388269 - DNA, 23 bp, Homo sapiens
catcctgcggaaggaattcagga

SEQ ID NO: 4388270 - DNA, 12 bp, Homo sapiens
catcctgctctt

SEQ ID NO: 4388271 - DNA, 21 bp, Homo sapiens
catcctgctcttttgtgatga

SEQ ID NO: 4388272 - DNA, 16 bp, Homo sapiens
catcctggcccagggc

SEQ ID NO: 4388273 - DNA, 18 bp, Homo sapiens
catcctggcccagggcat

SEQ ID NO: 4388274 - DNA, 18 bp, Homo sapiens
catcctgtagggcaccca

SEQ ID NO: 4388275 - DNA, 13 bp, Homo sapiens
catccttgtaata

SEQ ID NO: 4388276 - DNA, 14 bp, Homo sapiens
catccttgtaatac

SEQ ID NO: 4388277 - DNA, 15 bp, Homo sapiens
catccttgtaatacc

SEQ ID NO: 4388278 - DNA, 19 bp, Homo sapiens
catcgacttagcctgagtc

SEQ ID NO: 4388279 - DNA, 14 bp, Homo sapiens
catcgcagcttcct

SEQ ID NO: 4388280 - DNA, 19 bp, Homo sapiens
catcgctgttctgggcatg

SEQ ID NO: 4388281 - DNA, 20 bp, Homo sapiens
catcggccaagaatacttga

SEQ ID NO: 4388282 - DNA, 21 bp, Homo sapiens
catcggccaagaatacttgaa

SEQ ID NO: 4388283 - DNA, 16 bp, Homo sapiens
catcgggaaagaagaa

SEQ ID NO: 4388284 - DNA, 18 bp, Homo sapiens
catcggggtggcccactg

SEQ ID NO: 4388285 - DNA, 15 bp, Homo sapiens
catcgtcctgggact

SEQ ID NO: 4388286 - DNA, 15 bp, Homo sapiens
catcgtccttcctct

SEQ ID NO: 4388287 - DNA, 22 bp, Homo sapiens
catctaaacacaacaataactt

SEQ ID NO: 4388288 - DNA, 13 bp, Homo sapiens
catctaaagcttt

SEQ ID NO: 4388289 - DNA, 23 bp, Homo sapiens
catctaaagctttatctttgtgt

SEQ ID NO: 4388290 - DNA, 19 bp, Homo sapiens
catctaacctcatcttctt

SEQ ID NO: 4388291 - DNA, 20 bp, Homo sapiens
catctaacttcttaaagtta

SEQ ID NO: 4388292 - DNA, 10 bp, Homo sapiens
catcaactga

SEQ ID NO: 4388293 - DNA, 13 bp, Homo sapiens
catcaagcacttc

SEQ ID NO: 4388294 - DNA, 19 bp, Homo sapiens
catcaagcacttcccagga

SEQ ID NO: 4388295 - DNA, 14 bp, Homo sapiens
catcaagtaataca

SEQ ID NO: 4388296 - DNA, 14 bp, Homo sapiens
catcaagtccatct

SEQ ID NO: 4388297 - DNA, 17 bp, Homo sapiens
catcaatacaaccagcc

SEQ ID NO: 4388298 - DNA, 22 bp, Homo sapiens
catcaatagtgtcctatgcaat

SEQ ID NO: 4388299 - DNA, 13 bp, Homo sapiens
catcaatcttgtt

SEQ ID NO: 4388300 - DNA, 13 bp, Homo sapiens
catcaatgcagtt

SEQ ID NO: 4388301 - DNA, 13 bp, Homo sapiens
catcacacccatt

SEQ ID NO: 4388302 - DNA, 15 bp, Homo sapiens
catcacactcaagga

SEQ ID NO: 4388303 - DNA, 19 bp, Homo sapiens
catcacactgggtggtggc

SEQ ID NO: 4388304 - DNA, 17 bp, Homo sapiens
catcacagaccccagct

SEQ ID NO: 4388305 - DNA, 13 bp, Homo sapiens
catcacatcttat

SEQ ID NO: 4388306 - DNA, 16 bp, Homo sapiens
catcacatcttattta

SEQ ID NO: 4388307 - DNA, 19 bp, Homo sapiens
catcacatcttatttattt

SEQ ID NO: 4388308 - DNA, 21 bp, Homo sapiens
catcacatcttatttatttta

SEQ ID NO: 4388309 - DNA, 22 bp, Homo sapiens
catcacatcttatttattttag

SEQ ID NO: 4388310 - DNA, 16 bp, Homo sapiens
catcaccactcatttt

SEQ ID NO: 4388311 - DNA, 13 bp, Homo sapiens
catcacccaagcc

SEQ ID NO: 4388312 - DNA, 13 bp, Homo sapiens
catcacccttccg

SEQ ID NO: 4388313 - DNA, 11 bp, Homo sapiens
catcacctgct

SEQ ID NO: 4388314 - DNA, 14 bp, Homo sapiens
catcacctgggacc

SEQ ID NO: 4388315 - DNA, 16 bp, Homo sapiens
catcacgacacatttg

SEQ ID NO: 4388316 - DNA, 15 bp, Homo sapiens
catcactatcaattt

SEQ ID NO: 4388317 - DNA, 17 bp, Homo sapiens
catcactatcaatttta

SEQ ID NO: 4388318 - DNA, 13 bp, Homo sapiens
catcactcttgta

SEQ ID NO: 4388319 - DNA, 16 bp, Homo sapiens
catcactgatgggaat

SEQ ID NO: 4388320 - DNA, 19 bp, Homo sapiens
catcactggagcaccaggc

SEQ ID NO: 4388321 - DNA, 14 bp, Homo sapiens
catcacttctcccc

SEQ ID NO: 4388322 - DNA, 23 bp, Homo sapiens
catcagaaaacagggtccaggaa

SEQ ID NO: 4388323 - DNA, 22 bp, Homo sapiens
catcagaaaaccaaagggtgct

SEQ ID NO: 4388324 - DNA, 20 bp, Homo sapiens
catcagaacctcaattgaca

SEQ ID NO: 4388325 - DNA, 17 bp, Homo sapiens
catcagaacctgagcta

SEQ ID NO: 4388326 - DNA, 11 bp, Homo sapiens
catcagaagga

SEQ ID NO: 4388327 - DNA, 15 bp, Homo sapiens
catcagaaggagaag

SEQ ID NO: 4388328 - DNA, 20 bp, Homo sapiens
catcagacccaacccatgaa

SEQ ID NO: 4388329 - DNA, 14 bp, Homo sapiens
catcagagggctga

SEQ ID NO: 4388330 - DNA, 12 bp, Homo sapiens
catcagccctgc

SEQ ID NO: 4388331 - DNA, 15 bp, Homo sapiens
catcagccctgctag

SEQ ID NO: 4388332 - DNA, 15 bp, Homo sapiens
catcagctgctgaaa

SEQ ID NO: 4388333 - DNA, 20 bp, Homo sapiens
catcagcttgccctgttaaa

SEQ ID NO: 4388334 - DNA, 16 bp, Homo sapiens
catcaggtgtgctcag

SEQ ID NO: 4388335 - DNA, 17 bp, Homo sapiens
catcagtaagcagcctt

SEQ ID NO: 4388336 - DNA, 23 bp, Homo sapiens
catcagtcatcaggtgtgctcag

SEQ ID NO: 4388337 - DNA, 17 bp, Homo sapiens
catcagtctccaacatg

SEQ ID NO: 4388338 - DNA, 15 bp, Homo sapiens
catcagtgctccctc

SEQ ID NO: 4388339 - DNA, 16 bp, Homo sapiens
catcagtgctccctca

SEQ ID NO: 4388340 - DNA, 18 bp, Homo sapiens
catcagtggatggcagga

SEQ ID NO: 4388341 - DNA, 15 bp, Homo sapiens
catcagttccagcct

SEQ ID NO: 4388342 - DNA, 21 bp, Homo sapiens
cagtctttgaactgcagcaat

SEQ ID NO: 4388343 - DNA, 22 bp, Homo sapiens
cagtctttgaactgcagcaatc

SEQ ID NO: 4388344 - DNA, 14 bp, Homo sapiens
cagtgaactcctgc

SEQ ID NO: 4388345 - DNA, 16 bp, Homo sapiens
cagtgaactcctgcca

SEQ ID NO: 4388346 - DNA, 21 bp, Homo sapiens
cagtgaactcctgccaggcac

SEQ ID NO: 4388347 - DNA, 22 bp, Homo sapiens
cagtgaaggtggggagaagctg

SEQ ID NO: 4388348 - DNA, 20 bp, Homo sapiens
cagtgaatgattcagtgtta

SEQ ID NO: 4388349 - DNA, 16 bp, Homo sapiens
cagtgaatttttgcaa

SEQ ID NO: 4388350 - DNA, 22 bp, Homo sapiens
cagtgaatttttgcaataatgc

SEQ ID NO: 4388351 - DNA, 23 bp, Homo sapiens
cagtgaatttttgcaataatgca

SEQ ID NO: 4388352 - DNA, 17 bp, Homo sapiens
cagtgacacgtctcgcc

SEQ ID NO: 4388353 - DNA, 23 bp, Homo sapiens
cagtgacacgtctcgccaagcag

SEQ ID NO: 4388354 - DNA, 14 bp, Homo sapiens
cagtgaccagtgcc

SEQ ID NO: 4388355 - DNA, 17 bp, Homo sapiens
cagtgagactgccccac

SEQ ID NO: 4388356 - DNA, 23 bp, Homo sapiens
cagtgagagacgccctatttcta

SEQ ID NO: 4388357 - DNA, 18 bp, Homo sapiens
cagtgagcccctccccag

SEQ ID NO: 4388358 - DNA, 13 bp, Homo sapiens
cagtgagccctgc

SEQ ID NO: 4388359 - DNA, 16 bp, Homo sapiens
cagtgagccctgctct

SEQ ID NO: 4388360 - DNA, 15 bp, Homo sapiens
cagtgagcctcctgt

SEQ ID NO: 4388361 - DNA, 19 bp, Homo sapiens
cagtgagcctcctgtgcct

SEQ ID NO: 4388362 - DNA, 20 bp, Homo sapiens
cagtgagcctcctgtgcctg

SEQ ID NO: 4388363 - DNA, 21 bp, Homo sapiens
cagtgagtgccatgctttttg

SEQ ID NO: 4388364 - DNA, 17 bp, Homo sapiens
cagtgataatgttcatt

SEQ ID NO: 4388365 - DNA, 18 bp, Homo sapiens
cagtgataatgttcattt

SEQ ID NO: 4388366 - DNA, 22 bp, Homo sapiens
cagtgataatgttcattttgaa

SEQ ID NO: 4388367 - DNA, 22 bp, Homo sapiens
cagtgcaacaggaggctttttc

SEQ ID NO: 4388368 - DNA, 16 bp, Homo sapiens
cagtgcagagccttct

SEQ ID NO: 4388369 - DNA, 16 bp, Homo sapiens
cagtgcagcagaggac

SEQ ID NO: 4388370 - DNA, 20 bp, Homo sapiens
cagtgcagggcaaaatattc

SEQ ID NO: 4388371 - DNA, 18 bp, Homo sapiens
cagtgcagtttcttttca

SEQ ID NO: 4388372 - DNA, 23 bp, Homo sapiens
cagtgccacctatgcctgtggtg

SEQ ID NO: 4388373 - DNA, 15 bp, Homo sapiens
cagtgccattgtctt

SEQ ID NO: 4388374 - DNA, 21 bp, Homo sapiens
cagtgccattgtctttatatg

SEQ ID NO: 4388375 - DNA, 22 bp, Homo sapiens
cagtgccattgtctttatatga

SEQ ID NO: 4388376 - DNA, 14 bp, Homo sapiens
cagtgccccaggga

SEQ ID NO: 4388377 - DNA, 21 bp, Homo sapiens
cagtgcctctccctgctgctc

SEQ ID NO: 4388378 - DNA, 21 bp, Homo sapiens
cagtgcctgccactctctggg

SEQ ID NO: 4388379 - DNA, 13 bp, Homo sapiens
cagtgcctgtgag

SEQ ID NO: 4388380 - DNA, 21 bp, Homo sapiens
cagtgcctgtgagcatggggc

SEQ ID NO: 4388381 - DNA, 17 bp, Homo sapiens
cagtgccttacctcctg

SEQ ID NO: 4388382 - DNA, 13 bp, Homo sapiens
cagtgccttctct

SEQ ID NO: 4388383 - DNA, 14 bp, Homo sapiens
cagtgccttgggga

SEQ ID NO: 4388384 - DNA, 17 bp, Homo sapiens
cagtgccttttggaact

SEQ ID NO: 4388385 - DNA, 16 bp, Homo sapiens
cagtgctcctggaaac

SEQ ID NO: 4388386 - DNA, 24 bp, Homo sapiens
cagtgctcctggaaacttagcttt

SEQ ID NO: 4388387 - DNA, 14 bp, Homo sapiens
cagtgctctgcctc

SEQ ID NO: 4388388 - DNA, 15 bp, Homo sapiens
cagtgctctgcctca

SEQ ID NO: 4388389 - DNA, 23 bp, Homo sapiens
cagtgctcttttctcctcactgt

SEQ ID NO: 4388390 - DNA, 19 bp, Homo sapiens
cagtgctgcagctccctgg

SEQ ID NO: 4388391 - DNA, 19 bp, Homo sapiens
cagtgctgtccatgcttct

SEQ ID NO: 4388392 - DNA, 14 bp, Homo sapiens
cagtgcttagcaaa

SEQ ID NO: 4388393 - DNA, 12 bp, Homo sapiens
cagtggaagaaa

SEQ ID NO: 4388394 - DNA, 13 bp, Homo sapiens
cagtggaagaaac

SEQ ID NO: 4388395 - DNA, 21 bp, Homo sapiens
cagtggaccgaaatctgtatt

SEQ ID NO: 4388396 - DNA, 20 bp, Homo sapiens
cagtggactcagaaagccaa

SEQ ID NO: 4388397 - DNA, 22 bp, Homo sapiens
cagtggactcagaaagccaaca

SEQ ID NO: 4388398 - DNA, 17 bp, Homo sapiens
cagtggatcacaaagtg

SEQ ID NO: 4388399 - DNA, 14 bp, Homo sapiens
cagtggccactcag

SEQ ID NO: 4388400 - DNA, 12 bp, Homo sapiens
cagtggccaggt

SEQ ID NO: 4388401 - DNA, 23 bp, Homo sapiens
cagtggccaggtgccgacactga

SEQ ID NO: 4388402 - DNA, 15 bp, Homo sapiens
cagtagattgcagaa

SEQ ID NO: 4388403 - DNA, 16 bp, Homo sapiens
cagtagattgcagaaa

SEQ ID NO: 4388404 - DNA, 18 bp, Homo sapiens
cagtagattgcagaaaat

SEQ ID NO: 4388405 - DNA, 15 bp, Homo sapiens
cagtagcctcctcct

SEQ ID NO: 4388406 - DNA, 20 bp, Homo sapiens
cagtagctgtggtgaggtgg

SEQ ID NO: 4388407 - DNA, 21 bp, Homo sapiens
cagtagcttcccaaaaacagc

SEQ ID NO: 4388408 - DNA, 14 bp, Homo sapiens
cagtaggagcccag

SEQ ID NO: 4388409 - DNA, 22 bp, Homo sapiens
cagtaggagcccagctctgaaa

SEQ ID NO: 4388410 - DNA, 22 bp, Homo sapiens
cagtaggtgcccagaataagtt

SEQ ID NO: 4388411 - DNA, 17 bp, Homo sapiens
cagtagtcacaaactga

SEQ ID NO: 4388412 - DNA, 21 bp, Homo sapiens
cagtagtcacaaactgatcta

SEQ ID NO: 4388413 - DNA, 21 bp, Homo sapiens
cagtagttttgacacttccca

SEQ ID NO: 4388414 - DNA, 20 bp, Homo sapiens
cagtataacctgtctatact

SEQ ID NO: 4388415 - DNA, 12 bp, Homo sapiens
cagtatataagc

SEQ ID NO: 4388416 - DNA, 15 bp, Homo sapiens
cagtatataagcttt

SEQ ID NO: 4388417 - DNA, 16 bp, Homo sapiens
cagtatattagtatta

SEQ ID NO: 4388418 - DNA, 16 bp, Homo sapiens
cagtatattttatttc

SEQ ID NO: 4388419 - DNA, 13 bp, Homo sapiens
cagtatattttct

SEQ ID NO: 4388420 - DNA, 20 bp, Homo sapiens
cagtatcagtattttcacac

SEQ ID NO: 4388421 - DNA, 24 bp, Homo sapiens
cagtatccatgctcttgaccttgt

SEQ ID NO: 4388422 - DNA, 12 bp, Homo sapiens
cagtatggcagc

SEQ ID NO: 4388423 - DNA, 12 bp, Homo sapiens
cagtatgtggaa

SEQ ID NO: 4388424 - DNA, 13 bp, Homo sapiens
cagtatgttttaa

SEQ ID NO: 4388425 - DNA, 23 bp, Homo sapiens
cagtattaaattagatatcttca

SEQ ID NO: 4388426 - DNA, 21 bp, Homo sapiens
cagtattatagacaaaagaat

SEQ ID NO: 4388427 - DNA, 15 bp, Homo sapiens
cagtattctgacatg

SEQ ID NO: 4388428 - DNA, 16 bp, Homo sapiens
cagtattctgacatgt

SEQ ID NO: 4388429 - DNA, 17 bp, Homo sapiens
cagtattctgacatgta

SEQ ID NO: 4388430 - DNA, 21 bp, Homo sapiens
cagtattctgacatgtaagaa

SEQ ID NO: 4388431 - DNA, 17 bp, Homo sapiens
cagtattgccccctctc

SEQ ID NO: 4388432 - DNA, 14 bp, Homo sapiens
cagtattgggcagg

SEQ ID NO: 4388433 - DNA, 18 bp, Homo sapiens
cagtattgggcaggagga

SEQ ID NO: 4388434 - DNA, 12 bp, Homo sapiens
cagtatttaagc

SEQ ID NO: 4388435 - DNA, 16 bp, Homo sapiens
cagtatttaagcttta

SEQ ID NO: 4388436 - DNA, 20 bp, Homo sapiens
cagtatttaagctttaaatg

SEQ ID NO: 4388437 - DNA, 21 bp, Homo sapiens
cagtatttaagctttaaatga

SEQ ID NO: 4388438 - DNA, 12 bp, Homo sapiens
cagtatttgtaa

SEQ ID NO: 4388439 - DNA, 18 bp, Homo sapiens
cagtatttgtaattaaaa

SEQ ID NO: 4388440 - DNA, 14 bp, Homo sapiens
cagtattttcacac

SEQ ID NO: 4388441 - DNA, 11 bp, Homo sapiens
cagtattttcc

SEQ ID NO: 4388442 - DNA, 13 bp, Homo sapiens
cagtatttttaaa

SEQ ID NO: 4388443 - DNA, 15 bp, Homo sapiens
cagtatttttaaagg

SEQ ID NO: 4388444 - DNA, 20 bp, Homo sapiens
cagtatttttgctgcttctg

SEQ ID NO: 4388445 - DNA, 15 bp, Homo sapiens
cagtcaacctgggca

SEQ ID NO: 4388446 - DNA, 22 bp, Homo sapiens
cagtcaacctgggcaaagccta

SEQ ID NO: 4388447 - DNA, 22 bp, Homo sapiens
cagtcaagctgttgaagtctca

SEQ ID NO: 4388448 - DNA, 15 bp, Homo sapiens
cagtcactgcatttg

SEQ ID NO: 4388449 - DNA, 20 bp, Homo sapiens
cagtcactgcatttgcctgc

SEQ ID NO: 4388450 - DNA, 21 bp, Homo sapiens
cagtcactgcatttgcctgct

SEQ ID NO: 4388451 - DNA, 22 bp, Homo sapiens
cagtcactggcccaaccagaac

SEQ ID NO: 4388452 - DNA, 13 bp, Homo sapiens
cagtcagaaggac

SEQ ID NO: 4388453 - DNA, 15 bp, Homo sapiens
cagtcagagtccagt

SEQ ID NO: 4388454 - DNA, 18 bp, Homo sapiens
cagtcagagtccagtgct

SEQ ID NO: 4388455 - DNA, 15 bp, Homo sapiens
cagtcagcagtcatg

SEQ ID NO: 4388456 - DNA, 14 bp, Homo sapiens
cagtcagcctctct

SEQ ID NO: 4388457 - DNA, 17 bp, Homo sapiens
cagtcagcctctctccc

SEQ ID NO: 4388458 - DNA, 22 bp, Homo sapiens
cagtcagcctctctcccagtct

SEQ ID NO: 4388459 - DNA, 14 bp, Homo sapiens
cagtcagggccccc

SEQ ID NO: 4388460 - DNA, 16 bp, Homo sapiens
cagtcagttttgctcc

SEQ ID NO: 4388461 - DNA, 18 bp, Homo sapiens
cagtcataaatactgtca

SEQ ID NO: 4388462 - DNA, 14 bp, Homo sapiens
cagtcatcaggtgt

SEQ ID NO: 4388463 - DNA, 21 bp, Homo sapiens
cagtcatcaggtgtgctcagg

SEQ ID NO: 4388464 - DNA, 12 bp, Homo sapiens
cagtcatggtac

SEQ ID NO: 4388465 - DNA, 19 bp, Homo sapiens
cagtcattaaattactata

SEQ ID NO: 4388466 - DNA, 22 bp, Homo sapiens
cagtcattagactcctcctcca

SEQ ID NO: 4388467 - DNA, 20 bp, Homo sapiens
caggtggctgacccagtccc

SEQ ID NO: 4388468 - DNA, 23 bp, Homo sapiens
caggtggctgacccagtccctgg

SEQ ID NO: 4388469 - DNA, 19 bp, Homo sapiens
caggtggggagactgggct

SEQ ID NO: 4388470 - DNA, 22 bp, Homo sapiens
caggtggggagactgggctgag

SEQ ID NO: 4388471 - DNA, 21 bp, Homo sapiens
caggtggttaccaggcactgg

SEQ ID NO: 4388472 - DNA, 22 bp, Homo sapiens
caggtgtctttaactgtcattg

SEQ ID NO: 4388473 - DNA, 22 bp, Homo sapiens
caggtgttactgtaattcctca

SEQ ID NO: 4388474 - DNA, 23 bp, Homo sapiens
caggttagaacctagaagggcta

SEQ ID NO: 4388475 - DNA, 16 bp, Homo sapiens
caggttaggaaggcag

SEQ ID NO: 4388476 - DNA, 21 bp, Homo sapiens
caggttattgcaataaagtat

SEQ ID NO: 4388477 - DNA, 14 bp, Homo sapiens
caggttcatgaata

SEQ ID NO: 4388478 - DNA, 14 bp, Homo sapiens
caggttcccactta

SEQ ID NO: 4388479 - DNA, 16 bp, Homo sapiens
caggttcccccagcaa

SEQ ID NO: 4388480 - DNA, 18 bp, Homo sapiens
caggttcccccagcaagc

SEQ ID NO: 4388481 - DNA, 23 bp, Homo sapiens
caggttccctcccagaggagcca

SEQ ID NO: 4388482 - DNA, 15 bp, Homo sapiens
caggttgggatggga

SEQ ID NO: 4388483 - DNA, 18 bp, Homo sapiens
caggttttatgtgttctt

SEQ ID NO: 4388484 - DNA, 18 bp, Homo sapiens
caggtttttaagttgtct

SEQ ID NO: 4388485 - DNA, 13 bp, Homo sapiens
caggtttttcctt

SEQ ID NO: 4388486 - DNA, 16 bp, Homo sapiens
cagtaaaccactgaaa

SEQ ID NO: 4388487 - DNA, 21 bp, Homo sapiens
cagtaaaccactgaaaaaata

SEQ ID NO: 4388488 - DNA, 13 bp, Homo sapiens
cagtaaagagaaa

SEQ ID NO: 4388489 - DNA, 12 bp, Homo sapiens
cagtaaagagta

SEQ ID NO: 4388490 - DNA, 17 bp, Homo sapiens
cagtaaatgttacttct

SEQ ID NO: 4388491 - DNA, 18 bp, Homo sapiens
cagtaaggtagaaataga

SEQ ID NO: 4388492 - DNA, 17 bp, Homo sapiens
cagtaagtaaagtggtt

SEQ ID NO: 4388493 - DNA, 22 bp, Homo sapiens
cagtaagtctcataggttaaaa

SEQ ID NO: 4388494 - DNA, 20 bp, Homo sapiens
cagtaatattggcatagaaa

SEQ ID NO: 4388495 - DNA, 11 bp, Homo sapiens
cagtaatgaaa

SEQ ID NO: 4388496 - DNA, 15 bp, Homo sapiens
cagtaatgaaatgtt

SEQ ID NO: 4388497 - DNA, 13 bp, Homo sapiens
cagtaatgttatt

SEQ ID NO: 4388498 - DNA, 20 bp, Homo sapiens
cagtacatttaaattttttg

SEQ ID NO: 4388499 - DNA, 23 bp, Homo sapiens
cagtaccccatggagctgggcta

SEQ ID NO: 4388500 - DNA, 16 bp, Homo sapiens
cagtaccctccattgg

SEQ ID NO: 4388501 - DNA, 20 bp, Homo sapiens
cagtacctagctggctctgt

SEQ ID NO: 4388502 - DNA, 16 bp, Homo sapiens
cagtacctgattgtat

SEQ ID NO: 4388503 - DNA, 20 bp, Homo sapiens
cagtacctgattgtattttt

SEQ ID NO: 4388504 - DNA, 22 bp, Homo sapiens
cagtacgatcaagttgttgact

SEQ ID NO: 4388505 - DNA, 17 bp, Homo sapiens
cagtacgtcccgctgct

SEQ ID NO: 4388506 - DNA, 21 bp, Homo sapiens
cagtacgtcccgctgctgtgc

SEQ ID NO: 4388507 - DNA, 22 bp, Homo sapiens
cagtacgtcccgctgctgtgct

SEQ ID NO: 4388508 - DNA, 15 bp, Homo sapiens
cagtactattcctta

SEQ ID NO: 4388509 - DNA, 18 bp, Homo sapiens
cagtactggttactttca

SEQ ID NO: 4388510 - DNA, 21 bp, Homo sapiens
cagtactggttactttcaaaa

SEQ ID NO: 4388511 - DNA, 23 bp, Homo sapiens
cagtactggttactttcaaaatg

SEQ ID NO: 4388512 - DNA, 13 bp, Homo sapiens
cagtacttgtcat

SEQ ID NO: 4388513 - DNA, 16 bp, Homo sapiens
cagtactttgtgcatt

SEQ ID NO: 4388514 - DNA, 21 bp, Homo sapiens
cagtacttttttaaatatttt

SEQ ID NO: 4388515 - DNA, 14 bp, Homo sapiens
cagtagaaagctaa

SEQ ID NO: 4388516 - DNA, 15 bp, Homo sapiens
cagtagaaagctaaa

SEQ ID NO: 4388517 - DNA, 19 bp, Homo sapiens
cagtagaaagctaaagtga

SEQ ID NO: 4388518 - DNA, 17 bp, Homo sapiens
cagggctggactgaggc

SEQ ID NO: 4388519 - DNA, 18 bp, Homo sapiens
cagggctggactgaggcc

SEQ ID NO: 4388520 - DNA, 15 bp, Homo sapiens
cagggctggcccagc

SEQ ID NO: 4388521 - DNA, 18 bp, Homo sapiens
cagggctggcccagccct

SEQ ID NO: 4388522 - DNA, 23 bp, Homo sapiens
cagggctggcccagccctgctgg

SEQ ID NO: 4388523 - DNA, 12 bp, Homo sapiens
cagggctgggga

SEQ ID NO: 4388524 - DNA, 15 bp, Homo sapiens
cagggctggggacag

SEQ ID NO: 4388525 - DNA, 12 bp, Homo sapiens
cagggctggggt

SEQ ID NO: 4388526 - DNA, 18 bp, Homo sapiens
cagggctggggttgccag

SEQ ID NO: 4388527 - DNA, 14 bp, Homo sapiens
cagggctgtcccag

SEQ ID NO: 4388528 - DNA, 17 bp, Homo sapiens
cagggcttctcctcctc

SEQ ID NO: 4388529 - DNA, 15 bp, Homo sapiens
caggggaacctgcca

SEQ ID NO: 4388530 - DNA, 14 bp, Homo sapiens
caggggaagcagga

SEQ ID NO: 4388531 - DNA, 17 bp, Homo sapiens
caggggaaggccctgag

SEQ ID NO: 4388532 - DNA, 18 bp, Homo sapiens
caggggaaggccctgagg

SEQ ID NO: 4388533 - DNA, 20 bp, Homo sapiens
caggggaattccctccccct

SEQ ID NO: 4388534 - DNA, 21 bp, Homo sapiens
caggggaattccctccccctc

SEQ ID NO: 4388535 - DNA, 23 bp, Homo sapiens
caggggaattccctccccctcct

SEQ ID NO: 4388536 - DNA, 21 bp, Homo sapiens
caggggagacaggagcctagc

SEQ ID NO: 4388537 - DNA, 17 bp, Homo sapiens
caggggagagggtctgg

SEQ ID NO: 4388538 - DNA, 20 bp, Homo sapiens
caggggagagggtctggaga

SEQ ID NO: 4388539 - DNA, 22 bp, Homo sapiens
caggggaggggcgcaccccaca

SEQ ID NO: 4388540 - DNA, 13 bp, Homo sapiens
caggggcaccttc

SEQ ID NO: 4388541 - DNA, 22 bp, Homo sapiens
caggggcagccacaccactgcc

SEQ ID NO: 4388542 - DNA, 18 bp, Homo sapiens
caggggccaacctcaggc

SEQ ID NO: 4388543 - DNA, 19 bp, Homo sapiens
caggggccaacctcaggct

SEQ ID NO: 4388544 - DNA, 18 bp, Homo sapiens
caggggcccctccagctt

SEQ ID NO: 4388545 - DNA, 20 bp, Homo sapiens
caggggcccctccagcttgt

SEQ ID NO: 4388546 - DNA, 21 bp, Homo sapiens
caggggcctctctcctgcctg

SEQ ID NO: 4388547 - DNA, 11 bp, Homo sapiens
caggggctcca

SEQ ID NO: 4388548 - DNA, 13 bp, Homo sapiens
caggggctccagc

SEQ ID NO: 4388549 - DNA, 16 bp, Homo sapiens
cagggggagaatgggt

SEQ ID NO: 4388550 - DNA, 15 bp, Homo sapiens
cagggggcaagagga

SEQ ID NO: 4388551 - DNA, 19 bp, Homo sapiens
cagggggccccgccagggc

SEQ ID NO: 4388552 - DNA, 21 bp, Homo sapiens
cagggggccccgccagggctg

SEQ ID NO: 4388553 - DNA, 13 bp, Homo sapiens
cagggggccctgc

SEQ ID NO: 4388554 - DNA, 14 bp, Homo sapiens
cagggggccctgcc

SEQ ID NO: 4388555 - DNA, 17 bp, Homo sapiens
cagggggccctgcccca

SEQ ID NO: 4388556 - DNA, 20 bp, Homo sapiens
cagggggccctgccccaccc

SEQ ID NO: 4388557 - DNA, 13 bp, Homo sapiens
caggggtcagtgc

SEQ ID NO: 4388558 - DNA, 14 bp, Homo sapiens
caggggtcagtgca

SEQ ID NO: 4388559 - DNA, 16 bp, Homo sapiens
caggggtccaggcccc

SEQ ID NO: 4388560 - DNA, 18 bp, Homo sapiens
caggggtcccagccaccc

SEQ ID NO: 4388561 - DNA, 14 bp, Homo sapiens
caggggtcccccct

SEQ ID NO: 4388562 - DNA, 16 bp, Homo sapiens
caggggtcccccctca

SEQ ID NO: 4388563 - DNA, 15 bp, Homo sapiens
caggggtgctcctgt

SEQ ID NO: 4388564 - DNA, 14 bp, Homo sapiens
cagggtacctcaag

SEQ ID NO: 4388565 - DNA, 17 bp, Homo sapiens
cagggtacctcaagccc

SEQ ID NO: 4388566 - DNA, 16 bp, Homo sapiens
cagctagttaataatt

SEQ ID NO: 4388567 - DNA, 21 bp, Homo sapiens
cagctagttggggagctaagg

SEQ ID NO: 4388568 - DNA, 15 bp, Homo sapiens
cagctatatatttcc

SEQ ID NO: 4388569 - DNA, 23 bp, Homo sapiens
cagctatgggagccccagggtct

SEQ ID NO: 4388570 - DNA, 12 bp, Homo sapiens
cagctcaccccc

SEQ ID NO: 4388571 - DNA, 18 bp, Homo sapiens
cagctcaccccccacact

SEQ ID NO: 4388572 - DNA, 21 bp, Homo sapiens
cagctcatccatgcctcagaa

SEQ ID NO: 4388573 - DNA, 22 bp, Homo sapiens
cagctcatccatgcctcagaag

SEQ ID NO: 4388574 - DNA, 17 bp, Homo sapiens
cagctcatgcccccttt

SEQ ID NO: 4388575 - DNA, 16 bp, Homo sapiens
cagctcatttcagttt

SEQ ID NO: 4388576 - DNA, 16 bp, Homo sapiens
cagctcccctcggaga

SEQ ID NO: 4388577 - DNA, 21 bp, Homo sapiens
cagctcccctcggagaagagc

SEQ ID NO: 4388578 - DNA, 21 bp, Homo sapiens
cagctcccctcttttgtaagt

SEQ ID NO: 4388579 - DNA, 14 bp, Homo sapiens
cagctccctggctt

SEQ ID NO: 4388580 - DNA, 16 bp, Homo sapiens
cagctccctggcttct

SEQ ID NO: 4388581 - DNA, 20 bp, Homo sapiens
cagctccctggcttctgtgg

SEQ ID NO: 4388582 - DNA, 16 bp, Homo sapiens
cagctccctttctcag

SEQ ID NO: 4388583 - DNA, 18 bp, Homo sapiens
cagctccctttctcagga

SEQ ID NO: 4388584 - DNA, 19 bp, Homo sapiens
cagctcctggaccaggccc

SEQ ID NO: 4388585 - DNA, 16 bp, Homo sapiens
cagctctaggctgttc

SEQ ID NO: 4388586 - DNA, 17 bp, Homo sapiens
cagctctaggctgttct

SEQ ID NO: 4388587 - DNA, 15 bp, Homo sapiens
cagctctccctctgg

SEQ ID NO: 4388588 - DNA, 18 bp, Homo sapiens
cagctctccctctggccc

SEQ ID NO: 4388589 - DNA, 17 bp, Homo sapiens
cagctctgagccagatt

SEQ ID NO: 4388590 - DNA, 18 bp, Homo sapiens
cagctctgatctgaggct

SEQ ID NO: 4388591 - DNA, 22 bp, Homo sapiens
cagctctgatctgaggctaaga

SEQ ID NO: 4388592 - DNA, 13 bp, Homo sapiens
cagctctgccccc

SEQ ID NO: 4388593 - DNA, 15 bp, Homo sapiens
cagctctgcccccgc

SEQ ID NO: 4388594 - DNA, 16 bp, Homo sapiens
cagctctgccttgcac

SEQ ID NO: 4388595 - DNA, 19 bp, Homo sapiens
cagctctgccttgcactgt

SEQ ID NO: 4388596 - DNA, 17 bp, Homo sapiens
cagctctggctctgcct

SEQ ID NO: 4388597 - DNA, 20 bp, Homo sapiens
cagctctggctctgcctcag

SEQ ID NO: 4388598 - DNA, 22 bp, Homo sapiens
cagctctggggcagaggaagcc

SEQ ID NO: 4388599 - DNA, 14 bp, Homo sapiens
cagctctgttgaat

SEQ ID NO: 4388600 - DNA, 15 bp, Homo sapiens
cagctcttgaagtat

SEQ ID NO: 4388601 - DNA, 20 bp, Homo sapiens
cagctgaagtcaaaatatgt

SEQ ID NO: 4388602 - DNA, 22 bp, Homo sapiens
cagctgaagtcaaaatatgtaa

SEQ ID NO: 4388603 - DNA, 18 bp, Homo sapiens
cagctgactaaacttttt

SEQ ID NO: 4388604 - DNA, 15 bp, Homo sapiens
cagctgagagccctg

SEQ ID NO: 4388605 - DNA, 16 bp, Homo sapiens
cagctgagagccctgc

SEQ ID NO: 4388606 - DNA, 14 bp, Homo sapiens
cagctgagcctgag

SEQ ID NO: 4388607 - DNA, 11 bp, Homo sapiens
cagctgcaaag

SEQ ID NO: 4388608 - DNA, 16 bp, Homo sapiens
cagctgcaaagtgttt

SEQ ID NO: 4388609 - DNA, 12 bp, Homo sapiens
cagctgccacct

SEQ ID NO: 4388610 - DNA, 19 bp, Homo sapiens
cagctgccccggcccctcc

SEQ ID NO: 4388611 - DNA, 15 bp, Homo sapiens
cagctgcccttgcag

SEQ ID NO: 4388612 - DNA, 14 bp, Homo sapiens
cagctgcctcctgc

SEQ ID NO: 4388613 - DNA, 21 bp, Homo sapiens
cagctgcctcctgcgccctgt

SEQ ID NO: 4388614 - DNA, 12 bp, Homo sapiens
cagctgcctctg

SEQ ID NO: 4388615 - DNA, 15 bp, Homo sapiens
cagctgcctctgctc

SEQ ID NO: 4388616 - DNA, 16 bp, Homo sapiens
cagctgcctctgctcc

SEQ ID NO: 4388617 - DNA, 16 bp, Homo sapiens
cagctgccttagcttc

SEQ ID NO: 4388618 - DNA, 22 bp, Homo sapiens
cagctgccttagcttcaggaac

SEQ ID NO: 4388619 - DNA, 20 bp, Homo sapiens
cagctgcctttcgtgatctt

SEQ ID NO: 4388620 - DNA, 19 bp, Homo sapiens
cagctgcgcttgcttttct

SEQ ID NO: 4388621 - DNA, 19 bp, Homo sapiens
cagctgcggccaggcctgc

SEQ ID NO: 4388622 - DNA, 14 bp, Homo sapiens
cagctgctgtctga

SEQ ID NO: 4388623 - DNA, 14 bp, Homo sapiens
cagctgctgttctc

SEQ ID NO: 4388624 - DNA, 22 bp, Homo sapiens
cagctggaggaatacattttat

SEQ ID NO: 4388625 - DNA, 20 bp, Homo sapiens
cagctgggaagcccttttta

SEQ ID NO: 4388626 - DNA, 13 bp, Homo sapiens
cagctgggagcac

SEQ ID NO: 4388627 - DNA, 16 bp, Homo sapiens
cagctgggagcactgg

SEQ ID NO: 4388628 - DNA, 16 bp, Homo sapiens
cagctggggccagagg

SEQ ID NO: 4388629 - DNA, 23 bp, Homo sapiens
cagctggggccggttttcctcag

SEQ ID NO: 4388630 - DNA, 20 bp, Homo sapiens
cagctggtgcaaattcagaa

SEQ ID NO: 4388631 - DNA, 17 bp, Homo sapiens
cagctggttcagtactg

SEQ ID NO: 4388632 - DNA, 14 bp, Homo sapiens
cagctgtacaaatc

SEQ ID NO: 4388633 - DNA, 15 bp, Homo sapiens
cagctgtctcccacg

SEQ ID NO: 4388634 - DNA, 13 bp, Homo sapiens
cagctgtgcactt

SEQ ID NO: 4388635 - DNA, 20 bp, Homo sapiens
cagctgtgccgggaggcagc

SEQ ID NO: 4388636 - DNA, 16 bp, Homo sapiens
cagctgtgctgtggag

SEQ ID NO: 4388637 - DNA, 12 bp, Homo sapiens
cagctgtggcag

SEQ ID NO: 4388638 - DNA, 21 bp, Homo sapiens
cagctgtgggcggctcctggt

SEQ ID NO: 4388639 - DNA, 13 bp, Homo sapiens
cagcttaaaccca

SEQ ID NO: 4388640 - DNA, 21 bp, Homo sapiens
cagcttaaacccatacaatgt

SEQ ID NO: 4388641 - DNA, 19 bp, Homo sapiens
cagcttaagtccagctcat

SEQ ID NO: 4388642 - DNA, 14 bp, Homo sapiens
cagcttagatttca

SEQ ID NO: 4388643 - DNA, 15 bp, Homo sapiens
cagcttagatttcat

SEQ ID NO: 4388644 - DNA, 16 bp, Homo sapiens
cagcttattcacaaga

SEQ ID NO: 4388645 - DNA, 13 bp, Homo sapiens
cagcttcacccac

SEQ ID NO: 4388646 - DNA, 18 bp, Homo sapiens
cagcttcacccaccaggc

SEQ ID NO: 4388647 - DNA, 22 bp, Homo sapiens
cagcttcacccaccaggccagc

SEQ ID NO: 4388648 - DNA, 13 bp, Homo sapiens
cagcttcagtgat

SEQ ID NO: 4388649 - DNA, 18 bp, Homo sapiens
cagcttcctgtctgttta

SEQ ID NO: 4388650 - DNA, 13 bp, Homo sapiens
cagcttcgaggac

SEQ ID NO: 4388651 - DNA, 17 bp, Homo sapiens
cagcttcgaggacagga

SEQ ID NO: 4388652 - DNA, 22 bp, Homo sapiens
cagcttcgaggacaggaaaggc

SEQ ID NO: 4388653 - DNA, 20 bp, Homo sapiens
cagcttcggagggcccctgc

SEQ ID NO: 4388654 - DNA, 23 bp, Homo sapiens
cagcttcggagggcccctgcgtg

SEQ ID NO: 4388655 - DNA, 22 bp, Homo sapiens
cagcttcgtttattttcaagaa

SEQ ID NO: 4388656 - DNA, 18 bp, Homo sapiens
cagcttctactcctgcct

SEQ ID NO: 4388657 - DNA, 13 bp, Homo sapiens
cagcttctcccaa

SEQ ID NO: 4388658 - DNA, 22 bp, Homo sapiens
cagcttgagaaggtcactactg

SEQ ID NO: 4388659 - DNA, 13 bp, Homo sapiens
cagcttgccaggg

SEQ ID NO: 4388660 - DNA, 14 bp, Homo sapiens
cagcttgcgaataa

SEQ ID NO: 4388661 - DNA, 23 bp, Homo sapiens
cagcttgctcttcagtgggagaa

SEQ ID NO: 4388662 - DNA, 15 bp, Homo sapiens
cagcttgtggagccc

SEQ ID NO: 4388663 - DNA, 20 bp, Homo sapiens
cagctttcctcaaaaagcag

SEQ ID NO: 4388664 - DNA, 12 bp, Homo sapiens
cagctttgataa

SEQ ID NO: 4388665 - DNA, 20 bp, Homo sapiens
cagctttgataattgtgtac

SEQ ID NO: 4388666 - DNA, 18 bp, Homo sapiens
cagctttgtatgtttatg

SEQ ID NO: 4388667 - DNA, 14 bp, Homo sapiens
cagcttttgttcta

SEQ ID NO: 4388668 - DNA, 16 bp, Homo sapiens
cagcttttgttctaga

SEQ ID NO: 4388669 - DNA, 21 bp, Homo sapiens
cagcttttgttctagacttcc

SEQ ID NO: 4388670 - DNA, 16 bp, Homo sapiens
cagctttttattccct

SEQ ID NO: 4388671 - DNA, 13 bp, Homo sapiens
caggaaaatgtat

SEQ ID NO: 4388672 - DNA, 22 bp, Homo sapiens
caggaaactccacatctgcctt

SEQ ID NO: 4388673 - DNA, 19 bp, Homo sapiens
caggaaactcctgtgacca

SEQ ID NO: 4388674 - DNA, 13 bp, Homo sapiens
caggaaagaatag

SEQ ID NO: 4388675 - DNA, 11 bp, Homo sapiens
caggaaagagc

SEQ ID NO: 4388676 - DNA, 15 bp, Homo sapiens
caggaaagccctccc

SEQ ID NO: 4388677 - DNA, 19 bp, Homo sapiens
caggaaaggccccaatctt

SEQ ID NO: 4388678 - DNA, 23 bp, Homo sapiens
caggaaatcaaatatgcaaagca

SEQ ID NO: 4388679 - DNA, 13 bp, Homo sapiens
caggaaatgaaaa

SEQ ID NO: 4388680 - DNA, 23 bp, Homo sapiens
caggaacagctatgggagcccca

SEQ ID NO: 4388681 - DNA, 18 bp, Homo sapiens
caggaaccgaggcaggga

SEQ ID NO: 4388682 - DNA, 18 bp, Homo sapiens
caggaacctcgagtactg

SEQ ID NO: 4388683 - DNA, 15 bp, Homo sapiens
caggaactgggctgg

SEQ ID NO: 4388684 - DNA, 15 bp, Homo sapiens
caggaagatgggagg

SEQ ID NO: 4388685 - DNA, 14 bp, Homo sapiens
caggaagcacccca

SEQ ID NO: 4388686 - DNA, 15 bp, Homo sapiens
caggaagcaccccat

SEQ ID NO: 4388687 - DNA, 15 bp, Homo sapiens
cagccagcagagggg

SEQ ID NO: 4388688 - DNA, 19 bp, Homo sapiens
cagccagcagcagcaacct

SEQ ID NO: 4388689 - DNA, 15 bp, Homo sapiens
cagccagcccagccc

SEQ ID NO: 4388690 - DNA, 17 bp, Homo sapiens
cagccagcccagcccag

SEQ ID NO: 4388691 - DNA, 23 bp, Homo sapiens
cagccagcccatggcccccaata

SEQ ID NO: 4388692 - DNA, 22 bp, Homo sapiens
cagccagcccttccctggcccc

SEQ ID NO: 4388693 - DNA, 23 bp, Homo sapiens
cagccagccgccctgggctgtct

SEQ ID NO: 4388694 - DNA, 14 bp, Homo sapiens
cagccagcctcaga

SEQ ID NO: 4388695 - DNA, 22 bp, Homo sapiens
cagccagcctcagaaggcccca

SEQ ID NO: 4388696 - DNA, 16 bp, Homo sapiens
cagccagcgcctccct

SEQ ID NO: 4388697 - DNA, 21 bp, Homo sapiens
cagccaggagtgcccccggga

SEQ ID NO: 4388698 - DNA, 16 bp, Homo sapiens
cagccaggccaacagc

SEQ ID NO: 4388699 - DNA, 23 bp, Homo sapiens
cagccaggccaacagcacctccc

SEQ ID NO: 4388700 - DNA, 22 bp, Homo sapiens
cagccaggctctgtgctgaccc

SEQ ID NO: 4388701 - DNA, 13 bp, Homo sapiens
cagccaggctgcc

SEQ ID NO: 4388702 - DNA, 11 bp, Homo sapiens
cagccagggct

SEQ ID NO: 4388703 - DNA, 15 bp, Homo sapiens
cagccaggtggcacc

SEQ ID NO: 4388704 - DNA, 17 bp, Homo sapiens
cagccaggtggcacctg

SEQ ID NO: 4388705 - DNA, 20 bp, Homo sapiens
cagccaggtggcacctgcag

SEQ ID NO: 4388706 - DNA, 18 bp, Homo sapiens
cagccaggtttagcggca

SEQ ID NO: 4388707 - DNA, 22 bp, Homo sapiens
cagccagtgacctttgacctcg

SEQ ID NO: 4388708 - DNA, 20 bp, Homo sapiens
cagccagttttactgtgatt

SEQ ID NO: 4388709 - DNA, 16 bp, Homo sapiens
cagccataggtgcagt

SEQ ID NO: 4388710 - DNA, 23 bp, Homo sapiens
cagccatccagggggcaagagga

SEQ ID NO: 4388711 - DNA, 17 bp, Homo sapiens
cagccatcctccctcca

SEQ ID NO: 4388712 - DNA, 22 bp, Homo sapiens
cagccatttattttttaaaaag

SEQ ID NO: 4388713 - DNA, 21 bp, Homo sapiens
cagcccaagaggactgagact

SEQ ID NO: 4388714 - DNA, 13 bp, Homo sapiens
cagcccacagagc

SEQ ID NO: 4388715 - DNA, 22 bp, Homo sapiens
cagcccaccagacgtcaggccc

SEQ ID NO: 4388716 - DNA, 22 bp, Homo sapiens
cagcccaccccctttgactctg

SEQ ID NO: 4388717 - DNA, 13 bp, Homo sapiens
cagcccaccctcc

SEQ ID NO: 4388718 - DNA, 24 bp, Homo sapiens
cagcccaccctcctgtcttcccag

SEQ ID NO: 4388719 - DNA, 19 bp, Homo sapiens
cagcccagagccacctgga

SEQ ID NO: 4388720 - DNA, 13 bp, Homo sapiens
cagcccagccagg

SEQ ID NO: 4388721 - DNA, 15 bp, Homo sapiens
cagcccagccaggcc

SEQ ID NO: 4388722 - DNA, 22 bp, Homo sapiens
cagcccaggatactggcacaga

SEQ ID NO: 4388723 - DNA, 15 bp, Homo sapiens
cagcccatgcccacc

SEQ ID NO: 4388724 - DNA, 19 bp, Homo sapiens
cagcccatgcccacctgcc

SEQ ID NO: 4388725 - DNA, 15 bp, Homo sapiens
cagcccatggccccc

SEQ ID NO: 4388726 - DNA, 21 bp, Homo sapiens
cagcccatggcccccaataaa

SEQ ID NO: 4388727 - DNA, 22 bp, Homo sapiens
cagcccattctctctcctgtcc

SEQ ID NO: 4388728 - DNA, 15 bp, Homo sapiens
cagcccattggccga

SEQ ID NO: 4388729 - DNA, 18 bp, Homo sapiens
cagcccattggccgagct

SEQ ID NO: 4388730 - DNA, 22 bp, Homo sapiens
cagcccattggccgagctcctg

SEQ ID NO: 4388731 - DNA, 23 bp, Homo sapiens
cagcccattggccgagctcctgg

SEQ ID NO: 4388732 - DNA, 11 bp, Homo sapiens
cagccccaccc

SEQ ID NO: 4388733 - DNA, 13 bp, Homo sapiens
cagccccacccag

SEQ ID NO: 4388734 - DNA, 13 bp, Homo sapiens
cagccccagccca

SEQ ID NO: 4388735 - DNA, 13 bp, Homo sapiens
cagccccaggaga

SEQ ID NO: 4388736 - DNA, 19 bp, Homo sapiens
cagccccaggccagctgcg

SEQ ID NO: 4388737 - DNA, 21 bp, Homo sapiens
cagccccatcagaacctgagc

SEQ ID NO: 4388738 - DNA, 22 bp, Homo sapiens
cagccccatcagaacctgagct

SEQ ID NO: 4388739 - DNA, 20 bp, Homo sapiens
cagcccccactgcacccctg

SEQ ID NO: 4388740 - DNA, 14 bp, Homo sapiens
cagccccccagcac

SEQ ID NO: 4388741 - DNA, 15 bp, Homo sapiens
cagcccccgccccag

SEQ ID NO: 4388742 - DNA, 16 bp, Homo sapiens
cagcccccgccccaga

SEQ ID NO: 4388743 - DNA, 22 bp, Homo sapiens
cagcccccgggccgctggctgg

SEQ ID NO: 4388744 - DNA, 14 bp, Homo sapiens
cagccccctcccac

SEQ ID NO: 4388745 - DNA, 21 bp, Homo sapiens
cagccccctcccaccgctgcc

SEQ ID NO: 4388746 - DNA, 21 bp, Homo sapiens
cagccccctttgggcccaggg

SEQ ID NO: 4388747 - DNA, 18 bp, Homo sapiens
cagccccgactccagcca

SEQ ID NO: 4388748 - DNA, 24 bp, Homo sapiens
cagccccgcgtggaactcgtgtct

SEQ ID NO: 4388749 - DNA, 17 bp, Homo sapiens
cagccccggcaagccac

SEQ ID NO: 4388750 - DNA, 15 bp, Homo sapiens
cagccccggccctgg

SEQ ID NO: 4388751 - DNA, 16 bp, Homo sapiens
cagccccggccctggg

SEQ ID NO: 4388752 - DNA, 19 bp, Homo sapiens
cagccccggccctgggctc

SEQ ID NO: 4388753 - DNA, 21 bp, Homo sapiens
cagccccggggccccctggtc

SEQ ID NO: 4388754 - DNA, 19 bp, Homo sapiens
cagccccgtggggttcctc

SEQ ID NO: 4388755 - DNA, 18 bp, Homo sapiens
cagccccgttttggggac

SEQ ID NO: 4388756 - DNA, 17 bp, Homo sapiens
cagcccctccccagact

SEQ ID NO: 4388757 - DNA, 19 bp, Homo sapiens
cagcccctccccagactct

SEQ ID NO: 4388758 - DNA, 12 bp, Homo sapiens
cagcccctcctc

SEQ ID NO: 4388759 - DNA, 14 bp, Homo sapiens
cagcccctcctccc

SEQ ID NO: 4388760 - DNA, 23 bp, Homo sapiens
cagcccctcctccctcaaaccaa

SEQ ID NO: 4388761 - DNA, 19 bp, Homo sapiens
cagcccctcctccctcaga

SEQ ID NO: 4388762 - DNA, 20 bp, Homo sapiens
cagcccctcctccctcagac

SEQ ID NO: 4388763 - DNA, 21 bp, Homo sapiens
cagcccctcctccctcagacc

SEQ ID NO: 4388764 - DNA, 13 bp, Homo sapiens
cagcccctcctct

SEQ ID NO: 4388765 - DNA, 15 bp, Homo sapiens
cagcccctcctctgc

SEQ ID NO: 4388766 - DNA, 21 bp, Homo sapiens
cagcccctcctctgccacctc

SEQ ID NO: 4388767 - DNA, 23 bp, Homo sapiens
cagcccctcctctgccacctccc

SEQ ID NO: 4388768 - DNA, 12 bp, Homo sapiens
cagcccctgaga

SEQ ID NO: 4388769 - DNA, 17 bp, Homo sapiens
cagcccctgagagcctg

SEQ ID NO: 4388770 - DNA, 11 bp, Homo sapiens
cagcccctgca

SEQ ID NO: 4388771 - DNA, 12 bp, Homo sapiens
cagcccctgcag

SEQ ID NO: 4388772 - DNA, 13 bp, Homo sapiens
cagcccctgcaga

SEQ ID NO: 4388773 - DNA, 14 bp, Homo sapiens
cagcccctgcagat

SEQ ID NO: 4388774 - DNA, 17 bp, Homo sapiens
cagcccctgcagattct

SEQ ID NO: 4388775 - DNA, 14 bp, Homo sapiens
cagcccctggagcc

SEQ ID NO: 4388776 - DNA, 22 bp, Homo sapiens
cagcccctggggcccagcccct

SEQ ID NO: 4388777 - DNA, 21 bp, Homo sapiens
cagcccctgtttactggttct

SEQ ID NO: 4388778 - DNA, 15 bp, Homo sapiens
cagcccgcacacctg

SEQ ID NO: 4388779 - DNA, 22 bp, Homo sapiens
cagcccgcctgccgtgcatggc

SEQ ID NO: 4388780 - DNA, 16 bp, Homo sapiens
cagccctaaacatcat

SEQ ID NO: 4388781 - DNA, 23 bp, Homo sapiens
cagccctaagtggctgccttctt

SEQ ID NO: 4388782 - DNA, 12 bp, Homo sapiens
cagccctagagc

SEQ ID NO: 4388783 - DNA, 21 bp, Homo sapiens
cagccctagagcctgcctgga

SEQ ID NO: 4388784 - DNA, 22 bp, Homo sapiens
cagccctagagcctgcctggag

SEQ ID NO: 4388785 - DNA, 17 bp, Homo sapiens
cagccctagcggctgct

SEQ ID NO: 4388786 - DNA, 23 bp, Homo sapiens
cagccctagcggctgctccttca

SEQ ID NO: 4388787 - DNA, 15 bp, Homo sapiens
cagccctcacccctg

SEQ ID NO: 4388788 - DNA, 18 bp, Homo sapiens
cagccctcacccctggtt

SEQ ID NO: 4388789 - DNA, 13 bp, Homo sapiens
cagccctcatccc

SEQ ID NO: 4388790 - DNA, 15 bp, Homo sapiens
cagccctccctgtcc

SEQ ID NO: 4388791 - DNA, 18 bp, Homo sapiens
cagccctccctgtcctcc

SEQ ID NO: 4388792 - DNA, 22 bp, Homo sapiens
cagccctccctgtcctcctcgg

SEQ ID NO: 4388793 - DNA, 13 bp, Homo sapiens
cagccctcctcac

SEQ ID NO: 4388794 - DNA, 14 bp, Homo sapiens
cagccctcctcacc

SEQ ID NO: 4388795 - DNA, 14 bp, Homo sapiens
cagccctcggcctc

SEQ ID NO: 4388796 - DNA, 15 bp, Homo sapiens
cagccctcggcctcc

SEQ ID NO: 4388797 - DNA, 17 bp, Homo sapiens
cagccctctctctcact

SEQ ID NO: 4388798 - DNA, 12 bp, Homo sapiens
cagccctgaggt

SEQ ID NO: 4388799 - DNA, 17 bp, Homo sapiens
cagccctgattgtgcca

SEQ ID NO: 4388800 - DNA, 21 bp, Homo sapiens
cagccctgattgtgccagtgc

SEQ ID NO: 4388801 - DNA, 13 bp, Homo sapiens
cagccctgcacga

SEQ ID NO: 4388802 - DNA, 21 bp, Homo sapiens
cagccctgctagacgcaccgc

SEQ ID NO: 4388803 - DNA, 22 bp, Homo sapiens
cagccctgctagacgcaccgcc

SEQ ID NO: 4388804 - DNA, 15 bp, Homo sapiens
cagccctgctccctg

SEQ ID NO: 4388805 - DNA, 16 bp, Homo sapiens
cagccctgctccctgc

SEQ ID NO: 4388806 - DNA, 21 bp, Homo sapiens
cagccctgctccctgcctcct

SEQ ID NO: 4388807 - DNA, 14 bp, Homo sapiens
cagccctgctggcc

SEQ ID NO: 4388808 - DNA, 16 bp, Homo sapiens
cagccctgctggccgc

SEQ ID NO: 4388809 - DNA, 23 bp, Homo sapiens
cagccctgctggccgcctcaccc

SEQ ID NO: 4388810 - DNA, 14 bp, Homo sapiens
cagccctggcccag

SEQ ID NO: 4388811 - DNA, 11 bp, Homo sapiens
cagccctgggc

SEQ ID NO: 4388812 - DNA, 17 bp, Homo sapiens
cagccctgggccccacc

SEQ ID NO: 4388813 - DNA, 21 bp, Homo sapiens
cagccctgggccccaccacct

SEQ ID NO: 4388814 - DNA, 13 bp, Homo sapiens
cagccctggtctc

SEQ ID NO: 4388815 - DNA, 16 bp, Homo sapiens
cagccctggtctcagc

SEQ ID NO: 4388816 - DNA, 19 bp, Homo sapiens
cagccctggtctcagcagc

SEQ ID NO: 4388817 - DNA, 23 bp, Homo sapiens
cagcccttatgcggttaattttg

SEQ ID NO: 4388818 - DNA, 12 bp, Homo sapiens
cagcccttccct

SEQ ID NO: 4388819 - DNA, 17 bp, Homo sapiens
cagccgcaggaaggcag

SEQ ID NO: 4388820 - DNA, 18 bp, Homo sapiens
cagccgccattgccacca

SEQ ID NO: 4388821 - DNA, 19 bp, Homo sapiens
cagccgccattgccaccag

SEQ ID NO: 4388822 - DNA, 23 bp, Homo sapiens
cagccgcccacccccacccccag

SEQ ID NO: 4388823 - DNA, 14 bp, Homo sapiens
cagccgccctgggc

SEQ ID NO: 4388824 - DNA, 18 bp, Homo sapiens
cagccgcgggccaggagg

SEQ ID NO: 4388825 - DNA, 20 bp, Homo sapiens
cagccgctgagcgaggagat

SEQ ID NO: 4388826 - DNA, 21 bp, Homo sapiens
cagccggtacctgggaagggg

SEQ ID NO: 4388827 - DNA, 23 bp, Homo sapiens
cagccggttctgctagagcagac

SEQ ID NO: 4388828 - DNA, 14 bp, Homo sapiens
cagccgtattttac

SEQ ID NO: 4388829 - DNA, 15 bp, Homo sapiens
cagccgtattttaca

SEQ ID NO: 4388830 - DNA, 20 bp, Homo sapiens
cagccgtcccgcgttcaaga

SEQ ID NO: 4388831 - DNA, 22 bp, Homo sapiens
cagccgtcccgcgttcaagact

SEQ ID NO: 4388832 - DNA, 21 bp, Homo sapiens
cagccgtttgaatatatttta

SEQ ID NO: 4388833 - DNA, 16 bp, Homo sapiens
cagcctaagaaacact

SEQ ID NO: 4388834 - DNA, 21 bp, Homo sapiens
cagcctacactattctagcag

SEQ ID NO: 4388835 - DNA, 14 bp, Homo sapiens
cagcctacctctcc

SEQ ID NO: 4388836 - DNA, 15 bp, Homo sapiens
cagcctacctctcca

SEQ ID NO: 4388837 - DNA, 21 bp, Homo sapiens
cagcctcagaaggccccagag

SEQ ID NO: 4388838 - DNA, 19 bp, Homo sapiens
cagcctcatactcctgggc

SEQ ID NO: 4388839 - DNA, 20 bp, Homo sapiens
cagcctcatactcctgggct

SEQ ID NO: 4388840 - DNA, 21 bp, Homo sapiens
cagcctcatactcctgggctc

SEQ ID NO: 4388841 - DNA, 22 bp, Homo sapiens
cagcctcatactcctgggctca

SEQ ID NO: 4388842 - DNA, 12 bp, Homo sapiens
cagcctccagcc

SEQ ID NO: 4388843 - DNA, 13 bp, Homo sapiens
cagcctccagcct

SEQ ID NO: 4388844 - DNA, 16 bp, Homo sapiens
cagcctccagcctctg

SEQ ID NO: 4388845 - DNA, 15 bp, Homo sapiens
cagcctccagggccc

SEQ ID NO: 4388846 - DNA, 18 bp, Homo sapiens
cagcctccatcctacccc

SEQ ID NO: 4388847 - DNA, 19 bp, Homo sapiens
cagcctcccatagctggga

SEQ ID NO: 4388848 - DNA, 20 bp, Homo sapiens
cagcctcccatagctgggac

SEQ ID NO: 4388849 - DNA, 11 bp, Homo sapiens
cagcctcccct

SEQ ID NO: 4388850 - DNA, 21 bp, Homo sapiens
cagcctcccctcccctgggga

SEQ ID NO: 4388851 - DNA, 19 bp, Homo sapiens
cagcctcccctgccagggc

SEQ ID NO: 4388852 - DNA, 20 bp, Homo sapiens
cagcctcccctgccagggca

SEQ ID NO: 4388853 - DNA, 19 bp, Homo sapiens
cagcctcccgagtagctgg

SEQ ID NO: 4388854 - DNA, 17 bp, Homo sapiens
cagcctccgggcgtgtg

SEQ ID NO: 4388855 - DNA, 23 bp, Homo sapiens
cagcctccgggcgtgtgaagaac

SEQ ID NO: 4388856 - DNA, 22 bp, Homo sapiens
cagcctcctctggacggcaggc

SEQ ID NO: 4388857 - DNA, 17 bp, Homo sapiens
cagcctcctctgtctgc

SEQ ID NO: 4388858 - DNA, 23 bp, Homo sapiens
cagcctcctgagtagctgggact

SEQ ID NO: 4388859 - DNA, 18 bp, Homo sapiens
cagcctcgttggaagagg

SEQ ID NO: 4388860 - DNA, 18 bp, Homo sapiens
cagcctctccgactctgc

SEQ ID NO: 4388861 - DNA, 22 bp, Homo sapiens
cagcctctctcccagtctaccc

SEQ ID NO: 4388862 - DNA, 13 bp, Homo sapiens
cagcctctctctt

SEQ ID NO: 4388863 - DNA, 11 bp, Homo sapiens
cagcctctgcc

SEQ ID NO: 4388864 - DNA, 12 bp, Homo sapiens
cagcctctgccg

SEQ ID NO: 4388865 - DNA, 13 bp, Homo sapiens
cagcctctgccgc

SEQ ID NO: 4388866 - DNA, 15 bp, Homo sapiens
cagcctctgccgctg

SEQ ID NO: 4388867 - DNA, 13 bp, Homo sapiens
cagcctctggaca

SEQ ID NO: 4388868 - DNA, 14 bp, Homo sapiens
cagcctctgttccc

SEQ ID NO: 4388869 - DNA, 22 bp, Homo sapiens
cagcctgagcgacagtgagact

SEQ ID NO: 4388870 - DNA, 14 bp, Homo sapiens
cagcctgctctccc

SEQ ID NO: 4388871 - DNA, 15 bp, Homo sapiens
cagcctgctctccct

SEQ ID NO: 4388872 - DNA, 20 bp, Homo sapiens
cagcctgctttcctgcagca

SEQ ID NO: 4388873 - DNA, 12 bp, Homo sapiens
cagcctggatgc

SEQ ID NO: 4388874 - DNA, 21 bp, Homo sapiens
cagcctggatgccatccaagt

SEQ ID NO: 4388875 - DNA, 22 bp, Homo sapiens
cagcctggctctgccccctccc

SEQ ID NO: 4388876 - DNA, 18 bp, Homo sapiens
cagcctgggagcccagag

SEQ ID NO: 4388877 - DNA, 19 bp, Homo sapiens
cagcctgggagcccagagg

SEQ ID NO: 4388878 - DNA, 17 bp, Homo sapiens
cagcctgggcagccagg

SEQ ID NO: 4388879 - DNA, 20 bp, Homo sapiens
cagcctgggtcacagagtga

SEQ ID NO: 4388880 - DNA, 17 bp, Homo sapiens
cagcctgtatcttgggg

SEQ ID NO: 4388881 - DNA, 19 bp, Homo sapiens
cagcctgtggcatctttgc

SEQ ID NO: 4388882 - DNA, 18 bp, Homo sapiens
cagcctgtggcggtgcct

SEQ ID NO: 4388883 - DNA, 14 bp, Homo sapiens
cagccttaatattt

SEQ ID NO: 4388884 - DNA, 17 bp, Homo sapiens
cagccttagatgcctcg

SEQ ID NO: 4388885 - DNA, 23 bp, Homo sapiens
cagccttctccatatctccatgg

SEQ ID NO: 4388886 - DNA, 23 bp, Homo sapiens
cagccttgctacttgaaggtaca

SEQ ID NO: 4388887 - DNA, 17 bp, Homo sapiens
cagccttgctctcttca

SEQ ID NO: 4388888 - DNA, 20 bp, Homo sapiens
cagccttgctctcttcaata

SEQ ID NO: 4388889 - DNA, 20 bp, Homo sapiens
cagcctttttgtttcaatga

SEQ ID NO: 4388890 - DNA, 21 bp, Homo sapiens
cagcgaagccttaactttaaa

SEQ ID NO: 4388891 - DNA, 18 bp, Homo sapiens
cagcgataagctttcaat

SEQ ID NO: 4388892 - DNA, 18 bp, Homo sapiens
cagcgatggtgctgccca

SEQ ID NO: 4388893 - DNA, 23 bp, Homo sapiens
cagcgccaaaacaagccaaagag

SEQ ID NO: 4388894 - DNA, 14 bp, Homo sapiens
cagcgccaagtggc

SEQ ID NO: 4388895 - DNA, 17 bp, Homo sapiens
cagcgccaagtggccac

SEQ ID NO: 4388896 - DNA, 13 bp, Homo sapiens
cagcgccccacca

SEQ ID NO: 4388897 - DNA, 12 bp, Homo sapiens
cagcgcctccct

SEQ ID NO: 4388898 - DNA, 16 bp, Homo sapiens
cagcgcctccctccac

SEQ ID NO: 4388899 - DNA, 22 bp, Homo sapiens
cagcgcctccctccaccccagg

SEQ ID NO: 4388900 - DNA, 23 bp, Homo sapiens
cagcgcctccctccaccccagga

SEQ ID NO: 4388901 - DNA, 12 bp, Homo sapiens
cagcgctctgta

SEQ ID NO: 4388902 - DNA, 12 bp, Homo sapiens
cagcggcccccc

SEQ ID NO: 4388903 - DNA, 14 bp, Homo sapiens
cagcggctccaact

SEQ ID NO: 4388904 - DNA, 14 bp, Homo sapiens
cagcggctcccctc

SEQ ID NO: 4388905 - DNA, 21 bp, Homo sapiens
cagcggctcccctctgcttct

SEQ ID NO: 4388906 - DNA, 15 bp, Homo sapiens
cagcggctcctgcaa

SEQ ID NO: 4388907 - DNA, 17 bp, Homo sapiens
cagcgggagccagtggt

SEQ ID NO: 4388908 - DNA, 17 bp, Homo sapiens
cagcggggctgctcacc

SEQ ID NO: 4388909 - DNA, 15 bp, Homo sapiens
cagcgtcctcctctg

SEQ ID NO: 4388910 - DNA, 18 bp, Homo sapiens
cagcgtcctcctctgtga

SEQ ID NO: 4388911 - DNA, 20 bp, Homo sapiens
cagcgtcctgggctcaaatg

SEQ ID NO: 4388912 - DNA, 19 bp, Homo sapiens
cagctaaagcaatatgcat

SEQ ID NO: 4388913 - DNA, 14 bp, Homo sapiens
cagctaattctact

SEQ ID NO: 4388914 - DNA, 22 bp, Homo sapiens
cagctaattctactcacagtgc

SEQ ID NO: 4388915 - DNA, 16 bp, Homo sapiens
cagctaatttttgtat

SEQ ID NO: 4388916 - DNA, 13 bp, Homo sapiens
cagctactcagga

SEQ ID NO: 4388917 - DNA, 20 bp, Homo sapiens
cagctactcaggaggctgag

SEQ ID NO: 4388918 - DNA, 23 bp, Homo sapiens
cagctactctccccacgagggct

SEQ ID NO: 4388919 - DNA, 13 bp, Homo sapiens
cagctactggaat

SEQ ID NO: 4388920 - DNA, 16 bp, Homo sapiens
cagctactggaatggt

SEQ ID NO: 4388921 - DNA, 12 bp, Homo sapiens
cagctactgtag

SEQ ID NO: 4388922 - DNA, 15 bp, Homo sapiens
cagctacttgggagg

SEQ ID NO: 4388923 - DNA, 16 bp, Homo sapiens
cagctacttgggaggc

SEQ ID NO: 4388924 - DNA, 22 bp, Homo sapiens
cagctagaaaacacaaaatctt

SEQ ID NO: 4388925 - DNA, 16 bp, Homo sapiens
cagctaggaagagcag

SEQ ID NO: 4388926 - DNA, 20 bp, Homo sapiens
cagctaggaagagcaggact

SEQ ID NO: 4388927 - DNA, 17 bp, Homo sapiens
cactgcatgtcagagca

SEQ ID NO: 4388928 - DNA, 22 bp, Homo sapiens
cactgcattcctgtgccctaga

SEQ ID NO: 4388929 - DNA, 13 bp, Homo sapiens
cactgccagccca

SEQ ID NO: 4388930 - DNA, 12 bp, Homo sapiens
cactgccaggcc

SEQ ID NO: 4388931 - DNA, 20 bp, Homo sapiens
cactgccaggccagcctccg

SEQ ID NO: 4388932 - DNA, 19 bp, Homo sapiens
cactgccattacccagtgc

SEQ ID NO: 4388933 - DNA, 22 bp, Homo sapiens
cactgccattacccagtgccga

SEQ ID NO: 4388934 - DNA, 14 bp, Homo sapiens
cactgccccacatg

SEQ ID NO: 4388935 - DNA, 13 bp, Homo sapiens
cactgccccacgt

SEQ ID NO: 4388936 - DNA, 21 bp, Homo sapiens
cactgccccccgaggctgcta

SEQ ID NO: 4388937 - DNA, 20 bp, Homo sapiens
cactgcgaagaccctcttgc

SEQ ID NO: 4388938 - DNA, 12 bp, Homo sapiens
cactgctccagg

SEQ ID NO: 4388939 - DNA, 17 bp, Homo sapiens
cactgctccaggcctgc

SEQ ID NO: 4388940 - DNA, 20 bp, Homo sapiens
cactgctcgtggactgtgct

SEQ ID NO: 4388941 - DNA, 14 bp, Homo sapiens
cactgcttgaggaa

SEQ ID NO: 4388942 - DNA, 13 bp, Homo sapiens
cactgcttttccc

SEQ ID NO: 4388943 - DNA, 16 bp, Homo sapiens
cactggaaaggggaga

SEQ ID NO: 4388944 - DNA, 19 bp, Homo sapiens
cactggaaaggggagagcc

SEQ ID NO: 4388945 - DNA, 23 bp, Homo sapiens
cactggaaaggggagagcctgct

SEQ ID NO: 4388946 - DNA, 22 bp, Homo sapiens
cactggaaattgaggtccatgg

SEQ ID NO: 4388947 - DNA, 12 bp, Homo sapiens
cactggaatata

SEQ ID NO: 4388948 - DNA, 19 bp, Homo sapiens
cactggagacgcatatgag

SEQ ID NO: 4388949 - DNA, 21 bp, Homo sapiens
cactggagcaccaggcacgaa

SEQ ID NO: 4388950 - DNA, 18 bp, Homo sapiens
cactggaggttgaagcca

SEQ ID NO: 4388951 - DNA, 13 bp, Homo sapiens
cactggatcctgc

SEQ ID NO: 4388952 - DNA, 17 bp, Homo sapiens
cactggatcctgctgct

SEQ ID NO: 4388953 - DNA, 21 bp, Homo sapiens
cactggattgactttgctgtc

SEQ ID NO: 4388954 - DNA, 17 bp, Homo sapiens
cactggcaaacagggcc

SEQ ID NO: 4388955 - DNA, 19 bp, Homo sapiens
cactggcaaacagggcctc

SEQ ID NO: 4388956 - DNA, 17 bp, Homo sapiens
cactggcatcgcagctt

SEQ ID NO: 4388957 - DNA, 20 bp, Homo sapiens
cactggcatcgcagcttcct

SEQ ID NO: 4388958 - DNA, 22 bp, Homo sapiens
cactggcatcgcagcttcctgt

SEQ ID NO: 4388959 - DNA, 17 bp, Homo sapiens
cactggccgctgagcgc

SEQ ID NO: 4388960 - DNA, 16 bp, Homo sapiens
cactggcctctcccca

SEQ ID NO: 4388961 - DNA, 19 bp, Homo sapiens
cactggcctctccccagga

SEQ ID NO: 4388962 - DNA, 23 bp, Homo sapiens
cactggccttctgatgaaatgtt

SEQ ID NO: 4388963 - DNA, 15 bp, Homo sapiens
cactggctcacccag

SEQ ID NO: 4388964 - DNA, 17 bp, Homo sapiens
cactggctcacccagtc

SEQ ID NO: 4388965 - DNA, 22 bp, Homo sapiens
cactggcttggaacaccttggg

SEQ ID NO: 4388966 - DNA, 23 bp, Homo sapiens
cactgggaacctagctacactga

SEQ ID NO: 4388967 - DNA, 14 bp, Homo sapiens
cactgggagagctg

SEQ ID NO: 4388968 - DNA, 21 bp, Homo sapiens
cactgggaggcagggctctcc

SEQ ID NO: 4388969 - DNA, 18 bp, Homo sapiens
cactgggcccgagcctga

SEQ ID NO: 4388970 - DNA, 21 bp, Homo sapiens
cactggggcagacaataaacc

SEQ ID NO: 4388971 - DNA, 19 bp, Homo sapiens
cactggggcaggggccggg

SEQ ID NO: 4388972 - DNA, 13 bp, Homo sapiens
cactggggtgccg

SEQ ID NO: 4388973 - DNA, 20 bp, Homo sapiens
cactggggtgccgcctgccc

SEQ ID NO: 4388974 - DNA, 14 bp, Homo sapiens
cactgggtggtggc

SEQ ID NO: 4388975 - DNA, 22 bp, Homo sapiens
cactgggtggtggcctggtccc

SEQ ID NO: 4388976 - DNA, 22 bp, Homo sapiens
cactggtacttagagtttctgt

SEQ ID NO: 4388977 - DNA, 21 bp, Homo sapiens
cactggtctgctgttccagtg

SEQ ID NO: 4388978 - DNA, 17 bp, Homo sapiens
cactggtgaactgagct

SEQ ID NO: 4388979 - DNA, 19 bp, Homo sapiens
cactggtgagacaatgaaa

SEQ ID NO: 4388980 - DNA, 20 bp, Homo sapiens
cactggtgtgaactcaccct

SEQ ID NO: 4388981 - DNA, 16 bp, Homo sapiens
cactggttttacacag

SEQ ID NO: 4388982 - DNA, 19 bp, Homo sapiens
cactgtaaagacaaataaa

SEQ ID NO: 4388983 - DNA, 20 bp, Homo sapiens
cactgtaaagacaaataaat

SEQ ID NO: 4388984 - DNA, 17 bp, Homo sapiens
cactgtaaatatccctc

SEQ ID NO: 4388985 - DNA, 22 bp, Homo sapiens
cactgtaatacgtagctctctt

SEQ ID NO: 4388986 - DNA, 21 bp, Homo sapiens
cactgtacaaatgacactgca

SEQ ID NO: 4388987 - DNA, 16 bp, Homo sapiens
cactgtatataaacat

SEQ ID NO: 4388988 - DNA, 17 bp, Homo sapiens
cactgtatatgtaaatt

SEQ ID NO: 4388989 - DNA, 20 bp, Homo sapiens
cactgtatgttatagaactt

SEQ ID NO: 4388990 - DNA, 11 bp, Homo sapiens
cactgtatttt

SEQ ID NO: 4388991 - DNA, 13 bp, Homo sapiens
cactgtcacaggc

SEQ ID NO: 4388992 - DNA, 14 bp, Homo sapiens
cactgtcacaggca

SEQ ID NO: 4388993 - DNA, 21 bp, Homo sapiens
cactgtctatttaagtgcaat

SEQ ID NO: 4388994 - DNA, 19 bp, Homo sapiens
cactgtctctaccaaaaaa

SEQ ID NO: 4388995 - DNA, 20 bp, Homo sapiens
cactgtgcacatctgtgtct

SEQ ID NO: 4388996 - DNA, 22 bp, Homo sapiens
cactgtgcgtcttggtgtaatt

SEQ ID NO: 4388997 - DNA, 16 bp, Homo sapiens
cactgtgctattacaa

SEQ ID NO: 4388998 - DNA, 16 bp, Homo sapiens
cactgtggcactggcc

SEQ ID NO: 4388999 - DNA, 14 bp, Homo sapiens
cactgtggccccaa

SEQ ID NO: 4389000 - DNA, 14 bp, Homo sapiens
cactgtgggaaggc

SEQ ID NO: 4389001 - DNA, 22 bp, Homo sapiens
cactgtggtcgtcaactttcct

SEQ ID NO: 4389002 - DNA, 12 bp, Homo sapiens
cactgtgtaagc

SEQ ID NO: 4389003 - DNA, 16 bp, Homo sapiens
cactgtgtactggagc

SEQ ID NO: 4389004 - DNA, 22 bp, Homo sapiens
cactgtgtataggaatttgtat

SEQ ID NO: 4389005 - DNA, 14 bp, Homo sapiens
cactgttagaacac

SEQ ID NO: 4389006 - DNA, 17 bp, Homo sapiens
cactgttagaacactat

SEQ ID NO: 4389007 - DNA, 15 bp, Homo sapiens
cactgttcagcggag

SEQ ID NO: 4389008 - DNA, 17 bp, Homo sapiens
cactgttcagcggagct

SEQ ID NO: 4389009 - DNA, 19 bp, Homo sapiens
cactgttccccctgtgcag

SEQ ID NO: 4389010 - DNA, 15 bp, Homo sapiens
cactgtttccatgtt

SEQ ID NO: 4389011 - DNA, 22 bp, Homo sapiens
cactgtttgcatgcgcccgagg

SEQ ID NO: 4389012 - DNA, 15 bp, Homo sapiens
cactgtttgttttta

SEQ ID NO: 4389013 - DNA, 15 bp, Homo sapiens
cacttaaaaatggtt

SEQ ID NO: 4389014 - DNA, 22 bp, Homo sapiens
cacttaaactttgtcacttctg

SEQ ID NO: 4389015 - DNA, 12 bp, Homo sapiens
cacttaatcatt

SEQ ID NO: 4389016 - DNA, 13 bp, Homo sapiens
cacttaatcattt

SEQ ID NO: 4389017 - DNA, 17 bp, Homo sapiens
cacttaatttgaaatct

SEQ ID NO: 4389018 - DNA, 17 bp, Homo sapiens
cacttacagttaggatt

SEQ ID NO: 4389019 - DNA, 17 bp, Homo sapiens
cacttagacctgccagc

SEQ ID NO: 4389020 - DNA, 19 bp, Homo sapiens
cacttagacctgccagcca

SEQ ID NO: 4389021 - DNA, 21 bp, Homo sapiens
cacttagcaggcaccgccacg

SEQ ID NO: 4389022 - DNA, 15 bp, Homo sapiens
cacttagcccaagag

SEQ ID NO: 4389023 - DNA, 20 bp, Homo sapiens
cacttatattttatgaacat

SEQ ID NO: 4389024 - DNA, 23 bp, Homo sapiens
cacttatattttatgaacattgt

SEQ ID NO: 4389025 - DNA, 15 bp, Homo sapiens
cacttatcttctgga

SEQ ID NO: 4389026 - DNA, 16 bp, Homo sapiens
cacttattgtaaattt

SEQ ID NO: 4389027 - DNA, 18 bp, Homo sapiens
cacttcaaattcaaataa

SEQ ID NO: 4389028 - DNA, 23 bp, Homo sapiens
cacttcaagctgttatttcttcc

SEQ ID NO: 4389029 - DNA, 17 bp, Homo sapiens
cacttcactttcttcaa

SEQ ID NO: 4389030 - DNA, 16 bp, Homo sapiens
cacttcattttgtata

SEQ ID NO: 4389031 - DNA, 21 bp, Homo sapiens
cacttcatttttattaaacag

SEQ ID NO: 4389032 - DNA, 12 bp, Homo sapiens
cacttccagggg

SEQ ID NO: 4389033 - DNA, 20 bp, Homo sapiens
cacttccaggggaacctgcc

SEQ ID NO: 4389034 - DNA, 14 bp, Homo sapiens
cacttccagtctgg

SEQ ID NO: 4389035 - DNA, 14 bp, Homo sapiens
cacttcccagtgga

SEQ ID NO: 4389036 - DNA, 17 bp, Homo sapiens
cacttcctacaagagca

SEQ ID NO: 4389037 - DNA, 17 bp, Homo sapiens
cacttcgcacacaccca

SEQ ID NO: 4389038 - DNA, 15 bp, Homo sapiens
cacttcgcttcctgg

SEQ ID NO: 4389039 - DNA, 19 bp, Homo sapiens
cacttcgttcgcagagctt

SEQ ID NO: 4389040 - DNA, 21 bp, Homo sapiens
cacttctaaattaatggtaaa

SEQ ID NO: 4389041 - DNA, 18 bp, Homo sapiens
cacttctagatctcagcc

SEQ ID NO: 4389042 - DNA, 19 bp, Homo sapiens
cacttctccccgcagcccg

SEQ ID NO: 4389043 - DNA, 21 bp, Homo sapiens
cacttctcttaaacttgtgaa

SEQ ID NO: 4389044 - DNA, 12 bp, Homo sapiens
cacttctgctgt

SEQ ID NO: 4389045 - DNA, 18 bp, Homo sapiens
cagaatgactgacaaaga

SEQ ID NO: 4389046 - DNA, 18 bp, Homo sapiens
cagaatgctgtacatcta

SEQ ID NO: 4389047 - DNA, 15 bp, Homo sapiens
cagaatggaagagag

SEQ ID NO: 4389048 - DNA, 15 bp, Homo sapiens
cagaatgtaaaaaag

SEQ ID NO: 4389049 - DNA, 14 bp, Homo sapiens
cagaatgtgttctt

SEQ ID NO: 4389050 - DNA, 18 bp, Homo sapiens
cagaatgtgttcttttct

SEQ ID NO: 4389051 - DNA, 21 bp, Homo sapiens
cacctggctgaggttcctctg

SEQ ID NO: 4389052 - DNA, 22 bp, Homo sapiens
cacctggctgaggttcctctgc

SEQ ID NO: 4389053 - DNA, 13 bp, Homo sapiens
cacctgtaaaact

SEQ ID NO: 4389054 - DNA, 15 bp, Homo sapiens
cacctgtaaaacttt

SEQ ID NO: 4389055 - DNA, 15 bp, Homo sapiens
cacctgtaaacctga

SEQ ID NO: 4389056 - DNA, 14 bp, Homo sapiens
cacctgtacattct

SEQ ID NO: 4389057 - DNA, 19 bp, Homo sapiens
cacctgtatatttctttta

SEQ ID NO: 4389058 - DNA, 22 bp, Homo sapiens
cacctgtatatttcttttaatg

SEQ ID NO: 4389059 - DNA, 19 bp, Homo sapiens
cacctgtgcttcgggccct

SEQ ID NO: 4389060 - DNA, 22 bp, Homo sapiens
cacctgtggaacataaaaagga

SEQ ID NO: 4389061 - DNA, 14 bp, Homo sapiens
cacctgtggggcct

SEQ ID NO: 4389062 - DNA, 16 bp, Homo sapiens
cacctgtggggcctgg

SEQ ID NO: 4389063 - DNA, 17 bp, Homo sapiens
cacctgtggggcctggg

SEQ ID NO: 4389064 - DNA, 20 bp, Homo sapiens
cacctgtggggcctggggag

SEQ ID NO: 4389065 - DNA, 19 bp, Homo sapiens
cacctgtttctggaagact

SEQ ID NO: 4389066 - DNA, 21 bp, Homo sapiens
cacctgtttctggaagactgc

SEQ ID NO: 4389067 - DNA, 23 bp, Homo sapiens
cacctgtttctggaagactgctc

SEQ ID NO: 4389068 - DNA, 22 bp, Homo sapiens
caccttaaattaaacaatttat

SEQ ID NO: 4389069 - DNA, 13 bp, Homo sapiens
caccttagtgcaa

SEQ ID NO: 4389070 - DNA, 14 bp, Homo sapiens
caccttcagggctg

SEQ ID NO: 4389071 - DNA, 21 bp, Homo sapiens
caccttcccagctctccctct

SEQ ID NO: 4389072 - DNA, 17 bp, Homo sapiens
caccttcttaaaagaaa

SEQ ID NO: 4389073 - DNA, 17 bp, Homo sapiens
caccttctttctggact

SEQ ID NO: 4389074 - DNA, 18 bp, Homo sapiens
caccttctttctggactg

SEQ ID NO: 4389075 - DNA, 17 bp, Homo sapiens
caccttgaatctgcctg

SEQ ID NO: 4389076 - DNA, 12 bp, Homo sapiens
caccttgttaca

SEQ ID NO: 4389077 - DNA, 17 bp, Homo sapiens
cacctttcccacctctc

SEQ ID NO: 4389078 - DNA, 14 bp, Homo sapiens
cacctttgccacaa

SEQ ID NO: 4389079 - DNA, 17 bp, Homo sapiens
caccttttctgtggctg

SEQ ID NO: 4389080 - DNA, 17 bp, Homo sapiens
cacctttttaaatccta

SEQ ID NO: 4389081 - DNA, 19 bp, Homo sapiens
cacctttttaaatcctaaa

SEQ ID NO: 4389082 - DNA, 14 bp, Homo sapiens
cacgaacccacctg

SEQ ID NO: 4389083 - DNA, 18 bp, Homo sapiens
cacgaacccacctgctga

SEQ ID NO: 4389084 - DNA, 21 bp, Homo sapiens
cacgaaggtaaaaagtatttt

SEQ ID NO: 4389085 - DNA, 14 bp, Homo sapiens
cacgacagtggatg

SEQ ID NO: 4389086 - DNA, 22 bp, Homo sapiens
cacgacccctgaatctgctgag

SEQ ID NO: 4389087 - DNA, 15 bp, Homo sapiens
cacgactgcgggagc

SEQ ID NO: 4389088 - DNA, 17 bp, Homo sapiens
cacgactggccagggcc

SEQ ID NO: 4389089 - DNA, 19 bp, Homo sapiens
cacgagcaggctactgtca

SEQ ID NO: 4389090 - DNA, 18 bp, Homo sapiens
cacgagccacaagctgca

SEQ ID NO: 4389091 - DNA, 20 bp, Homo sapiens
cacgagccacaagctgcact

SEQ ID NO: 4389092 - DNA, 18 bp, Homo sapiens
cacgagcccattctcatg

SEQ ID NO: 4389093 - DNA, 23 bp, Homo sapiens
cacgaggaatctgtgggtctggg

SEQ ID NO: 4389094 - DNA, 17 bp, Homo sapiens
cacgagggccccgtggg

SEQ ID NO: 4389095 - DNA, 12 bp, Homo sapiens
cacgagggctgg

SEQ ID NO: 4389096 - DNA, 13 bp, Homo sapiens
cacgagggctggc

SEQ ID NO: 4389097 - DNA, 21 bp, Homo sapiens
cacgagggctggctggcctca

SEQ ID NO: 4389098 - DNA, 15 bp, Homo sapiens
cacgaggtcaggaga

SEQ ID NO: 4389099 - DNA, 14 bp, Homo sapiens
cacgatgtggccct

SEQ ID NO: 4389100 - DNA, 20 bp, Homo sapiens
cacgcacccgtatctgccct

SEQ ID NO: 4389101 - DNA, 14 bp, Homo sapiens
cacgcatacttgga

SEQ ID NO: 4389102 - DNA, 19 bp, Homo sapiens
cacgccattgtactccagc

SEQ ID NO: 4389103 - DNA, 20 bp, Homo sapiens
cacgccattgtactccagcc

SEQ ID NO: 4389104 - DNA, 21 bp, Homo sapiens
cacgccattgtactccagcct

SEQ ID NO: 4389105 - DNA, 22 bp, Homo sapiens
cacgccattgtactccagcctg

SEQ ID NO: 4389106 - DNA, 19 bp, Homo sapiens
cacgccctccctgctagca

SEQ ID NO: 4389107 - DNA, 13 bp, Homo sapiens
cacgccggccaca

SEQ ID NO: 4389108 - DNA, 16 bp, Homo sapiens
cacgccggccacaccc

SEQ ID NO: 4389109 - DNA, 14 bp, Homo sapiens
cacgcctcaccagc

SEQ ID NO: 4389110 - DNA, 13 bp, Homo sapiens
cacgcctcctggc

SEQ ID NO: 4389111 - DNA, 16 bp, Homo sapiens
cacgcctcctggccag

SEQ ID NO: 4389112 - DNA, 19 bp, Homo sapiens
cacgcctgtaatcccagca

SEQ ID NO: 4389113 - DNA, 20 bp, Homo sapiens
cacgcctgtaatcccagcag

SEQ ID NO: 4389114 - DNA, 14 bp, Homo sapiens
cacgcgtatttaca

SEQ ID NO: 4389115 - DNA, 11 bp, Homo sapiens
cacgcttctga

SEQ ID NO: 4389116 - DNA, 17 bp, Homo sapiens
cacgcttctgagcaggg

SEQ ID NO: 4389117 - DNA, 18 bp, Homo sapiens
cacgcttctgagcagggg

SEQ ID NO: 4389118 - DNA, 14 bp, Homo sapiens
cacgctttcctgaa

SEQ ID NO: 4389119 - DNA, 14 bp, Homo sapiens
cacgctttgtttac

SEQ ID NO: 4389120 - DNA, 15 bp, Homo sapiens
cacggactctcccag

SEQ ID NO: 4389121 - DNA, 16 bp, Homo sapiens
cacggagccactcctc

SEQ ID NO: 4389122 - DNA, 18 bp, Homo sapiens
cacggagccactcctctg

SEQ ID NO: 4389123 - DNA, 19 bp, Homo sapiens
cacggagccactcctctga

SEQ ID NO: 4389124 - DNA, 23 bp, Homo sapiens
cacggagccactcctctgactca

SEQ ID NO: 4389125 - DNA, 17 bp, Homo sapiens
cacggagcgggaggcag

SEQ ID NO: 4389126 - DNA, 16 bp, Homo sapiens
cacggagggagcgaca

SEQ ID NO: 4389127 - DNA, 20 bp, Homo sapiens
cacggatccatgtagcagga

SEQ ID NO: 4389128 - DNA, 19 bp, Homo sapiens
cacggcgggatcctccaca

SEQ ID NO: 4389129 - DNA, 20 bp, Homo sapiens
cacggcgggatcctccacag

SEQ ID NO: 4389130 - DNA, 18 bp, Homo sapiens
cacggggttccctcctag

SEQ ID NO: 4389131 - DNA, 17 bp, Homo sapiens
cacggtcccccaggagg

SEQ ID NO: 4389132 - DNA, 12 bp, Homo sapiens
cacgtcccagca

SEQ ID NO: 4389133 - DNA, 14 bp, Homo sapiens
cacgtcccagcatc

SEQ ID NO: 4389134 - DNA, 20 bp, Homo sapiens
cacgtcccagcatccctgga

SEQ ID NO: 4389135 - DNA, 14 bp, Homo sapiens
cacgtgccaggccc

SEQ ID NO: 4389136 - DNA, 15 bp, Homo sapiens
cacgtgccaggcccg

SEQ ID NO: 4389137 - DNA, 15 bp, Homo sapiens
cacgtggagagctgg

SEQ ID NO: 4389138 - DNA, 19 bp, Homo sapiens
cacgtgtggcctgttcttc

SEQ ID NO: 4389139 - DNA, 14 bp, Homo sapiens
cacgttgtccctga

SEQ ID NO: 4389140 - DNA, 20 bp, Homo sapiens
cacgtttaatcccagcactt

SEQ ID NO: 4389141 - DNA, 21 bp, Homo sapiens
cacgtttaatcccagcacttt

SEQ ID NO: 4389142 - DNA, 21 bp, Homo sapiens
cactaaacttggtgcttattg

SEQ ID NO: 4389143 - DNA, 21 bp, Homo sapiens
cactaaattgacacttaaaaa

SEQ ID NO: 4389144 - DNA, 19 bp, Homo sapiens
cactaacatcaatggcttt

SEQ ID NO: 4389145 - DNA, 14 bp, Homo sapiens
cactaaccatcccc

SEQ ID NO: 4389146 - DNA, 14 bp, Homo sapiens
cactaagacaagaa

SEQ ID NO: 4389147 - DNA, 16 bp, Homo sapiens
cactaaggtggacagc

SEQ ID NO: 4389148 - DNA, 21 bp, Homo sapiens
cactaatatatttaaaaataa

SEQ ID NO: 4389149 - DNA, 15 bp, Homo sapiens
cactaatttttgtat

SEQ ID NO: 4389150 - DNA, 15 bp, Homo sapiens
cactacacatttgaa

SEQ ID NO: 4389151 - DNA, 16 bp, Homo sapiens
cactacacatttgaaa

SEQ ID NO: 4389152 - DNA, 15 bp, Homo sapiens
cactacatgcagccc

SEQ ID NO: 4389153 - DNA, 18 bp, Homo sapiens
cactaccagccagcctca

SEQ ID NO: 4389154 - DNA, 17 bp, Homo sapiens
cactaccctgagatctg

SEQ ID NO: 4389155 - DNA, 18 bp, Homo sapiens
cactacgcactggacagc

SEQ ID NO: 4389156 - DNA, 15 bp, Homo sapiens
cactactcctctgca

SEQ ID NO: 4389157 - DNA, 18 bp, Homo sapiens
cactactcctctgcagtg

SEQ ID NO: 4389158 - DNA, 12 bp, Homo sapiens
cactactgggtg

SEQ ID NO: 4389159 - DNA, 16 bp, Homo sapiens
cactactgggtgtcat

SEQ ID NO: 4389160 - DNA, 16 bp, Homo sapiens
cactagagaatgcaca

SEQ ID NO: 4389161 - DNA, 19 bp, Homo sapiens
cactagccatgctttatgt

SEQ ID NO: 4389162 - DNA, 19 bp, Homo sapiens
cactaggcacccagctgcc

SEQ ID NO: 4389163 - DNA, 19 bp, Homo sapiens
cactagggactatcaggta

SEQ ID NO: 4389164 - DNA, 14 bp, Homo sapiens
cactaggtgtcccc

SEQ ID NO: 4389165 - DNA, 16 bp, Homo sapiens
cactaggtgtccccaa

SEQ ID NO: 4389166 - DNA, 22 bp, Homo sapiens
cactaggtgtccccaacgtccc

SEQ ID NO: 4389167 - DNA, 17 bp, Homo sapiens
cactagtaagtaattat

SEQ ID NO: 4389168 - DNA, 22 bp, Homo sapiens
cactatacaggctgggaagtgt

SEQ ID NO: 4389169 - DNA, 12 bp, Homo sapiens
cactatcaattt

SEQ ID NO: 4389170 - DNA, 19 bp, Homo sapiens
cactatctccgttccatct

SEQ ID NO: 4389171 - DNA, 23 bp, Homo sapiens
cactatggaccagggagcttatt

SEQ ID NO: 4389172 - DNA, 21 bp, Homo sapiens
cactattgtgaatatttggaa

SEQ ID NO: 4389173 - DNA, 13 bp, Homo sapiens
cactatttccaaa

SEQ ID NO: 4389174 - DNA, 12 bp, Homo sapiens
cactattttcag

SEQ ID NO: 4389175 - DNA, 13 bp, Homo sapiens
cactattttcaga

SEQ ID NO: 4389176 - DNA, 14 bp, Homo sapiens
cactattttcagaa

SEQ ID NO: 4389177 - DNA, 17 bp, Homo sapiens
cactattttcagaatct

SEQ ID NO: 4389178 - DNA, 20 bp, Homo sapiens
cactattttcagaatctgaa

SEQ ID NO: 4389179 - DNA, 16 bp, Homo sapiens
cactcaaatcaagaaa

SEQ ID NO: 4389180 - DNA, 17 bp, Homo sapiens
cactcaataaacagtca

SEQ ID NO: 4389181 - DNA, 15 bp, Homo sapiens
cactcacacagccag

SEQ ID NO: 4389182 - DNA, 22 bp, Homo sapiens
cactcacacagccaggtgcctt

SEQ ID NO: 4389183 - DNA, 20 bp, Homo sapiens
cactcaccactaccagccag

SEQ ID NO: 4389184 - DNA, 14 bp, Homo sapiens
cactcactcctgag

SEQ ID NO: 4389185 - DNA, 11 bp, Homo sapiens
cactcactgtt

SEQ ID NO: 4389186 - DNA, 15 bp, Homo sapiens
cactcactgtttata

SEQ ID NO: 4389187 - DNA, 12 bp, Homo sapiens
cactcagaaaat

SEQ ID NO: 4389188 - DNA, 16 bp, Homo sapiens
cactcagccactgtca

SEQ ID NO: 4389189 - DNA, 18 bp, Homo sapiens
cactcagtgagcctcctg

SEQ ID NO: 4389190 - DNA, 23 bp, Homo sapiens
cactcagtgagcctcctgtgcct

SEQ ID NO: 4389191 - DNA, 21 bp, Homo sapiens
cactcatgcaaactgctttat

SEQ ID NO: 4389192 - DNA, 20 bp, Homo sapiens
cactcattccttcactcatc

SEQ ID NO: 4389193 - DNA, 17 bp, Homo sapiens
cactcattgaaatgtaa

SEQ ID NO: 4389194 - DNA, 13 bp, Homo sapiens
cactcatttcatc

SEQ ID NO: 4389195 - DNA, 17 bp, Homo sapiens
cactcatttcatctcat

SEQ ID NO: 4389196 - DNA, 22 bp, Homo sapiens
cactcatttcatctcatttaag

SEQ ID NO: 4389197 - DNA, 19 bp, Homo sapiens
cactccaccacccaaaagt

SEQ ID NO: 4389198 - DNA, 13 bp, Homo sapiens
cactccaccatcc

SEQ ID NO: 4389199 - DNA, 12 bp, Homo sapiens
cactccagcctg

SEQ ID NO: 4389200 - DNA, 22 bp, Homo sapiens
cactccagcctgggtcacagag

SEQ ID NO: 4389201 - DNA, 21 bp, Homo sapiens
cactccagtgagacagctctg

SEQ ID NO: 4389202 - DNA, 22 bp, Homo sapiens
cactccagtttttgtttttgca

SEQ ID NO: 4389203 - DNA, 23 bp, Homo sapiens
cactcccacctgacacaccaggc

SEQ ID NO: 4389204 - DNA, 20 bp, Homo sapiens
cactccccacttcactttct

SEQ ID NO: 4389205 - DNA, 19 bp, Homo sapiens
cactccccgaagtcttttg

SEQ ID NO: 4389206 - DNA, 21 bp, Homo sapiens
cactcccctctcctccccttc

SEQ ID NO: 4389207 - DNA, 14 bp, Homo sapiens
cactccctaattta

SEQ ID NO: 4389208 - DNA, 14 bp, Homo sapiens
cactccctgggaca

SEQ ID NO: 4389209 - DNA, 20 bp, Homo sapiens
cactcccttctacctgccac

SEQ ID NO: 4389210 - DNA, 23 bp, Homo sapiens
cactcccttctacctgccactca

SEQ ID NO: 4389211 - DNA, 13 bp, Homo sapiens
cactcccttgggc

SEQ ID NO: 4389212 - DNA, 17 bp, Homo sapiens
cactccggccctccaga

SEQ ID NO: 4389213 - DNA, 12 bp, Homo sapiens
cactcctagaga

SEQ ID NO: 4389214 - DNA, 18 bp, Homo sapiens
cactcctctatcatgcaa

SEQ ID NO: 4389215 - DNA, 12 bp, Homo sapiens
cactcctctgac

SEQ ID NO: 4389216 - DNA, 20 bp, Homo sapiens
cactcctctgactcagggct

SEQ ID NO: 4389217 - DNA, 23 bp, Homo sapiens
cactcctgagacccctggcctcc

SEQ ID NO: 4389218 - DNA, 21 bp, Homo sapiens
cactcctggtgcaggtctcca

SEQ ID NO: 4389219 - DNA, 21 bp, Homo sapiens
cactccttccatctcttcctt

SEQ ID NO: 4389220 - DNA, 20 bp, Homo sapiens
cactccttccttcaggactc

SEQ ID NO: 4389221 - DNA, 14 bp, Homo sapiens
cactcgacccagaa

SEQ ID NO: 4389222 - DNA, 19 bp, Homo sapiens
cactcgctgtgattttaag

SEQ ID NO: 4389223 - DNA, 16 bp, Homo sapiens
cactcggggtccctgg

SEQ ID NO: 4389224 - DNA, 16 bp, Homo sapiens
cactctaactgtatat

SEQ ID NO: 4389225 - DNA, 18 bp, Homo sapiens
cactctaccctcccaccc

SEQ ID NO: 4389226 - DNA, 19 bp, Homo sapiens
cactctaccctcccacccc

SEQ ID NO: 4389227 - DNA, 15 bp, Homo sapiens
cactctagttctaga

SEQ ID NO: 4389228 - DNA, 15 bp, Homo sapiens
cactctatatgtagt

SEQ ID NO: 4389229 - DNA, 12 bp, Homo sapiens
cactctccccac

SEQ ID NO: 4389230 - DNA, 14 bp, Homo sapiens
cactctccccacac

SEQ ID NO: 4389231 - DNA, 15 bp, Homo sapiens
cactctccccacact

SEQ ID NO: 4389232 - DNA, 18 bp, Homo sapiens
cactctcccccaccccct

SEQ ID NO: 4389233 - DNA, 20 bp, Homo sapiens
cactctcccccaccccctcc

SEQ ID NO: 4389234 - DNA, 14 bp, Homo sapiens
cactctcctgggcc

SEQ ID NO: 4389235 - DNA, 15 bp, Homo sapiens
cactctcctgggccc

SEQ ID NO: 4389236 - DNA, 13 bp, Homo sapiens
cactctgcttctt

SEQ ID NO: 4389237 - DNA, 23 bp, Homo sapiens
cactctggtccctttaaagagca

SEQ ID NO: 4389238 - DNA, 23 bp, Homo sapiens
cactctgtaattgcactttttaa

SEQ ID NO: 4389239 - DNA, 22 bp, Homo sapiens
cactctgtattgaaaatggctt

SEQ ID NO: 4389240 - DNA, 14 bp, Homo sapiens
cactctgtcagcca

SEQ ID NO: 4389241 - DNA, 20 bp, Homo sapiens
cactctgtccctgtccttcc

SEQ ID NO: 4389242 - DNA, 22 bp, Homo sapiens
cactctgttgcccaggctggag

SEQ ID NO: 4389243 - DNA, 15 bp, Homo sapiens
cactcttaaacagca

SEQ ID NO: 4389244 - DNA, 22 bp, Homo sapiens
cactcttctttaagccatagac

SEQ ID NO: 4389245 - DNA, 20 bp, Homo sapiens
cactctttatagtgcacaaa

SEQ ID NO: 4389246 - DNA, 14 bp, Homo sapiens
cactgaaaaaatat

SEQ ID NO: 4389247 - DNA, 17 bp, Homo sapiens
cactgaaaaaatatatg

SEQ ID NO: 4389248 - DNA, 17 bp, Homo sapiens
cactgaaagttttgtaa

SEQ ID NO: 4389249 - DNA, 19 bp, Homo sapiens
cactgaaagttttgtaaaa

SEQ ID NO: 4389250 - DNA, 21 bp, Homo sapiens
cactgaaagttttgtaaaaga

SEQ ID NO: 4389251 - DNA, 22 bp, Homo sapiens
cactgaaccttaggctttgtat

SEQ ID NO: 4389252 - DNA, 16 bp, Homo sapiens
cactgaactgctttta

SEQ ID NO: 4389253 - DNA, 12 bp, Homo sapiens
cactgaagagct

SEQ ID NO: 4389254 - DNA, 14 bp, Homo sapiens
cactgaagagctct

SEQ ID NO: 4389255 - DNA, 15 bp, Homo sapiens
cactgaagagctctt

SEQ ID NO: 4389256 - DNA, 14 bp, Homo sapiens
cactgaattgcttg

SEQ ID NO: 4389257 - DNA, 17 bp, Homo sapiens
cactgaccatccactct

SEQ ID NO: 4389258 - DNA, 21 bp, Homo sapiens
cactgacttctaagtaaaacc

SEQ ID NO: 4389259 - DNA, 19 bp, Homo sapiens
cactgagaatgtaagaact

SEQ ID NO: 4389260 - DNA, 21 bp, Homo sapiens
cactgagaatgtaagaactac

SEQ ID NO: 4389261 - DNA, 12 bp, Homo sapiens
cactgagcaggg

SEQ ID NO: 4389262 - DNA, 20 bp, Homo sapiens
cactgagctgtgacccagag

SEQ ID NO: 4389263 - DNA, 21 bp, Homo sapiens
cactgagctgtgacccagagg

SEQ ID NO: 4389264 - DNA, 20 bp, Homo sapiens
cactgaggggtggcacggga

SEQ ID NO: 4389265 - DNA, 15 bp, Homo sapiens
cactgagttgcacat

SEQ ID NO: 4389266 - DNA, 16 bp, Homo sapiens
cactgagttgcacata

SEQ ID NO: 4389267 - DNA, 17 bp, Homo sapiens
cactgatgggaataaaa

SEQ ID NO: 4389268 - DNA, 18 bp, Homo sapiens
cactgatgggaataaaag

SEQ ID NO: 4389269 - DNA, 20 bp, Homo sapiens
cactgatgggaataaaagta

SEQ ID NO: 4389270 - DNA, 16 bp, Homo sapiens
cactgatttggagata

SEQ ID NO: 4389271 - DNA, 20 bp, Homo sapiens
cactgcaacctccaactccc

SEQ ID NO: 4389272 - DNA, 15 bp, Homo sapiens
cactgcaagagcctt

SEQ ID NO: 4389273 - DNA, 16 bp, Homo sapiens
cactgcaagagccttg

SEQ ID NO: 4389274 - DNA, 19 bp, Homo sapiens
cactgcaagagccttggtg

SEQ ID NO: 4389275 - DNA, 20 bp, Homo sapiens
cactgcaatctccacctccc

SEQ ID NO: 4389276 - DNA, 13 bp, Homo sapiens
cactgcacatctt

SEQ ID NO: 4389277 - DNA, 20 bp, Homo sapiens
cactgcacccctgcccccag

SEQ ID NO: 4389278 - DNA, 15 bp, Homo sapiens
cactgcactccagcc

SEQ ID NO: 4389279 - DNA, 13 bp, Homo sapiens
cactgcactttgt

SEQ ID NO: 4389280 - DNA, 21 bp, Homo sapiens
cactgcagcctcatactcctg

SEQ ID NO: 4389281 - DNA, 13 bp, Homo sapiens
cactgcaggcccc

SEQ ID NO: 4389282 - DNA, 22 bp, Homo sapiens
cacaggcagggcctggctccag

SEQ ID NO: 4389283 - DNA, 22 bp, Homo sapiens
cacaggcaggtcacagaaaggc

SEQ ID NO: 4389284 - DNA, 14 bp, Homo sapiens
cacaggcctgagat

SEQ ID NO: 4389285 - DNA, 15 bp, Homo sapiens
cacaggcctgagatt

SEQ ID NO: 4389286 - DNA, 20 bp, Homo sapiens
cacaggcctgagatttcatc

SEQ ID NO: 4389287 - DNA, 20 bp, Homo sapiens
cacagggaaaattgccccat

SEQ ID NO: 4389288 - DNA, 22 bp, Homo sapiens
cacagggcagctgggcccaacc

SEQ ID NO: 4389289 - DNA, 22 bp, Homo sapiens
cacagggcccggccacacccag

SEQ ID NO: 4389290 - DNA, 16 bp, Homo sapiens
cacagggttgggccca

SEQ ID NO: 4389291 - DNA, 15 bp, Homo sapiens
cacaggtccaaggac

SEQ ID NO: 4389292 - DNA, 16 bp, Homo sapiens
cacaggtccaaggaca

SEQ ID NO: 4389293 - DNA, 16 bp, Homo sapiens
cacaggtgttccgtgg

SEQ ID NO: 4389294 - DNA, 22 bp, Homo sapiens
cacaggtgttccgtgggaccct

SEQ ID NO: 4389295 - DNA, 13 bp, Homo sapiens
cacaggttttatg

SEQ ID NO: 4389296 - DNA, 17 bp, Homo sapiens
cacaggttttatgtgtt

SEQ ID NO: 4389297 - DNA, 14 bp, Homo sapiens
cacagtaaaaataa

SEQ ID NO: 4389298 - DNA, 17 bp, Homo sapiens
cacagtaaaaataaaat

SEQ ID NO: 4389299 - DNA, 13 bp, Homo sapiens
cacagtaaagagt

SEQ ID NO: 4389300 - DNA, 20 bp, Homo sapiens
cacagtaaagagtacactca

SEQ ID NO: 4389301 - DNA, 21 bp, Homo sapiens
cacagtaaagagtacactcag

SEQ ID NO: 4389302 - DNA, 21 bp, Homo sapiens
cacagtacttcctcccagcat

SEQ ID NO: 4389303 - DNA, 22 bp, Homo sapiens
cacagtattatttctccatccc

SEQ ID NO: 4389304 - DNA, 16 bp, Homo sapiens
cacagtcactgatgta

SEQ ID NO: 4389305 - DNA, 14 bp, Homo sapiens
cacagtcactggat

SEQ ID NO: 4389306 - DNA, 15 bp, Homo sapiens
cacagtcagaaggac

SEQ ID NO: 4389307 - DNA, 21 bp, Homo sapiens
cacagtcagaaggacggcagg

SEQ ID NO: 4389308 - DNA, 19 bp, Homo sapiens
cacagtcatacaagtcatg

SEQ ID NO: 4389309 - DNA, 15 bp, Homo sapiens
cacagtccagaccca

SEQ ID NO: 4389310 - DNA, 15 bp, Homo sapiens
cacagtcttgtgaac

SEQ ID NO: 4389311 - DNA, 16 bp, Homo sapiens
cacagtgagactgtac

SEQ ID NO: 4389312 - DNA, 13 bp, Homo sapiens
cacagtgccccct

SEQ ID NO: 4389313 - DNA, 22 bp, Homo sapiens
cacagtggatggacggacaaga

SEQ ID NO: 4389314 - DNA, 19 bp, Homo sapiens
cacagtggcgggcccactc

SEQ ID NO: 4389315 - DNA, 20 bp, Homo sapiens
cacagtggctcacacctgta

SEQ ID NO: 4389316 - DNA, 20 bp, Homo sapiens
cacagtgtaatccaggggtg

SEQ ID NO: 4389317 - DNA, 22 bp, Homo sapiens
cacagttaaataaatagaaaga

SEQ ID NO: 4389318 - DNA, 18 bp, Homo sapiens
cacagttcaacataaaga

SEQ ID NO: 4389319 - DNA, 18 bp, Homo sapiens
cacagttcttggtgactg

SEQ ID NO: 4389320 - DNA, 22 bp, Homo sapiens
cacagttcttggtgactgtccc

SEQ ID NO: 4389321 - DNA, 18 bp, Homo sapiens
cacagttgaagggagggg

SEQ ID NO: 4389322 - DNA, 18 bp, Homo sapiens
cacagtttagaacagagg

SEQ ID NO: 4389323 - DNA, 20 bp, Homo sapiens
cacagtttagaacagaggga

SEQ ID NO: 4389324 - DNA, 19 bp, Homo sapiens
cacagttttaataagaaca

SEQ ID NO: 4389325 - DNA, 14 bp, Homo sapiens
cacagttttctgag

SEQ ID NO: 4389326 - DNA, 16 bp, Homo sapiens
cacataaattttaatt

SEQ ID NO: 4389327 - DNA, 19 bp, Homo sapiens
cacataaattttaattcaa

SEQ ID NO: 4389328 - DNA, 14 bp, Homo sapiens
cacataagcactag

SEQ ID NO: 4389329 - DNA, 19 bp, Homo sapiens
cacataagcccagttcatc

SEQ ID NO: 4389330 - DNA, 17 bp, Homo sapiens
cacatagagctttttaa

SEQ ID NO: 4389331 - DNA, 14 bp, Homo sapiens
cacatagattcacc

SEQ ID NO: 4389332 - DNA, 21 bp, Homo sapiens
cacatagcaggggcaccttcc

SEQ ID NO: 4389333 - DNA, 22 bp, Homo sapiens
cacatagttctgtaataaaact

SEQ ID NO: 4389334 - DNA, 15 bp, Homo sapiens
cacatatacatatga

SEQ ID NO: 4389335 - DNA, 18 bp, Homo sapiens
cacatatcaaactgaaac

SEQ ID NO: 4389336 - DNA, 12 bp, Homo sapiens
cacatattttaa

SEQ ID NO: 4389337 - DNA, 14 bp, Homo sapiens
cacatattttaaaa

SEQ ID NO: 4389338 - DNA, 19 bp, Homo sapiens
cacatcacacccatttaaa

SEQ ID NO: 4389339 - DNA, 14 bp, Homo sapiens
cacatcctccgtcc

SEQ ID NO: 4389340 - DNA, 18 bp, Homo sapiens
cacatctaaagctttatc

SEQ ID NO: 4389341 - DNA, 23 bp, Homo sapiens
cacatctaaagctttatctttgt

SEQ ID NO: 4389342 - DNA, 17 bp, Homo sapiens
cacatctaacctcatct

SEQ ID NO: 4389343 - DNA, 17 bp, Homo sapiens
cacatctacatgccatg

SEQ ID NO: 4389344 - DNA, 16 bp, Homo sapiens
cacatctctctgccct

SEQ ID NO: 4389345 - DNA, 12 bp, Homo sapiens
cacatctgcctt

SEQ ID NO: 4389346 - DNA, 13 bp, Homo sapiens
cacatctgcctta

SEQ ID NO: 4389347 - DNA, 12 bp, Homo sapiens
cacatcttaaaa

SEQ ID NO: 4389348 - DNA, 16 bp, Homo sapiens
cacatcttatttattt

SEQ ID NO: 4389349 - DNA, 15 bp, Homo sapiens
cacatgaaaaatttt

SEQ ID NO: 4389350 - DNA, 15 bp, Homo sapiens
cacatgaggccatct

SEQ ID NO: 4389351 - DNA, 16 bp, Homo sapiens
cacatgaggccatctc

SEQ ID NO: 4389352 - DNA, 21 bp, Homo sapiens
cacatgaggccatctcaggag

SEQ ID NO: 4389353 - DNA, 20 bp, Homo sapiens
cacatgcatacttacagact

SEQ ID NO: 4389354 - DNA, 18 bp, Homo sapiens
cacatgcatgtctgccta

SEQ ID NO: 4389355 - DNA, 14 bp, Homo sapiens
cacatgccccaggc

SEQ ID NO: 4389356 - DNA, 14 bp, Homo sapiens
cacatgcctgcgcc

SEQ ID NO: 4389357 - DNA, 17 bp, Homo sapiens
cacatgctgtctggccc

SEQ ID NO: 4389358 - DNA, 21 bp, Homo sapiens
cacatgctgtctggccctggg

SEQ ID NO: 4389359 - DNA, 23 bp, Homo sapiens
cacatgggagcagtccatgcatg

SEQ ID NO: 4389360 - DNA, 14 bp, Homo sapiens
cacatggtaacatt

SEQ ID NO: 4389361 - DNA, 15 bp, Homo sapiens
cacatggtgtctccc

SEQ ID NO: 4389362 - DNA, 16 bp, Homo sapiens
cacattaaaaaggaaa

SEQ ID NO: 4389363 - DNA, 13 bp, Homo sapiens
cacattctgcctt

SEQ ID NO: 4389364 - DNA, 13 bp, Homo sapiens
cacattcttggct

SEQ ID NO: 4389365 - DNA, 16 bp, Homo sapiens
cacattgcccctctgc

SEQ ID NO: 4389366 - DNA, 17 bp, Homo sapiens
cacattgcccctctgcc

SEQ ID NO: 4389367 - DNA, 22 bp, Homo sapiens
cacattgggtggggctcctggg

SEQ ID NO: 4389368 - DNA, 17 bp, Homo sapiens
cacattgttcaactccc

SEQ ID NO: 4389369 - DNA, 16 bp, Homo sapiens
cacatttcttaaaaca

SEQ ID NO: 4389370 - DNA, 19 bp, Homo sapiens
cacatttcttaaaacacat

SEQ ID NO: 4389371 - DNA, 20 bp, Homo sapiens
cacatttcttaaaacacatg

SEQ ID NO: 4389372 - DNA, 16 bp, Homo sapiens
cacatttggaatactt

SEQ ID NO: 4389373 - DNA, 19 bp, Homo sapiens
cacatttggaatacttttt

SEQ ID NO: 4389374 - DNA, 13 bp, Homo sapiens
cacattttatgag

SEQ ID NO: 4389375 - DNA, 15 bp, Homo sapiens
cacattttatgagag

SEQ ID NO: 4389376 - DNA, 19 bp, Homo sapiens
cacatttttggatttctgt

SEQ ID NO: 4389377 - DNA, 20 bp, Homo sapiens
caccaactgaattaaactta

SEQ ID NO: 4389378 - DNA, 16 bp, Homo sapiens
caccaacttacaaaaa

SEQ ID NO: 4389379 - DNA, 15 bp, Homo sapiens
caccaagtgcaatag

SEQ ID NO: 4389380 - DNA, 14 bp, Homo sapiens
caccaatcagcgct

SEQ ID NO: 4389381 - DNA, 15 bp, Homo sapiens
caccaatgaaaacat

SEQ ID NO: 4389382 - DNA, 21 bp, Homo sapiens
caccaatgccgccgtgtttcc

SEQ ID NO: 4389383 - DNA, 23 bp, Homo sapiens
caccaatgccgccgtgtttcctc

SEQ ID NO: 4389384 - DNA, 15 bp, Homo sapiens
caccaattaaaaacc

SEQ ID NO: 4389385 - DNA, 17 bp, Homo sapiens
caccaattaaaaacctt

SEQ ID NO: 4389386 - DNA, 18 bp, Homo sapiens
caccacaaacacagccct

SEQ ID NO: 4389387 - DNA, 23 bp, Homo sapiens
caccacaactaacaatgccttgt

SEQ ID NO: 4389388 - DNA, 13 bp, Homo sapiens
caccacatgctat

SEQ ID NO: 4389389 - DNA, 15 bp, Homo sapiens
caccacatgctattg

SEQ ID NO: 4389390 - DNA, 22 bp, Homo sapiens
caccaccagggctccaggagcc

SEQ ID NO: 4389391 - DNA, 16 bp, Homo sapiens
caccaccccctgtccc

SEQ ID NO: 4389392 - DNA, 17 bp, Homo sapiens
caccaccccctgtccca

SEQ ID NO: 4389393 - DNA, 23 bp, Homo sapiens
caccacctaggccactcctccaa

SEQ ID NO: 4389394 - DNA, 16 bp, Homo sapiens
caccaccttcccagct

SEQ ID NO: 4389395 - DNA, 18 bp, Homo sapiens
caccaccttcccagctct

SEQ ID NO: 4389396 - DNA, 22 bp, Homo sapiens
caccacgatgtggccctggcct

SEQ ID NO: 4389397 - DNA, 16 bp, Homo sapiens
caccactaaccatccc

SEQ ID NO: 4389398 - DNA, 22 bp, Homo sapiens
caccactaaccatccccaactc

SEQ ID NO: 4389399 - DNA, 17 bp, Homo sapiens
caccactaccagccagc

SEQ ID NO: 4389400 - DNA, 22 bp, Homo sapiens
cacccgccgcctcccacggcac

SEQ ID NO: 4389401 - DNA, 15 bp, Homo sapiens
cacccggcccggctg

SEQ ID NO: 4389402 - DNA, 20 bp, Homo sapiens
cacccgggggagcccagtga

SEQ ID NO: 4389403 - DNA, 20 bp, Homo sapiens
caccctagtcccttcccctc

SEQ ID NO: 4389404 - DNA, 14 bp, Homo sapiens
caccctcagggagc

SEQ ID NO: 4389405 - DNA, 16 bp, Homo sapiens
caccctccagagacaa

SEQ ID NO: 4389406 - DNA, 14 bp, Homo sapiens
caccctccatgctc

SEQ ID NO: 4389407 - DNA, 19 bp, Homo sapiens
caccctccattctgcactc

SEQ ID NO: 4389408 - DNA, 14 bp, Homo sapiens
caccctccctccag

SEQ ID NO: 4389409 - DNA, 15 bp, Homo sapiens
caccctccctggagt

SEQ ID NO: 4389410 - DNA, 22 bp, Homo sapiens
caccctcctgtcttcccagggt

SEQ ID NO: 4389411 - DNA, 14 bp, Homo sapiens
caccctctcttggt

SEQ ID NO: 4389412 - DNA, 13 bp, Homo sapiens
caccctctgagct

SEQ ID NO: 4389413 - DNA, 18 bp, Homo sapiens
caccctctgagctttgca

SEQ ID NO: 4389414 - DNA, 14 bp, Homo sapiens
caccctgagccggc

SEQ ID NO: 4389415 - DNA, 13 bp, Homo sapiens
caccctgctgaga

SEQ ID NO: 4389416 - DNA, 12 bp, Homo sapiens
caccctggcctg

SEQ ID NO: 4389417 - DNA, 13 bp, Homo sapiens
caccctggcctga

SEQ ID NO: 4389418 - DNA, 21 bp, Homo sapiens
caccctggcctgaactgagga

SEQ ID NO: 4389419 - DNA, 15 bp, Homo sapiens
caccctgggagccag

SEQ ID NO: 4389420 - DNA, 16 bp, Homo sapiens
caccctgggccacgcc

SEQ ID NO: 4389421 - DNA, 16 bp, Homo sapiens
caccctgtcctgcaca

SEQ ID NO: 4389422 - DNA, 23 bp, Homo sapiens
caccctgtcctgcacaccctggg

SEQ ID NO: 4389423 - DNA, 14 bp, Homo sapiens
cacccttaatcttc

SEQ ID NO: 4389424 - DNA, 15 bp, Homo sapiens
cacccttccacagct

SEQ ID NO: 4389425 - DNA, 18 bp, Homo sapiens
cacccttccacagctggc

SEQ ID NO: 4389426 - DNA, 20 bp, Homo sapiens
cacccttcccggcccccggc

SEQ ID NO: 4389427 - DNA, 23 bp, Homo sapiens
cacccttggcctgtctcatcccc

SEQ ID NO: 4389428 - DNA, 15 bp, Homo sapiens
cacccttttccagct

SEQ ID NO: 4389429 - DNA, 21 bp, Homo sapiens
cacccttttccagctggatga

SEQ ID NO: 4389430 - DNA, 22 bp, Homo sapiens
caccgaagtggactggcccctg

SEQ ID NO: 4389431 - DNA, 15 bp, Homo sapiens
caccgagactcagcc

SEQ ID NO: 4389432 - DNA, 18 bp, Homo sapiens
caccgagactcagcctct

SEQ ID NO: 4389433 - DNA, 20 bp, Homo sapiens
caccgagactcagcctctgc

SEQ ID NO: 4389434 - DNA, 21 bp, Homo sapiens
caccgagactcagcctctgct

SEQ ID NO: 4389435 - DNA, 22 bp, Homo sapiens
caccgagactcagcctctgctg

SEQ ID NO: 4389436 - DNA, 22 bp, Homo sapiens
caccgagcgggtgcaagcactc

SEQ ID NO: 4389437 - DNA, 15 bp, Homo sapiens
caccgaggttcccag

SEQ ID NO: 4389438 - DNA, 19 bp, Homo sapiens
caccgccacgtcccagcat

SEQ ID NO: 4389439 - DNA, 19 bp, Homo sapiens
caccgccccttctccaaca

SEQ ID NO: 4389440 - DNA, 17 bp, Homo sapiens
caccgcctgaaggcaca

SEQ ID NO: 4389441 - DNA, 22 bp, Homo sapiens
caccgctgcctaagtggctgct

SEQ ID NO: 4389442 - DNA, 12 bp, Homo sapiens
caccgctgcctc

SEQ ID NO: 4389443 - DNA, 14 bp, Homo sapiens
caccgctgcctcgt

SEQ ID NO: 4389444 - DNA, 16 bp, Homo sapiens
caccgctggttggaaa

SEQ ID NO: 4389445 - DNA, 17 bp, Homo sapiens
caccggaactgggctgg

SEQ ID NO: 4389446 - DNA, 18 bp, Homo sapiens
caccggcctgtgggtctc

SEQ ID NO: 4389447 - DNA, 19 bp, Homo sapiens
caccggcctgtgggtctct

SEQ ID NO: 4389448 - DNA, 20 bp, Homo sapiens
caccggcctgtgggtctctg

SEQ ID NO: 4389449 - DNA, 22 bp, Homo sapiens
caccggcctgtgggtctctgaa

SEQ ID NO: 4389450 - DNA, 14 bp, Homo sapiens
caccggtcagtgcc

SEQ ID NO: 4389451 - DNA, 24 bp, Homo sapiens
caccgtgcccagccctaaacatca

SEQ ID NO: 4389452 - DNA, 12 bp, Homo sapiens
cacctaaagaaa

SEQ ID NO: 4389453 - DNA, 14 bp, Homo sapiens
cacctaaccccagg

SEQ ID NO: 4389454 - DNA, 17 bp, Homo sapiens
cacctaaccccagggca

SEQ ID NO: 4389455 - DNA, 18 bp, Homo sapiens
cacctaaccccagggcac

SEQ ID NO: 4389456 - DNA, 19 bp, Homo sapiens
cacctaagcacttctagaa

SEQ ID NO: 4389457 - DNA, 16 bp, Homo sapiens
cacctacagtgtacag

SEQ ID NO: 4389458 - DNA, 17 bp, Homo sapiens
cacctacagtgtacagt

SEQ ID NO: 4389459 - DNA, 15 bp, Homo sapiens
cacctactctcaggt

SEQ ID NO: 4389460 - DNA, 17 bp, Homo sapiens
cacctactctcaggttt

SEQ ID NO: 4389461 - DNA, 22 bp, Homo sapiens
cacctagctttttgcagataac

SEQ ID NO: 4389462 - DNA, 19 bp, Homo sapiens
cacctaggctagggtgggg

SEQ ID NO: 4389463 - DNA, 14 bp, Homo sapiens
cacctatctcagcc

SEQ ID NO: 4389464 - DNA, 23 bp, Homo sapiens
cacctatgcctgtggtgaagtgt

SEQ ID NO: 4389465 - DNA, 14 bp, Homo sapiens
cacctatttaatgt

SEQ ID NO: 4389466 - DNA, 11 bp, Homo sapiens
cacctcagttc

SEQ ID NO: 4389467 - DNA, 17 bp, Homo sapiens
cacctcagttcccttgg

SEQ ID NO: 4389468 - DNA, 18 bp, Homo sapiens
cacctcagttcccttggc

SEQ ID NO: 4389469 - DNA, 14 bp, Homo sapiens
cacctcatgcccac

SEQ ID NO: 4389470 - DNA, 20 bp, Homo sapiens
cacctcatgcccaccccctg

SEQ ID NO: 4389471 - DNA, 19 bp, Homo sapiens
cacctccaagcatttcatg

SEQ ID NO: 4389472 - DNA, 12 bp, Homo sapiens
cacctccccaaa

SEQ ID NO: 4389473 - DNA, 14 bp, Homo sapiens
cacctccccaaagc

SEQ ID NO: 4389474 - DNA, 13 bp, Homo sapiens
cacctccccctgc

SEQ ID NO: 4389475 - DNA, 17 bp, Homo sapiens
cacctccccctgcgccc

SEQ ID NO: 4389476 - DNA, 21 bp, Homo sapiens
cacctccccctgcgccccgca

SEQ ID NO: 4389477 - DNA, 18 bp, Homo sapiens
cacctcccctatccaccc

SEQ ID NO: 4389478 - DNA, 18 bp, Homo sapiens
cacctccctgctcagtgc

SEQ ID NO: 4389479 - DNA, 22 bp, Homo sapiens
cacctccctgctcagtgcttgg

SEQ ID NO: 4389480 - DNA, 23 bp, Homo sapiens
cacctccctgctcagtgcttggg

SEQ ID NO: 4389481 - DNA, 13 bp, Homo sapiens
cacctcctaccct

SEQ ID NO: 4389482 - DNA, 17 bp, Homo sapiens
cacctcctctgtgattt

SEQ ID NO: 4389483 - DNA, 20 bp, Homo sapiens
cacctcggggacaccagagc

SEQ ID NO: 4389484 - DNA, 14 bp, Homo sapiens
cacctctcagctgc

SEQ ID NO: 4389485 - DNA, 17 bp, Homo sapiens
cacctctcagctgctgg

SEQ ID NO: 4389486 - DNA, 17 bp, Homo sapiens
cacctctcctgccctgt

SEQ ID NO: 4389487 - DNA, 12 bp, Homo sapiens
cacctctgccag

SEQ ID NO: 4389488 - DNA, 13 bp, Homo sapiens
cacctctgcctca

SEQ ID NO: 4389489 - DNA, 17 bp, Homo sapiens
cacctgaaccccagagg

SEQ ID NO: 4389490 - DNA, 20 bp, Homo sapiens
cacctgaaccccagaggcag

SEQ ID NO: 4389491 - DNA, 13 bp, Homo sapiens
cacctgaactgaa

SEQ ID NO: 4389492 - DNA, 19 bp, Homo sapiens
cacctgaactgaacaccat

SEQ ID NO: 4389493 - DNA, 15 bp, Homo sapiens
cacctgaagggtgga

SEQ ID NO: 4389494 - DNA, 16 bp, Homo sapiens
cacctgacacaccagg

SEQ ID NO: 4389495 - DNA, 13 bp, Homo sapiens
cacctgaggtcag

SEQ ID NO: 4389496 - DNA, 12 bp, Homo sapiens
cacctgcacatt

SEQ ID NO: 4389497 - DNA, 14 bp, Homo sapiens
cacctgcacctccc

SEQ ID NO: 4389498 - DNA, 17 bp, Homo sapiens
cacctgcacctcccccc

SEQ ID NO: 4389499 - DNA, 21 bp, Homo sapiens
cacctgcactaacagagtggc

SEQ ID NO: 4389500 - DNA, 18 bp, Homo sapiens
cacctgcccatcacaggg

SEQ ID NO: 4389501 - DNA, 22 bp, Homo sapiens
cacctgcccttttttctgcctc

SEQ ID NO: 4389502 - DNA, 13 bp, Homo sapiens
cacctgccgacct

SEQ ID NO: 4389503 - DNA, 21 bp, Homo sapiens
cacctgccgacctcgtcctcc

SEQ ID NO: 4389504 - DNA, 14 bp, Homo sapiens
cacctgccgccctg

SEQ ID NO: 4389505 - DNA, 18 bp, Homo sapiens
cacctgccttggcctccc

SEQ ID NO: 4389506 - DNA, 22 bp, Homo sapiens
cacctgctcccagtcctgcctg

SEQ ID NO: 4389507 - DNA, 20 bp, Homo sapiens
caagtcatttttgtattttt

SEQ ID NO: 4389508 - DNA, 15 bp, Homo sapiens
caagtcatttttgtt

SEQ ID NO: 4389509 - DNA, 14 bp, Homo sapiens
caagtccagctggg

SEQ ID NO: 4389510 - DNA, 13 bp, Homo sapiens
caagtcccaccct

SEQ ID NO: 4389511 - DNA, 19 bp, Homo sapiens
caagtccgcagaagccctg

SEQ ID NO: 4389512 - DNA, 19 bp, Homo sapiens
caagtctgcatttcatatt

SEQ ID NO: 4389513 - DNA, 22 bp, Homo sapiens
caagtctgcatttcatattatt

SEQ ID NO: 4389514 - DNA, 21 bp, Homo sapiens
caagtctgccgattttgtaaa

SEQ ID NO: 4389515 - DNA, 13 bp, Homo sapiens
caagtctggatct

SEQ ID NO: 4389516 - DNA, 18 bp, Homo sapiens
caagtctggcaccatgtt

SEQ ID NO: 4389517 - DNA, 19 bp, Homo sapiens
caagtgaggtgtgtcacaa

SEQ ID NO: 4389518 - DNA, 17 bp, Homo sapiens
caagtgcagagttcaga

SEQ ID NO: 4389519 - DNA, 19 bp, Homo sapiens
caagtgcatgctctctgca

SEQ ID NO: 4389520 - DNA, 15 bp, Homo sapiens
caagtgccaaacaga

SEQ ID NO: 4389521 - DNA, 17 bp, Homo sapiens
caagtgccgcaaattgt

SEQ ID NO: 4389522 - DNA, 21 bp, Homo sapiens
caagtgcctagactgttactt

SEQ ID NO: 4389523 - DNA, 21 bp, Homo sapiens
caagtgcctgcaccaggggtg

SEQ ID NO: 4389524 - DNA, 20 bp, Homo sapiens
caagtgggatctgtcacacc

SEQ ID NO: 4389525 - DNA, 13 bp, Homo sapiens
caagtgggggcag

SEQ ID NO: 4389526 - DNA, 15 bp, Homo sapiens
caagtggggtgctgg

SEQ ID NO: 4389527 - DNA, 16 bp, Homo sapiens
caagtgtaaaatattt

SEQ ID NO: 4389528 - DNA, 21 bp, Homo sapiens
caagtgtaaaatattttgaat

SEQ ID NO: 4389529 - DNA, 16 bp, Homo sapiens
caagtgtgctaaaaat

SEQ ID NO: 4389530 - DNA, 19 bp, Homo sapiens
caagtgtgctaaaaatgag

SEQ ID NO: 4389531 - DNA, 15 bp, Homo sapiens
caagtgtggaggaga

SEQ ID NO: 4389532 - DNA, 18 bp, Homo sapiens
caagtgttaggtcaataa

SEQ ID NO: 4389533 - DNA, 21 bp, Homo sapiens
caagttccttggccatgcaga

SEQ ID NO: 4389534 - DNA, 20 bp, Homo sapiens
caagttgaaaaatagcatat

SEQ ID NO: 4389535 - DNA, 15 bp, Homo sapiens
caagttgctaataca

SEQ ID NO: 4389536 - DNA, 12 bp, Homo sapiens
caagttgctctg

SEQ ID NO: 4389537 - DNA, 21 bp, Homo sapiens
caagttgtgacagtcactgca

SEQ ID NO: 4389538 - DNA, 18 bp, Homo sapiens
caagttgtgcttgagcca

SEQ ID NO: 4389539 - DNA, 16 bp, Homo sapiens
caagttgttgactgtg

SEQ ID NO: 4389540 - DNA, 21 bp, Homo sapiens
caagttttaaacccaaaatat

SEQ ID NO: 4389541 - DNA, 14 bp, Homo sapiens
caagttttaaagtt

SEQ ID NO: 4389542 - DNA, 15 bp, Homo sapiens
caagttttagttaaa

SEQ ID NO: 4389543 - DNA, 18 bp, Homo sapiens
caagttttagttaaaact

SEQ ID NO: 4389544 - DNA, 21 bp, Homo sapiens
caagttttgtttcctcattga

SEQ ID NO: 4389545 - DNA, 17 bp, Homo sapiens
caagtttttatagttat

SEQ ID NO: 4389546 - DNA, 22 bp, Homo sapiens
caagtttttatagttattaaat

SEQ ID NO: 4389547 - DNA, 15 bp, Homo sapiens
caagtttttcatact

SEQ ID NO: 4389548 - DNA, 17 bp, Homo sapiens
caagtttttcatactgt

SEQ ID NO: 4389549 - DNA, 20 bp, Homo sapiens
caagtttttcatactgtaca

SEQ ID NO: 4389550 - DNA, 21 bp, Homo sapiens
caagtttttcatactgtacac

SEQ ID NO: 4389551 - DNA, 19 bp, Homo sapiens
caataaaaacattttgaag

SEQ ID NO: 4389552 - DNA, 20 bp, Homo sapiens
caataaaaacattttgaagt

SEQ ID NO: 4389553 - DNA, 22 bp, Homo sapiens
caataaaaacattttgaagtgt

SEQ ID NO: 4389554 - DNA, 20 bp, Homo sapiens
caataaaaatgtttaacggt

SEQ ID NO: 4389555 - DNA, 20 bp, Homo sapiens
caataaaagcaattccaacc

SEQ ID NO: 4389556 - DNA, 21 bp, Homo sapiens
caataaaatattattgaacta

SEQ ID NO: 4389557 - DNA, 12 bp, Homo sapiens
caataaaatgta

SEQ ID NO: 4389558 - DNA, 13 bp, Homo sapiens
caataaaatgtat

SEQ ID NO: 4389559 - DNA, 17 bp, Homo sapiens
caataaaattatttgca

SEQ ID NO: 4389560 - DNA, 19 bp, Homo sapiens
caataaaattatttgcagg

SEQ ID NO: 4389561 - DNA, 16 bp, Homo sapiens
caataaaattctgtaa

SEQ ID NO: 4389562 - DNA, 17 bp, Homo sapiens
caataaaattctgtaat

SEQ ID NO: 4389563 - DNA, 18 bp, Homo sapiens
caataaaattctgtaatt

SEQ ID NO: 4389564 - DNA, 18 bp, Homo sapiens
caataaaatttttttaaa

SEQ ID NO: 4389565 - DNA, 20 bp, Homo sapiens
caataaaatttttttaaagt

SEQ ID NO: 4389566 - DNA, 14 bp, Homo sapiens
caataaacagctcc

SEQ ID NO: 4389567 - DNA, 15 bp, Homo sapiens
caataaacagctccc

SEQ ID NO: 4389568 - DNA, 13 bp, Homo sapiens
caataaacagtca

SEQ ID NO: 4389569 - DNA, 18 bp, Homo sapiens
caataaacagtcactgga

SEQ ID NO: 4389570 - DNA, 12 bp, Homo sapiens
caataaaccagt

SEQ ID NO: 4389571 - DNA, 19 bp, Homo sapiens
caataaaccagtgtgaacc

SEQ ID NO: 4389572 - DNA, 19 bp, Homo sapiens
caataaaccctcagagcct

SEQ ID NO: 4389573 - DNA, 11 bp, Homo sapiens
caataaagcct

SEQ ID NO: 4389574 - DNA, 15 bp, Homo sapiens
caataaagcctgact

SEQ ID NO: 4389575 - DNA, 18 bp, Homo sapiens
caataaagcctgacttca

SEQ ID NO: 4389576 - DNA, 14 bp, Homo sapiens
caataaagcctttt

SEQ ID NO: 4389577 - DNA, 12 bp, Homo sapiens
caataaaggcag

SEQ ID NO: 4389578 - DNA, 24 bp, Homo sapiens
caataaaggcagctgcctctgctc

SEQ ID NO: 4389579 - DNA, 13 bp, Homo sapiens
caataaagggaga

SEQ ID NO: 4389580 - DNA, 18 bp, Homo sapiens
caataaagtataatgttt

SEQ ID NO: 4389581 - DNA, 20 bp, Homo sapiens
caataaagtataatgtttat

SEQ ID NO: 4389582 - DNA, 18 bp, Homo sapiens
caataaagtgccttctgg

SEQ ID NO: 4389583 - DNA, 17 bp, Homo sapiens
caataaagttattcaga

SEQ ID NO: 4389584 - DNA, 17 bp, Homo sapiens
caataaataaatgtttt

SEQ ID NO: 4389585 - DNA, 20 bp, Homo sapiens
caataaataaatgttttagt

SEQ ID NO: 4389586 - DNA, 14 bp, Homo sapiens
caataaatccacac

SEQ ID NO: 4389587 - DNA, 19 bp, Homo sapiens
caataaatgttttaatgct

SEQ ID NO: 4389588 - DNA, 13 bp, Homo sapiens
caataaattgcta

SEQ ID NO: 4389589 - DNA, 22 bp, Homo sapiens
caataaattgctaatgttgctg

SEQ ID NO: 4389590 - DNA, 20 bp, Homo sapiens
caacttagatctctcctgca

SEQ ID NO: 4389591 - DNA, 17 bp, Homo sapiens
caacttcaccaccccct

SEQ ID NO: 4389592 - DNA, 20 bp, Homo sapiens
caacttcccattaaaaatga

SEQ ID NO: 4389593 - DNA, 19 bp, Homo sapiens
caacttctcttgctttcta

SEQ ID NO: 4389594 - DNA, 22 bp, Homo sapiens
caacttctgcctcccatgctta

SEQ ID NO: 4389595 - DNA, 19 bp, Homo sapiens
caacttgcaatttgcaagg

SEQ ID NO: 4389596 - DNA, 15 bp, Homo sapiens
caacttgcttctaaa

SEQ ID NO: 4389597 - DNA, 16 bp, Homo sapiens
caacttgtatttccaa

SEQ ID NO: 4389598 - DNA, 22 bp, Homo sapiens
caactttgaataaagaatactt

SEQ ID NO: 4389599 - DNA, 23 bp, Homo sapiens
caacttttcttggaactgtccca

SEQ ID NO: 4389600 - DNA, 19 bp, Homo sapiens
caactttttattgccttct

SEQ ID NO: 4389601 - DNA, 16 bp, Homo sapiens
caagaaacctgactca

SEQ ID NO: 4389602 - DNA, 17 bp, Homo sapiens
caagaaagctattccaa

SEQ ID NO: 4389603 - DNA, 17 bp, Homo sapiens
caagaaaggaaaccttt

SEQ ID NO: 4389604 - DNA, 15 bp, Homo sapiens
caagaaatgaaagca

SEQ ID NO: 4389605 - DNA, 10 bp, Homo sapiens
caagaaatgg

SEQ ID NO: 4389606 - DNA, 14 bp, Homo sapiens
caagaagcagtggc

SEQ ID NO: 4389607 - DNA, 16 bp, Homo sapiens
caagaagttaaaaaac

SEQ ID NO: 4389608 - DNA, 18 bp, Homo sapiens
caagaataatcacgcttt

SEQ ID NO: 4389609 - DNA, 18 bp, Homo sapiens
caagaatatggaggctgg

SEQ ID NO: 4389610 - DNA, 14 bp, Homo sapiens
caagaatcagaaga

SEQ ID NO: 4389611 - DNA, 16 bp, Homo sapiens
caagaatcagaagaaa

SEQ ID NO: 4389612 - DNA, 19 bp, Homo sapiens
caagaatcagaagaaaggc

SEQ ID NO: 4389613 - DNA, 18 bp, Homo sapiens
caagaatctagaagatgt

SEQ ID NO: 4389614 - DNA, 19 bp, Homo sapiens
caagaatctagaagatgtg

SEQ ID NO: 4389615 - DNA, 17 bp, Homo sapiens
caagacagatgagcagg

SEQ ID NO: 4389616 - DNA, 22 bp, Homo sapiens
caagacagatgagcaggagctt

SEQ ID NO: 4389617 - DNA, 22 bp, Homo sapiens
caagacagatgccccagagctg

SEQ ID NO: 4389618 - DNA, 15 bp, Homo sapiens
caagacagcagcagc

SEQ ID NO: 4389619 - DNA, 16 bp, Homo sapiens
caagacagcagcagcc

SEQ ID NO: 4389620 - DNA, 17 bp, Homo sapiens
caagacagcagcagcct

SEQ ID NO: 4389621 - DNA, 22 bp, Homo sapiens
caagacagcagcagcctgcacc

SEQ ID NO: 4389622 - DNA, 14 bp, Homo sapiens
caagacatgtctgt

SEQ ID NO: 4389623 - DNA, 12 bp, Homo sapiens
caagacatttct

SEQ ID NO: 4389624 - DNA, 16 bp, Homo sapiens
caagacatttctttct

SEQ ID NO: 4389625 - DNA, 19 bp, Homo sapiens
caagacccaaaaggcagaa

SEQ ID NO: 4389626 - DNA, 23 bp, Homo sapiens
caagaccccaagaggaagttcag

SEQ ID NO: 4389627 - DNA, 13 bp, Homo sapiens
caagacccccagc

SEQ ID NO: 4389628 - DNA, 16 bp, Homo sapiens
caagacccccagcact

SEQ ID NO: 4389629 - DNA, 20 bp, Homo sapiens
caagacccccatttgtccca

SEQ ID NO: 4389630 - DNA, 21 bp, Homo sapiens
caagacccccatttgtcccag

SEQ ID NO: 4389631 - DNA, 17 bp, Homo sapiens
caagacctcagtgcctt

SEQ ID NO: 4389632 - DNA, 16 bp, Homo sapiens
caagacctcatctcta

SEQ ID NO: 4389633 - DNA, 17 bp, Homo sapiens
caagactagcctggcca

SEQ ID NO: 4389634 - DNA, 18 bp, Homo sapiens
caagactatctacaaaaa

SEQ ID NO: 4389635 - DNA, 19 bp, Homo sapiens
caagactatctacaaaaat

SEQ ID NO: 4389636 - DNA, 18 bp, Homo sapiens
caagactcccatgaggga

SEQ ID NO: 4389637 - DNA, 22 bp, Homo sapiens
caagactccctcgtcgagctgg

SEQ ID NO: 4389638 - DNA, 13 bp, Homo sapiens
caagactgggccc

SEQ ID NO: 4389639 - DNA, 18 bp, Homo sapiens
caagagaaaattcctaga

SEQ ID NO: 4389640 - DNA, 12 bp, Homo sapiens
caagagaactaa

SEQ ID NO: 4389641 - DNA, 23 bp, Homo sapiens
caagagagcgagaccctgtctca

SEQ ID NO: 4389642 - DNA, 13 bp, Homo sapiens
caagagataactg

SEQ ID NO: 4389643 - DNA, 12 bp, Homo sapiens
caagagatctac

SEQ ID NO: 4389644 - DNA, 15 bp, Homo sapiens
caagagatctacaca

SEQ ID NO: 4389645 - DNA, 16 bp, Homo sapiens
caagagcagcctgtgg

SEQ ID NO: 4389646 - DNA, 19 bp, Homo sapiens
caagagctacataatttag

SEQ ID NO: 4389647 - DNA, 19 bp, Homo sapiens
caagagctactcccacagc

SEQ ID NO: 4389648 - DNA, 13 bp, Homo sapiens
caagagctgccct

SEQ ID NO: 4389649 - DNA, 16 bp, Homo sapiens
caagagctgccctcct

SEQ ID NO: 4389650 - DNA, 22 bp, Homo sapiens
caagaggaatctgtttctctgc

SEQ ID NO: 4389651 - DNA, 19 bp, Homo sapiens
caagaggattgtaaaatgc

SEQ ID NO: 4389652 - DNA, 20 bp, Homo sapiens
caagaggcaagctgaaattt

SEQ ID NO: 4389653 - DNA, 22 bp, Homo sapiens
caagaggccacttagggaaaga

SEQ ID NO: 4389654 - DNA, 17 bp, Homo sapiens
caagagggcaagcctct

SEQ ID NO: 4389655 - DNA, 21 bp, Homo sapiens
caagaggggcgggctcagagc

SEQ ID NO: 4389656 - DNA, 18 bp, Homo sapiens
caagagggttcacacagc

SEQ ID NO: 4389657 - DNA, 12 bp, Homo sapiens
caagaggtctga

SEQ ID NO: 4389658 - DNA, 20 bp, Homo sapiens
caagaggtctgagccctggt

SEQ ID NO: 4389659 - DNA, 21 bp, Homo sapiens
caagagtatgtggcaaaacat

SEQ ID NO: 4389660 - DNA, 20 bp, Homo sapiens
caagagtctaatagtctttg

SEQ ID NO: 4389661 - DNA, 18 bp, Homo sapiens
caagagtctgtctcaaaa

SEQ ID NO: 4389662 - DNA, 22 bp, Homo sapiens
caagagtgagatgtagaaagtt

SEQ ID NO: 4389663 - DNA, 12 bp, Homo sapiens
caagagttaaac

SEQ ID NO: 4389664 - DNA, 18 bp, Homo sapiens
caacatcccattgccctg

SEQ ID NO: 4389665 - DNA, 19 bp, Homo sapiens
caacatcccattgccctgg

SEQ ID NO: 4389666 - DNA, 13 bp, Homo sapiens
caacatcttttct

SEQ ID NO: 4389667 - DNA, 23 bp, Homo sapiens
caacatgccagccactgtgatag

SEQ ID NO: 4389668 - DNA, 10 bp, Homo sapiens
caacatggga

SEQ ID NO: 4389669 - DNA, 18 bp, Homo sapiens
caacatgggagggatcag

SEQ ID NO: 4389670 - DNA, 20 bp, Homo sapiens
caacatgggagggatcagcc

SEQ ID NO: 4389671 - DNA, 22 bp, Homo sapiens
caacatgggagggatcagcccc

SEQ ID NO: 4389672 - DNA, 22 bp, Homo sapiens
caacatggtgaaacccccatct

SEQ ID NO: 4389673 - DNA, 18 bp, Homo sapiens
caacatgtggctcctccc

SEQ ID NO: 4389674 - DNA, 22 bp, Homo sapiens
caacatgttatttgtaatagat

SEQ ID NO: 4389675 - DNA, 13 bp, Homo sapiens
caacatgttcaga

SEQ ID NO: 4389676 - DNA, 16 bp, Homo sapiens
caacatgttcagaaaa

SEQ ID NO: 4389677 - DNA, 13 bp, Homo sapiens
caacatgtttctg

SEQ ID NO: 4389678 - DNA, 14 bp, Homo sapiens
caacattggacaga

SEQ ID NO: 4389679 - DNA, 21 bp, Homo sapiens
caacattggacagaaaatgca

SEQ ID NO: 4389680 - DNA, 13 bp, Homo sapiens
caacatttatgtg

SEQ ID NO: 4389681 - DNA, 20 bp, Homo sapiens
caacatttcttaaattattt

SEQ ID NO: 4389682 - DNA, 16 bp, Homo sapiens
caacatttttttttct

SEQ ID NO: 4389683 - DNA, 17 bp, Homo sapiens
caacatttttttttctc

SEQ ID NO: 4389684 - DNA, 21 bp, Homo sapiens
caacatttttttttctccata

SEQ ID NO: 4389685 - DNA, 15 bp, Homo sapiens
caaccaactgcccca

SEQ ID NO: 4389686 - DNA, 16 bp, Homo sapiens
caaccaatgtagaaag

SEQ ID NO: 4389687 - DNA, 12 bp, Homo sapiens
caaccatattta

SEQ ID NO: 4389688 - DNA, 16 bp, Homo sapiens
caaccatgtcatttca

SEQ ID NO: 4389689 - DNA, 15 bp, Homo sapiens
caacccaaggactga

SEQ ID NO: 4389690 - DNA, 19 bp, Homo sapiens
caacccaaggactgaggga

SEQ ID NO: 4389691 - DNA, 17 bp, Homo sapiens
caacccaataggagtct

SEQ ID NO: 4389692 - DNA, 14 bp, Homo sapiens
caacccaccatttc

SEQ ID NO: 4389693 - DNA, 18 bp, Homo sapiens
caacccaccatttctggg

SEQ ID NO: 4389694 - DNA, 12 bp, Homo sapiens
caacccagaatg

SEQ ID NO: 4389695 - DNA, 14 bp, Homo sapiens
caacccccacccca

SEQ ID NO: 4389696 - DNA, 23 bp, Homo sapiens
caacccccaccccacacttgttc

SEQ ID NO: 4389697 - DNA, 13 bp, Homo sapiens
caacccccatctc

SEQ ID NO: 4389698 - DNA, 14 bp, Homo sapiens
caaccccccagcac

SEQ ID NO: 4389699 - DNA, 18 bp, Homo sapiens
caaccccccagcactgag

SEQ ID NO: 4389700 - DNA, 20 bp, Homo sapiens
caaccccccagcactgagga

SEQ ID NO: 4389701 - DNA, 19 bp, Homo sapiens
caacccctccttccccaga

SEQ ID NO: 4389702 - DNA, 21 bp, Homo sapiens
caacccgtctggcccaccagg

SEQ ID NO: 4389703 - DNA, 11 bp, Homo sapiens
caaccctgacc

SEQ ID NO: 4389704 - DNA, 15 bp, Homo sapiens
caacccttacccctt

SEQ ID NO: 4389705 - DNA, 13 bp, Homo sapiens
caaccggctttgt

SEQ ID NO: 4389706 - DNA, 18 bp, Homo sapiens
caacctcacctcccgggt

SEQ ID NO: 4389707 - DNA, 16 bp, Homo sapiens
caacctcaccttcctg

SEQ ID NO: 4389708 - DNA, 19 bp, Homo sapiens
caacctcaccttcctgtgg

SEQ ID NO: 4389709 - DNA, 14 bp, Homo sapiens
caacctcagggctc

SEQ ID NO: 4389710 - DNA, 17 bp, Homo sapiens
caacctcagggctccca

SEQ ID NO: 4389711 - DNA, 19 bp, Homo sapiens
caacctcagggctcccagg

SEQ ID NO: 4389712 - DNA, 15 bp, Homo sapiens
caacctcagtaattt

SEQ ID NO: 4389713 - DNA, 18 bp, Homo sapiens
caacctcagtaatttaga

SEQ ID NO: 4389714 - DNA, 16 bp, Homo sapiens
caacctctttttcctc

SEQ ID NO: 4389715 - DNA, 20 bp, Homo sapiens
caacctctttttcctcctgg

SEQ ID NO: 4389716 - DNA, 23 bp, Homo sapiens
caacctctttttcctcctggaca

SEQ ID NO: 4389717 - DNA, 21 bp, Homo sapiens
caacctgaccaacatggagaa

SEQ ID NO: 4389718 - DNA, 12 bp, Homo sapiens
caacctgctctg

SEQ ID NO: 4389719 - DNA, 14 bp, Homo sapiens
caacctgctctgtc

SEQ ID NO: 4389720 - DNA, 18 bp, Homo sapiens
caacctgctctgtcccca

SEQ ID NO: 4389721 - DNA, 11 bp, Homo sapiens
caacctggaga

SEQ ID NO: 4389722 - DNA, 20 bp, Homo sapiens
caacctggggggcagtggtg

SEQ ID NO: 4389723 - DNA, 16 bp, Homo sapiens
caacctgtaaattatt

SEQ ID NO: 4389724 - DNA, 20 bp, Homo sapiens
caacctgttacctactttga

SEQ ID NO: 4389725 - DNA, 22 bp, Homo sapiens
caacctgttacctactttgact

SEQ ID NO: 4389726 - DNA, 20 bp, Homo sapiens
caaccttccaacttcctgtg

SEQ ID NO: 4389727 - DNA, 18 bp, Homo sapiens
caacctttccctcacccc

SEQ ID NO: 4389728 - DNA, 19 bp, Homo sapiens
caacctttccctcaccccc

SEQ ID NO: 4389729 - DNA, 21 bp, Homo sapiens
caacgaaccctagaaatatat

SEQ ID NO: 4389730 - DNA, 17 bp, Homo sapiens
caacgagacacattgcc

SEQ ID NO: 4389731 - DNA, 21 bp, Homo sapiens
caacgcaggaggagaaaagaa

SEQ ID NO: 4389732 - DNA, 23 bp, Homo sapiens
caacgcaggaggagaaaagaaat

SEQ ID NO: 4389733 - DNA, 18 bp, Homo sapiens
caacggggggctcctgcc

SEQ ID NO: 4389734 - DNA, 20 bp, Homo sapiens
caacggggggctcctgccca

SEQ ID NO: 4389735 - DNA, 18 bp, Homo sapiens
caaatataaccatttaaa

SEQ ID NO: 4389736 - DNA, 18 bp, Homo sapiens
caaatatgcaaagcactg

SEQ ID NO: 4389737 - DNA, 12 bp, Homo sapiens
caaatattagca

SEQ ID NO: 4389738 - DNA, 13 bp, Homo sapiens
caaatattcagaa

SEQ ID NO: 4389739 - DNA, 23 bp, Homo sapiens
caaatattgaagttgtttatcaa

SEQ ID NO: 4389740 - DNA, 15 bp, Homo sapiens
caaatcaatacacta

SEQ ID NO: 4389741 - DNA, 13 bp, Homo sapiens
caaatcaggcttt

SEQ ID NO: 4389742 - DNA, 21 bp, Homo sapiens
caaatcagtatattttctgta

SEQ ID NO: 4389743 - DNA, 15 bp, Homo sapiens
caaatcctatttaaa

SEQ ID NO: 4389744 - DNA, 18 bp, Homo sapiens
caaatcctatttaaagac

SEQ ID NO: 4389745 - DNA, 15 bp, Homo sapiens
caaatcctctgtttt

SEQ ID NO: 4389746 - DNA, 23 bp, Homo sapiens
caaatcctggaaggacacagtga

SEQ ID NO: 4389747 - DNA, 15 bp, Homo sapiens
caaatccttattgtt

SEQ ID NO: 4389748 - DNA, 21 bp, Homo sapiens
caaatccttggagtcccaggg

SEQ ID NO: 4389749 - DNA, 16 bp, Homo sapiens
caaatcgatttagtaa

SEQ ID NO: 4389750 - DNA, 21 bp, Homo sapiens
caaatcgtggcacgtattgct

SEQ ID NO: 4389751 - DNA, 18 bp, Homo sapiens
caaatctaccactgtatg

SEQ ID NO: 4389752 - DNA, 14 bp, Homo sapiens
caaatctcagtggc

SEQ ID NO: 4389753 - DNA, 14 bp, Homo sapiens
caaatctgtaatta

SEQ ID NO: 4389754 - DNA, 13 bp, Homo sapiens
caaatcttgaaat

SEQ ID NO: 4389755 - DNA, 15 bp, Homo sapiens
caaatgaaagcataa

SEQ ID NO: 4389756 - DNA, 14 bp, Homo sapiens
caaatgaaatgcca

SEQ ID NO: 4389757 - DNA, 15 bp, Homo sapiens
caaatgaactttaaa

SEQ ID NO: 4389758 - DNA, 14 bp, Homo sapiens
caaatgaatgatta

SEQ ID NO: 4389759 - DNA, 16 bp, Homo sapiens
caaatgacagatttct

SEQ ID NO: 4389760 - DNA, 23 bp, Homo sapiens
caaatgactgtatctaggcattt

SEQ ID NO: 4389761 - DNA, 16 bp, Homo sapiens
caaatgatcctcccac

SEQ ID NO: 4389762 - DNA, 14 bp, Homo sapiens
caaatgatttcata

SEQ ID NO: 4389763 - DNA, 21 bp, Homo sapiens
caaatgatttcatattgatct

SEQ ID NO: 4389764 - DNA, 19 bp, Homo sapiens
caaatgcaaaaactctttg

SEQ ID NO: 4389765 - DNA, 12 bp, Homo sapiens
caaatgcaaatt

SEQ ID NO: 4389766 - DNA, 16 bp, Homo sapiens
caaatgcagtatattt

SEQ ID NO: 4389767 - DNA, 21 bp, Homo sapiens
caaatgggcattttacaagaa

SEQ ID NO: 4389768 - DNA, 20 bp, Homo sapiens
caaatggtaggcatttccta

SEQ ID NO: 4389769 - DNA, 17 bp, Homo sapiens
caaatgtagttttgtat

SEQ ID NO: 4389770 - DNA, 16 bp, Homo sapiens
caaatgtcattgtcta

SEQ ID NO: 4389771 - DNA, 17 bp, Homo sapiens
caaatgtcattgtctac

SEQ ID NO: 4389772 - DNA, 18 bp, Homo sapiens
caaatgtcattgtctact

SEQ ID NO: 4389773 - DNA, 18 bp, Homo sapiens
caaatgtcctccagaagc

SEQ ID NO: 4389774 - DNA, 14 bp, Homo sapiens
caaatgtcctttct

SEQ ID NO: 4389775 - DNA, 17 bp, Homo sapiens
caaatgtcctttctcag

SEQ ID NO: 4389776 - DNA, 18 bp, Homo sapiens
caaatgtcctttctcaga

SEQ ID NO: 4389777 - DNA, 18 bp, Homo sapiens
caaatgtgctttgagaag

SEQ ID NO: 4389778 - DNA, 15 bp, Homo sapiens
caaatgtggccaagc

SEQ ID NO: 4389779 - DNA, 20 bp, Homo sapiens
caaatgtggccaagcctatc

SEQ ID NO: 4389780 - DNA, 18 bp, Homo sapiens
caaatgtggctgtaaaac

SEQ ID NO: 4389781 - DNA, 21 bp, Homo sapiens
caaatgtgtgggtttttaaaa

SEQ ID NO: 4389782 - DNA, 14 bp, Homo sapiens
caaatgttagactt

SEQ ID NO: 4389783 - DNA, 21 bp, Homo sapiens
caaatgttcatcaatgaatga

SEQ ID NO: 4389784 - DNA, 17 bp, Homo sapiens
caaatgttttaaagttt

SEQ ID NO: 4389785 - DNA, 14 bp, Homo sapiens
caaattactaatga

SEQ ID NO: 4389786 - DNA, 18 bp, Homo sapiens
caaattactttgtgaata

SEQ ID NO: 4389787 - DNA, 12 bp, Homo sapiens
caaattagaaac

SEQ ID NO: 4389788 - DNA, 14 bp, Homo sapiens
caaattagtaattt

SEQ ID NO: 4389789 - DNA, 16 bp, Homo sapiens
caaattcagctctgat

SEQ ID NO: 4389790 - DNA, 12 bp, Homo sapiens
caaattcagttt

SEQ ID NO: 4389791 - DNA, 17 bp, Homo sapiens
caaattcagtttcataa

SEQ ID NO: 4389792 - DNA, 23 bp, Homo sapiens
caaattccgattagacctttatc

SEQ ID NO: 4389793 - DNA, 15 bp, Homo sapiens
caaattcttctgaac

SEQ ID NO: 4389794 - DNA, 17 bp, Homo sapiens
caaattcttttgaattg

SEQ ID NO: 4389795 - DNA, 23 bp, Homo sapiens
caaattgcttctaggagtcaact

SEQ ID NO: 4389796 - DNA, 20 bp, Homo sapiens
caaattgcttttttccaaaa

SEQ ID NO: 4389797 - DNA, 22 bp, Homo sapiens
caaattgcttttttccaaaaca

SEQ ID NO: 4389798 - DNA, 21 bp, Homo sapiens
caaattggagcttcatggcag

SEQ ID NO: 4389799 - DNA, 13 bp, Homo sapiens
caaattgtgaaat

SEQ ID NO: 4389800 - DNA, 18 bp, Homo sapiens
caaattgtgcagtacttt

SEQ ID NO: 4389801 - DNA, 14 bp, Homo sapiens
caaattgtgcttct

SEQ ID NO: 4389802 - DNA, 21 bp, Homo sapiens
caaacggcaacgtagcctggg

SEQ ID NO: 4389803 - DNA, 15 bp, Homo sapiens
caaactaaattcaaa

SEQ ID NO: 4389804 - DNA, 21 bp, Homo sapiens
caaactatgatttattttggt

SEQ ID NO: 4389805 - DNA, 17 bp, Homo sapiens
caaactatttcagtgat

SEQ ID NO: 4389806 - DNA, 18 bp, Homo sapiens
caaactccaaggttccct

SEQ ID NO: 4389807 - DNA, 15 bp, Homo sapiens
caaactcctatttca

SEQ ID NO: 4389808 - DNA, 17 bp, Homo sapiens
caaactcctatttcaat

SEQ ID NO: 4389809 - DNA, 19 bp, Homo sapiens
caaactcctatttcaatga

SEQ ID NO: 4389810 - DNA, 17 bp, Homo sapiens
caaactgactcaacagt

SEQ ID NO: 4389811 - DNA, 15 bp, Homo sapiens
caaactgatctaaaa

SEQ ID NO: 4389812 - DNA, 17 bp, Homo sapiens
caaactgatctaaaatg

SEQ ID NO: 4389813 - DNA, 17 bp, Homo sapiens
caaactggttcacctga

SEQ ID NO: 4389814 - DNA, 15 bp, Homo sapiens
caaactgtgaaaata

SEQ ID NO: 4389815 - DNA, 18 bp, Homo sapiens
caaactgtgaaaatagtg

SEQ ID NO: 4389816 - DNA, 13 bp, Homo sapiens
caaactgttgatt

SEQ ID NO: 4389817 - DNA, 18 bp, Homo sapiens
caaacttttatactcttt

SEQ ID NO: 4389818 - DNA, 16 bp, Homo sapiens
caaacttttgaaagat

SEQ ID NO: 4389819 - DNA, 19 bp, Homo sapiens
caaacttttgaaagatgta

SEQ ID NO: 4389820 - DNA, 17 bp, Homo sapiens
caaactttttgttcatg

SEQ ID NO: 4389821 - DNA, 16 bp, Homo sapiens
caaagaaacaaagatg

SEQ ID NO: 4389822 - DNA, 20 bp, Homo sapiens
caaagaaatgaacattccaa

SEQ ID NO: 4389823 - DNA, 14 bp, Homo sapiens
caaagaagcttcat

SEQ ID NO: 4389824 - DNA, 20 bp, Homo sapiens
caaagaagcttccacaaaat

SEQ ID NO: 4389825 - DNA, 12 bp, Homo sapiens
caaagaatattt

SEQ ID NO: 4389826 - DNA, 15 bp, Homo sapiens
caaagaatattttga

SEQ ID NO: 4389827 - DNA, 12 bp, Homo sapiens
caaagacaggca

SEQ ID NO: 4389828 - DNA, 13 bp, Homo sapiens
caaagacaggcaa

SEQ ID NO: 4389829 - DNA, 17 bp, Homo sapiens
caaagacatgctttcca

SEQ ID NO: 4389830 - DNA, 14 bp, Homo sapiens
caaagactcaaatt

SEQ ID NO: 4389831 - DNA, 13 bp, Homo sapiens
caaagagaagatg

SEQ ID NO: 4389832 - DNA, 20 bp, Homo sapiens
caaagagaagatgcctgtta

SEQ ID NO: 4389833 - DNA, 15 bp, Homo sapiens
caaagagacatttca

SEQ ID NO: 4389834 - DNA, 14 bp, Homo sapiens
caaagagagttttt

SEQ ID NO: 4389835 - DNA, 22 bp, Homo sapiens
caaagagagtttttaatagaac

SEQ ID NO: 4389836 - DNA, 23 bp, Homo sapiens
caaagagccttcagaatgctcct

SEQ ID NO: 4389837 - DNA, 14 bp, Homo sapiens
caaagagggcttcc

SEQ ID NO: 4389838 - DNA, 16 bp, Homo sapiens
caaagagggcttcctc

SEQ ID NO: 4389839 - DNA, 18 bp, Homo sapiens
caaagagggcttcctcta

SEQ ID NO: 4389840 - DNA, 15 bp, Homo sapiens
caaagagttcaagaa

SEQ ID NO: 4389841 - DNA, 17 bp, Homo sapiens
caaagagttcaagaaat

SEQ ID NO: 4389842 - DNA, 12 bp, Homo sapiens
caaagataattt

SEQ ID NO: 4389843 - DNA, 19 bp, Homo sapiens
caaagataatttatttcaa

SEQ ID NO: 4389844 - DNA, 13 bp, Homo sapiens
caaagatgataat

SEQ ID NO: 4389845 - DNA, 16 bp, Homo sapiens
caaagattaaatgtgt

SEQ ID NO: 4389846 - DNA, 21 bp, Homo sapiens
caaagattaaatgtgtcattg

SEQ ID NO: 4389847 - DNA, 18 bp, Homo sapiens
caaagattaggtcgtttt

SEQ ID NO: 4389848 - DNA, 15 bp, Homo sapiens
caaagattgagaagc

SEQ ID NO: 4389849 - DNA, 17 bp, Homo sapiens
caaagattgagaagcca

SEQ ID NO: 4389850 - DNA, 16 bp, Homo sapiens
caaagatttcatatct

SEQ ID NO: 4389851 - DNA, 17 bp, Homo sapiens
caaagatttcatatcta

SEQ ID NO: 4389852 - DNA, 22 bp, Homo sapiens
caaagcaagcattcagaagaaa

SEQ ID NO: 4389853 - DNA, 16 bp, Homo sapiens
caaagcaatcttttat

SEQ ID NO: 4389854 - DNA, 20 bp, Homo sapiens
caaagcactgacttctaagt

SEQ ID NO: 4389855 - DNA, 18 bp, Homo sapiens
caaagcagcaggcctctg

SEQ ID NO: 4389856 - DNA, 16 bp, Homo sapiens
caaagccaagacctca

SEQ ID NO: 4389857 - DNA, 20 bp, Homo sapiens
caaagccagcgtcctcctct

SEQ ID NO: 4389858 - DNA, 21 bp, Homo sapiens
caaagccagcgtcctcctctg

SEQ ID NO: 4389859 - DNA, 23 bp, Homo sapiens
caaagccagcgtcctcctctgtg

SEQ ID NO: 4389860 - DNA, 17 bp, Homo sapiens
caaagcccaaagtggta

SEQ ID NO: 4389861 - DNA, 18 bp, Homo sapiens
caaagccccccagctccc

SEQ ID NO: 4389862 - DNA, 19 bp, Homo sapiens
caaagccccccagctccca

SEQ ID NO: 4389863 - DNA, 17 bp, Homo sapiens
caaagcggtccctgtcc

SEQ ID NO: 4389864 - DNA, 17 bp, Homo sapiens
caaagctgctaaatctc

SEQ ID NO: 4389865 - DNA, 19 bp, Homo sapiens
atgtacaccacatgctatt

SEQ ID NO: 4389866 - DNA, 24 bp, Homo sapiens
atgtacaccacatgctattgtctg

SEQ ID NO: 4389867 - DNA, 21 bp, Homo sapiens
atgtacactttttacagcagc

SEQ ID NO: 4389868 - DNA, 18 bp, Homo sapiens
atgtacagacatatttaa

SEQ ID NO: 4389869 - DNA, 19 bp, Homo sapiens
atgtacagacatatttaac

SEQ ID NO: 4389870 - DNA, 23 bp, Homo sapiens
atgtacagacatatttaactggt

SEQ ID NO: 4389871 - DNA, 16 bp, Homo sapiens
atgtacagtctgtcat

SEQ ID NO: 4389872 - DNA, 13 bp, Homo sapiens
atgtacataactc

SEQ ID NO: 4389873 - DNA, 22 bp, Homo sapiens
atgtacatagttatttttctct

SEQ ID NO: 4389874 - DNA, 15 bp, Homo sapiens
atgtacatgagaagg

SEQ ID NO: 4389875 - DNA, 17 bp, Homo sapiens
atgtacattacagatta

SEQ ID NO: 4389876 - DNA, 16 bp, Homo sapiens
atgtaccgtaggcttt

SEQ ID NO: 4389877 - DNA, 18 bp, Homo sapiens
atgtacggattttcagtt

SEQ ID NO: 4389878 - DNA, 19 bp, Homo sapiens
atgtactacagctatattt

SEQ ID NO: 4389879 - DNA, 14 bp, Homo sapiens
atgtactctctaag

SEQ ID NO: 4389880 - DNA, 16 bp, Homo sapiens
atgtactgaattcttt

SEQ ID NO: 4389881 - DNA, 17 bp, Homo sapiens
atgtactgatttcagta

SEQ ID NO: 4389882 - DNA, 15 bp, Homo sapiens
atgtactgttgaaaa

SEQ ID NO: 4389883 - DNA, 20 bp, Homo sapiens
atgtacttgtttgaatattt

SEQ ID NO: 4389884 - DNA, 14 bp, Homo sapiens
atgtagaaacttaa

SEQ ID NO: 4389885 - DNA, 17 bp, Homo sapiens
atgtagaataaatgaag

SEQ ID NO: 4389886 - DNA, 16 bp, Homo sapiens
atgtagacataaagaa

SEQ ID NO: 4389887 - DNA, 22 bp, Homo sapiens
atgtagacataaagaagaaact

SEQ ID NO: 4389888 - DNA, 17 bp, Homo sapiens
atgtagactgtgccaga

SEQ ID NO: 4389889 - DNA, 13 bp, Homo sapiens
atgtagaggagaa

SEQ ID NO: 4389890 - DNA, 19 bp, Homo sapiens
atgtagataacaagacctc

SEQ ID NO: 4389891 - DNA, 22 bp, Homo sapiens
atgtagcacttacgtaaaacat

SEQ ID NO: 4389892 - DNA, 14 bp, Homo sapiens
atgtagcatataaa

SEQ ID NO: 4389893 - DNA, 15 bp, Homo sapiens
atgtagcatataaat

SEQ ID NO: 4389894 - DNA, 22 bp, Homo sapiens
atgtagccttcacacagataga

SEQ ID NO: 4389895 - DNA, 19 bp, Homo sapiens
atgtagcgctttgaatatg

SEQ ID NO: 4389896 - DNA, 21 bp, Homo sapiens
atgtagcgctttgaatatgaa

SEQ ID NO: 4389897 - DNA, 20 bp, Homo sapiens
atgtaggatgacaggctctc

SEQ ID NO: 4389898 - DNA, 13 bp, Homo sapiens
atgtagtaacact

SEQ ID NO: 4389899 - DNA, 14 bp, Homo sapiens
atgtagtaacacta

SEQ ID NO: 4389900 - DNA, 16 bp, Homo sapiens
atgtagtaacactaat

SEQ ID NO: 4389901 - DNA, 16 bp, Homo sapiens
atgtagtaattgacat

SEQ ID NO: 4389902 - DNA, 18 bp, Homo sapiens
atgtagtaattgacatgt

SEQ ID NO: 4389903 - DNA, 23 bp, Homo sapiens
atgtagtatggcctgacagctct

SEQ ID NO: 4389904 - DNA, 22 bp, Homo sapiens
atgtagtattttttgtataatt

SEQ ID NO: 4389905 - DNA, 20 bp, Homo sapiens
atgtagtgcatttttaaact

SEQ ID NO: 4389906 - DNA, 22 bp, Homo sapiens
atgtataaaaattatcaaaaag

SEQ ID NO: 4389907 - DNA, 12 bp, Homo sapiens
atgtatagtaaa

SEQ ID NO: 4389908 - DNA, 16 bp, Homo sapiens
atgtatagtaaatcac

SEQ ID NO: 4389909 - DNA, 15 bp, Homo sapiens
atgtatagttgcttt

SEQ ID NO: 4389910 - DNA, 17 bp, Homo sapiens
atgtatataaacatgct

SEQ ID NO: 4389911 - DNA, 19 bp, Homo sapiens
atgtatattgtgttgcaaa

SEQ ID NO: 4389912 - DNA, 14 bp, Homo sapiens
atgtatctgcatat

SEQ ID NO: 4389913 - DNA, 22 bp, Homo sapiens
atgtatctgcatatgttttcca

SEQ ID NO: 4389914 - DNA, 17 bp, Homo sapiens
atgtatctttattaaaa

SEQ ID NO: 4389915 - DNA, 18 bp, Homo sapiens
atgtatctttattaaaac

SEQ ID NO: 4389916 - DNA, 16 bp, Homo sapiens
atgtatggatatattt

SEQ ID NO: 4389917 - DNA, 19 bp, Homo sapiens
atgtatggatatatttgaa

SEQ ID NO: 4389918 - DNA, 18 bp, Homo sapiens
atgtatgtacaatacaat

SEQ ID NO: 4389919 - DNA, 14 bp, Homo sapiens
atgtatgttaccaa

SEQ ID NO: 4389920 - DNA, 21 bp, Homo sapiens
atgtattaagcccacagtata

SEQ ID NO: 4389921 - DNA, 18 bp, Homo sapiens
atgtattcctttaaaata

SEQ ID NO: 4389922 - DNA, 20 bp, Homo sapiens
atgtattcctttaaaatatt

SEQ ID NO: 4389923 - DNA, 12 bp, Homo sapiens
atgtattgattc

SEQ ID NO: 4389924 - DNA, 18 bp, Homo sapiens
atgtatttgaaaattaca

SEQ ID NO: 4389925 - DNA, 22 bp, Homo sapiens
atgtatttgaaaattacatgtt

SEQ ID NO: 4389926 - DNA, 13 bp, Homo sapiens
atgtatttgtagt

SEQ ID NO: 4389927 - DNA, 19 bp, Homo sapiens
atgtatttgtagtgttatt

SEQ ID NO: 4389928 - DNA, 16 bp, Homo sapiens
atgtatttgttatata

SEQ ID NO: 4389929 - DNA, 18 bp, Homo sapiens
atgtatttgttatatata

SEQ ID NO: 4389930 - DNA, 15 bp, Homo sapiens
atgtattttcatagt

SEQ ID NO: 4389931 - DNA, 18 bp, Homo sapiens
atgtattttcctaatgtg

SEQ ID NO: 4389932 - DNA, 16 bp, Homo sapiens
atgtatttttctacat

SEQ ID NO: 4389933 - DNA, 19 bp, Homo sapiens
atgtatttttctacattat

SEQ ID NO: 4389934 - DNA, 23 bp, Homo sapiens
atgtatttttctacattattgct

SEQ ID NO: 4389935 - DNA, 19 bp, Homo sapiens
atgtatttttgatgtatat

SEQ ID NO: 4389936 - DNA, 22 bp, Homo sapiens
atgtcaaaggtcgggacagctg

SEQ ID NO: 4389937 - DNA, 22 bp, Homo sapiens
atgtcaaggaagacttttggta

SEQ ID NO: 4389938 - DNA, 15 bp, Homo sapiens
atgtcaccaccttcc

SEQ ID NO: 4389939 - DNA, 16 bp, Homo sapiens
atgtcaccaccttccc

SEQ ID NO: 4389940 - DNA, 18 bp, Homo sapiens
atgtcaccaccttcccag

SEQ ID NO: 4389941 - DNA, 19 bp, Homo sapiens
atgtcaccaccttcccagc

SEQ ID NO: 4389942 - DNA, 20 bp, Homo sapiens
atgtcaccaccttcccagct

SEQ ID NO: 4389943 - DNA, 21 bp, Homo sapiens
atgtcaccataatgaacaatt

SEQ ID NO: 4389944 - DNA, 15 bp, Homo sapiens
atgtcactcagaaag

SEQ ID NO: 4389945 - DNA, 19 bp, Homo sapiens
atgtcactctggtcccttt

SEQ ID NO: 4389946 - DNA, 15 bp, Homo sapiens
atgtcagattccttt

SEQ ID NO: 4389947 - DNA, 14 bp, Homo sapiens
atgtcagtatgtgg

SEQ ID NO: 4389948 - DNA, 17 bp, Homo sapiens
atgtcagtgtttgggaa

SEQ ID NO: 4389949 - DNA, 17 bp, Homo sapiens
atgtcagttgttattta

SEQ ID NO: 4389950 - DNA, 22 bp, Homo sapiens
atgtcatagaaatattgactca

SEQ ID NO: 4389951 - DNA, 20 bp, Homo sapiens
atgtcatagtcttgaaatga

SEQ ID NO: 4389952 - DNA, 14 bp, Homo sapiens
atgtcatttgcaca

SEQ ID NO: 4389953 - DNA, 17 bp, Homo sapiens
atgtcatttttaatgta

SEQ ID NO: 4389954 - DNA, 19 bp, Homo sapiens
atgtcatttttaatgtatc

SEQ ID NO: 4389955 - DNA, 20 bp, Homo sapiens
atgtcatttttaatgtatct

SEQ ID NO: 4389956 - DNA, 22 bp, Homo sapiens
atgtcatttttaatgtatctat

SEQ ID NO: 4389957 - DNA, 15 bp, Homo sapiens
atgtccaaagaggct

SEQ ID NO: 4389958 - DNA, 16 bp, Homo sapiens
atgtccaaagaggctg

SEQ ID NO: 4389959 - DNA, 22 bp, Homo sapiens
atgtccaaagaggctgcccctc

SEQ ID NO: 4389960 - DNA, 21 bp, Homo sapiens
atgtccactgttctgttctca

SEQ ID NO: 4389961 - DNA, 12 bp, Homo sapiens
atgtccaggaaa

SEQ ID NO: 4389962 - DNA, 18 bp, Homo sapiens
atgtccataaaagagacc

SEQ ID NO: 4389963 - DNA, 21 bp, Homo sapiens
atgtccatacactttgttgca

SEQ ID NO: 4389964 - DNA, 14 bp, Homo sapiens
atgtccatttacac

SEQ ID NO: 4389965 - DNA, 14 bp, Homo sapiens
atgtcccacccacc

SEQ ID NO: 4389966 - DNA, 23 bp, Homo sapiens
atgtcccagtgctcaccagccct

SEQ ID NO: 4389967 - DNA, 22 bp, Homo sapiens
atgtcccctcaaactcattgca

SEQ ID NO: 4389968 - DNA, 19 bp, Homo sapiens
atgtcctccagaagcctct

SEQ ID NO: 4389969 - DNA, 22 bp, Homo sapiens
atgtcctgcctattatctgtca

SEQ ID NO: 4389970 - DNA, 17 bp, Homo sapiens
atgtccttcagctgact

SEQ ID NO: 4389971 - DNA, 19 bp, Homo sapiens
atgtcgtggacacacacag

SEQ ID NO: 4389972 - DNA, 20 bp, Homo sapiens
atgtcgtggacacacacaga

SEQ ID NO: 4389973 - DNA, 15 bp, Homo sapiens
atgtctattcagctt

SEQ ID NO: 4389974 - DNA, 20 bp, Homo sapiens
atgtctcactttactttcaa

SEQ ID NO: 4389975 - DNA, 22 bp, Homo sapiens
atgtctccccagttccacagca

SEQ ID NO: 4389976 - DNA, 14 bp, Homo sapiens
attacccagtgccg

SEQ ID NO: 4389977 - DNA, 14 bp, Homo sapiens
attacctgtggata

SEQ ID NO: 4389978 - DNA, 19 bp, Homo sapiens
attaccttctattggtctc

SEQ ID NO: 4389979 - DNA, 21 bp, Homo sapiens
attaccttttaccagctttta

SEQ ID NO: 4389980 - DNA, 23 bp, Homo sapiens
attaccttttaccagcttttaac

SEQ ID NO: 4389981 - DNA, 16 bp, Homo sapiens
attacgatgtaaattt

SEQ ID NO: 4389982 - DNA, 19 bp, Homo sapiens
attactagtactattacta

SEQ ID NO: 4389983 - DNA, 15 bp, Homo sapiens
attactagtgtttaa

SEQ ID NO: 4389984 - DNA, 17 bp, Homo sapiens
attactagtgtttaagt

SEQ ID NO: 4389985 - DNA, 18 bp, Homo sapiens
attactagtgtttaagtc

SEQ ID NO: 4389986 - DNA, 20 bp, Homo sapiens
attactcactaaagggcttc

SEQ ID NO: 4389987 - DNA, 14 bp, Homo sapiens
attactcctatttt

SEQ ID NO: 4389988 - DNA, 16 bp, Homo sapiens
attactcctatttttg

SEQ ID NO: 4389989 - DNA, 14 bp, Homo sapiens
attactccttcagc

SEQ ID NO: 4389990 - DNA, 16 bp, Homo sapiens
attactctagtttatt

SEQ ID NO: 4389991 - DNA, 16 bp, Homo sapiens
attactctttgctttg

SEQ ID NO: 4389992 - DNA, 17 bp, Homo sapiens
attactgatgtgatatt

SEQ ID NO: 4389993 - DNA, 19 bp, Homo sapiens
attactggaattcttctgc

SEQ ID NO: 4389994 - DNA, 19 bp, Homo sapiens
attactggatctcttaaga

SEQ ID NO: 4389995 - DNA, 13 bp, Homo sapiens
attacttatttaa

SEQ ID NO: 4389996 - DNA, 22 bp, Homo sapiens
attacttctctataaaaaatat

SEQ ID NO: 4389997 - DNA, 18 bp, Homo sapiens
attacttgaactttccaa

SEQ ID NO: 4389998 - DNA, 22 bp, Homo sapiens
attactttaaattatatgatat

SEQ ID NO: 4389999 - DNA, 19 bp, Homo sapiens
attactttgattccatttt

SEQ ID NO: 4390000 - DNA, 15 bp, Homo sapiens
attactttgtctttt

SEQ ID NO: 4390001 - DNA, 20 bp, Homo sapiens
attactttgtcttttcaatc

SEQ ID NO: 4390002 - DNA, 13 bp, Homo sapiens
attagaaaatatt

SEQ ID NO: 4390003 - DNA, 13 bp, Homo sapiens
attagaaaattag

SEQ ID NO: 4390004 - DNA, 15 bp, Homo sapiens
attagaaatatttta

SEQ ID NO: 4390005 - DNA, 17 bp, Homo sapiens
attagaacattcacttt

SEQ ID NO: 4390006 - DNA, 20 bp, Homo sapiens
attagaatgaatttatcttt

SEQ ID NO: 4390007 - DNA, 14 bp, Homo sapiens
attagaatggagga

SEQ ID NO: 4390008 - DNA, 13 bp, Homo sapiens
attagactcctcc

SEQ ID NO: 4390009 - DNA, 15 bp, Homo sapiens
attagactcctcctc

SEQ ID NO: 4390010 - DNA, 16 bp, Homo sapiens
attagactcctcctcc

SEQ ID NO: 4390011 - DNA, 16 bp, Homo sapiens
attagagtgtctttcc

SEQ ID NO: 4390012 - DNA, 17 bp, Homo sapiens
attagataaagatttct

SEQ ID NO: 4390013 - DNA, 16 bp, Homo sapiens
attagatcaaatagtt

SEQ ID NO: 4390014 - DNA, 14 bp, Homo sapiens
attagattttagaa

SEQ ID NO: 4390015 - DNA, 15 bp, Homo sapiens
attagccaggtaatg

SEQ ID NO: 4390016 - DNA, 19 bp, Homo sapiens
attagccgggcatggtggc

SEQ ID NO: 4390017 - DNA, 19 bp, Homo sapiens
attaggaaccttgcaacgg

SEQ ID NO: 4390018 - DNA, 13 bp, Homo sapiens
attaggaataaat

SEQ ID NO: 4390019 - DNA, 21 bp, Homo sapiens
attaggctgtaactactttat

SEQ ID NO: 4390020 - DNA, 22 bp, Homo sapiens
attaggctgtaactactttata

SEQ ID NO: 4390021 - DNA, 16 bp, Homo sapiens
attaggctgttttctt

SEQ ID NO: 4390022 - DNA, 23 bp, Homo sapiens
attagggaaaatggatatagaaa

SEQ ID NO: 4390023 - DNA, 18 bp, Homo sapiens
attagggcaattggaaca

SEQ ID NO: 4390024 - DNA, 18 bp, Homo sapiens
attagggccctgtgtctg

SEQ ID NO: 4390025 - DNA, 20 bp, Homo sapiens
attaggtcgttttccaaaga

SEQ ID NO: 4390026 - DNA, 16 bp, Homo sapiens
attaggtcttaaagta

SEQ ID NO: 4390027 - DNA, 15 bp, Homo sapiens
attaggtggaaattt

SEQ ID NO: 4390028 - DNA, 16 bp, Homo sapiens
attagtaacatgtgtt

SEQ ID NO: 4390029 - DNA, 20 bp, Homo sapiens
attagtaatttatatagatg

SEQ ID NO: 4390030 - DNA, 13 bp, Homo sapiens
attagtattcagg

SEQ ID NO: 4390031 - DNA, 20 bp, Homo sapiens
attagtattcaggcactgag

SEQ ID NO: 4390032 - DNA, 19 bp, Homo sapiens
attagtgaaccaaaaatag

SEQ ID NO: 4390033 - DNA, 22 bp, Homo sapiens
attagtgaaccaaaaatagaaa

SEQ ID NO: 4390034 - DNA, 13 bp, Homo sapiens
attagtgcagtta

SEQ ID NO: 4390035 - DNA, 21 bp, Homo sapiens
attagtgccacttaatgtatg

SEQ ID NO: 4390036 - DNA, 13 bp, Homo sapiens
attagttgctttg

SEQ ID NO: 4390037 - DNA, 13 bp, Homo sapiens
attagttttgatt

SEQ ID NO: 4390038 - DNA, 14 bp, Homo sapiens
attataaaaaatta

SEQ ID NO: 4390039 - DNA, 14 bp, Homo sapiens
attataaaaatatt

SEQ ID NO: 4390040 - DNA, 13 bp, Homo sapiens
attataaaatgct

SEQ ID NO: 4390041 - DNA, 14 bp, Homo sapiens
attataaaatgctc

SEQ ID NO: 4390042 - DNA, 12 bp, Homo sapiens
attataaactat

SEQ ID NO: 4390043 - DNA, 13 bp, Homo sapiens
attataaactata

SEQ ID NO: 4390044 - DNA, 20 bp, Homo sapiens
attataaactataaacttaa

SEQ ID NO: 4390045 - DNA, 21 bp, Homo sapiens
attataaactataaacttaag

SEQ ID NO: 4390046 - DNA, 19 bp, Homo sapiens
attataaatatatataaag

SEQ ID NO: 4390047 - DNA, 17 bp, Homo sapiens
attataacataaaagca

SEQ ID NO: 4390048 - DNA, 21 bp, Homo sapiens
attataactctgtataataga

SEQ ID NO: 4390049 - DNA, 10 bp, Homo sapiens
attataagga

SEQ ID NO: 4390050 - DNA, 15 bp, Homo sapiens
attataagtcttaca

SEQ ID NO: 4390051 - DNA, 11 bp, Homo sapiens
attataagttg

SEQ ID NO: 4390052 - DNA, 14 bp, Homo sapiens
attataatcttata

SEQ ID NO: 4390053 - DNA, 16 bp, Homo sapiens
attatacaaaagagca

SEQ ID NO: 4390054 - DNA, 14 bp, Homo sapiens
attataccatgtgt

SEQ ID NO: 4390055 - DNA, 20 bp, Homo sapiens
attataccatgtgtgctaat

SEQ ID NO: 4390056 - DNA, 17 bp, Homo sapiens
attatacgtatgcattt

SEQ ID NO: 4390057 - DNA, 13 bp, Homo sapiens
attatactgtgtg

SEQ ID NO: 4390058 - DNA, 15 bp, Homo sapiens
attatactgtgtgtg

SEQ ID NO: 4390059 - DNA, 21 bp, Homo sapiens
attatactttatatctgtaat

SEQ ID NO: 4390060 - DNA, 21 bp, Homo sapiens
attatagaaaattatttgtat

SEQ ID NO: 4390061 - DNA, 15 bp, Homo sapiens
attatagcaacttta

SEQ ID NO: 4390062 - DNA, 18 bp, Homo sapiens
attatagtgaaacatgta

SEQ ID NO: 4390063 - DNA, 23 bp, Homo sapiens
attatagtgatgtaatcttgaat

SEQ ID NO: 4390064 - DNA, 11 bp, Homo sapiens
attatataaca

SEQ ID NO: 4390065 - DNA, 14 bp, Homo sapiens
attatatatttaca

SEQ ID NO: 4390066 - DNA, 13 bp, Homo sapiens
attatatgatatg

SEQ ID NO: 4390067 - DNA, 14 bp, Homo sapiens
attatatgatatgc

SEQ ID NO: 4390068 - DNA, 13 bp, Homo sapiens
attatattaaaca

SEQ ID NO: 4390069 - DNA, 20 bp, Homo sapiens
attatattattagttttgat

SEQ ID NO: 4390070 - DNA, 18 bp, Homo sapiens
attatattctaattaaaa

SEQ ID NO: 4390071 - DNA, 14 bp, Homo sapiens
attatattgcaatg

SEQ ID NO: 4390072 - DNA, 21 bp, Homo sapiens
attatattttgttgctttctt

SEQ ID NO: 4390073 - DNA, 20 bp, Homo sapiens
attatcaaggggactaaagt

SEQ ID NO: 4390074 - DNA, 13 bp, Homo sapiens
attatcagcaaag

SEQ ID NO: 4390075 - DNA, 14 bp, Homo sapiens
attatccatattga

SEQ ID NO: 4390076 - DNA, 17 bp, Homo sapiens
attatccatattgagtc

SEQ ID NO: 4390077 - DNA, 12 bp, Homo sapiens
attatccctgaa

SEQ ID NO: 4390078 - DNA, 22 bp, Homo sapiens
attatctatagctaagtacaca

SEQ ID NO: 4390079 - DNA, 16 bp, Homo sapiens
attatctcactttgta

SEQ ID NO: 4390080 - DNA, 11 bp, Homo sapiens
attatcttacg

SEQ ID NO: 4390081 - DNA, 18 bp, Homo sapiens
attatcttgttcaggaaa

SEQ ID NO: 4390082 - DNA, 15 bp, Homo sapiens
attatctttgctgtt

SEQ ID NO: 4390083 - DNA, 13 bp, Homo sapiens
attatgaaaacta

SEQ ID NO: 4390084 - DNA, 16 bp, Homo sapiens
attatgaagctcatat

SEQ ID NO: 4390085 - DNA, 16 bp, Homo sapiens
caaaaatctgcctggg

SEQ ID NO: 4390086 - DNA, 22 bp, Homo sapiens
caaaaatgttcccttgaccatt

SEQ ID NO: 4390087 - DNA, 15 bp, Homo sapiens
caaaaattagccggg

SEQ ID NO: 4390088 - DNA, 17 bp, Homo sapiens
caaaaattagccgggca

SEQ ID NO: 4390089 - DNA, 23 bp, Homo sapiens
caaaaattcagagtccttgcaaa

SEQ ID NO: 4390090 - DNA, 13 bp, Homo sapiens
caaaaattttgaa

SEQ ID NO: 4390091 - DNA, 17 bp, Homo sapiens
caaaaattttgaatgta

SEQ ID NO: 4390092 - DNA, 14 bp, Homo sapiens
caaaaattttgtga

SEQ ID NO: 4390093 - DNA, 14 bp, Homo sapiens
caaaacaaaacaaa

SEQ ID NO: 4390094 - DNA, 17 bp, Homo sapiens
caaaacaaaacaaaact

SEQ ID NO: 4390095 - DNA, 18 bp, Homo sapiens
caaaacgcacaagccaga

SEQ ID NO: 4390096 - DNA, 21 bp, Homo sapiens
caaaactacttttctaaaatc

SEQ ID NO: 4390097 - DNA, 15 bp, Homo sapiens
caaaactcaggcaga

SEQ ID NO: 4390098 - DNA, 15 bp, Homo sapiens
caaaactccaggcag

SEQ ID NO: 4390099 - DNA, 17 bp, Homo sapiens
caaaactccaggcagga

SEQ ID NO: 4390100 - DNA, 17 bp, Homo sapiens
caaaactgcactgtcaa

SEQ ID NO: 4390101 - DNA, 18 bp, Homo sapiens
caaaactgcactgtcaag

SEQ ID NO: 4390102 - DNA, 23 bp, Homo sapiens
caaaacttcagacatagaattaa

SEQ ID NO: 4390103 - DNA, 23 bp, Homo sapiens
caaaactttaggccctgccccag

SEQ ID NO: 4390104 - DNA, 20 bp, Homo sapiens
caaaagaaaattgatatttt

SEQ ID NO: 4390105 - DNA, 20 bp, Homo sapiens
caaaagaagaagtttcatca

SEQ ID NO: 4390106 - DNA, 12 bp, Homo sapiens
caaaagaagtaa

SEQ ID NO: 4390107 - DNA, 16 bp, Homo sapiens
caaaagaataagacaa

SEQ ID NO: 4390108 - DNA, 12 bp, Homo sapiens
caaaagaatcta

SEQ ID NO: 4390109 - DNA, 13 bp, Homo sapiens
caaaagataatat

SEQ ID NO: 4390110 - DNA, 16 bp, Homo sapiens
caaaagattgctgaaa

SEQ ID NO: 4390111 - DNA, 17 bp, Homo sapiens
caaaagatttattgtaa

SEQ ID NO: 4390112 - DNA, 15 bp, Homo sapiens
caaaagcgccctcac

SEQ ID NO: 4390113 - DNA, 21 bp, Homo sapiens
caaaagctatttaaagcatct

SEQ ID NO: 4390114 - DNA, 13 bp, Homo sapiens
caaaagcttttta

SEQ ID NO: 4390115 - DNA, 11 bp, Homo sapiens
caaaaggaaaa

SEQ ID NO: 4390116 - DNA, 12 bp, Homo sapiens
caaaaggaaaaa

SEQ ID NO: 4390117 - DNA, 14 bp, Homo sapiens
caaaagggtcagag

SEQ ID NO: 4390118 - DNA, 23 bp, Homo sapiens
caaaagggtcagaggacctgtat

SEQ ID NO: 4390119 - DNA, 15 bp, Homo sapiens
caaaagggtgtatag

SEQ ID NO: 4390120 - DNA, 18 bp, Homo sapiens
caaaagggtgtatagtgt

SEQ ID NO: 4390121 - DNA, 15 bp, Homo sapiens
caaaaggtgcctgtg

SEQ ID NO: 4390122 - DNA, 14 bp, Homo sapiens
caaaagtccctccc

SEQ ID NO: 4390123 - DNA, 15 bp, Homo sapiens
caaaagtccctccct

SEQ ID NO: 4390124 - DNA, 16 bp, Homo sapiens
caaaagtctgtctttc

SEQ ID NO: 4390125 - DNA, 19 bp, Homo sapiens
caaaagtctgtctttcctg

SEQ ID NO: 4390126 - DNA, 15 bp, Homo sapiens
caaaagtgtgtgtgg

SEQ ID NO: 4390127 - DNA, 15 bp, Homo sapiens
caaaataaaaactat

SEQ ID NO: 4390128 - DNA, 17 bp, Homo sapiens
caaaataataaaaatca

SEQ ID NO: 4390129 - DNA, 14 bp, Homo sapiens
caaaataccagagc

SEQ ID NO: 4390130 - DNA, 22 bp, Homo sapiens
caaaataccagagccttcaagt

SEQ ID NO: 4390131 - DNA, 23 bp, Homo sapiens
caaaataccagagccttcaagtg

SEQ ID NO: 4390132 - DNA, 14 bp, Homo sapiens
caaaatagaaaagt

SEQ ID NO: 4390133 - DNA, 16 bp, Homo sapiens
caaaatagacaagttt

SEQ ID NO: 4390134 - DNA, 18 bp, Homo sapiens
caaaatagacaagttttg

SEQ ID NO: 4390135 - DNA, 20 bp, Homo sapiens
caaaatatattttgtttaca

SEQ ID NO: 4390136 - DNA, 14 bp, Homo sapiens
caaaatatttaaaa

SEQ ID NO: 4390137 - DNA, 17 bp, Homo sapiens
caaaatatttaaaaatg

SEQ ID NO: 4390138 - DNA, 19 bp, Homo sapiens
caaaatatttaaaaatgtc

SEQ ID NO: 4390139 - DNA, 23 bp, Homo sapiens
caaaatatttaagtgaaggagaa

SEQ ID NO: 4390140 - DNA, 13 bp, Homo sapiens
caaaatcaagagt

SEQ ID NO: 4390141 - DNA, 15 bp, Homo sapiens
caaaatcaggtaact

SEQ ID NO: 4390142 - DNA, 16 bp, Homo sapiens
caaaatcctcaggaaa

SEQ ID NO: 4390143 - DNA, 12 bp, Homo sapiens
caaaatctaaaa

SEQ ID NO: 4390144 - DNA, 21 bp, Homo sapiens
caaaatctgtccaaaggaggc

SEQ ID NO: 4390145 - DNA, 19 bp, Homo sapiens
attaaactgaatagttcag

SEQ ID NO: 4390146 - DNA, 16 bp, Homo sapiens
attaaacttcagcaac

SEQ ID NO: 4390147 - DNA, 15 bp, Homo sapiens
attaaagactccagt

SEQ ID NO: 4390148 - DNA, 15 bp, Homo sapiens
attaaagccttaagc

SEQ ID NO: 4390149 - DNA, 18 bp, Homo sapiens
attaaagccttaagcaca

SEQ ID NO: 4390150 - DNA, 19 bp, Homo sapiens
attaaaggtgaaaattgta

SEQ ID NO: 4390151 - DNA, 19 bp, Homo sapiens
attaaagtcagaagtttta

SEQ ID NO: 4390152 - DNA, 21 bp, Homo sapiens
attaaagttgtttcccactct

SEQ ID NO: 4390153 - DNA, 20 bp, Homo sapiens
attaaatagtgtgatgtttg

SEQ ID NO: 4390154 - DNA, 21 bp, Homo sapiens
attaaatagtgtgatgtttgg

SEQ ID NO: 4390155 - DNA, 17 bp, Homo sapiens
attaaatatatgtatgt

SEQ ID NO: 4390156 - DNA, 21 bp, Homo sapiens
attaaatatatgtatgtaaaa

SEQ ID NO: 4390157 - DNA, 13 bp, Homo sapiens
attaaatatttct

SEQ ID NO: 4390158 - DNA, 16 bp, Homo sapiens
attaaatatttcttaa

SEQ ID NO: 4390159 - DNA, 22 bp, Homo sapiens
attaaatgaatattttgataat

SEQ ID NO: 4390160 - DNA, 16 bp, Homo sapiens
attaaatgcttcattt

SEQ ID NO: 4390161 - DNA, 16 bp, Homo sapiens
attaaatgtgtcattg

SEQ ID NO: 4390162 - DNA, 15 bp, Homo sapiens
attaaatgtttcaaa

SEQ ID NO: 4390163 - DNA, 18 bp, Homo sapiens
attaaatgtttcaaaata

SEQ ID NO: 4390164 - DNA, 20 bp, Homo sapiens
attaaatgtttcaaaataga

SEQ ID NO: 4390165 - DNA, 21 bp, Homo sapiens
attaaatgtttcaaaatagac

SEQ ID NO: 4390166 - DNA, 23 bp, Homo sapiens
attaaatgtttcaaaatagacaa

SEQ ID NO: 4390167 - DNA, 18 bp, Homo sapiens
attaaattaggaataaat

SEQ ID NO: 4390168 - DNA, 14 bp, Homo sapiens
attaaattcacaaa

SEQ ID NO: 4390169 - DNA, 16 bp, Homo sapiens
attaaattcacaaact

SEQ ID NO: 4390170 - DNA, 17 bp, Homo sapiens
attaaattggaaagcag

SEQ ID NO: 4390171 - DNA, 19 bp, Homo sapiens
attaaatttgatggttgaa

SEQ ID NO: 4390172 - DNA, 12 bp, Homo sapiens
attaaattttag

SEQ ID NO: 4390173 - DNA, 17 bp, Homo sapiens
attaaattttttttaca

SEQ ID NO: 4390174 - DNA, 19 bp, Homo sapiens
attaacaaaatgtatgtct

SEQ ID NO: 4390175 - DNA, 16 bp, Homo sapiens
attaacaattaattgt

SEQ ID NO: 4390176 - DNA, 18 bp, Homo sapiens
attaacaattaattgtct

SEQ ID NO: 4390177 - DNA, 19 bp, Homo sapiens
attaacatacatcattcca

SEQ ID NO: 4390178 - DNA, 18 bp, Homo sapiens
attaacataggtgaaagt

SEQ ID NO: 4390179 - DNA, 18 bp, Homo sapiens
attaacatgcaataacaa

SEQ ID NO: 4390180 - DNA, 19 bp, Homo sapiens
attaaccgagacactttat

SEQ ID NO: 4390181 - DNA, 17 bp, Homo sapiens
attaaccttactaatta

SEQ ID NO: 4390182 - DNA, 15 bp, Homo sapiens
attaacgatgtccaa

SEQ ID NO: 4390183 - DNA, 20 bp, Homo sapiens
attaactatttttttcaaag

SEQ ID NO: 4390184 - DNA, 13 bp, Homo sapiens
attaactctgcat

SEQ ID NO: 4390185 - DNA, 21 bp, Homo sapiens
attaactctgcatagacaaag

SEQ ID NO: 4390186 - DNA, 19 bp, Homo sapiens
attaactgggtaatgaaac

SEQ ID NO: 4390187 - DNA, 17 bp, Homo sapiens
attaactgtgaaatgta

SEQ ID NO: 4390188 - DNA, 15 bp, Homo sapiens
attaacttagttttt

SEQ ID NO: 4390189 - DNA, 17 bp, Homo sapiens
attaacttagtttttaa

SEQ ID NO: 4390190 - DNA, 18 bp, Homo sapiens
attaagaaaaacaataaa

SEQ ID NO: 4390191 - DNA, 22 bp, Homo sapiens
attaagaaaaacaataaagata

SEQ ID NO: 4390192 - DNA, 19 bp, Homo sapiens
attaagaaaactattaaga

SEQ ID NO: 4390193 - DNA, 12 bp, Homo sapiens
attaagaaagga

SEQ ID NO: 4390194 - DNA, 13 bp, Homo sapiens
attaagaaaggaa

SEQ ID NO: 4390195 - DNA, 20 bp, Homo sapiens
attaagaatcttagataact

SEQ ID NO: 4390196 - DNA, 21 bp, Homo sapiens
attaagaatcttagataactt

SEQ ID NO: 4390197 - DNA, 21 bp, Homo sapiens
attaagatcctaaactctcta

SEQ ID NO: 4390198 - DNA, 20 bp, Homo sapiens
attaagattctctgcccagc

SEQ ID NO: 4390199 - DNA, 11 bp, Homo sapiens
attaagatttc

SEQ ID NO: 4390200 - DNA, 14 bp, Homo sapiens
attaagcagaaaca

SEQ ID NO: 4390201 - DNA, 18 bp, Homo sapiens
attaagcagaaacagcat

SEQ ID NO: 4390202 - DNA, 20 bp, Homo sapiens
attaagccacttaaaatgtt

SEQ ID NO: 4390203 - DNA, 18 bp, Homo sapiens
attaagcccacagtatat

SEQ ID NO: 4390204 - DNA, 22 bp, Homo sapiens
attaagctgttcctgttcagta

SEQ ID NO: 4390205 - DNA, 21 bp, Homo sapiens
attaagcttttcattttaata

SEQ ID NO: 4390206 - DNA, 17 bp, Homo sapiens
attaagctttttggaat

SEQ ID NO: 4390207 - DNA, 14 bp, Homo sapiens
attaagttgttaat

SEQ ID NO: 4390208 - DNA, 12 bp, Homo sapiens
attaataaaaag

SEQ ID NO: 4390209 - DNA, 12 bp, Homo sapiens
attaataacttt

SEQ ID NO: 4390210 - DNA, 23 bp, Homo sapiens
attaataactttctctgtgaaag

SEQ ID NO: 4390211 - DNA, 15 bp, Homo sapiens
attaataagattttt

SEQ ID NO: 4390212 - DNA, 16 bp, Homo sapiens
attaataatatttatg

SEQ ID NO: 4390213 - DNA, 21 bp, Homo sapiens
attaatactctatttttacat

SEQ ID NO: 4390214 - DNA, 20 bp, Homo sapiens
attaatagtaatttgtaaag

SEQ ID NO: 4390215 - DNA, 17 bp, Homo sapiens
attaatataagtttctt

SEQ ID NO: 4390216 - DNA, 19 bp, Homo sapiens
attaatattcccattttat

SEQ ID NO: 4390217 - DNA, 11 bp, Homo sapiens
attaatcaaga

SEQ ID NO: 4390218 - DNA, 22 bp, Homo sapiens
attaatcaagagaaacttcaaa

SEQ ID NO: 4390219 - DNA, 18 bp, Homo sapiens
attaatcacctctctgta

SEQ ID NO: 4390220 - DNA, 14 bp, Homo sapiens
attaatcatagatt

SEQ ID NO: 4390221 - DNA, 16 bp, Homo sapiens
attaatctactgtatc

SEQ ID NO: 4390222 - DNA, 17 bp, Homo sapiens
attaatcttagtgtatg

SEQ ID NO: 4390223 - DNA, 21 bp, Homo sapiens
attaatcttagtgtatgatta

SEQ ID NO: 4390224 - DNA, 22 bp, Homo sapiens
attaatgaaatgataaagactt

SEQ ID NO: 4390225 - DNA, 13 bp, Homo sapiens
attaatgcacttt

SEQ ID NO: 4390226 - DNA, 14 bp, Homo sapiens
attaatgcactttc

SEQ ID NO: 4390227 - DNA, 13 bp, Homo sapiens
attaatgtaataa

SEQ ID NO: 4390228 - DNA, 15 bp, Homo sapiens
attaatgtaataaag

SEQ ID NO: 4390229 - DNA, 18 bp, Homo sapiens
attaatgtaataaagtga

SEQ ID NO: 4390230 - DNA, 19 bp, Homo sapiens
attaatgtaggatgacagg

SEQ ID NO: 4390231 - DNA, 24 bp, Homo sapiens
attaatgtaggatgacaggctctc

SEQ ID NO: 4390232 - DNA, 20 bp, Homo sapiens
attaatgtctcactttactt

SEQ ID NO: 4390233 - DNA, 22 bp, Homo sapiens
attaatgtctcactttactttc

SEQ ID NO: 4390234 - DNA, 23 bp, Homo sapiens
attaatgtctcactttactttca

SEQ ID NO: 4390235 - DNA, 17 bp, Homo sapiens
attaattaaatgaactt

SEQ ID NO: 4390236 - DNA, 16 bp, Homo sapiens
attaattaatttggag

SEQ ID NO: 4390237 - DNA, 14 bp, Homo sapiens
attaatttaaatga

SEQ ID NO: 4390238 - DNA, 14 bp, Homo sapiens
attaatttattggg

SEQ ID NO: 4390239 - DNA, 13 bp, Homo sapiens
attaatttctgcc

SEQ ID NO: 4390240 - DNA, 17 bp, Homo sapiens
attaatttgttaattaa

SEQ ID NO: 4390241 - DNA, 18 bp, Homo sapiens
attaatttgttaattaaa

SEQ ID NO: 4390242 - DNA, 18 bp, Homo sapiens
attaattttagtttttca

SEQ ID NO: 4390243 - DNA, 16 bp, Homo sapiens
attacaaatcagaagt

SEQ ID NO: 4390244 - DNA, 22 bp, Homo sapiens
attacaaatgtggctgtaaaac

SEQ ID NO: 4390245 - DNA, 13 bp, Homo sapiens
attacaacattta

SEQ ID NO: 4390246 - DNA, 17 bp, Homo sapiens
attacagaaccaaatcg

SEQ ID NO: 4390247 - DNA, 18 bp, Homo sapiens
attacaggaatgaagaac

SEQ ID NO: 4390248 - DNA, 21 bp, Homo sapiens
attacaggaatgaagaactgt

SEQ ID NO: 4390249 - DNA, 20 bp, Homo sapiens
attacaggcacctgccacca

SEQ ID NO: 4390250 - DNA, 22 bp, Homo sapiens
attacaggcacctgccaccatg

SEQ ID NO: 4390251 - DNA, 15 bp, Homo sapiens
attacataatttagt

SEQ ID NO: 4390252 - DNA, 22 bp, Homo sapiens
attacataatttagttgtttct

SEQ ID NO: 4390253 - DNA, 23 bp, Homo sapiens
attacataatttagttgtttcta

SEQ ID NO: 4390254 - DNA, 17 bp, Homo sapiens
attacatctgagtattt

SEQ ID NO: 4390255 - DNA, 16 bp, Homo sapiens
attacatctgccttaa

SEQ ID NO: 4390256 - DNA, 18 bp, Homo sapiens
attacatgttttttcatt

SEQ ID NO: 4390257 - DNA, 20 bp, Homo sapiens
atggaccaacctgctctgtc

SEQ ID NO: 4390258 - DNA, 22 bp, Homo sapiens
atggaccacgaatattctttct

SEQ ID NO: 4390259 - DNA, 14 bp, Homo sapiens
atggaccccagcat

SEQ ID NO: 4390260 - DNA, 13 bp, Homo sapiens
atggacctcagca

SEQ ID NO: 4390261 - DNA, 21 bp, Homo sapiens
atggacctcagcaagctgccc

SEQ ID NO: 4390262 - DNA, 20 bp, Homo sapiens
atggactaaatgatctctga

SEQ ID NO: 4390263 - DNA, 14 bp, Homo sapiens
atggagaaaccctg

SEQ ID NO: 4390264 - DNA, 16 bp, Homo sapiens
atggagaggcggcctc

SEQ ID NO: 4390265 - DNA, 18 bp, Homo sapiens
atggagcatcaagccact

SEQ ID NO: 4390266 - DNA, 15 bp, Homo sapiens
atggagccccagccc

SEQ ID NO: 4390267 - DNA, 16 bp, Homo sapiens
atggagccccagcccc

SEQ ID NO: 4390268 - DNA, 17 bp, Homo sapiens
atggagccccctctgcc

SEQ ID NO: 4390269 - DNA, 13 bp, Homo sapiens
atggagctgtcat

SEQ ID NO: 4390270 - DNA, 17 bp, Homo sapiens
atggaggattctttccc

SEQ ID NO: 4390271 - DNA, 18 bp, Homo sapiens
atggaggattctttcccc

SEQ ID NO: 4390272 - DNA, 19 bp, Homo sapiens
atggaggattctttcccca

SEQ ID NO: 4390273 - DNA, 14 bp, Homo sapiens
atggagggcttggc

SEQ ID NO: 4390274 - DNA, 19 bp, Homo sapiens
atggagggcttggcccagc

SEQ ID NO: 4390275 - DNA, 15 bp, Homo sapiens
atggagggggctggg

SEQ ID NO: 4390276 - DNA, 17 bp, Homo sapiens
atggagggggctggggt

SEQ ID NO: 4390277 - DNA, 17 bp, Homo sapiens
atggagtaatggtcacg

SEQ ID NO: 4390278 - DNA, 18 bp, Homo sapiens
atggagtacggctggtgt

SEQ ID NO: 4390279 - DNA, 21 bp, Homo sapiens
atggagtaggtaccatttgtg

SEQ ID NO: 4390280 - DNA, 16 bp, Homo sapiens
atggagtgtacaagta

SEQ ID NO: 4390281 - DNA, 15 bp, Homo sapiens
atggagttaaataaa

SEQ ID NO: 4390282 - DNA, 13 bp, Homo sapiens
atggatcagagga

SEQ ID NO: 4390283 - DNA, 19 bp, Homo sapiens
atggatcagaggagtaaat

SEQ ID NO: 4390284 - DNA, 14 bp, Homo sapiens
atggatgattaaat

SEQ ID NO: 4390285 - DNA, 13 bp, Homo sapiens
atggatgcaaagt

SEQ ID NO: 4390286 - DNA, 19 bp, Homo sapiens
atggatgcaaagtacaatg

SEQ ID NO: 4390287 - DNA, 16 bp, Homo sapiens
atggatgcatttcaaa

SEQ ID NO: 4390288 - DNA, 13 bp, Homo sapiens
atggatgccaata

SEQ ID NO: 4390289 - DNA, 12 bp, Homo sapiens
atggattcactt

SEQ ID NO: 4390290 - DNA, 19 bp, Homo sapiens
atggattcagtttctaaaa

SEQ ID NO: 4390291 - DNA, 18 bp, Homo sapiens
atggattctaaaatgcct

SEQ ID NO: 4390292 - DNA, 16 bp, Homo sapiens
atggattgttaatttc

SEQ ID NO: 4390293 - DNA, 17 bp, Homo sapiens
atggatttccagttttt

SEQ ID NO: 4390294 - DNA, 16 bp, Homo sapiens
atggatttttctttaa

SEQ ID NO: 4390295 - DNA, 20 bp, Homo sapiens
atggatttttctttaactgc

SEQ ID NO: 4390296 - DNA, 19 bp, Homo sapiens
atggcaaaaccagtagctt

SEQ ID NO: 4390297 - DNA, 20 bp, Homo sapiens
atggcaaaagatccaggagt

SEQ ID NO: 4390298 - DNA, 19 bp, Homo sapiens
atggcaaacgattttacta

SEQ ID NO: 4390299 - DNA, 18 bp, Homo sapiens
atggcaacattggacaga

SEQ ID NO: 4390300 - DNA, 23 bp, Homo sapiens
atggcaatgaaaattttaagaag

SEQ ID NO: 4390301 - DNA, 14 bp, Homo sapiens
atggcagaagggaa

SEQ ID NO: 4390302 - DNA, 14 bp, Homo sapiens
atggcagatacatt

SEQ ID NO: 4390303 - DNA, 17 bp, Homo sapiens
atggcagcagaaaactt

SEQ ID NO: 4390304 - DNA, 17 bp, Homo sapiens
atggcaggacagctcct

SEQ ID NO: 4390305 - DNA, 16 bp, Homo sapiens
atggcatatggtccta

SEQ ID NO: 4390306 - DNA, 19 bp, Homo sapiens
atggccaaggctctctctg

SEQ ID NO: 4390307 - DNA, 22 bp, Homo sapiens
atggccacagtagtcttgatga

SEQ ID NO: 4390308 - DNA, 18 bp, Homo sapiens
atggccagagcctctggc

SEQ ID NO: 4390309 - DNA, 12 bp, Homo sapiens
atggccagcccc

SEQ ID NO: 4390310 - DNA, 13 bp, Homo sapiens
atggccagcccct

SEQ ID NO: 4390311 - DNA, 19 bp, Homo sapiens
atggccaggatcctctcct

SEQ ID NO: 4390312 - DNA, 22 bp, Homo sapiens
atggccatggagtgtacaagta

SEQ ID NO: 4390313 - DNA, 14 bp, Homo sapiens
atggcccccaataa

SEQ ID NO: 4390314 - DNA, 19 bp, Homo sapiens
atggcccccaataaaggca

SEQ ID NO: 4390315 - DNA, 23 bp, Homo sapiens
atggcccccaataaaggcagctg

SEQ ID NO: 4390316 - DNA, 16 bp, Homo sapiens
atggccctgtcccagg

SEQ ID NO: 4390317 - DNA, 17 bp, Homo sapiens
atggccctgtcccaggc

SEQ ID NO: 4390318 - DNA, 20 bp, Homo sapiens
atggccgcagggctgtgcac

SEQ ID NO: 4390319 - DNA, 19 bp, Homo sapiens
atggcctcagccctgctcc

SEQ ID NO: 4390320 - DNA, 23 bp, Homo sapiens
atggcctcagccctgctccctgc

SEQ ID NO: 4390321 - DNA, 13 bp, Homo sapiens
atggcctcagctg

SEQ ID NO: 4390322 - DNA, 19 bp, Homo sapiens
atggcctcagctgcctcac

SEQ ID NO: 4390323 - DNA, 21 bp, Homo sapiens
atggcctcagctgcctcactt

SEQ ID NO: 4390324 - DNA, 21 bp, Homo sapiens
atggcctcgcctccccaccct

SEQ ID NO: 4390325 - DNA, 21 bp, Homo sapiens
atggcctgagcatccagacct

SEQ ID NO: 4390326 - DNA, 19 bp, Homo sapiens
atggccttaatttcctttt

SEQ ID NO: 4390327 - DNA, 23 bp, Homo sapiens
atggccttcatatcatccacaca

SEQ ID NO: 4390328 - DNA, 13 bp, Homo sapiens
atggcctttcctt

SEQ ID NO: 4390329 - DNA, 23 bp, Homo sapiens
atggcctttccttccctctctga

SEQ ID NO: 4390330 - DNA, 14 bp, Homo sapiens
atggcctttggacc

SEQ ID NO: 4390331 - DNA, 15 bp, Homo sapiens
atggcctttggaccc

SEQ ID NO: 4390332 - DNA, 22 bp, Homo sapiens
atggcctttggacccagggcct

SEQ ID NO: 4390333 - DNA, 19 bp, Homo sapiens
atggctaagcaaaatgtga

SEQ ID NO: 4390334 - DNA, 13 bp, Homo sapiens
atggctacctcag

SEQ ID NO: 4390335 - DNA, 22 bp, Homo sapiens
atggctatctatacctgccttt

SEQ ID NO: 4390336 - DNA, 15 bp, Homo sapiens
atggctatgaacaga

SEQ ID NO: 4390337 - DNA, 14 bp, Homo sapiens
atggctcatcagat

SEQ ID NO: 4390338 - DNA, 15 bp, Homo sapiens
atggctgcccaggag

SEQ ID NO: 4390339 - DNA, 17 bp, Homo sapiens
atggctgcccaggagac

SEQ ID NO: 4390340 - DNA, 15 bp, Homo sapiens
atggctgtgaggatg

SEQ ID NO: 4390341 - DNA, 13 bp, Homo sapiens
atggcttaggaat

SEQ ID NO: 4390342 - DNA, 20 bp, Homo sapiens
atggctttaaataaattaag

SEQ ID NO: 4390343 - DNA, 13 bp, Homo sapiens
atggctttcaaag

SEQ ID NO: 4390344 - DNA, 14 bp, Homo sapiens
atggcttttcctgg

SEQ ID NO: 4390345 - DNA, 20 bp, Homo sapiens
atgggaaagcattgtaaatg

SEQ ID NO: 4390346 - DNA, 20 bp, Homo sapiens
atgggaaatagcggccctgg

SEQ ID NO: 4390347 - DNA, 14 bp, Homo sapiens
atgggaagactcag

SEQ ID NO: 4390348 - DNA, 17 bp, Homo sapiens
atgggaataattgcttt

SEQ ID NO: 4390349 - DNA, 17 bp, Homo sapiens
atgggaatgaggtggga

SEQ ID NO: 4390350 - DNA, 15 bp, Homo sapiens
atgggaattgcgctc

SEQ ID NO: 4390351 - DNA, 15 bp, Homo sapiens
atgggacagcaacaa

SEQ ID NO: 4390352 - DNA, 22 bp, Homo sapiens
atgggagcagtccatgcatgac

SEQ ID NO: 4390353 - DNA, 22 bp, Homo sapiens
atgggagccccagggtcttccc

SEQ ID NO: 4390354 - DNA, 14 bp, Homo sapiens
atgggagctcctct

SEQ ID NO: 4390355 - DNA, 15 bp, Homo sapiens
atgggagctcctctc

SEQ ID NO: 4390356 - DNA, 14 bp, Homo sapiens
atgggaggaacaaa

SEQ ID NO: 4390357 - DNA, 18 bp, Homo sapiens
atgggaggaacaaagaca

SEQ ID NO: 4390358 - DNA, 23 bp, Homo sapiens
atgggaggctcacccccttctcc

SEQ ID NO: 4390359 - DNA, 21 bp, Homo sapiens
atgggatggtcggatctcaca

SEQ ID NO: 4390360 - DNA, 20 bp, Homo sapiens
atgaataatgcctttgtaac

SEQ ID NO: 4390361 - DNA, 14 bp, Homo sapiens
atgaataatggaaa

SEQ ID NO: 4390362 - DNA, 22 bp, Homo sapiens
atgaatattttcaagtttttca

SEQ ID NO: 4390363 - DNA, 13 bp, Homo sapiens
atgaatattttga

SEQ ID NO: 4390364 - DNA, 15 bp, Homo sapiens
atgaatattttgata

SEQ ID NO: 4390365 - DNA, 21 bp, Homo sapiens
atgaatcactgttgctttgaa

SEQ ID NO: 4390366 - DNA, 18 bp, Homo sapiens
atgaatctgcacatctgt

SEQ ID NO: 4390367 - DNA, 16 bp, Homo sapiens
atgaatcttatgcaaa

SEQ ID NO: 4390368 - DNA, 15 bp, Homo sapiens
atgaatgaggtctgg

SEQ ID NO: 4390369 - DNA, 17 bp, Homo sapiens
atgaatgattaaattat

SEQ ID NO: 4390370 - DNA, 23 bp, Homo sapiens
atgaatggctaagcaaaatgtga

SEQ ID NO: 4390371 - DNA, 21 bp, Homo sapiens
atgaatgggctgagctgcctg

SEQ ID NO: 4390372 - DNA, 16 bp, Homo sapiens
atgaatgtaatctaat

SEQ ID NO: 4390373 - DNA, 22 bp, Homo sapiens
atgaattcaacctcagccctga

SEQ ID NO: 4390374 - DNA, 16 bp, Homo sapiens
atgaattcctagaatt

SEQ ID NO: 4390375 - DNA, 17 bp, Homo sapiens
atgaatttcatgtgaat

SEQ ID NO: 4390376 - DNA, 14 bp, Homo sapiens
atgacaaatattct

SEQ ID NO: 4390377 - DNA, 23 bp, Homo sapiens
atgacaaatattctgaatcacca

SEQ ID NO: 4390378 - DNA, 14 bp, Homo sapiens
atgacaacacttaa

SEQ ID NO: 4390379 - DNA, 16 bp, Homo sapiens
atgacaagatgggaca

SEQ ID NO: 4390380 - DNA, 17 bp, Homo sapiens
atgacacccatgccaga

SEQ ID NO: 4390381 - DNA, 15 bp, Homo sapiens
atgacaccctggcct

SEQ ID NO: 4390382 - DNA, 15 bp, Homo sapiens
atgacagaggctgca

SEQ ID NO: 4390383 - DNA, 13 bp, Homo sapiens
atgacagatttct

SEQ ID NO: 4390384 - DNA, 20 bp, Homo sapiens
atgacagccttttttcctgg

SEQ ID NO: 4390385 - DNA, 15 bp, Homo sapiens
atgacagctgtccct

SEQ ID NO: 4390386 - DNA, 17 bp, Homo sapiens
atgacagctgtccctgt

SEQ ID NO: 4390387 - DNA, 22 bp, Homo sapiens
atgacaggcctgaagatattac

SEQ ID NO: 4390388 - DNA, 23 bp, Homo sapiens
atgacaggcctgaagatattact

SEQ ID NO: 4390389 - DNA, 15 bp, Homo sapiens
atgacaggctctcct

SEQ ID NO: 4390390 - DNA, 19 bp, Homo sapiens
atgacaggctctcctggct

SEQ ID NO: 4390391 - DNA, 21 bp, Homo sapiens
atgacaggctctcctggctgt

SEQ ID NO: 4390392 - DNA, 19 bp, Homo sapiens
atgccaacacttaatcatt

SEQ ID NO: 4390393 - DNA, 20 bp, Homo sapiens
atgccaacacttaatcattt

SEQ ID NO: 4390394 - DNA, 14 bp, Homo sapiens
atgccaccaaagga

SEQ ID NO: 4390395 - DNA, 15 bp, Homo sapiens
atgccaccaaaggag

SEQ ID NO: 4390396 - DNA, 16 bp, Homo sapiens
atgccacctagactct

SEQ ID NO: 4390397 - DNA, 14 bp, Homo sapiens
atgccacctggcaa

SEQ ID NO: 4390398 - DNA, 17 bp, Homo sapiens
atgccactaaattgaca

SEQ ID NO: 4390399 - DNA, 23 bp, Homo sapiens
atgccagaccgcagagaggctca

SEQ ID NO: 4390400 - DNA, 12 bp, Homo sapiens
atgccagagagg

SEQ ID NO: 4390401 - DNA, 21 bp, Homo sapiens
atgccagattctgcctctctg

SEQ ID NO: 4390402 - DNA, 19 bp, Homo sapiens
atgccaggcggacaaagtt

SEQ ID NO: 4390403 - DNA, 21 bp, Homo sapiens
atgccatcctctttctctttt

SEQ ID NO: 4390404 - DNA, 14 bp, Homo sapiens
atgcccaatatatt

SEQ ID NO: 4390405 - DNA, 20 bp, Homo sapiens
atgcccacctgcccatcaca

SEQ ID NO: 4390406 - DNA, 21 bp, Homo sapiens
atgcccacctgcccatcacag

SEQ ID NO: 4390407 - DNA, 21 bp, Homo sapiens
atgcccagctaatttttgtat

SEQ ID NO: 4390408 - DNA, 19 bp, Homo sapiens
atgcccattcctgcctggt

SEQ ID NO: 4390409 - DNA, 23 bp, Homo sapiens
atgccccattccttgcgcctcag

SEQ ID NO: 4390410 - DNA, 19 bp, Homo sapiens
atgccccctgtggatgctg

SEQ ID NO: 4390411 - DNA, 13 bp, Homo sapiens
atgccccctttca

SEQ ID NO: 4390412 - DNA, 16 bp, Homo sapiens
atgcccttctgattcc

SEQ ID NO: 4390413 - DNA, 23 bp, Homo sapiens
atgcccttctgattcccctccac

SEQ ID NO: 4390414 - DNA, 19 bp, Homo sapiens
atgccgatttctgtaaact

SEQ ID NO: 4390415 - DNA, 18 bp, Homo sapiens
atgccgcgatgggtcagg

SEQ ID NO: 4390416 - DNA, 21 bp, Homo sapiens
atgcctatggtggatccaaac

SEQ ID NO: 4390417 - DNA, 20 bp, Homo sapiens
atgcctcactaatttttgta

SEQ ID NO: 4390418 - DNA, 21 bp, Homo sapiens
atgcctcactaatttttgtat

SEQ ID NO: 4390419 - DNA, 23 bp, Homo sapiens
atgcctcagccacttgcctgtgc

SEQ ID NO: 4390420 - DNA, 20 bp, Homo sapiens
atgcctctgacagtccacag

SEQ ID NO: 4390421 - DNA, 13 bp, Homo sapiens
atgcctcttaaat

SEQ ID NO: 4390422 - DNA, 19 bp, Homo sapiens
atgcctgactaatttttgt

SEQ ID NO: 4390423 - DNA, 18 bp, Homo sapiens
atgcctgctttttggaaa

SEQ ID NO: 4390424 - DNA, 19 bp, Homo sapiens
atgcctgctttttggaaag

SEQ ID NO: 4390425 - DNA, 19 bp, Homo sapiens
atgcctgtaatcccagaac

SEQ ID NO: 4390426 - DNA, 20 bp, Homo sapiens
atgcctgtagctttcctggt

SEQ ID NO: 4390427 - DNA, 22 bp, Homo sapiens
atgcctgtagctttcctggtcc

SEQ ID NO: 4390428 - DNA, 17 bp, Homo sapiens
atgcctgtccagcctgg

SEQ ID NO: 4390429 - DNA, 21 bp, Homo sapiens
atgcctgttaatttataatgt

SEQ ID NO: 4390430 - DNA, 22 bp, Homo sapiens
atgcctgttaatttataatgta

SEQ ID NO: 4390431 - DNA, 15 bp, Homo sapiens
atgccttgaataata

SEQ ID NO: 4390432 - DNA, 21 bp, Homo sapiens
atgccttgtataatattgaaa

SEQ ID NO: 4390433 - DNA, 20 bp, Homo sapiens
atgcctttaaatctgtgatg

SEQ ID NO: 4390434 - DNA, 13 bp, Homo sapiens
atgcctttgtaac

SEQ ID NO: 4390435 - DNA, 22 bp, Homo sapiens
atgcctttttagatgtattttt

SEQ ID NO: 4390436 - DNA, 17 bp, Homo sapiens
atgcgccttcgtgcctg

SEQ ID NO: 4390437 - DNA, 13 bp, Homo sapiens
atgcggcccagcc

SEQ ID NO: 4390438 - DNA, 14 bp, Homo sapiens
atgcggcccagccc

SEQ ID NO: 4390439 - DNA, 16 bp, Homo sapiens
atgcgtgcccagctct

SEQ ID NO: 4390440 - DNA, 23 bp, Homo sapiens
atgctaacaaagacaaaagtctg

SEQ ID NO: 4390441 - DNA, 21 bp, Homo sapiens
atgctaatataagtttctttg

SEQ ID NO: 4390442 - DNA, 19 bp, Homo sapiens
atgctagaaaaatgttctt

SEQ ID NO: 4390443 - DNA, 21 bp, Homo sapiens
atgctattgacaataaaatat

SEQ ID NO: 4390444 - DNA, 23 bp, Homo sapiens
atgctattgacaataaaatatta

SEQ ID NO: 4390445 - DNA, 11 bp, Homo sapiens
atgctattttt

SEQ ID NO: 4390446 - DNA, 22 bp, Homo sapiens
atgctatttttgtttttagaat

SEQ ID NO: 4390447 - DNA, 18 bp, Homo sapiens
atgctcaagaatgtagtc

SEQ ID NO: 4390448 - DNA, 21 bp, Homo sapiens
atgctcagtttaaggtacact

SEQ ID NO: 4390449 - DNA, 12 bp, Homo sapiens
atgctcatgtat

SEQ ID NO: 4390450 - DNA, 18 bp, Homo sapiens
atgctcccagctgtgctg

SEQ ID NO: 4390451 - DNA, 19 bp, Homo sapiens
atgctcccagctgtgctgt

SEQ ID NO: 4390452 - DNA, 22 bp, Homo sapiens
atgctccccacagcgtccctgg

SEQ ID NO: 4390453 - DNA, 20 bp, Homo sapiens
atgctccctcccctgccctg

SEQ ID NO: 4390454 - DNA, 22 bp, Homo sapiens
atgctccctcccctgccctggt

SEQ ID NO: 4390455 - DNA, 14 bp, Homo sapiens
atgctcctagaagt

SEQ ID NO: 4390456 - DNA, 13 bp, Homo sapiens
atgctcctcacct

SEQ ID NO: 4390457 - DNA, 20 bp, Homo sapiens
atgctcctcacctgtctagg

SEQ ID NO: 4390458 - DNA, 22 bp, Homo sapiens
atgctctaatgagcatttcctt

SEQ ID NO: 4390459 - DNA, 17 bp, Homo sapiens
atgctctctcacctgct

SEQ ID NO: 4390460 - DNA, 19 bp, Homo sapiens
atgctctctcacctgctcc

SEQ ID NO: 4390461 - DNA, 22 bp, Homo sapiens
atgctctctgcagccagcccag

SEQ ID NO: 4390462 - DNA, 23 bp, Homo sapiens
atgctctctgcagccagcccagc

SEQ ID NO: 4390463 - DNA, 21 bp, Homo sapiens
atgctcttgaaatattcagaa

SEQ ID NO: 4390464 - DNA, 18 bp, Homo sapiens
atgctctttaaataataa

SEQ ID NO: 4390465 - DNA, 13 bp, Homo sapiens
atgctgatggagc

SEQ ID NO: 4390466 - DNA, 15 bp, Homo sapiens
atgctgcaacaaaat

SEQ ID NO: 4390467 - DNA, 20 bp, Homo sapiens
atgctgcaacaaaatgtaga

SEQ ID NO: 4390468 - DNA, 22 bp, Homo sapiens
atgctgccttcagggagacagg

SEQ ID NO: 4390469 - DNA, 14 bp, Homo sapiens
atgctgctttctgc

SEQ ID NO: 4390470 - DNA, 17 bp, Homo sapiens
atgctggaacctgcaaa

SEQ ID NO: 4390471 - DNA, 23 bp, Homo sapiens
atgctggaacctgcaaaaaatac

SEQ ID NO: 4390472 - DNA, 13 bp, Homo sapiens
atgctgggctggg

SEQ ID NO: 4390473 - DNA, 14 bp, Homo sapiens
atgctgggctgggc

SEQ ID NO: 4390474 - DNA, 18 bp, Homo sapiens
atgctgggctgggccctc

SEQ ID NO: 4390475 - DNA, 20 bp, Homo sapiens
atgctggggacacacattct

SEQ ID NO: 4390476 - DNA, 21 bp, Homo sapiens
atgctgggtccatatcacaca

SEQ ID NO: 4390477 - DNA, 19 bp, Homo sapiens
atgctgggtctgaggcccc

SEQ ID NO: 4390478 - DNA, 21 bp, Homo sapiens
atgctggtggaggaagggctg

SEQ ID NO: 4390479 - DNA, 22 bp, Homo sapiens
atgctggtggaggaagggctgg

SEQ ID NO: 4390480 - DNA, 13 bp, Homo sapiens
atgctggtttttc

SEQ ID NO: 4390481 - DNA, 12 bp, Homo sapiens
atgctgtacatc

SEQ ID NO: 4390482 - DNA, 20 bp, Homo sapiens
atgctgtagacatctgtcct

SEQ ID NO: 4390483 - DNA, 12 bp, Homo sapiens
atgctgtatttc

SEQ ID NO: 4390484 - DNA, 13 bp, Homo sapiens
atgctgtatttct

SEQ ID NO: 4390485 - DNA, 17 bp, Homo sapiens
atgctgtatttctttgt

SEQ ID NO: 4390486 - DNA, 16 bp, Homo sapiens
atgctgtctggccctg

SEQ ID NO: 4390487 - DNA, 13 bp, Homo sapiens
atgcttaaatttt

SEQ ID NO: 4390488 - DNA, 20 bp, Homo sapiens
atgcttacctaatttcattt

SEQ ID NO: 4390489 - DNA, 23 bp, Homo sapiens
atgcttacgtgatcctctcacct

SEQ ID NO: 4390490 - DNA, 13 bp, Homo sapiens
atgcttactgata

SEQ ID NO: 4390491 - DNA, 23 bp, Homo sapiens
atgcttactgatatattttacaa

SEQ ID NO: 4390492 - DNA, 15 bp, Homo sapiens
atgcttagtccctca

SEQ ID NO: 4390493 - DNA, 21 bp, Homo sapiens
atgcttctcatcttgtgaaat

SEQ ID NO: 4390494 - DNA, 20 bp, Homo sapiens
atgcttgcggcaaaaggaaa

SEQ ID NO: 4390495 - DNA, 19 bp, Homo sapiens
atgcttggagcaatcagaa

SEQ ID NO: 4390496 - DNA, 12 bp, Homo sapiens
atgcttgtttat

SEQ ID NO: 4390497 - DNA, 17 bp, Homo sapiens
atgctttgaaaatgtat

SEQ ID NO: 4390498 - DNA, 15 bp, Homo sapiens
atgctttgaacttta

SEQ ID NO: 4390499 - DNA, 11 bp, Homo sapiens
atgctttgagt

SEQ ID NO: 4390500 - DNA, 15 bp, Homo sapiens
atgctttggaaaaat

SEQ ID NO: 4390501 - DNA, 22 bp, Homo sapiens
atgctttggaaaaatgggtctt

SEQ ID NO: 4390502 - DNA, 14 bp, Homo sapiens
atgctttgggaact

SEQ ID NO: 4390503 - DNA, 17 bp, Homo sapiens
atgcttttataggcctg

SEQ ID NO: 4390504 - DNA, 19 bp, Homo sapiens
atgcttttatattctaata

SEQ ID NO: 4390505 - DNA, 18 bp, Homo sapiens
atgcttttgcttgcaatg

SEQ ID NO: 4390506 - DNA, 13 bp, Homo sapiens
atggaaaaataaa

SEQ ID NO: 4390507 - DNA, 17 bp, Homo sapiens
atggaaaaataaaactg

SEQ ID NO: 4390508 - DNA, 20 bp, Homo sapiens
atggaaaatgccatgaatta

SEQ ID NO: 4390509 - DNA, 20 bp, Homo sapiens
atggaacataaagttgtatt

SEQ ID NO: 4390510 - DNA, 14 bp, Homo sapiens
atggaaccttccct

SEQ ID NO: 4390511 - DNA, 15 bp, Homo sapiens
atgatatttcttgct

SEQ ID NO: 4390512 - DNA, 18 bp, Homo sapiens
atgatatttcttgctttc

SEQ ID NO: 4390513 - DNA, 17 bp, Homo sapiens
atgatattttaaaatct

SEQ ID NO: 4390514 - DNA, 18 bp, Homo sapiens
atgatcaaaaactgcctt

SEQ ID NO: 4390515 - DNA, 22 bp, Homo sapiens
atgatcagaagaacatgatttt

SEQ ID NO: 4390516 - DNA, 22 bp, Homo sapiens
atgatcctggaaattgcagtaa

SEQ ID NO: 4390517 - DNA, 22 bp, Homo sapiens
atgatcgaaaaaataattattt

SEQ ID NO: 4390518 - DNA, 11 bp, Homo sapiens
atgatctattc

SEQ ID NO: 4390519 - DNA, 15 bp, Homo sapiens
atgatctccctgccg

SEQ ID NO: 4390520 - DNA, 23 bp, Homo sapiens
atgatctctccacggtagcactt

SEQ ID NO: 4390521 - DNA, 17 bp, Homo sapiens
atgatctcttctggtgt

SEQ ID NO: 4390522 - DNA, 22 bp, Homo sapiens
atgatctgtatttaatggtttt

SEQ ID NO: 4390523 - DNA, 16 bp, Homo sapiens
atgatctttaaaatac

SEQ ID NO: 4390524 - DNA, 17 bp, Homo sapiens
atgatgacaaaaaatgt

SEQ ID NO: 4390525 - DNA, 22 bp, Homo sapiens
atgatgatacagtgttaaaaga

SEQ ID NO: 4390526 - DNA, 20 bp, Homo sapiens
atgatgatgtggaagaactt

SEQ ID NO: 4390527 - DNA, 16 bp, Homo sapiens
atgatgccctgctcca

SEQ ID NO: 4390528 - DNA, 19 bp, Homo sapiens
atgatgccctgctccaggg

SEQ ID NO: 4390529 - DNA, 17 bp, Homo sapiens
atgatggagcaactgaa

SEQ ID NO: 4390530 - DNA, 19 bp, Homo sapiens
atgatggatgccaatatta

SEQ ID NO: 4390531 - DNA, 17 bp, Homo sapiens
atgatggttttaaactt

SEQ ID NO: 4390532 - DNA, 22 bp, Homo sapiens
atgatgttaaaaaaataagaag

SEQ ID NO: 4390533 - DNA, 20 bp, Homo sapiens
atgattaagggacatttcta

SEQ ID NO: 4390534 - DNA, 14 bp, Homo sapiens
atgattactggcct

SEQ ID NO: 4390535 - DNA, 19 bp, Homo sapiens
atgattactggcctttttc

SEQ ID NO: 4390536 - DNA, 22 bp, Homo sapiens
atgattactggcctttttcatt

SEQ ID NO: 4390537 - DNA, 12 bp, Homo sapiens
atgattatacaa

SEQ ID NO: 4390538 - DNA, 21 bp, Homo sapiens
atgattatacaaaagagcatg

SEQ ID NO: 4390539 - DNA, 16 bp, Homo sapiens
atgattcagtgttaaa

SEQ ID NO: 4390540 - DNA, 18 bp, Homo sapiens
atgattcctggacatcac

SEQ ID NO: 4390541 - DNA, 22 bp, Homo sapiens
atgattctatttatatgtacat

SEQ ID NO: 4390542 - DNA, 20 bp, Homo sapiens
atgattggttaaaatgtgat

SEQ ID NO: 4390543 - DNA, 13 bp, Homo sapiens
atgatttcacagt

SEQ ID NO: 4390544 - DNA, 13 bp, Homo sapiens
atgatttcagaag

SEQ ID NO: 4390545 - DNA, 21 bp, Homo sapiens
atgatttcagtcatagcaagc

SEQ ID NO: 4390546 - DNA, 13 bp, Homo sapiens
atgatttcatatt

SEQ ID NO: 4390547 - DNA, 13 bp, Homo sapiens
atgatttccttga

SEQ ID NO: 4390548 - DNA, 15 bp, Homo sapiens
atgatttccttgaat

SEQ ID NO: 4390549 - DNA, 17 bp, Homo sapiens
atgatttccttgaatgt

SEQ ID NO: 4390550 - DNA, 20 bp, Homo sapiens
atgattttcctttttcttcg

SEQ ID NO: 4390551 - DNA, 14 bp, Homo sapiens
atgatttttcattg

SEQ ID NO: 4390552 - DNA, 17 bp, Homo sapiens
atgattttttgaaagtt

SEQ ID NO: 4390553 - DNA, 21 bp, Homo sapiens
atgatttttttttcatacact

SEQ ID NO: 4390554 - DNA, 23 bp, Homo sapiens
atgcaaaaactctttgagagggt

SEQ ID NO: 4390555 - DNA, 14 bp, Homo sapiens
atgcaaaccatagc

SEQ ID NO: 4390556 - DNA, 18 bp, Homo sapiens
atgcaaacgttggagttt

SEQ ID NO: 4390557 - DNA, 22 bp, Homo sapiens
atgcaaactgctttattttccc

SEQ ID NO: 4390558 - DNA, 16 bp, Homo sapiens
atgcaaagtacaatgt

SEQ ID NO: 4390559 - DNA, 18 bp, Homo sapiens
atgcaaagtacaatgtgt

SEQ ID NO: 4390560 - DNA, 18 bp, Homo sapiens
atgcaaatcaattactgg

SEQ ID NO: 4390561 - DNA, 13 bp, Homo sapiens
atgcaaattgtga

SEQ ID NO: 4390562 - DNA, 18 bp, Homo sapiens
atgcaaattgtgaaatag

SEQ ID NO: 4390563 - DNA, 19 bp, Homo sapiens
atgcaaatttctataaatt

SEQ ID NO: 4390564 - DNA, 15 bp, Homo sapiens
atgcaacgcaggagg

SEQ ID NO: 4390565 - DNA, 20 bp, Homo sapiens
atgcaactaattcaataaaa

SEQ ID NO: 4390566 - DNA, 18 bp, Homo sapiens
atgcaagtcaggaatcat

SEQ ID NO: 4390567 - DNA, 18 bp, Homo sapiens
atgcaataaaattatttg

SEQ ID NO: 4390568 - DNA, 20 bp, Homo sapiens
atgcaataaaattatttgca

SEQ ID NO: 4390569 - DNA, 13 bp, Homo sapiens
atgcaataactct

SEQ ID NO: 4390570 - DNA, 17 bp, Homo sapiens
atgcaataactctggga

SEQ ID NO: 4390571 - DNA, 12 bp, Homo sapiens
atgcaataagat

SEQ ID NO: 4390572 - DNA, 16 bp, Homo sapiens
atgcaataagatttag

SEQ ID NO: 4390573 - DNA, 24 bp, Homo sapiens
atgcaatgtaagcatactttgtaa

SEQ ID NO: 4390574 - DNA, 16 bp, Homo sapiens
atgcacagatatactt

SEQ ID NO: 4390575 - DNA, 14 bp, Homo sapiens
atgcacagtatttg

SEQ ID NO: 4390576 - DNA, 18 bp, Homo sapiens
atgcaccaatcttgttta

SEQ ID NO: 4390577 - DNA, 22 bp, Homo sapiens
atgcacccatcagtgctctgta

SEQ ID NO: 4390578 - DNA, 14 bp, Homo sapiens
atgcacccctgagc

SEQ ID NO: 4390579 - DNA, 22 bp, Homo sapiens
atgcacccctgagccagcaggg

SEQ ID NO: 4390580 - DNA, 15 bp, Homo sapiens
atgcacctaaagaaa

SEQ ID NO: 4390581 - DNA, 16 bp, Homo sapiens
atgcacctaaagaaaa

SEQ ID NO: 4390582 - DNA, 19 bp, Homo sapiens
atgcacgtggggcccactg

SEQ ID NO: 4390583 - DNA, 23 bp, Homo sapiens
atgcactaagacaagaacattct

SEQ ID NO: 4390584 - DNA, 15 bp, Homo sapiens
atgcactctgggtct

SEQ ID NO: 4390585 - DNA, 16 bp, Homo sapiens
atgcactgaagagctc

SEQ ID NO: 4390586 - DNA, 13 bp, Homo sapiens
atgcactgtaaat

SEQ ID NO: 4390587 - DNA, 21 bp, Homo sapiens
atgcactgtaaatatccctcc

SEQ ID NO: 4390588 - DNA, 14 bp, Homo sapiens
atgcacttctattt

SEQ ID NO: 4390589 - DNA, 20 bp, Homo sapiens
atgcacttttttgtgtgttc

SEQ ID NO: 4390590 - DNA, 15 bp, Homo sapiens
atgcagaaagcatcc

SEQ ID NO: 4390591 - DNA, 16 bp, Homo sapiens
atgcagaaagcatccc

SEQ ID NO: 4390592 - DNA, 14 bp, Homo sapiens
atgcagcatttgat

SEQ ID NO: 4390593 - DNA, 15 bp, Homo sapiens
atgcagcatttgata

SEQ ID NO: 4390594 - DNA, 16 bp, Homo sapiens
atgcagctactggaat

SEQ ID NO: 4390595 - DNA, 17 bp, Homo sapiens
atgcagggaggggaggc

SEQ ID NO: 4390596 - DNA, 19 bp, Homo sapiens
atgcagggaggggaggcag

SEQ ID NO: 4390597 - DNA, 18 bp, Homo sapiens
atgcaggggtcagtgcag

SEQ ID NO: 4390598 - DNA, 15 bp, Homo sapiens
atgcagtatggtaca

SEQ ID NO: 4390599 - DNA, 22 bp, Homo sapiens
atgcagtatggtacatttttca

SEQ ID NO: 4390600 - DNA, 13 bp, Homo sapiens
atgcagtctcctc

SEQ ID NO: 4390601 - DNA, 16 bp, Homo sapiens
atgcagtctcctcttt

SEQ ID NO: 4390602 - DNA, 20 bp, Homo sapiens
atgcagtctcctctttaaaa

SEQ ID NO: 4390603 - DNA, 19 bp, Homo sapiens
atgcagtgtagattttata

SEQ ID NO: 4390604 - DNA, 11 bp, Homo sapiens
atgcagtttga

SEQ ID NO: 4390605 - DNA, 18 bp, Homo sapiens
atgcagtttgaaattctg

SEQ ID NO: 4390606 - DNA, 22 bp, Homo sapiens
atgcagtttgaaattctgaatt

SEQ ID NO: 4390607 - DNA, 13 bp, Homo sapiens
atgcataaatgca

SEQ ID NO: 4390608 - DNA, 13 bp, Homo sapiens
atgcataatttat

SEQ ID NO: 4390609 - DNA, 20 bp, Homo sapiens
atgcataccacaagacattt

SEQ ID NO: 4390610 - DNA, 22 bp, Homo sapiens
atgcataccacaagacatttct

SEQ ID NO: 4390611 - DNA, 14 bp, Homo sapiens
atgcataccagtaa

SEQ ID NO: 4390612 - DNA, 16 bp, Homo sapiens
atgcatattaaataat

SEQ ID NO: 4390613 - DNA, 20 bp, Homo sapiens
atgcatattaaataataaag

SEQ ID NO: 4390614 - DNA, 15 bp, Homo sapiens
atgcatattcaatgt

SEQ ID NO: 4390615 - DNA, 16 bp, Homo sapiens
atgcatatttgtttat

SEQ ID NO: 4390616 - DNA, 22 bp, Homo sapiens
atgcatccattcctcagggaca

SEQ ID NO: 4390617 - DNA, 23 bp, Homo sapiens
atgcatccattcctcagggacag

SEQ ID NO: 4390618 - DNA, 16 bp, Homo sapiens
atgcatcgggaaagaa

SEQ ID NO: 4390619 - DNA, 22 bp, Homo sapiens
atgcatcgggaaagaagaaact

SEQ ID NO: 4390620 - DNA, 22 bp, Homo sapiens
atgcatgtctgccaaaatgcaa

SEQ ID NO: 4390621 - DNA, 15 bp, Homo sapiens
atgcatgttctcctc

SEQ ID NO: 4390622 - DNA, 19 bp, Homo sapiens
atgcattcacatttagaaa

SEQ ID NO: 4390623 - DNA, 17 bp, Homo sapiens
atgcattccagaacaaa

SEQ ID NO: 4390624 - DNA, 14 bp, Homo sapiens
atgcattctttata

SEQ ID NO: 4390625 - DNA, 17 bp, Homo sapiens
atgcattgaaaaatttc

SEQ ID NO: 4390626 - DNA, 15 bp, Homo sapiens
atgcattgttgtaaa

SEQ ID NO: 4390627 - DNA, 16 bp, Homo sapiens
atgcatttcaaatgtt

SEQ ID NO: 4390628 - DNA, 20 bp, Homo sapiens
atgcatttttttagtttgtt

SEQ ID NO: 4390629 - DNA, 19 bp, Homo sapiens
atgccaaaaaaaaatacat

SEQ ID NO: 4390630 - DNA, 20 bp, Homo sapiens
atgccaaagccattctcccc

SEQ ID NO: 4390631 - DNA, 16 bp, Homo sapiens
atcttggacaaatcac

SEQ ID NO: 4390632 - DNA, 14 bp, Homo sapiens
atcttggagctgct

SEQ ID NO: 4390633 - DNA, 17 bp, Homo sapiens
atcttggagctgcttgg

SEQ ID NO: 4390634 - DNA, 20 bp, Homo sapiens
atcttggttgatgccaaaaa

SEQ ID NO: 4390635 - DNA, 21 bp, Homo sapiens
atcttggttgatgccaaaaaa

SEQ ID NO: 4390636 - DNA, 15 bp, Homo sapiens
atcttgtaggtcatt

SEQ ID NO: 4390637 - DNA, 15 bp, Homo sapiens
atcttgtgaaatggc

SEQ ID NO: 4390638 - DNA, 20 bp, Homo sapiens
atcttgtgaaatggccagga

SEQ ID NO: 4390639 - DNA, 13 bp, Homo sapiens
atcttgtgcttct

SEQ ID NO: 4390640 - DNA, 14 bp, Homo sapiens
atcttgtgcttctt

SEQ ID NO: 4390641 - DNA, 22 bp, Homo sapiens
atcttgtgcttcttcacttacc

SEQ ID NO: 4390642 - DNA, 17 bp, Homo sapiens
atcttgttcaggaaaag

SEQ ID NO: 4390643 - DNA, 19 bp, Homo sapiens
atcttgttcaggaaaaggt

SEQ ID NO: 4390644 - DNA, 22 bp, Homo sapiens
atcttgtttacaataaagaatt

SEQ ID NO: 4390645 - DNA, 17 bp, Homo sapiens
atcttgtttatagcaaa

SEQ ID NO: 4390646 - DNA, 14 bp, Homo sapiens
atcttgtttgttac

SEQ ID NO: 4390647 - DNA, 18 bp, Homo sapiens
atcttgtttgttactgtc

SEQ ID NO: 4390648 - DNA, 15 bp, Homo sapiens
atctttaccaaaaac

SEQ ID NO: 4390649 - DNA, 23 bp, Homo sapiens
atctttccaggcttccctgactt

SEQ ID NO: 4390650 - DNA, 22 bp, Homo sapiens
atctttctccttgaatatcttt

SEQ ID NO: 4390651 - DNA, 18 bp, Homo sapiens
atctttcttgatcaacat

SEQ ID NO: 4390652 - DNA, 15 bp, Homo sapiens
atctttctttccaaa

SEQ ID NO: 4390653 - DNA, 22 bp, Homo sapiens
atctttctttccaaaacatttc

SEQ ID NO: 4390654 - DNA, 16 bp, Homo sapiens
atctttctttctctaa

SEQ ID NO: 4390655 - DNA, 21 bp, Homo sapiens
atctttgacatggtgccttag

SEQ ID NO: 4390656 - DNA, 21 bp, Homo sapiens
atctttgagaccatccattct

SEQ ID NO: 4390657 - DNA, 16 bp, Homo sapiens
atctttgattctcctt

SEQ ID NO: 4390658 - DNA, 17 bp, Homo sapiens
atctttgattctccttc

SEQ ID NO: 4390659 - DNA, 19 bp, Homo sapiens
atctttgattctccttcag

SEQ ID NO: 4390660 - DNA, 20 bp, Homo sapiens
atctttgattctccttcagc

SEQ ID NO: 4390661 - DNA, 14 bp, Homo sapiens
atctttgccttggg

SEQ ID NO: 4390662 - DNA, 21 bp, Homo sapiens
atctttgctgttattgacagc

SEQ ID NO: 4390663 - DNA, 17 bp, Homo sapiens
atctttgtaccaaaatt

SEQ ID NO: 4390664 - DNA, 19 bp, Homo sapiens
atctttgtaccaaaatttt

SEQ ID NO: 4390665 - DNA, 20 bp, Homo sapiens
atctttgtaccaaaatttta

SEQ ID NO: 4390666 - DNA, 21 bp, Homo sapiens
atctttgtattcttcatgaaa

SEQ ID NO: 4390667 - DNA, 14 bp, Homo sapiens
atctttgtgacagg

SEQ ID NO: 4390668 - DNA, 20 bp, Homo sapiens
atattgctctatatgtaata

SEQ ID NO: 4390669 - DNA, 14 bp, Homo sapiens
atattgcttcaatt

SEQ ID NO: 4390670 - DNA, 16 bp, Homo sapiens
atattgcttcttgtgt

SEQ ID NO: 4390671 - DNA, 12 bp, Homo sapiens
atattggaactt

SEQ ID NO: 4390672 - DNA, 21 bp, Homo sapiens
atattggggaccaaatcaaat

SEQ ID NO: 4390673 - DNA, 19 bp, Homo sapiens
atattgggtgtagatttct

SEQ ID NO: 4390674 - DNA, 24 bp, Homo sapiens
atattggtatgtaacacaggataa

SEQ ID NO: 4390675 - DNA, 23 bp, Homo sapiens
atattggtccagaagttcaaaat

SEQ ID NO: 4390676 - DNA, 15 bp, Homo sapiens
atattggtttgcaca

SEQ ID NO: 4390677 - DNA, 17 bp, Homo sapiens
atattgtaaaacaggta

SEQ ID NO: 4390678 - DNA, 16 bp, Homo sapiens
atattgtattaagggc

SEQ ID NO: 4390679 - DNA, 12 bp, Homo sapiens
atattgtcatct

SEQ ID NO: 4390680 - DNA, 23 bp, Homo sapiens
atattgtcatctttttctagagt

SEQ ID NO: 4390681 - DNA, 17 bp, Homo sapiens
atattgtgattctgcct

SEQ ID NO: 4390682 - DNA, 23 bp, Homo sapiens
atattgttctgctgtctgggact

SEQ ID NO: 4390683 - DNA, 12 bp, Homo sapiens
atattgtttgct

SEQ ID NO: 4390684 - DNA, 15 bp, Homo sapiens
atattgtttgctgtt

SEQ ID NO: 4390685 - DNA, 18 bp, Homo sapiens
atattgtttgctgttggg

SEQ ID NO: 4390686 - DNA, 16 bp, Homo sapiens
atattgtttttatata

SEQ ID NO: 4390687 - DNA, 14 bp, Homo sapiens
atatttaaaaataa

SEQ ID NO: 4390688 - DNA, 15 bp, Homo sapiens
atatttaaaaatgtc

SEQ ID NO: 4390689 - DNA, 11 bp, Homo sapiens
atatttaagtg

SEQ ID NO: 4390690 - DNA, 9 bp, Homo sapiens
atatttaat

SEQ ID NO: 4390691 - DNA, 13 bp, Homo sapiens
atatttaatatca

SEQ ID NO: 4390692 - DNA, 14 bp, Homo sapiens
atatttaatgtttt

SEQ ID NO: 4390693 - DNA, 14 bp, Homo sapiens
atatttaggaaaat

SEQ ID NO: 4390694 - DNA, 21 bp, Homo sapiens
atatttaggaaaatgcttatt

SEQ ID NO: 4390695 - DNA, 19 bp, Homo sapiens
atatttatggggggagaac

SEQ ID NO: 4390696 - DNA, 19 bp, Homo sapiens
atatttattcattatttgt

SEQ ID NO: 4390697 - DNA, 13 bp, Homo sapiens
atatttattgtta

SEQ ID NO: 4390698 - DNA, 20 bp, Homo sapiens
atatttattttcttccccaa

SEQ ID NO: 4390699 - DNA, 12 bp, Homo sapiens
atatttcaagtg

SEQ ID NO: 4390700 - DNA, 15 bp, Homo sapiens
atatttcaagtgcct

SEQ ID NO: 4390701 - DNA, 18 bp, Homo sapiens
atatttcagatgtaatgt

SEQ ID NO: 4390702 - DNA, 21 bp, Homo sapiens
atatttcctttatgtgaattt

SEQ ID NO: 4390703 - DNA, 17 bp, Homo sapiens
atatttcgaccctgggg

SEQ ID NO: 4390704 - DNA, 19 bp, Homo sapiens
atatttcgaccctggggcg

SEQ ID NO: 4390705 - DNA, 20 bp, Homo sapiens
atatttctgctttctttgat

SEQ ID NO: 4390706 - DNA, 13 bp, Homo sapiens
atatttcttcaaa

SEQ ID NO: 4390707 - DNA, 15 bp, Homo sapiens
atatttgaaaaaaac

SEQ ID NO: 4390708 - DNA, 23 bp, Homo sapiens
atatttgaaaaaaacttcattct

SEQ ID NO: 4390709 - DNA, 17 bp, Homo sapiens
atatttgaggagtgtta

SEQ ID NO: 4390710 - DNA, 18 bp, Homo sapiens
atatttgctttatactga

SEQ ID NO: 4390711 - DNA, 14 bp, Homo sapiens
atatttgtaaaaat

SEQ ID NO: 4390712 - DNA, 21 bp, Homo sapiens
atatttgtaaggcttgttcca

SEQ ID NO: 4390713 - DNA, 22 bp, Homo sapiens
atatttgtgctatagtatttga

SEQ ID NO: 4390714 - DNA, 14 bp, Homo sapiens
atatttgtttagtt

SEQ ID NO: 4390715 - DNA, 16 bp, Homo sapiens
atatttgttttaatac

SEQ ID NO: 4390716 - DNA, 13 bp, Homo sapiens
atattttaaaatt

SEQ ID NO: 4390717 - DNA, 17 bp, Homo sapiens
atattttaaaatttgtt

SEQ ID NO: 4390718 - DNA, 18 bp, Homo sapiens
atattttaaaatttgttc

SEQ ID NO: 4390719 - DNA, 12 bp, Homo sapiens
atattttaatgt

SEQ ID NO: 4390720 - DNA, 15 bp, Homo sapiens
atattttatataaag

SEQ ID NO: 4390721 - DNA, 13 bp, Homo sapiens
atattttatcctg

SEQ ID NO: 4390722 - DNA, 15 bp, Homo sapiens
atattttatcctgta

SEQ ID NO: 4390723 - DNA, 19 bp, Homo sapiens
atattttatgaacattgta

SEQ ID NO: 4390724 - DNA, 23 bp, Homo sapiens
atattttatgaacattgtactgt

SEQ ID NO: 4390725 - DNA, 19 bp, Homo sapiens
atattttatttcaatgtaa

SEQ ID NO: 4390726 - DNA, 20 bp, Homo sapiens
atattttatttcaatgtaat

SEQ ID NO: 4390727 - DNA, 21 bp, Homo sapiens
atattttatttcaatgtaatt

SEQ ID NO: 4390728 - DNA, 17 bp, Homo sapiens
atattttccataaattt

SEQ ID NO: 4390729 - DNA, 24 bp, Homo sapiens
atattttcctagtagatctatatt

SEQ ID NO: 4390730 - DNA, 13 bp, Homo sapiens
atattttcttttc

SEQ ID NO: 4390731 - DNA, 17 bp, Homo sapiens
atctgatacttatttac

SEQ ID NO: 4390732 - DNA, 23 bp, Homo sapiens
atctgatggccttaatttccttt

SEQ ID NO: 4390733 - DNA, 22 bp, Homo sapiens
atctgattgttgtcaggccata

SEQ ID NO: 4390734 - DNA, 22 bp, Homo sapiens
atctgcaaaaggcctcttgtaa

SEQ ID NO: 4390735 - DNA, 13 bp, Homo sapiens
atctgcaaaatgt

SEQ ID NO: 4390736 - DNA, 19 bp, Homo sapiens
atctgcaaaatgtagaaat

SEQ ID NO: 4390737 - DNA, 14 bp, Homo sapiens
atctgcaatatgaa

SEQ ID NO: 4390738 - DNA, 12 bp, Homo sapiens
atctgcacagtc

SEQ ID NO: 4390739 - DNA, 21 bp, Homo sapiens
atctgcacataggcagtagcc

SEQ ID NO: 4390740 - DNA, 18 bp, Homo sapiens
atctgcaccccttctctc

SEQ ID NO: 4390741 - DNA, 18 bp, Homo sapiens
atctgcatttaccactgt

SEQ ID NO: 4390742 - DNA, 18 bp, Homo sapiens
atctgccatttatttcct

SEQ ID NO: 4390743 - DNA, 19 bp, Homo sapiens
atctgccatttatttcctc

SEQ ID NO: 4390744 - DNA, 22 bp, Homo sapiens
atctgccccaggtacacctccc

SEQ ID NO: 4390745 - DNA, 17 bp, Homo sapiens
atctgcccctcccccaa

SEQ ID NO: 4390746 - DNA, 14 bp, Homo sapiens
atctgcctgtaatt

SEQ ID NO: 4390747 - DNA, 20 bp, Homo sapiens
atctgcctgtaattaaacta

SEQ ID NO: 4390748 - DNA, 17 bp, Homo sapiens
atctgccttaaaaccaa

SEQ ID NO: 4390749 - DNA, 18 bp, Homo sapiens
atctgccttaaaaccaaa

SEQ ID NO: 4390750 - DNA, 23 bp, Homo sapiens
atctgcgggggcagtgctcaccc

SEQ ID NO: 4390751 - DNA, 16 bp, Homo sapiens
atctgctaagtaattt

SEQ ID NO: 4390752 - DNA, 13 bp, Homo sapiens
atctgctctcctt

SEQ ID NO: 4390753 - DNA, 14 bp, Homo sapiens
atctgctctccttc

SEQ ID NO: 4390754 - DNA, 15 bp, Homo sapiens
atctgctctccttcc

SEQ ID NO: 4390755 - DNA, 16 bp, Homo sapiens
atctgctctccttcct

SEQ ID NO: 4390756 - DNA, 17 bp, Homo sapiens
atctgctgtccagacag

SEQ ID NO: 4390757 - DNA, 14 bp, Homo sapiens
atctggagagaaca

SEQ ID NO: 4390758 - DNA, 14 bp, Homo sapiens
atctggcatggctc

SEQ ID NO: 4390759 - DNA, 14 bp, Homo sapiens
atctggctcagcat

SEQ ID NO: 4390760 - DNA, 21 bp, Homo sapiens
atctggctgcagttttgctat

SEQ ID NO: 4390761 - DNA, 23 bp, Homo sapiens
atctgggaccctttccttccttc

SEQ ID NO: 4390762 - DNA, 17 bp, Homo sapiens
atctgggactgtgcctg

SEQ ID NO: 4390763 - DNA, 19 bp, Homo sapiens
atctgggactgtgcctggc

SEQ ID NO: 4390764 - DNA, 21 bp, Homo sapiens
atctgggactgtgcctggctc

SEQ ID NO: 4390765 - DNA, 23 bp, Homo sapiens
atctgggcattttcctcctctgc

SEQ ID NO: 4390766 - DNA, 17 bp, Homo sapiens
atctgggctgtgggcaa

SEQ ID NO: 4390767 - DNA, 23 bp, Homo sapiens
atctggggcagcaccctataaat

SEQ ID NO: 4390768 - DNA, 19 bp, Homo sapiens
atctgggtaagaagaaagc

SEQ ID NO: 4390769 - DNA, 23 bp, Homo sapiens
atctgggtaagaagaaagcaaaa

SEQ ID NO: 4390770 - DNA, 15 bp, Homo sapiens
atctgggtatctttc

SEQ ID NO: 4390771 - DNA, 16 bp, Homo sapiens
atctggtattaaatgc

SEQ ID NO: 4390772 - DNA, 22 bp, Homo sapiens
atcataagttatgcctctgaca

SEQ ID NO: 4390773 - DNA, 15 bp, Homo sapiens
atcatacaaactctc

SEQ ID NO: 4390774 - DNA, 16 bp, Homo sapiens
atcatacaaactctca

SEQ ID NO: 4390775 - DNA, 16 bp, Homo sapiens
atcatacaccagaaga

SEQ ID NO: 4390776 - DNA, 20 bp, Homo sapiens
atcatactcttctaaaactt

SEQ ID NO: 4390777 - DNA, 19 bp, Homo sapiens
atcatatataataaattaa

SEQ ID NO: 4390778 - DNA, 16 bp, Homo sapiens
atcatatccttgccct

SEQ ID NO: 4390779 - DNA, 21 bp, Homo sapiens
atcatatgaggacctttatat

SEQ ID NO: 4390780 - DNA, 16 bp, Homo sapiens
atcatcaagtaataca

SEQ ID NO: 4390781 - DNA, 13 bp, Homo sapiens
atcatcactgtaa

SEQ ID NO: 4390782 - DNA, 18 bp, Homo sapiens
atcatcactgtaaagaca

SEQ ID NO: 4390783 - DNA, 21 bp, Homo sapiens
atcatcactgtaaagacaaat

SEQ ID NO: 4390784 - DNA, 20 bp, Homo sapiens
atcatcagaaaggaaaaaca

SEQ ID NO: 4390785 - DNA, 18 bp, Homo sapiens
atcatcatgcagctcaac

SEQ ID NO: 4390786 - DNA, 14 bp, Homo sapiens
atcatctattttga

SEQ ID NO: 4390787 - DNA, 15 bp, Homo sapiens
atcatctattttgat

SEQ ID NO: 4390788 - DNA, 16 bp, Homo sapiens
atcatctattttgatg

SEQ ID NO: 4390789 - DNA, 19 bp, Homo sapiens
atcatctattttgatgcag

SEQ ID NO: 4390790 - DNA, 23 bp, Homo sapiens
atcatctattttgatgcagcatt

SEQ ID NO: 4390791 - DNA, 20 bp, Homo sapiens
atcatctgtcattatattct

SEQ ID NO: 4390792 - DNA, 21 bp, Homo sapiens
atcatctgtcattatattcta

SEQ ID NO: 4390793 - DNA, 19 bp, Homo sapiens
atcatctgtttgtaatcat

SEQ ID NO: 4390794 - DNA, 11 bp, Homo sapiens
atcatgaagcc

SEQ ID NO: 4390795 - DNA, 14 bp, Homo sapiens
atcatgaattttaa

SEQ ID NO: 4390796 - DNA, 14 bp, Homo sapiens
atcatgatttccct

SEQ ID NO: 4390797 - DNA, 15 bp, Homo sapiens
atcatgctcatgtat

SEQ ID NO: 4390798 - DNA, 19 bp, Homo sapiens
atcatgctggaacctgcaa

SEQ ID NO: 4390799 - DNA, 22 bp, Homo sapiens
atcatgctggaacctgcaaaaa

SEQ ID NO: 4390800 - DNA, 14 bp, Homo sapiens
atcatggaagaaaa

SEQ ID NO: 4390801 - DNA, 16 bp, Homo sapiens
atcatggaagaaaagg

SEQ ID NO: 4390802 - DNA, 17 bp, Homo sapiens
atcatggacctggtgcc

SEQ ID NO: 4390803 - DNA, 15 bp, Homo sapiens
atcatggcttaggat

SEQ ID NO: 4390804 - DNA, 16 bp, Homo sapiens
atcatgtccatacact

SEQ ID NO: 4390805 - DNA, 16 bp, Homo sapiens
atcatgtctgtatact

SEQ ID NO: 4390806 - DNA, 23 bp, Homo sapiens
atcatgtctgtatactcctgtca

SEQ ID NO: 4390807 - DNA, 15 bp, Homo sapiens
atcatgttaaattag

SEQ ID NO: 4390808 - DNA, 17 bp, Homo sapiens
atcatgttaaattagaa

SEQ ID NO: 4390809 - DNA, 20 bp, Homo sapiens
atcatgttaaattagaatga

SEQ ID NO: 4390810 - DNA, 18 bp, Homo sapiens
atcatgtttacagaggac

SEQ ID NO: 4390811 - DNA, 23 bp, Homo sapiens
atcattaccttttaccagctttt

SEQ ID NO: 4390812 - DNA, 20 bp, Homo sapiens
atcattatctcactttgtaa

SEQ ID NO: 4390813 - DNA, 15 bp, Homo sapiens
atcattcatttttgt

SEQ ID NO: 4390814 - DNA, 13 bp, Homo sapiens
atcattgtatgtg

SEQ ID NO: 4390815 - DNA, 17 bp, Homo sapiens
atcatttggttaaatca

SEQ ID NO: 4390816 - DNA, 18 bp, Homo sapiens
atcatttgtttaaaaagg

SEQ ID NO: 4390817 - DNA, 17 bp, Homo sapiens
atcattttaaattccac

SEQ ID NO: 4390818 - DNA, 22 bp, Homo sapiens
atcattttaaattccactgaaa

SEQ ID NO: 4390819 - DNA, 15 bp, Homo sapiens
atcattttcccccca

SEQ ID NO: 4390820 - DNA, 18 bp, Homo sapiens
atcatttttacactattg

SEQ ID NO: 4390821 - DNA, 18 bp, Homo sapiens
atccaaaaatagccctgc

SEQ ID NO: 4390822 - DNA, 13 bp, Homo sapiens
atccaaaatgctt

SEQ ID NO: 4390823 - DNA, 21 bp, Homo sapiens
atccaaacatgtatttatgta

SEQ ID NO: 4390824 - DNA, 23 bp, Homo sapiens
atccaaattgtgcttctccccag

SEQ ID NO: 4390825 - DNA, 17 bp, Homo sapiens
atccaaccattttcatt

SEQ ID NO: 4390826 - DNA, 22 bp, Homo sapiens
atccaagggttgagagccagtg

SEQ ID NO: 4390827 - DNA, 14 bp, Homo sapiens
atcctgtttaataa

SEQ ID NO: 4390828 - DNA, 21 bp, Homo sapiens
atcctgtttttagtgctgact

SEQ ID NO: 4390829 - DNA, 21 bp, Homo sapiens
atccttataggcctgtccctt

SEQ ID NO: 4390830 - DNA, 15 bp, Homo sapiens
atccttccattccat

SEQ ID NO: 4390831 - DNA, 22 bp, Homo sapiens
atccttcccaacgtactcctca

SEQ ID NO: 4390832 - DNA, 22 bp, Homo sapiens
atccttgccaatagtgtcatcc

SEQ ID NO: 4390833 - DNA, 17 bp, Homo sapiens
atccttggagtcccagg

SEQ ID NO: 4390834 - DNA, 19 bp, Homo sapiens
atccttgtgacttacaatt

SEQ ID NO: 4390835 - DNA, 21 bp, Homo sapiens
atccttgtgacttacaatttg

SEQ ID NO: 4390836 - DNA, 19 bp, Homo sapiens
atcctttagggttctgcct

SEQ ID NO: 4390837 - DNA, 21 bp, Homo sapiens
atcctttagggttctgcctct

SEQ ID NO: 4390838 - DNA, 22 bp, Homo sapiens
atcctttatacagttgtataaa

SEQ ID NO: 4390839 - DNA, 19 bp, Homo sapiens
atcctttggtcctggtgct

SEQ ID NO: 4390840 - DNA, 18 bp, Homo sapiens
atccttttatctcacaaa

SEQ ID NO: 4390841 - DNA, 13 bp, Homo sapiens
atccttttcctta

SEQ ID NO: 4390842 - DNA, 14 bp, Homo sapiens
atccttttccttat

SEQ ID NO: 4390843 - DNA, 13 bp, Homo sapiens
atccttttgcctg

SEQ ID NO: 4390844 - DNA, 15 bp, Homo sapiens
atcgaaccgttttga

SEQ ID NO: 4390845 - DNA, 15 bp, Homo sapiens
atcgaagcaaaagta

SEQ ID NO: 4390846 - DNA, 20 bp, Homo sapiens
atcgaatctactaattccac

SEQ ID NO: 4390847 - DNA, 17 bp, Homo sapiens
atcgagaccatcctggc

SEQ ID NO: 4390848 - DNA, 12 bp, Homo sapiens
atcgcctttccc

SEQ ID NO: 4390849 - DNA, 18 bp, Homo sapiens
atcgctgcacatggcctg

SEQ ID NO: 4390850 - DNA, 21 bp, Homo sapiens
atcgctgctacatcagactct

SEQ ID NO: 4390851 - DNA, 21 bp, Homo sapiens
atcgctgttctgggcatggca

SEQ ID NO: 4390852 - DNA, 15 bp, Homo sapiens
atcggaaaaataatc

SEQ ID NO: 4390853 - DNA, 13 bp, Homo sapiens
atcggactgccaa

SEQ ID NO: 4390854 - DNA, 14 bp, Homo sapiens
atcggactgccaaa

SEQ ID NO: 4390855 - DNA, 15 bp, Homo sapiens
atcggactgccaaat

SEQ ID NO: 4390856 - DNA, 16 bp, Homo sapiens
atcggattactgaatt

SEQ ID NO: 4390857 - DNA, 23 bp, Homo sapiens
atcggccaagaatacttgaagaa

SEQ ID NO: 4390858 - DNA, 20 bp, Homo sapiens
atcggctggggactgctacc

SEQ ID NO: 4390859 - DNA, 15 bp, Homo sapiens
atcgggagcacccag

SEQ ID NO: 4390860 - DNA, 18 bp, Homo sapiens
atcgggagcacccagagc

SEQ ID NO: 4390861 - DNA, 19 bp, Homo sapiens
atcgggagcacccagagca

SEQ ID NO: 4390862 - DNA, 20 bp, Homo sapiens
atcgggtccagagaccacac

SEQ ID NO: 4390863 - DNA, 22 bp, Homo sapiens
atcgggtccagagaccacacca

SEQ ID NO: 4390864 - DNA, 18 bp, Homo sapiens
atcgtgaaatcctcagcc

SEQ ID NO: 4390865 - DNA, 18 bp, Homo sapiens
atcgtgccgttactctcc

SEQ ID NO: 4390866 - DNA, 21 bp, Homo sapiens
atcgtggcacgtattgctgtg

SEQ ID NO: 4390867 - DNA, 18 bp, Homo sapiens
atcgttaagcacaagaca

SEQ ID NO: 4390868 - DNA, 13 bp, Homo sapiens
atcgttctgctgg

SEQ ID NO: 4390869 - DNA, 14 bp, Homo sapiens
atcgttctgctggc

SEQ ID NO: 4390870 - DNA, 20 bp, Homo sapiens
atcgttgcaaccactgcaat

SEQ ID NO: 4390871 - DNA, 18 bp, Homo sapiens
atctaaaagctctgttcc

SEQ ID NO: 4390872 - DNA, 22 bp, Homo sapiens
atctaaaatttcataattctga

SEQ ID NO: 4390873 - DNA, 18 bp, Homo sapiens
atctaaacagttatttct

SEQ ID NO: 4390874 - DNA, 19 bp, Homo sapiens
atctaaacagttatttctg

SEQ ID NO: 4390875 - DNA, 22 bp, Homo sapiens
atctaaagctttatctttgtgt

SEQ ID NO: 4390876 - DNA, 17 bp, Homo sapiens
atctaaagttatatttc

SEQ ID NO: 4390877 - DNA, 15 bp, Homo sapiens
atctaacaataatat

SEQ ID NO: 4390878 - DNA, 16 bp, Homo sapiens
atctaacaatggaaga

SEQ ID NO: 4390879 - DNA, 14 bp, Homo sapiens
atctaacattatta

SEQ ID NO: 4390880 - DNA, 16 bp, Homo sapiens
atctaacattattact

SEQ ID NO: 4390881 - DNA, 15 bp, Homo sapiens
atctaaccctcccat

SEQ ID NO: 4390882 - DNA, 22 bp, Homo sapiens
atctaaccctcccatggcacct

SEQ ID NO: 4390883 - DNA, 13 bp, Homo sapiens
atctaacctcatc

SEQ ID NO: 4390884 - DNA, 22 bp, Homo sapiens
atctaactgatgagtaaactga

SEQ ID NO: 4390885 - DNA, 17 bp, Homo sapiens
atctaagaataataaaa

SEQ ID NO: 4390886 - DNA, 17 bp, Homo sapiens
atctaatgcttgtttat

SEQ ID NO: 4390887 - DNA, 15 bp, Homo sapiens
atctaatttataaaa

SEQ ID NO: 4390888 - DNA, 18 bp, Homo sapiens
atctacaaagaaaaatta

SEQ ID NO: 4390889 - DNA, 12 bp, Homo sapiens
atctacaagcca

SEQ ID NO: 4390890 - DNA, 13 bp, Homo sapiens
atctacacatgtt

SEQ ID NO: 4390891 - DNA, 19 bp, Homo sapiens
atctacactccagtgagac

SEQ ID NO: 4390892 - DNA, 14 bp, Homo sapiens
atctacattataat

SEQ ID NO: 4390893 - DNA, 14 bp, Homo sapiens
atctaccccagact

SEQ ID NO: 4390894 - DNA, 20 bp, Homo sapiens
atctaccccagactagatgt

SEQ ID NO: 4390895 - DNA, 16 bp, Homo sapiens
atctacctaaaggact

SEQ ID NO: 4390896 - DNA, 18 bp, Homo sapiens
ataatgcagtatggtaca

SEQ ID NO: 4390897 - DNA, 20 bp, Homo sapiens
ataatgccaatgaacatctc

SEQ ID NO: 4390898 - DNA, 15 bp, Homo sapiens
ataatgcctttgtaa

SEQ ID NO: 4390899 - DNA, 12 bp, Homo sapiens
ataatgctttct

SEQ ID NO: 4390900 - DNA, 13 bp, Homo sapiens
ataatgctttctg

SEQ ID NO: 4390901 - DNA, 15 bp, Homo sapiens
ataatgctttctgag

SEQ ID NO: 4390902 - DNA, 16 bp, Homo sapiens
ataatgctttggaaaa

SEQ ID NO: 4390903 - DNA, 23 bp, Homo sapiens
ataatgggccactgaaatctgtc

SEQ ID NO: 4390904 - DNA, 20 bp, Homo sapiens
ataatgtactgatttcagta

SEQ ID NO: 4390905 - DNA, 13 bp, Homo sapiens
ataatgtatttga

SEQ ID NO: 4390906 - DNA, 15 bp, Homo sapiens
ataatgtatttgaaa

SEQ ID NO: 4390907 - DNA, 20 bp, Homo sapiens
ataatgtattttctttttat

SEQ ID NO: 4390908 - DNA, 16 bp, Homo sapiens
ataatgtgaaaatggt

SEQ ID NO: 4390909 - DNA, 16 bp, Homo sapiens
ataatgtttattaaat

SEQ ID NO: 4390910 - DNA, 19 bp, Homo sapiens
ataattagatccattaatt

SEQ ID NO: 4390911 - DNA, 12 bp, Homo sapiens
ataattatgaaa

SEQ ID NO: 4390912 - DNA, 17 bp, Homo sapiens
ataattcagaactaaat

SEQ ID NO: 4390913 - DNA, 14 bp, Homo sapiens
ataattcatatcta

SEQ ID NO: 4390914 - DNA, 16 bp, Homo sapiens
ataattcatatctaaa

SEQ ID NO: 4390915 - DNA, 19 bp, Homo sapiens
ataattcctacagcactac

SEQ ID NO: 4390916 - DNA, 14 bp, Homo sapiens
ataattctcattaa

SEQ ID NO: 4390917 - DNA, 13 bp, Homo sapiens
ataattctgaaac

SEQ ID NO: 4390918 - DNA, 14 bp, Homo sapiens
ataattctgaaaca

SEQ ID NO: 4390919 - DNA, 20 bp, Homo sapiens
ataattctgagttttgtgtt

SEQ ID NO: 4390920 - DNA, 17 bp, Homo sapiens
ataattctgttatatga

SEQ ID NO: 4390921 - DNA, 20 bp, Homo sapiens
ataattcttccttccctcct

SEQ ID NO: 4390922 - DNA, 19 bp, Homo sapiens
ataattgagttttcagtgg

SEQ ID NO: 4390923 - DNA, 13 bp, Homo sapiens
ataattgtactgt

SEQ ID NO: 4390924 - DNA, 18 bp, Homo sapiens
ataatttaataaaaagga

SEQ ID NO: 4390925 - DNA, 16 bp, Homo sapiens
ataatttaatgtaaat

SEQ ID NO: 4390926 - DNA, 17 bp, Homo sapiens
ataatttaatgtaaata

SEQ ID NO: 4390927 - DNA, 22 bp, Homo sapiens
ataatttaatgtaaataaaaca

SEQ ID NO: 4390928 - DNA, 16 bp, Homo sapiens
ataatttacctaagat

SEQ ID NO: 4390929 - DNA, 18 bp, Homo sapiens
ataatttagttgtttcta

SEQ ID NO: 4390930 - DNA, 14 bp, Homo sapiens
ataattttaaattc

SEQ ID NO: 4390931 - DNA, 19 bp, Homo sapiens
ataatttttccttttgcca

SEQ ID NO: 4390932 - DNA, 19 bp, Homo sapiens
ataatttttgctgaattcc

SEQ ID NO: 4390933 - DNA, 22 bp, Homo sapiens
ataattttttttaaaatagaaa

SEQ ID NO: 4390934 - DNA, 23 bp, Homo sapiens
atacaaaaagcaaaacaaaaccc

SEQ ID NO: 4390935 - DNA, 13 bp, Homo sapiens
atacaaactctca

SEQ ID NO: 4390936 - DNA, 17 bp, Homo sapiens
atacaaagatgactggt

SEQ ID NO: 4390937 - DNA, 16 bp, Homo sapiens
atacaaagtggaaact

SEQ ID NO: 4390938 - DNA, 14 bp, Homo sapiens
atacaaatttggcc

SEQ ID NO: 4390939 - DNA, 19 bp, Homo sapiens
atacaaattttcagaaggt

SEQ ID NO: 4390940 - DNA, 19 bp, Homo sapiens
atacaacctaacttatgga

SEQ ID NO: 4390941 - DNA, 13 bp, Homo sapiens
atacaagtaattt

SEQ ID NO: 4390942 - DNA, 21 bp, Homo sapiens
atacaagtcatggtcacagta

SEQ ID NO: 4390943 - DNA, 13 bp, Homo sapiens
atacaataaaaca

SEQ ID NO: 4390944 - DNA, 20 bp, Homo sapiens
atacaataaaacaaataaat

SEQ ID NO: 4390945 - DNA, 12 bp, Homo sapiens
atacaataaatt

SEQ ID NO: 4390946 - DNA, 14 bp, Homo sapiens
atacaataaattgc

SEQ ID NO: 4390947 - DNA, 14 bp, Homo sapiens
atacaatatatagc

SEQ ID NO: 4390948 - DNA, 16 bp, Homo sapiens
atacaatatatagctg

SEQ ID NO: 4390949 - DNA, 19 bp, Homo sapiens
atacaattggacgcatttt

SEQ ID NO: 4390950 - DNA, 22 bp, Homo sapiens
atacacaaagctttcttttcta

SEQ ID NO: 4390951 - DNA, 21 bp, Homo sapiens
atacacagaggagtgcagcct

SEQ ID NO: 4390952 - DNA, 13 bp, Homo sapiens
atacacagtaatt

SEQ ID NO: 4390953 - DNA, 18 bp, Homo sapiens
atacacagttaaataaat

SEQ ID NO: 4390954 - DNA, 20 bp, Homo sapiens
atacacagttaaataaatag

SEQ ID NO: 4390955 - DNA, 13 bp, Homo sapiens
atacaccagaaga

SEQ ID NO: 4390956 - DNA, 24 bp, Homo sapiens
atacacccaagatgggcatctttt

SEQ ID NO: 4390957 - DNA, 15 bp, Homo sapiens
atacactatgaaatt

SEQ ID NO: 4390958 - DNA, 14 bp, Homo sapiens
atacactgcacttt

SEQ ID NO: 4390959 - DNA, 23 bp, Homo sapiens
atacactttttctctttccatga

SEQ ID NO: 4390960 - DNA, 18 bp, Homo sapiens
atacagaactctttcaaa

SEQ ID NO: 4390961 - DNA, 20 bp, Homo sapiens
atacagaactctttcaaaac

SEQ ID NO: 4390962 - DNA, 12 bp, Homo sapiens
atacagaggaga

SEQ ID NO: 4390963 - DNA, 16 bp, Homo sapiens
atacagaggtaactat

SEQ ID NO: 4390964 - DNA, 13 bp, Homo sapiens
atacaggaaacag

SEQ ID NO: 4390965 - DNA, 15 bp, Homo sapiens
atacaggaaacagtt

SEQ ID NO: 4390966 - DNA, 17 bp, Homo sapiens
atacagtcttccacaaa

SEQ ID NO: 4390967 - DNA, 19 bp, Homo sapiens
atacagtcttccatttgca

SEQ ID NO: 4390968 - DNA, 17 bp, Homo sapiens
atacagtgcagagcctt

SEQ ID NO: 4390969 - DNA, 14 bp, Homo sapiens
atacagtgttaaaa

SEQ ID NO: 4390970 - DNA, 16 bp, Homo sapiens
atacagtgttaaaaga

SEQ ID NO: 4390971 - DNA, 16 bp, Homo sapiens
atacagttacttaatg

SEQ ID NO: 4390972 - DNA, 17 bp, Homo sapiens
atacagttacttaatga

SEQ ID NO: 4390973 - DNA, 15 bp, Homo sapiens
atacagttataaaat

SEQ ID NO: 4390974 - DNA, 21 bp, Homo sapiens
atacagttctgctctggttgt

SEQ ID NO: 4390975 - DNA, 20 bp, Homo sapiens
atacagttgaaaacttgtaa

SEQ ID NO: 4390976 - DNA, 16 bp, Homo sapiens
atacagttttcattga

SEQ ID NO: 4390977 - DNA, 14 bp, Homo sapiens
atacatacatgtat

SEQ ID NO: 4390978 - DNA, 16 bp, Homo sapiens
atacatacatgtatct

SEQ ID NO: 4390979 - DNA, 20 bp, Homo sapiens
atacatacatgtatctggtt

SEQ ID NO: 4390980 - DNA, 13 bp, Homo sapiens
atacatactaatg

SEQ ID NO: 4390981 - DNA, 14 bp, Homo sapiens
atacatactaatga

SEQ ID NO: 4390982 - DNA, 13 bp, Homo sapiens
atacatcacatct

SEQ ID NO: 4390983 - DNA, 18 bp, Homo sapiens
agggctagaacctggagg

SEQ ID NO: 4390984 - DNA, 13 bp, Homo sapiens
agggctccaggag

SEQ ID NO: 4390985 - DNA, 13 bp, Homo sapiens
agggctcccaggg

SEQ ID NO: 4390986 - DNA, 14 bp, Homo sapiens
agggctctgtttgt

SEQ ID NO: 4390987 - DNA, 20 bp, Homo sapiens
agggctgatggattccaaac

SEQ ID NO: 4390988 - DNA, 20 bp, Homo sapiens
agggctgccttctggccttg

SEQ ID NO: 4390989 - DNA, 21 bp, Homo sapiens
agggctggagacttcctctgg

SEQ ID NO: 4390990 - DNA, 15 bp, Homo sapiens
agggctggaggccca

SEQ ID NO: 4390991 - DNA, 19 bp, Homo sapiens
agggctggaggcccaggct

SEQ ID NO: 4390992 - DNA, 17 bp, Homo sapiens
agggctggcccagccct

SEQ ID NO: 4390993 - DNA, 23 bp, Homo sapiens
agggctggcccagccctgctggc

SEQ ID NO: 4390994 - DNA, 18 bp, Homo sapiens
agggctggccgggactgc

SEQ ID NO: 4390995 - DNA, 20 bp, Homo sapiens
agggctggccgggactgctg

SEQ ID NO: 4390996 - DNA, 12 bp, Homo sapiens
agggctggctcc

SEQ ID NO: 4390997 - DNA, 13 bp, Homo sapiens
agggctggctccc

SEQ ID NO: 4390998 - DNA, 12 bp, Homo sapiens
agggctggctgg

SEQ ID NO: 4390999 - DNA, 21 bp, Homo sapiens
agggctgggcaaggaaaaaga

SEQ ID NO: 4391000 - DNA, 12 bp, Homo sapiens
agggctgggcca

SEQ ID NO: 4391001 - DNA, 15 bp, Homo sapiens
agggctggggacaga

SEQ ID NO: 4391002 - DNA, 16 bp, Homo sapiens
agggctggggttgcca

SEQ ID NO: 4391003 - DNA, 17 bp, Homo sapiens
agggctggggttgccag

SEQ ID NO: 4391004 - DNA, 20 bp, Homo sapiens
agggctggggttgccagagg

SEQ ID NO: 4391005 - DNA, 22 bp, Homo sapiens
agggctggggttgccagaggcc

SEQ ID NO: 4391006 - DNA, 16 bp, Homo sapiens
agggctggttaatgta

SEQ ID NO: 4391007 - DNA, 13 bp, Homo sapiens
agggcttcctcaa

SEQ ID NO: 4391008 - DNA, 16 bp, Homo sapiens
agggcttcctcaaata

SEQ ID NO: 4391009 - DNA, 22 bp, Homo sapiens
agggcttcctctagaagccaag

SEQ ID NO: 4391010 - DNA, 20 bp, Homo sapiens
agggcttggggctgcacctc

SEQ ID NO: 4391011 - DNA, 17 bp, Homo sapiens
aggggaaaaaaatgttg

SEQ ID NO: 4391012 - DNA, 20 bp, Homo sapiens
aggggaaagacttccatcta

SEQ ID NO: 4391013 - DNA, 18 bp, Homo sapiens
aggggaagagaagacaaa

SEQ ID NO: 4391014 - DNA, 23 bp, Homo sapiens
aggggaagcaggacccagtggtc

SEQ ID NO: 4391015 - DNA, 21 bp, Homo sapiens
aggggaattccctccccctcc

SEQ ID NO: 4391016 - DNA, 18 bp, Homo sapiens
aggggacacctgtacatt

SEQ ID NO: 4391017 - DNA, 17 bp, Homo sapiens
aggggacgctgaggaag

SEQ ID NO: 4391018 - DNA, 14 bp, Homo sapiens
aggggactcagccc

SEQ ID NO: 4391019 - DNA, 11 bp, Homo sapiens
aggggagaaag

SEQ ID NO: 4391020 - DNA, 16 bp, Homo sapiens
aggggagagcctgctg

SEQ ID NO: 4391021 - DNA, 17 bp, Homo sapiens
aggggagagcctgctgg

SEQ ID NO: 4391022 - DNA, 17 bp, Homo sapiens
aggggagccaaggagga

SEQ ID NO: 4391023 - DNA, 13 bp, Homo sapiens
aggggagggcagg

SEQ ID NO: 4391024 - DNA, 17 bp, Homo sapiens
aggggcaaattcttttg

SEQ ID NO: 4391025 - DNA, 23 bp, Homo sapiens
aggggcaaccaactgccccaggg

SEQ ID NO: 4391026 - DNA, 14 bp, Homo sapiens
aggggcagccacac

SEQ ID NO: 4391027 - DNA, 14 bp, Homo sapiens
aggggcatctgccc

SEQ ID NO: 4391028 - DNA, 16 bp, Homo sapiens
aggggcatctgcccct

SEQ ID NO: 4391029 - DNA, 19 bp, Homo sapiens
aggggcatctgcccctccc

SEQ ID NO: 4391030 - DNA, 22 bp, Homo sapiens
aggggcatctgcccctccccca

SEQ ID NO: 4391031 - DNA, 15 bp, Homo sapiens
aggggcattgctgac

SEQ ID NO: 4391032 - DNA, 16 bp, Homo sapiens
aggggccaacctcagg

SEQ ID NO: 4391033 - DNA, 14 bp, Homo sapiens
aggggccagaggct

SEQ ID NO: 4391034 - DNA, 13 bp, Homo sapiens
aggggcctctctc

SEQ ID NO: 4391035 - DNA, 20 bp, Homo sapiens
aggggcctctctcctgcctg

SEQ ID NO: 4391036 - DNA, 23 bp, Homo sapiens
aggggcctctctcctgcctgccc

SEQ ID NO: 4391037 - DNA, 19 bp, Homo sapiens
aggggctcagggcctcagg

SEQ ID NO: 4391038 - DNA, 13 bp, Homo sapiens
aggggctgcaggg

SEQ ID NO: 4391039 - DNA, 18 bp, Homo sapiens
aggggctggggacttgtg

SEQ ID NO: 4391040 - DNA, 19 bp, Homo sapiens
aggggctgtggccgtctcc

SEQ ID NO: 4391041 - DNA, 18 bp, Homo sapiens
aggggctgttaggacagc

SEQ ID NO: 4391042 - DNA, 13 bp, Homo sapiens
aggggcttcctgg

SEQ ID NO: 4391043 - DNA, 18 bp, Homo sapiens
agggggagtagccaagct

SEQ ID NO: 4391044 - DNA, 20 bp, Homo sapiens
agggggccccgccagggctg

SEQ ID NO: 4391045 - DNA, 15 bp, Homo sapiens
agggggccctgcccc

SEQ ID NO: 4391046 - DNA, 20 bp, Homo sapiens
agggggccctgccccacccc

SEQ ID NO: 4391047 - DNA, 15 bp, Homo sapiens
agggggtggaggggt

SEQ ID NO: 4391048 - DNA, 22 bp, Homo sapiens
agggggtgtctgcaccttagaa

SEQ ID NO: 4391049 - DNA, 15 bp, Homo sapiens
aggggtcccccctca

SEQ ID NO: 4391050 - DNA, 13 bp, Homo sapiens
aggggtctgtctg

SEQ ID NO: 4391051 - DNA, 19 bp, Homo sapiens
aggggtgagagacctgctc

SEQ ID NO: 4391052 - DNA, 20 bp, Homo sapiens
aggggtgagagacctgctca

SEQ ID NO: 4391053 - DNA, 21 bp, Homo sapiens
aggggtgagagacctgctcag

SEQ ID NO: 4391054 - DNA, 13 bp, Homo sapiens
aggggtgctcctg

SEQ ID NO: 4391055 - DNA, 15 bp, Homo sapiens
aggggtggcccagag

SEQ ID NO: 4391056 - DNA, 16 bp, Homo sapiens
aggggtggcccagagc

SEQ ID NO: 4391057 - DNA, 17 bp, Homo sapiens
aggggtggcccagagcc

SEQ ID NO: 4391058 - DNA, 18 bp, Homo sapiens
aggggtggcccagagcca

SEQ ID NO: 4391059 - DNA, 19 bp, Homo sapiens
aggggtgggggtggaggct

SEQ ID NO: 4391060 - DNA, 18 bp, Homo sapiens
aggggtgtggcagtggtt

SEQ ID NO: 4391061 - DNA, 21 bp, Homo sapiens
aggggttaacttggtcagagc

SEQ ID NO: 4391062 - DNA, 23 bp, Homo sapiens
aggggttaacttggtcagagcca

SEQ ID NO: 4391063 - DNA, 20 bp, Homo sapiens
aggggttggttgaggtggaa

SEQ ID NO: 4391064 - DNA, 11 bp, Homo sapiens
aggggtttaca

SEQ ID NO: 4391065 - DNA, 15 bp, Homo sapiens
agggtagcaggtacc

SEQ ID NO: 4391066 - DNA, 16 bp, Homo sapiens
agggtagcccgcctgc

SEQ ID NO: 4391067 - DNA, 14 bp, Homo sapiens
agggtcaatgctat

SEQ ID NO: 4391068 - DNA, 13 bp, Homo sapiens
agggtcaccctgg

SEQ ID NO: 4391069 - DNA, 15 bp, Homo sapiens
agggtcaccctggcc

SEQ ID NO: 4391070 - DNA, 15 bp, Homo sapiens
agggtcactggcctc

SEQ ID NO: 4391071 - DNA, 16 bp, Homo sapiens
agggtcactggcctct

SEQ ID NO: 4391072 - DNA, 20 bp, Homo sapiens
agggtcactggcctctcccc

SEQ ID NO: 4391073 - DNA, 12 bp, Homo sapiens
agggtcaggccc

SEQ ID NO: 4391074 - DNA, 20 bp, Homo sapiens
agggtcaggcccgtcagcat

SEQ ID NO: 4391075 - DNA, 20 bp, Homo sapiens
agggtccaggaatggtgctt

SEQ ID NO: 4391076 - DNA, 15 bp, Homo sapiens
agggtcccttttgca

SEQ ID NO: 4391077 - DNA, 17 bp, Homo sapiens
agggtcctctcttccac

SEQ ID NO: 4391078 - DNA, 19 bp, Homo sapiens
agggtcctctcttccacag

SEQ ID NO: 4391079 - DNA, 16 bp, Homo sapiens
agggtcctggctcctg

SEQ ID NO: 4391080 - DNA, 19 bp, Homo sapiens
agggtcctggctcctgagg

SEQ ID NO: 4391081 - DNA, 16 bp, Homo sapiens
agggtcggaggtgctg

SEQ ID NO: 4391082 - DNA, 13 bp, Homo sapiens
agggtctggagaa

SEQ ID NO: 4391083 - DNA, 19 bp, Homo sapiens
agggtctggagaagcagtg

SEQ ID NO: 4391084 - DNA, 15 bp, Homo sapiens
agggtcttccctacc

SEQ ID NO: 4391085 - DNA, 17 bp, Homo sapiens
agggtcttccctacctc

SEQ ID NO: 4391086 - DNA, 14 bp, Homo sapiens
agggtcttgctctg

SEQ ID NO: 4391087 - DNA, 18 bp, Homo sapiens
agggtgacttttcctgct

SEQ ID NO: 4391088 - DNA, 22 bp, Homo sapiens
agggtgacttttcctgctgcct

SEQ ID NO: 4391089 - DNA, 19 bp, Homo sapiens
ataaatttaagaaaacaag

SEQ ID NO: 4391090 - DNA, 20 bp, Homo sapiens
ataaatttcccagttaaaga

SEQ ID NO: 4391091 - DNA, 14 bp, Homo sapiens
ataaatttctgtct

SEQ ID NO: 4391092 - DNA, 13 bp, Homo sapiens
ataaattttaatt

SEQ ID NO: 4391093 - DNA, 14 bp, Homo sapiens
ataaattttaattc

SEQ ID NO: 4391094 - DNA, 15 bp, Homo sapiens
ataaattttaattca

SEQ ID NO: 4391095 - DNA, 17 bp, Homo sapiens
ataaattttaattcaag

SEQ ID NO: 4391096 - DNA, 19 bp, Homo sapiens
ataaattttaattcaagaa

SEQ ID NO: 4391097 - DNA, 21 bp, Homo sapiens
ataaattttaattcaagaaat

SEQ ID NO: 4391098 - DNA, 14 bp, Homo sapiens
ataaattttctaaa

SEQ ID NO: 4391099 - DNA, 11 bp, Homo sapiens
ataacaaaaaa

SEQ ID NO: 4391100 - DNA, 12 bp, Homo sapiens
ataacaaaagca

SEQ ID NO: 4391101 - DNA, 19 bp, Homo sapiens
ataacaagcatgcataaat

SEQ ID NO: 4391102 - DNA, 21 bp, Homo sapiens
ataacaagcatgcataaatca

SEQ ID NO: 4391103 - DNA, 16 bp, Homo sapiens
ataacacagatattgt

SEQ ID NO: 4391104 - DNA, 23 bp, Homo sapiens
ataacacagatattgttataaat

SEQ ID NO: 4391105 - DNA, 21 bp, Homo sapiens
ataacactgtattttaatgta

SEQ ID NO: 4391106 - DNA, 20 bp, Homo sapiens
ataacagatgtgaaaatata

SEQ ID NO: 4391107 - DNA, 19 bp, Homo sapiens
ataacagccttttccttct

SEQ ID NO: 4391108 - DNA, 12 bp, Homo sapiens
ataacagtgcag

SEQ ID NO: 4391109 - DNA, 21 bp, Homo sapiens
ataacagtgtctttctagcca

SEQ ID NO: 4391110 - DNA, 18 bp, Homo sapiens
ataacatctttattgaaa

SEQ ID NO: 4391111 - DNA, 15 bp, Homo sapiens
ataacattttctata

SEQ ID NO: 4391112 - DNA, 12 bp, Homo sapiens
ataacccacttt

SEQ ID NO: 4391113 - DNA, 15 bp, Homo sapiens
ataacctagttaaag

SEQ ID NO: 4391114 - DNA, 19 bp, Homo sapiens
ataacctagttaaagaaag

SEQ ID NO: 4391115 - DNA, 22 bp, Homo sapiens
ataacctgtctcacctggactt

SEQ ID NO: 4391116 - DNA, 22 bp, Homo sapiens
ataacgtttaagccaaaacaat

SEQ ID NO: 4391117 - DNA, 15 bp, Homo sapiens
ataactaaaatgtat

SEQ ID NO: 4391118 - DNA, 19 bp, Homo sapiens
ataactcctgtcccttttc

SEQ ID NO: 4391119 - DNA, 22 bp, Homo sapiens
ataactcctgtcccttttccct

SEQ ID NO: 4391120 - DNA, 17 bp, Homo sapiens
ataactgaaaatgaaag

SEQ ID NO: 4391121 - DNA, 15 bp, Homo sapiens
ataactgaaaatgtg

SEQ ID NO: 4391122 - DNA, 14 bp, Homo sapiens
ataactgaaggaga

SEQ ID NO: 4391123 - DNA, 23 bp, Homo sapiens
ataactgagatattattttaaat

SEQ ID NO: 4391124 - DNA, 19 bp, Homo sapiens
ataactgatttctatggct

SEQ ID NO: 4391125 - DNA, 13 bp, Homo sapiens
ataactgcttctt

SEQ ID NO: 4391126 - DNA, 20 bp, Homo sapiens
ataactgtaaatgtgacatt

SEQ ID NO: 4391127 - DNA, 18 bp, Homo sapiens
ataactgtatttgaaata

SEQ ID NO: 4391128 - DNA, 13 bp, Homo sapiens
ataactgtcttgt

SEQ ID NO: 4391129 - DNA, 14 bp, Homo sapiens
ataactgtcttgtt

SEQ ID NO: 4391130 - DNA, 17 bp, Homo sapiens
ataactgtcttgtttca

SEQ ID NO: 4391131 - DNA, 21 bp, Homo sapiens
ataactgttttagaaattggt

SEQ ID NO: 4391132 - DNA, 13 bp, Homo sapiens
ataacttcaaatt

SEQ ID NO: 4391133 - DNA, 13 bp, Homo sapiens
ataacttgtaagt

SEQ ID NO: 4391134 - DNA, 18 bp, Homo sapiens
ataacttttttttaagtt

SEQ ID NO: 4391135 - DNA, 21 bp, Homo sapiens
ataagaaacttttttatttaa

SEQ ID NO: 4391136 - DNA, 22 bp, Homo sapiens
ataagaaacttttttatttaaa

SEQ ID NO: 4391137 - DNA, 14 bp, Homo sapiens
ataagaacagatca

SEQ ID NO: 4391138 - DNA, 20 bp, Homo sapiens
ataagaagaatgcttaatca

SEQ ID NO: 4391139 - DNA, 15 bp, Homo sapiens
ataagacaaaaataa

SEQ ID NO: 4391140 - DNA, 17 bp, Homo sapiens
ataagacaatagtattt

SEQ ID NO: 4391141 - DNA, 22 bp, Homo sapiens
ataagacattttgtttttactg

SEQ ID NO: 4391142 - DNA, 17 bp, Homo sapiens
ataagataaaataaaat

SEQ ID NO: 4391143 - DNA, 21 bp, Homo sapiens
ataagataaaataaaatttta

SEQ ID NO: 4391144 - DNA, 19 bp, Homo sapiens
ataagatgtattctttata

SEQ ID NO: 4391145 - DNA, 21 bp, Homo sapiens
ataagattccaaaaagcacat

SEQ ID NO: 4391146 - DNA, 13 bp, Homo sapiens
ataagatttagtt

SEQ ID NO: 4391147 - DNA, 21 bp, Homo sapiens
ataagatttagttgagttatt

SEQ ID NO: 4391148 - DNA, 18 bp, Homo sapiens
ataagatttttcaaaatc

SEQ ID NO: 4391149 - DNA, 20 bp, Homo sapiens
ataagcaaaaacaaaaagaa

SEQ ID NO: 4391150 - DNA, 16 bp, Homo sapiens
ataagcaagaaggcaa

SEQ ID NO: 4391151 - DNA, 21 bp, Homo sapiens
ataagcaagaaggcaaaaata

SEQ ID NO: 4391152 - DNA, 13 bp, Homo sapiens
ataagcagaacat

SEQ ID NO: 4391153 - DNA, 20 bp, Homo sapiens
ataagcagaacatactgttc

SEQ ID NO: 4391154 - DNA, 18 bp, Homo sapiens
ataagcgtatttagactg

SEQ ID NO: 4391155 - DNA, 16 bp, Homo sapiens
ataagctactgccatc

SEQ ID NO: 4391156 - DNA, 15 bp, Homo sapiens
ataagcttaaatagg

SEQ ID NO: 4391157 - DNA, 20 bp, Homo sapiens
ataagcttttgttttttaaa

SEQ ID NO: 4391158 - DNA, 11 bp, Homo sapiens
ataaggaaact

SEQ ID NO: 4391159 - DNA, 17 bp, Homo sapiens
ataaggagaaagaaagt

SEQ ID NO: 4391160 - DNA, 19 bp, Homo sapiens
ataaggagttagaaccaca

SEQ ID NO: 4391161 - DNA, 20 bp, Homo sapiens
ataaggattctgaagtttta

SEQ ID NO: 4391162 - DNA, 17 bp, Homo sapiens
ataaggtgctctctttc

SEQ ID NO: 4391163 - DNA, 17 bp, Homo sapiens
ataagtcaacagtaaac

SEQ ID NO: 4391164 - DNA, 18 bp, Homo sapiens
ataagtcaacagtaaacc

SEQ ID NO: 4391165 - DNA, 22 bp, Homo sapiens
ataagtggacaaattttgagtt

SEQ ID NO: 4391166 - DNA, 16 bp, Homo sapiens
ataagttattgcagtt

SEQ ID NO: 4391167 - DNA, 20 bp, Homo sapiens
ataagttattgcagtttatc

SEQ ID NO: 4391168 - DNA, 24 bp, Homo sapiens
ataagttattgcagtttatcattc

SEQ ID NO: 4391169 - DNA, 17 bp, Homo sapiens
ataagttcttaaaaaat

SEQ ID NO: 4391170 - DNA, 21 bp, Homo sapiens
ataagttgctgtaaaatttgt

SEQ ID NO: 4391171 - DNA, 13 bp, Homo sapiens
ataataaaatcac

SEQ ID NO: 4391172 - DNA, 22 bp, Homo sapiens
ataataaagtattccaccttaa

SEQ ID NO: 4391173 - DNA, 14 bp, Homo sapiens
ataataatagtact

SEQ ID NO: 4391174 - DNA, 17 bp, Homo sapiens
ataataatgccaatgaa

SEQ ID NO: 4391175 - DNA, 21 bp, Homo sapiens
ataatacagaatcttgttttg

SEQ ID NO: 4391176 - DNA, 17 bp, Homo sapiens
ataatacatactaatga

SEQ ID NO: 4391177 - DNA, 22 bp, Homo sapiens
ataatactgttttaaaatgtga

SEQ ID NO: 4391178 - DNA, 18 bp, Homo sapiens
ataatactttgtatacaa

SEQ ID NO: 4391179 - DNA, 12 bp, Homo sapiens
ataaaaatggat

SEQ ID NO: 4391180 - DNA, 14 bp, Homo sapiens
ataaaaatgtcttg

SEQ ID NO: 4391181 - DNA, 15 bp, Homo sapiens
ataaaaattaagctt

SEQ ID NO: 4391182 - DNA, 18 bp, Homo sapiens
ataaaaccctatacaagt

SEQ ID NO: 4391183 - DNA, 16 bp, Homo sapiens
ataaaactatttgtat

SEQ ID NO: 4391184 - DNA, 20 bp, Homo sapiens
ataaaactgcgaggacatca

SEQ ID NO: 4391185 - DNA, 17 bp, Homo sapiens
ataaaactgtttgactt

SEQ ID NO: 4391186 - DNA, 22 bp, Homo sapiens
ataaaactgtttgacttctcaa

SEQ ID NO: 4391187 - DNA, 17 bp, Homo sapiens
ataaaacttaaaaacaa

SEQ ID NO: 4391188 - DNA, 17 bp, Homo sapiens
ataaaagcaattccaac

SEQ ID NO: 4391189 - DNA, 20 bp, Homo sapiens
ataaaagctttgactccctg

SEQ ID NO: 4391190 - DNA, 21 bp, Homo sapiens
ataaaaggtggagtttctctg

SEQ ID NO: 4391191 - DNA, 13 bp, Homo sapiens
ataaaatatcaat

SEQ ID NO: 4391192 - DNA, 21 bp, Homo sapiens
ataaaatattttgttaacttt

SEQ ID NO: 4391193 - DNA, 18 bp, Homo sapiens
ataaaatgaaaattgtat

SEQ ID NO: 4391194 - DNA, 16 bp, Homo sapiens
ataaaatgaaatgcta

SEQ ID NO: 4391195 - DNA, 16 bp, Homo sapiens
ataaaatgctcctaga

SEQ ID NO: 4391196 - DNA, 23 bp, Homo sapiens
ataaaatgctcctagaagtctta

SEQ ID NO: 4391197 - DNA, 14 bp, Homo sapiens
ataaaatgctttaa

SEQ ID NO: 4391198 - DNA, 20 bp, Homo sapiens
ataaaattgcagtttcatgt

SEQ ID NO: 4391199 - DNA, 13 bp, Homo sapiens
ataaaatttgttg

SEQ ID NO: 4391200 - DNA, 16 bp, Homo sapiens
ataaaatttgttgcat

SEQ ID NO: 4391201 - DNA, 15 bp, Homo sapiens
ataaaattttttaaa

SEQ ID NO: 4391202 - DNA, 24 bp, Homo sapiens
ataaacacatagattcacctgtaa

SEQ ID NO: 4391203 - DNA, 21 bp, Homo sapiens
ataaacagacaaaaacaagta

SEQ ID NO: 4391204 - DNA, 16 bp, Homo sapiens
ataaacagtcactgga

SEQ ID NO: 4391205 - DNA, 22 bp, Homo sapiens
ataaacagtggaatataaggaa

SEQ ID NO: 4391206 - DNA, 12 bp, Homo sapiens
ataaacataatt

SEQ ID NO: 4391207 - DNA, 19 bp, Homo sapiens
ataaacatatttttatact

SEQ ID NO: 4391208 - DNA, 14 bp, Homo sapiens
ataaacatgtcaca

SEQ ID NO: 4391209 - DNA, 16 bp, Homo sapiens
ataaaccaaaaacatt

SEQ ID NO: 4391210 - DNA, 19 bp, Homo sapiens
ataaaccaaaaacatttga

SEQ ID NO: 4391211 - DNA, 15 bp, Homo sapiens
ataaaccacaagcat

SEQ ID NO: 4391212 - DNA, 16 bp, Homo sapiens
ataaaccacaagcatc

SEQ ID NO: 4391213 - DNA, 17 bp, Homo sapiens
ataaaccacaagcatct

SEQ ID NO: 4391214 - DNA, 18 bp, Homo sapiens
ataaaccacaagcatctc

SEQ ID NO: 4391215 - DNA, 15 bp, Homo sapiens
ataaaccagtgtgaa

SEQ ID NO: 4391216 - DNA, 16 bp, Homo sapiens
ataaaccagtgtgaac

SEQ ID NO: 4391217 - DNA, 19 bp, Homo sapiens
ataaaccagtgtgaacccc

SEQ ID NO: 4391218 - DNA, 17 bp, Homo sapiens
ataaacctgttcttcct

SEQ ID NO: 4391219 - DNA, 20 bp, Homo sapiens
ataaaccttatgaactacag

SEQ ID NO: 4391220 - DNA, 22 bp, Homo sapiens
ataaaccttgtctatgaaatga

SEQ ID NO: 4391221 - DNA, 22 bp, Homo sapiens
ataaactaaaaactaacagcta

SEQ ID NO: 4391222 - DNA, 21 bp, Homo sapiens
ataaactaccaaattagtgaa

SEQ ID NO: 4391223 - DNA, 12 bp, Homo sapiens
ataaactataaa

SEQ ID NO: 4391224 - DNA, 15 bp, Homo sapiens
ataaactataaactt

SEQ ID NO: 4391225 - DNA, 17 bp, Homo sapiens
ataaactataaacttaa

SEQ ID NO: 4391226 - DNA, 20 bp, Homo sapiens
ataaactatttttttcttaa

SEQ ID NO: 4391227 - DNA, 16 bp, Homo sapiens
ataaactgtattttga

SEQ ID NO: 4391228 - DNA, 16 bp, Homo sapiens
ataaactgtgtttact

SEQ ID NO: 4391229 - DNA, 14 bp, Homo sapiens
ataaagaaattcaa

SEQ ID NO: 4391230 - DNA, 16 bp, Homo sapiens
ataaagacccaggggg

SEQ ID NO: 4391231 - DNA, 12 bp, Homo sapiens
ataaagactttt

SEQ ID NO: 4391232 - DNA, 14 bp, Homo sapiens
ataaagacttttat

SEQ ID NO: 4391233 - DNA, 22 bp, Homo sapiens
ataaagataacccttattccat

SEQ ID NO: 4391234 - DNA, 16 bp, Homo sapiens
ataaagatattgttca

SEQ ID NO: 4391235 - DNA, 14 bp, Homo sapiens
ataaagattctcac

SEQ ID NO: 4391236 - DNA, 16 bp, Homo sapiens
ataaagattctcacat

SEQ ID NO: 4391237 - DNA, 16 bp, Homo sapiens
ataaagattttttaat

SEQ ID NO: 4391238 - DNA, 18 bp, Homo sapiens
ataaagattttttaataa

SEQ ID NO: 4391239 - DNA, 21 bp, Homo sapiens
ataaagattttttaataattt

SEQ ID NO: 4391240 - DNA, 18 bp, Homo sapiens
ataaagcctttgtatctt

SEQ ID NO: 4391241 - DNA, 22 bp, Homo sapiens
ataaagcctttgtatctttctt

SEQ ID NO: 4391242 - DNA, 23 bp, Homo sapiens
ataaagctacaatattctctctt

SEQ ID NO: 4391243 - DNA, 22 bp, Homo sapiens
ataaagctcaaatgaaatgtat

SEQ ID NO: 4391244 - DNA, 13 bp, Homo sapiens
ataaaggatgtga

SEQ ID NO: 4391245 - DNA, 14 bp, Homo sapiens
ataaaggatgtgat

SEQ ID NO: 4391246 - DNA, 12 bp, Homo sapiens
ataaaggcagct

SEQ ID NO: 4391247 - DNA, 13 bp, Homo sapiens
ataaaggcagctg

SEQ ID NO: 4391248 - DNA, 14 bp, Homo sapiens
ataaaggcagctgc

SEQ ID NO: 4391249 - DNA, 16 bp, Homo sapiens
ataaaggcagctgcct

SEQ ID NO: 4391250 - DNA, 17 bp, Homo sapiens
ataaaggcagctgcctc

SEQ ID NO: 4391251 - DNA, 18 bp, Homo sapiens
ataaaggcagctgcctct

SEQ ID NO: 4391252 - DNA, 20 bp, Homo sapiens
ataaaggcagctgcctctgc

SEQ ID NO: 4391253 - DNA, 21 bp, Homo sapiens
ataaaggcagctgcctctgct

SEQ ID NO: 4391254 - DNA, 12 bp, Homo sapiens
ataaagggtcag

SEQ ID NO: 4391255 - DNA, 20 bp, Homo sapiens
ataaagtatagagagaagtt

SEQ ID NO: 4391256 - DNA, 15 bp, Homo sapiens
ataaagtatcatcag

SEQ ID NO: 4391257 - DNA, 23 bp, Homo sapiens
ataaagtattccaccttaaatta

SEQ ID NO: 4391258 - DNA, 21 bp, Homo sapiens
ataaagtcattattaggaagt

SEQ ID NO: 4391259 - DNA, 18 bp, Homo sapiens
ataaagtgaactttgttt

SEQ ID NO: 4391260 - DNA, 20 bp, Homo sapiens
ataaagtgccttctgggctt

SEQ ID NO: 4391261 - DNA, 15 bp, Homo sapiens
ataaagtgttttcag

SEQ ID NO: 4391262 - DNA, 16 bp, Homo sapiens
ataaagttacctacat

SEQ ID NO: 4391263 - DNA, 15 bp, Homo sapiens
ataaagttctgtact

SEQ ID NO: 4391264 - DNA, 21 bp, Homo sapiens
ataaagttgtatttcaaatat

SEQ ID NO: 4391265 - DNA, 16 bp, Homo sapiens
ataaataaaaatgcat

SEQ ID NO: 4391266 - DNA, 20 bp, Homo sapiens
ataaataaaatcatgtagtt

SEQ ID NO: 4391267 - DNA, 19 bp, Homo sapiens
ataaataaaattcatttct

SEQ ID NO: 4391268 - DNA, 13 bp, Homo sapiens
ataaataaatgtt

SEQ ID NO: 4391269 - DNA, 12 bp, Homo sapiens
ataaataacttt

SEQ ID NO: 4391270 - DNA, 18 bp, Homo sapiens
ataaatagaaaagtagac

SEQ ID NO: 4391271 - DNA, 16 bp, Homo sapiens
ataaatagcatttgga

SEQ ID NO: 4391272 - DNA, 13 bp, Homo sapiens
ataaatatatcta

SEQ ID NO: 4391273 - DNA, 13 bp, Homo sapiens
ataaatatgaaag

SEQ ID NO: 4391274 - DNA, 17 bp, Homo sapiens
ataaatcagtgaactgt

SEQ ID NO: 4391275 - DNA, 15 bp, Homo sapiens
ataaatcataaagtc

SEQ ID NO: 4391276 - DNA, 16 bp, Homo sapiens
ataaatcataaagtca

SEQ ID NO: 4391277 - DNA, 12 bp, Homo sapiens
ataaatcatgtt

SEQ ID NO: 4391278 - DNA, 15 bp, Homo sapiens
ataaatcatgttgtt

SEQ ID NO: 4391279 - DNA, 15 bp, Homo sapiens
ataaatctaggatgt

SEQ ID NO: 4391280 - DNA, 11 bp, Homo sapiens
ataaatgaatg

SEQ ID NO: 4391281 - DNA, 20 bp, Homo sapiens
ataaatggtttggtgctttt

SEQ ID NO: 4391282 - DNA, 21 bp, Homo sapiens
ataaatggtttggtgcttttt

SEQ ID NO: 4391283 - DNA, 17 bp, Homo sapiens
ataaatgtaaaaatgaa

SEQ ID NO: 4391284 - DNA, 18 bp, Homo sapiens
ataaatgtaccagagaga

SEQ ID NO: 4391285 - DNA, 19 bp, Homo sapiens
ataaatgtgccttcatttt

SEQ ID NO: 4391286 - DNA, 14 bp, Homo sapiens
ataaatgtgtgtat

SEQ ID NO: 4391287 - DNA, 20 bp, Homo sapiens
ataaatgtgtgtatgtgtgt

SEQ ID NO: 4391288 - DNA, 12 bp, Homo sapiens
ataaatgttcaa

SEQ ID NO: 4391289 - DNA, 23 bp, Homo sapiens
ataaatgttctggtatgcattct

SEQ ID NO: 4391290 - DNA, 14 bp, Homo sapiens
ataaatgtttatat

SEQ ID NO: 4391291 - DNA, 20 bp, Homo sapiens
ataaattaagatcctaaact

SEQ ID NO: 4391292 - DNA, 14 bp, Homo sapiens
ataaattaatttgt

SEQ ID NO: 4391293 - DNA, 15 bp, Homo sapiens
ataaattcactttca

SEQ ID NO: 4391294 - DNA, 23 bp, Homo sapiens
ataaattcactttcatttttgat

SEQ ID NO: 4391295 - DNA, 23 bp, Homo sapiens
ataaattctacctccttgtgttg

SEQ ID NO: 4391296 - DNA, 21 bp, Homo sapiens
ataaattctataggaacatat

SEQ ID NO: 4391297 - DNA, 21 bp, Homo sapiens
ataaattgcacaccttggaat

SEQ ID NO: 4391298 - DNA, 17 bp, Homo sapiens
ataaattgtacattttg

SEQ ID NO: 4391299 - DNA, 17 bp, Homo sapiens
ataaattgtctttaaaa

SEQ ID NO: 4391300 - DNA, 14 bp, Homo sapiens
agtggttaggcagc

SEQ ID NO: 4391301 - DNA, 16 bp, Homo sapiens
agtggttaggcagcaa

SEQ ID NO: 4391302 - DNA, 16 bp, Homo sapiens
agtggttctctgcctt

SEQ ID NO: 4391303 - DNA, 17 bp, Homo sapiens
agtggttctctgccttt

SEQ ID NO: 4391304 - DNA, 17 bp, Homo sapiens
agtggttttatactgaa

SEQ ID NO: 4391305 - DNA, 21 bp, Homo sapiens
agtggttttatactgaaggaa

SEQ ID NO: 4391306 - DNA, 23 bp, Homo sapiens
agtggttttatactgaaggaaaa

SEQ ID NO: 4391307 - DNA, 18 bp, Homo sapiens
agtgtaacagatatcagt

SEQ ID NO: 4391308 - DNA, 18 bp, Homo sapiens
agtgtaacttgcttaaat

SEQ ID NO: 4391309 - DNA, 12 bp, Homo sapiens
agtgtaactttc

SEQ ID NO: 4391310 - DNA, 12 bp, Homo sapiens
agtgtaagaact

SEQ ID NO: 4391311 - DNA, 16 bp, Homo sapiens
agtgtaagaactgtac

SEQ ID NO: 4391312 - DNA, 18 bp, Homo sapiens
agtgtaagaactgtacat

SEQ ID NO: 4391313 - DNA, 21 bp, Homo sapiens
agtgtacacgtctggaccccg

SEQ ID NO: 4391314 - DNA, 14 bp, Homo sapiens
agtgtacagactct

SEQ ID NO: 4391315 - DNA, 18 bp, Homo sapiens
agtgtaccaagtgcttcc

SEQ ID NO: 4391316 - DNA, 23 bp, Homo sapiens
agtgtaccaagtgcttcctacaa

SEQ ID NO: 4391317 - DNA, 15 bp, Homo sapiens
agtgtagaacctaat

SEQ ID NO: 4391318 - DNA, 14 bp, Homo sapiens
agtgtatgattact

SEQ ID NO: 4391319 - DNA, 15 bp, Homo sapiens
agtgtatgattactg

SEQ ID NO: 4391320 - DNA, 19 bp, Homo sapiens
agtgtatgattactggcct

SEQ ID NO: 4391321 - DNA, 19 bp, Homo sapiens
agtgtcaaataaacactgt

SEQ ID NO: 4391322 - DNA, 19 bp, Homo sapiens
agtgtcaagttgtgcttgt

SEQ ID NO: 4391323 - DNA, 20 bp, Homo sapiens
agtgtcaagttgtgcttgtt

SEQ ID NO: 4391324 - DNA, 22 bp, Homo sapiens
agtgtcattttgatctgctttt

SEQ ID NO: 4391325 - DNA, 16 bp, Homo sapiens
agtgtcctatgcaata

SEQ ID NO: 4391326 - DNA, 19 bp, Homo sapiens
agtgtcctatgcaataaaa

SEQ ID NO: 4391327 - DNA, 15 bp, Homo sapiens
agtgtcctgcccatg

SEQ ID NO: 4391328 - DNA, 18 bp, Homo sapiens
agtgtcctggctgtgaat

SEQ ID NO: 4391329 - DNA, 20 bp, Homo sapiens
agtgtctggatcagtaaaat

SEQ ID NO: 4391330 - DNA, 21 bp, Homo sapiens
agtgtctggatcagtaaaatt

SEQ ID NO: 4391331 - DNA, 16 bp, Homo sapiens
agtgtctggcacacag

SEQ ID NO: 4391332 - DNA, 22 bp, Homo sapiens
agtgtctgtgttttgaaagaat

SEQ ID NO: 4391333 - DNA, 15 bp, Homo sapiens
agtgtcttaattaaa

SEQ ID NO: 4391334 - DNA, 21 bp, Homo sapiens
agtgtcttaattaaaagaata

SEQ ID NO: 4391335 - DNA, 19 bp, Homo sapiens
agtgtctttctagccataa

SEQ ID NO: 4391336 - DNA, 15 bp, Homo sapiens
agtgtctttctttgg

SEQ ID NO: 4391337 - DNA, 21 bp, Homo sapiens
agtgtctttctttggtgcctt

SEQ ID NO: 4391338 - DNA, 15 bp, Homo sapiens
agtgtgaaatagaca

SEQ ID NO: 4391339 - DNA, 14 bp, Homo sapiens
agtgtgaaatatat

SEQ ID NO: 4391340 - DNA, 16 bp, Homo sapiens
agtgtgaaatatatta

SEQ ID NO: 4391341 - DNA, 16 bp, Homo sapiens
agtgtgaatagcctgg

SEQ ID NO: 4391342 - DNA, 18 bp, Homo sapiens
agtgtgaatataaatgtg

SEQ ID NO: 4391343 - DNA, 21 bp, Homo sapiens
agtgtgaatataaatgtgtgt

SEQ ID NO: 4391344 - DNA, 17 bp, Homo sapiens
agtgtgaatattccttt

SEQ ID NO: 4391345 - DNA, 16 bp, Homo sapiens
agtgtgagctcttccc

SEQ ID NO: 4391346 - DNA, 17 bp, Homo sapiens
agtgtgagctcttccct

SEQ ID NO: 4391347 - DNA, 23 bp, Homo sapiens
agtgtgatgtttggattgatatc

SEQ ID NO: 4391348 - DNA, 18 bp, Homo sapiens
agtgtgctcggacacagt

SEQ ID NO: 4391349 - DNA, 12 bp, Homo sapiens
agtgtggagacc

SEQ ID NO: 4391350 - DNA, 15 bp, Homo sapiens
agtgtggctggtgtc

SEQ ID NO: 4391351 - DNA, 18 bp, Homo sapiens
agtgtgggagtgcagaga

SEQ ID NO: 4391352 - DNA, 11 bp, Homo sapiens
agtgtgtaaaa

SEQ ID NO: 4391353 - DNA, 12 bp, Homo sapiens
agtgtgtaaaat

SEQ ID NO: 4391354 - DNA, 13 bp, Homo sapiens
agtgtgtaaaatt

SEQ ID NO: 4391355 - DNA, 15 bp, Homo sapiens
agtgtgtaaaattaa

SEQ ID NO: 4391356 - DNA, 18 bp, Homo sapiens
agtgtgtaaaattaatgt

SEQ ID NO: 4391357 - DNA, 17 bp, Homo sapiens
agtgtgtacttcttcat

SEQ ID NO: 4391358 - DNA, 16 bp, Homo sapiens
agtgtgtctttataaa

SEQ ID NO: 4391359 - DNA, 12 bp, Homo sapiens
agtgtgtgcagc

SEQ ID NO: 4391360 - DNA, 21 bp, Homo sapiens
agtgtgtgtttgtgtgtttca

SEQ ID NO: 4391361 - DNA, 16 bp, Homo sapiens
agtgtgttataaaata

SEQ ID NO: 4391362 - DNA, 12 bp, Homo sapiens
agtgtgtttgcc

SEQ ID NO: 4391363 - DNA, 15 bp, Homo sapiens
agtgttaatacatca

SEQ ID NO: 4391364 - DNA, 23 bp, Homo sapiens
agtgttagggaagggcctgccac

SEQ ID NO: 4391365 - DNA, 13 bp, Homo sapiens
agtgttagtgctg

SEQ ID NO: 4391366 - DNA, 19 bp, Homo sapiens
agtgttagtgctggtcaga

SEQ ID NO: 4391367 - DNA, 16 bp, Homo sapiens
agtgttccccttccac

SEQ ID NO: 4391368 - DNA, 21 bp, Homo sapiens
agtgttccccttccactgagg

SEQ ID NO: 4391369 - DNA, 18 bp, Homo sapiens
agtgttcccgtgcctggg

SEQ ID NO: 4391370 - DNA, 20 bp, Homo sapiens
agtgttcctgaagctgctgt

SEQ ID NO: 4391371 - DNA, 23 bp, Homo sapiens
agtgttggtttaatattacctaa

SEQ ID NO: 4391372 - DNA, 14 bp, Homo sapiens
agtgtttaaaactt

SEQ ID NO: 4391373 - DNA, 16 bp, Homo sapiens
agtgtttcagattttt

SEQ ID NO: 4391374 - DNA, 14 bp, Homo sapiens
agtgtttctgtgaa

SEQ ID NO: 4391375 - DNA, 16 bp, Homo sapiens
agtgtttggacagctg

SEQ ID NO: 4391376 - DNA, 18 bp, Homo sapiens
agtgttttcagaagaaat

SEQ ID NO: 4391377 - DNA, 14 bp, Homo sapiens
agtgttttgtacca

SEQ ID NO: 4391378 - DNA, 16 bp, Homo sapiens
agtgttttgtaccagt

SEQ ID NO: 4391379 - DNA, 22 bp, Homo sapiens
agtgttttgtaccagtgaattt

SEQ ID NO: 4391380 - DNA, 13 bp, Homo sapiens
agttaaaaattaa

SEQ ID NO: 4391381 - DNA, 14 bp, Homo sapiens
agttaaactatttt

SEQ ID NO: 4391382 - DNA, 14 bp, Homo sapiens
agttaactgtgaaa

SEQ ID NO: 4391383 - DNA, 19 bp, Homo sapiens
agttaagacatgatttcct

SEQ ID NO: 4391384 - DNA, 20 bp, Homo sapiens
agttaaggtgtgcagtgttt

SEQ ID NO: 4391385 - DNA, 15 bp, Homo sapiens
agttaattcttaaaa

SEQ ID NO: 4391386 - DNA, 17 bp, Homo sapiens
agttaattcttaaaact

SEQ ID NO: 4391387 - DNA, 23 bp, Homo sapiens
agttaatttttccaactactaat

SEQ ID NO: 4391388 - DNA, 13 bp, Homo sapiens
agttacagttctg

SEQ ID NO: 4391389 - DNA, 14 bp, Homo sapiens
agttacagttctgt

SEQ ID NO: 4391390 - DNA, 16 bp, Homo sapiens
agttacagttctgtgg

SEQ ID NO: 4391391 - DNA, 18 bp, Homo sapiens
agttacatgctgtatatg

SEQ ID NO: 4391392 - DNA, 23 bp, Homo sapiens
agttacctgagagatttaacatt

SEQ ID NO: 4391393 - DNA, 21 bp, Homo sapiens
agttaccttatagttactgtg

SEQ ID NO: 4391394 - DNA, 21 bp, Homo sapiens
agttacgtataatgctttctg

SEQ ID NO: 4391395 - DNA, 13 bp, Homo sapiens
agttactcagccc

SEQ ID NO: 4391396 - DNA, 17 bp, Homo sapiens
agttactcagccctggg

SEQ ID NO: 4391397 - DNA, 21 bp, Homo sapiens
agttactgtcctgttgattaa

SEQ ID NO: 4391398 - DNA, 18 bp, Homo sapiens
agttactgtgtaattagt

SEQ ID NO: 4391399 - DNA, 15 bp, Homo sapiens
agttacttagaatgc

SEQ ID NO: 4391400 - DNA, 17 bp, Homo sapiens
agttagaaccacagcag

SEQ ID NO: 4391401 - DNA, 22 bp, Homo sapiens
agttagcatccaggctggccag

SEQ ID NO: 4391402 - DNA, 15 bp, Homo sapiens
agttagctttaactt

SEQ ID NO: 4391403 - DNA, 22 bp, Homo sapiens
agttagctttaacttaaatagt

SEQ ID NO: 4391404 - DNA, 17 bp, Homo sapiens
agttagtggattactgc

SEQ ID NO: 4391405 - DNA, 14 bp, Homo sapiens
agttagtttgtata

SEQ ID NO: 4391406 - DNA, 19 bp, Homo sapiens
agttataaaactatgtgtt

SEQ ID NO: 4391407 - DNA, 20 bp, Homo sapiens
agttataaaactatgtgttc

SEQ ID NO: 4391408 - DNA, 16 bp, Homo sapiens
agttataaaaggcttt

SEQ ID NO: 4391409 - DNA, 13 bp, Homo sapiens
agttataacagat

SEQ ID NO: 4391410 - DNA, 16 bp, Homo sapiens
agttataacagatgtg

SEQ ID NO: 4391411 - DNA, 17 bp, Homo sapiens
agttataacagatgtga

SEQ ID NO: 4391412 - DNA, 19 bp, Homo sapiens
agttataacagatgtgaaa

SEQ ID NO: 4391413 - DNA, 20 bp, Homo sapiens
agttataacagatgtgaaaa

SEQ ID NO: 4391414 - DNA, 22 bp, Homo sapiens
agttataacagatgtgaaaata

SEQ ID NO: 4391415 - DNA, 17 bp, Homo sapiens
agttataagcgtattta

SEQ ID NO: 4391416 - DNA, 18 bp, Homo sapiens
agttataagcgtatttag

SEQ ID NO: 4391417 - DNA, 19 bp, Homo sapiens
agttatacagttataaaat

SEQ ID NO: 4391418 - DNA, 22 bp, Homo sapiens
agttataggattttcacacatt

SEQ ID NO: 4391419 - DNA, 23 bp, Homo sapiens
agttatatttcagatgtaatgtt

SEQ ID NO: 4391420 - DNA, 22 bp, Homo sapiens
agtgcagagaaagaaagggaaa

SEQ ID NO: 4391421 - DNA, 17 bp, Homo sapiens
agtgcagagccttctca

SEQ ID NO: 4391422 - DNA, 18 bp, Homo sapiens
agtgcagagccttctcag

SEQ ID NO: 4391423 - DNA, 14 bp, Homo sapiens
agtgcagcagagga

SEQ ID NO: 4391424 - DNA, 15 bp, Homo sapiens
agtgcagcagaggac

SEQ ID NO: 4391425 - DNA, 15 bp, Homo sapiens
agtgcagccactggc

SEQ ID NO: 4391426 - DNA, 14 bp, Homo sapiens
agtgcagccttctc

SEQ ID NO: 4391427 - DNA, 16 bp, Homo sapiens
agtgcagccttctcca

SEQ ID NO: 4391428 - DNA, 20 bp, Homo sapiens
agtgcaggtgcagtttcatt

SEQ ID NO: 4391429 - DNA, 16 bp, Homo sapiens
agtgcagtcctgatca

SEQ ID NO: 4391430 - DNA, 23 bp, Homo sapiens
agtgcagtcctgatcagagccgt

SEQ ID NO: 4391431 - DNA, 14 bp, Homo sapiens
agtgcatctggaga

SEQ ID NO: 4391432 - DNA, 16 bp, Homo sapiens
agtgcatgctctctgc

SEQ ID NO: 4391433 - DNA, 15 bp, Homo sapiens
agtgcatgtgcatgc

SEQ ID NO: 4391434 - DNA, 17 bp, Homo sapiens
agtgcatttttaaactt

SEQ ID NO: 4391435 - DNA, 18 bp, Homo sapiens
agtgcatttttaaacttg

SEQ ID NO: 4391436 - DNA, 20 bp, Homo sapiens
agtgcatttttaaacttgaa

SEQ ID NO: 4391437 - DNA, 21 bp, Homo sapiens
agtgccaaagaagcagaccat

SEQ ID NO: 4391438 - DNA, 20 bp, Homo sapiens
agtgccacccacctttgcca

SEQ ID NO: 4391439 - DNA, 22 bp, Homo sapiens
agtgccacccacctttgccaca

SEQ ID NO: 4391440 - DNA, 18 bp, Homo sapiens
agtgccacctatgcctgt

SEQ ID NO: 4391441 - DNA, 21 bp, Homo sapiens
agtgccacctatgcctgtggt

SEQ ID NO: 4391442 - DNA, 18 bp, Homo sapiens
agtgccactgccccccga

SEQ ID NO: 4391443 - DNA, 14 bp, Homo sapiens
agtgccacttaatg

SEQ ID NO: 4391444 - DNA, 20 bp, Homo sapiens
agtgccacttaatgtatgtt

SEQ ID NO: 4391445 - DNA, 19 bp, Homo sapiens
agtgcccaccaacatccca

SEQ ID NO: 4391446 - DNA, 22 bp, Homo sapiens
agtgccccagggagtccagggt

SEQ ID NO: 4391447 - DNA, 14 bp, Homo sapiens
agtgcctagactgt

SEQ ID NO: 4391448 - DNA, 22 bp, Homo sapiens
agtgcctagactgttactttgg

SEQ ID NO: 4391449 - DNA, 20 bp, Homo sapiens
agtgcctctccctgctgctc

SEQ ID NO: 4391450 - DNA, 22 bp, Homo sapiens
agtgcctctccctgctgctcct

SEQ ID NO: 4391451 - DNA, 19 bp, Homo sapiens
agtgcctgcaccaggggtg

SEQ ID NO: 4391452 - DNA, 11 bp, Homo sapiens
agtgcctgcca

SEQ ID NO: 4391453 - DNA, 17 bp, Homo sapiens
agtgcctgccactctct

SEQ ID NO: 4391454 - DNA, 18 bp, Homo sapiens
agtgcctgccactctctg

SEQ ID NO: 4391455 - DNA, 20 bp, Homo sapiens
agtgcctgccactctctggg

SEQ ID NO: 4391456 - DNA, 21 bp, Homo sapiens
agtgcctgccactctctggga

SEQ ID NO: 4391457 - DNA, 17 bp, Homo sapiens
agtgccttacctcctgc

SEQ ID NO: 4391458 - DNA, 18 bp, Homo sapiens
agtgccttacctcctgcc

SEQ ID NO: 4391459 - DNA, 19 bp, Homo sapiens
agtgccttacctcctgccc

SEQ ID NO: 4391460 - DNA, 19 bp, Homo sapiens
agtgccttcctgtttttca

SEQ ID NO: 4391461 - DNA, 12 bp, Homo sapiens
agtgccttctct

SEQ ID NO: 4391462 - DNA, 16 bp, Homo sapiens
agtgccttctgggctt

SEQ ID NO: 4391463 - DNA, 17 bp, Homo sapiens
agtgccttctgtgggga

SEQ ID NO: 4391464 - DNA, 21 bp, Homo sapiens
agtgccttggatgagaagtgt

SEQ ID NO: 4391465 - DNA, 16 bp, Homo sapiens
agtgcctttagagggt

SEQ ID NO: 4391466 - DNA, 15 bp, Homo sapiens
agtgccttttggaac

SEQ ID NO: 4391467 - DNA, 22 bp, Homo sapiens
agtgcggcccctcggctgttcc

SEQ ID NO: 4391468 - DNA, 19 bp, Homo sapiens
agtgcggtttactcactgc

SEQ ID NO: 4391469 - DNA, 15 bp, Homo sapiens
agtgcgtccacgagc

SEQ ID NO: 4391470 - DNA, 16 bp, Homo sapiens
agtgctcaccagccct

SEQ ID NO: 4391471 - DNA, 11 bp, Homo sapiens
agtgctccctc

SEQ ID NO: 4391472 - DNA, 11 bp, Homo sapiens
agtgctctgat

SEQ ID NO: 4391473 - DNA, 17 bp, Homo sapiens
agtgctctgatccctct

SEQ ID NO: 4391474 - DNA, 14 bp, Homo sapiens
agtgctctgtaaaa

SEQ ID NO: 4391475 - DNA, 14 bp, Homo sapiens
agtgctcttttctc

SEQ ID NO: 4391476 - DNA, 15 bp, Homo sapiens
agtgctgcactcaaa

SEQ ID NO: 4391477 - DNA, 17 bp, Homo sapiens
agtgctgcagctccctg

SEQ ID NO: 4391478 - DNA, 19 bp, Homo sapiens
agtgctggcccacccagtc

SEQ ID NO: 4391479 - DNA, 23 bp, Homo sapiens
agtgctggcccacccagtccatg

SEQ ID NO: 4391480 - DNA, 19 bp, Homo sapiens
agtgctgggattaaggcgt

SEQ ID NO: 4391481 - DNA, 19 bp, Homo sapiens
agtgctggtcagagagacc

SEQ ID NO: 4391482 - DNA, 19 bp, Homo sapiens
agtgctgtccatgcttctc

SEQ ID NO: 4391483 - DNA, 20 bp, Homo sapiens
agtgctgtctgatctgtgct

SEQ ID NO: 4391484 - DNA, 22 bp, Homo sapiens
agtgctgtttattaatcttagt

SEQ ID NO: 4391485 - DNA, 13 bp, Homo sapiens
agtgcttcctaca

SEQ ID NO: 4391486 - DNA, 18 bp, Homo sapiens
agtgcttctccaacactg

SEQ ID NO: 4391487 - DNA, 14 bp, Homo sapiens
agtgcttgggctcc

SEQ ID NO: 4391488 - DNA, 18 bp, Homo sapiens
agtgcttgtatagctttt

SEQ ID NO: 4391489 - DNA, 19 bp, Homo sapiens
agtgcttgttagagagaaa

SEQ ID NO: 4391490 - DNA, 21 bp, Homo sapiens
agtgcttgttagagagaaaga

SEQ ID NO: 4391491 - DNA, 21 bp, Homo sapiens
agtgctttatactgaacgtgg

SEQ ID NO: 4391492 - DNA, 23 bp, Homo sapiens
agtgcttttcagtgatactcacg

SEQ ID NO: 4391493 - DNA, 16 bp, Homo sapiens
agtgcttttctgttta

SEQ ID NO: 4391494 - DNA, 19 bp, Homo sapiens
agtggacaaattttgagtt

SEQ ID NO: 4391495 - DNA, 19 bp, Homo sapiens
agtggaccaggacaggacc

SEQ ID NO: 4391496 - DNA, 16 bp, Homo sapiens
agtggactggcccctg

SEQ ID NO: 4391497 - DNA, 22 bp, Homo sapiens
agtggactggcctcaaagcaag

SEQ ID NO: 4391498 - DNA, 17 bp, Homo sapiens
agtggagttataggatt

SEQ ID NO: 4391499 - DNA, 23 bp, Homo sapiens
agtggatcttcagaactgccctt

SEQ ID NO: 4391500 - DNA, 18 bp, Homo sapiens
agtggcctacaaatcagt

SEQ ID NO: 4391501 - DNA, 14 bp, Homo sapiens
agtggcctccctgc

SEQ ID NO: 4391502 - DNA, 18 bp, Homo sapiens
agtggcctccctgctgtg

SEQ ID NO: 4391503 - DNA, 15 bp, Homo sapiens
agtggcctggccagg

SEQ ID NO: 4391504 - DNA, 13 bp, Homo sapiens
agtggcgggccca

SEQ ID NO: 4391505 - DNA, 19 bp, Homo sapiens
agtggcgggtgatggccag

SEQ ID NO: 4391506 - DNA, 14 bp, Homo sapiens
agtggctagtcctc

SEQ ID NO: 4391507 - DNA, 14 bp, Homo sapiens
agtggctgccacac

SEQ ID NO: 4391508 - DNA, 14 bp, Homo sapiens
agtggctgctctgg

SEQ ID NO: 4391509 - DNA, 18 bp, Homo sapiens
agtggctgctctgggaag

SEQ ID NO: 4391510 - DNA, 16 bp, Homo sapiens
agtggctggaagaacc

SEQ ID NO: 4391511 - DNA, 16 bp, Homo sapiens
agtggctggatctgtg

SEQ ID NO: 4391512 - DNA, 13 bp, Homo sapiens
agtggctgtctta

SEQ ID NO: 4391513 - DNA, 15 bp, Homo sapiens
agtggctgtttcatc

SEQ ID NO: 4391514 - DNA, 17 bp, Homo sapiens
agtggcttcatctgtca

SEQ ID NO: 4391515 - DNA, 13 bp, Homo sapiens
agtggcttctcca

SEQ ID NO: 4391516 - DNA, 21 bp, Homo sapiens
agtggctttctaccacacaca

SEQ ID NO: 4391517 - DNA, 23 bp, Homo sapiens
agtggctttctaccacacacagc

SEQ ID NO: 4391518 - DNA, 20 bp, Homo sapiens
agtgggaacgtgactgcccc

SEQ ID NO: 4391519 - DNA, 12 bp, Homo sapiens
agtgggagaaaa

SEQ ID NO: 4391520 - DNA, 17 bp, Homo sapiens
agtgggagaaaacactt

SEQ ID NO: 4391521 - DNA, 20 bp, Homo sapiens
agtgggatctgtcacaccag

SEQ ID NO: 4391522 - DNA, 15 bp, Homo sapiens
agtgggccaggacag

SEQ ID NO: 4391523 - DNA, 19 bp, Homo sapiens
agtgggccaggacaggccc

SEQ ID NO: 4391524 - DNA, 16 bp, Homo sapiens
agtgggcttgattctg

SEQ ID NO: 4391525 - DNA, 13 bp, Homo sapiens
agtggggaagagt

SEQ ID NO: 4391526 - DNA, 16 bp, Homo sapiens
agtggggcctttgcca

SEQ ID NO: 4391527 - DNA, 19 bp, Homo sapiens
agtggggcctttgccagca

SEQ ID NO: 4391528 - DNA, 22 bp, Homo sapiens
agggtgatgggaaagcattgta

SEQ ID NO: 4391529 - DNA, 17 bp, Homo sapiens
agggtgccctttggggt

SEQ ID NO: 4391530 - DNA, 22 bp, Homo sapiens
agggtgctacgtacatgtgagg

SEQ ID NO: 4391531 - DNA, 21 bp, Homo sapiens
agggtggatgtgctggagggg

SEQ ID NO: 4391532 - DNA, 20 bp, Homo sapiens
agggtggccacacaggcagg

SEQ ID NO: 4391533 - DNA, 21 bp, Homo sapiens
agggtggccacacaggcaggg

SEQ ID NO: 4391534 - DNA, 11 bp, Homo sapiens
agggtggccct

SEQ ID NO: 4391535 - DNA, 18 bp, Homo sapiens
agggtggctttgctgttg

SEQ ID NO: 4391536 - DNA, 17 bp, Homo sapiens
agggtgggaagaaagaa

SEQ ID NO: 4391537 - DNA, 14 bp, Homo sapiens
agggtgggagccta

SEQ ID NO: 4391538 - DNA, 19 bp, Homo sapiens
agggtgggagggaggaggg

SEQ ID NO: 4391539 - DNA, 19 bp, Homo sapiens
aggtggaagaagggagaag

SEQ ID NO: 4391540 - DNA, 18 bp, Homo sapiens
aggtggaagcagaggccc

SEQ ID NO: 4391541 - DNA, 19 bp, Homo sapiens
aggtggaagcagaggccct

SEQ ID NO: 4391542 - DNA, 21 bp, Homo sapiens
aggtggaagcagaggccctgc

SEQ ID NO: 4391543 - DNA, 11 bp, Homo sapiens
aggtggaagcc

SEQ ID NO: 4391544 - DNA, 15 bp, Homo sapiens
aggtggaagccctcc

SEQ ID NO: 4391545 - DNA, 16 bp, Homo sapiens
aggtggaagccctcct

SEQ ID NO: 4391546 - DNA, 22 bp, Homo sapiens
aggtggacagcagacaagaggg

SEQ ID NO: 4391547 - DNA, 16 bp, Homo sapiens
aggtggacgctgcaga

SEQ ID NO: 4391548 - DNA, 17 bp, Homo sapiens
aggtggacgctgcagac

SEQ ID NO: 4391549 - DNA, 16 bp, Homo sapiens
aggtggatcacagagg

SEQ ID NO: 4391550 - DNA, 14 bp, Homo sapiens
aggtggatcctgta

SEQ ID NO: 4391551 - DNA, 15 bp, Homo sapiens
aggtggattcatgtc

SEQ ID NO: 4391552 - DNA, 14 bp, Homo sapiens
aggtggcctttgtg

SEQ ID NO: 4391553 - DNA, 20 bp, Homo sapiens
aggtggctgacccagtccct

SEQ ID NO: 4391554 - DNA, 22 bp, Homo sapiens
aggtgggccacacccaggaagg

SEQ ID NO: 4391555 - DNA, 15 bp, Homo sapiens
aggtgggctggactt

SEQ ID NO: 4391556 - DNA, 19 bp, Homo sapiens
aggtggggagactgggctg

SEQ ID NO: 4391557 - DNA, 21 bp, Homo sapiens
aggtggggtacatttctctga

SEQ ID NO: 4391558 - DNA, 14 bp, Homo sapiens
aggtgggtcccggc

SEQ ID NO: 4391559 - DNA, 22 bp, Homo sapiens
aggtgggttttcttcccatcac

SEQ ID NO: 4391560 - DNA, 16 bp, Homo sapiens
aggtggtgtgatctta

SEQ ID NO: 4391561 - DNA, 18 bp, Homo sapiens
aggtggttaccaggcact

SEQ ID NO: 4391562 - DNA, 21 bp, Homo sapiens
aggtggttaccaggcactggt

SEQ ID NO: 4391563 - DNA, 18 bp, Homo sapiens
aggtgtcaggctgctggc

SEQ ID NO: 4391564 - DNA, 19 bp, Homo sapiens
aggtgtcaggctgctggcg

SEQ ID NO: 4391565 - DNA, 15 bp, Homo sapiens
aggtgtccccaacgt

SEQ ID NO: 4391566 - DNA, 19 bp, Homo sapiens
aggtgtcttcctcccaagt

SEQ ID NO: 4391567 - DNA, 14 bp, Homo sapiens
aggtgtgagactgg

SEQ ID NO: 4391568 - DNA, 20 bp, Homo sapiens
aggtgtgctctgagccacag

SEQ ID NO: 4391569 - DNA, 15 bp, Homo sapiens
aggtgttccgtggga

SEQ ID NO: 4391570 - DNA, 17 bp, Homo sapiens
aggtgtttattaaaatt

SEQ ID NO: 4391571 - DNA, 18 bp, Homo sapiens
aggttaaacggtgcccat

SEQ ID NO: 4391572 - DNA, 13 bp, Homo sapiens
aggttaaagctaa

SEQ ID NO: 4391573 - DNA, 16 bp, Homo sapiens
aggttaaagctaaact

SEQ ID NO: 4391574 - DNA, 20 bp, Homo sapiens
aggttaaagctaaactgaat

SEQ ID NO: 4391575 - DNA, 15 bp, Homo sapiens
aggttacaagcctgc

SEQ ID NO: 4391576 - DNA, 21 bp, Homo sapiens
aggttacaagcctgcacaata

SEQ ID NO: 4391577 - DNA, 14 bp, Homo sapiens
aggttataattttt

SEQ ID NO: 4391578 - DNA, 18 bp, Homo sapiens
aggttccgcttggagcag

SEQ ID NO: 4391579 - DNA, 21 bp, Homo sapiens
aggttccgcttggagcagagg

SEQ ID NO: 4391580 - DNA, 12 bp, Homo sapiens
aggttcctctgc

SEQ ID NO: 4391581 - DNA, 18 bp, Homo sapiens
aggttcctctgcctgccc

SEQ ID NO: 4391582 - DNA, 19 bp, Homo sapiens
aggttcctctgcctgcccc

SEQ ID NO: 4391583 - DNA, 19 bp, Homo sapiens
aggttctcccagcccatct

SEQ ID NO: 4391584 - DNA, 19 bp, Homo sapiens
aggttcttcttgttctgag

SEQ ID NO: 4391585 - DNA, 12 bp, Homo sapiens
aggttcttgctt

SEQ ID NO: 4391586 - DNA, 14 bp, Homo sapiens
aggttcttgctttc

SEQ ID NO: 4391587 - DNA, 17 bp, Homo sapiens
aggttcttgctttctct

SEQ ID NO: 4391588 - DNA, 13 bp, Homo sapiens
aggttgaagccaa

SEQ ID NO: 4391589 - DNA, 23 bp, Homo sapiens
aggttgaagccaagtggggtgct

SEQ ID NO: 4391590 - DNA, 20 bp, Homo sapiens
aggttgagcaatttccccct

SEQ ID NO: 4391591 - DNA, 12 bp, Homo sapiens
aggttgcacagc

SEQ ID NO: 4391592 - DNA, 15 bp, Homo sapiens
aggttgcacagcaag

SEQ ID NO: 4391593 - DNA, 16 bp, Homo sapiens
aggttgcacagcaaga

SEQ ID NO: 4391594 - DNA, 18 bp, Homo sapiens
aggttgggctagagaaat

SEQ ID NO: 4391595 - DNA, 22 bp, Homo sapiens
aggttggtttggggagacaggt

SEQ ID NO: 4391596 - DNA, 22 bp, Homo sapiens
aggttgtggggcctcaggctcc

SEQ ID NO: 4391597 - DNA, 15 bp, Homo sapiens
aggtttcagatgagg

SEQ ID NO: 4391598 - DNA, 19 bp, Homo sapiens
aggtttggtgcaaagtatt

SEQ ID NO: 4391599 - DNA, 18 bp, Homo sapiens
aggtttgttttcagcact

SEQ ID NO: 4391600 - DNA, 20 bp, Homo sapiens
aggttttatttcatttttca

SEQ ID NO: 4391601 - DNA, 10 bp, Homo sapiens
aggttttcag

SEQ ID NO: 4391602 - DNA, 12 bp, Homo sapiens
aggtttttcctt

SEQ ID NO: 4391603 - DNA, 14 bp, Homo sapiens
agtaaaacagtcat

SEQ ID NO: 4391604 - DNA, 15 bp, Homo sapiens
agtaaaaccacagca

SEQ ID NO: 4391605 - DNA, 17 bp, Homo sapiens
agtaaaaccacagcagt

SEQ ID NO: 4391606 - DNA, 13 bp, Homo sapiens
agtaaaagacatt

SEQ ID NO: 4391607 - DNA, 16 bp, Homo sapiens
agtaaaagcaaaaaag

SEQ ID NO: 4391608 - DNA, 16 bp, Homo sapiens
agtaaaattatactgt

SEQ ID NO: 4391609 - DNA, 21 bp, Homo sapiens
agtaaaattatactgtgtgtg

SEQ ID NO: 4391610 - DNA, 15 bp, Homo sapiens
agtaaaattgaagca

SEQ ID NO: 4391611 - DNA, 15 bp, Homo sapiens
agtaaaccactgaaa

SEQ ID NO: 4391612 - DNA, 17 bp, Homo sapiens
agtaaaccactgaaaaa

SEQ ID NO: 4391613 - DNA, 15 bp, Homo sapiens
agtaaactgaggccc

SEQ ID NO: 4391614 - DNA, 12 bp, Homo sapiens
agtaaactttct

SEQ ID NO: 4391615 - DNA, 13 bp, Homo sapiens
agtaaagagaaac

SEQ ID NO: 4391616 - DNA, 14 bp, Homo sapiens
agtaaagagaaact

SEQ ID NO: 4391617 - DNA, 24 bp, Homo sapiens
agtaaagagtacactcagccactg

SEQ ID NO: 4391618 - DNA, 14 bp, Homo sapiens
agtaaagtaccttt

SEQ ID NO: 4391619 - DNA, 15 bp, Homo sapiens
agtaaataattggaa

SEQ ID NO: 4391620 - DNA, 20 bp, Homo sapiens
agtaaatcacgctttttgaa

SEQ ID NO: 4391621 - DNA, 15 bp, Homo sapiens
agtaaatcttttaca

SEQ ID NO: 4391622 - DNA, 12 bp, Homo sapiens
agtaaatgttaa

SEQ ID NO: 4391623 - DNA, 15 bp, Homo sapiens
agtaaattattaagc

SEQ ID NO: 4391624 - DNA, 12 bp, Homo sapiens
agtaacactaat

SEQ ID NO: 4391625 - DNA, 13 bp, Homo sapiens
agtaacagacaca

SEQ ID NO: 4391626 - DNA, 20 bp, Homo sapiens
agtaacatgacttccttatt

SEQ ID NO: 4391627 - DNA, 13 bp, Homo sapiens
agtaacctttaaa

SEQ ID NO: 4391628 - DNA, 16 bp, Homo sapiens
agtaacgagaagtgct

SEQ ID NO: 4391629 - DNA, 15 bp, Homo sapiens
agtaacgtgctcact

SEQ ID NO: 4391630 - DNA, 18 bp, Homo sapiens
agtaacgtgctcactgtg

SEQ ID NO: 4391631 - DNA, 16 bp, Homo sapiens
agtaagagtggtggcc

SEQ ID NO: 4391632 - DNA, 13 bp, Homo sapiens
agtaagtgccttc

SEQ ID NO: 4391633 - DNA, 15 bp, Homo sapiens
agtaagtgccttcca

SEQ ID NO: 4391634 - DNA, 15 bp, Homo sapiens
agtaagttaatgtat

SEQ ID NO: 4391635 - DNA, 22 bp, Homo sapiens
agtaataaaaagagatgaaata

SEQ ID NO: 4391636 - DNA, 17 bp, Homo sapiens
agtaataaactgtgttt

SEQ ID NO: 4391637 - DNA, 15 bp, Homo sapiens
agtaatactttttaa

SEQ ID NO: 4391638 - DNA, 17 bp, Homo sapiens
agtaatactttttaaat

SEQ ID NO: 4391639 - DNA, 14 bp, Homo sapiens
agtaatagcctggg

SEQ ID NO: 4391640 - DNA, 17 bp, Homo sapiens
agtaataggaccagagc

SEQ ID NO: 4391641 - DNA, 17 bp, Homo sapiens
agtaataggcattttaa

SEQ ID NO: 4391642 - DNA, 13 bp, Homo sapiens
agtaatatcaaag

SEQ ID NO: 4391643 - DNA, 18 bp, Homo sapiens
agtaatcacttaaaggca

SEQ ID NO: 4391644 - DNA, 23 bp, Homo sapiens
agtaatctgcattattggaatat

SEQ ID NO: 4391645 - DNA, 15 bp, Homo sapiens
agtaatctgtataat

SEQ ID NO: 4391646 - DNA, 22 bp, Homo sapiens
agtaatctgtcagtgtttgtat

SEQ ID NO: 4391647 - DNA, 16 bp, Homo sapiens
agtaatgacttagaaa

SEQ ID NO: 4391648 - DNA, 22 bp, Homo sapiens
agtaatgatgtaacagtgcaag

SEQ ID NO: 4391649 - DNA, 15 bp, Homo sapiens
agtaatgcagttttt

SEQ ID NO: 4391650 - DNA, 18 bp, Homo sapiens
agtaattaaggtacatca

SEQ ID NO: 4391651 - DNA, 23 bp, Homo sapiens
agtaattaaggtacatcattatt

SEQ ID NO: 4391652 - DNA, 15 bp, Homo sapiens
agtaattatgcacta

SEQ ID NO: 4391653 - DNA, 13 bp, Homo sapiens
agtaattgtgaca

SEQ ID NO: 4391654 - DNA, 18 bp, Homo sapiens
aggccttttatgtaattt

SEQ ID NO: 4391655 - DNA, 22 bp, Homo sapiens
aggccttttatgtaatttcttt

SEQ ID NO: 4391656 - DNA, 18 bp, Homo sapiens
aggcgaagcgttgtcctc

SEQ ID NO: 4391657 - DNA, 12 bp, Homo sapiens
aggcgaataaat

SEQ ID NO: 4391658 - DNA, 15 bp, Homo sapiens
aggcgaataaatgtt

SEQ ID NO: 4391659 - DNA, 19 bp, Homo sapiens
aggcgcctataatcccagc

SEQ ID NO: 4391660 - DNA, 24 bp, Homo sapiens
aggcgcctataatcccagctactg

SEQ ID NO: 4391661 - DNA, 18 bp, Homo sapiens
aggcgctccgggaacagt

SEQ ID NO: 4391662 - DNA, 14 bp, Homo sapiens
aggcggcccctccc

SEQ ID NO: 4391663 - DNA, 13 bp, Homo sapiens
aggcgggctcctt

SEQ ID NO: 4391664 - DNA, 19 bp, Homo sapiens
aggcggtgcactcactcct

SEQ ID NO: 4391665 - DNA, 16 bp, Homo sapiens
aggcgtgcccccctcc

SEQ ID NO: 4391666 - DNA, 19 bp, Homo sapiens
aggcgttcttcgaggtgga

SEQ ID NO: 4391667 - DNA, 19 bp, Homo sapiens
aggctaaaaggcttccagg

SEQ ID NO: 4391668 - DNA, 13 bp, Homo sapiens
aggctaagaaaaa

SEQ ID NO: 4391669 - DNA, 17 bp, Homo sapiens
aggctaagaaaaaggaa

SEQ ID NO: 4391670 - DNA, 16 bp, Homo sapiens
aggctaagaatagtgg

SEQ ID NO: 4391671 - DNA, 17 bp, Homo sapiens
aggctaattcagtgtca

SEQ ID NO: 4391672 - DNA, 19 bp, Homo sapiens
aggctaattcagtgtcaca

SEQ ID NO: 4391673 - DNA, 20 bp, Homo sapiens
aggctaattcagtgtcacat

SEQ ID NO: 4391674 - DNA, 21 bp, Homo sapiens
aggctaattcagtgtcacatg

SEQ ID NO: 4391675 - DNA, 12 bp, Homo sapiens
aggctaattttt

SEQ ID NO: 4391676 - DNA, 23 bp, Homo sapiens
agggaaggatcccatgagctcct

SEQ ID NO: 4391677 - DNA, 12 bp, Homo sapiens
agggaaggccca

SEQ ID NO: 4391678 - DNA, 13 bp, Homo sapiens
agggaaggcctga

SEQ ID NO: 4391679 - DNA, 22 bp, Homo sapiens
agggaatctaatatccccaaat

SEQ ID NO: 4391680 - DNA, 13 bp, Homo sapiens
agggaattgctca

SEQ ID NO: 4391681 - DNA, 16 bp, Homo sapiens
agggacacatatcaaa

SEQ ID NO: 4391682 - DNA, 15 bp, Homo sapiens
agggacaccagccag

SEQ ID NO: 4391683 - DNA, 20 bp, Homo sapiens
agggacaccagccaggctct

SEQ ID NO: 4391684 - DNA, 10 bp, Homo sapiens
agggacagag

SEQ ID NO: 4391685 - DNA, 20 bp, Homo sapiens
agggacagagacacctgcac

SEQ ID NO: 4391686 - DNA, 20 bp, Homo sapiens
agggacatgccctgtgtggc

SEQ ID NO: 4391687 - DNA, 22 bp, Homo sapiens
agggacatgccctgtgtggctg

SEQ ID NO: 4391688 - DNA, 21 bp, Homo sapiens
agggacatttctataaaaata

SEQ ID NO: 4391689 - DNA, 18 bp, Homo sapiens
agggaccaaattgcttct

SEQ ID NO: 4391690 - DNA, 22 bp, Homo sapiens
agggaccagcccttcatgggtg

SEQ ID NO: 4391691 - DNA, 15 bp, Homo sapiens
agggaccggtgctgc

SEQ ID NO: 4391692 - DNA, 20 bp, Homo sapiens
agggaccggtgctgcaggag

SEQ ID NO: 4391693 - DNA, 16 bp, Homo sapiens
agggaccttcatgccc

SEQ ID NO: 4391694 - DNA, 21 bp, Homo sapiens
agggactctgaagcctctggg

SEQ ID NO: 4391695 - DNA, 15 bp, Homo sapiens
agggactgaggggag

SEQ ID NO: 4391696 - DNA, 17 bp, Homo sapiens
agggactgccaggctgt

SEQ ID NO: 4391697 - DNA, 16 bp, Homo sapiens
agggacttaacttgtt

SEQ ID NO: 4391698 - DNA, 23 bp, Homo sapiens
agggacttctgtcttcacaacag

SEQ ID NO: 4391699 - DNA, 21 bp, Homo sapiens
agggagaagacaacagaaaga

SEQ ID NO: 4391700 - DNA, 21 bp, Homo sapiens
agggagaatggtgctgtttaa

SEQ ID NO: 4391701 - DNA, 17 bp, Homo sapiens
agggagacatctgcacc

SEQ ID NO: 4391702 - DNA, 13 bp, Homo sapiens
agggagagaagat

SEQ ID NO: 4391703 - DNA, 22 bp, Homo sapiens
agggagagagagagagagagga

SEQ ID NO: 4391704 - DNA, 16 bp, Homo sapiens
agggagcaagaggtgt

SEQ ID NO: 4391705 - DNA, 14 bp, Homo sapiens
agggagcagccccc

SEQ ID NO: 4391706 - DNA, 13 bp, Homo sapiens
agggagcatcccc

SEQ ID NO: 4391707 - DNA, 14 bp, Homo sapiens
agggagcatggctg

SEQ ID NO: 4391708 - DNA, 22 bp, Homo sapiens
agggagcctccccatctgtcca

SEQ ID NO: 4391709 - DNA, 23 bp, Homo sapiens
agggagcctccccatctgtccag

SEQ ID NO: 4391710 - DNA, 17 bp, Homo sapiens
agggaggaacacctgat

SEQ ID NO: 4391711 - DNA, 14 bp, Homo sapiens
agggaggaaggagg

SEQ ID NO: 4391712 - DNA, 14 bp, Homo sapiens
agggaggctcccgg

SEQ ID NO: 4391713 - DNA, 22 bp, Homo sapiens
agggaggctcccggggcctgga

SEQ ID NO: 4391714 - DNA, 13 bp, Homo sapiens
agggaggggaggc

SEQ ID NO: 4391715 - DNA, 21 bp, Homo sapiens
agggagttagcactgaactgc

SEQ ID NO: 4391716 - DNA, 14 bp, Homo sapiens
agggagttcatctg

SEQ ID NO: 4391717 - DNA, 13 bp, Homo sapiens
agggagtttttga

SEQ ID NO: 4391718 - DNA, 15 bp, Homo sapiens
agggatattgcctta

SEQ ID NO: 4391719 - DNA, 21 bp, Homo sapiens
agggatcagccccgcctgtca

SEQ ID NO: 4391720 - DNA, 22 bp, Homo sapiens
agggatcagccccgcctgtcac

SEQ ID NO: 4391721 - DNA, 19 bp, Homo sapiens
agggatcatcatgcagctc

SEQ ID NO: 4391722 - DNA, 15 bp, Homo sapiens
agggatccctcatct

SEQ ID NO: 4391723 - DNA, 16 bp, Homo sapiens
agggatccctcatctg

SEQ ID NO: 4391724 - DNA, 19 bp, Homo sapiens
agggatccctcatctgtcc

SEQ ID NO: 4391725 - DNA, 20 bp, Homo sapiens
agggatctgccattgggacc

SEQ ID NO: 4391726 - DNA, 14 bp, Homo sapiens
agggatgctgggct

SEQ ID NO: 4391727 - DNA, 16 bp, Homo sapiens
agggatgctgggctgg

SEQ ID NO: 4391728 - DNA, 17 bp, Homo sapiens
agggatggagaggcggc

SEQ ID NO: 4391729 - DNA, 18 bp, Homo sapiens
agggatggggaaaactac

SEQ ID NO: 4391730 - DNA, 20 bp, Homo sapiens
agggatgggggatgggccag

SEQ ID NO: 4391731 - DNA, 15 bp, Homo sapiens
agggattagggagag

SEQ ID NO: 4391732 - DNA, 14 bp, Homo sapiens
agggattcaggctg

SEQ ID NO: 4391733 - DNA, 18 bp, Homo sapiens
agggattcaggctgcttg

SEQ ID NO: 4391734 - DNA, 22 bp, Homo sapiens
agggattctgggcttggggtgt

SEQ ID NO: 4391735 - DNA, 16 bp, Homo sapiens
agggatttccctgcag

SEQ ID NO: 4391736 - DNA, 14 bp, Homo sapiens
agggcaagcctcta

SEQ ID NO: 4391737 - DNA, 16 bp, Homo sapiens
agggcacaaagatgga

SEQ ID NO: 4391738 - DNA, 19 bp, Homo sapiens
agggcacacccctggggct

SEQ ID NO: 4391739 - DNA, 22 bp, Homo sapiens
agggcacacccctggggctgag

SEQ ID NO: 4391740 - DNA, 15 bp, Homo sapiens
agggcactgccagcc

SEQ ID NO: 4391741 - DNA, 20 bp, Homo sapiens
agggcactgtgatacagttt

SEQ ID NO: 4391742 - DNA, 22 bp, Homo sapiens
agggcagaacactaacctgacc

SEQ ID NO: 4391743 - DNA, 14 bp, Homo sapiens
agggcagaggctgg

SEQ ID NO: 4391744 - DNA, 19 bp, Homo sapiens
agggcagagggagaatcca

SEQ ID NO: 4391745 - DNA, 19 bp, Homo sapiens
agggcagattcggaccact

SEQ ID NO: 4391746 - DNA, 17 bp, Homo sapiens
agggcagattttcatgc

SEQ ID NO: 4391747 - DNA, 14 bp, Homo sapiens
agggcagcagggct

SEQ ID NO: 4391748 - DNA, 16 bp, Homo sapiens
agggcagctgggccca

SEQ ID NO: 4391749 - DNA, 17 bp, Homo sapiens
agggcagctgggcccaa

SEQ ID NO: 4391750 - DNA, 18 bp, Homo sapiens
agggcagctgggcccaac

SEQ ID NO: 4391751 - DNA, 20 bp, Homo sapiens
agggcaggatggcctttcct

SEQ ID NO: 4391752 - DNA, 17 bp, Homo sapiens
agggcagggacaggata

SEQ ID NO: 4391753 - DNA, 17 bp, Homo sapiens
agggcagggcgagctgc

SEQ ID NO: 4391754 - DNA, 21 bp, Homo sapiens
agggccacatgggaggctcac

SEQ ID NO: 4391755 - DNA, 15 bp, Homo sapiens
agggccacgtgccag

SEQ ID NO: 4391756 - DNA, 20 bp, Homo sapiens
agggccactggaaggaacat

SEQ ID NO: 4391757 - DNA, 15 bp, Homo sapiens
agggccaggcctctg

SEQ ID NO: 4391758 - DNA, 18 bp, Homo sapiens
agggccagtcctgcctgg

SEQ ID NO: 4391759 - DNA, 22 bp, Homo sapiens
agggccagtcctgcctggccag

SEQ ID NO: 4391760 - DNA, 16 bp, Homo sapiens
agggcccaaagaattg

SEQ ID NO: 4391761 - DNA, 21 bp, Homo sapiens
agggcccaaagaattggaatc

SEQ ID NO: 4391762 - DNA, 12 bp, Homo sapiens
agggcccagccc

SEQ ID NO: 4391763 - DNA, 14 bp, Homo sapiens
agggcccagcccag

SEQ ID NO: 4391764 - DNA, 17 bp, Homo sapiens
agggcccagcccagagc

SEQ ID NO: 4391765 - DNA, 22 bp, Homo sapiens
agggcccagcccagagccacct

SEQ ID NO: 4391766 - DNA, 16 bp, Homo sapiens
agggcccccaataaac

SEQ ID NO: 4391767 - DNA, 18 bp, Homo sapiens
agggcccccaataaacca

SEQ ID NO: 4391768 - DNA, 21 bp, Homo sapiens
agggcccccaataaaccagtg

SEQ ID NO: 4391769 - DNA, 23 bp, Homo sapiens
agggcccccaccgaggttcccag

SEQ ID NO: 4391770 - DNA, 17 bp, Homo sapiens
agggcccggccacaccc

SEQ ID NO: 4391771 - DNA, 20 bp, Homo sapiens
agggcccggccacacccagc

SEQ ID NO: 4391772 - DNA, 13 bp, Homo sapiens
agggccctacctg

SEQ ID NO: 4391773 - DNA, 15 bp, Homo sapiens
agggccctgtgtctg

SEQ ID NO: 4391774 - DNA, 21 bp, Homo sapiens
agggcctctccttggaaggtc

SEQ ID NO: 4391775 - DNA, 15 bp, Homo sapiens
agggcctgacttgag

SEQ ID NO: 4391776 - DNA, 16 bp, Homo sapiens
agggcctggctccagt

SEQ ID NO: 4391777 - DNA, 19 bp, Homo sapiens
agggccttgcccagagatg

SEQ ID NO: 4391778 - DNA, 20 bp, Homo sapiens
aggcattgccaagggctttg

SEQ ID NO: 4391779 - DNA, 14 bp, Homo sapiens
aggcattggatatt

SEQ ID NO: 4391780 - DNA, 17 bp, Homo sapiens
aggcatttaaaatggaa

SEQ ID NO: 4391781 - DNA, 12 bp, Homo sapiens
aggcatttccta

SEQ ID NO: 4391782 - DNA, 18 bp, Homo sapiens
aggcatttgcagggtcct

SEQ ID NO: 4391783 - DNA, 17 bp, Homo sapiens
aggccaaaatcaagagt

SEQ ID NO: 4391784 - DNA, 21 bp, Homo sapiens
aggccaaagagtctccagttt

SEQ ID NO: 4391785 - DNA, 20 bp, Homo sapiens
aggccaaaggccagtggaag

SEQ ID NO: 4391786 - DNA, 19 bp, Homo sapiens
aggccaaatctagaattta

SEQ ID NO: 4391787 - DNA, 13 bp, Homo sapiens
aggccaaggtgct

SEQ ID NO: 4391788 - DNA, 23 bp, Homo sapiens
aggccaagtccgcagaagccctg

SEQ ID NO: 4391789 - DNA, 19 bp, Homo sapiens
aggccacagagaacctgag

SEQ ID NO: 4391790 - DNA, 14 bp, Homo sapiens
aggccacaggcagt

SEQ ID NO: 4391791 - DNA, 14 bp, Homo sapiens
aggccacatgggag

SEQ ID NO: 4391792 - DNA, 21 bp, Homo sapiens
aggccacatgggagcagtcca

SEQ ID NO: 4391793 - DNA, 14 bp, Homo sapiens
aggccaccccaaac

SEQ ID NO: 4391794 - DNA, 20 bp, Homo sapiens
aggccaccccaaaccccagc

SEQ ID NO: 4391795 - DNA, 21 bp, Homo sapiens
aggccaccccctatcctctga

SEQ ID NO: 4391796 - DNA, 17 bp, Homo sapiens
aggccacgtccaggtcc

SEQ ID NO: 4391797 - DNA, 19 bp, Homo sapiens
aggccactcctccaaagga

SEQ ID NO: 4391798 - DNA, 20 bp, Homo sapiens
aggccactggagacgcatat

SEQ ID NO: 4391799 - DNA, 19 bp, Homo sapiens
aggccactgtttggaaata

SEQ ID NO: 4391800 - DNA, 22 bp, Homo sapiens
aggccagacatggtgtctcaca

SEQ ID NO: 4391801 - DNA, 19 bp, Homo sapiens
aggccagagtggcctggcc

SEQ ID NO: 4391802 - DNA, 21 bp, Homo sapiens
aggccagagtggcctggccag

SEQ ID NO: 4391803 - DNA, 15 bp, Homo sapiens
aggccagatggcccc

SEQ ID NO: 4391804 - DNA, 16 bp, Homo sapiens
aggatctgtctgtgca

SEQ ID NO: 4391805 - DNA, 22 bp, Homo sapiens
aggatctgtctgtgcacatgcc

SEQ ID NO: 4391806 - DNA, 19 bp, Homo sapiens
aggatgacaggctctcctg

SEQ ID NO: 4391807 - DNA, 21 bp, Homo sapiens
aggatgaggacagagggcaca

SEQ ID NO: 4391808 - DNA, 15 bp, Homo sapiens
aggatgatttcagaa

SEQ ID NO: 4391809 - DNA, 21 bp, Homo sapiens
aggatgatttcagaaggagaa

SEQ ID NO: 4391810 - DNA, 22 bp, Homo sapiens
aggatgatttcagaaggagaag

SEQ ID NO: 4391811 - DNA, 14 bp, Homo sapiens
aggatggcctttcc

SEQ ID NO: 4391812 - DNA, 18 bp, Homo sapiens
aggatggcctttccttcc

SEQ ID NO: 4391813 - DNA, 21 bp, Homo sapiens
aggatggcctttccttccctc

SEQ ID NO: 4391814 - DNA, 22 bp, Homo sapiens
aggatggcctttccttccctct

SEQ ID NO: 4391815 - DNA, 21 bp, Homo sapiens
aggatggtctcgatctcctga

SEQ ID NO: 4391816 - DNA, 18 bp, Homo sapiens
aggatggtcttacagcag

SEQ ID NO: 4391817 - DNA, 18 bp, Homo sapiens
aggatgtaaacagtgcct

SEQ ID NO: 4391818 - DNA, 19 bp, Homo sapiens
aggatgtactgttgaaaaa

SEQ ID NO: 4391819 - DNA, 16 bp, Homo sapiens
aggatgtatattttat

SEQ ID NO: 4391820 - DNA, 17 bp, Homo sapiens
aggattagataaggctg

SEQ ID NO: 4391821 - DNA, 12 bp, Homo sapiens
aggattatggaa

SEQ ID NO: 4391822 - DNA, 21 bp, Homo sapiens
aggattctgttctgcaactcc

SEQ ID NO: 4391823 - DNA, 17 bp, Homo sapiens
aggattctttccccaga

SEQ ID NO: 4391824 - DNA, 18 bp, Homo sapiens
aggattctttccccagag

SEQ ID NO: 4391825 - DNA, 22 bp, Homo sapiens
aggatttggccacactggggct

SEQ ID NO: 4391826 - DNA, 16 bp, Homo sapiens
aggattttaatttcag

SEQ ID NO: 4391827 - DNA, 18 bp, Homo sapiens
aggattttaccaaagcat

SEQ ID NO: 4391828 - DNA, 15 bp, Homo sapiens
aggattttgaaccca

SEQ ID NO: 4391829 - DNA, 12 bp, Homo sapiens
aggatttttaga

SEQ ID NO: 4391830 - DNA, 22 bp, Homo sapiens
aggcaaagataatttatttcaa

SEQ ID NO: 4391831 - DNA, 13 bp, Homo sapiens
aggcaaagtttta

SEQ ID NO: 4391832 - DNA, 19 bp, Homo sapiens
aggcaaagttttacagaga

SEQ ID NO: 4391833 - DNA, 17 bp, Homo sapiens
aggcaagagggggtgga

SEQ ID NO: 4391834 - DNA, 17 bp, Homo sapiens
aggcaagcgtgttctca

SEQ ID NO: 4391835 - DNA, 18 bp, Homo sapiens
aggcaagcgtgttctcag

SEQ ID NO: 4391836 - DNA, 17 bp, Homo sapiens
aggcaataaaaatcata

SEQ ID NO: 4391837 - DNA, 21 bp, Homo sapiens
aggcaataagaattactttgt

SEQ ID NO: 4391838 - DNA, 19 bp, Homo sapiens
aggcaatcgttctgctggc

SEQ ID NO: 4391839 - DNA, 17 bp, Homo sapiens
aggcaattcctacctct

SEQ ID NO: 4391840 - DNA, 23 bp, Homo sapiens
aggcacacactgtgctttctatt

SEQ ID NO: 4391841 - DNA, 15 bp, Homo sapiens
aggcacacagctact

SEQ ID NO: 4391842 - DNA, 18 bp, Homo sapiens
aggcaccaaaagaagtaa

SEQ ID NO: 4391843 - DNA, 15 bp, Homo sapiens
aggcaccagtccagc

SEQ ID NO: 4391844 - DNA, 20 bp, Homo sapiens
aggcacccctccgtgtggag

SEQ ID NO: 4391845 - DNA, 22 bp, Homo sapiens
aggcacccctccgtgtggagca

SEQ ID NO: 4391846 - DNA, 15 bp, Homo sapiens
aggcaccctcaggga

SEQ ID NO: 4391847 - DNA, 21 bp, Homo sapiens
aggcaccgccacgtcccagca

SEQ ID NO: 4391848 - DNA, 14 bp, Homo sapiens
aggcacgaacccac

SEQ ID NO: 4391849 - DNA, 19 bp, Homo sapiens
aggcacgaacccacctgct

SEQ ID NO: 4391850 - DNA, 13 bp, Homo sapiens
aggcactcagtga

SEQ ID NO: 4391851 - DNA, 19 bp, Homo sapiens
aggcactcagtgagcctcc

SEQ ID NO: 4391852 - DNA, 17 bp, Homo sapiens
aggcacttattgtaaat

SEQ ID NO: 4391853 - DNA, 23 bp, Homo sapiens
aggcagacgtctgtcaggggctt

SEQ ID NO: 4391854 - DNA, 16 bp, Homo sapiens
aggcagagacctccaa

SEQ ID NO: 4391855 - DNA, 23 bp, Homo sapiens
aggcagagctggagcccccagca

SEQ ID NO: 4391856 - DNA, 20 bp, Homo sapiens
aggcagatctgtgccccatg

SEQ ID NO: 4391857 - DNA, 17 bp, Homo sapiens
aggcagatggagcccat

SEQ ID NO: 4391858 - DNA, 23 bp, Homo sapiens
aggcagcagtgtgaggccagggc

SEQ ID NO: 4391859 - DNA, 23 bp, Homo sapiens
aggcagcatcggggtggcccact

SEQ ID NO: 4391860 - DNA, 18 bp, Homo sapiens
aggcagccacagggaagc

SEQ ID NO: 4391861 - DNA, 16 bp, Homo sapiens
aggcagcgccccacca

SEQ ID NO: 4391862 - DNA, 13 bp, Homo sapiens
aggcagctcagga

SEQ ID NO: 4391863 - DNA, 12 bp, Homo sapiens
aggcagctgcct

SEQ ID NO: 4391864 - DNA, 13 bp, Homo sapiens
aggcagctgcctc

SEQ ID NO: 4391865 - DNA, 14 bp, Homo sapiens
aggcagctgcctct

SEQ ID NO: 4391866 - DNA, 21 bp, Homo sapiens
aggcagctgcctctgctccct

SEQ ID NO: 4391867 - DNA, 21 bp, Homo sapiens
aggcagcttctactcctgcct

SEQ ID NO: 4391868 - DNA, 16 bp, Homo sapiens
aggcaggaagggcagg

SEQ ID NO: 4391869 - DNA, 17 bp, Homo sapiens
aggcaggaagggcagga

SEQ ID NO: 4391870 - DNA, 17 bp, Homo sapiens
aggcaggagaatcactt

SEQ ID NO: 4391871 - DNA, 17 bp, Homo sapiens
aggcaggctgggacgga

SEQ ID NO: 4391872 - DNA, 13 bp, Homo sapiens
aggcagggcctgg

SEQ ID NO: 4391873 - DNA, 17 bp, Homo sapiens
aggcagggcctggctcc

SEQ ID NO: 4391874 - DNA, 18 bp, Homo sapiens
aggcagggcctggctcca

SEQ ID NO: 4391875 - DNA, 19 bp, Homo sapiens
aggcagggccttgcccaga

SEQ ID NO: 4391876 - DNA, 14 bp, Homo sapiens
aggcaggggaatgt

SEQ ID NO: 4391877 - DNA, 16 bp, Homo sapiens
aggcagggggccctgc

SEQ ID NO: 4391878 - DNA, 15 bp, Homo sapiens
aggcaggggtggggg

SEQ ID NO: 4391879 - DNA, 23 bp, Homo sapiens
aggcaggggtgggggtggaggct

SEQ ID NO: 4391880 - DNA, 20 bp, Homo sapiens
aggcaggtggacgctgcaga

SEQ ID NO: 4391881 - DNA, 21 bp, Homo sapiens
aggcaggtggacgctgcagac

SEQ ID NO: 4391882 - DNA, 19 bp, Homo sapiens
aggcagtaataaaaagatt

SEQ ID NO: 4391883 - DNA, 20 bp, Homo sapiens
aggcagtccaggcctctctc

SEQ ID NO: 4391884 - DNA, 23 bp, Homo sapiens
aggcagtccaggcctctctctgc

SEQ ID NO: 4391885 - DNA, 16 bp, Homo sapiens
aggcagtctctctctt

SEQ ID NO: 4391886 - DNA, 14 bp, Homo sapiens
aggcagtttgcaaa

SEQ ID NO: 4391887 - DNA, 20 bp, Homo sapiens
aggcatattccctgcacaca

SEQ ID NO: 4391888 - DNA, 12 bp, Homo sapiens
aggcatatttta

SEQ ID NO: 4391889 - DNA, 19 bp, Homo sapiens
aggcatcggggagccggga

SEQ ID NO: 4391890 - DNA, 23 bp, Homo sapiens
aggcatcgtcatgcacagtattt

SEQ ID NO: 4391891 - DNA, 15 bp, Homo sapiens
aggcatgtcccaccc

SEQ ID NO: 4391892 - DNA, 18 bp, Homo sapiens
aggcattgccaagggctt

SEQ ID NO: 4391893 - DNA, 18 bp, Homo sapiens
tcatcctcaaagaaagtg

SEQ ID NO: 4391894 - DNA, 21 bp, Homo sapiens
tcatcctcccattgcccagtg

SEQ ID NO: 4391895 - DNA, 19 bp, Homo sapiens
tcatcctgactctgccccc

SEQ ID NO: 4391896 - DNA, 15 bp, Homo sapiens
tcatcctgattttta

SEQ ID NO: 4391897 - DNA, 18 bp, Homo sapiens
tcatcctgatttttacta

SEQ ID NO: 4391898 - DNA, 20 bp, Homo sapiens
tcatcctgctcttttgtgat

SEQ ID NO: 4391899 - DNA, 22 bp, Homo sapiens
tcatcctgctcttttgtgatga

SEQ ID NO: 4391900 - DNA, 17 bp, Homo sapiens
tcatccttttggataag

SEQ ID NO: 4391901 - DNA, 23 bp, Homo sapiens
tcatcgctcgtgtgttctatcca

SEQ ID NO: 4391902 - DNA, 14 bp, Homo sapiens
tcatctaaatgaaa

SEQ ID NO: 4391903 - DNA, 13 bp, Homo sapiens
tcatctaataaat

SEQ ID NO: 4391904 - DNA, 11 bp, Homo sapiens
tcatctatttt

SEQ ID NO: 4391905 - DNA, 18 bp, Homo sapiens
tcatctattttgatgcag

SEQ ID NO: 4391906 - DNA, 16 bp, Homo sapiens
tcattcttttctttat

SEQ ID NO: 4391907 - DNA, 19 bp, Homo sapiens
tcattcttttgccacatcc

SEQ ID NO: 4391908 - DNA, 21 bp, Homo sapiens
tcattctttttgaaatgtcaa

SEQ ID NO: 4391909 - DNA, 23 bp, Homo sapiens
tcattgaaatgtaatttcagttc

SEQ ID NO: 4391910 - DNA, 13 bp, Homo sapiens
tcattgaagcaga

SEQ ID NO: 4391911 - DNA, 13 bp, Homo sapiens
tcattgacttcat

SEQ ID NO: 4391912 - DNA, 17 bp, Homo sapiens
tcattgattatatgggt

SEQ ID NO: 4391913 - DNA, 17 bp, Homo sapiens
tcattgcagcagataac

SEQ ID NO: 4391914 - DNA, 19 bp, Homo sapiens
tcattgcagcagataactt

SEQ ID NO: 4391915 - DNA, 21 bp, Homo sapiens
tcattgcctcttctacttgta

SEQ ID NO: 4391916 - DNA, 16 bp, Homo sapiens
tcattgctaaactgat

SEQ ID NO: 4391917 - DNA, 14 bp, Homo sapiens
tcattgtaatctgc

SEQ ID NO: 4391918 - DNA, 16 bp, Homo sapiens
tcattgtacaagtatt

SEQ ID NO: 4391919 - DNA, 21 bp, Homo sapiens
tcattgtacaagtattacaac

SEQ ID NO: 4391920 - DNA, 15 bp, Homo sapiens
tcattgtcagccttg

SEQ ID NO: 4391921 - DNA, 19 bp, Homo sapiens
tcattgtctactcctagaa

SEQ ID NO: 4391922 - DNA, 12 bp, Homo sapiens
tcattgttttga

SEQ ID NO: 4391923 - DNA, 13 bp, Homo sapiens
tcattgttttgaa

SEQ ID NO: 4391924 - DNA, 12 bp, Homo sapiens
tcatttaaaaca

SEQ ID NO: 4391925 - DNA, 13 bp, Homo sapiens
tcatttaaaacag

SEQ ID NO: 4391926 - DNA, 18 bp, Homo sapiens
tcatttaaacatgcagaa

SEQ ID NO: 4391927 - DNA, 14 bp, Homo sapiens
tcatttaagggaaa

SEQ ID NO: 4391928 - DNA, 16 bp, Homo sapiens
tcatttaagggaaaaa

SEQ ID NO: 4391929 - DNA, 17 bp, Homo sapiens
tcatttaagggaaaaat

SEQ ID NO: 4391930 - DNA, 23 bp, Homo sapiens
tcatttaagggaaaaatatatat

SEQ ID NO: 4391931 - DNA, 17 bp, Homo sapiens
tcatttagcatgttgtt

SEQ ID NO: 4391932 - DNA, 12 bp, Homo sapiens
tcatttatctat

SEQ ID NO: 4391933 - DNA, 15 bp, Homo sapiens
tcatttcacccctcc

SEQ ID NO: 4391934 - DNA, 23 bp, Homo sapiens
tcatttcacccctccctttctcc

SEQ ID NO: 4391935 - DNA, 21 bp, Homo sapiens
tcatttcagaagttagtttgt

SEQ ID NO: 4391936 - DNA, 16 bp, Homo sapiens
tcatttcagccaaagt

SEQ ID NO: 4391937 - DNA, 16 bp, Homo sapiens
tcatttcagtttctat

SEQ ID NO: 4391938 - DNA, 15 bp, Homo sapiens
tcatttcatctcatt

SEQ ID NO: 4391939 - DNA, 18 bp, Homo sapiens
tcatttcatctcatttaa

SEQ ID NO: 4391940 - DNA, 14 bp, Homo sapiens
tcatttcattccat

SEQ ID NO: 4391941 - DNA, 12 bp, Homo sapiens
tcatttctctgc

SEQ ID NO: 4391942 - DNA, 19 bp, Homo sapiens
tcatttctctttttatctc

SEQ ID NO: 4391943 - DNA, 15 bp, Homo sapiens
tcatttcttatcaca

SEQ ID NO: 4391944 - DNA, 20 bp, Homo sapiens
tcatttcttatcacataaga

SEQ ID NO: 4391945 - DNA, 13 bp, Homo sapiens
tcatttgcacaca

SEQ ID NO: 4391946 - DNA, 18 bp, Homo sapiens
tcatttgcacacaaaaat

SEQ ID NO: 4391947 - DNA, 20 bp, Homo sapiens
tcatttgcttgcaatctaat

SEQ ID NO: 4391948 - DNA, 17 bp, Homo sapiens
tcatttggcttgctgtt

SEQ ID NO: 4391949 - DNA, 19 bp, Homo sapiens
tcatttggcttgctgttta

SEQ ID NO: 4391950 - DNA, 21 bp, Homo sapiens
tcatttggcttgctgtttact

SEQ ID NO: 4391951 - DNA, 20 bp, Homo sapiens
tcatttggttcattaattct

SEQ ID NO: 4391952 - DNA, 13 bp, Homo sapiens
tcatttgtttaaa

SEQ ID NO: 4391953 - DNA, 17 bp, Homo sapiens
tcatttgtttaaaaagg

SEQ ID NO: 4391954 - DNA, 21 bp, Homo sapiens
tcatttgtttaaaaaggcagt

SEQ ID NO: 4391955 - DNA, 18 bp, Homo sapiens
tcatttgtttaaacaatc

SEQ ID NO: 4391956 - DNA, 15 bp, Homo sapiens
tcatttgtttacatt

SEQ ID NO: 4391957 - DNA, 17 bp, Homo sapiens
tcattttaactggcatg

SEQ ID NO: 4391958 - DNA, 14 bp, Homo sapiens
tcattttaatatat

SEQ ID NO: 4391959 - DNA, 17 bp, Homo sapiens
tcattttactgtatatt

SEQ ID NO: 4391960 - DNA, 15 bp, Homo sapiens
tcattttatatttaa

SEQ ID NO: 4391961 - DNA, 17 bp, Homo sapiens
tcattttatatttaaaa

SEQ ID NO: 4391962 - DNA, 17 bp, Homo sapiens
tcattttattttgtaat

SEQ ID NO: 4391963 - DNA, 15 bp, Homo sapiens
tcattttcactttta

SEQ ID NO: 4391964 - DNA, 17 bp, Homo sapiens
tcattttcctgacattt

SEQ ID NO: 4391965 - DNA, 12 bp, Homo sapiens
tcattttctaga

SEQ ID NO: 4391966 - DNA, 20 bp, Homo sapiens
tcattttctagatacaataa

SEQ ID NO: 4391967 - DNA, 21 bp, Homo sapiens
tcattttctagatacaataaa

SEQ ID NO: 4391968 - DNA, 14 bp, Homo sapiens
tcattttgaaaata

SEQ ID NO: 4391969 - DNA, 19 bp, Homo sapiens
tcattttgttttgctctga

SEQ ID NO: 4391970 - DNA, 13 bp, Homo sapiens
tcatttttaatgt

SEQ ID NO: 4391971 - DNA, 15 bp, Homo sapiens
tcatttttaatgtat

SEQ ID NO: 4391972 - DNA, 15 bp, Homo sapiens
tcatttttacactat

SEQ ID NO: 4391973 - DNA, 21 bp, Homo sapiens
tcatttttatagcaacaacaa

SEQ ID NO: 4391974 - DNA, 23 bp, Homo sapiens
tcatttttgtttttggtttctta

SEQ ID NO: 4391975 - DNA, 16 bp, Homo sapiens
tcattttttaaaaaag

SEQ ID NO: 4391976 - DNA, 18 bp, Homo sapiens
tcattttttaatgtgctc

SEQ ID NO: 4391977 - DNA, 21 bp, Homo sapiens
tcattttttaatgtgctctgt

SEQ ID NO: 4391978 - DNA, 13 bp, Homo sapiens
tcattttttactt

SEQ ID NO: 4391979 - DNA, 14 bp, Homo sapiens
tcattttttacttg

SEQ ID NO: 4391980 - DNA, 18 bp, Homo sapiens
tcattttttttttatcag

SEQ ID NO: 4391981 - DNA, 20 bp, Homo sapiens
tccaaaagattgctgaaatt

SEQ ID NO: 4391982 - DNA, 22 bp, Homo sapiens
tccaaaagattgctgaaatttt

SEQ ID NO: 4391983 - DNA, 14 bp, Homo sapiens
tccaaaagcacatg

SEQ ID NO: 4391984 - DNA, 17 bp, Homo sapiens
tccaaaagcgccctcac

SEQ ID NO: 4391985 - DNA, 13 bp, Homo sapiens
tccaaaagctttt

SEQ ID NO: 4391986 - DNA, 22 bp, Homo sapiens
tccaaaataatctatattaaat

SEQ ID NO: 4391987 - DNA, 22 bp, Homo sapiens
tccaaaatgttggtcattttat

SEQ ID NO: 4391988 - DNA, 15 bp, Homo sapiens
tccaaaccaggacac

SEQ ID NO: 4391989 - DNA, 14 bp, Homo sapiens
tccaaacctggttc

SEQ ID NO: 4391990 - DNA, 12 bp, Homo sapiens
tccaaagaaatg

SEQ ID NO: 4391991 - DNA, 17 bp, Homo sapiens
tccaaagagccttcaga

SEQ ID NO: 4391992 - DNA, 22 bp, Homo sapiens
tccaaagagtagaattgcattg

SEQ ID NO: 4391993 - DNA, 23 bp, Homo sapiens
tccaaagagtagaattgcattga

SEQ ID NO: 4391994 - DNA, 11 bp, Homo sapiens
tccaaagcaaa

SEQ ID NO: 4391995 - DNA, 19 bp, Homo sapiens
tccaaagcaaaaccagaac

SEQ ID NO: 4391996 - DNA, 21 bp, Homo sapiens
tccaaagctttattaccagtg

SEQ ID NO: 4391997 - DNA, 13 bp, Homo sapiens
tccaaaggaggct

SEQ ID NO: 4391998 - DNA, 19 bp, Homo sapiens
tccaaaggaggctggcagg

SEQ ID NO: 4391999 - DNA, 18 bp, Homo sapiens
tccaaatccaaggaaaca

SEQ ID NO: 4392000 - DNA, 20 bp, Homo sapiens
tccaaatggcgtctggaagt

SEQ ID NO: 4392001 - DNA, 20 bp, Homo sapiens
tccaaatgtcctccagaagc

SEQ ID NO: 4392002 - DNA, 14 bp, Homo sapiens
tccaaattcagttt

SEQ ID NO: 4392003 - DNA, 14 bp, Homo sapiens
tccaaattgtgctt

SEQ ID NO: 4392004 - DNA, 18 bp, Homo sapiens
tccaacatttctcactga

SEQ ID NO: 4392005 - DNA, 21 bp, Homo sapiens
tccaacatttctcactgaaag

SEQ ID NO: 4392006 - DNA, 15 bp, Homo sapiens
tccaaccactgtaca

SEQ ID NO: 4392007 - DNA, 18 bp, Homo sapiens
tccaaccccccagcactg

SEQ ID NO: 4392008 - DNA, 19 bp, Homo sapiens
tccaaccccccagcactga

SEQ ID NO: 4392009 - DNA, 23 bp, Homo sapiens
tccaacccgtctggcccaccagg

SEQ ID NO: 4392010 - DNA, 21 bp, Homo sapiens
tccaaccggctttgtggcact

SEQ ID NO: 4392011 - DNA, 22 bp, Homo sapiens
tccaactaatgccttactcttc

SEQ ID NO: 4392012 - DNA, 21 bp, Homo sapiens
tccaactactaatagaataaa

SEQ ID NO: 4392013 - DNA, 20 bp, Homo sapiens
tccaactcctttcagccaca

SEQ ID NO: 4392014 - DNA, 18 bp, Homo sapiens
tccaactcgaatctgtgt

SEQ ID NO: 4392015 - DNA, 23 bp, Homo sapiens
tccaactggccctatttagatga

SEQ ID NO: 4392016 - DNA, 12 bp, Homo sapiens
tccaacttcctg

SEQ ID NO: 4392017 - DNA, 13 bp, Homo sapiens
tccaacttcctgt

SEQ ID NO: 4392018 - DNA, 13 bp, Homo sapiens
tccaagaaaatat

SEQ ID NO: 4392019 - DNA, 17 bp, Homo sapiens
tccaagacagcagcagc

SEQ ID NO: 4392020 - DNA, 19 bp, Homo sapiens
tccaagacagcagcagcct

SEQ ID NO: 4392021 - DNA, 22 bp, Homo sapiens
tccaagacagcagcagcctgca

SEQ ID NO: 4392022 - DNA, 21 bp, Homo sapiens
tccaagagctacataatttag

SEQ ID NO: 4392023 - DNA, 13 bp, Homo sapiens
tccaagaggctgt

SEQ ID NO: 4392024 - DNA, 22 bp, Homo sapiens
tccaagatattttaaaatctgt

SEQ ID NO: 4392025 - DNA, 18 bp, Homo sapiens
tccaagcacagagcctgg

SEQ ID NO: 4392026 - DNA, 21 bp, Homo sapiens
tccaagcacagagcctggccc

SEQ ID NO: 4392027 - DNA, 23 bp, Homo sapiens
tccaagcacagagcctggcccca

SEQ ID NO: 4392028 - DNA, 23 bp, Homo sapiens
tccaagcagcctgagcaactctt

SEQ ID NO: 4392029 - DNA, 15 bp, Homo sapiens
tccaagcatttcatg

SEQ ID NO: 4392030 - DNA, 17 bp, Homo sapiens
tccaagcatttcatgaa

SEQ ID NO: 4392031 - DNA, 20 bp, Homo sapiens
tccaagcatttcatgaaaaa

SEQ ID NO: 4392032 - DNA, 14 bp, Homo sapiens
tccaagcctgcctc

SEQ ID NO: 4392033 - DNA, 21 bp, Homo sapiens
tccaagcgaggtcaacagaga

SEQ ID NO: 4392034 - DNA, 22 bp, Homo sapiens
tccaagcgaggtcaacagagaa

SEQ ID NO: 4392035 - DNA, 12 bp, Homo sapiens
tccaagcttcca

SEQ ID NO: 4392036 - DNA, 14 bp, Homo sapiens
tccaaggaaacatg

SEQ ID NO: 4392037 - DNA, 17 bp, Homo sapiens
tccaaggacaccctccc

SEQ ID NO: 4392038 - DNA, 12 bp, Homo sapiens
tccaaggccagt

SEQ ID NO: 4392039 - DNA, 18 bp, Homo sapiens
tccaagggttgagagcca

SEQ ID NO: 4392040 - DNA, 20 bp, Homo sapiens
tccaagggttgagagccagt

SEQ ID NO: 4392041 - DNA, 21 bp, Homo sapiens
tccaagggttgagagccagtg

SEQ ID NO: 4392042 - DNA, 18 bp, Homo sapiens
tccaaggtggcagatgtc

SEQ ID NO: 4392043 - DNA, 22 bp, Homo sapiens
tccaataaaaacattttgaagt

SEQ ID NO: 4392044 - DNA, 18 bp, Homo sapiens
tccaataaagtgccttct

SEQ ID NO: 4392045 - DNA, 20 bp, Homo sapiens
tccaataaagtgccttctgg

SEQ ID NO: 4392046 - DNA, 21 bp, Homo sapiens
tccaataaagtgccttctggg

SEQ ID NO: 4392047 - DNA, 17 bp, Homo sapiens
tccaatagaaagaaact

SEQ ID NO: 4392048 - DNA, 15 bp, Homo sapiens
tccaatatgaaaacc

SEQ ID NO: 4392049 - DNA, 16 bp, Homo sapiens
tccaatatttctgctt

SEQ ID NO: 4392050 - DNA, 16 bp, Homo sapiens
tccaatcctatgtttt

SEQ ID NO: 4392051 - DNA, 21 bp, Homo sapiens
tccaatgatacccaacagttt

SEQ ID NO: 4392052 - DNA, 16 bp, Homo sapiens
tccaatgccacagaca

SEQ ID NO: 4392053 - DNA, 24 bp, Homo sapiens
tccaatgccacctagactctccct

SEQ ID NO: 4392054 - DNA, 20 bp, Homo sapiens
tccaatggaaagcttttcag

SEQ ID NO: 4392055 - DNA, 15 bp, Homo sapiens
tccaattctgaaata

SEQ ID NO: 4392056 - DNA, 16 bp, Homo sapiens
tccacaaaattagaaa

SEQ ID NO: 4392057 - DNA, 19 bp, Homo sapiens
tccacaaacacattataaa

SEQ ID NO: 4392058 - DNA, 20 bp, Homo sapiens
tccacaaagaaaattcctat

SEQ ID NO: 4392059 - DNA, 21 bp, Homo sapiens
tccacaaagaaaattcctata

SEQ ID NO: 4392060 - DNA, 14 bp, Homo sapiens
tccacaaattatta

SEQ ID NO: 4392061 - DNA, 18 bp, Homo sapiens
tccacaagattcccagag

SEQ ID NO: 4392062 - DNA, 19 bp, Homo sapiens
tccacaagattcccagaga

SEQ ID NO: 4392063 - DNA, 18 bp, Homo sapiens
tccacaaggaataaatga

SEQ ID NO: 4392064 - DNA, 19 bp, Homo sapiens
tccacaattattggcaaag

SEQ ID NO: 4392065 - DNA, 22 bp, Homo sapiens
tccacacgccccggtcccccag

SEQ ID NO: 4392066 - DNA, 18 bp, Homo sapiens
tccacactccttgtcaac

SEQ ID NO: 4392067 - DNA, 19 bp, Homo sapiens
tccacactgaccaagtgct

SEQ ID NO: 4392068 - DNA, 18 bp, Homo sapiens
tccacagaaaatgtaaac

SEQ ID NO: 4392069 - DNA, 18 bp, Homo sapiens
tccacagaacctttgtca

SEQ ID NO: 4392070 - DNA, 20 bp, Homo sapiens
tccacagccttgcagcggct

SEQ ID NO: 4392071 - DNA, 12 bp, Homo sapiens
tccacagctggc

SEQ ID NO: 4392072 - DNA, 14 bp, Homo sapiens
tccacaggggccac

SEQ ID NO: 4392073 - DNA, 11 bp, Homo sapiens
tccacagtggc

SEQ ID NO: 4392074 - DNA, 21 bp, Homo sapiens
tccacataaattttaattcaa

SEQ ID NO: 4392075 - DNA, 16 bp, Homo sapiens
tccacataagcactcc

SEQ ID NO: 4392076 - DNA, 14 bp, Homo sapiens
tccacatctgcctt

SEQ ID NO: 4392077 - DNA, 18 bp, Homo sapiens
tccacatctgccttaaaa

SEQ ID NO: 4392078 - DNA, 15 bp, Homo sapiens
tccacatgggagccg

SEQ ID NO: 4392079 - DNA, 16 bp, Homo sapiens
tccaccaacccatcag

SEQ ID NO: 4392080 - DNA, 19 bp, Homo sapiens
tccaccatgctctctcacc

SEQ ID NO: 4392081 - DNA, 12 bp, Homo sapiens
tccacccagccc

SEQ ID NO: 4392082 - DNA, 13 bp, Homo sapiens
tccaccccagggt

SEQ ID NO: 4392083 - DNA, 15 bp, Homo sapiens
tccaccccagggtca

SEQ ID NO: 4392084 - DNA, 14 bp, Homo sapiens
tccaccctctgagc

SEQ ID NO: 4392085 - DNA, 13 bp, Homo sapiens
tccaccctgagct

SEQ ID NO: 4392086 - DNA, 17 bp, Homo sapiens
tccaccctgagctcggg

SEQ ID NO: 4392087 - DNA, 13 bp, Homo sapiens
tccacccttggcc

SEQ ID NO: 4392088 - DNA, 15 bp, Homo sapiens
tccacccttggcctg

SEQ ID NO: 4392089 - DNA, 17 bp, Homo sapiens
tccacccttggcctgtc

SEQ ID NO: 4392090 - DNA, 19 bp, Homo sapiens
tccacccttggcctgtctc

SEQ ID NO: 4392091 - DNA, 13 bp, Homo sapiens
tccaccgctgcct

SEQ ID NO: 4392092 - DNA, 15 bp, Homo sapiens
tccaccgctgcctaa

SEQ ID NO: 4392093 - DNA, 18 bp, Homo sapiens
tccacctgagaccctggg

SEQ ID NO: 4392094 - DNA, 12 bp, Homo sapiens
tccacctgcctt

SEQ ID NO: 4392095 - DNA, 14 bp, Homo sapiens
tccacctgccttgg

SEQ ID NO: 4392096 - DNA, 18 bp, Homo sapiens
tccacctgccttggcctc

SEQ ID NO: 4392097 - DNA, 21 bp, Homo sapiens
tccacctggaaactgctcaga

SEQ ID NO: 4392098 - DNA, 15 bp, Homo sapiens
tccacgactgtctcc

SEQ ID NO: 4392099 - DNA, 16 bp, Homo sapiens
tccacgactgtctcca

SEQ ID NO: 4392100 - DNA, 15 bp, Homo sapiens
tccacgcccaccagc

SEQ ID NO: 4392101 - DNA, 18 bp, Homo sapiens
tccacgcccaccagcctt

SEQ ID NO: 4392102 - DNA, 20 bp, Homo sapiens
tccacgcccaccagccttgc

SEQ ID NO: 4392103 - DNA, 22 bp, Homo sapiens
tccacgcccaccagccttgctc

SEQ ID NO: 4392104 - DNA, 17 bp, Homo sapiens
tccacgcctcctggcca

SEQ ID NO: 4392105 - DNA, 19 bp, Homo sapiens
tccacgcctcctggccaga

SEQ ID NO: 4392106 - DNA, 20 bp, Homo sapiens
tccacggagccactcctctg

SEQ ID NO: 4392107 - DNA, 21 bp, Homo sapiens
tccacggagccactcctctga

SEQ ID NO: 4392108 - DNA, 16 bp, Homo sapiens
tccacgtacttaattt

SEQ ID NO: 4392109 - DNA, 21 bp, Homo sapiens
tccacgtacttaatttactta

SEQ ID NO: 4392110 - DNA, 17 bp, Homo sapiens
tccactaaaaatattgt

SEQ ID NO: 4392111 - DNA, 16 bp, Homo sapiens
tccactaaccccgggc

SEQ ID NO: 4392112 - DNA, 15 bp, Homo sapiens
tccactcgtgtgttt

SEQ ID NO: 4392113 - DNA, 16 bp, Homo sapiens
tccactcgtgtgtttc

SEQ ID NO: 4392114 - DNA, 18 bp, Homo sapiens
tccactcgtgtgtttcta

SEQ ID NO: 4392115 - DNA, 18 bp, Homo sapiens
tccactctaccctcccac

SEQ ID NO: 4392116 - DNA, 20 bp, Homo sapiens
tccactctaccctcccaccc

SEQ ID NO: 4392117 - DNA, 17 bp, Homo sapiens
tccactctagttctaga

SEQ ID NO: 4392118 - DNA, 18 bp, Homo sapiens
tccactctagttctagat

SEQ ID NO: 4392119 - DNA, 16 bp, Homo sapiens
tccactctcccccacc

SEQ ID NO: 4392120 - DNA, 22 bp, Homo sapiens
tccactctcccccaccccctcc

SEQ ID NO: 4392121 - DNA, 16 bp, Homo sapiens
tccactcttgatctct

SEQ ID NO: 4392122 - DNA, 20 bp, Homo sapiens
tccactcttgatctctcttg

SEQ ID NO: 4392123 - DNA, 14 bp, Homo sapiens
tccactgaaaattt

SEQ ID NO: 4392124 - DNA, 19 bp, Homo sapiens
tccactgaaaatttaacag

SEQ ID NO: 4392125 - DNA, 20 bp, Homo sapiens
tccactgaaaatttaacagt

SEQ ID NO: 4392126 - DNA, 11 bp, Homo sapiens
tccactgagca

SEQ ID NO: 4392127 - DNA, 17 bp, Homo sapiens
tccactgcaagtctgtg

SEQ ID NO: 4392128 - DNA, 21 bp, Homo sapiens
tccactggggaatgctcccag

SEQ ID NO: 4392129 - DNA, 19 bp, Homo sapiens
tccactggtttcaggccaa

SEQ ID NO: 4392130 - DNA, 23 bp, Homo sapiens
tccactgttctcctgaatatttt

SEQ ID NO: 4392131 - DNA, 17 bp, Homo sapiens
tccacttcattttgtat

SEQ ID NO: 4392132 - DNA, 22 bp, Homo sapiens
tccacttcattttgtataatca

SEQ ID NO: 4392133 - DNA, 20 bp, Homo sapiens
tccacttccaggtctgcctg

SEQ ID NO: 4392134 - DNA, 18 bp, Homo sapiens
tccagaaaacctctcctg

SEQ ID NO: 4392135 - DNA, 15 bp, Homo sapiens
tccagaacagccctc

SEQ ID NO: 4392136 - DNA, 22 bp, Homo sapiens
tcaccataatgaacaattgcta

SEQ ID NO: 4392137 - DNA, 16 bp, Homo sapiens
tcaccatcggactcat

SEQ ID NO: 4392138 - DNA, 16 bp, Homo sapiens
tcaccatgatcactta

SEQ ID NO: 4392139 - DNA, 17 bp, Homo sapiens
tcaccatgtaagcactc

SEQ ID NO: 4392140 - DNA, 19 bp, Homo sapiens
tcacccaagccacaagctg

SEQ ID NO: 4392141 - DNA, 14 bp, Homo sapiens
tcacccacagggct

SEQ ID NO: 4392142 - DNA, 23 bp, Homo sapiens
tcacccaccaggccagctcagga

SEQ ID NO: 4392143 - DNA, 12 bp, Homo sapiens
tcacccaccata

SEQ ID NO: 4392144 - DNA, 14 bp, Homo sapiens
tcacccacccctgc

SEQ ID NO: 4392145 - DNA, 20 bp, Homo sapiens
tcacccagacagcctgtttc

SEQ ID NO: 4392146 - DNA, 13 bp, Homo sapiens
tcacccccttctc

SEQ ID NO: 4392147 - DNA, 22 bp, Homo sapiens
tcacccccttctccatccacat

SEQ ID NO: 4392148 - DNA, 17 bp, Homo sapiens
tcacccctccctttctc

SEQ ID NO: 4392149 - DNA, 13 bp, Homo sapiens
tcacccctctgcc

SEQ ID NO: 4392150 - DNA, 20 bp, Homo sapiens
tcacccctctgcccctgcag

SEQ ID NO: 4392151 - DNA, 22 bp, Homo sapiens
tcacccctggttctcatctttc

SEQ ID NO: 4392152 - DNA, 15 bp, Homo sapiens
tcacccctgtttctg

SEQ ID NO: 4392153 - DNA, 19 bp, Homo sapiens
tcacccctttctgtcccac

SEQ ID NO: 4392154 - DNA, 12 bp, Homo sapiens
tcaccctggcct

SEQ ID NO: 4392155 - DNA, 13 bp, Homo sapiens
tcaccctgggagc

SEQ ID NO: 4392156 - DNA, 17 bp, Homo sapiens
tcaccctgggagccagt

SEQ ID NO: 4392157 - DNA, 11 bp, Homo sapiens
tcacccttccc

SEQ ID NO: 4392158 - DNA, 22 bp, Homo sapiens
tcaccgactgaaaatattgttt

SEQ ID NO: 4392159 - DNA, 14 bp, Homo sapiens
tcaccgagactcag

SEQ ID NO: 4392160 - DNA, 21 bp, Homo sapiens
tcaccgagactcagcctctgc

SEQ ID NO: 4392161 - DNA, 22 bp, Homo sapiens
tcaccgagactcagcctctgct

SEQ ID NO: 4392162 - DNA, 20 bp, Homo sapiens
tcaccgagagtagccgagag

SEQ ID NO: 4392163 - DNA, 23 bp, Homo sapiens
tcaccgagagtagccgagagcct

SEQ ID NO: 4392164 - DNA, 14 bp, Homo sapiens
tcaccgagcagagg

SEQ ID NO: 4392165 - DNA, 13 bp, Homo sapiens
tcaccgcccatca

SEQ ID NO: 4392166 - DNA, 14 bp, Homo sapiens
tcaccgctggccct

SEQ ID NO: 4392167 - DNA, 18 bp, Homo sapiens
tcaccgtgggctccctga

SEQ ID NO: 4392168 - DNA, 19 bp, Homo sapiens
tcaccgtgggctccctgac

SEQ ID NO: 4392169 - DNA, 20 bp, Homo sapiens
tcacctaagcacttctagaa

SEQ ID NO: 4392170 - DNA, 16 bp, Homo sapiens
tcacctagaacgtgca

SEQ ID NO: 4392171 - DNA, 17 bp, Homo sapiens
tcacctagcatgtgtaa

SEQ ID NO: 4392172 - DNA, 13 bp, Homo sapiens
tcacctccctgct

SEQ ID NO: 4392173 - DNA, 16 bp, Homo sapiens
tcacctctcagctgct

SEQ ID NO: 4392174 - DNA, 22 bp, Homo sapiens
tcacctctcagctgctggatga

SEQ ID NO: 4392175 - DNA, 14 bp, Homo sapiens
tcacctctgcctca

SEQ ID NO: 4392176 - DNA, 14 bp, Homo sapiens
tcacctcttctacc

SEQ ID NO: 4392177 - DNA, 19 bp, Homo sapiens
tcacctgaaccccagaggc

SEQ ID NO: 4392178 - DNA, 23 bp, Homo sapiens
tcacctgaaccccagaggcagag

SEQ ID NO: 4392179 - DNA, 15 bp, Homo sapiens
tcacctgaggtcggg

SEQ ID NO: 4392180 - DNA, 17 bp, Homo sapiens
tcacctgaggtcgggag

SEQ ID NO: 4392181 - DNA, 16 bp, Homo sapiens
tcacctgccgccctgt

SEQ ID NO: 4392182 - DNA, 14 bp, Homo sapiens
tcacctgctcccag

SEQ ID NO: 4392183 - DNA, 17 bp, Homo sapiens
tcacctgtaaacctgag

SEQ ID NO: 4392184 - DNA, 14 bp, Homo sapiens
tcacctgtgcttcg

SEQ ID NO: 4392185 - DNA, 13 bp, Homo sapiens
tcaccttcctgtg

SEQ ID NO: 4392186 - DNA, 20 bp, Homo sapiens
tcacctttcccacctctctc

SEQ ID NO: 4392187 - DNA, 17 bp, Homo sapiens
tcaccttttctgtggct

SEQ ID NO: 4392188 - DNA, 18 bp, Homo sapiens
tcaccttttctgtggctg

SEQ ID NO: 4392189 - DNA, 22 bp, Homo sapiens
tcacgaaagtatttacttttta

SEQ ID NO: 4392190 - DNA, 21 bp, Homo sapiens
tcacgattaactgtgaaatgt

SEQ ID NO: 4392191 - DNA, 19 bp, Homo sapiens
tcacgcctgtaatcccagc

SEQ ID NO: 4392192 - DNA, 20 bp, Homo sapiens
tcacgcctgtaatcccagca

SEQ ID NO: 4392193 - DNA, 21 bp, Homo sapiens
tcacgcctgtaatcccagcac

SEQ ID NO: 4392194 - DNA, 14 bp, Homo sapiens
tcacgctttcctga

SEQ ID NO: 4392195 - DNA, 15 bp, Homo sapiens
tcacgctttcctgaa

SEQ ID NO: 4392196 - DNA, 14 bp, Homo sapiens
tcacgctttgttta

SEQ ID NO: 4392197 - DNA, 15 bp, Homo sapiens
tcacgctttgtttac

SEQ ID NO: 4392198 - DNA, 18 bp, Homo sapiens
tcacgggcagtagctgtg

SEQ ID NO: 4392199 - DNA, 21 bp, Homo sapiens
tcacggggttccctcctagct

SEQ ID NO: 4392200 - DNA, 18 bp, Homo sapiens
tcacgtaaagctagaaat

SEQ ID NO: 4392201 - DNA, 12 bp, Homo sapiens
tcacgtcatttg

SEQ ID NO: 4392202 - DNA, 17 bp, Homo sapiens
tcacgttagaggaaaaa

SEQ ID NO: 4392203 - DNA, 19 bp, Homo sapiens
tcactaaaaggaagacagt

SEQ ID NO: 4392204 - DNA, 21 bp, Homo sapiens
tcactaaataaacacgatttt

SEQ ID NO: 4392205 - DNA, 12 bp, Homo sapiens
tcactaaatctt

SEQ ID NO: 4392206 - DNA, 14 bp, Homo sapiens
tcactaacagggag

SEQ ID NO: 4392207 - DNA, 22 bp, Homo sapiens
tcactaacagggagaagtagct

SEQ ID NO: 4392208 - DNA, 15 bp, Homo sapiens
tcactaacattatat

SEQ ID NO: 4392209 - DNA, 21 bp, Homo sapiens
tcactatatatatttctagaa

SEQ ID NO: 4392210 - DNA, 22 bp, Homo sapiens
tcactatggtatgctggccagc

SEQ ID NO: 4392211 - DNA, 18 bp, Homo sapiens
tcactattacttgaactt

SEQ ID NO: 4392212 - DNA, 21 bp, Homo sapiens
tcactcaccactaccagccag

SEQ ID NO: 4392213 - DNA, 15 bp, Homo sapiens
tcactcactcattcc

SEQ ID NO: 4392214 - DNA, 16 bp, Homo sapiens
tcactcactcattcct

SEQ ID NO: 4392215 - DNA, 12 bp, Homo sapiens
tcactcactgtt

SEQ ID NO: 4392216 - DNA, 14 bp, Homo sapiens
tcactcattaatta

SEQ ID NO: 4392217 - DNA, 14 bp, Homo sapiens
tcactccaccaccc

SEQ ID NO: 4392218 - DNA, 14 bp, Homo sapiens
tcactccaccatcc

SEQ ID NO: 4392219 - DNA, 17 bp, Homo sapiens
tcactccaccatcccca

SEQ ID NO: 4392220 - DNA, 14 bp, Homo sapiens
tcactcccagtcca

SEQ ID NO: 4392221 - DNA, 19 bp, Homo sapiens
tcactcccctctcctcccc

SEQ ID NO: 4392222 - DNA, 19 bp, Homo sapiens
tcactcccttctacctgcc

SEQ ID NO: 4392223 - DNA, 16 bp, Homo sapiens
tcactcctccgtgagc

SEQ ID NO: 4392224 - DNA, 17 bp, Homo sapiens
tcactgagagtcaggag

SEQ ID NO: 4392225 - DNA, 22 bp, Homo sapiens
tcactgagtgcctactctttgc

SEQ ID NO: 4392226 - DNA, 16 bp, Homo sapiens
tcactgatgggaataa

SEQ ID NO: 4392227 - DNA, 14 bp, Homo sapiens
tcactgatgtacaa

SEQ ID NO: 4392228 - DNA, 21 bp, Homo sapiens
tcactgatgtacaattaaaaa

SEQ ID NO: 4392229 - DNA, 17 bp, Homo sapiens
tcactgcaacctctgcc

SEQ ID NO: 4392230 - DNA, 18 bp, Homo sapiens
tcactgcaacctctgcct

SEQ ID NO: 4392231 - DNA, 21 bp, Homo sapiens
tcactgcaacctctgcctccc

SEQ ID NO: 4392232 - DNA, 14 bp, Homo sapiens
tcactgcagcctca

SEQ ID NO: 4392233 - DNA, 17 bp, Homo sapiens
tcactgcagtcacctct

SEQ ID NO: 4392234 - DNA, 22 bp, Homo sapiens
tcactgcagtcacctcttctac

SEQ ID NO: 4392235 - DNA, 21 bp, Homo sapiens
tcactgcatttgcctgcttct

SEQ ID NO: 4392236 - DNA, 23 bp, Homo sapiens
tcactgccaggccagcctccgag

SEQ ID NO: 4392237 - DNA, 15 bp, Homo sapiens
tcactgctgctggga

SEQ ID NO: 4392238 - DNA, 19 bp, Homo sapiens
tcactgcttgaactaggct

SEQ ID NO: 4392239 - DNA, 23 bp, Homo sapiens
tcactggaaaggggagagcctgc

SEQ ID NO: 4392240 - DNA, 14 bp, Homo sapiens
tcactggaaattga

SEQ ID NO: 4392241 - DNA, 22 bp, Homo sapiens
tcactggagcaccaggcacgaa

SEQ ID NO: 4392242 - DNA, 16 bp, Homo sapiens
tcactggcctctcccc

SEQ ID NO: 4392243 - DNA, 20 bp, Homo sapiens
tcactggcctctccccagga

SEQ ID NO: 4392244 - DNA, 15 bp, Homo sapiens
tcactgtaaagacaa

SEQ ID NO: 4392245 - DNA, 17 bp, Homo sapiens
tcactgtatataaacat

SEQ ID NO: 4392246 - DNA, 17 bp, Homo sapiens
tcactgtctatttaagt

SEQ ID NO: 4392247 - DNA, 19 bp, Homo sapiens
tcactgtctatttaagtgc

SEQ ID NO: 4392248 - DNA, 23 bp, Homo sapiens
tcactgtgaaccaacccccatct

SEQ ID NO: 4392249 - DNA, 21 bp, Homo sapiens
tcactgtgatcaatattttta

SEQ ID NO: 4392250 - DNA, 15 bp, Homo sapiens
tcactgtgtatagga

SEQ ID NO: 4392251 - DNA, 18 bp, Homo sapiens
tcactgtgtataggaatt

SEQ ID NO: 4392252 - DNA, 23 bp, Homo sapiens
tcactgtgtataggaatttgtat

SEQ ID NO: 4392253 - DNA, 21 bp, Homo sapiens
tcactgtttataaatgttctg

SEQ ID NO: 4392254 - DNA, 14 bp, Homo sapiens
tcactgtttcatct

SEQ ID NO: 4392255 - DNA, 16 bp, Homo sapiens
tcactgtttgttttta

SEQ ID NO: 4392256 - DNA, 18 bp, Homo sapiens
tcacttaaactttgtcac

SEQ ID NO: 4392257 - DNA, 21 bp, Homo sapiens
tcacttaaactttgtcacttc

SEQ ID NO: 4392258 - DNA, 22 bp, Homo sapiens
tcacttcgttggtgaccagttt

SEQ ID NO: 4392259 - DNA, 16 bp, Homo sapiens
tcacttctaaaccaaa

SEQ ID NO: 4392260 - DNA, 17 bp, Homo sapiens
tcacttctccccgcagc

SEQ ID NO: 4392261 - DNA, 18 bp, Homo sapiens
tcacttctttgcagagcc

SEQ ID NO: 4392262 - DNA, 19 bp, Homo sapiens
tcacttctttgcagagcct

SEQ ID NO: 4392263 - DNA, 23 bp, Homo sapiens
tcacttgaggaggagctggcctg

SEQ ID NO: 4392264 - DNA, 24 bp, Homo sapiens
tcacttgaggaggagctggcctgc

SEQ ID NO: 4392265 - DNA, 13 bp, Homo sapiens
tcacttgtaaggg

SEQ ID NO: 4392266 - DNA, 14 bp, Homo sapiens
tcactttactttca

SEQ ID NO: 4392267 - DNA, 12 bp, Homo sapiens
tcactttcataa

SEQ ID NO: 4392268 - DNA, 20 bp, Homo sapiens
tcactttcttcaaagccaca

SEQ ID NO: 4392269 - DNA, 21 bp, Homo sapiens
tcacttttgttaacagtattt

SEQ ID NO: 4392270 - DNA, 14 bp, Homo sapiens
tcactttttctgat

SEQ ID NO: 4392271 - DNA, 16 bp, Homo sapiens
tcactttttctgataa

SEQ ID NO: 4392272 - DNA, 18 bp, Homo sapiens
tcactttttttctttttc

SEQ ID NO: 4392273 - DNA, 18 bp, Homo sapiens
tcactttttttttttgtt

SEQ ID NO: 4392274 - DNA, 21 bp, Homo sapiens
tcagaaaacagggtccaggaa

SEQ ID NO: 4392275 - DNA, 13 bp, Homo sapiens
tcagaaaacataa

SEQ ID NO: 4392276 - DNA, 15 bp, Homo sapiens
tcagaaaatgttctg

SEQ ID NO: 4392277 - DNA, 18 bp, Homo sapiens
tcagaaaatgttctgttt

SEQ ID NO: 4392278 - DNA, 19 bp, Homo sapiens
tcagaaaatgttctgtttg

SEQ ID NO: 4392279 - DNA, 20 bp, Homo sapiens
tcagaaaccctcattgtgtt

SEQ ID NO: 4392280 - DNA, 21 bp, Homo sapiens
tcagaaaccctcattgtgttt

SEQ ID NO: 4392281 - DNA, 16 bp, Homo sapiens
tcagaaacttgtgaag

SEQ ID NO: 4392282 - DNA, 20 bp, Homo sapiens
tcagaaagaaaaaattttat

SEQ ID NO: 4392283 - DNA, 14 bp, Homo sapiens
tcagaaagagcaag

SEQ ID NO: 4392284 - DNA, 20 bp, Homo sapiens
tcagaaaggaaaaacaaact

SEQ ID NO: 4392285 - DNA, 16 bp, Homo sapiens
tcagaaatagctcctc

SEQ ID NO: 4392286 - DNA, 16 bp, Homo sapiens
tcagaaatcctctgtt

SEQ ID NO: 4392287 - DNA, 21 bp, Homo sapiens
tcagaaatcctctgttaatgt

SEQ ID NO: 4392288 - DNA, 22 bp, Homo sapiens
tcagaaatcctctgttaatgtg

SEQ ID NO: 4392289 - DNA, 19 bp, Homo sapiens
tcagaacacgataaaccat

SEQ ID NO: 4392290 - DNA, 16 bp, Homo sapiens
tcagaaccatttcacc

SEQ ID NO: 4392291 - DNA, 21 bp, Homo sapiens
tcagaaccctgccatggaact

SEQ ID NO: 4392292 - DNA, 16 bp, Homo sapiens
tcagaacctcttcccc

SEQ ID NO: 4392293 - DNA, 17 bp, Homo sapiens
tcagaacctcttcccca

SEQ ID NO: 4392294 - DNA, 18 bp, Homo sapiens
tcagaacctcttccccag

SEQ ID NO: 4392295 - DNA, 18 bp, Homo sapiens
tcagaactaaatttttca

SEQ ID NO: 4392296 - DNA, 14 bp, Homo sapiens
tcagaactaacttt

SEQ ID NO: 4392297 - DNA, 12 bp, Homo sapiens
tcagaactgccc

SEQ ID NO: 4392298 - DNA, 16 bp, Homo sapiens
tcagaagaaaaagaag

SEQ ID NO: 4392299 - DNA, 14 bp, Homo sapiens
tcagaagaaataaa

SEQ ID NO: 4392300 - DNA, 16 bp, Homo sapiens
tcagaagaaataaata

SEQ ID NO: 4392301 - DNA, 13 bp, Homo sapiens
tcagaagatagtc

SEQ ID NO: 4392302 - DNA, 19 bp, Homo sapiens
tcagaagcaagccagacct

SEQ ID NO: 4392303 - DNA, 20 bp, Homo sapiens
tcagaagcacagaatatttt

SEQ ID NO: 4392304 - DNA, 17 bp, Homo sapiens
tcagaaggacggcagga

SEQ ID NO: 4392305 - DNA, 18 bp, Homo sapiens
tcagaaggacggcaggag

SEQ ID NO: 4392306 - DNA, 20 bp, Homo sapiens
tcagaaggacggcaggagtg

SEQ ID NO: 4392307 - DNA, 12 bp, Homo sapiens
tcagaaggagaa

SEQ ID NO: 4392308 - DNA, 23 bp, Homo sapiens
tcagaaggagaaggaaggagact

SEQ ID NO: 4392309 - DNA, 15 bp, Homo sapiens
tcagaaggccccaga

SEQ ID NO: 4392310 - DNA, 18 bp, Homo sapiens
tcagaagtctagttttat

SEQ ID NO: 4392311 - DNA, 22 bp, Homo sapiens
tcagaagttgtgctaaaccaag

SEQ ID NO: 4392312 - DNA, 16 bp, Homo sapiens
tcagaagtttcctgga

SEQ ID NO: 4392313 - DNA, 18 bp, Homo sapiens
tcagaataaaaatgtggt

SEQ ID NO: 4392314 - DNA, 22 bp, Homo sapiens
tcagaataaagttgtatttcaa

SEQ ID NO: 4392315 - DNA, 14 bp, Homo sapiens
tcagaatgtcattt

SEQ ID NO: 4392316 - DNA, 19 bp, Homo sapiens
tcagaattcggtgtgctgc

SEQ ID NO: 4392317 - DNA, 22 bp, Homo sapiens
tcagaattggcataatttgtct

SEQ ID NO: 4392318 - DNA, 21 bp, Homo sapiens
tcagaatttagtgtatccata

SEQ ID NO: 4392319 - DNA, 17 bp, Homo sapiens
tcagacacatttttgga

SEQ ID NO: 4392320 - DNA, 13 bp, Homo sapiens
tcagacaccaagg

SEQ ID NO: 4392321 - DNA, 20 bp, Homo sapiens
tcagacactaaatgcagaca

SEQ ID NO: 4392322 - DNA, 22 bp, Homo sapiens
tcagacatagaattaacacatg

SEQ ID NO: 4392323 - DNA, 19 bp, Homo sapiens
tcagacatctgaggtttta

SEQ ID NO: 4392324 - DNA, 22 bp, Homo sapiens
tcagacatctgaggttttattt

SEQ ID NO: 4392325 - DNA, 14 bp, Homo sapiens
tcagacccaggagt

SEQ ID NO: 4392326 - DNA, 15 bp, Homo sapiens
tcagacccaggagtc

SEQ ID NO: 4392327 - DNA, 17 bp, Homo sapiens
tcagacccaggagtcca

SEQ ID NO: 4392328 - DNA, 21 bp, Homo sapiens
tcagacccaggggtccaggcc

SEQ ID NO: 4392329 - DNA, 22 bp, Homo sapiens
tcagacccaggggtccaggccc

SEQ ID NO: 4392330 - DNA, 13 bp, Homo sapiens
tcagaccccagcg

SEQ ID NO: 4392331 - DNA, 17 bp, Homo sapiens
tcagaccccagcggctg

SEQ ID NO: 4392332 - DNA, 14 bp, Homo sapiens
tcagacccccactc

SEQ ID NO: 4392333 - DNA, 22 bp, Homo sapiens
tcagacccccactctcattccc

SEQ ID NO: 4392334 - DNA, 18 bp, Homo sapiens
tcagacccctcagcccca

SEQ ID NO: 4392335 - DNA, 16 bp, Homo sapiens
tcagacccctgcctgg

SEQ ID NO: 4392336 - DNA, 18 bp, Homo sapiens
tcagacccctttgagaga

SEQ ID NO: 4392337 - DNA, 16 bp, Homo sapiens
tcagaccctaccccac

SEQ ID NO: 4392338 - DNA, 14 bp, Homo sapiens
tcagaccctgctta

SEQ ID NO: 4392339 - DNA, 21 bp, Homo sapiens
tcagacgtctagatgggttct

SEQ ID NO: 4392340 - DNA, 18 bp, Homo sapiens
tcagacgttgcctgagaa

SEQ ID NO: 4392341 - DNA, 22 bp, Homo sapiens
tcagactagccactcctgccag

SEQ ID NO: 4392342 - DNA, 21 bp, Homo sapiens
tcagactcagaggtccaggcc

SEQ ID NO: 4392343 - DNA, 17 bp, Homo sapiens
tcagactctagaaaaaa

SEQ ID NO: 4392344 - DNA, 20 bp, Homo sapiens
tcagactctcagcccagaag

SEQ ID NO: 4392345 - DNA, 23 bp, Homo sapiens
tcagacttccaaatcctggaagg

SEQ ID NO: 4392346 - DNA, 18 bp, Homo sapiens
tcaaagtggtaaatactg

SEQ ID NO: 4392347 - DNA, 14 bp, Homo sapiens
tcaaagtttaataa

SEQ ID NO: 4392348 - DNA, 17 bp, Homo sapiens
tcaaagtttatatgcct

SEQ ID NO: 4392349 - DNA, 20 bp, Homo sapiens
tcaaataaaaattctagatt

SEQ ID NO: 4392350 - DNA, 11 bp, Homo sapiens
tcaaataaaca

SEQ ID NO: 4392351 - DNA, 20 bp, Homo sapiens
tcaaataatgcttttctaat

SEQ ID NO: 4392352 - DNA, 13 bp, Homo sapiens
tcaaatacatgca

SEQ ID NO: 4392353 - DNA, 15 bp, Homo sapiens
tcaaatagttgcata

SEQ ID NO: 4392354 - DNA, 16 bp, Homo sapiens
tcaaatatgcaaagca

SEQ ID NO: 4392355 - DNA, 18 bp, Homo sapiens
tcaaatatgcaaagcact

SEQ ID NO: 4392356 - DNA, 19 bp, Homo sapiens
tcaaatatgcaaagcactg

SEQ ID NO: 4392357 - DNA, 13 bp, Homo sapiens
tcaaatccctttt

SEQ ID NO: 4392358 - DNA, 15 bp, Homo sapiens
tcaaatctaccactg

SEQ ID NO: 4392359 - DNA, 20 bp, Homo sapiens
tcaaatctaccactgtatga

SEQ ID NO: 4392360 - DNA, 21 bp, Homo sapiens
tcaaatgaaacagggaaaatg

SEQ ID NO: 4392361 - DNA, 20 bp, Homo sapiens
tcaaatgaaatgtatgcatt

SEQ ID NO: 4392362 - DNA, 16 bp, Homo sapiens
tcaaatgaaggtggtt

SEQ ID NO: 4392363 - DNA, 23 bp, Homo sapiens
tcaaatgaatggaggaactttcc

SEQ ID NO: 4392364 - DNA, 16 bp, Homo sapiens
tcaaatgatcctccca

SEQ ID NO: 4392365 - DNA, 19 bp, Homo sapiens
tcaaatgatcctcccacct

SEQ ID NO: 4392366 - DNA, 15 bp, Homo sapiens
tcaaatgatttcata

SEQ ID NO: 4392367 - DNA, 16 bp, Homo sapiens
tcaaatgatttcatat

SEQ ID NO: 4392368 - DNA, 12 bp, Homo sapiens
tcaaatgtttta

SEQ ID NO: 4392369 - DNA, 15 bp, Homo sapiens
tcaaattaagattct

SEQ ID NO: 4392370 - DNA, 20 bp, Homo sapiens
tcaaattaagattctctgcc

SEQ ID NO: 4392371 - DNA, 17 bp, Homo sapiens
tcaaattattaatctga

SEQ ID NO: 4392372 - DNA, 20 bp, Homo sapiens
tcaaattattaatctgaaaa

SEQ ID NO: 4392373 - DNA, 13 bp, Homo sapiens
tcaaattcaaata

SEQ ID NO: 4392374 - DNA, 22 bp, Homo sapiens
tcaaattcaataatcttaaaca

SEQ ID NO: 4392375 - DNA, 14 bp, Homo sapiens
tcaaattcagctct

SEQ ID NO: 4392376 - DNA, 17 bp, Homo sapiens
tcaaattgctgcttgga

SEQ ID NO: 4392377 - DNA, 23 bp, Homo sapiens
tcaaattggctacaatcttggag

SEQ ID NO: 4392378 - DNA, 22 bp, Homo sapiens
tcaaattgtgcagtactttgtg

SEQ ID NO: 4392379 - DNA, 18 bp, Homo sapiens
tcaaatttgtaataaaac

SEQ ID NO: 4392380 - DNA, 21 bp, Homo sapiens
tcaaattttgtaccaagtaaa

SEQ ID NO: 4392381 - DNA, 20 bp, Homo sapiens
tcaaattttttaaaagagac

SEQ ID NO: 4392382 - DNA, 18 bp, Homo sapiens
tcaacaaaaattgtccct

SEQ ID NO: 4392383 - DNA, 16 bp, Homo sapiens
tcaatatttttatatc

SEQ ID NO: 4392384 - DNA, 20 bp, Homo sapiens
tcaatccaccttcaggcccc

SEQ ID NO: 4392385 - DNA, 15 bp, Homo sapiens
tcaatcccctcattc

SEQ ID NO: 4392386 - DNA, 17 bp, Homo sapiens
tcaatcccctcattcag

SEQ ID NO: 4392387 - DNA, 22 bp, Homo sapiens
tcaatcccctcattcaggaaaa

SEQ ID NO: 4392388 - DNA, 20 bp, Homo sapiens
tcaatcctccatttgctgta

SEQ ID NO: 4392389 - DNA, 20 bp, Homo sapiens
tcaatctggcttctgcatta

SEQ ID NO: 4392390 - DNA, 14 bp, Homo sapiens
tcaatctgtaaact

SEQ ID NO: 4392391 - DNA, 22 bp, Homo sapiens
tcaatctgtgaagcctttatct

SEQ ID NO: 4392392 - DNA, 13 bp, Homo sapiens
tcaatcttgttac

SEQ ID NO: 4392393 - DNA, 23 bp, Homo sapiens
tcaatgaatgaatgaatggctaa

SEQ ID NO: 4392394 - DNA, 21 bp, Homo sapiens
tcaatgaattttataatctgc

SEQ ID NO: 4392395 - DNA, 17 bp, Homo sapiens
tcaatgaggtgtccaac

SEQ ID NO: 4392396 - DNA, 18 bp, Homo sapiens
tcaatgccacgtgctgct

SEQ ID NO: 4392397 - DNA, 14 bp, Homo sapiens
tcaatggctttgta

SEQ ID NO: 4392398 - DNA, 16 bp, Homo sapiens
tcaatggttcaagtct

SEQ ID NO: 4392399 - DNA, 17 bp, Homo sapiens
tcaatggttcaagtctt

SEQ ID NO: 4392400 - DNA, 14 bp, Homo sapiens
tcaatgtacttgtt

SEQ ID NO: 4392401 - DNA, 17 bp, Homo sapiens
tcaatgtacttgtttga

SEQ ID NO: 4392402 - DNA, 20 bp, Homo sapiens
tcaatgtacttgtttgaata

SEQ ID NO: 4392403 - DNA, 19 bp, Homo sapiens
tcaatgtctaaaaacattt

SEQ ID NO: 4392404 - DNA, 15 bp, Homo sapiens
tcaatgtgaatcaga

SEQ ID NO: 4392405 - DNA, 17 bp, Homo sapiens
tcaatgtgtataaattg

SEQ ID NO: 4392406 - DNA, 22 bp, Homo sapiens
tcaatgtgtcatttccggctgc

SEQ ID NO: 4392407 - DNA, 16 bp, Homo sapiens
tcaatgtgtctttcta

SEQ ID NO: 4392408 - DNA, 17 bp, Homo sapiens
tcaatgtgtctttctaa

SEQ ID NO: 4392409 - DNA, 20 bp, Homo sapiens
tcaatgtgtctttctaagaa

SEQ ID NO: 4392410 - DNA, 16 bp, Homo sapiens
tcaattactggtccaa

SEQ ID NO: 4392411 - DNA, 15 bp, Homo sapiens
tcaattatttgcata

SEQ ID NO: 4392412 - DNA, 16 bp, Homo sapiens
tcaattgcatctccca

SEQ ID NO: 4392413 - DNA, 18 bp, Homo sapiens
tcaattgcatctcccaga

SEQ ID NO: 4392414 - DNA, 17 bp, Homo sapiens
tcaattgtcacttttta

SEQ ID NO: 4392415 - DNA, 18 bp, Homo sapiens
tcaatttcaaacttttga

SEQ ID NO: 4392416 - DNA, 20 bp, Homo sapiens
tcaatttcaaacttttgaaa

SEQ ID NO: 4392417 - DNA, 18 bp, Homo sapiens
tcaatttcatgtttcttg

SEQ ID NO: 4392418 - DNA, 19 bp, Homo sapiens
tcaatttctcccaaggcca

SEQ ID NO: 4392419 - DNA, 21 bp, Homo sapiens
tcacaaaaaaatgttcattgt

SEQ ID NO: 4392420 - DNA, 20 bp, Homo sapiens
tcacaaaaaggcaaatattg

SEQ ID NO: 4392421 - DNA, 20 bp, Homo sapiens
tcacaaactgatctaaaatg

SEQ ID NO: 4392422 - DNA, 18 bp, Homo sapiens
tcacaaactgtgaaaata

SEQ ID NO: 4392423 - DNA, 20 bp, Homo sapiens
tcacaaactgtgaaaatagt

SEQ ID NO: 4392424 - DNA, 20 bp, Homo sapiens
tcacaaaggctgacattcac

SEQ ID NO: 4392425 - DNA, 21 bp, Homo sapiens
tcacaacagattattacctta

SEQ ID NO: 4392426 - DNA, 22 bp, Homo sapiens
tcacaacagcctgacaacattt

SEQ ID NO: 4392427 - DNA, 17 bp, Homo sapiens
tcacaagacccaaaagg

SEQ ID NO: 4392428 - DNA, 18 bp, Homo sapiens
tcacaagacccaaaaggc

SEQ ID NO: 4392429 - DNA, 20 bp, Homo sapiens
tcacaagcaacagactctca

SEQ ID NO: 4392430 - DNA, 23 bp, Homo sapiens
tcacaagcctcctgtacctcagt

SEQ ID NO: 4392431 - DNA, 18 bp, Homo sapiens
tcacaagttctatttctt

SEQ ID NO: 4392432 - DNA, 19 bp, Homo sapiens
tcacaatgttctggcacta

SEQ ID NO: 4392433 - DNA, 15 bp, Homo sapiens
tcacacaatatagtt

SEQ ID NO: 4392434 - DNA, 19 bp, Homo sapiens
tcacacagccaggtgcctt

SEQ ID NO: 4392435 - DNA, 20 bp, Homo sapiens
tcacacagccaggtgccttg

SEQ ID NO: 4392436 - DNA, 22 bp, Homo sapiens
tcacacagccaggtgccttgga

SEQ ID NO: 4392437 - DNA, 11 bp, Homo sapiens
tcacacagtgt

SEQ ID NO: 4392438 - DNA, 12 bp, Homo sapiens
tcacacagtgtt

SEQ ID NO: 4392439 - DNA, 15 bp, Homo sapiens
tcacacatcctgtca

SEQ ID NO: 4392440 - DNA, 22 bp, Homo sapiens
tcacacccaacttggttttgct

SEQ ID NO: 4392441 - DNA, 16 bp, Homo sapiens
tcacacccatttaaaa

SEQ ID NO: 4392442 - DNA, 22 bp, Homo sapiens
tcacacctcactctttatagtg

SEQ ID NO: 4392443 - DNA, 15 bp, Homo sapiens
tcacactcaaggaca

SEQ ID NO: 4392444 - DNA, 11 bp, Homo sapiens
tcacactgaga

SEQ ID NO: 4392445 - DNA, 20 bp, Homo sapiens
tcacactgagaatgtaagaa

SEQ ID NO: 4392446 - DNA, 23 bp, Homo sapiens
tcacactgagaatgtaagaacta

SEQ ID NO: 4392447 - DNA, 24 bp, Homo sapiens
tcacactggatccatcttgagcca

SEQ ID NO: 4392448 - DNA, 16 bp, Homo sapiens
tcacactgggtggtgg

SEQ ID NO: 4392449 - DNA, 18 bp, Homo sapiens
tcacacttatattttatg

SEQ ID NO: 4392450 - DNA, 16 bp, Homo sapiens
tcacagaaaatttaac

SEQ ID NO: 4392451 - DNA, 12 bp, Homo sapiens
tcacagaagaat

SEQ ID NO: 4392452 - DNA, 17 bp, Homo sapiens
tcacagacttctggcct

SEQ ID NO: 4392453 - DNA, 13 bp, Homo sapiens
tcacagagtgaga

SEQ ID NO: 4392454 - DNA, 23 bp, Homo sapiens
tcacagccagactggcacagttt

SEQ ID NO: 4392455 - DNA, 13 bp, Homo sapiens
tcacagcctcctc

SEQ ID NO: 4392456 - DNA, 23 bp, Homo sapiens
tcacaggcatattccctgcacac

SEQ ID NO: 4392457 - DNA, 19 bp, Homo sapiens
tcacagggttgggcccaga

SEQ ID NO: 4392458 - DNA, 16 bp, Homo sapiens
tcacaggtagcctatt

SEQ ID NO: 4392459 - DNA, 20 bp, Homo sapiens
tcacaggttttatgtgttct

SEQ ID NO: 4392460 - DNA, 21 bp, Homo sapiens
tcacaggttttatgtgttctt

SEQ ID NO: 4392461 - DNA, 18 bp, Homo sapiens
tcacagtaaaaataaaat

SEQ ID NO: 4392462 - DNA, 22 bp, Homo sapiens
tcacagtaaagagtacactcag

SEQ ID NO: 4392463 - DNA, 14 bp, Homo sapiens
tcacagtcaatgga

SEQ ID NO: 4392464 - DNA, 17 bp, Homo sapiens
tcacagtcccactgtgc

SEQ ID NO: 4392465 - DNA, 18 bp, Homo sapiens
tcacagtcccactgtgca

SEQ ID NO: 4392466 - DNA, 14 bp, Homo sapiens
tcacagttcctcgc

SEQ ID NO: 4392467 - DNA, 14 bp, Homo sapiens
tcacataaaagtct

SEQ ID NO: 4392468 - DNA, 22 bp, Homo sapiens
tattttattgaatactgtctgt

SEQ ID NO: 4392469 - DNA, 16 bp, Homo sapiens
tattttatttcaatgt

SEQ ID NO: 4392470 - DNA, 13 bp, Homo sapiens
tattttcaagttt

SEQ ID NO: 4392471 - DNA, 14 bp, Homo sapiens
tattttcaagtttt

SEQ ID NO: 4392472 - DNA, 19 bp, Homo sapiens
tattttcaagtttttcata

SEQ ID NO: 4392473 - DNA, 20 bp, Homo sapiens
tattttcaagtttttcatac

SEQ ID NO: 4392474 - DNA, 13 bp, Homo sapiens
tattttcagaatc

SEQ ID NO: 4392475 - DNA, 22 bp, Homo sapiens
tattttcagaatctgaatgtaa

SEQ ID NO: 4392476 - DNA, 18 bp, Homo sapiens
tattttcagtaatgttat

SEQ ID NO: 4392477 - DNA, 19 bp, Homo sapiens
tattttcagtcaaaacttt

SEQ ID NO: 4392478 - DNA, 21 bp, Homo sapiens
tattttcagtcaaaactttaa

SEQ ID NO: 4392479 - DNA, 11 bp, Homo sapiens
tattttcatag

SEQ ID NO: 4392480 - DNA, 12 bp, Homo sapiens
tattttcatagt

SEQ ID NO: 4392481 - DNA, 13 bp, Homo sapiens
tattttcatagtg

SEQ ID NO: 4392482 - DNA, 18 bp, Homo sapiens
tattttcatgtggtacta

SEQ ID NO: 4392483 - DNA, 20 bp, Homo sapiens
tattttccagccttatgtgt

SEQ ID NO: 4392484 - DNA, 18 bp, Homo sapiens
tattttcccaatagcact

SEQ ID NO: 4392485 - DNA, 20 bp, Homo sapiens
tattttccctacttgcagcg

SEQ ID NO: 4392486 - DNA, 14 bp, Homo sapiens
tattttctacagtg

SEQ ID NO: 4392487 - DNA, 14 bp, Homo sapiens
tattttctatttta

SEQ ID NO: 4392488 - DNA, 20 bp, Homo sapiens
tattttctctgtacttttca

SEQ ID NO: 4392489 - DNA, 21 bp, Homo sapiens
tattttctgtgcctgaatatt

SEQ ID NO: 4392490 - DNA, 12 bp, Homo sapiens
tattttctttct

SEQ ID NO: 4392491 - DNA, 14 bp, Homo sapiens
tattttctttctag

SEQ ID NO: 4392492 - DNA, 22 bp, Homo sapiens
tattttctttctagtttgttta

SEQ ID NO: 4392493 - DNA, 12 bp, Homo sapiens
tattttgaatca

SEQ ID NO: 4392494 - DNA, 14 bp, Homo sapiens
tattttgagcatta

SEQ ID NO: 4392495 - DNA, 15 bp, Homo sapiens
tattttgataataat

SEQ ID NO: 4392496 - DNA, 18 bp, Homo sapiens
tattttgataataatatt

SEQ ID NO: 4392497 - DNA, 23 bp, Homo sapiens
tattttgatgcagcatttgataa

SEQ ID NO: 4392498 - DNA, 13 bp, Homo sapiens
tattttgcaaaca

SEQ ID NO: 4392499 - DNA, 22 bp, Homo sapiens
tattttgcaaacactgtgatta

SEQ ID NO: 4392500 - DNA, 21 bp, Homo sapiens
tattttgcactctgtaattgc

SEQ ID NO: 4392501 - DNA, 22 bp, Homo sapiens
tattttggagtgtaggtgactt

SEQ ID NO: 4392502 - DNA, 16 bp, Homo sapiens
tattttgtaaaatgta

SEQ ID NO: 4392503 - DNA, 19 bp, Homo sapiens
tattttgtaaaatgtatta

SEQ ID NO: 4392504 - DNA, 12 bp, Homo sapiens
tattttgtaata

SEQ ID NO: 4392505 - DNA, 18 bp, Homo sapiens
tattttgtaatattctgt

SEQ ID NO: 4392506 - DNA, 16 bp, Homo sapiens
tattttgttgtgcact

SEQ ID NO: 4392507 - DNA, 12 bp, Homo sapiens
tatttttacagc

SEQ ID NO: 4392508 - DNA, 20 bp, Homo sapiens
tatttttagatggttacact

SEQ ID NO: 4392509 - DNA, 16 bp, Homo sapiens
tatttttatatttcct

SEQ ID NO: 4392510 - DNA, 12 bp, Homo sapiens
tatttttatctt

SEQ ID NO: 4392511 - DNA, 14 bp, Homo sapiens
tatttttcctgtcc

SEQ ID NO: 4392512 - DNA, 20 bp, Homo sapiens
tatttttctacattattgct

SEQ ID NO: 4392513 - DNA, 18 bp, Homo sapiens
tatttttctcttgtacca

SEQ ID NO: 4392514 - DNA, 15 bp, Homo sapiens
tatttttctctttgt

SEQ ID NO: 4392515 - DNA, 12 bp, Homo sapiens
tatttttcttga

SEQ ID NO: 4392516 - DNA, 16 bp, Homo sapiens
tatttttgctgcttct

SEQ ID NO: 4392517 - DNA, 20 bp, Homo sapiens
tatttttggcagtctgaatt

SEQ ID NO: 4392518 - DNA, 19 bp, Homo sapiens
tattttttatatctggaat

SEQ ID NO: 4392519 - DNA, 11 bp, Homo sapiens
tattttttcct

SEQ ID NO: 4392520 - DNA, 14 bp, Homo sapiens
tattttttcctttt

SEQ ID NO: 4392521 - DNA, 20 bp, Homo sapiens
tattttttgctctaatctct

SEQ ID NO: 4392522 - DNA, 17 bp, Homo sapiens
tatttttttaaaatcac

SEQ ID NO: 4392523 - DNA, 22 bp, Homo sapiens
tatttttttaaacaaaatttca

SEQ ID NO: 4392524 - DNA, 17 bp, Homo sapiens
tatttttttaaatcaag

SEQ ID NO: 4392525 - DNA, 21 bp, Homo sapiens
tatttttttaaatcaaggaaa

SEQ ID NO: 4392526 - DNA, 21 bp, Homo sapiens
tatttttttaactttaccatg

SEQ ID NO: 4392527 - DNA, 16 bp, Homo sapiens
tatttttttttctaag

SEQ ID NO: 4392528 - DNA, 18 bp, Homo sapiens
tcaaaaaaaagaaaatgt

SEQ ID NO: 4392529 - DNA, 16 bp, Homo sapiens
tcaaaaaacctttaca

SEQ ID NO: 4392530 - DNA, 20 bp, Homo sapiens
tcaaaaaactctctcccagg

SEQ ID NO: 4392531 - DNA, 13 bp, Homo sapiens
tcaaaaactgcct

SEQ ID NO: 4392532 - DNA, 12 bp, Homo sapiens
tcaaaaagaacc

SEQ ID NO: 4392533 - DNA, 18 bp, Homo sapiens
tcaaaaagctaatgtgca

SEQ ID NO: 4392534 - DNA, 20 bp, Homo sapiens
tcaaaaattatctatagcta

SEQ ID NO: 4392535 - DNA, 19 bp, Homo sapiens
tcaaaacacttccagtctg

SEQ ID NO: 4392536 - DNA, 21 bp, Homo sapiens
tcaaaacctggagatgcagct

SEQ ID NO: 4392537 - DNA, 17 bp, Homo sapiens
tcaaaacttctgctttt

SEQ ID NO: 4392538 - DNA, 22 bp, Homo sapiens
tcaaaagaaaattgatattttt

SEQ ID NO: 4392539 - DNA, 16 bp, Homo sapiens
tcaaaagataatattt

SEQ ID NO: 4392540 - DNA, 16 bp, Homo sapiens
tcaaaagatccttcat

SEQ ID NO: 4392541 - DNA, 20 bp, Homo sapiens
tcaaaagtggtctcaaaata

SEQ ID NO: 4392542 - DNA, 17 bp, Homo sapiens
tcaaaataaagaagtat

SEQ ID NO: 4392543 - DNA, 15 bp, Homo sapiens
tcaaaatacttcttt

SEQ ID NO: 4392544 - DNA, 14 bp, Homo sapiens
tcaaaatagaaaag

SEQ ID NO: 4392545 - DNA, 17 bp, Homo sapiens
tcaaaatagacaagttt

SEQ ID NO: 4392546 - DNA, 22 bp, Homo sapiens
tcaaaatatgtaagaacacatt

SEQ ID NO: 4392547 - DNA, 14 bp, Homo sapiens
tcaaaatattgagc

SEQ ID NO: 4392548 - DNA, 15 bp, Homo sapiens
tcaaaatatttaaaa

SEQ ID NO: 4392549 - DNA, 20 bp, Homo sapiens
tcaaaatatttaaaaatgtc

SEQ ID NO: 4392550 - DNA, 23 bp, Homo sapiens
tcaaaatatttaaaaatgtcttg

SEQ ID NO: 4392551 - DNA, 18 bp, Homo sapiens
tcaaaatgaacagcgaag

SEQ ID NO: 4392552 - DNA, 20 bp, Homo sapiens
tcaaaatgctctaatgagca

SEQ ID NO: 4392553 - DNA, 12 bp, Homo sapiens
tcaaaatgcttc

SEQ ID NO: 4392554 - DNA, 19 bp, Homo sapiens
tcaaaatgctttttatttc

SEQ ID NO: 4392555 - DNA, 13 bp, Homo sapiens
tcaaaattacata

SEQ ID NO: 4392556 - DNA, 15 bp, Homo sapiens
tcaaaattacatata

SEQ ID NO: 4392557 - DNA, 20 bp, Homo sapiens
tcaaacagtctcaggaaatc

SEQ ID NO: 4392558 - DNA, 18 bp, Homo sapiens
tcaaaccaagggtacaga

SEQ ID NO: 4392559 - DNA, 21 bp, Homo sapiens
tcaaaccaagggtacagatcc

SEQ ID NO: 4392560 - DNA, 14 bp, Homo sapiens
tcaaactcattgca

SEQ ID NO: 4392561 - DNA, 21 bp, Homo sapiens
tcaaactccaaggttcccttg

SEQ ID NO: 4392562 - DNA, 20 bp, Homo sapiens
tcaaactcctgacctcaggt

SEQ ID NO: 4392563 - DNA, 15 bp, Homo sapiens
tcaaactgaggaatt

SEQ ID NO: 4392564 - DNA, 15 bp, Homo sapiens
tcaaactgtaaaaat

SEQ ID NO: 4392565 - DNA, 14 bp, Homo sapiens
tcaaacttccagtc

SEQ ID NO: 4392566 - DNA, 16 bp, Homo sapiens
tcaaacttgtggcctc

SEQ ID NO: 4392567 - DNA, 12 bp, Homo sapiens
tcaaacttttga

SEQ ID NO: 4392568 - DNA, 16 bp, Homo sapiens
tcaaagaaagtgtatt

SEQ ID NO: 4392569 - DNA, 19 bp, Homo sapiens
tcaaagaagagtcaacatt

SEQ ID NO: 4392570 - DNA, 15 bp, Homo sapiens
tcaaagaaggtgctg

SEQ ID NO: 4392571 - DNA, 18 bp, Homo sapiens
tcaaagaaggtgctgatc

SEQ ID NO: 4392572 - DNA, 22 bp, Homo sapiens
tcaaagaaggtgctgatcctaa

SEQ ID NO: 4392573 - DNA, 18 bp, Homo sapiens
tcaaagaagtcggaatgt

SEQ ID NO: 4392574 - DNA, 14 bp, Homo sapiens
tcaaagactcaaat

SEQ ID NO: 4392575 - DNA, 17 bp, Homo sapiens
tcaaagactcaaatttt

SEQ ID NO: 4392576 - DNA, 14 bp, Homo sapiens
tcaaagagaagatg

SEQ ID NO: 4392577 - DNA, 16 bp, Homo sapiens
tcaaagagagttttta

SEQ ID NO: 4392578 - DNA, 18 bp, Homo sapiens
tcaaagaggtgaacatta

SEQ ID NO: 4392579 - DNA, 16 bp, Homo sapiens
tcaaagcaaggaaact

SEQ ID NO: 4392580 - DNA, 20 bp, Homo sapiens
tcaaagcaaggaaactatgt

SEQ ID NO: 4392581 - DNA, 12 bp, Homo sapiens
tcaaagcaattg

SEQ ID NO: 4392582 - DNA, 21 bp, Homo sapiens
tcaaagcaattgaaatgcatt

SEQ ID NO: 4392583 - DNA, 20 bp, Homo sapiens
tcaaagcatggacatttaga

SEQ ID NO: 4392584 - DNA, 22 bp, Homo sapiens
tcaaagccagcgtcctcctctg

SEQ ID NO: 4392585 - DNA, 19 bp, Homo sapiens
tcaaagctgtgtgtttgga

SEQ ID NO: 4392586 - DNA, 14 bp, Homo sapiens
tcaaaggacggaag

SEQ ID NO: 4392587 - DNA, 20 bp, Homo sapiens
tcaaagtctcaatgaaatag

SEQ ID NO: 4392588 - DNA, 17 bp, Homo sapiens
tcaaagtggtaaatact

SEQ ID NO: 4392589 - DNA, 18 bp, Homo sapiens
tatccagctagtgccaaa

SEQ ID NO: 4392590 - DNA, 19 bp, Homo sapiens
tatccagctagtgccaaat

SEQ ID NO: 4392591 - DNA, 14 bp, Homo sapiens
tatccataaaaaaa

SEQ ID NO: 4392592 - DNA, 13 bp, Homo sapiens
tatccccaaatta

SEQ ID NO: 4392593 - DNA, 13 bp, Homo sapiens
tatccccatctcc

SEQ ID NO: 4392594 - DNA, 14 bp, Homo sapiens
tatccctcccctct

SEQ ID NO: 4392595 - DNA, 16 bp, Homo sapiens
tatccctctcttcccc

SEQ ID NO: 4392596 - DNA, 22 bp, Homo sapiens
tatccctctcttccccttccct

SEQ ID NO: 4392597 - DNA, 19 bp, Homo sapiens
tatccctgcggcctccaca

SEQ ID NO: 4392598 - DNA, 19 bp, Homo sapiens
tatcccttggacattttat

SEQ ID NO: 4392599 - DNA, 14 bp, Homo sapiens
tatccgctgccagc

SEQ ID NO: 4392600 - DNA, 14 bp, Homo sapiens
tatcctaaacttta

SEQ ID NO: 4392601 - DNA, 12 bp, Homo sapiens
tatcctctgtaa

SEQ ID NO: 4392602 - DNA, 22 bp, Homo sapiens
tatcctgctgaaagtcctgctt

SEQ ID NO: 4392603 - DNA, 12 bp, Homo sapiens
tatcctgtattc

SEQ ID NO: 4392604 - DNA, 17 bp, Homo sapiens
tatcctgtattcttgtt

SEQ ID NO: 4392605 - DNA, 23 bp, Homo sapiens
tatcctgtgtacctcactgtcca

SEQ ID NO: 4392606 - DNA, 21 bp, Homo sapiens
tatccttataggcctgtccct

SEQ ID NO: 4392607 - DNA, 14 bp, Homo sapiens
tatccttcagcctg

SEQ ID NO: 4392608 - DNA, 12 bp, Homo sapiens
tatctaaagtta

SEQ ID NO: 4392609 - DNA, 21 bp, Homo sapiens
tatctaaatagtattttgtct

SEQ ID NO: 4392610 - DNA, 19 bp, Homo sapiens
tatctaacttcgaatatat

SEQ ID NO: 4392611 - DNA, 19 bp, Homo sapiens
tatctaagaataataaaat

SEQ ID NO: 4392612 - DNA, 13 bp, Homo sapiens
tatctaatgacat

SEQ ID NO: 4392613 - DNA, 19 bp, Homo sapiens
tatctagaactatcatttt

SEQ ID NO: 4392614 - DNA, 20 bp, Homo sapiens
tatctagaactatcattttt

SEQ ID NO: 4392615 - DNA, 16 bp, Homo sapiens
tatctataatttacct

SEQ ID NO: 4392616 - DNA, 15 bp, Homo sapiens
tatctatacctgcct

SEQ ID NO: 4392617 - DNA, 16 bp, Homo sapiens
tatctatacctgcctt

SEQ ID NO: 4392618 - DNA, 13 bp, Homo sapiens
tatctatataaaa

SEQ ID NO: 4392619 - DNA, 13 bp, Homo sapiens
tatctattagata

SEQ ID NO: 4392620 - DNA, 15 bp, Homo sapiens
tatctattgaaaata

SEQ ID NO: 4392621 - DNA, 14 bp, Homo sapiens
tatctatttgtaca

SEQ ID NO: 4392622 - DNA, 23 bp, Homo sapiens
tatctcacctaatggttgtacat

SEQ ID NO: 4392623 - DNA, 14 bp, Homo sapiens
tatctcactttgta

SEQ ID NO: 4392624 - DNA, 17 bp, Homo sapiens
tatctctatttgagaat

SEQ ID NO: 4392625 - DNA, 13 bp, Homo sapiens
tatctctctgtgc

SEQ ID NO: 4392626 - DNA, 18 bp, Homo sapiens
tatctctgagttctgtgt

SEQ ID NO: 4392627 - DNA, 15 bp, Homo sapiens
tatctcttggaaaat

SEQ ID NO: 4392628 - DNA, 13 bp, Homo sapiens
tatctctttctct

SEQ ID NO: 4392629 - DNA, 18 bp, Homo sapiens
tatctctttctctctttc

SEQ ID NO: 4392630 - DNA, 15 bp, Homo sapiens
tatctgaacatttac

SEQ ID NO: 4392631 - DNA, 20 bp, Homo sapiens
tatctgaatttttaaacaag

SEQ ID NO: 4392632 - DNA, 18 bp, Homo sapiens
tatctgacccactttgta

SEQ ID NO: 4392633 - DNA, 22 bp, Homo sapiens
tatctgacccactttgtaattt

SEQ ID NO: 4392634 - DNA, 13 bp, Homo sapiens
tatctgcatatgt

SEQ ID NO: 4392635 - DNA, 20 bp, Homo sapiens
tatctgcccctcccccactt

SEQ ID NO: 4392636 - DNA, 12 bp, Homo sapiens
tatctgccctcc

SEQ ID NO: 4392637 - DNA, 17 bp, Homo sapiens
tatctgctgtccagaca

SEQ ID NO: 4392638 - DNA, 16 bp, Homo sapiens
tatctggaatgagcct

SEQ ID NO: 4392639 - DNA, 18 bp, Homo sapiens
tatctggattcaaattta

SEQ ID NO: 4392640 - DNA, 18 bp, Homo sapiens
tatctgggctgtgggcaa

SEQ ID NO: 4392641 - DNA, 21 bp, Homo sapiens
tatctgggtaagaagaaagca

SEQ ID NO: 4392642 - DNA, 13 bp, Homo sapiens
tatctgtaatgat

SEQ ID NO: 4392643 - DNA, 15 bp, Homo sapiens
tatctgttgccttat

SEQ ID NO: 4392644 - DNA, 14 bp, Homo sapiens
tatcttaattgcaa

SEQ ID NO: 4392645 - DNA, 17 bp, Homo sapiens
tatcttataactgtttt

SEQ ID NO: 4392646 - DNA, 14 bp, Homo sapiens
tatcttcatgtaaa

SEQ ID NO: 4392647 - DNA, 19 bp, Homo sapiens
tatcttcccatttaacatt

SEQ ID NO: 4392648 - DNA, 20 bp, Homo sapiens
tatcttcccatttaacattg

SEQ ID NO: 4392649 - DNA, 22 bp, Homo sapiens
tatcttcccatttaacattgtt

SEQ ID NO: 4392650 - DNA, 23 bp, Homo sapiens
tatcttcccatttaacattgttt

SEQ ID NO: 4392651 - DNA, 20 bp, Homo sapiens
tatcttcgttagtaatctgt

SEQ ID NO: 4392652 - DNA, 13 bp, Homo sapiens
tatcttctggatt

SEQ ID NO: 4392653 - DNA, 19 bp, Homo sapiens
tatcttctttattattcct

SEQ ID NO: 4392654 - DNA, 14 bp, Homo sapiens
tatcttgtgcttct

SEQ ID NO: 4392655 - DNA, 15 bp, Homo sapiens
tatcttgtttacaat

SEQ ID NO: 4392656 - DNA, 16 bp, Homo sapiens
tatctttgattctcct

SEQ ID NO: 4392657 - DNA, 17 bp, Homo sapiens
tatctttgattctcctt

SEQ ID NO: 4392658 - DNA, 18 bp, Homo sapiens
tatctttgattctccttc

SEQ ID NO: 4392659 - DNA, 19 bp, Homo sapiens
tatctttgtattcttcatg

SEQ ID NO: 4392660 - DNA, 21 bp, Homo sapiens
tatctttgtattcttcatgaa

SEQ ID NO: 4392661 - DNA, 23 bp, Homo sapiens
tatgaaaaccgtaaagtgcctta

SEQ ID NO: 4392662 - DNA, 17 bp, Homo sapiens
tatgaaaatatagacat

SEQ ID NO: 4392663 - DNA, 17 bp, Homo sapiens
tatgaaaatgagccctg

SEQ ID NO: 4392664 - DNA, 21 bp, Homo sapiens
tatgaaagtagattcatgaaa

SEQ ID NO: 4392665 - DNA, 14 bp, Homo sapiens
tatgaaataagtaa

SEQ ID NO: 4392666 - DNA, 16 bp, Homo sapiens
tatgaaatatatgtga

SEQ ID NO: 4392667 - DNA, 21 bp, Homo sapiens
tatgaacatagactagagaaa

SEQ ID NO: 4392668 - DNA, 17 bp, Homo sapiens
tatgaacatattgttga

SEQ ID NO: 4392669 - DNA, 10 bp, Homo sapiens
tatgaacatc

SEQ ID NO: 4392670 - DNA, 13 bp, Homo sapiens
tatgaacattgta

SEQ ID NO: 4392671 - DNA, 15 bp, Homo sapiens
tatgaacattgtact

SEQ ID NO: 4392672 - DNA, 18 bp, Homo sapiens
tatgaacattgtactgtt

SEQ ID NO: 4392673 - DNA, 17 bp, Homo sapiens
tatgaagtttttaaaaa

SEQ ID NO: 4392674 - DNA, 21 bp, Homo sapiens
tatgaagtttttaaaaataaa

SEQ ID NO: 4392675 - DNA, 17 bp, Homo sapiens
tatgaataaagaatgcc

SEQ ID NO: 4392676 - DNA, 23 bp, Homo sapiens
tatgaatatgatccctaatgtgt

SEQ ID NO: 4392677 - DNA, 18 bp, Homo sapiens
tatgaattcaagaaagga

SEQ ID NO: 4392678 - DNA, 18 bp, Homo sapiens
tatgaattgaattatctt

SEQ ID NO: 4392679 - DNA, 21 bp, Homo sapiens
tatgacataagcaatcatttt

SEQ ID NO: 4392680 - DNA, 15 bp, Homo sapiens
tatgaccagaagcct

SEQ ID NO: 4392681 - DNA, 17 bp, Homo sapiens
tatgaccagaagccttg

SEQ ID NO: 4392682 - DNA, 22 bp, Homo sapiens
tatgacccacattactttttat

SEQ ID NO: 4392683 - DNA, 17 bp, Homo sapiens
tatgactatgtaaacta

SEQ ID NO: 4392684 - DNA, 22 bp, Homo sapiens
tatgagacagggtcttgctctg

SEQ ID NO: 4392685 - DNA, 16 bp, Homo sapiens
tatgagatactttgca

SEQ ID NO: 4392686 - DNA, 18 bp, Homo sapiens
tatgagatggccatgctc

SEQ ID NO: 4392687 - DNA, 21 bp, Homo sapiens
tatgagatggccatgctcaac

SEQ ID NO: 4392688 - DNA, 14 bp, Homo sapiens
tatgagatttactg

SEQ ID NO: 4392689 - DNA, 12 bp, Homo sapiens
tatgagcttcaa

SEQ ID NO: 4392690 - DNA, 22 bp, Homo sapiens
tatgaggatataatgtgtgctt

SEQ ID NO: 4392691 - DNA, 16 bp, Homo sapiens
tatgagtgttttgaaa

SEQ ID NO: 4392692 - DNA, 20 bp, Homo sapiens
tatgatacaccattatgttt

SEQ ID NO: 4392693 - DNA, 22 bp, Homo sapiens
tatgatacaccattatgtttaa

SEQ ID NO: 4392694 - DNA, 20 bp, Homo sapiens
tatgatagcgggaaaaggag

SEQ ID NO: 4392695 - DNA, 14 bp, Homo sapiens
tatgatatgcatgt

SEQ ID NO: 4392696 - DNA, 19 bp, Homo sapiens
tatgatatttcttgctttc

SEQ ID NO: 4392697 - DNA, 15 bp, Homo sapiens
tatgatattttctgt

SEQ ID NO: 4392698 - DNA, 14 bp, Homo sapiens
tatgatgttaaaaa

SEQ ID NO: 4392699 - DNA, 22 bp, Homo sapiens
tatgattactggcctttttcat

SEQ ID NO: 4392700 - DNA, 13 bp, Homo sapiens
tatgattatacaa

SEQ ID NO: 4392701 - DNA, 20 bp, Homo sapiens
tatgcaaaaatgacccaaga

SEQ ID NO: 4392702 - DNA, 13 bp, Homo sapiens
tatgcaaagcact

SEQ ID NO: 4392703 - DNA, 15 bp, Homo sapiens
tatgcaaagcactga

SEQ ID NO: 4392704 - DNA, 20 bp, Homo sapiens
tatgcaaatggagataaaag

SEQ ID NO: 4392705 - DNA, 19 bp, Homo sapiens
tatgcaagcagctttttat

SEQ ID NO: 4392706 - DNA, 15 bp, Homo sapiens
tatgcacgaccttgg

SEQ ID NO: 4392707 - DNA, 15 bp, Homo sapiens
tatgcactaaatatg

SEQ ID NO: 4392708 - DNA, 21 bp, Homo sapiens
tatgcactgaagagctcttgg

SEQ ID NO: 4392709 - DNA, 19 bp, Homo sapiens
tatgcacttataattttcc

SEQ ID NO: 4392710 - DNA, 23 bp, Homo sapiens
tattctaatagtttttcactttg

SEQ ID NO: 4392711 - DNA, 14 bp, Homo sapiens
tattctacttttaa

SEQ ID NO: 4392712 - DNA, 17 bp, Homo sapiens
tattctatgtatgttaa

SEQ ID NO: 4392713 - DNA, 18 bp, Homo sapiens
tattctctgagctgtgca

SEQ ID NO: 4392714 - DNA, 15 bp, Homo sapiens
tattctctgcaattt

SEQ ID NO: 4392715 - DNA, 21 bp, Homo sapiens
tattctctgcaattttactgt

SEQ ID NO: 4392716 - DNA, 23 bp, Homo sapiens
tattctgaatcaccaattaaaaa

SEQ ID NO: 4392717 - DNA, 17 bp, Homo sapiens
tattctgacatgtaaga

SEQ ID NO: 4392718 - DNA, 19 bp, Homo sapiens
tattctgacatgtaagaaa

SEQ ID NO: 4392719 - DNA, 21 bp, Homo sapiens
tattctgaccgttaaaaaatt

SEQ ID NO: 4392720 - DNA, 22 bp, Homo sapiens
tattctgtcagtgttaaagatt

SEQ ID NO: 4392721 - DNA, 11 bp, Homo sapiens
tattctgttcc

SEQ ID NO: 4392722 - DNA, 16 bp, Homo sapiens
tattctgttttgttaa

SEQ ID NO: 4392723 - DNA, 15 bp, Homo sapiens
tattcttaaaatgca

SEQ ID NO: 4392724 - DNA, 17 bp, Homo sapiens
tattcttaaaatgcaat

SEQ ID NO: 4392725 - DNA, 15 bp, Homo sapiens
tattcttaataaaac

SEQ ID NO: 4392726 - DNA, 18 bp, Homo sapiens
tattcttcatgaaatgtg

SEQ ID NO: 4392727 - DNA, 17 bp, Homo sapiens
tattcttcttgaaaata

SEQ ID NO: 4392728 - DNA, 20 bp, Homo sapiens
tattcttgatttatttgctt

SEQ ID NO: 4392729 - DNA, 18 bp, Homo sapiens
tattcttgtcattttgaa

SEQ ID NO: 4392730 - DNA, 20 bp, Homo sapiens
tattgaaaattgaaaagtac

SEQ ID NO: 4392731 - DNA, 20 bp, Homo sapiens
tattgaaaggggacacctgt

SEQ ID NO: 4392732 - DNA, 22 bp, Homo sapiens
tattgaaaggggacacctgtac

SEQ ID NO: 4392733 - DNA, 23 bp, Homo sapiens
tattgaaaggggacacctgtaca

SEQ ID NO: 4392734 - DNA, 19 bp, Homo sapiens
tattgaacttttgtactga

SEQ ID NO: 4392735 - DNA, 16 bp, Homo sapiens
tattgaagttgtttat

SEQ ID NO: 4392736 - DNA, 22 bp, Homo sapiens
tattgaatactgtctgtatctt

SEQ ID NO: 4392737 - DNA, 17 bp, Homo sapiens
tattgaattagaaaatt

SEQ ID NO: 4392738 - DNA, 14 bp, Homo sapiens
tattgaatttgtgt

SEQ ID NO: 4392739 - DNA, 13 bp, Homo sapiens
tattgaatttttc

SEQ ID NO: 4392740 - DNA, 18 bp, Homo sapiens
tattgaatttttcctatg

SEQ ID NO: 4392741 - DNA, 16 bp, Homo sapiens
tattgacaacagtttt

SEQ ID NO: 4392742 - DNA, 19 bp, Homo sapiens
tattgacaataaaatatta

SEQ ID NO: 4392743 - DNA, 13 bp, Homo sapiens
tattgacacagaa

SEQ ID NO: 4392744 - DNA, 16 bp, Homo sapiens
tattgacacagaaaat

SEQ ID NO: 4392745 - DNA, 20 bp, Homo sapiens
tattgacacagaaaatgttg

SEQ ID NO: 4392746 - DNA, 23 bp, Homo sapiens
tattgacacagaaaatgttgaga

SEQ ID NO: 4392747 - DNA, 13 bp, Homo sapiens
tattgacactgaa

SEQ ID NO: 4392748 - DNA, 14 bp, Homo sapiens
tattgacactgaac

SEQ ID NO: 4392749 - DNA, 15 bp, Homo sapiens
tattgacaggtcttt

SEQ ID NO: 4392750 - DNA, 19 bp, Homo sapiens
tattgacaggtcttttcaa

SEQ ID NO: 4392751 - DNA, 19 bp, Homo sapiens
tattgagcaatatgtcagt

SEQ ID NO: 4392752 - DNA, 21 bp, Homo sapiens
tattgagttccagttgaagtt

SEQ ID NO: 4392753 - DNA, 21 bp, Homo sapiens
tattgagtttgtaggtaaaat

SEQ ID NO: 4392754 - DNA, 13 bp, Homo sapiens
tattgataaattt

SEQ ID NO: 4392755 - DNA, 21 bp, Homo sapiens
tattgataaattttaaaattg

SEQ ID NO: 4392756 - DNA, 21 bp, Homo sapiens
tattgatctttttatcatgat

SEQ ID NO: 4392757 - DNA, 14 bp, Homo sapiens
tattgatgttttca

SEQ ID NO: 4392758 - DNA, 13 bp, Homo sapiens
tattgatttgaaa

SEQ ID NO: 4392759 - DNA, 23 bp, Homo sapiens
tattgcaaatgagggaagaacat

SEQ ID NO: 4392760 - DNA, 15 bp, Homo sapiens
tattgcaactctttt

SEQ ID NO: 4392761 - DNA, 15 bp, Homo sapiens
tattgccccttctta

SEQ ID NO: 4392762 - DNA, 17 bp, Homo sapiens
tattgccttctcaccag

SEQ ID NO: 4392763 - DNA, 22 bp, Homo sapiens
tattgccttctcaccagctgca

SEQ ID NO: 4392764 - DNA, 21 bp, Homo sapiens
tattgctaaaagcatgtatag

SEQ ID NO: 4392765 - DNA, 22 bp, Homo sapiens
tattgctcgcccagacaccatg

SEQ ID NO: 4392766 - DNA, 20 bp, Homo sapiens
tattgctctatatgtaatat

SEQ ID NO: 4392767 - DNA, 13 bp, Homo sapiens
tattgctgctgcc

SEQ ID NO: 4392768 - DNA, 16 bp, Homo sapiens
tattgcttagtaaaat

SEQ ID NO: 4392769 - DNA, 17 bp, Homo sapiens
tattgcttagtaaaatt

SEQ ID NO: 4392770 - DNA, 21 bp, Homo sapiens
tattgcttattgcttagtaaa

SEQ ID NO: 4392771 - DNA, 21 bp, Homo sapiens
tattgcttcaatttcaaactt

SEQ ID NO: 4392772 - DNA, 23 bp, Homo sapiens
tattgcttcaatttcaaactttt

SEQ ID NO: 4392773 - DNA, 13 bp, Homo sapiens
tattgcttcttgt

SEQ ID NO: 4392774 - DNA, 21 bp, Homo sapiens
tattggaagctgctgaggccc

SEQ ID NO: 4392775 - DNA, 16 bp, Homo sapiens
tattggaatataattg

SEQ ID NO: 4392776 - DNA, 14 bp, Homo sapiens
tattgggcaggagg

SEQ ID NO: 4392777 - DNA, 20 bp, Homo sapiens
tattggggaattaaatagtg

SEQ ID NO: 4392778 - DNA, 22 bp, Homo sapiens
tattggggaccaaatcaaatga

SEQ ID NO: 4392779 - DNA, 20 bp, Homo sapiens
tattggtttaaagaaagtgt

SEQ ID NO: 4392780 - DNA, 18 bp, Homo sapiens
tattgtaaatgtggattt

SEQ ID NO: 4392781 - DNA, 11 bp, Homo sapiens
tattgtacaga

SEQ ID NO: 4392782 - DNA, 12 bp, Homo sapiens
tattgtacagtt

SEQ ID NO: 4392783 - DNA, 15 bp, Homo sapiens
tattgtacagttttt

SEQ ID NO: 4392784 - DNA, 17 bp, Homo sapiens
tattgtacagtttttat

SEQ ID NO: 4392785 - DNA, 16 bp, Homo sapiens
tattgtagtaaactat

SEQ ID NO: 4392786 - DNA, 15 bp, Homo sapiens
tattgtagtttgaaa

SEQ ID NO: 4392787 - DNA, 16 bp, Homo sapiens
tattgtatattacaat

SEQ ID NO: 4392788 - DNA, 16 bp, Homo sapiens
tattgtattaagggca

SEQ ID NO: 4392789 - DNA, 11 bp, Homo sapiens
tattgtcatct

SEQ ID NO: 4392790 - DNA, 20 bp, Homo sapiens
tattgtcatctttttctaga

SEQ ID NO: 4392791 - DNA, 15 bp, Homo sapiens
tattgtccattgtcc

SEQ ID NO: 4392792 - DNA, 16 bp, Homo sapiens
tattgtctgtaaatct

SEQ ID NO: 4392793 - DNA, 19 bp, Homo sapiens
tattgtctgtctacatttc

SEQ ID NO: 4392794 - DNA, 13 bp, Homo sapiens
tattgtgaatatt

SEQ ID NO: 4392795 - DNA, 18 bp, Homo sapiens
tattgtgacttcactgta

SEQ ID NO: 4392796 - DNA, 19 bp, Homo sapiens
tattgtgcaatgtaaatat

SEQ ID NO: 4392797 - DNA, 22 bp, Homo sapiens
tattgtgtggtctggttcctgt

SEQ ID NO: 4392798 - DNA, 17 bp, Homo sapiens
tattgtgttgactttat

SEQ ID NO: 4392799 - DNA, 22 bp, Homo sapiens
tattgtgttgactttataaatt

SEQ ID NO: 4392800 - DNA, 14 bp, Homo sapiens
tattgtgttgcaaa

SEQ ID NO: 4392801 - DNA, 18 bp, Homo sapiens
tattgttactcttacgaa

SEQ ID NO: 4392802 - DNA, 16 bp, Homo sapiens
tattgttagaaaatga

SEQ ID NO: 4392803 - DNA, 17 bp, Homo sapiens
tattgtttaaaatcatt

SEQ ID NO: 4392804 - DNA, 20 bp, Homo sapiens
tattgtttaaaatcatttct

SEQ ID NO: 4392805 - DNA, 18 bp, Homo sapiens
tattgtttcaattgcatc

SEQ ID NO: 4392806 - DNA, 12 bp, Homo sapiens
tattgtttctgc

SEQ ID NO: 4392807 - DNA, 17 bp, Homo sapiens
tattgtttgatgttttt

SEQ ID NO: 4392808 - DNA, 16 bp, Homo sapiens
tattgtttgctgttgg

SEQ ID NO: 4392809 - DNA, 15 bp, Homo sapiens
tattgttttacaata

SEQ ID NO: 4392810 - DNA, 19 bp, Homo sapiens
tattgtttttattctgtat

SEQ ID NO: 4392811 - DNA, 18 bp, Homo sapiens
tattgtttttatttctag

SEQ ID NO: 4392812 - DNA, 21 bp, Homo sapiens
tatttaaaaaattaaaaatga

SEQ ID NO: 4392813 - DNA, 19 bp, Homo sapiens
tatttaaaaaattatggaa

SEQ ID NO: 4392814 - DNA, 20 bp, Homo sapiens
tatttaaaaaattatggaat

SEQ ID NO: 4392815 - DNA, 13 bp, Homo sapiens
tatttaaaaataa

SEQ ID NO: 4392816 - DNA, 17 bp, Homo sapiens
tatttaaaaataagtca

SEQ ID NO: 4392817 - DNA, 12 bp, Homo sapiens
tatttaaaaatg

SEQ ID NO: 4392818 - DNA, 16 bp, Homo sapiens
tatttaaaaatgtctt

SEQ ID NO: 4392819 - DNA, 12 bp, Homo sapiens
tatttaaagttg

SEQ ID NO: 4392820 - DNA, 22 bp, Homo sapiens
tatttaaatagataaccaattt

SEQ ID NO: 4392821 - DNA, 14 bp, Homo sapiens
tatttaaattattt

SEQ ID NO: 4392822 - DNA, 17 bp, Homo sapiens
tatttaacaaaaaatgt

SEQ ID NO: 4392823 - DNA, 16 bp, Homo sapiens
tatttaacaagatgtt

SEQ ID NO: 4392824 - DNA, 16 bp, Homo sapiens
tatttaacagaaattg

SEQ ID NO: 4392825 - DNA, 16 bp, Homo sapiens
tatttaactctcttta

SEQ ID NO: 4392826 - DNA, 14 bp, Homo sapiens
tatttaactgatta

SEQ ID NO: 4392827 - DNA, 21 bp, Homo sapiens
tatttaactgattaaaaatac

SEQ ID NO: 4392828 - DNA, 23 bp, Homo sapiens
tatttaactggtgcactttgtaa

SEQ ID NO: 4392829 - DNA, 18 bp, Homo sapiens
tatttaagatgtacattt

SEQ ID NO: 4392830 - DNA, 19 bp, Homo sapiens
tatttaagatgtacattta

SEQ ID NO: 4392831 - DNA, 21 bp, Homo sapiens
tatttaagatgtacatttaat

SEQ ID NO: 4392832 - DNA, 22 bp, Homo sapiens
tatttaagatgtacatttaata

SEQ ID NO: 4392833 - DNA, 16 bp, Homo sapiens
tatttaagcaaatact

SEQ ID NO: 4392834 - DNA, 13 bp, Homo sapiens
tatttaagcttta

SEQ ID NO: 4392835 - DNA, 12 bp, Homo sapiens
tatttaagtagt

SEQ ID NO: 4392836 - DNA, 23 bp, Homo sapiens
tatttaagtagtgggcatttcat

SEQ ID NO: 4392837 - DNA, 13 bp, Homo sapiens
tatttaatagcaa

SEQ ID NO: 4392838 - DNA, 14 bp, Homo sapiens
tatttaatatttaa

SEQ ID NO: 4392839 - DNA, 17 bp, Homo sapiens
tatttaatggaagtgta

SEQ ID NO: 4392840 - DNA, 13 bp, Homo sapiens
tatttaatgtttt

SEQ ID NO: 4392841 - DNA, 20 bp, Homo sapiens
tatttaatgttttaaatgta

SEQ ID NO: 4392842 - DNA, 18 bp, Homo sapiens
tatttaattgtaaactgt

SEQ ID NO: 4392843 - DNA, 20 bp, Homo sapiens
tatttaattgtaaactgtac

SEQ ID NO: 4392844 - DNA, 20 bp, Homo sapiens
tatttaattttttactttca

SEQ ID NO: 4392845 - DNA, 11 bp, Homo sapiens
tatttacaaga

SEQ ID NO: 4392846 - DNA, 16 bp, Homo sapiens
tatttacaagaagaac

SEQ ID NO: 4392847 - DNA, 17 bp, Homo sapiens
tatttacccctccccta

SEQ ID NO: 4392848 - DNA, 23 bp, Homo sapiens
tatttactgctctttattgcaga

SEQ ID NO: 4392849 - DNA, 17 bp, Homo sapiens
tatttactttttaaaaa

SEQ ID NO: 4392850 - DNA, 13 bp, Homo sapiens
tatttagacaaga

SEQ ID NO: 4392851 - DNA, 20 bp, Homo sapiens
tatttagacaagagatggga

SEQ ID NO: 4392852 - DNA, 21 bp, Homo sapiens
tatttagactgtggccatata

SEQ ID NO: 4392853 - DNA, 19 bp, Homo sapiens
tatttagccagcgtttatt

SEQ ID NO: 4392854 - DNA, 22 bp, Homo sapiens
tatttagccagcgtttattgta

SEQ ID NO: 4392855 - DNA, 18 bp, Homo sapiens
tatttagctgttttggaa

SEQ ID NO: 4392856 - DNA, 22 bp, Homo sapiens
tatttaggaaaatgcttattga

SEQ ID NO: 4392857 - DNA, 13 bp, Homo sapiens
tatttagttacgt

SEQ ID NO: 4392858 - DNA, 22 bp, Homo sapiens
tatttagttgattttaattact

SEQ ID NO: 4392859 - DNA, 23 bp, Homo sapiens
tatttagttgattttaattactt

SEQ ID NO: 4392860 - DNA, 16 bp, Homo sapiens
tatttataatacagaa

SEQ ID NO: 4392861 - DNA, 21 bp, Homo sapiens
tatttatatactttttcatga

SEQ ID NO: 4392862 - DNA, 22 bp, Homo sapiens
tatttatatactttttcatgaa

SEQ ID NO: 4392863 - DNA, 13 bp, Homo sapiens
tatttatatcttg

SEQ ID NO: 4392864 - DNA, 17 bp, Homo sapiens
tatttatatgtacatga

SEQ ID NO: 4392865 - DNA, 13 bp, Homo sapiens
tatttatgttgtt

SEQ ID NO: 4392866 - DNA, 12 bp, Homo sapiens
tatttattaaac

SEQ ID NO: 4392867 - DNA, 20 bp, Homo sapiens
tatttattaaacttcagcaa

SEQ ID NO: 4392868 - DNA, 15 bp, Homo sapiens
tatttattattaatt

SEQ ID NO: 4392869 - DNA, 23 bp, Homo sapiens
tatttattcattatttgtcaaat

SEQ ID NO: 4392870 - DNA, 20 bp, Homo sapiens
tatttattgagcatctagta

SEQ ID NO: 4392871 - DNA, 14 bp, Homo sapiens
tatttattggtttt

SEQ ID NO: 4392872 - DNA, 24 bp, Homo sapiens
tatttattgttagaaaatgactta

SEQ ID NO: 4392873 - DNA, 12 bp, Homo sapiens
tatttatttcta

SEQ ID NO: 4392874 - DNA, 23 bp, Homo sapiens
tatttatttctagcaaacagatg

SEQ ID NO: 4392875 - DNA, 19 bp, Homo sapiens
tatttatttttgtgtaggt

SEQ ID NO: 4392876 - DNA, 20 bp, Homo sapiens
tatttcaaaatatacattca

SEQ ID NO: 4392877 - DNA, 14 bp, Homo sapiens
tatttcaaattgga

SEQ ID NO: 4392878 - DNA, 17 bp, Homo sapiens
tatttcaataaatcttt

SEQ ID NO: 4392879 - DNA, 16 bp, Homo sapiens
tatttcaatgtaatta

SEQ ID NO: 4392880 - DNA, 20 bp, Homo sapiens
tatttcagatgtaatgtttt

SEQ ID NO: 4392881 - DNA, 12 bp, Homo sapiens
tatttcagattt

SEQ ID NO: 4392882 - DNA, 20 bp, Homo sapiens
tatttcagattttgataact

SEQ ID NO: 4392883 - DNA, 22 bp, Homo sapiens
tatttcagtattttccagcctt

SEQ ID NO: 4392884 - DNA, 13 bp, Homo sapiens
tatttcatttatt

SEQ ID NO: 4392885 - DNA, 12 bp, Homo sapiens
tatttcatttct

SEQ ID NO: 4392886 - DNA, 18 bp, Homo sapiens
tatttccattcaacaaga

SEQ ID NO: 4392887 - DNA, 14 bp, Homo sapiens
tatttcctctgctg

SEQ ID NO: 4392888 - DNA, 18 bp, Homo sapiens
tatttcctggatgtttgg

SEQ ID NO: 4392889 - DNA, 19 bp, Homo sapiens
tatttctaatccttttcct

SEQ ID NO: 4392890 - DNA, 13 bp, Homo sapiens
tatttctagccat

SEQ ID NO: 4392891 - DNA, 17 bp, Homo sapiens
tatttctagctttttaa

SEQ ID NO: 4392892 - DNA, 15 bp, Homo sapiens
tatttctatgtcatt

SEQ ID NO: 4392893 - DNA, 13 bp, Homo sapiens
tatttctattatt

SEQ ID NO: 4392894 - DNA, 23 bp, Homo sapiens
tatttctcttttattctgttata

SEQ ID NO: 4392895 - DNA, 23 bp, Homo sapiens
tatttctgaggagcctgcaacat

SEQ ID NO: 4392896 - DNA, 19 bp, Homo sapiens
tatttctgttccagtcaca

SEQ ID NO: 4392897 - DNA, 21 bp, Homo sapiens
tatttctgtttcctatttaat

SEQ ID NO: 4392898 - DNA, 20 bp, Homo sapiens
tatttcttaacctttgctat

SEQ ID NO: 4392899 - DNA, 19 bp, Homo sapiens
tatttcttcgttcttttta

SEQ ID NO: 4392900 - DNA, 13 bp, Homo sapiens
tatttctttgtag

SEQ ID NO: 4392901 - DNA, 12 bp, Homo sapiens
tatttgaaatag

SEQ ID NO: 4392902 - DNA, 22 bp, Homo sapiens
tatttgaaatagattttttcat

SEQ ID NO: 4392903 - DNA, 20 bp, Homo sapiens
tatttgaaatagtatacatt

SEQ ID NO: 4392904 - DNA, 19 bp, Homo sapiens
tatttgaggggtttcagaa

SEQ ID NO: 4392905 - DNA, 18 bp, Homo sapiens
tatttgatgtacattaca

SEQ ID NO: 4392906 - DNA, 16 bp, Homo sapiens
tatttgattcaaaata

SEQ ID NO: 4392907 - DNA, 16 bp, Homo sapiens
tatttgcagtatgaac

SEQ ID NO: 4392908 - DNA, 19 bp, Homo sapiens
tatttgccttctactcccc

SEQ ID NO: 4392909 - DNA, 16 bp, Homo sapiens
tatttgctaagaatgt

SEQ ID NO: 4392910 - DNA, 14 bp, Homo sapiens
tatttgggaagtga

SEQ ID NO: 4392911 - DNA, 15 bp, Homo sapiens
tatttgggaagtgaa

SEQ ID NO: 4392912 - DNA, 17 bp, Homo sapiens
tatttggtactgtattt

SEQ ID NO: 4392913 - DNA, 14 bp, Homo sapiens
tatttgtaaaaata

SEQ ID NO: 4392914 - DNA, 17 bp, Homo sapiens
tatttgtaaatttatgt

SEQ ID NO: 4392915 - DNA, 12 bp, Homo sapiens
tatttgtaagat

SEQ ID NO: 4392916 - DNA, 21 bp, Homo sapiens
tatttgtataaaaattaagct

SEQ ID NO: 4392917 - DNA, 14 bp, Homo sapiens
tatttgtatgatat

SEQ ID NO: 4392918 - DNA, 12 bp, Homo sapiens
tatttgtcaaat

SEQ ID NO: 4392919 - DNA, 18 bp, Homo sapiens
tatttgtcttaaaaaatg

SEQ ID NO: 4392920 - DNA, 21 bp, Homo sapiens
tatttgtcttaaaaaatgtga

SEQ ID NO: 4392921 - DNA, 23 bp, Homo sapiens
tatttgtcttaaaaaatgtgaaa

SEQ ID NO: 4392922 - DNA, 17 bp, Homo sapiens
tatttgtgctatagtat

SEQ ID NO: 4392923 - DNA, 20 bp, Homo sapiens
tatttgttatatataataaa

SEQ ID NO: 4392924 - DNA, 24 bp, Homo sapiens
tatttgttatatataataaatact

SEQ ID NO: 4392925 - DNA, 14 bp, Homo sapiens
tatttgttttaata

SEQ ID NO: 4392926 - DNA, 19 bp, Homo sapiens
tattttaaaatatatgaag

SEQ ID NO: 4392927 - DNA, 18 bp, Homo sapiens
tattttaaaatctgtcac

SEQ ID NO: 4392928 - DNA, 12 bp, Homo sapiens
tattttaaagaa

SEQ ID NO: 4392929 - DNA, 16 bp, Homo sapiens
tattttaaagaattgt

SEQ ID NO: 4392930 - DNA, 22 bp, Homo sapiens
tattttaaatatccatttatct

SEQ ID NO: 4392931 - DNA, 13 bp, Homo sapiens
tattttaaatttc

SEQ ID NO: 4392932 - DNA, 15 bp, Homo sapiens
tattttaaatttctt

SEQ ID NO: 4392933 - DNA, 23 bp, Homo sapiens
tattttaagactgattttaatag

SEQ ID NO: 4392934 - DNA, 14 bp, Homo sapiens
tattttaattttaa

SEQ ID NO: 4392935 - DNA, 22 bp, Homo sapiens
tattttagcagttctgcaaata

SEQ ID NO: 4392936 - DNA, 16 bp, Homo sapiens
tattttaggtgctgtt

SEQ ID NO: 4392937 - DNA, 14 bp, Homo sapiens
tattttagtgtgta

SEQ ID NO: 4392938 - DNA, 16 bp, Homo sapiens
tattttagtgtgtaaa

SEQ ID NO: 4392939 - DNA, 17 bp, Homo sapiens
tattttagtgtgtaaaa

SEQ ID NO: 4392940 - DNA, 18 bp, Homo sapiens
tattttagtgtgtaaaat

SEQ ID NO: 4392941 - DNA, 22 bp, Homo sapiens
tattttagtgtgtaaaattaat

SEQ ID NO: 4392942 - DNA, 20 bp, Homo sapiens
tattttatataataaagtat

SEQ ID NO: 4392943 - DNA, 21 bp, Homo sapiens
tattttatataataaagtatt

SEQ ID NO: 4392944 - DNA, 22 bp, Homo sapiens
tattttatatctgagcaaggag

SEQ ID NO: 4392945 - DNA, 13 bp, Homo sapiens
tattttatcctgt

SEQ ID NO: 4392946 - DNA, 20 bp, Homo sapiens
tattttatcctgtattcttg

SEQ ID NO: 4392947 - DNA, 13 bp, Homo sapiens
tattttatgaaca

SEQ ID NO: 4392948 - DNA, 15 bp, Homo sapiens
tattttatgaacatt

SEQ ID NO: 4392949 - DNA, 20 bp, Homo sapiens
tattttattgaatactgtct

SEQ ID NO: 4392950 - DNA, 16 bp, Homo sapiens
tatgcatattcaatgt

SEQ ID NO: 4392951 - DNA, 15 bp, Homo sapiens
tatgcatgtagcata

SEQ ID NO: 4392952 - DNA, 22 bp, Homo sapiens
tatgcatgtagcatataaatgt

SEQ ID NO: 4392953 - DNA, 17 bp, Homo sapiens
tatgcattattaaattg

SEQ ID NO: 4392954 - DNA, 19 bp, Homo sapiens
tatgcattctttatagtga

SEQ ID NO: 4392955 - DNA, 22 bp, Homo sapiens
tatgcatttaaatacagtcttc

SEQ ID NO: 4392956 - DNA, 20 bp, Homo sapiens
tatgccacctgaataaagaa

SEQ ID NO: 4392957 - DNA, 18 bp, Homo sapiens
tatgccatgttaatattt

SEQ ID NO: 4392958 - DNA, 19 bp, Homo sapiens
tatgccccaccaaggctga

SEQ ID NO: 4392959 - DNA, 22 bp, Homo sapiens
tatgcctctgacagtccacagg

SEQ ID NO: 4392960 - DNA, 16 bp, Homo sapiens
tatgcctttaaatctg

SEQ ID NO: 4392961 - DNA, 20 bp, Homo sapiens
tatgcctttaaatctgtgat

SEQ ID NO: 4392962 - DNA, 15 bp, Homo sapiens
tatgctattgacaat

SEQ ID NO: 4392963 - DNA, 14 bp, Homo sapiens
tatgctatttctgt

SEQ ID NO: 4392964 - DNA, 18 bp, Homo sapiens
tatgctctcactgtttgt

SEQ ID NO: 4392965 - DNA, 17 bp, Homo sapiens
tatgctcttgaaatatt

SEQ ID NO: 4392966 - DNA, 21 bp, Homo sapiens
tatgctcttgaaatattcaga

SEQ ID NO: 4392967 - DNA, 15 bp, Homo sapiens
tatgctgcaatacat

SEQ ID NO: 4392968 - DNA, 13 bp, Homo sapiens
tatgctggccagc

SEQ ID NO: 4392969 - DNA, 14 bp, Homo sapiens
tatgctgtatctgt

SEQ ID NO: 4392970 - DNA, 16 bp, Homo sapiens
tatgctgtatttcttt

SEQ ID NO: 4392971 - DNA, 17 bp, Homo sapiens
tatgctgtatttctttg

SEQ ID NO: 4392972 - DNA, 23 bp, Homo sapiens
tatgctgtatttctttgtagaat

SEQ ID NO: 4392973 - DNA, 15 bp, Homo sapiens
tatgctgtcatggtc

SEQ ID NO: 4392974 - DNA, 15 bp, Homo sapiens
tatgcttactgatat

SEQ ID NO: 4392975 - DNA, 16 bp, Homo sapiens
tatgcttactgatata

SEQ ID NO: 4392976 - DNA, 21 bp, Homo sapiens
tatgcttactgatatatttta

SEQ ID NO: 4392977 - DNA, 14 bp, Homo sapiens
tatgctttccttct

SEQ ID NO: 4392978 - DNA, 14 bp, Homo sapiens
tatggaaaaataaa

SEQ ID NO: 4392979 - DNA, 15 bp, Homo sapiens
tatggaaaactgtgt

SEQ ID NO: 4392980 - DNA, 22 bp, Homo sapiens
tatggaaatattaagaacattt

SEQ ID NO: 4392981 - DNA, 21 bp, Homo sapiens
tatggaaatcttttacatttt

SEQ ID NO: 4392982 - DNA, 20 bp, Homo sapiens
tatggaaccttccctccaaa

SEQ ID NO: 4392983 - DNA, 13 bp, Homo sapiens
tatggaagaaagt

SEQ ID NO: 4392984 - DNA, 22 bp, Homo sapiens
tatggaaggaggcctccactcc

SEQ ID NO: 4392985 - DNA, 19 bp, Homo sapiens
tatggaagggtttgtggct

SEQ ID NO: 4392986 - DNA, 21 bp, Homo sapiens
tatggaatatcatctgtcatt

SEQ ID NO: 4392987 - DNA, 15 bp, Homo sapiens
tatggaattttgcaa

SEQ ID NO: 4392988 - DNA, 17 bp, Homo sapiens
tatggagaattgctgaa

SEQ ID NO: 4392989 - DNA, 19 bp, Homo sapiens
tatggagactttgctgtta

SEQ ID NO: 4392990 - DNA, 18 bp, Homo sapiens
tatggagtcttgtgaaag

SEQ ID NO: 4392991 - DNA, 16 bp, Homo sapiens
tatggatatatttgaa

SEQ ID NO: 4392992 - DNA, 21 bp, Homo sapiens
tatggatcagaggagtaaata

SEQ ID NO: 4392993 - DNA, 16 bp, Homo sapiens
tatggattcacttcta

SEQ ID NO: 4392994 - DNA, 13 bp, Homo sapiens
tatggattctaaa

SEQ ID NO: 4392995 - DNA, 15 bp, Homo sapiens
tatggattctaaaat

SEQ ID NO: 4392996 - DNA, 16 bp, Homo sapiens
tatggattctaaaatg

SEQ ID NO: 4392997 - DNA, 19 bp, Homo sapiens
tatggcaaatagccacaat

SEQ ID NO: 4392998 - DNA, 23 bp, Homo sapiens
tatggcagaagggaattgctcag

SEQ ID NO: 4392999 - DNA, 12 bp, Homo sapiens
tatggcctcagc

SEQ ID NO: 4393000 - DNA, 19 bp, Homo sapiens
tatggcctcagctgcctca

SEQ ID NO: 4393001 - DNA, 15 bp, Homo sapiens
tatggcctcgcctcc

SEQ ID NO: 4393002 - DNA, 21 bp, Homo sapiens
tatggctagacaggaaccctt

SEQ ID NO: 4393003 - DNA, 16 bp, Homo sapiens
tatggctataggtgct

SEQ ID NO: 4393004 - DNA, 14 bp, Homo sapiens
tatggctttcaaag

SEQ ID NO: 4393005 - DNA, 17 bp, Homo sapiens
tatggggatagatgtgt

SEQ ID NO: 4393006 - DNA, 20 bp, Homo sapiens
tatggggctgaacggggaga

SEQ ID NO: 4393007 - DNA, 17 bp, Homo sapiens
tatgggggaaaattatt

SEQ ID NO: 4393008 - DNA, 22 bp, Homo sapiens
tatgggggcatctcttccccag

SEQ ID NO: 4393009 - DNA, 17 bp, Homo sapiens
tatgggtatatattcat

SEQ ID NO: 4393010 - DNA, 13 bp, Homo sapiens
tatgggtcctctg

SEQ ID NO: 4393011 - DNA, 14 bp, Homo sapiens
tatgggtgaaaata

SEQ ID NO: 4393012 - DNA, 22 bp, Homo sapiens
tatgggtttagttactttagat

SEQ ID NO: 4393013 - DNA, 13 bp, Homo sapiens
tatgggtttggct

SEQ ID NO: 4393014 - DNA, 15 bp, Homo sapiens
tatggtaaaaaattt

SEQ ID NO: 4393015 - DNA, 21 bp, Homo sapiens
tatggtaggaactgctgggct

SEQ ID NO: 4393016 - DNA, 18 bp, Homo sapiens
tatggtatgctggccagc

SEQ ID NO: 4393017 - DNA, 19 bp, Homo sapiens
tatggtatgctggccagca

SEQ ID NO: 4393018 - DNA, 22 bp, Homo sapiens
tatggtatgtagccagctgtgc

SEQ ID NO: 4393019 - DNA, 13 bp, Homo sapiens
tatggttaatact

SEQ ID NO: 4393020 - DNA, 19 bp, Homo sapiens
tatggttacttcttctctt

SEQ ID NO: 4393021 - DNA, 20 bp, Homo sapiens
tatggttacttcttctctta

SEQ ID NO: 4393022 - DNA, 13 bp, Homo sapiens
tatggttctaaat

SEQ ID NO: 4393023 - DNA, 20 bp, Homo sapiens
tatgtaaaatgaattgaaaa

SEQ ID NO: 4393024 - DNA, 13 bp, Homo sapiens
tatgtaaatgtgt

SEQ ID NO: 4393025 - DNA, 12 bp, Homo sapiens
tatgtaacatgt

SEQ ID NO: 4393026 - DNA, 18 bp, Homo sapiens
tatgtaataatgtacaga

SEQ ID NO: 4393027 - DNA, 19 bp, Homo sapiens
tatgtacaaacatgttgtt

SEQ ID NO: 4393028 - DNA, 15 bp, Homo sapiens
tatgtacaaccctga

SEQ ID NO: 4393029 - DNA, 16 bp, Homo sapiens
tatgtacaaccctgac

SEQ ID NO: 4393030 - DNA, 14 bp, Homo sapiens
tatgtactgtataa

SEQ ID NO: 4393031 - DNA, 21 bp, Homo sapiens
tatgtagtgcatttttaaact

SEQ ID NO: 4393032 - DNA, 18 bp, Homo sapiens
tatgtatggatatatttg

SEQ ID NO: 4393033 - DNA, 16 bp, Homo sapiens
tatgtatgtaaaaatg

SEQ ID NO: 4393034 - DNA, 21 bp, Homo sapiens
tatgtatttaagatgtacatt

SEQ ID NO: 4393035 - DNA, 17 bp, Homo sapiens
tatgtcacgaacttgaa

SEQ ID NO: 4393036 - DNA, 15 bp, Homo sapiens
tatgtcagtccctgg

SEQ ID NO: 4393037 - DNA, 19 bp, Homo sapiens
tatgtcatttttaatgtat

SEQ ID NO: 4393038 - DNA, 20 bp, Homo sapiens
tatgtcatttttaatgtatc

SEQ ID NO: 4393039 - DNA, 13 bp, Homo sapiens
tatgtcctgtcat

SEQ ID NO: 4393040 - DNA, 20 bp, Homo sapiens
tatgtcctgtgagatgtgta

SEQ ID NO: 4393041 - DNA, 19 bp, Homo sapiens
tatgtctcttctgagctat

SEQ ID NO: 4393042 - DNA, 12 bp, Homo sapiens
tatgtctgcctt

SEQ ID NO: 4393043 - DNA, 23 bp, Homo sapiens
tatgtcttgtatttaaaaacatt

SEQ ID NO: 4393044 - DNA, 20 bp, Homo sapiens
tatgtctttttttttctttt

SEQ ID NO: 4393045 - DNA, 22 bp, Homo sapiens
tatgtgaaaggatatgaatctg

SEQ ID NO: 4393046 - DNA, 18 bp, Homo sapiens
tatgtgaatttttaagct

SEQ ID NO: 4393047 - DNA, 19 bp, Homo sapiens
tatgtgacatttctcttcc

SEQ ID NO: 4393048 - DNA, 14 bp, Homo sapiens
tatgtgacatttta

SEQ ID NO: 4393049 - DNA, 18 bp, Homo sapiens
tatgtgacttgcaataaa

SEQ ID NO: 4393050 - DNA, 20 bp, Homo sapiens
tatgtgaggtaattattgct

SEQ ID NO: 4393051 - DNA, 21 bp, Homo sapiens
tatgtgcattattcataaaaa

SEQ ID NO: 4393052 - DNA, 20 bp, Homo sapiens
tatgtgccacattttcttaa

SEQ ID NO: 4393053 - DNA, 17 bp, Homo sapiens
tatgtggcaaaacatat

SEQ ID NO: 4393054 - DNA, 21 bp, Homo sapiens
tatgtgtgaggagctgctggc

SEQ ID NO: 4393055 - DNA, 14 bp, Homo sapiens
tatgtgtgccctgg

SEQ ID NO: 4393056 - DNA, 18 bp, Homo sapiens
tatgtgtgccctggactg

SEQ ID NO: 4393057 - DNA, 23 bp, Homo sapiens
tatgtgtgtgtgttgtgtgtggg

SEQ ID NO: 4393058 - DNA, 16 bp, Homo sapiens
tatgtgtgtttctgtc

SEQ ID NO: 4393059 - DNA, 21 bp, Homo sapiens
tatgtgtttttctcatatttg

SEQ ID NO: 4393060 - DNA, 13 bp, Homo sapiens
tatgttaatattt

SEQ ID NO: 4393061 - DNA, 21 bp, Homo sapiens
tatgttatacaaccttcattt

SEQ ID NO: 4393062 - DNA, 22 bp, Homo sapiens
tatgttatagaacttcatggat

SEQ ID NO: 4393063 - DNA, 20 bp, Homo sapiens
tatgttcaccaggagattac

SEQ ID NO: 4393064 - DNA, 22 bp, Homo sapiens
tatgttgtaatatttcttcaaa

SEQ ID NO: 4393065 - DNA, 18 bp, Homo sapiens
tatgtttgctgattattt

SEQ ID NO: 4393066 - DNA, 22 bp, Homo sapiens
tatgtttgctgattatttatga

SEQ ID NO: 4393067 - DNA, 18 bp, Homo sapiens
tatgttttccacataaat

SEQ ID NO: 4393068 - DNA, 15 bp, Homo sapiens
tattaaaaaacttca

SEQ ID NO: 4393069 - DNA, 15 bp, Homo sapiens
tattaaaattccaaa

SEQ ID NO: 4393070 - DNA, 15 bp, Homo sapiens
tattaaaattctgaa

SEQ ID NO: 4393071 - DNA, 19 bp, Homo sapiens
tattaaaattctgaatttt

SEQ ID NO: 4393072 - DNA, 18 bp, Homo sapiens
tattaaacaaagtttcag

SEQ ID NO: 4393073 - DNA, 12 bp, Homo sapiens
tattaaactgaa

SEQ ID NO: 4393074 - DNA, 13 bp, Homo sapiens
tattaaactgaat

SEQ ID NO: 4393075 - DNA, 12 bp, Homo sapiens
tattaaagattt

SEQ ID NO: 4393076 - DNA, 15 bp, Homo sapiens
tattaaaggttaaat

SEQ ID NO: 4393077 - DNA, 12 bp, Homo sapiens
tattaaatatta

SEQ ID NO: 4393078 - DNA, 16 bp, Homo sapiens
tattaaatgagggttt

SEQ ID NO: 4393079 - DNA, 15 bp, Homo sapiens
tattaaatgtttcaa

SEQ ID NO: 4393080 - DNA, 19 bp, Homo sapiens
tattaaatgtttcaaaata

SEQ ID NO: 4393081 - DNA, 22 bp, Homo sapiens
tattaaatgtttcaaaatagac

SEQ ID NO: 4393082 - DNA, 23 bp, Homo sapiens
tattaaatgtttcaaaatagaca

SEQ ID NO: 4393083 - DNA, 19 bp, Homo sapiens
tattaaattaaattttgtg

SEQ ID NO: 4393084 - DNA, 15 bp, Homo sapiens
tattaacaattaatt

SEQ ID NO: 4393085 - DNA, 19 bp, Homo sapiens
tattaacaattaattgtct

SEQ ID NO: 4393086 - DNA, 16 bp, Homo sapiens
tattaacatgcaataa

SEQ ID NO: 4393087 - DNA, 18 bp, Homo sapiens
tattaacatgcaataaca

SEQ ID NO: 4393088 - DNA, 20 bp, Homo sapiens
tattaactctgcatagacaa

SEQ ID NO: 4393089 - DNA, 12 bp, Homo sapiens
tattaagaaagg

SEQ ID NO: 4393090 - DNA, 14 bp, Homo sapiens
tattaagaaaggaa

SEQ ID NO: 4393091 - DNA, 13 bp, Homo sapiens
tattaagaacatt

SEQ ID NO: 4393092 - DNA, 17 bp, Homo sapiens
tattaagaacattttat

SEQ ID NO: 4393093 - DNA, 15 bp, Homo sapiens
tattaagagctattt

SEQ ID NO: 4393094 - DNA, 23 bp, Homo sapiens
tattaagcagactggaaaagtga

SEQ ID NO: 4393095 - DNA, 17 bp, Homo sapiens
tattaatagtaatttgt

SEQ ID NO: 4393096 - DNA, 15 bp, Homo sapiens
tattaatataagttt

SEQ ID NO: 4393097 - DNA, 20 bp, Homo sapiens
tattaatatatatctgctgt

SEQ ID NO: 4393098 - DNA, 14 bp, Homo sapiens
tattaatcaagaga

SEQ ID NO: 4393099 - DNA, 19 bp, Homo sapiens
tattaatcaagagaaactt

SEQ ID NO: 4393100 - DNA, 20 bp, Homo sapiens
tattaatcaagagaaacttc

SEQ ID NO: 4393101 - DNA, 14 bp, Homo sapiens
tattaatgcacttt

SEQ ID NO: 4393102 - DNA, 20 bp, Homo sapiens
tattaatgcactttctatcc

SEQ ID NO: 4393103 - DNA, 22 bp, Homo sapiens
tattaatgtctcactttacttt

SEQ ID NO: 4393104 - DNA, 23 bp, Homo sapiens
tattaattccaggaacacatgtt

SEQ ID NO: 4393105 - DNA, 14 bp, Homo sapiens
tattaattttagtt

SEQ ID NO: 4393106 - DNA, 21 bp, Homo sapiens
tattaattttagtttttcatt

SEQ ID NO: 4393107 - DNA, 14 bp, Homo sapiens
tattacaaatgcaa

SEQ ID NO: 4393108 - DNA, 21 bp, Homo sapiens
tattacaaatgcaaatttcta

SEQ ID NO: 4393109 - DNA, 13 bp, Homo sapiens
tattacaacattt

SEQ ID NO: 4393110 - DNA, 17 bp, Homo sapiens
tattacaatgtatcttt

SEQ ID NO: 4393111 - DNA, 16 bp, Homo sapiens
tattacctcaggtgcc

SEQ ID NO: 4393112 - DNA, 17 bp, Homo sapiens
tattactaaattgacct

SEQ ID NO: 4393113 - DNA, 17 bp, Homo sapiens
tattactcctatttttg

SEQ ID NO: 4393114 - DNA, 13 bp, Homo sapiens
tattactgttctt

SEQ ID NO: 4393115 - DNA, 16 bp, Homo sapiens
tattactttgtctttt

SEQ ID NO: 4393116 - DNA, 20 bp, Homo sapiens
tattactttgtcttttcaat

SEQ ID NO: 4393117 - DNA, 23 bp, Homo sapiens
tattactttgtcttttcaatctt

SEQ ID NO: 4393118 - DNA, 17 bp, Homo sapiens
tattagaacattcactt

SEQ ID NO: 4393119 - DNA, 19 bp, Homo sapiens
tattagcagggattctctc

SEQ ID NO: 4393120 - DNA, 21 bp, Homo sapiens
tattagccaggtaatgtgaat

SEQ ID NO: 4393121 - DNA, 17 bp, Homo sapiens
tattaggaaaataaaca

SEQ ID NO: 4393122 - DNA, 19 bp, Homo sapiens
tattaggaaaataaacaga

SEQ ID NO: 4393123 - DNA, 16 bp, Homo sapiens
tattaggtcttaaagt

SEQ ID NO: 4393124 - DNA, 17 bp, Homo sapiens
tattagtgacttttcag

SEQ ID NO: 4393125 - DNA, 16 bp, Homo sapiens
tattagtgctttgcca

SEQ ID NO: 4393126 - DNA, 22 bp, Homo sapiens
tattagtggtttatcagcaaaa

SEQ ID NO: 4393127 - DNA, 12 bp, Homo sapiens
tattagttgctt

SEQ ID NO: 4393128 - DNA, 13 bp, Homo sapiens
tattataaaaata

SEQ ID NO: 4393129 - DNA, 13 bp, Homo sapiens
tattataaatata

SEQ ID NO: 4393130 - DNA, 15 bp, Homo sapiens
tattataaatatata

SEQ ID NO: 4393131 - DNA, 22 bp, Homo sapiens
tattataaatatatataaagaa

SEQ ID NO: 4393132 - DNA, 18 bp, Homo sapiens
tattataagtcttacata

SEQ ID NO: 4393133 - DNA, 23 bp, Homo sapiens
tattataatataatatggaacct

SEQ ID NO: 4393134 - DNA, 14 bp, Homo sapiens
tattataatcttat

SEQ ID NO: 4393135 - DNA, 19 bp, Homo sapiens
tattataatcttataattg

SEQ ID NO: 4393136 - DNA, 15 bp, Homo sapiens
tattatagacaaaag

SEQ ID NO: 4393137 - DNA, 15 bp, Homo sapiens
tattatagtgaaaca

SEQ ID NO: 4393138 - DNA, 13 bp, Homo sapiens
tattatatacata

SEQ ID NO: 4393139 - DNA, 13 bp, Homo sapiens
tattatctgtcag

SEQ ID NO: 4393140 - DNA, 18 bp, Homo sapiens
tattatcttgttcaggaa

SEQ ID NO: 4393141 - DNA, 15 bp, Homo sapiens
tattatggaattact

SEQ ID NO: 4393142 - DNA, 21 bp, Homo sapiens
tattatggttagctgtcacat

SEQ ID NO: 4393143 - DNA, 21 bp, Homo sapiens
tattatgtcctgtgagatgtg

SEQ ID NO: 4393144 - DNA, 12 bp, Homo sapiens
tattatgtgaag

SEQ ID NO: 4393145 - DNA, 17 bp, Homo sapiens
tattatgtgaagaattt

SEQ ID NO: 4393146 - DNA, 20 bp, Homo sapiens
tattatgtttgatttctcta

SEQ ID NO: 4393147 - DNA, 12 bp, Homo sapiens
tattattagggc

SEQ ID NO: 4393148 - DNA, 15 bp, Homo sapiens
tattattattactgt

SEQ ID NO: 4393149 - DNA, 17 bp, Homo sapiens
tattattcctagtcttt

SEQ ID NO: 4393150 - DNA, 17 bp, Homo sapiens
tattattgcttcatgtt

SEQ ID NO: 4393151 - DNA, 19 bp, Homo sapiens
tattattttagtgtgtaaa

SEQ ID NO: 4393152 - DNA, 19 bp, Homo sapiens
tattatttttttaaacaaa

SEQ ID NO: 4393153 - DNA, 21 bp, Homo sapiens
tattcaaaaaatcatgtttat

SEQ ID NO: 4393154 - DNA, 15 bp, Homo sapiens
tattcaaacagtctc

SEQ ID NO: 4393155 - DNA, 14 bp, Homo sapiens
tattcaaagatgat

SEQ ID NO: 4393156 - DNA, 18 bp, Homo sapiens
tattcaaagatgataatt

SEQ ID NO: 4393157 - DNA, 19 bp, Homo sapiens
tattcaaatgaaggtggtt

SEQ ID NO: 4393158 - DNA, 13 bp, Homo sapiens
tattcaaatttga

SEQ ID NO: 4393159 - DNA, 14 bp, Homo sapiens
tattcaaatttgat

SEQ ID NO: 4393160 - DNA, 20 bp, Homo sapiens
tattcaactattcttcattt

SEQ ID NO: 4393161 - DNA, 21 bp, Homo sapiens
tattcaaggctttaaaagtca

SEQ ID NO: 4393162 - DNA, 14 bp, Homo sapiens
tattcactgggcca

SEQ ID NO: 4393163 - DNA, 19 bp, Homo sapiens
tattcagccagcttaaacc

SEQ ID NO: 4393164 - DNA, 14 bp, Homo sapiens
tattcagctagaat

SEQ ID NO: 4393165 - DNA, 19 bp, Homo sapiens
tattcagctagaatttctg

SEQ ID NO: 4393166 - DNA, 17 bp, Homo sapiens
tattcagtggtgaaatc

SEQ ID NO: 4393167 - DNA, 16 bp, Homo sapiens
tattcatattggaaaa

SEQ ID NO: 4393168 - DNA, 12 bp, Homo sapiens
tattcatggcta

SEQ ID NO: 4393169 - DNA, 22 bp, Homo sapiens
tattcattatttgtcaaattgt

SEQ ID NO: 4393170 - DNA, 23 bp, Homo sapiens
tattcattatttgtcaaattgtc

SEQ ID NO: 4393171 - DNA, 23 bp, Homo sapiens
tattcattctttttgaaatgtca

SEQ ID NO: 4393172 - DNA, 16 bp, Homo sapiens
tattccaaaccaaatt

SEQ ID NO: 4393173 - DNA, 17 bp, Homo sapiens
tattccaagcttccata

SEQ ID NO: 4393174 - DNA, 16 bp, Homo sapiens
tattccacaaacacat

SEQ ID NO: 4393175 - DNA, 15 bp, Homo sapiens
tattccaccttaaat

SEQ ID NO: 4393176 - DNA, 19 bp, Homo sapiens
tattccaccttaaattaaa

SEQ ID NO: 4393177 - DNA, 20 bp, Homo sapiens
tattccaccttaaattaaac

SEQ ID NO: 4393178 - DNA, 20 bp, Homo sapiens
tattccagaatgctgtacat

SEQ ID NO: 4393179 - DNA, 12 bp, Homo sapiens
tattcccatgag

SEQ ID NO: 4393180 - DNA, 18 bp, Homo sapiens
tattcccccaaacttttt

SEQ ID NO: 4393181 - DNA, 14 bp, Homo sapiens
tattccctcagcct

SEQ ID NO: 4393182 - DNA, 17 bp, Homo sapiens
tattccctgcacacaca

SEQ ID NO: 4393183 - DNA, 13 bp, Homo sapiens
tattccctgccca

SEQ ID NO: 4393184 - DNA, 19 bp, Homo sapiens
tattcctagtctttccagt

SEQ ID NO: 4393185 - DNA, 16 bp, Homo sapiens
tattcctttaaaatat

SEQ ID NO: 4393186 - DNA, 17 bp, Homo sapiens
tattcctttaaaatatt

SEQ ID NO: 4393187 - DNA, 15 bp, Homo sapiens
tattcctttattttg

SEQ ID NO: 4393188 - DNA, 13 bp, Homo sapiens
tattccttttaaa

SEQ ID NO: 4393189 - DNA, 14 bp, Homo sapiens
tattccttttaaaa

SEQ ID NO: 4393190 - DNA, 12 bp, Homo sapiens
tattctaactta

SEQ ID NO: 4393191 - DNA, 18 bp, Homo sapiens
tataaatgtaaaaatgaa

SEQ ID NO: 4393192 - DNA, 15 bp, Homo sapiens
tataaatgtgtttat

SEQ ID NO: 4393193 - DNA, 19 bp, Homo sapiens
tataaatgtttatattgtt

SEQ ID NO: 4393194 - DNA, 20 bp, Homo sapiens
tataaatgtttatattgttt

SEQ ID NO: 4393195 - DNA, 17 bp, Homo sapiens
tataaattaatttgtta

SEQ ID NO: 4393196 - DNA, 16 bp, Homo sapiens
tataaattattacttt

SEQ ID NO: 4393197 - DNA, 14 bp, Homo sapiens
tataaattcagaac

SEQ ID NO: 4393198 - DNA, 17 bp, Homo sapiens
tataaattgtacatttt

SEQ ID NO: 4393199 - DNA, 21 bp, Homo sapiens
tataaattgtacattttgtaa

SEQ ID NO: 4393200 - DNA, 18 bp, Homo sapiens
tataaatttaagaaaaca

SEQ ID NO: 4393201 - DNA, 21 bp, Homo sapiens
tataaatttaagaaaacaagt

SEQ ID NO: 4393202 - DNA, 17 bp, Homo sapiens
tataacaactatttact

SEQ ID NO: 4393203 - DNA, 16 bp, Homo sapiens
tataacagatgtgaaa

SEQ ID NO: 4393204 - DNA, 20 bp, Homo sapiens
tataacagtgtctttctagc

SEQ ID NO: 4393205 - DNA, 22 bp, Homo sapiens
tataacagtgtctttctagcca

SEQ ID NO: 4393206 - DNA, 22 bp, Homo sapiens
tataacagttttgagtaattca

SEQ ID NO: 4393207 - DNA, 16 bp, Homo sapiens
tataacattatataac

SEQ ID NO: 4393208 - DNA, 19 bp, Homo sapiens
tataacattatataacaaa

SEQ ID NO: 4393209 - DNA, 22 bp, Homo sapiens
tataacattatataacaaaaaa

SEQ ID NO: 4393210 - DNA, 20 bp, Homo sapiens
tataacgtgttcaatatttt

SEQ ID NO: 4393211 - DNA, 16 bp, Homo sapiens
tataactagctagaag

SEQ ID NO: 4393212 - DNA, 14 bp, Homo sapiens
tataactgtcttgt

SEQ ID NO: 4393213 - DNA, 19 bp, Homo sapiens
tataactgtcttgtttcag

SEQ ID NO: 4393214 - DNA, 21 bp, Homo sapiens
tataactgtcttgtttcagtg

SEQ ID NO: 4393215 - DNA, 19 bp, Homo sapiens
tataactgttttagaaatt

SEQ ID NO: 4393216 - DNA, 13 bp, Homo sapiens
tataacttgtaag

SEQ ID NO: 4393217 - DNA, 23 bp, Homo sapiens
tataagaagcaatctttgaaata

SEQ ID NO: 4393218 - DNA, 20 bp, Homo sapiens
tataagatacaataaaacaa

SEQ ID NO: 4393219 - DNA, 22 bp, Homo sapiens
tataagcaagaaggcaaaaata

SEQ ID NO: 4393220 - DNA, 22 bp, Homo sapiens
tataagcagattgctttaattt

SEQ ID NO: 4393221 - DNA, 17 bp, Homo sapiens
tataagcgtatttagac

SEQ ID NO: 4393222 - DNA, 16 bp, Homo sapiens
tataaggaaagcaata

SEQ ID NO: 4393223 - DNA, 11 bp, Homo sapiens
tataaggactg

SEQ ID NO: 4393224 - DNA, 13 bp, Homo sapiens
tataaggactgca

SEQ ID NO: 4393225 - DNA, 15 bp, Homo sapiens
tataaggactgcatg

SEQ ID NO: 4393226 - DNA, 15 bp, Homo sapiens
tataaggtaatgtag

SEQ ID NO: 4393227 - DNA, 16 bp, Homo sapiens
tataaggtgctctctt

SEQ ID NO: 4393228 - DNA, 23 bp, Homo sapiens
tataagtctgggcactggatgca

SEQ ID NO: 4393229 - DNA, 18 bp, Homo sapiens
tataagtgagagaaatga

SEQ ID NO: 4393230 - DNA, 13 bp, Homo sapiens
tataagtttcttt

SEQ ID NO: 4393231 - DNA, 14 bp, Homo sapiens
tataataaaggact

SEQ ID NO: 4393232 - DNA, 19 bp, Homo sapiens
tataataaaggactgtaat

SEQ ID NO: 4393233 - DNA, 22 bp, Homo sapiens
tataataaaggactgtaatctt

SEQ ID NO: 4393234 - DNA, 13 bp, Homo sapiens
tataataaagtat

SEQ ID NO: 4393235 - DNA, 20 bp, Homo sapiens
tataatacagaatcttgttt

SEQ ID NO: 4393236 - DNA, 22 bp, Homo sapiens
tataatactttgtatacaagta

SEQ ID NO: 4393237 - DNA, 17 bp, Homo sapiens
tataatatactaaacca

SEQ ID NO: 4393238 - DNA, 14 bp, Homo sapiens
tataatatctaaag

SEQ ID NO: 4393239 - DNA, 13 bp, Homo sapiens
tataatattcagc

SEQ ID NO: 4393240 - DNA, 22 bp, Homo sapiens
tataatattcagccagcttaaa

SEQ ID NO: 4393241 - DNA, 23 bp, Homo sapiens
tataatattcagccagcttaaac

SEQ ID NO: 4393242 - DNA, 19 bp, Homo sapiens
tataatattgaaaattgaa

SEQ ID NO: 4393243 - DNA, 13 bp, Homo sapiens
tataatcaaatga

SEQ ID NO: 4393244 - DNA, 18 bp, Homo sapiens
tataatcaaatgatttca

SEQ ID NO: 4393245 - DNA, 20 bp, Homo sapiens
tataatcaaatgatttcata

SEQ ID NO: 4393246 - DNA, 23 bp, Homo sapiens
tataatcaaatgatttcatattg

SEQ ID NO: 4393247 - DNA, 16 bp, Homo sapiens
tataatcatcaagtaa

SEQ ID NO: 4393248 - DNA, 15 bp, Homo sapiens
tataatgacttttaa

SEQ ID NO: 4393249 - DNA, 14 bp, Homo sapiens
tataatgtatttga

SEQ ID NO: 4393250 - DNA, 15 bp, Homo sapiens
tataatgtatttgaa

SEQ ID NO: 4393251 - DNA, 16 bp, Homo sapiens
tataatgtatttgaaa

SEQ ID NO: 4393252 - DNA, 20 bp, Homo sapiens
tataatgtatttgaaaatta

SEQ ID NO: 4393253 - DNA, 15 bp, Homo sapiens
tataatgtgaaatgt

SEQ ID NO: 4393254 - DNA, 21 bp, Homo sapiens
tataatgtgagtagttactaa

SEQ ID NO: 4393255 - DNA, 15 bp, Homo sapiens
tataatgttattcat

SEQ ID NO: 4393256 - DNA, 17 bp, Homo sapiens
tataatgtttattaaat

SEQ ID NO: 4393257 - DNA, 12 bp, Homo sapiens
tataattctgga

SEQ ID NO: 4393258 - DNA, 18 bp, Homo sapiens
tataattggatttcctaa

SEQ ID NO: 4393259 - DNA, 21 bp, Homo sapiens
tataattgttctcagaatccc

SEQ ID NO: 4393260 - DNA, 18 bp, Homo sapiens
tataattgttttatctga

SEQ ID NO: 4393261 - DNA, 22 bp, Homo sapiens
tataattgttttatctgaattt

SEQ ID NO: 4393262 - DNA, 18 bp, Homo sapiens
tataatttaataaaaagg

SEQ ID NO: 4393263 - DNA, 22 bp, Homo sapiens
tataatttaataaaaaggaata

SEQ ID NO: 4393264 - DNA, 18 bp, Homo sapiens
tataatttaatgtaaata

SEQ ID NO: 4393265 - DNA, 19 bp, Homo sapiens
tataatttaatgtaaataa

SEQ ID NO: 4393266 - DNA, 22 bp, Homo sapiens
tataatttaatgtaaataaaac

SEQ ID NO: 4393267 - DNA, 20 bp, Homo sapiens
tataatttacctaagattac

SEQ ID NO: 4393268 - DNA, 18 bp, Homo sapiens
tataatttactttgtaga

SEQ ID NO: 4393269 - DNA, 13 bp, Homo sapiens
tatacaaaacttt

SEQ ID NO: 4393270 - DNA, 15 bp, Homo sapiens
tatacaaaactttat

SEQ ID NO: 4393271 - DNA, 17 bp, Homo sapiens
tatacaaaactttatca

SEQ ID NO: 4393272 - DNA, 14 bp, Homo sapiens
tatacaaaagagca

SEQ ID NO: 4393273 - DNA, 15 bp, Homo sapiens
tatacaaaagagcat

SEQ ID NO: 4393274 - DNA, 23 bp, Homo sapiens
tatacaaattttcagaaggttat

SEQ ID NO: 4393275 - DNA, 17 bp, Homo sapiens
tatacaaccttcattta

SEQ ID NO: 4393276 - DNA, 19 bp, Homo sapiens
tatacaagtaatttcctga

SEQ ID NO: 4393277 - DNA, 17 bp, Homo sapiens
tatacagtgcagagcct

SEQ ID NO: 4393278 - DNA, 18 bp, Homo sapiens
tatacagtgcagagcctt

SEQ ID NO: 4393279 - DNA, 20 bp, Homo sapiens
tatacagttataaaattaaa

SEQ ID NO: 4393280 - DNA, 16 bp, Homo sapiens
tatacagtttgacttt

SEQ ID NO: 4393281 - DNA, 19 bp, Homo sapiens
tatacagttttaaagaatc

SEQ ID NO: 4393282 - DNA, 13 bp, Homo sapiens
tatacatggaatc

SEQ ID NO: 4393283 - DNA, 14 bp, Homo sapiens
tatacatggaatcg

SEQ ID NO: 4393284 - DNA, 20 bp, Homo sapiens
tatacatgttggaaatgtgt

SEQ ID NO: 4393285 - DNA, 22 bp, Homo sapiens
tatacattacatctgagtattt

SEQ ID NO: 4393286 - DNA, 19 bp, Homo sapiens
tatacattttataatgatg

SEQ ID NO: 4393287 - DNA, 22 bp, Homo sapiens
tataccaaaaacaagtctataa

SEQ ID NO: 4393288 - DNA, 16 bp, Homo sapiens
tataccaaattaaaaa

SEQ ID NO: 4393289 - DNA, 14 bp, Homo sapiens
tataccaatgtgtt

SEQ ID NO: 4393290 - DNA, 21 bp, Homo sapiens
tataccacccatagtgcttca

SEQ ID NO: 4393291 - DNA, 19 bp, Homo sapiens
tataccaggatttattttg

SEQ ID NO: 4393292 - DNA, 19 bp, Homo sapiens
tataccagtataattgagt

SEQ ID NO: 4393293 - DNA, 13 bp, Homo sapiens
tataccatgagat

SEQ ID NO: 4393294 - DNA, 18 bp, Homo sapiens
tataccatgtgtgctaat

SEQ ID NO: 4393295 - DNA, 20 bp, Homo sapiens
tataccctggtgcaatcaca

SEQ ID NO: 4393296 - DNA, 20 bp, Homo sapiens
tatacctgattttttttcct

SEQ ID NO: 4393297 - DNA, 19 bp, Homo sapiens
tatacctgccttttaagtt

SEQ ID NO: 4393298 - DNA, 19 bp, Homo sapiens
tatacctggcaattcacaa

SEQ ID NO: 4393299 - DNA, 20 bp, Homo sapiens
tataccttactgacacattg

SEQ ID NO: 4393300 - DNA, 22 bp, Homo sapiens
tatactaaaccaactctaatat

SEQ ID NO: 4393301 - DNA, 23 bp, Homo sapiens
tatactaaaccaactctaatatt

SEQ ID NO: 4393302 - DNA, 21 bp, Homo sapiens
tatactactttgttaggattt

SEQ ID NO: 4393303 - DNA, 17 bp, Homo sapiens
tatactatagtaccagt

SEQ ID NO: 4393304 - DNA, 20 bp, Homo sapiens
tatactatagtaccagtagg

SEQ ID NO: 4393305 - DNA, 15 bp, Homo sapiens
tatactcattagaat

SEQ ID NO: 4393306 - DNA, 21 bp, Homo sapiens
tatactgtacaataaaaacat

SEQ ID NO: 4393307 - DNA, 23 bp, Homo sapiens
tatactgtgtgtgagtgtgaata

SEQ ID NO: 4393308 - DNA, 22 bp, Homo sapiens
tatacttaaaaaatcctgccca

SEQ ID NO: 4393309 - DNA, 18 bp, Homo sapiens
tatacttacactgtattg

SEQ ID NO: 4393310 - DNA, 14 bp, Homo sapiens
tatacttgaacaaa

SEQ ID NO: 4393311 - DNA, 16 bp, Homo sapiens
tatacttgactctaat

SEQ ID NO: 4393312 - DNA, 18 bp, Homo sapiens
tatacttgactctaatat

SEQ ID NO: 4393313 - DNA, 22 bp, Homo sapiens
tatactttactttttccatttg

SEQ ID NO: 4393314 - DNA, 19 bp, Homo sapiens
tatactttagtagacattt

SEQ ID NO: 4393315 - DNA, 16 bp, Homo sapiens
tatactttatatctgt

SEQ ID NO: 4393316 - DNA, 15 bp, Homo sapiens
tatactttattgaaa

SEQ ID NO: 4393317 - DNA, 20 bp, Homo sapiens
tatagaaaaaaacattctat

SEQ ID NO: 4393318 - DNA, 17 bp, Homo sapiens
tatagaaaatcttagta

SEQ ID NO: 4393319 - DNA, 19 bp, Homo sapiens
tatagaattatattttctt

SEQ ID NO: 4393320 - DNA, 15 bp, Homo sapiens
tatagaatttcctgt

SEQ ID NO: 4393321 - DNA, 17 bp, Homo sapiens
tatagaatttcctgtaa

SEQ ID NO: 4393322 - DNA, 21 bp, Homo sapiens
tatagacaaaagaataagaca

SEQ ID NO: 4393323 - DNA, 14 bp, Homo sapiens
tatagacagtgccc

SEQ ID NO: 4393324 - DNA, 19 bp, Homo sapiens
tatagagatatttttgtac

SEQ ID NO: 4393325 - DNA, 21 bp, Homo sapiens
tatagaggctagcttctgctt

SEQ ID NO: 4393326 - DNA, 20 bp, Homo sapiens
tatagatataatgaacaaaa

SEQ ID NO: 4393327 - DNA, 21 bp, Homo sapiens
tatagatataatgaacaaaat

SEQ ID NO: 4393328 - DNA, 23 bp, Homo sapiens
tatagatataatgaacaaaatta

SEQ ID NO: 4393329 - DNA, 19 bp, Homo sapiens
tatagatgcctcttaggac

SEQ ID NO: 4393330 - DNA, 14 bp, Homo sapiens
tatagatggccaaa

SEQ ID NO: 4393331 - DNA, 19 bp, Homo sapiens
tatagattgaaatttccta

SEQ ID NO: 4393332 - DNA, 15 bp, Homo sapiens
tatagcactgagctc

SEQ ID NO: 4393333 - DNA, 19 bp, Homo sapiens
tatagccaaaaatagctaa

SEQ ID NO: 4393334 - DNA, 22 bp, Homo sapiens
tatagccaaaaatagctaaata

SEQ ID NO: 4393335 - DNA, 18 bp, Homo sapiens
tatagctggcaagaatgg

SEQ ID NO: 4393336 - DNA, 13 bp, Homo sapiens
tatagcttaaaac

SEQ ID NO: 4393337 - DNA, 19 bp, Homo sapiens
tataggaaaaaaactggga

SEQ ID NO: 4393338 - DNA, 19 bp, Homo sapiens
tataggaacatatgaaaat

SEQ ID NO: 4393339 - DNA, 22 bp, Homo sapiens
tataggcctgtcccttgcctct

SEQ ID NO: 4393340 - DNA, 23 bp, Homo sapiens
tataggcctgtcccttgcctctg

SEQ ID NO: 4393341 - DNA, 13 bp, Homo sapiens
tataggcgttttt

SEQ ID NO: 4393342 - DNA, 18 bp, Homo sapiens
tataggggatacttgaaa

SEQ ID NO: 4393343 - DNA, 20 bp, Homo sapiens
tataggtcctgtgttaaaca

SEQ ID NO: 4393344 - DNA, 16 bp, Homo sapiens
tataggtttattacaa

SEQ ID NO: 4393345 - DNA, 13 bp, Homo sapiens
tatagtacatgat

SEQ ID NO: 4393346 - DNA, 18 bp, Homo sapiens
tatagtatttgattcaaa

SEQ ID NO: 4393347 - DNA, 13 bp, Homo sapiens
tatagtcaaatcg

SEQ ID NO: 4393348 - DNA, 23 bp, Homo sapiens
tatagtgacagtataacctgtct

SEQ ID NO: 4393349 - DNA, 17 bp, Homo sapiens
tatagtgcacaaaatga

SEQ ID NO: 4393350 - DNA, 20 bp, Homo sapiens
tatagtggatgatatacaca

SEQ ID NO: 4393351 - DNA, 14 bp, Homo sapiens
tatagtgtgttgtg

SEQ ID NO: 4393352 - DNA, 15 bp, Homo sapiens
tatagttactgtgta

SEQ ID NO: 4393353 - DNA, 14 bp, Homo sapiens
tatagttattaaat

SEQ ID NO: 4393354 - DNA, 16 bp, Homo sapiens
tatagttattaaatgt

SEQ ID NO: 4393355 - DNA, 17 bp, Homo sapiens
tatagttattaaatgtt

SEQ ID NO: 4393356 - DNA, 22 bp, Homo sapiens
tatagttattaaatgtttcaaa

SEQ ID NO: 4393357 - DNA, 17 bp, Homo sapiens
tatagttttacttttaa

SEQ ID NO: 4393358 - DNA, 13 bp, Homo sapiens
tatagttttttct

SEQ ID NO: 4393359 - DNA, 19 bp, Homo sapiens
tatataaaacggtgctgtg

SEQ ID NO: 4393360 - DNA, 13 bp, Homo sapiens
tatataaacatat

SEQ ID NO: 4393361 - DNA, 14 bp, Homo sapiens
tatataaagtatag

SEQ ID NO: 4393362 - DNA, 19 bp, Homo sapiens
tatataaagtattcttttt

SEQ ID NO: 4393363 - DNA, 13 bp, Homo sapiens
tatataaatcatt

SEQ ID NO: 4393364 - DNA, 12 bp, Homo sapiens
tatataaattat

SEQ ID NO: 4393365 - DNA, 14 bp, Homo sapiens
tatataaattatta

SEQ ID NO: 4393366 - DNA, 23 bp, Homo sapiens
tatataaattttttttgtttcat

SEQ ID NO: 4393367 - DNA, 19 bp, Homo sapiens
tatataagactgctgcagt

SEQ ID NO: 4393368 - DNA, 21 bp, Homo sapiens
tatataagcccttaataataa

SEQ ID NO: 4393369 - DNA, 22 bp, Homo sapiens
tatataagcccttaataataat

SEQ ID NO: 4393370 - DNA, 12 bp, Homo sapiens
tatataagcttt

SEQ ID NO: 4393371 - DNA, 19 bp, Homo sapiens
tatataatatctaaagtta

SEQ ID NO: 4393372 - DNA, 20 bp, Homo sapiens
tatataatcatgctcatgta

SEQ ID NO: 4393373 - DNA, 14 bp, Homo sapiens
tatataatttaatg

SEQ ID NO: 4393374 - DNA, 15 bp, Homo sapiens
tatatagaatttcct

SEQ ID NO: 4393375 - DNA, 18 bp, Homo sapiens
tatatagaatttcctgta

SEQ ID NO: 4393376 - DNA, 21 bp, Homo sapiens
tatatagaatttcctgtaata

SEQ ID NO: 4393377 - DNA, 14 bp, Homo sapiens
tatatagctggcaa

SEQ ID NO: 4393378 - DNA, 20 bp, Homo sapiens
tatatagctggcaagaatgg

SEQ ID NO: 4393379 - DNA, 13 bp, Homo sapiens
tatatataaaacg

SEQ ID NO: 4393380 - DNA, 12 bp, Homo sapiens
tatatataaaga

SEQ ID NO: 4393381 - DNA, 14 bp, Homo sapiens
tatatataaagaat

SEQ ID NO: 4393382 - DNA, 15 bp, Homo sapiens
tatatataaagtata

SEQ ID NO: 4393383 - DNA, 16 bp, Homo sapiens
tatatataataaatac

SEQ ID NO: 4393384 - DNA, 11 bp, Homo sapiens
tatatatataa

SEQ ID NO: 4393385 - DNA, 12 bp, Homo sapiens
tatatatataaa

SEQ ID NO: 4393386 - DNA, 13 bp, Homo sapiens
tatatatatataa

SEQ ID NO: 4393387 - DNA, 15 bp, Homo sapiens
tatatatatatataa

SEQ ID NO: 4393388 - DNA, 17 bp, Homo sapiens
tatatatctattattca

SEQ ID NO: 4393389 - DNA, 20 bp, Homo sapiens
tatatatctattattcaaaa

SEQ ID NO: 4393390 - DNA, 18 bp, Homo sapiens
tatatatctgctgtccag

SEQ ID NO: 4393391 - DNA, 16 bp, Homo sapiens
tatatatcttataact

SEQ ID NO: 4393392 - DNA, 18 bp, Homo sapiens
tatatatggtcatataca

SEQ ID NO: 4393393 - DNA, 19 bp, Homo sapiens
tatatatggtcatatacat

SEQ ID NO: 4393394 - DNA, 15 bp, Homo sapiens
tatatattataagtt

SEQ ID NO: 4393395 - DNA, 13 bp, Homo sapiens
tatatattatata

SEQ ID NO: 4393396 - DNA, 15 bp, Homo sapiens
tatatattatgtgaa

SEQ ID NO: 4393397 - DNA, 21 bp, Homo sapiens
tatatattatgtgaagaattt

SEQ ID NO: 4393398 - DNA, 17 bp, Homo sapiens
tatatattcatctaata

SEQ ID NO: 4393399 - DNA, 19 bp, Homo sapiens
tatatattgaaagttgctt

SEQ ID NO: 4393400 - DNA, 21 bp, Homo sapiens
tatatattgaaagttgctttt

SEQ ID NO: 4393401 - DNA, 12 bp, Homo sapiens
tatatattgtat

SEQ ID NO: 4393402 - DNA, 15 bp, Homo sapiens
tatatatttacagaa

SEQ ID NO: 4393403 - DNA, 16 bp, Homo sapiens
tatatcaaaaaacctt

SEQ ID NO: 4393404 - DNA, 13 bp, Homo sapiens
tatatcaaagcag

SEQ ID NO: 4393405 - DNA, 14 bp, Homo sapiens
tatatcacacaata

SEQ ID NO: 4393406 - DNA, 17 bp, Homo sapiens
tatatcacacaatatag

SEQ ID NO: 4393407 - DNA, 13 bp, Homo sapiens
tatatcactgtct

SEQ ID NO: 4393408 - DNA, 21 bp, Homo sapiens
tatatcactgtctagctgttt

SEQ ID NO: 4393409 - DNA, 15 bp, Homo sapiens
tatatcagctactgt

SEQ ID NO: 4393410 - DNA, 21 bp, Homo sapiens
tatatcagcttttctgatggt

SEQ ID NO: 4393411 - DNA, 20 bp, Homo sapiens
tatatcatacagttttcatt

SEQ ID NO: 4393412 - DNA, 14 bp, Homo sapiens
tatatcatgcaaaa

SEQ ID NO: 4393413 - DNA, 20 bp, Homo sapiens
tatatccaaaagctttttat

SEQ ID NO: 4393414 - DNA, 15 bp, Homo sapiens
tatatcctgtgtacc

SEQ ID NO: 4393415 - DNA, 20 bp, Homo sapiens
tatatcgttatcactgtgca

SEQ ID NO: 4393416 - DNA, 15 bp, Homo sapiens
tatatctattattca

SEQ ID NO: 4393417 - DNA, 14 bp, Homo sapiens
tatatctctatttg

SEQ ID NO: 4393418 - DNA, 15 bp, Homo sapiens
tatatctctatttga

SEQ ID NO: 4393419 - DNA, 14 bp, Homo sapiens
tatatctgtaatga

SEQ ID NO: 4393420 - DNA, 17 bp, Homo sapiens
tatatcttataactgtt

SEQ ID NO: 4393421 - DNA, 14 bp, Homo sapiens
tatatcttcttata

SEQ ID NO: 4393422 - DNA, 18 bp, Homo sapiens
tatatctttaataagtaa

SEQ ID NO: 4393423 - DNA, 14 bp, Homo sapiens
tatatgaaaacctg

SEQ ID NO: 4393424 - DNA, 13 bp, Homo sapiens
tatatgaacatag

SEQ ID NO: 4393425 - DNA, 15 bp, Homo sapiens
tatatgaccagaagc

SEQ ID NO: 4393426 - DNA, 15 bp, Homo sapiens
tatatgagaagaata

SEQ ID NO: 4393427 - DNA, 17 bp, Homo sapiens
tatatgaggctacagaa

SEQ ID NO: 4393428 - DNA, 13 bp, Homo sapiens
tatatgatatgca

SEQ ID NO: 4393429 - DNA, 16 bp, Homo sapiens
tatatgatatgcatgt

SEQ ID NO: 4393430 - DNA, 21 bp, Homo sapiens
tatatgatatgcatgtagcat

SEQ ID NO: 4393431 - DNA, 17 bp, Homo sapiens
tatatgcacaaaactac

SEQ ID NO: 4393432 - DNA, 21 bp, Homo sapiens
tatatgcacttataattttcc

SEQ ID NO: 4393433 - DNA, 16 bp, Homo sapiens
tatatgctgtatttct

SEQ ID NO: 4393434 - DNA, 16 bp, Homo sapiens
tatatgcttactgata

SEQ ID NO: 4393435 - DNA, 20 bp, Homo sapiens
tatatgggggaaaattattt

SEQ ID NO: 4393436 - DNA, 21 bp, Homo sapiens
tatatgggggaaaattatttt

SEQ ID NO: 4393437 - DNA, 23 bp, Homo sapiens
tatatgggggaaaattattttga

SEQ ID NO: 4393438 - DNA, 13 bp, Homo sapiens
tatatgtaaatgt

SEQ ID NO: 4393439 - DNA, 12 bp, Homo sapiens
tatatgtatgta

SEQ ID NO: 4393440 - DNA, 16 bp, Homo sapiens
tatatgtatttaagat

SEQ ID NO: 4393441 - DNA, 18 bp, Homo sapiens
tatatgtatttaagatgt

SEQ ID NO: 4393442 - DNA, 18 bp, Homo sapiens
tatatgtgaaaggatatg

SEQ ID NO: 4393443 - DNA, 14 bp, Homo sapiens
tatatgtgagaaat

SEQ ID NO: 4393444 - DNA, 15 bp, Homo sapiens
tatatgtgtatacat

SEQ ID NO: 4393445 - DNA, 12 bp, Homo sapiens
tatattaaaaca

SEQ ID NO: 4393446 - DNA, 13 bp, Homo sapiens
tatattaaacaaa

SEQ ID NO: 4393447 - DNA, 12 bp, Homo sapiens
tatattaaatga

SEQ ID NO: 4393448 - DNA, 13 bp, Homo sapiens
tatattaaatgag

SEQ ID NO: 4393449 - DNA, 15 bp, Homo sapiens
tatattaatagtaat

SEQ ID NO: 4393450 - DNA, 22 bp, Homo sapiens
tatattaatagtaatttgtaaa

SEQ ID NO: 4393451 - DNA, 12 bp, Homo sapiens
tatattacaatg

SEQ ID NO: 4393452 - DNA, 22 bp, Homo sapiens
tatattagatcaaatagttgca

SEQ ID NO: 4393453 - DNA, 12 bp, Homo sapiens
tatattatatac

SEQ ID NO: 4393454 - DNA, 13 bp, Homo sapiens
tatattatgtgaa

SEQ ID NO: 4393455 - DNA, 15 bp, Homo sapiens
tatattatgtgaaga

SEQ ID NO: 4393456 - DNA, 17 bp, Homo sapiens
tatattatgtgaagaat

SEQ ID NO: 4393457 - DNA, 18 bp, Homo sapiens
tatattatgtgaagaatt

SEQ ID NO: 4393458 - DNA, 13 bp, Homo sapiens
tatattatgttta

SEQ ID NO: 4393459 - DNA, 19 bp, Homo sapiens
tatattcaaattatgtata

SEQ ID NO: 4393460 - DNA, 12 bp, Homo sapiens
tatattcacaga

SEQ ID NO: 4393461 - DNA, 21 bp, Homo sapiens
tatattccaggtttaagtaga

SEQ ID NO: 4393462 - DNA, 14 bp, Homo sapiens
tatattcccaagct

SEQ ID NO: 4393463 - DNA, 21 bp, Homo sapiens
tatattgaacttttgtactga

SEQ ID NO: 4393464 - DNA, 14 bp, Homo sapiens
tatattgcaatgaa

SEQ ID NO: 4393465 - DNA, 16 bp, Homo sapiens
tatattggtttgcaca

SEQ ID NO: 4393466 - DNA, 21 bp, Homo sapiens
tatattggtttgcacaagttc

SEQ ID NO: 4393467 - DNA, 12 bp, Homo sapiens
tatattgtaatt

SEQ ID NO: 4393468 - DNA, 15 bp, Homo sapiens
tatattgtattaagg

SEQ ID NO: 4393469 - DNA, 19 bp, Homo sapiens
tatattgttcagcatgcaa

SEQ ID NO: 4393470 - DNA, 22 bp, Homo sapiens
tatattgtttttatatattata

SEQ ID NO: 4393471 - DNA, 23 bp, Homo sapiens
tatatttaaaaaattatggaata

SEQ ID NO: 4393472 - DNA, 22 bp, Homo sapiens
tatatttagttacgtataatgc

SEQ ID NO: 4393473 - DNA, 13 bp, Homo sapiens
tatatttccttta

SEQ ID NO: 4393474 - DNA, 20 bp, Homo sapiens
tatatttcctttatgtgaat

SEQ ID NO: 4393475 - DNA, 18 bp, Homo sapiens
tatatttcttcttctaag

SEQ ID NO: 4393476 - DNA, 18 bp, Homo sapiens
tatatttgaaataaagtt

SEQ ID NO: 4393477 - DNA, 16 bp, Homo sapiens
tatatttgaaatagta

SEQ ID NO: 4393478 - DNA, 16 bp, Homo sapiens
tatatttgtgctatag

SEQ ID NO: 4393479 - DNA, 21 bp, Homo sapiens
tatatttgtgctatagtattt

SEQ ID NO: 4393480 - DNA, 17 bp, Homo sapiens
tatattttatttcaatg

SEQ ID NO: 4393481 - DNA, 18 bp, Homo sapiens
tatattttatttcaatgt

SEQ ID NO: 4393482 - DNA, 21 bp, Homo sapiens
tatattttctgtatttaatta

SEQ ID NO: 4393483 - DNA, 17 bp, Homo sapiens
tatattttgtttacaaa

SEQ ID NO: 4393484 - DNA, 13 bp, Homo sapiens
tatatttttatct

SEQ ID NO: 4393485 - DNA, 14 bp, Homo sapiens
tatcaaaagaaaga

SEQ ID NO: 4393486 - DNA, 16 bp, Homo sapiens
tatcaaagagaagatg

SEQ ID NO: 4393487 - DNA, 20 bp, Homo sapiens
tatcaaagagaagatgcctg

SEQ ID NO: 4393488 - DNA, 14 bp, Homo sapiens
tatcaaataaaatt

SEQ ID NO: 4393489 - DNA, 15 bp, Homo sapiens
tatcaaatctaccac

SEQ ID NO: 4393490 - DNA, 14 bp, Homo sapiens
tatcaaatgaaaca

SEQ ID NO: 4393491 - DNA, 15 bp, Homo sapiens
tatcaaatgaaacag

SEQ ID NO: 4393492 - DNA, 23 bp, Homo sapiens
tatcaaatgcagtatatttcttc

SEQ ID NO: 4393493 - DNA, 19 bp, Homo sapiens
tatcaacttcgctagaaaa

SEQ ID NO: 4393494 - DNA, 16 bp, Homo sapiens
tatcaagcaacattct

SEQ ID NO: 4393495 - DNA, 18 bp, Homo sapiens
tatcaagcaacattcttg

SEQ ID NO: 4393496 - DNA, 15 bp, Homo sapiens
tatcaataaaattct

SEQ ID NO: 4393497 - DNA, 17 bp, Homo sapiens
tatcaataaaattctgt

SEQ ID NO: 4393498 - DNA, 18 bp, Homo sapiens
tatcaataaaattctgta

SEQ ID NO: 4393499 - DNA, 12 bp, Homo sapiens
tatcaatgtgtc

SEQ ID NO: 4393500 - DNA, 21 bp, Homo sapiens
tatcaatttctaatgtttact

SEQ ID NO: 4393501 - DNA, 13 bp, Homo sapiens
tatcaattttaag

SEQ ID NO: 4393502 - DNA, 17 bp, Homo sapiens
tatcaattttaaggaaa

SEQ ID NO: 4393503 - DNA, 14 bp, Homo sapiens
tatcacaaatctta

SEQ ID NO: 4393504 - DNA, 12 bp, Homo sapiens
tatcacagtgtt

SEQ ID NO: 4393505 - DNA, 21 bp, Homo sapiens
tatcacataagagagatgaga

SEQ ID NO: 4393506 - DNA, 18 bp, Homo sapiens
tatcacatgttttctctg

SEQ ID NO: 4393507 - DNA, 18 bp, Homo sapiens
tatcacctcgagaagtaa

SEQ ID NO: 4393508 - DNA, 13 bp, Homo sapiens
tatcactaaataa

SEQ ID NO: 4393509 - DNA, 19 bp, Homo sapiens
tatcactcattaattaacc

SEQ ID NO: 4393510 - DNA, 16 bp, Homo sapiens
tatcactgcagtcacc

SEQ ID NO: 4393511 - DNA, 19 bp, Homo sapiens
tatcactgcagtcacctct

SEQ ID NO: 4393512 - DNA, 12 bp, Homo sapiens
tatcactgctgc

SEQ ID NO: 4393513 - DNA, 13 bp, Homo sapiens
tatcagaatttgt

SEQ ID NO: 4393514 - DNA, 20 bp, Homo sapiens
tatcagaatttgtgttgaag

SEQ ID NO: 4393515 - DNA, 14 bp, Homo sapiens
tatcagagatgtcc

SEQ ID NO: 4393516 - DNA, 14 bp, Homo sapiens
tatcagcaaagaaa

SEQ ID NO: 4393517 - DNA, 20 bp, Homo sapiens
tatcagcatctgacaggtga

SEQ ID NO: 4393518 - DNA, 14 bp, Homo sapiens
tatcagctactgta

SEQ ID NO: 4393519 - DNA, 16 bp, Homo sapiens
tatcagctactgtagt

SEQ ID NO: 4393520 - DNA, 21 bp, Homo sapiens
tatcaggacccagaggaaggg

SEQ ID NO: 4393521 - DNA, 13 bp, Homo sapiens
tatcaggtaataa

SEQ ID NO: 4393522 - DNA, 14 bp, Homo sapiens
tatcaggtaataaa

SEQ ID NO: 4393523 - DNA, 14 bp, Homo sapiens
tatcagtattctga

SEQ ID NO: 4393524 - DNA, 21 bp, Homo sapiens
tatcagtcaatatttttagat

SEQ ID NO: 4393525 - DNA, 16 bp, Homo sapiens
tatcagtgtcctttcc

SEQ ID NO: 4393526 - DNA, 15 bp, Homo sapiens
tatcagttactcagc

SEQ ID NO: 4393527 - DNA, 16 bp, Homo sapiens
tatcagttactcagcc

SEQ ID NO: 4393528 - DNA, 21 bp, Homo sapiens
tatcagttgagcttcatatac

SEQ ID NO: 4393529 - DNA, 12 bp, Homo sapiens
tatcatacagtt

SEQ ID NO: 4393530 - DNA, 13 bp, Homo sapiens
tatcatacagttt

SEQ ID NO: 4393531 - DNA, 14 bp, Homo sapiens
tatcatacagtttt

SEQ ID NO: 4393532 - DNA, 20 bp, Homo sapiens
tatcatactgttttgaataa

SEQ ID NO: 4393533 - DNA, 12 bp, Homo sapiens
tatcatagcaaa

SEQ ID NO: 4393534 - DNA, 13 bp, Homo sapiens
tatcatagttaac

SEQ ID NO: 4393535 - DNA, 17 bp, Homo sapiens
tatcatatattaaaaca

SEQ ID NO: 4393536 - DNA, 21 bp, Homo sapiens
tatcatatattaaaacaataa

SEQ ID NO: 4393537 - DNA, 16 bp, Homo sapiens
tatcatatccttgccc

SEQ ID NO: 4393538 - DNA, 18 bp, Homo sapiens
tatcatcacgtatgttat

SEQ ID NO: 4393539 - DNA, 13 bp, Homo sapiens
tatcatctttgcc

SEQ ID NO: 4393540 - DNA, 13 bp, Homo sapiens
tatcatgaagcct

SEQ ID NO: 4393541 - DNA, 24 bp, Homo sapiens
tatcatgaattttaaagtatgcat

SEQ ID NO: 4393542 - DNA, 13 bp, Homo sapiens
tatcatgcaaaat

SEQ ID NO: 4393543 - DNA, 19 bp, Homo sapiens
tatcatgcatgtcctgtaa

SEQ ID NO: 4393544 - DNA, 17 bp, Homo sapiens
tatcatggaagaaaagg

SEQ ID NO: 4393545 - DNA, 15 bp, Homo sapiens
tatcatgttaaatta

SEQ ID NO: 4393546 - DNA, 19 bp, Homo sapiens
tatcatgttaaattagaat

SEQ ID NO: 4393547 - DNA, 22 bp, Homo sapiens
tatcattcaagtgtaaaatatt

SEQ ID NO: 4393548 - DNA, 13 bp, Homo sapiens
tatcattcatctt

SEQ ID NO: 4393549 - DNA, 17 bp, Homo sapiens
tatcatttcttaaccca

SEQ ID NO: 4393550 - DNA, 19 bp, Homo sapiens
tatccaaaaatagccctgc

SEQ ID NO: 4393551 - DNA, 14 bp, Homo sapiens
tatccaaacatgta

SEQ ID NO: 4393552 - DNA, 22 bp, Homo sapiens
tatccacaattattggcaaagt

SEQ ID NO: 4393553 - DNA, 15 bp, Homo sapiens
tatccaccactttaa

SEQ ID NO: 4393554 - DNA, 21 bp, Homo sapiens
tagcttctcttctttctgaag

SEQ ID NO: 4393555 - DNA, 17 bp, Homo sapiens
tagcttgaagcccaaga

SEQ ID NO: 4393556 - DNA, 23 bp, Homo sapiens
tagcttgtctgtgatctctgctg

SEQ ID NO: 4393557 - DNA, 13 bp, Homo sapiens
tagctttcctggt

SEQ ID NO: 4393558 - DNA, 15 bp, Homo sapiens
tagcttttgatgtct

SEQ ID NO: 4393559 - DNA, 15 bp, Homo sapiens
tagctttttattatt

SEQ ID NO: 4393560 - DNA, 22 bp, Homo sapiens
taggaaaaaaactgggataact

SEQ ID NO: 4393561 - DNA, 14 bp, Homo sapiens
taggaaactgaagc

SEQ ID NO: 4393562 - DNA, 20 bp, Homo sapiens
taggaaactgaagcataaag

SEQ ID NO: 4393563 - DNA, 16 bp, Homo sapiens
taggaacatatgaaaa

SEQ ID NO: 4393564 - DNA, 23 bp, Homo sapiens
taggaagaacgttttttcctcag

SEQ ID NO: 4393565 - DNA, 18 bp, Homo sapiens
taggaagagcaggactcc

SEQ ID NO: 4393566 - DNA, 16 bp, Homo sapiens
taggaaggattttctt

SEQ ID NO: 4393567 - DNA, 21 bp, Homo sapiens
taggaagtgaacccatatttt

SEQ ID NO: 4393568 - DNA, 14 bp, Homo sapiens
taggaatttgtatt

SEQ ID NO: 4393569 - DNA, 14 bp, Homo sapiens
taggacaagtttta

SEQ ID NO: 4393570 - DNA, 19 bp, Homo sapiens
taggacagcaaagcagcag

SEQ ID NO: 4393571 - DNA, 16 bp, Homo sapiens
taggactggtgcctgg

SEQ ID NO: 4393572 - DNA, 20 bp, Homo sapiens
taggactggtgcctggcaca

SEQ ID NO: 4393573 - DNA, 16 bp, Homo sapiens
taggagggtgggaagg

SEQ ID NO: 4393574 - DNA, 19 bp, Homo sapiens
taggaggtgtgggtgcctt

SEQ ID NO: 4393575 - DNA, 15 bp, Homo sapiens
taggagtatttttgg

SEQ ID NO: 4393576 - DNA, 15 bp, Homo sapiens
taggatacaatgtat

SEQ ID NO: 4393577 - DNA, 20 bp, Homo sapiens
taggatgacaggctctcctg

SEQ ID NO: 4393578 - DNA, 17 bp, Homo sapiens
taggatggggctcccag

SEQ ID NO: 4393579 - DNA, 23 bp, Homo sapiens
taggatgtatattttatataaag

SEQ ID NO: 4393580 - DNA, 21 bp, Homo sapiens
taggatttatttaaaatagca

SEQ ID NO: 4393581 - DNA, 13 bp, Homo sapiens
taggattttcaca

SEQ ID NO: 4393582 - DNA, 13 bp, Homo sapiens
taggatttttaga

SEQ ID NO: 4393583 - DNA, 19 bp, Homo sapiens
taggcaaagataatttatt

SEQ ID NO: 4393584 - DNA, 22 bp, Homo sapiens
taggcacttttattttcattgt

SEQ ID NO: 4393585 - DNA, 15 bp, Homo sapiens
taggcaggacctgtg

SEQ ID NO: 4393586 - DNA, 14 bp, Homo sapiens
taggcagggggccc

SEQ ID NO: 4393587 - DNA, 15 bp, Homo sapiens
taggcagggggccct

SEQ ID NO: 4393588 - DNA, 16 bp, Homo sapiens
taggcagggggccctg

SEQ ID NO: 4393589 - DNA, 17 bp, Homo sapiens
taggcagggggccctgc

SEQ ID NO: 4393590 - DNA, 16 bp, Homo sapiens
taggcatgtcccaccc

SEQ ID NO: 4393591 - DNA, 20 bp, Homo sapiens
taggcatttcattatgcttt

SEQ ID NO: 4393592 - DNA, 23 bp, Homo sapiens
taggcatttcattatgctttgaa

SEQ ID NO: 4393593 - DNA, 22 bp, Homo sapiens
taggcctactggggatcagagt

SEQ ID NO: 4393594 - DNA, 14 bp, Homo sapiens
taggcctgaaatga

SEQ ID NO: 4393595 - DNA, 19 bp, Homo sapiens
taggcctgtcccttgcctc

SEQ ID NO: 4393596 - DNA, 20 bp, Homo sapiens
taggcctgtcccttgcctct

SEQ ID NO: 4393597 - DNA, 15 bp, Homo sapiens
taggctaaaaggctt

SEQ ID NO: 4393598 - DNA, 19 bp, Homo sapiens
taggctaaaaggcttccag

SEQ ID NO: 4393599 - DNA, 13 bp, Homo sapiens
taggctaaatgtt

SEQ ID NO: 4393600 - DNA, 24 bp, Homo sapiens
taggctagagacagatgctggtgg

SEQ ID NO: 4393601 - DNA, 15 bp, Homo sapiens
taggctagggtgggg

SEQ ID NO: 4393602 - DNA, 16 bp, Homo sapiens
taggctattaaaaaag

SEQ ID NO: 4393603 - DNA, 19 bp, Homo sapiens
taggctgatgggcaaaaaa

SEQ ID NO: 4393604 - DNA, 19 bp, Homo sapiens
taggcttcaggttgcattg

SEQ ID NO: 4393605 - DNA, 20 bp, Homo sapiens
tagggacccctcgccccagc

SEQ ID NO: 4393606 - DNA, 18 bp, Homo sapiens
tagggactatcaggtaat

SEQ ID NO: 4393607 - DNA, 15 bp, Homo sapiens
tagggagagaagata

SEQ ID NO: 4393608 - DNA, 17 bp, Homo sapiens
tagggatccctcatctg

SEQ ID NO: 4393609 - DNA, 16 bp, Homo sapiens
tagggattcaggctgc

SEQ ID NO: 4393610 - DNA, 20 bp, Homo sapiens
tagggctgggcaaggaaaaa

SEQ ID NO: 4393611 - DNA, 19 bp, Homo sapiens
taggggaagtaaaacagtc

SEQ ID NO: 4393612 - DNA, 17 bp, Homo sapiens
taggggccaataaaatg

SEQ ID NO: 4393613 - DNA, 21 bp, Homo sapiens
taggggcttataataaaggac

SEQ ID NO: 4393614 - DNA, 23 bp, Homo sapiens
taggggcttataataaaggactg

SEQ ID NO: 4393615 - DNA, 18 bp, Homo sapiens
tagggtataatgtgtctg

SEQ ID NO: 4393616 - DNA, 13 bp, Homo sapiens
tagggttatattt

SEQ ID NO: 4393617 - DNA, 17 bp, Homo sapiens
tagggttatatttggga

SEQ ID NO: 4393618 - DNA, 19 bp, Homo sapiens
tagggttctaaatgcaata

SEQ ID NO: 4393619 - DNA, 14 bp, Homo sapiens
taggtaaaatgtat

SEQ ID NO: 4393620 - DNA, 15 bp, Homo sapiens
taggtaaaatgtatt

SEQ ID NO: 4393621 - DNA, 16 bp, Homo sapiens
taggtaaaatgtattt

SEQ ID NO: 4393622 - DNA, 16 bp, Homo sapiens
taggtagtaccaaaat

SEQ ID NO: 4393623 - DNA, 19 bp, Homo sapiens
taggtcaagtaataaaaag

SEQ ID NO: 4393624 - DNA, 20 bp, Homo sapiens
taggtcaagtaataaaaaga

SEQ ID NO: 4393625 - DNA, 23 bp, Homo sapiens
taggtcattcttttgccacatcc

SEQ ID NO: 4393626 - DNA, 15 bp, Homo sapiens
taggtcattgcacct

SEQ ID NO: 4393627 - DNA, 20 bp, Homo sapiens
taggtctcctcagggtgggg

SEQ ID NO: 4393628 - DNA, 21 bp, Homo sapiens
taggtctcctcagggtggggg

SEQ ID NO: 4393629 - DNA, 12 bp, Homo sapiens
taggtctggttg

SEQ ID NO: 4393630 - DNA, 12 bp, Homo sapiens
taggtctttctc

SEQ ID NO: 4393631 - DNA, 18 bp, Homo sapiens
taggtgctacaaaaacac

SEQ ID NO: 4393632 - DNA, 22 bp, Homo sapiens
taggttgttaccaagtatgaag

SEQ ID NO: 4393633 - DNA, 20 bp, Homo sapiens
taggtttctaaaaagtcaga

SEQ ID NO: 4393634 - DNA, 18 bp, Homo sapiens
tagtaaaatgttttcatt

SEQ ID NO: 4393635 - DNA, 15 bp, Homo sapiens
tagtaaaatttattt

SEQ ID NO: 4393636 - DNA, 14 bp, Homo sapiens
tagtaaacatatgt

SEQ ID NO: 4393637 - DNA, 14 bp, Homo sapiens
tagtaaatgttaac

SEQ ID NO: 4393638 - DNA, 13 bp, Homo sapiens
tagtaaatgttat

SEQ ID NO: 4393639 - DNA, 23 bp, Homo sapiens
tagtaacaatacatgagaaagat

SEQ ID NO: 4393640 - DNA, 21 bp, Homo sapiens
tagtaacctttaaaaatgtat

SEQ ID NO: 4393641 - DNA, 19 bp, Homo sapiens
tagtaacttcttatggaat

SEQ ID NO: 4393642 - DNA, 21 bp, Homo sapiens
tagtaagatctctttctaaag

SEQ ID NO: 4393643 - DNA, 16 bp, Homo sapiens
tagtaagtatttccat

SEQ ID NO: 4393644 - DNA, 20 bp, Homo sapiens
tagtaagtttttcttcatga

SEQ ID NO: 4393645 - DNA, 13 bp, Homo sapiens
tagtaatctgtat

SEQ ID NO: 4393646 - DNA, 15 bp, Homo sapiens
tagtaatgagtttaa

SEQ ID NO: 4393647 - DNA, 17 bp, Homo sapiens
tagtaatgagtttaaaa

SEQ ID NO: 4393648 - DNA, 21 bp, Homo sapiens
tagtaatttctttttttcctt

SEQ ID NO: 4393649 - DNA, 14 bp, Homo sapiens
tagtaatttgtaaa

SEQ ID NO: 4393650 - DNA, 20 bp, Homo sapiens
tagtacaatagtatacattt

SEQ ID NO: 4393651 - DNA, 14 bp, Homo sapiens
tagtacaatttcaa

SEQ ID NO: 4393652 - DNA, 21 bp, Homo sapiens
tagtacaatttcaactacagt

SEQ ID NO: 4393653 - DNA, 23 bp, Homo sapiens
tagtactagagatattttgtaaa

SEQ ID NO: 4393654 - DNA, 18 bp, Homo sapiens
tagtactagtactattgc

SEQ ID NO: 4393655 - DNA, 14 bp, Homo sapiens
tagtactattacta

SEQ ID NO: 4393656 - DNA, 22 bp, Homo sapiens
tagtactattatggaattactc

SEQ ID NO: 4393657 - DNA, 17 bp, Homo sapiens
tagtaggaatgtacatg

SEQ ID NO: 4393658 - DNA, 17 bp, Homo sapiens
tagtatacgtataaata

SEQ ID NO: 4393659 - DNA, 19 bp, Homo sapiens
tagtatgttcaactctcat

SEQ ID NO: 4393660 - DNA, 21 bp, Homo sapiens
tagtattaccaccctttcaca

SEQ ID NO: 4393661 - DNA, 23 bp, Homo sapiens
tagtattaccaccctttcacaag

SEQ ID NO: 4393662 - DNA, 23 bp, Homo sapiens
tagtattcaggcactgagaatga

SEQ ID NO: 4393663 - DNA, 20 bp, Homo sapiens
tagtattcttgagggacaat

SEQ ID NO: 4393664 - DNA, 22 bp, Homo sapiens
tagtatttaactacatctgcct

SEQ ID NO: 4393665 - DNA, 23 bp, Homo sapiens
tagtatttaactacatctgcctc

SEQ ID NO: 4393666 - DNA, 12 bp, Homo sapiens
tagtatttctcc

SEQ ID NO: 4393667 - DNA, 19 bp, Homo sapiens
tagtatttctcctttgcaa

SEQ ID NO: 4393668 - DNA, 12 bp, Homo sapiens
tagtatttgatt

SEQ ID NO: 4393669 - DNA, 21 bp, Homo sapiens
tagtatttttactattataat

SEQ ID NO: 4393670 - DNA, 18 bp, Homo sapiens
tagtattttttgtataat

SEQ ID NO: 4393671 - DNA, 19 bp, Homo sapiens
tagtcaaaaacaaagctga

SEQ ID NO: 4393672 - DNA, 16 bp, Homo sapiens
tagtcaaaaattaaat

SEQ ID NO: 4393673 - DNA, 16 bp, Homo sapiens
tagtcaatttctactt

SEQ ID NO: 4393674 - DNA, 20 bp, Homo sapiens
tagtcactggcatactgaga

SEQ ID NO: 4393675 - DNA, 19 bp, Homo sapiens
tagtcatcagatatgctta

SEQ ID NO: 4393676 - DNA, 19 bp, Homo sapiens
tagtcatggataactacat

SEQ ID NO: 4393677 - DNA, 17 bp, Homo sapiens
tagtcattaacccatct

SEQ ID NO: 4393678 - DNA, 15 bp, Homo sapiens
tagtccaccttcatt

SEQ ID NO: 4393679 - DNA, 18 bp, Homo sapiens
tagtccctcatgcaaatc

SEQ ID NO: 4393680 - DNA, 23 bp, Homo sapiens
tagtcccttcccctccctggctc

SEQ ID NO: 4393681 - DNA, 13 bp, Homo sapiens
tagtccttggcat

SEQ ID NO: 4393682 - DNA, 19 bp, Homo sapiens
tagtctcactgcttgaact

SEQ ID NO: 4393683 - DNA, 17 bp, Homo sapiens
tagtctcgctaaagtta

SEQ ID NO: 4393684 - DNA, 15 bp, Homo sapiens
tagtctgaaactggc

SEQ ID NO: 4393685 - DNA, 18 bp, Homo sapiens
tagtctgaaactggcttc

SEQ ID NO: 4393686 - DNA, 22 bp, Homo sapiens
tagtctgtgtgggactgtacac

SEQ ID NO: 4393687 - DNA, 16 bp, Homo sapiens
tagtcttgaaatgaaa

SEQ ID NO: 4393688 - DNA, 21 bp, Homo sapiens
tagtcttgtcccaattaaaat

SEQ ID NO: 4393689 - DNA, 19 bp, Homo sapiens
tagtctttagctattactg

SEQ ID NO: 4393690 - DNA, 18 bp, Homo sapiens
tagtctttgccagtcatt

SEQ ID NO: 4393691 - DNA, 15 bp, Homo sapiens
tagtctttggagaaa

SEQ ID NO: 4393692 - DNA, 15 bp, Homo sapiens
tagtctttgtttaca

SEQ ID NO: 4393693 - DNA, 15 bp, Homo sapiens
tagtctttttttcct

SEQ ID NO: 4393694 - DNA, 11 bp, Homo sapiens
tagtgaaaaat

SEQ ID NO: 4393695 - DNA, 19 bp, Homo sapiens
tagtgaaggcttctctctg

SEQ ID NO: 4393696 - DNA, 22 bp, Homo sapiens
tagtgacctgtgtttcacttaa

SEQ ID NO: 4393697 - DNA, 12 bp, Homo sapiens
tagtgagccaag

SEQ ID NO: 4393698 - DNA, 19 bp, Homo sapiens
tagtgatcaaattgtgcag

SEQ ID NO: 4393699 - DNA, 21 bp, Homo sapiens
tagtgatggagttccttctgg

SEQ ID NO: 4393700 - DNA, 20 bp, Homo sapiens
tagtgcaaaaactgtaaaag

SEQ ID NO: 4393701 - DNA, 22 bp, Homo sapiens
tagtgcaaaaactgtaaaagtg

SEQ ID NO: 4393702 - DNA, 23 bp, Homo sapiens
tagtgcaattccaagaaaatatc

SEQ ID NO: 4393703 - DNA, 16 bp, Homo sapiens
tagtgccacccacctt

SEQ ID NO: 4393704 - DNA, 22 bp, Homo sapiens
tagtgctgctgtgtgctttttt

SEQ ID NO: 4393705 - DNA, 13 bp, Homo sapiens
tagtggaaaaaca

SEQ ID NO: 4393706 - DNA, 16 bp, Homo sapiens
tagtggaaaataggct

SEQ ID NO: 4393707 - DNA, 17 bp, Homo sapiens
tagtggaacattttcat

SEQ ID NO: 4393708 - DNA, 17 bp, Homo sapiens
tagtggattactgccat

SEQ ID NO: 4393709 - DNA, 23 bp, Homo sapiens
tagtggattactgccattcactt

SEQ ID NO: 4393710 - DNA, 21 bp, Homo sapiens
tagtggcataccaaatggcac

SEQ ID NO: 4393711 - DNA, 14 bp, Homo sapiens
tagtggccactggg

SEQ ID NO: 4393712 - DNA, 18 bp, Homo sapiens
tagtggggtctccctctc

SEQ ID NO: 4393713 - DNA, 21 bp, Homo sapiens
tagtggggtctccctctcctg

SEQ ID NO: 4393714 - DNA, 23 bp, Homo sapiens
tagtggggtctccctctcctgcc

SEQ ID NO: 4393715 - DNA, 19 bp, Homo sapiens
tagtggttaacagagctaa

SEQ ID NO: 4393716 - DNA, 15 bp, Homo sapiens
tagtgtaagaactgt

SEQ ID NO: 4393717 - DNA, 18 bp, Homo sapiens
tagtgtaagaactgtaca

SEQ ID NO: 4393718 - DNA, 19 bp, Homo sapiens
tagtgtctggatcagtaaa

SEQ ID NO: 4393719 - DNA, 21 bp, Homo sapiens
tagtgtctggatcagtaaaat

SEQ ID NO: 4393720 - DNA, 17 bp, Homo sapiens
tagtgtgaaatatatta

SEQ ID NO: 4393721 - DNA, 15 bp, Homo sapiens
tagtgtgaagttgat

SEQ ID NO: 4393722 - DNA, 12 bp, Homo sapiens
tagtgtgtaaaa

SEQ ID NO: 4393723 - DNA, 14 bp, Homo sapiens
tagtgtgtaaaatt

SEQ ID NO: 4393724 - DNA, 14 bp, Homo sapiens
tagtgttattgcca

SEQ ID NO: 4393725 - DNA, 16 bp, Homo sapiens
tagtgttcacaaactg

SEQ ID NO: 4393726 - DNA, 16 bp, Homo sapiens
tagtgttctctgtatt

SEQ ID NO: 4393727 - DNA, 17 bp, Homo sapiens
tagtgtttaagtcattt

SEQ ID NO: 4393728 - DNA, 13 bp, Homo sapiens
tagttaaagaaag

SEQ ID NO: 4393729 - DNA, 20 bp, Homo sapiens
tagttaagcaaatttcattt

SEQ ID NO: 4393730 - DNA, 21 bp, Homo sapiens
tagttaccttatagttactgt

SEQ ID NO: 4393731 - DNA, 23 bp, Homo sapiens
tagttaccttatagttactgtgt

SEQ ID NO: 4393732 - DNA, 18 bp, Homo sapiens
tagttacgtataatgctt

SEQ ID NO: 4393733 - DNA, 12 bp, Homo sapiens
tagttactaaaa

SEQ ID NO: 4393734 - DNA, 15 bp, Homo sapiens
tagttatataattgt

SEQ ID NO: 4393735 - DNA, 21 bp, Homo sapiens
tagttattaaatgtttcaaaa

SEQ ID NO: 4393736 - DNA, 17 bp, Homo sapiens
tagttattctgccttcc

SEQ ID NO: 4393737 - DNA, 16 bp, Homo sapiens
tagttcagaatttagt

SEQ ID NO: 4393738 - DNA, 21 bp, Homo sapiens
tagttccagtcctaactttct

SEQ ID NO: 4393739 - DNA, 15 bp, Homo sapiens
tagttcccaggtgat

SEQ ID NO: 4393740 - DNA, 20 bp, Homo sapiens
tagttctataagtgaggaag

SEQ ID NO: 4393741 - DNA, 22 bp, Homo sapiens
tagttctatccttttgcctgca

SEQ ID NO: 4393742 - DNA, 18 bp, Homo sapiens
tagttctgtaataaaact

SEQ ID NO: 4393743 - DNA, 16 bp, Homo sapiens
tagttctttcctcccc

SEQ ID NO: 4393744 - DNA, 12 bp, Homo sapiens
tagttgaaatga

SEQ ID NO: 4393745 - DNA, 16 bp, Homo sapiens
tagttgaatttcagtc

SEQ ID NO: 4393746 - DNA, 23 bp, Homo sapiens
tagttgcaaagagacatttcaaa

SEQ ID NO: 4393747 - DNA, 14 bp, Homo sapiens
tagttgcaattgaa

SEQ ID NO: 4393748 - DNA, 13 bp, Homo sapiens
tagttgccaacag

SEQ ID NO: 4393749 - DNA, 19 bp, Homo sapiens
tagttgccaacagttgtat

SEQ ID NO: 4393750 - DNA, 16 bp, Homo sapiens
tagttggcagaaatac

SEQ ID NO: 4393751 - DNA, 22 bp, Homo sapiens
tagttggctttcataaatcatg

SEQ ID NO: 4393752 - DNA, 20 bp, Homo sapiens
tagttgtagacaaagtacat

SEQ ID NO: 4393753 - DNA, 19 bp, Homo sapiens
tagttgttggtctgtagca

SEQ ID NO: 4393754 - DNA, 14 bp, Homo sapiens
tagtttatttctgt

SEQ ID NO: 4393755 - DNA, 20 bp, Homo sapiens
tagtttcatataaagtatca

SEQ ID NO: 4393756 - DNA, 13 bp, Homo sapiens
tagtttgaaagtt

SEQ ID NO: 4393757 - DNA, 22 bp, Homo sapiens
tagtttgaaagttgtacatgat

SEQ ID NO: 4393758 - DNA, 13 bp, Homo sapiens
tagtttgaatgtt

SEQ ID NO: 4393759 - DNA, 11 bp, Homo sapiens
tagtttggata

SEQ ID NO: 4393760 - DNA, 14 bp, Homo sapiens
tagtttgttaaagc

SEQ ID NO: 4393761 - DNA, 14 bp, Homo sapiens
tagtttgttcttca

SEQ ID NO: 4393762 - DNA, 15 bp, Homo sapiens
tagtttgtttttgtt

SEQ ID NO: 4393763 - DNA, 16 bp, Homo sapiens
tagttttacattttaa

SEQ ID NO: 4393764 - DNA, 20 bp, Homo sapiens
tagttttctttcctcctttc

SEQ ID NO: 4393765 - DNA, 15 bp, Homo sapiens
tagttttgtcaaact

SEQ ID NO: 4393766 - DNA, 20 bp, Homo sapiens
tagtttttcatcaagagttt

SEQ ID NO: 4393767 - DNA, 21 bp, Homo sapiens
tagtttttcattaaataaatt

SEQ ID NO: 4393768 - DNA, 10 bp, Homo sapiens
tagtttttgt

SEQ ID NO: 4393769 - DNA, 16 bp, Homo sapiens
tataaaaaagaaaact

SEQ ID NO: 4393770 - DNA, 16 bp, Homo sapiens
tataaaaaatatgtat

SEQ ID NO: 4393771 - DNA, 14 bp, Homo sapiens
tataaaaagataat

SEQ ID NO: 4393772 - DNA, 16 bp, Homo sapiens
tataaaaatataaatt

SEQ ID NO: 4393773 - DNA, 22 bp, Homo sapiens
tataaaaatataaattgtacat

SEQ ID NO: 4393774 - DNA, 21 bp, Homo sapiens
tataaaaattatcaaaaagct

SEQ ID NO: 4393775 - DNA, 18 bp, Homo sapiens
tataaaacttaaaaacaa

SEQ ID NO: 4393776 - DNA, 14 bp, Homo sapiens
tataaaagactgac

SEQ ID NO: 4393777 - DNA, 15 bp, Homo sapiens
tataaaagctttctg

SEQ ID NO: 4393778 - DNA, 17 bp, Homo sapiens
tataaaataaagcaaat

SEQ ID NO: 4393779 - DNA, 19 bp, Homo sapiens
tataaaataactaaaatgt

SEQ ID NO: 4393780 - DNA, 20 bp, Homo sapiens
tataaacatatttttatact

SEQ ID NO: 4393781 - DNA, 20 bp, Homo sapiens
tataaactaccaaattagtg

SEQ ID NO: 4393782 - DNA, 12 bp, Homo sapiens
tataaactgtat

SEQ ID NO: 4393783 - DNA, 15 bp, Homo sapiens
tataaagaatatata

SEQ ID NO: 4393784 - DNA, 14 bp, Homo sapiens
tataaagatcattt

SEQ ID NO: 4393785 - DNA, 20 bp, Homo sapiens
tataaagtatagagagaagt

SEQ ID NO: 4393786 - DNA, 14 bp, Homo sapiens
tataaataaaattg

SEQ ID NO: 4393787 - DNA, 18 bp, Homo sapiens
tataaatactgcaaatca

SEQ ID NO: 4393788 - DNA, 19 bp, Homo sapiens
tataaatatatataaagaa

SEQ ID NO: 4393789 - DNA, 19 bp, Homo sapiens
tataaatatcagtattctg

SEQ ID NO: 4393790 - DNA, 13 bp, Homo sapiens
tataaatgaatgt

SEQ ID NO: 4393791 - DNA, 15 bp, Homo sapiens
tataaatgaatgtgc

SEQ ID NO: 4393792 - DNA, 19 bp, Homo sapiens
tataaatgatatcaaagaa

SEQ ID NO: 4393793 - DNA, 16 bp, Homo sapiens
tataaatgtaaaaatg

SEQ ID NO: 4393794 - DNA, 20 bp, Homo sapiens
tagatggttacactgttaga

SEQ ID NO: 4393795 - DNA, 15 bp, Homo sapiens
tagatgtagtatttt

SEQ ID NO: 4393796 - DNA, 23 bp, Homo sapiens
tagatgtatttttgatgtatata

SEQ ID NO: 4393797 - DNA, 14 bp, Homo sapiens
tagatgtcttttat

SEQ ID NO: 4393798 - DNA, 21 bp, Homo sapiens
tagattcacctgtaaaacttt

SEQ ID NO: 4393799 - DNA, 16 bp, Homo sapiens
tagattgattgtattg

SEQ ID NO: 4393800 - DNA, 23 bp, Homo sapiens
tagattgcagaaaattctgtgcc

SEQ ID NO: 4393801 - DNA, 15 bp, Homo sapiens
tagattgtcttaatg

SEQ ID NO: 4393802 - DNA, 16 bp, Homo sapiens
tagatttcatagttca

SEQ ID NO: 4393803 - DNA, 18 bp, Homo sapiens
tagatttcatagttcaga

SEQ ID NO: 4393804 - DNA, 13 bp, Homo sapiens
tagatttgaaaaa

SEQ ID NO: 4393805 - DNA, 13 bp, Homo sapiens
tagatttgaaaat

SEQ ID NO: 4393806 - DNA, 14 bp, Homo sapiens
tagatttgaaaatt

SEQ ID NO: 4393807 - DNA, 21 bp, Homo sapiens
tagatttgaaaattgtatacc

SEQ ID NO: 4393808 - DNA, 20 bp, Homo sapiens
tagatttggctcctctgctt

SEQ ID NO: 4393809 - DNA, 16 bp, Homo sapiens
tagattttattatgtt

SEQ ID NO: 4393810 - DNA, 13 bp, Homo sapiens
tagattttctgct

SEQ ID NO: 4393811 - DNA, 18 bp, Homo sapiens
tagcaaaaatgttttcca

SEQ ID NO: 4393812 - DNA, 19 bp, Homo sapiens
tagcaaaaatgttttccaa

SEQ ID NO: 4393813 - DNA, 22 bp, Homo sapiens
tagcaaaaatgttttccaatat

SEQ ID NO: 4393814 - DNA, 12 bp, Homo sapiens
tagcaaagaatt

SEQ ID NO: 4393815 - DNA, 21 bp, Homo sapiens
tagcaaagattaaatgtgtca

SEQ ID NO: 4393816 - DNA, 15 bp, Homo sapiens
tagcaaataagtcat

SEQ ID NO: 4393817 - DNA, 17 bp, Homo sapiens
tagcaaatgtttactgt

SEQ ID NO: 4393818 - DNA, 21 bp, Homo sapiens
tagcaaatgtttactgtatca

SEQ ID NO: 4393819 - DNA, 16 bp, Homo sapiens
tagcaacaacaattgg

SEQ ID NO: 4393820 - DNA, 21 bp, Homo sapiens
tagcaactcttatttctttcc

SEQ ID NO: 4393821 - DNA, 23 bp, Homo sapiens
tagcaaggtttggtgcaaagtat

SEQ ID NO: 4393822 - DNA, 18 bp, Homo sapiens
tagcaagttacagtgatg

SEQ ID NO: 4393823 - DNA, 16 bp, Homo sapiens
tagcaataactgaaaa

SEQ ID NO: 4393824 - DNA, 17 bp, Homo sapiens
tagcaataactgaaaat

SEQ ID NO: 4393825 - DNA, 16 bp, Homo sapiens
tagcacagattttgaa

SEQ ID NO: 4393826 - DNA, 18 bp, Homo sapiens
tagcaccttcagggctga

SEQ ID NO: 4393827 - DNA, 19 bp, Homo sapiens
tagcacgtttaaagttctg

SEQ ID NO: 4393828 - DNA, 19 bp, Homo sapiens
tagcactgatagtcctttt

SEQ ID NO: 4393829 - DNA, 17 bp, Homo sapiens
tagcactgccccacatg

SEQ ID NO: 4393830 - DNA, 22 bp, Homo sapiens
tagcactgccccacatgcatgt

SEQ ID NO: 4393831 - DNA, 15 bp, Homo sapiens
tagcactggcctgca

SEQ ID NO: 4393832 - DNA, 15 bp, Homo sapiens
tagcagaaagaagag

SEQ ID NO: 4393833 - DNA, 23 bp, Homo sapiens
tagcagaaggttgcacctccccc

SEQ ID NO: 4393834 - DNA, 23 bp, Homo sapiens
tagcagacctaaagcaagcctga

SEQ ID NO: 4393835 - DNA, 14 bp, Homo sapiens
tagcagagttaaat

SEQ ID NO: 4393836 - DNA, 15 bp, Homo sapiens
tagcagcaggctcag

SEQ ID NO: 4393837 - DNA, 12 bp, Homo sapiens
tagcaggctgtt

SEQ ID NO: 4393838 - DNA, 16 bp, Homo sapiens
tagcagggattctctc

SEQ ID NO: 4393839 - DNA, 17 bp, Homo sapiens
tagcaggggcaccttcc

SEQ ID NO: 4393840 - DNA, 22 bp, Homo sapiens
tagcagtttagaatggaggaag

SEQ ID NO: 4393841 - DNA, 15 bp, Homo sapiens
tagcatataaatgtt

SEQ ID NO: 4393842 - DNA, 14 bp, Homo sapiens
tagcatccaggctg

SEQ ID NO: 4393843 - DNA, 13 bp, Homo sapiens
tagcatttggaaa

SEQ ID NO: 4393844 - DNA, 17 bp, Homo sapiens
tagcatttttctaaaac

SEQ ID NO: 4393845 - DNA, 14 bp, Homo sapiens
tagccaacatagta

SEQ ID NO: 4393846 - DNA, 19 bp, Homo sapiens
tagccacagctgctgttct

SEQ ID NO: 4393847 - DNA, 17 bp, Homo sapiens
tagccagagggtgggag

SEQ ID NO: 4393848 - DNA, 21 bp, Homo sapiens
tagccagagggtgggagccta

SEQ ID NO: 4393849 - DNA, 18 bp, Homo sapiens
tagccagcgtttattgta

SEQ ID NO: 4393850 - DNA, 18 bp, Homo sapiens
tagccagctgtcaagggc

SEQ ID NO: 4393851 - DNA, 13 bp, Homo sapiens
tagccataataaa

SEQ ID NO: 4393852 - DNA, 18 bp, Homo sapiens
tagccatttttcaaagca

SEQ ID NO: 4393853 - DNA, 19 bp, Homo sapiens
tagccatttttcaaagcaa

SEQ ID NO: 4393854 - DNA, 20 bp, Homo sapiens
tagccatttttcaaagcaat

SEQ ID NO: 4393855 - DNA, 22 bp, Homo sapiens
tagccatttttcaaagcaattg

SEQ ID NO: 4393856 - DNA, 15 bp, Homo sapiens
tagcccaagaggtct

SEQ ID NO: 4393857 - DNA, 13 bp, Homo sapiens
tagcccacccccc

SEQ ID NO: 4393858 - DNA, 16 bp, Homo sapiens
tagcccacccccctcc

SEQ ID NO: 4393859 - DNA, 22 bp, Homo sapiens
tagcccctggggtggccaccag

SEQ ID NO: 4393860 - DNA, 20 bp, Homo sapiens
tagccctcagacatttatat

SEQ ID NO: 4393861 - DNA, 15 bp, Homo sapiens
tagccctgccctccc

SEQ ID NO: 4393862 - DNA, 12 bp, Homo sapiens
tagcccttccct

SEQ ID NO: 4393863 - DNA, 13 bp, Homo sapiens
tagcccttccctg

SEQ ID NO: 4393864 - DNA, 18 bp, Homo sapiens
tagcccttccctgagtgc

SEQ ID NO: 4393865 - DNA, 15 bp, Homo sapiens
tagccgagagcctgc

SEQ ID NO: 4393866 - DNA, 19 bp, Homo sapiens
tagccgagagcctgctccc

SEQ ID NO: 4393867 - DNA, 19 bp, Homo sapiens
tagccgggcatggtggcgc

SEQ ID NO: 4393868 - DNA, 18 bp, Homo sapiens
tagcctagatatgaatat

SEQ ID NO: 4393869 - DNA, 13 bp, Homo sapiens
tagcctccctgaa

SEQ ID NO: 4393870 - DNA, 17 bp, Homo sapiens
tagcctcctcctgggct

SEQ ID NO: 4393871 - DNA, 14 bp, Homo sapiens
tagcctctcccacc

SEQ ID NO: 4393872 - DNA, 23 bp, Homo sapiens
tagcctgcactttgatgtcatgt

SEQ ID NO: 4393873 - DNA, 14 bp, Homo sapiens
tagcctggctctgc

SEQ ID NO: 4393874 - DNA, 22 bp, Homo sapiens
tagcctttacctgtgaagtgtt

SEQ ID NO: 4393875 - DNA, 14 bp, Homo sapiens
tagcggagcccagc

SEQ ID NO: 4393876 - DNA, 16 bp, Homo sapiens
tagcggagcccagcct

SEQ ID NO: 4393877 - DNA, 21 bp, Homo sapiens
tagcggcaaacctttccccct

SEQ ID NO: 4393878 - DNA, 17 bp, Homo sapiens
tagcggccctggaggat

SEQ ID NO: 4393879 - DNA, 14 bp, Homo sapiens
tagcgtcaagacat

SEQ ID NO: 4393880 - DNA, 15 bp, Homo sapiens
tagcgtcaagacatt

SEQ ID NO: 4393881 - DNA, 16 bp, Homo sapiens
tagcgtcaagacattt

SEQ ID NO: 4393882 - DNA, 20 bp, Homo sapiens
tagcgtcaagacatttgctg

SEQ ID NO: 4393883 - DNA, 18 bp, Homo sapiens
tagcgtgtgtagatagta

SEQ ID NO: 4393884 - DNA, 14 bp, Homo sapiens
tagcgttctggact

SEQ ID NO: 4393885 - DNA, 21 bp, Homo sapiens
tagcgttctggactctgcccc

SEQ ID NO: 4393886 - DNA, 22 bp, Homo sapiens
tagcgttctggactctgcccca

SEQ ID NO: 4393887 - DNA, 17 bp, Homo sapiens
tagcgttttttaaatgt

SEQ ID NO: 4393888 - DNA, 22 bp, Homo sapiens
tagcgttttttaaatgtatact

SEQ ID NO: 4393889 - DNA, 18 bp, Homo sapiens
tagctaaacggattccaa

SEQ ID NO: 4393890 - DNA, 18 bp, Homo sapiens
tagctaaattcagggaga

SEQ ID NO: 4393891 - DNA, 17 bp, Homo sapiens
tagctaactgtaaatca

SEQ ID NO: 4393892 - DNA, 15 bp, Homo sapiens
tagctacagtgcata

SEQ ID NO: 4393893 - DNA, 19 bp, Homo sapiens
tagctacctttttatattt

SEQ ID NO: 4393894 - DNA, 17 bp, Homo sapiens
tagctatttttttccta

SEQ ID NO: 4393895 - DNA, 14 bp, Homo sapiens
tagctcccctccaa

SEQ ID NO: 4393896 - DNA, 14 bp, Homo sapiens
tagctcccctggct

SEQ ID NO: 4393897 - DNA, 18 bp, Homo sapiens
tagctcccctggctggct

SEQ ID NO: 4393898 - DNA, 18 bp, Homo sapiens
tagctcggcaccaactaa

SEQ ID NO: 4393899 - DNA, 11 bp, Homo sapiens
tagctctccca

SEQ ID NO: 4393900 - DNA, 14 bp, Homo sapiens
tagctctcccagtg

SEQ ID NO: 4393901 - DNA, 14 bp, Homo sapiens
tagctctgcctccc

SEQ ID NO: 4393902 - DNA, 11 bp, Homo sapiens
tagctctgggg

SEQ ID NO: 4393903 - DNA, 19 bp, Homo sapiens
tagctcttttttgtttgtt

SEQ ID NO: 4393904 - DNA, 23 bp, Homo sapiens
tagctgccttcaaggactgtttc

SEQ ID NO: 4393905 - DNA, 15 bp, Homo sapiens
tagctgggattacag

SEQ ID NO: 4393906 - DNA, 14 bp, Homo sapiens
tagctgtggtgagg

SEQ ID NO: 4393907 - DNA, 17 bp, Homo sapiens
tagctgttctaattaag

SEQ ID NO: 4393908 - DNA, 14 bp, Homo sapiens
tagctgtttcaaat

SEQ ID NO: 4393909 - DNA, 15 bp, Homo sapiens
tagctgtttcaaatg

SEQ ID NO: 4393910 - DNA, 18 bp, Homo sapiens
tagctgtttcaaatgtgc

SEQ ID NO: 4393911 - DNA, 16 bp, Homo sapiens
tagctgttttggaacg

SEQ ID NO: 4393912 - DNA, 16 bp, Homo sapiens
tagcttaagtgtaaat

SEQ ID NO: 4393913 - DNA, 15 bp, Homo sapiens
tagcttatctgcccc

SEQ ID NO: 4393914 - DNA, 14 bp, Homo sapiens
tagcttcagtcatt

SEQ ID NO: 4393915 - DNA, 13 bp, Homo sapiens
taaattaggcagt

SEQ ID NO: 4393916 - DNA, 13 bp, Homo sapiens
taaattataagga

SEQ ID NO: 4393917 - DNA, 17 bp, Homo sapiens
taaattataaggactgc

SEQ ID NO: 4393918 - DNA, 21 bp, Homo sapiens
taaattatatgatatgcatgt

SEQ ID NO: 4393919 - DNA, 22 bp, Homo sapiens
taaattatatgatatgcatgta

SEQ ID NO: 4393920 - DNA, 21 bp, Homo sapiens
taaattatatttgtgctatag

SEQ ID NO: 4393921 - DNA, 23 bp, Homo sapiens
taaattatgagctatcctttcaa

SEQ ID NO: 4393922 - DNA, 13 bp, Homo sapiens
taaattattactt

SEQ ID NO: 4393923 - DNA, 17 bp, Homo sapiens
taaattattactttaaa

SEQ ID NO: 4393924 - DNA, 22 bp, Homo sapiens
taaattattttatatcatacag

SEQ ID NO: 4393925 - DNA, 15 bp, Homo sapiens
taaattcaaagaagt

SEQ ID NO: 4393926 - DNA, 18 bp, Homo sapiens
taaattcactttcatttt

SEQ ID NO: 4393927 - DNA, 20 bp, Homo sapiens
taaattccacagattatcaa

SEQ ID NO: 4393928 - DNA, 21 bp, Homo sapiens
taaattccatatgctccagga

SEQ ID NO: 4393929 - DNA, 18 bp, Homo sapiens
taaattcccgttttgtca

SEQ ID NO: 4393930 - DNA, 20 bp, Homo sapiens
taaattcctcaacagtgttt

SEQ ID NO: 4393931 - DNA, 22 bp, Homo sapiens
taaattctctctcttgcaggaa

SEQ ID NO: 4393932 - DNA, 18 bp, Homo sapiens
taaattcttttttaaatt

SEQ ID NO: 4393933 - DNA, 19 bp, Homo sapiens
taaattcttttttaaattt

SEQ ID NO: 4393934 - DNA, 20 bp, Homo sapiens
taaattcttttttaaatttt

SEQ ID NO: 4393935 - DNA, 13 bp, Homo sapiens
taaattgaaagca

SEQ ID NO: 4393936 - DNA, 20 bp, Homo sapiens
taaattgacacttaaaaatg

SEQ ID NO: 4393937 - DNA, 23 bp, Homo sapiens
taaattgacacttaaaaatggtt

SEQ ID NO: 4393938 - DNA, 12 bp, Homo sapiens
taaattgactgt

SEQ ID NO: 4393939 - DNA, 13 bp, Homo sapiens
taaattgattttt

SEQ ID NO: 4393940 - DNA, 21 bp, Homo sapiens
taaattgatttttataaatac

SEQ ID NO: 4393941 - DNA, 19 bp, Homo sapiens
taaattgcagaattcaaaa

SEQ ID NO: 4393942 - DNA, 16 bp, Homo sapiens
taaattgctaatgttg

SEQ ID NO: 4393943 - DNA, 21 bp, Homo sapiens
taaattgggttcatgatgcag

SEQ ID NO: 4393944 - DNA, 15 bp, Homo sapiens
taaattggtcatggt

SEQ ID NO: 4393945 - DNA, 18 bp, Homo sapiens
taaattgtacattttgta

SEQ ID NO: 4393946 - DNA, 21 bp, Homo sapiens
taaattgtacattttgtaaaa

SEQ ID NO: 4393947 - DNA, 23 bp, Homo sapiens
taaattgtctttaaaaactgttt

SEQ ID NO: 4393948 - DNA, 15 bp, Homo sapiens
taaatttaaaaatca

SEQ ID NO: 4393949 - DNA, 23 bp, Homo sapiens
taaatttaagaaaacaagtatat

SEQ ID NO: 4393950 - DNA, 14 bp, Homo sapiens
taaatttaatcctt

SEQ ID NO: 4393951 - DNA, 22 bp, Homo sapiens
taaatttaatccttctttgtaa

SEQ ID NO: 4393952 - DNA, 18 bp, Homo sapiens
taaatttatcacattgaa

SEQ ID NO: 4393953 - DNA, 13 bp, Homo sapiens
taaatttatgtga

SEQ ID NO: 4393954 - DNA, 18 bp, Homo sapiens
taaatttcccaattttct

SEQ ID NO: 4393955 - DNA, 23 bp, Homo sapiens
taaatttcttttattaatacttt

SEQ ID NO: 4393956 - DNA, 19 bp, Homo sapiens
taaatttgacttttctgta

SEQ ID NO: 4393957 - DNA, 17 bp, Homo sapiens
taaatttgatggttgaa

SEQ ID NO: 4393958 - DNA, 13 bp, Homo sapiens
taaattttaaagc

SEQ ID NO: 4393959 - DNA, 14 bp, Homo sapiens
taaattttaaagcc

SEQ ID NO: 4393960 - DNA, 15 bp, Homo sapiens
taaattttaattcaa

SEQ ID NO: 4393961 - DNA, 13 bp, Homo sapiens
taaattttctaaa

SEQ ID NO: 4393962 - DNA, 15 bp, Homo sapiens
taaattttcttcagt

SEQ ID NO: 4393963 - DNA, 16 bp, Homo sapiens
taaattttctttttct

SEQ ID NO: 4393964 - DNA, 15 bp, Homo sapiens
taaattttgtgtctc

SEQ ID NO: 4393965 - DNA, 21 bp, Homo sapiens
taaattttgttttttaagttt

SEQ ID NO: 4393966 - DNA, 19 bp, Homo sapiens
taaatttttaggcaaagat

SEQ ID NO: 4393967 - DNA, 15 bp, Homo sapiens
taaatttttcataga

SEQ ID NO: 4393968 - DNA, 16 bp, Homo sapiens
taaatttttttcctta

SEQ ID NO: 4393969 - DNA, 22 bp, Homo sapiens
taacaaaagcacacaacgatta

SEQ ID NO: 4393970 - DNA, 13 bp, Homo sapiens
taacaaagacaaa

SEQ ID NO: 4393971 - DNA, 12 bp, Homo sapiens
taacaaataaaa

SEQ ID NO: 4393972 - DNA, 21 bp, Homo sapiens
taacaaataaaaaagctcttt

SEQ ID NO: 4393973 - DNA, 18 bp, Homo sapiens
taacaaatgactgtatct

SEQ ID NO: 4393974 - DNA, 21 bp, Homo sapiens
taacaaatgctttattattta

SEQ ID NO: 4393975 - DNA, 16 bp, Homo sapiens
taacaagagtatgtgg

SEQ ID NO: 4393976 - DNA, 12 bp, Homo sapiens
taacaagatgtt

SEQ ID NO: 4393977 - DNA, 21 bp, Homo sapiens
taacaagatgtttcattttac

SEQ ID NO: 4393978 - DNA, 17 bp, Homo sapiens
taacaataatatttcaa

SEQ ID NO: 4393979 - DNA, 20 bp, Homo sapiens
taacaataatatttcaagtg

SEQ ID NO: 4393980 - DNA, 14 bp, Homo sapiens
taacaatcagctcc

SEQ ID NO: 4393981 - DNA, 18 bp, Homo sapiens
taacaatccattcacaag

SEQ ID NO: 4393982 - DNA, 17 bp, Homo sapiens
taacaatgcctattgta

SEQ ID NO: 4393983 - DNA, 21 bp, Homo sapiens
taacaatgcctattgtaatat

SEQ ID NO: 4393984 - DNA, 12 bp, Homo sapiens
taacaatgcctt

SEQ ID NO: 4393985 - DNA, 18 bp, Homo sapiens
taacaatgccttgttgta

SEQ ID NO: 4393986 - DNA, 24 bp, Homo sapiens
taacaatggaagatttgcccattt

SEQ ID NO: 4393987 - DNA, 18 bp, Homo sapiens
taacacaaagagatattt

SEQ ID NO: 4393988 - DNA, 12 bp, Homo sapiens
taacacagatat

SEQ ID NO: 4393989 - DNA, 13 bp, Homo sapiens
taacacagatatt

SEQ ID NO: 4393990 - DNA, 21 bp, Homo sapiens
taacacagcattgtatatgtg

SEQ ID NO: 4393991 - DNA, 20 bp, Homo sapiens
taacactaatatatttaaaa

SEQ ID NO: 4393992 - DNA, 15 bp, Homo sapiens
taacagaaattgtat

SEQ ID NO: 4393993 - DNA, 16 bp, Homo sapiens
taacagatgtgaaaat

SEQ ID NO: 4393994 - DNA, 14 bp, Homo sapiens
taacagcaacgaac

SEQ ID NO: 4393995 - DNA, 11 bp, Homo sapiens
taacagccctc

SEQ ID NO: 4393996 - DNA, 14 bp, Homo sapiens
taacaggagaaagg

SEQ ID NO: 4393997 - DNA, 23 bp, Homo sapiens
taacagggagaagtagctagtag

SEQ ID NO: 4393998 - DNA, 13 bp, Homo sapiens
taacagtatttct

SEQ ID NO: 4393999 - DNA, 23 bp, Homo sapiens
taacagtccccgtggccatccct

SEQ ID NO: 4394000 - DNA, 16 bp, Homo sapiens
taacagtctagtgcaa

SEQ ID NO: 4394001 - DNA, 14 bp, Homo sapiens
taacagtgtttaaa

SEQ ID NO: 4394002 - DNA, 18 bp, Homo sapiens
taacagttgtatttaaca

SEQ ID NO: 4394003 - DNA, 15 bp, Homo sapiens
taacataactgcttc

SEQ ID NO: 4394004 - DNA, 22 bp, Homo sapiens
taacatctttattgaaattcta

SEQ ID NO: 4394005 - DNA, 12 bp, Homo sapiens
taacatgcaata

SEQ ID NO: 4394006 - DNA, 14 bp, Homo sapiens
taacatgtcagttt

SEQ ID NO: 4394007 - DNA, 22 bp, Homo sapiens
taacattaagaaaaacaataaa

SEQ ID NO: 4394008 - DNA, 21 bp, Homo sapiens
taacattaatgcctgcttttt

SEQ ID NO: 4394009 - DNA, 14 bp, Homo sapiens
taacattatataac

SEQ ID NO: 4394010 - DNA, 13 bp, Homo sapiens
taacattatattg

SEQ ID NO: 4394011 - DNA, 17 bp, Homo sapiens
taacattatattgcaat

SEQ ID NO: 4394012 - DNA, 15 bp, Homo sapiens
taacattctttttct

SEQ ID NO: 4394013 - DNA, 17 bp, Homo sapiens
taacatttcattgtaca

SEQ ID NO: 4394014 - DNA, 17 bp, Homo sapiens
taacattttacagtaaa

SEQ ID NO: 4394015 - DNA, 18 bp, Homo sapiens
taacattttacagtaaat

SEQ ID NO: 4394016 - DNA, 16 bp, Homo sapiens
taaccaatttgtaatg

SEQ ID NO: 4394017 - DNA, 14 bp, Homo sapiens
taaccaattttcag

SEQ ID NO: 4394018 - DNA, 16 bp, Homo sapiens
taaccaggccccagcc

SEQ ID NO: 4394019 - DNA, 19 bp, Homo sapiens
taaccaggccccagcctcc

SEQ ID NO: 4394020 - DNA, 21 bp, Homo sapiens
taaccagtacttctaagagca

SEQ ID NO: 4394021 - DNA, 17 bp, Homo sapiens
taaccatccccaactcc

SEQ ID NO: 4394022 - DNA, 18 bp, Homo sapiens
taaccatttaaagaaaga

SEQ ID NO: 4394023 - DNA, 18 bp, Homo sapiens
taaccatttatataaaac

SEQ ID NO: 4394024 - DNA, 19 bp, Homo sapiens
taacccagtggctggaaga

SEQ ID NO: 4394025 - DNA, 14 bp, Homo sapiens
taaccccattcttt

SEQ ID NO: 4394026 - DNA, 16 bp, Homo sapiens
taaccccattctttgc

SEQ ID NO: 4394027 - DNA, 20 bp, Homo sapiens
taacccccagcccacagagc

SEQ ID NO: 4394028 - DNA, 16 bp, Homo sapiens
taacccctttcctgcg

SEQ ID NO: 4394029 - DNA, 18 bp, Homo sapiens
taaccctcccatggcacc

SEQ ID NO: 4394030 - DNA, 13 bp, Homo sapiens
taacctagttaaa

SEQ ID NO: 4394031 - DNA, 17 bp, Homo sapiens
taacctagttaaagaaa

SEQ ID NO: 4394032 - DNA, 18 bp, Homo sapiens
taacctccaacacagtgc

SEQ ID NO: 4394033 - DNA, 23 bp, Homo sapiens
taacctcggagacgggaccctgc

SEQ ID NO: 4394034 - DNA, 15 bp, Homo sapiens
taacctctgctttta

SEQ ID NO: 4394035 - DNA, 20 bp, Homo sapiens
taaagtggttctctgccttt

SEQ ID NO: 4394036 - DNA, 17 bp, Homo sapiens
taaagtgtacttataaa

SEQ ID NO: 4394037 - DNA, 17 bp, Homo sapiens
taaagtgtgtttctatg

SEQ ID NO: 4394038 - DNA, 15 bp, Homo sapiens
taaagttagtaaaga

SEQ ID NO: 4394039 - DNA, 15 bp, Homo sapiens
taaagttatatttgt

SEQ ID NO: 4394040 - DNA, 21 bp, Homo sapiens
taaagttattcttgtcatttt

SEQ ID NO: 4394041 - DNA, 22 bp, Homo sapiens
taaagttcagatgtttcatcaa

SEQ ID NO: 4394042 - DNA, 12 bp, Homo sapiens
taaagttctgtg

SEQ ID NO: 4394043 - DNA, 23 bp, Homo sapiens
taaagttctgtgtatttaattgt

SEQ ID NO: 4394044 - DNA, 12 bp, Homo sapiens
taaagttgaata

SEQ ID NO: 4394045 - DNA, 20 bp, Homo sapiens
taaagttgataaagattttt

SEQ ID NO: 4394046 - DNA, 19 bp, Homo sapiens
taaagttggtattaataaa

SEQ ID NO: 4394047 - DNA, 20 bp, Homo sapiens
taaagttggtattaataaaa

SEQ ID NO: 4394048 - DNA, 18 bp, Homo sapiens
taaagttggttggataag

SEQ ID NO: 4394049 - DNA, 13 bp, Homo sapiens
taaagttgtattg

SEQ ID NO: 4394050 - DNA, 15 bp, Homo sapiens
taaagttgtattgca

SEQ ID NO: 4394051 - DNA, 20 bp, Homo sapiens
taaagttgtatttcaaatat

SEQ ID NO: 4394052 - DNA, 16 bp, Homo sapiens
taaagtttaatgccta

SEQ ID NO: 4394053 - DNA, 16 bp, Homo sapiens
taaataaaaatttata

SEQ ID NO: 4394054 - DNA, 18 bp, Homo sapiens
taaataaaatcatgtagt

SEQ ID NO: 4394055 - DNA, 13 bp, Homo sapiens
taaataaaatttg

SEQ ID NO: 4394056 - DNA, 14 bp, Homo sapiens
taaataaaatttgt

SEQ ID NO: 4394057 - DNA, 20 bp, Homo sapiens
taaataaacacatagattca

SEQ ID NO: 4394058 - DNA, 14 bp, Homo sapiens
taaataaaccactg

SEQ ID NO: 4394059 - DNA, 13 bp, Homo sapiens
taaataaatagaa

SEQ ID NO: 4394060 - DNA, 16 bp, Homo sapiens
taaataaatagaaaga

SEQ ID NO: 4394061 - DNA, 13 bp, Homo sapiens
taaataaattaag

SEQ ID NO: 4394062 - DNA, 13 bp, Homo sapiens
taaataaattatg

SEQ ID NO: 4394063 - DNA, 15 bp, Homo sapiens
taaataaatttccca

SEQ ID NO: 4394064 - DNA, 13 bp, Homo sapiens
taaataacttttt

SEQ ID NO: 4394065 - DNA, 15 bp, Homo sapiens
taaataagaaacttt

SEQ ID NO: 4394066 - DNA, 21 bp, Homo sapiens
taaataatcatccctccttgc

SEQ ID NO: 4394067 - DNA, 15 bp, Homo sapiens
taaataattggaaaa

SEQ ID NO: 4394068 - DNA, 14 bp, Homo sapiens
taaataatttaact

SEQ ID NO: 4394069 - DNA, 14 bp, Homo sapiens
taaataatttattt

SEQ ID NO: 4394070 - DNA, 13 bp, Homo sapiens
taaatacagtctt

SEQ ID NO: 4394071 - DNA, 16 bp, Homo sapiens
taaatactgcaaatca

SEQ ID NO: 4394072 - DNA, 16 bp, Homo sapiens
taaatagaaattttca

SEQ ID NO: 4394073 - DNA, 16 bp, Homo sapiens
taaatagcatttggaa

SEQ ID NO: 4394074 - DNA, 11 bp, Homo sapiens
taaatatatat

SEQ ID NO: 4394075 - DNA, 13 bp, Homo sapiens
taaatatatataa

SEQ ID NO: 4394076 - DNA, 14 bp, Homo sapiens
taaatatatatggt

SEQ ID NO: 4394077 - DNA, 17 bp, Homo sapiens
taaatatatatttctaa

SEQ ID NO: 4394078 - DNA, 18 bp, Homo sapiens
taaatatatctaccccag

SEQ ID NO: 4394079 - DNA, 20 bp, Homo sapiens
taaatatatctaccccagac

SEQ ID NO: 4394080 - DNA, 22 bp, Homo sapiens
taaatatatctagaactatcat

SEQ ID NO: 4394081 - DNA, 13 bp, Homo sapiens
taaatatatgtat

SEQ ID NO: 4394082 - DNA, 19 bp, Homo sapiens
taaatatccatttatcttt

SEQ ID NO: 4394083 - DNA, 22 bp, Homo sapiens
taaatatcccttggacatttta

SEQ ID NO: 4394084 - DNA, 17 bp, Homo sapiens
taaatattgctaaaagc

SEQ ID NO: 4394085 - DNA, 19 bp, Homo sapiens
taaatattgctaaaagcat

SEQ ID NO: 4394086 - DNA, 20 bp, Homo sapiens
taaatattgctaaaagcatg

SEQ ID NO: 4394087 - DNA, 11 bp, Homo sapiens
taaatatttat

SEQ ID NO: 4394088 - DNA, 12 bp, Homo sapiens
taaatatttctt

SEQ ID NO: 4394089 - DNA, 14 bp, Homo sapiens
taaatatttcttaa

SEQ ID NO: 4394090 - DNA, 17 bp, Homo sapiens
taaatattttaaagaat

SEQ ID NO: 4394091 - DNA, 14 bp, Homo sapiens
taaatattttctat

SEQ ID NO: 4394092 - DNA, 16 bp, Homo sapiens
taaatattttctattt

SEQ ID NO: 4394093 - DNA, 18 bp, Homo sapiens
taaatcacagaaaattta

SEQ ID NO: 4394094 - DNA, 19 bp, Homo sapiens
taaatcacagaaaatttaa

SEQ ID NO: 4394095 - DNA, 18 bp, Homo sapiens
taaatcacgctttttgaa

SEQ ID NO: 4394096 - DNA, 22 bp, Homo sapiens
taaatcagtcaagctgttgaag

SEQ ID NO: 4394097 - DNA, 15 bp, Homo sapiens
taaatcagtgaactg

SEQ ID NO: 4394098 - DNA, 16 bp, Homo sapiens
taaatcataaagtcag

SEQ ID NO: 4394099 - DNA, 13 bp, Homo sapiens
taaatcatgttgt

SEQ ID NO: 4394100 - DNA, 12 bp, Homo sapiens
taaatcatttta

SEQ ID NO: 4394101 - DNA, 14 bp, Homo sapiens
taaatccaataaaa

SEQ ID NO: 4394102 - DNA, 13 bp, Homo sapiens
taaatcctgtgtt

SEQ ID NO: 4394103 - DNA, 19 bp, Homo sapiens
taaatccttgggagtcatt

SEQ ID NO: 4394104 - DNA, 23 bp, Homo sapiens
taaatccttgggagtcattacca

SEQ ID NO: 4394105 - DNA, 13 bp, Homo sapiens
taaatctacacac

SEQ ID NO: 4394106 - DNA, 15 bp, Homo sapiens
taaatctacacacgg

SEQ ID NO: 4394107 - DNA, 17 bp, Homo sapiens
taaatctaggatgtgat

SEQ ID NO: 4394108 - DNA, 19 bp, Homo sapiens
taaatctaggatgtgatga

SEQ ID NO: 4394109 - DNA, 16 bp, Homo sapiens
taaatctcctattttt

SEQ ID NO: 4394110 - DNA, 12 bp, Homo sapiens
taaatctgtgat

SEQ ID NO: 4394111 - DNA, 13 bp, Homo sapiens
taaatctgtgatg

SEQ ID NO: 4394112 - DNA, 15 bp, Homo sapiens
taaatctgtgatgat

SEQ ID NO: 4394113 - DNA, 13 bp, Homo sapiens
taaatcttttata

SEQ ID NO: 4394114 - DNA, 19 bp, Homo sapiens
taaatcttttataggattt

SEQ ID NO: 4394115 - DNA, 17 bp, Homo sapiens
taaatctttttgcttct

SEQ ID NO: 4394116 - DNA, 18 bp, Homo sapiens
taaatctttttgcttcta

SEQ ID NO: 4394117 - DNA, 24 bp, Homo sapiens
taaatctttttgcttctactttca

SEQ ID NO: 4394118 - DNA, 21 bp, Homo sapiens
taaatgaatattttgataata

SEQ ID NO: 4394119 - DNA, 21 bp, Homo sapiens
taaatgaatcgcaagttaact

SEQ ID NO: 4394120 - DNA, 15 bp, Homo sapiens
taaatgaatgcttct

SEQ ID NO: 4394121 - DNA, 16 bp, Homo sapiens
taaatgacagtaatat

SEQ ID NO: 4394122 - DNA, 15 bp, Homo sapiens
taaatgattatattc

SEQ ID NO: 4394123 - DNA, 16 bp, Homo sapiens
taaatgcatattaaat

SEQ ID NO: 4394124 - DNA, 16 bp, Homo sapiens
taaatgccaaaatgta

SEQ ID NO: 4394125 - DNA, 19 bp, Homo sapiens
taaatgccaaaatgtactt

SEQ ID NO: 4394126 - DNA, 14 bp, Homo sapiens
taaatgcccagttc

SEQ ID NO: 4394127 - DNA, 16 bp, Homo sapiens
taaatgcctcttaaat

SEQ ID NO: 4394128 - DNA, 19 bp, Homo sapiens
taaatgcctcttaaattat

SEQ ID NO: 4394129 - DNA, 16 bp, Homo sapiens
taaatgcttaaatttc

SEQ ID NO: 4394130 - DNA, 22 bp, Homo sapiens
taaatggaattttctaatataa

SEQ ID NO: 4394131 - DNA, 19 bp, Homo sapiens
taaatggcttcttctagaa

SEQ ID NO: 4394132 - DNA, 21 bp, Homo sapiens
taaatggtttggtgcttttta

SEQ ID NO: 4394133 - DNA, 18 bp, Homo sapiens
taaatgtacagacatatt

SEQ ID NO: 4394134 - DNA, 21 bp, Homo sapiens
taaatgtagcttcagtcatta

SEQ ID NO: 4394135 - DNA, 13 bp, Homo sapiens
taaatgtatacta

SEQ ID NO: 4394136 - DNA, 22 bp, Homo sapiens
taaatgtgcaatagaaggtgat

SEQ ID NO: 4394137 - DNA, 18 bp, Homo sapiens
taaatgtggattttgtag

SEQ ID NO: 4394138 - DNA, 14 bp, Homo sapiens
taaatgtgtacaat

SEQ ID NO: 4394139 - DNA, 15 bp, Homo sapiens
taaatgtgtgtatgt

SEQ ID NO: 4394140 - DNA, 13 bp, Homo sapiens
taaatgttaactg

SEQ ID NO: 4394141 - DNA, 21 bp, Homo sapiens
taaatgttatgactatgtaaa

SEQ ID NO: 4394142 - DNA, 23 bp, Homo sapiens
taaatgttctggtatgcattctt

SEQ ID NO: 4394143 - DNA, 17 bp, Homo sapiens
taaatgtttatattgtt

SEQ ID NO: 4394144 - DNA, 13 bp, Homo sapiens
taaatgtttcaaa

SEQ ID NO: 4394145 - DNA, 20 bp, Homo sapiens
taaatgtttcaaaatagaca

SEQ ID NO: 4394146 - DNA, 22 bp, Homo sapiens
taaatgtttgtttatatcactg

SEQ ID NO: 4394147 - DNA, 13 bp, Homo sapiens
taaatgttttagt

SEQ ID NO: 4394148 - DNA, 16 bp, Homo sapiens
taaattaaacaattta

SEQ ID NO: 4394149 - DNA, 16 bp, Homo sapiens
taaattacaaatgtgg

SEQ ID NO: 4394150 - DNA, 17 bp, Homo sapiens
taaattacaattttatc

SEQ ID NO: 4394151 - DNA, 11 bp, Homo sapiens
taaattacagc

SEQ ID NO: 4394152 - DNA, 20 bp, Homo sapiens
taaattacagcttttatgga

SEQ ID NO: 4394153 - DNA, 12 bp, Homo sapiens
taaattagaaaa

SEQ ID NO: 4394154 - DNA, 18 bp, Homo sapiens
taaattagaaaatattct

SEQ ID NO: 4394155 - DNA, 20 bp, Homo sapiens
taaattagaatgaatttatc

SEQ ID NO: 4394156 - DNA, 14 bp, Homo sapiens
taaattaggaataa

SEQ ID NO: 4394157 - DNA, 15 bp, Homo sapiens
taaaacttaaaaaca

SEQ ID NO: 4394158 - DNA, 13 bp, Homo sapiens
taaaactttattt

SEQ ID NO: 4394159 - DNA, 14 bp, Homo sapiens
taaaactttgaagt

SEQ ID NO: 4394160 - DNA, 17 bp, Homo sapiens
taaaagaaaaaatgaca

SEQ ID NO: 4394161 - DNA, 19 bp, Homo sapiens
taaaagaaatcttgcttca

SEQ ID NO: 4394162 - DNA, 13 bp, Homo sapiens
taaaagaatattt

SEQ ID NO: 4394163 - DNA, 15 bp, Homo sapiens
taaaagaatgactat

SEQ ID NO: 4394164 - DNA, 13 bp, Homo sapiens
taaaagacttttt

SEQ ID NO: 4394165 - DNA, 23 bp, Homo sapiens
taaaagagaccacccatatcatg

SEQ ID NO: 4394166 - DNA, 22 bp, Homo sapiens
taaaagcaaaaaagaaaacctt

SEQ ID NO: 4394167 - DNA, 15 bp, Homo sapiens
gtgcactttgtaaat

SEQ ID NO: 4394168 - DNA, 18 bp, Homo sapiens
gtgcagaaaatatttaat

SEQ ID NO: 4394169 - DNA, 15 bp, Homo sapiens
gtgcagaaccagcac

SEQ ID NO: 4394170 - DNA, 22 bp, Homo sapiens
gtgcagacacctaaccccaggg

SEQ ID NO: 4394171 - DNA, 16 bp, Homo sapiens
gtgcagagccttctca

SEQ ID NO: 4394172 - DNA, 23 bp, Homo sapiens
gtgcagagccttctcagaagcac

SEQ ID NO: 4394173 - DNA, 17 bp, Homo sapiens
gtgcagccgctgagcga

SEQ ID NO: 4394174 - DNA, 13 bp, Homo sapiens
gtgcagccttccc

SEQ ID NO: 4394175 - DNA, 18 bp, Homo sapiens
gtgcagccttcccctccc

SEQ ID NO: 4394176 - DNA, 13 bp, Homo sapiens
gtgcagccttctc

SEQ ID NO: 4394177 - DNA, 14 bp, Homo sapiens
gtgcagccttctcc

SEQ ID NO: 4394178 - DNA, 21 bp, Homo sapiens
gtgcagcgtgtgtgccacctc

SEQ ID NO: 4394179 - DNA, 14 bp, Homo sapiens
gtgcagcttcgagg

SEQ ID NO: 4394180 - DNA, 19 bp, Homo sapiens
gtgcagcttcgaggacagg

SEQ ID NO: 4394181 - DNA, 18 bp, Homo sapiens
gtgcaggcctgctcaggg

SEQ ID NO: 4394182 - DNA, 17 bp, Homo sapiens
gtgcaggcctgtccctg

SEQ ID NO: 4394183 - DNA, 18 bp, Homo sapiens
gtgcaggcctgtccctgg

SEQ ID NO: 4394184 - DNA, 20 bp, Homo sapiens
gtgcaggctgcagtggctcc

SEQ ID NO: 4394185 - DNA, 21 bp, Homo sapiens
gtgcaggctgcagtggctccc

SEQ ID NO: 4394186 - DNA, 14 bp, Homo sapiens
gtgcagtcactgga

SEQ ID NO: 4394187 - DNA, 17 bp, Homo sapiens
gtgcatatttgttactt

SEQ ID NO: 4394188 - DNA, 21 bp, Homo sapiens
gtgcatccttgtaatacctga

SEQ ID NO: 4394189 - DNA, 14 bp, Homo sapiens
gtgcatctcctccc

SEQ ID NO: 4394190 - DNA, 22 bp, Homo sapiens
gtgcatgcctgtagtctcagct

SEQ ID NO: 4394191 - DNA, 20 bp, Homo sapiens
gtgcatgggacccacgaaac

SEQ ID NO: 4394192 - DNA, 19 bp, Homo sapiens
gtgcatggtatgtgggtga

SEQ ID NO: 4394193 - DNA, 16 bp, Homo sapiens
gtgcatgtgcatgcat

SEQ ID NO: 4394194 - DNA, 22 bp, Homo sapiens
gtgcattttctaagtgggacat

SEQ ID NO: 4394195 - DNA, 13 bp, Homo sapiens
gtgcatttttaaa

SEQ ID NO: 4394196 - DNA, 14 bp, Homo sapiens
gtgccaactgccag

SEQ ID NO: 4394197 - DNA, 14 bp, Homo sapiens
gtgccaagccctgg

SEQ ID NO: 4394198 - DNA, 15 bp, Homo sapiens
gtgccaagccctggc

SEQ ID NO: 4394199 - DNA, 12 bp, Homo sapiens
gtgccacagagg

SEQ ID NO: 4394200 - DNA, 14 bp, Homo sapiens
gtgccacagaggcc

SEQ ID NO: 4394201 - DNA, 20 bp, Homo sapiens
gtgccacagaggccccacct

SEQ ID NO: 4394202 - DNA, 21 bp, Homo sapiens
gtgccacagaggccccacctg

SEQ ID NO: 4394203 - DNA, 16 bp, Homo sapiens
gtgccaccatgcctca

SEQ ID NO: 4394204 - DNA, 20 bp, Homo sapiens
gtgccacccagtagcccaga

SEQ ID NO: 4394205 - DNA, 17 bp, Homo sapiens
gtgccacctatgcctgt

SEQ ID NO: 4394206 - DNA, 20 bp, Homo sapiens
gtgccacctatgcctgtggt

SEQ ID NO: 4394207 - DNA, 12 bp, Homo sapiens
gtgccactgccc

SEQ ID NO: 4394208 - DNA, 17 bp, Homo sapiens
gtgccactgccccccga

SEQ ID NO: 4394209 - DNA, 23 bp, Homo sapiens
gtgccactgccccccgaggctgc

SEQ ID NO: 4394210 - DNA, 15 bp, Homo sapiens
gtgccacttaatgta

SEQ ID NO: 4394211 - DNA, 16 bp, Homo sapiens
gtgccagcattccaga

SEQ ID NO: 4394212 - DNA, 21 bp, Homo sapiens
gtgccagcattccagacttca

SEQ ID NO: 4394213 - DNA, 14 bp, Homo sapiens
gtgccagctgccct

SEQ ID NO: 4394214 - DNA, 15 bp, Homo sapiens
gtgccagctgccctt

SEQ ID NO: 4394215 - DNA, 18 bp, Homo sapiens
gtgccagctgcccttgca

SEQ ID NO: 4394216 - DNA, 16 bp, Homo sapiens
gtgccaggaccagtca

SEQ ID NO: 4394217 - DNA, 21 bp, Homo sapiens
gtgccaggatggaatgatggg

SEQ ID NO: 4394218 - DNA, 17 bp, Homo sapiens
gtgccatggatttccac

SEQ ID NO: 4394219 - DNA, 14 bp, Homo sapiens
gtgccattgtcttt

SEQ ID NO: 4394220 - DNA, 15 bp, Homo sapiens
gtgcccagcctggaa

SEQ ID NO: 4394221 - DNA, 11 bp, Homo sapiens
gtgcccaggaa

SEQ ID NO: 4394222 - DNA, 16 bp, Homo sapiens
gtgcccatcctgccat

SEQ ID NO: 4394223 - DNA, 19 bp, Homo sapiens
gtgcccattaccactcaag

SEQ ID NO: 4394224 - DNA, 18 bp, Homo sapiens
gtgccccagggagtccag

SEQ ID NO: 4394225 - DNA, 21 bp, Homo sapiens
gtgccccatgcctgtccagcc

SEQ ID NO: 4394226 - DNA, 18 bp, Homo sapiens
gtgcccccctcctccagt

SEQ ID NO: 4394227 - DNA, 19 bp, Homo sapiens
gtgcccccctcctccagta

SEQ ID NO: 4394228 - DNA, 16 bp, Homo sapiens
gtgcccgcaggaactg

SEQ ID NO: 4394229 - DNA, 17 bp, Homo sapiens
gtgcccgcaggaactgg

SEQ ID NO: 4394230 - DNA, 15 bp, Homo sapiens
gtgcccttggtgcga

SEQ ID NO: 4394231 - DNA, 14 bp, Homo sapiens
gtgccgcctgcccg

SEQ ID NO: 4394232 - DNA, 21 bp, Homo sapiens
gtgccggcggcagccccactt

SEQ ID NO: 4394233 - DNA, 22 bp, Homo sapiens
gtgccggcggcagccccacttc

SEQ ID NO: 4394234 - DNA, 21 bp, Homo sapiens
gtgccgttactctccaacctg

SEQ ID NO: 4394235 - DNA, 20 bp, Homo sapiens
gtgcctaatggagaagaccc

SEQ ID NO: 4394236 - DNA, 15 bp, Homo sapiens
gtgcctaatgtgttt

SEQ ID NO: 4394237 - DNA, 18 bp, Homo sapiens
gtgcctagactgttactt

SEQ ID NO: 4394238 - DNA, 20 bp, Homo sapiens
gtgcctagtaaatgttaact

SEQ ID NO: 4394239 - DNA, 22 bp, Homo sapiens
gtgcctcacatttttttctacc

SEQ ID NO: 4394240 - DNA, 17 bp, Homo sapiens
gtgcctccccccagacc

SEQ ID NO: 4394241 - DNA, 18 bp, Homo sapiens
gtgcctccccccagaccc

SEQ ID NO: 4394242 - DNA, 19 bp, Homo sapiens
gtgcctcctcaaacccagt

SEQ ID NO: 4394243 - DNA, 21 bp, Homo sapiens
gtgcctcctcaaacccagtct

SEQ ID NO: 4394244 - DNA, 12 bp, Homo sapiens
gtgcctctccct

SEQ ID NO: 4394245 - DNA, 15 bp, Homo sapiens
gtgcctgagaccagg

SEQ ID NO: 4394246 - DNA, 17 bp, Homo sapiens
gtgttcaaaacaaaatg

SEQ ID NO: 4394247 - DNA, 14 bp, Homo sapiens
gtgttcatttcatt

SEQ ID NO: 4394248 - DNA, 18 bp, Homo sapiens
gtgttccccttccactga

SEQ ID NO: 4394249 - DNA, 22 bp, Homo sapiens
gtgttccccttccactgagggc

SEQ ID NO: 4394250 - DNA, 13 bp, Homo sapiens
gtgttcccgtgcc

SEQ ID NO: 4394251 - DNA, 17 bp, Homo sapiens
gtgttccctttttcata

SEQ ID NO: 4394252 - DNA, 15 bp, Homo sapiens
gtgttccgtgggacc

SEQ ID NO: 4394253 - DNA, 23 bp, Homo sapiens
gtgttccgtgggaccctcagcag

SEQ ID NO: 4394254 - DNA, 15 bp, Homo sapiens
gtgttcctgaagctg

SEQ ID NO: 4394255 - DNA, 17 bp, Homo sapiens
gtgttcctgaagctgct

SEQ ID NO: 4394256 - DNA, 17 bp, Homo sapiens
gtgttcgtttccatcat

SEQ ID NO: 4394257 - DNA, 21 bp, Homo sapiens
gtgttcgtttccatcatgtct

SEQ ID NO: 4394258 - DNA, 15 bp, Homo sapiens
gtgttctaagactct

SEQ ID NO: 4394259 - DNA, 12 bp, Homo sapiens
gtgttctcagca

SEQ ID NO: 4394260 - DNA, 12 bp, Homo sapiens
gtgttctgggct

SEQ ID NO: 4394261 - DNA, 13 bp, Homo sapiens
gtgttctgggctg

SEQ ID NO: 4394262 - DNA, 18 bp, Homo sapiens
gtgttctgtttgaaacta

SEQ ID NO: 4394263 - DNA, 16 bp, Homo sapiens
gtgttctttcctgccc

SEQ ID NO: 4394264 - DNA, 21 bp, Homo sapiens
gtgttgaaaaccaaaatgaca

SEQ ID NO: 4394265 - DNA, 16 bp, Homo sapiens
gtgttgaaatggcatt

SEQ ID NO: 4394266 - DNA, 14 bp, Homo sapiens
gtgttgcactgaac

SEQ ID NO: 4394267 - DNA, 16 bp, Homo sapiens
gtgttgcactgaacag

SEQ ID NO: 4394268 - DNA, 19 bp, Homo sapiens
gtgttgccacagtagaact

SEQ ID NO: 4394269 - DNA, 18 bp, Homo sapiens
gtgttggctggggtgtca

SEQ ID NO: 4394270 - DNA, 22 bp, Homo sapiens
gtgttggctttgcagctgctgt

SEQ ID NO: 4394271 - DNA, 23 bp, Homo sapiens
gtgttgtatctacagtaatgaaa

SEQ ID NO: 4394272 - DNA, 16 bp, Homo sapiens
gtgttgtgctttcaag

SEQ ID NO: 4394273 - DNA, 18 bp, Homo sapiens
gttatcctgtttgaagaa

SEQ ID NO: 4394274 - DNA, 23 bp, Homo sapiens
gttatcttatactgtacaataaa

SEQ ID NO: 4394275 - DNA, 13 bp, Homo sapiens
gttatgaacatcc

SEQ ID NO: 4394276 - DNA, 15 bp, Homo sapiens
gttatgactatgtaa

SEQ ID NO: 4394277 - DNA, 20 bp, Homo sapiens
gttatgaggatataatgtgt

SEQ ID NO: 4394278 - DNA, 20 bp, Homo sapiens
gttatgatttttttttcata

SEQ ID NO: 4394279 - DNA, 15 bp, Homo sapiens
gttatggtagaaaaa

SEQ ID NO: 4394280 - DNA, 20 bp, Homo sapiens
gttatggtagaaaaatttca

SEQ ID NO: 4394281 - DNA, 12 bp, Homo sapiens
gttatgtattta

SEQ ID NO: 4394282 - DNA, 13 bp, Homo sapiens
gttatgtatttcc

SEQ ID NO: 4394283 - DNA, 23 bp, Homo sapiens
gttatgtatttcctggatgtttg

SEQ ID NO: 4394284 - DNA, 15 bp, Homo sapiens
gttattaaactgaat

SEQ ID NO: 4394285 - DNA, 12 bp, Homo sapiens
gttattaaatgt

SEQ ID NO: 4394286 - DNA, 13 bp, Homo sapiens
gttattaaatgtt

SEQ ID NO: 4394287 - DNA, 17 bp, Homo sapiens
gttattatctgggctta

SEQ ID NO: 4394288 - DNA, 22 bp, Homo sapiens
gttattatctgggcttatatct

SEQ ID NO: 4394289 - DNA, 15 bp, Homo sapiens
gttattcaaatttga

SEQ ID NO: 4394290 - DNA, 18 bp, Homo sapiens
gttattccacaaacacat

SEQ ID NO: 4394291 - DNA, 13 bp, Homo sapiens
gttattgcagttt

SEQ ID NO: 4394292 - DNA, 16 bp, Homo sapiens
gttattgcagtttatc

SEQ ID NO: 4394293 - DNA, 13 bp, Homo sapiens
gttatttaagcat

SEQ ID NO: 4394294 - DNA, 19 bp, Homo sapiens
gttatttccccagccacag

SEQ ID NO: 4394295 - DNA, 13 bp, Homo sapiens
gttatttcttccc

SEQ ID NO: 4394296 - DNA, 15 bp, Homo sapiens
gttatttcttccctg

SEQ ID NO: 4394297 - DNA, 16 bp, Homo sapiens
gttatttgtaatagat

SEQ ID NO: 4394298 - DNA, 13 bp, Homo sapiens
gttattttatagg

SEQ ID NO: 4394299 - DNA, 13 bp, Homo sapiens
gttattttgcaac

SEQ ID NO: 4394300 - DNA, 14 bp, Homo sapiens
gttatttttctctt

SEQ ID NO: 4394301 - DNA, 17 bp, Homo sapiens
gttatttttctcttgta

SEQ ID NO: 4394302 - DNA, 21 bp, Homo sapiens
gttatttttctcttgtaccat

SEQ ID NO: 4394303 - DNA, 13 bp, Homo sapiens
gttcaacaaagaa

SEQ ID NO: 4394304 - DNA, 23 bp, Homo sapiens
gttcaacaaagaaacaaagatgt

SEQ ID NO: 4394305 - DNA, 15 bp, Homo sapiens
gttcaagaccagcct

SEQ ID NO: 4394306 - DNA, 18 bp, Homo sapiens
gttcaagcacactggaat

SEQ ID NO: 4394307 - DNA, 15 bp, Homo sapiens
gttcaagcagttctc

SEQ ID NO: 4394308 - DNA, 13 bp, Homo sapiens
gttcaagcctgtg

SEQ ID NO: 4394309 - DNA, 14 bp, Homo sapiens
gttcaatttcatgt

SEQ ID NO: 4394310 - DNA, 12 bp, Homo sapiens
gttcacaaactg

SEQ ID NO: 4394311 - DNA, 19 bp, Homo sapiens
gttcacacagcccagttcc

SEQ ID NO: 4394312 - DNA, 16 bp, Homo sapiens
gttcacaccagagaac

SEQ ID NO: 4394313 - DNA, 22 bp, Homo sapiens
gttcacctccaagcatttcatg

SEQ ID NO: 4394314 - DNA, 23 bp, Homo sapiens
gttcacgccattctcctgcctca

SEQ ID NO: 4394315 - DNA, 16 bp, Homo sapiens
gttcacttttgacaaa

SEQ ID NO: 4394316 - DNA, 20 bp, Homo sapiens
gttcagaaatagctcctcaa

SEQ ID NO: 4394317 - DNA, 19 bp, Homo sapiens
gttcagataattgaataag

SEQ ID NO: 4394318 - DNA, 17 bp, Homo sapiens
gttcagcaccaccctag

SEQ ID NO: 4394319 - DNA, 15 bp, Homo sapiens
gttcagcacttgtct

SEQ ID NO: 4394320 - DNA, 22 bp, Homo sapiens
gttcagcacttgtctcatttta

SEQ ID NO: 4394321 - DNA, 23 bp, Homo sapiens
gttcagcacttgtctcattttaa

SEQ ID NO: 4394322 - DNA, 16 bp, Homo sapiens
gttcagcattcttagc

SEQ ID NO: 4394323 - DNA, 15 bp, Homo sapiens
gttcagcccctcctc

SEQ ID NO: 4394324 - DNA, 17 bp, Homo sapiens
gttcagcccctcctctg

SEQ ID NO: 4394325 - DNA, 22 bp, Homo sapiens
gttcagcccctcctctgccacc

SEQ ID NO: 4394326 - DNA, 20 bp, Homo sapiens
gttcaggggactcagccctg

SEQ ID NO: 4394327 - DNA, 20 bp, Homo sapiens
gttcagtttttttttttcca

SEQ ID NO: 4394328 - DNA, 19 bp, Homo sapiens
gttcatatttatactttgc

SEQ ID NO: 4394329 - DNA, 23 bp, Homo sapiens
gttcatgatgcagtctcctcttt

SEQ ID NO: 4394330 - DNA, 16 bp, Homo sapiens
gttcatgcagctgtgg

SEQ ID NO: 4394331 - DNA, 18 bp, Homo sapiens
gttcatggattacttctc

SEQ ID NO: 4394332 - DNA, 18 bp, Homo sapiens
gttcattagaaatatttt

SEQ ID NO: 4394333 - DNA, 12 bp, Homo sapiens
gttcatttcatt

SEQ ID NO: 4394334 - DNA, 21 bp, Homo sapiens
gttcattttaagtaacgtgct

SEQ ID NO: 4394335 - DNA, 17 bp, Homo sapiens
gttcattttgaaaatat

SEQ ID NO: 4394336 - DNA, 14 bp, Homo sapiens
gttccaaattcagt

SEQ ID NO: 4394337 - DNA, 15 bp, Homo sapiens
gttccaaattcagtt

SEQ ID NO: 4394338 - DNA, 20 bp, Homo sapiens
gttccaaattcagtttcata

SEQ ID NO: 4394339 - DNA, 14 bp, Homo sapiens
gttccacctgccac

SEQ ID NO: 4394340 - DNA, 20 bp, Homo sapiens
gttccacttccaggtctgcc

SEQ ID NO: 4394341 - DNA, 18 bp, Homo sapiens
gttccagactcaggttcc

SEQ ID NO: 4394342 - DNA, 22 bp, Homo sapiens
gttccagactcaggttccagaa

SEQ ID NO: 4394343 - DNA, 18 bp, Homo sapiens
gttccagccttctctcaa

SEQ ID NO: 4394344 - DNA, 20 bp, Homo sapiens
gttccagccttctctcaagg

SEQ ID NO: 4394345 - DNA, 16 bp, Homo sapiens
gttccagctctttgaa

SEQ ID NO: 4394346 - DNA, 23 bp, Homo sapiens
gttccagtcctaactttctgaat

SEQ ID NO: 4394347 - DNA, 17 bp, Homo sapiens
gttcccactgaggccct

SEQ ID NO: 4394348 - DNA, 17 bp, Homo sapiens
gttcccagcccctcctc

SEQ ID NO: 4394349 - DNA, 20 bp, Homo sapiens
gttcccagcccctcctccct

SEQ ID NO: 4394350 - DNA, 23 bp, Homo sapiens
gttcccagcccctcctccctcag

SEQ ID NO: 4394351 - DNA, 16 bp, Homo sapiens
gttcccagcccctgca

SEQ ID NO: 4394352 - DNA, 20 bp, Homo sapiens
gttcccctagtaagtgcctt

SEQ ID NO: 4394353 - DNA, 23 bp, Homo sapiens
gttcccctagtaagtgccttcca

SEQ ID NO: 4394354 - DNA, 13 bp, Homo sapiens
gttccccttccac

SEQ ID NO: 4394355 - DNA, 15 bp, Homo sapiens
gttccccttccactg

SEQ ID NO: 4394356 - DNA, 13 bp, Homo sapiens
gttccctccccaa

SEQ ID NO: 4394357 - DNA, 17 bp, Homo sapiens
gttccctgaaaacccag

SEQ ID NO: 4394358 - DNA, 20 bp, Homo sapiens
gttccctgaaaacccagaga

SEQ ID NO: 4394359 - DNA, 20 bp, Homo sapiens
gttcccttgaccattggctg

SEQ ID NO: 4394360 - DNA, 14 bp, Homo sapiens
gttcccttggcctc

SEQ ID NO: 4394361 - DNA, 22 bp, Homo sapiens
gttccctttccttccatcccta

SEQ ID NO: 4394362 - DNA, 19 bp, Homo sapiens
gttccctttgtctttcaaa

SEQ ID NO: 4394363 - DNA, 22 bp, Homo sapiens
gttccgcttctctcttttaaag

SEQ ID NO: 4394364 - DNA, 21 bp, Homo sapiens
gttccgtgggaccctcagcag

SEQ ID NO: 4394365 - DNA, 18 bp, Homo sapiens
gttcctcatgttgctgaa

SEQ ID NO: 4394366 - DNA, 22 bp, Homo sapiens
gttcctcccccagttcctccca

SEQ ID NO: 4394367 - DNA, 14 bp, Homo sapiens
gttcctcccctgta

SEQ ID NO: 4394368 - DNA, 19 bp, Homo sapiens
gttcctccttttcttcacc

SEQ ID NO: 4394369 - DNA, 16 bp, Homo sapiens
gttcctcgccctgggt

SEQ ID NO: 4394370 - DNA, 14 bp, Homo sapiens
gttcctctgcctgc

SEQ ID NO: 4394371 - DNA, 15 bp, Homo sapiens
gttcctctgcctgcc

SEQ ID NO: 4394372 - DNA, 18 bp, Homo sapiens
gttcctctgggtttctaa

SEQ ID NO: 4394373 - DNA, 14 bp, Homo sapiens
gttcctctgtacag

SEQ ID NO: 4394374 - DNA, 16 bp, Homo sapiens
gttcctgaagctgctg

SEQ ID NO: 4394375 - DNA, 19 bp, Homo sapiens
gttcctgaagctgctgtgt

SEQ ID NO: 4394376 - DNA, 21 bp, Homo sapiens
gttcctgaattctatttgctg

SEQ ID NO: 4394377 - DNA, 20 bp, Homo sapiens
gttcctgtaaaatccattta

SEQ ID NO: 4394378 - DNA, 20 bp, Homo sapiens
gttcctgttcagtaataaaa

SEQ ID NO: 4394379 - DNA, 17 bp, Homo sapiens
gttccttatccctctct

SEQ ID NO: 4394380 - DNA, 19 bp, Homo sapiens
gttccttatccctctcttc

SEQ ID NO: 4394381 - DNA, 13 bp, Homo sapiens
gttccttctggtg

SEQ ID NO: 4394382 - DNA, 15 bp, Homo sapiens
gttcctttttctttt

SEQ ID NO: 4394383 - DNA, 19 bp, Homo sapiens
gttccttttttgtatatta

SEQ ID NO: 4394384 - DNA, 19 bp, Homo sapiens
gttcgagaccaacctgacc

SEQ ID NO: 4394385 - DNA, 16 bp, Homo sapiens
gttcgccgcgtggaat

SEQ ID NO: 4394386 - DNA, 17 bp, Homo sapiens
gttcgtttccatcatgt

SEQ ID NO: 4394387 - DNA, 14 bp, Homo sapiens
gttctaaaaagatg

SEQ ID NO: 4394388 - DNA, 15 bp, Homo sapiens
gttctaaaaagatgt

SEQ ID NO: 4394389 - DNA, 15 bp, Homo sapiens
gttctaaatattgct

SEQ ID NO: 4394390 - DNA, 12 bp, Homo sapiens
gttctaaatgca

SEQ ID NO: 4394391 - DNA, 16 bp, Homo sapiens
gttgcatgtagtaaca

SEQ ID NO: 4394392 - DNA, 20 bp, Homo sapiens
gttgcattaattgtgctgtt

SEQ ID NO: 4394393 - DNA, 17 bp, Homo sapiens
gttgccagaggccctgg

SEQ ID NO: 4394394 - DNA, 23 bp, Homo sapiens
gttgccatcctaccgtcttttcc

SEQ ID NO: 4394395 - DNA, 20 bp, Homo sapiens
gttgcccaaggttgcacagc

SEQ ID NO: 4394396 - DNA, 16 bp, Homo sapiens
gttgccgagcccagct

SEQ ID NO: 4394397 - DNA, 22 bp, Homo sapiens
gttgcctaattggaaagtgcca

SEQ ID NO: 4394398 - DNA, 21 bp, Homo sapiens
gttgcctcccccgcctccagt

SEQ ID NO: 4394399 - DNA, 15 bp, Homo sapiens
gttgcctgaaaaatg

SEQ ID NO: 4394400 - DNA, 15 bp, Homo sapiens
gttgccttgcatttg

SEQ ID NO: 4394401 - DNA, 17 bp, Homo sapiens
gttgcgttcctttcttt

SEQ ID NO: 4394402 - DNA, 15 bp, Homo sapiens
gttgctatacatgtt

SEQ ID NO: 4394403 - DNA, 21 bp, Homo sapiens
gttgcttctcaggctatatgc

SEQ ID NO: 4394404 - DNA, 17 bp, Homo sapiens
gttggaatggatttttc

SEQ ID NO: 4394405 - DNA, 20 bp, Homo sapiens
gttggacatttttttcgaat

SEQ ID NO: 4394406 - DNA, 16 bp, Homo sapiens
gttggagttccctcag

SEQ ID NO: 4394407 - DNA, 20 bp, Homo sapiens
gttggatttttgtcttgtgt

SEQ ID NO: 4394408 - DNA, 15 bp, Homo sapiens
gttggcactgtaagg

SEQ ID NO: 4394409 - DNA, 12 bp, Homo sapiens
gtttctgactct

SEQ ID NO: 4394410 - DNA, 19 bp, Homo sapiens
gtttctgatctgtactttg

SEQ ID NO: 4394411 - DNA, 21 bp, Homo sapiens
gtttctgatctgtactttgtg

SEQ ID NO: 4394412 - DNA, 20 bp, Homo sapiens
gtttctggattagcttttcc

SEQ ID NO: 4394413 - DNA, 14 bp, Homo sapiens
gtttctggatttca

SEQ ID NO: 4394414 - DNA, 14 bp, Homo sapiens
gtttctggtgtctg

SEQ ID NO: 4394415 - DNA, 19 bp, Homo sapiens
gtttctgtcctgtaactgt

SEQ ID NO: 4394416 - DNA, 14 bp, Homo sapiens
gtttctgttccaaa

SEQ ID NO: 4394417 - DNA, 15 bp, Homo sapiens
gtttctgttccaaat

SEQ ID NO: 4394418 - DNA, 14 bp, Homo sapiens
gtttctgttggata

SEQ ID NO: 4394419 - DNA, 18 bp, Homo sapiens
gtttcttcatttctctgc

SEQ ID NO: 4394420 - DNA, 20 bp, Homo sapiens
gtttcttgccttttgttaat

SEQ ID NO: 4394421 - DNA, 16 bp, Homo sapiens
gtttctttagtttttg

SEQ ID NO: 4394422 - DNA, 21 bp, Homo sapiens
gtttctttgtggtctgtgtca

SEQ ID NO: 4394423 - DNA, 23 bp, Homo sapiens
gtttcttttcacattaggctgtt

SEQ ID NO: 4394424 - DNA, 20 bp, Homo sapiens
gtttgaaaagcaatattgta

SEQ ID NO: 4394425 - DNA, 11 bp, Homo sapiens
gtttgaaattc

SEQ ID NO: 4394426 - DNA, 18 bp, Homo sapiens
gtttgaaattctgaattt

SEQ ID NO: 4394427 - DNA, 23 bp, Homo sapiens
gtttgaaattctgaatttgcaaa

SEQ ID NO: 4394428 - DNA, 15 bp, Homo sapiens
gtttgacaaacacaa

SEQ ID NO: 4394429 - DNA, 16 bp, Homo sapiens
gtttgactttttggaa

SEQ ID NO: 4394430 - DNA, 21 bp, Homo sapiens
gtttgagaccaggctgggcat

SEQ ID NO: 4394431 - DNA, 15 bp, Homo sapiens
gtttgagctcagacc

SEQ ID NO: 4394432 - DNA, 18 bp, Homo sapiens
gtttgagctgccttccct

SEQ ID NO: 4394433 - DNA, 23 bp, Homo sapiens
gtttgaggctgcaatgagccatg

SEQ ID NO: 4394434 - DNA, 16 bp, Homo sapiens
gtttgatagattttct

SEQ ID NO: 4394435 - DNA, 15 bp, Homo sapiens
gtttgatcagacagc

SEQ ID NO: 4394436 - DNA, 19 bp, Homo sapiens
gtttgatcagacagcttga

SEQ ID NO: 4394437 - DNA, 22 bp, Homo sapiens
gtttgatgcaggcacttattgt

SEQ ID NO: 4394438 - DNA, 18 bp, Homo sapiens
gtttgatgtttttaaagg

SEQ ID NO: 4394439 - DNA, 18 bp, Homo sapiens
gtttgcaaaaaatgtttt

SEQ ID NO: 4394440 - DNA, 19 bp, Homo sapiens
gtttgcaaacctgcagttt

SEQ ID NO: 4394441 - DNA, 15 bp, Homo sapiens
gtttgcaagaatgaa

SEQ ID NO: 4394442 - DNA, 22 bp, Homo sapiens
gtttgcaagaatgaaatgaatg

SEQ ID NO: 4394443 - DNA, 23 bp, Homo sapiens
gtttgcaagaatgaaatgaatga

SEQ ID NO: 4394444 - DNA, 21 bp, Homo sapiens
gtttgcagaaaagcacctgcc

SEQ ID NO: 4394445 - DNA, 13 bp, Homo sapiens
gtttgctaatgtt

SEQ ID NO: 4394446 - DNA, 22 bp, Homo sapiens
gtttgctgttgggtttttgctg

SEQ ID NO: 4394447 - DNA, 19 bp, Homo sapiens
gtttgctttgctttgtagg

SEQ ID NO: 4394448 - DNA, 15 bp, Homo sapiens
gtttggaatattaaa

SEQ ID NO: 4394449 - DNA, 21 bp, Homo sapiens
gtttggatatgtaaaacattt

SEQ ID NO: 4394450 - DNA, 19 bp, Homo sapiens
gtttggatgtctgtagcat

SEQ ID NO: 4394451 - DNA, 23 bp, Homo sapiens
gtttggcaaaactcaggcagaag

SEQ ID NO: 4394452 - DNA, 13 bp, Homo sapiens
gtttgggctggag

SEQ ID NO: 4394453 - DNA, 14 bp, Homo sapiens
gtttggtataaatt

SEQ ID NO: 4394454 - DNA, 18 bp, Homo sapiens
gtttgtacatatcaaata

SEQ ID NO: 4394455 - DNA, 14 bp, Homo sapiens
gtttgtggcctcag

SEQ ID NO: 4394456 - DNA, 22 bp, Homo sapiens
gtttgtggctgggggcaggagg

SEQ ID NO: 4394457 - DNA, 22 bp, Homo sapiens
gtttgtgtatttacgctttgat

SEQ ID NO: 4394458 - DNA, 15 bp, Homo sapiens
gtttgtgtgtttcaa

SEQ ID NO: 4394459 - DNA, 22 bp, Homo sapiens
gtttgttgagctggtaacatcg

SEQ ID NO: 4394460 - DNA, 20 bp, Homo sapiens
gtttgtttatatcactgtct

SEQ ID NO: 4394461 - DNA, 15 bp, Homo sapiens
gtttgtttctttgtg

SEQ ID NO: 4394462 - DNA, 13 bp, Homo sapiens
gtttgtttgttgc

SEQ ID NO: 4394463 - DNA, 12 bp, Homo sapiens
gtttgtttttgg

SEQ ID NO: 4394464 - DNA, 16 bp, Homo sapiens
gttttaaaaaagcatt

SEQ ID NO: 4394465 - DNA, 23 bp, Homo sapiens
gttttaaaatgtgaggcaataag

SEQ ID NO: 4394466 - DNA, 21 bp, Homo sapiens
gttttaaacccaaaatatata

SEQ ID NO: 4394467 - DNA, 14 bp, Homo sapiens
gttttaaatgtaca

SEQ ID NO: 4394468 - DNA, 15 bp, Homo sapiens
gttttaaatgtacag

SEQ ID NO: 4394469 - DNA, 20 bp, Homo sapiens
gttttaaccagtacttctaa

SEQ ID NO: 4394470 - DNA, 16 bp, Homo sapiens
gttttaactgtggata

SEQ ID NO: 4394471 - DNA, 22 bp, Homo sapiens
gttttaactgtggatattgtta

SEQ ID NO: 4394472 - DNA, 23 bp, Homo sapiens
gttttaagctaaagcctgaattt

SEQ ID NO: 4394473 - DNA, 20 bp, Homo sapiens
gttttaataccacagctatt

SEQ ID NO: 4394474 - DNA, 19 bp, Homo sapiens
gttttacaagaaaacaatg

SEQ ID NO: 4394475 - DNA, 23 bp, Homo sapiens
gttttacagagaggatacattta

SEQ ID NO: 4394476 - DNA, 21 bp, Homo sapiens
gttttacttttaaactgtgta

SEQ ID NO: 4394477 - DNA, 14 bp, Homo sapiens
gttttagaaattgg

SEQ ID NO: 4394478 - DNA, 15 bp, Homo sapiens
gttttatatattatg

SEQ ID NO: 4394479 - DNA, 13 bp, Homo sapiens
gttttattacaaa

SEQ ID NO: 4394480 - DNA, 21 bp, Homo sapiens
gttttattggggaattaaata

SEQ ID NO: 4394481 - DNA, 23 bp, Homo sapiens
gttttatttatatcttgttatta

SEQ ID NO: 4394482 - DNA, 12 bp, Homo sapiens
gttttatttcat

SEQ ID NO: 4394483 - DNA, 14 bp, Homo sapiens
gttttattttatgt

SEQ ID NO: 4394484 - DNA, 19 bp, Homo sapiens
gttttcagaacctcttccc

SEQ ID NO: 4394485 - DNA, 20 bp, Homo sapiens
gttttcagaacctcttcccc

SEQ ID NO: 4394486 - DNA, 16 bp, Homo sapiens
gttttcagaagaaata

SEQ ID NO: 4394487 - DNA, 13 bp, Homo sapiens
gttttcatcattt

SEQ ID NO: 4394488 - DNA, 16 bp, Homo sapiens
gttttcatcatttcag

SEQ ID NO: 4394489 - DNA, 14 bp, Homo sapiens
gttttccctctgct

SEQ ID NO: 4394490 - DNA, 15 bp, Homo sapiens
gttttccctctgctg

SEQ ID NO: 4394491 - DNA, 16 bp, Homo sapiens
gttttccctctgctgc

SEQ ID NO: 4394492 - DNA, 15 bp, Homo sapiens
gttttccctgcactg

SEQ ID NO: 4394493 - DNA, 16 bp, Homo sapiens
gttttcctcagctcta

SEQ ID NO: 4394494 - DNA, 17 bp, Homo sapiens
gttttcctcagctctag

SEQ ID NO: 4394495 - DNA, 15 bp, Homo sapiens
gttttccttgctatt

SEQ ID NO: 4394496 - DNA, 18 bp, Homo sapiens
gttttctccaagagctac

SEQ ID NO: 4394497 - DNA, 15 bp, Homo sapiens
gttttctgagaaaga

SEQ ID NO: 4394498 - DNA, 22 bp, Homo sapiens
gttttctgagaaagactattca

SEQ ID NO: 4394499 - DNA, 16 bp, Homo sapiens
gttttctgtagactct

SEQ ID NO: 4394500 - DNA, 16 bp, Homo sapiens
gttttcttaacttaaa

SEQ ID NO: 4394501 - DNA, 12 bp, Homo sapiens
gttttcttccca

SEQ ID NO: 4394502 - DNA, 15 bp, Homo sapiens
gttttcttcccatca

SEQ ID NO: 4394503 - DNA, 20 bp, Homo sapiens
gttttctttcctcctttcct

SEQ ID NO: 4394504 - DNA, 15 bp, Homo sapiens
gttttctttggtttt

SEQ ID NO: 4394505 - DNA, 19 bp, Homo sapiens
gttttgaagctactgtgtg

SEQ ID NO: 4394506 - DNA, 18 bp, Homo sapiens
gttttgaataaattttca

SEQ ID NO: 4394507 - DNA, 18 bp, Homo sapiens
gttttgaatattactcct

SEQ ID NO: 4394508 - DNA, 18 bp, Homo sapiens
gttttgaatggtgttgta

SEQ ID NO: 4394509 - DNA, 16 bp, Homo sapiens
gttttgacacttccca

SEQ ID NO: 4394510 - DNA, 15 bp, Homo sapiens
gttttgcacagccaa

SEQ ID NO: 4394511 - DNA, 22 bp, Homo sapiens
gttttgcacagccaaatttaaa

SEQ ID NO: 4394512 - DNA, 17 bp, Homo sapiens
gttttgctacataatta

SEQ ID NO: 4394513 - DNA, 20 bp, Homo sapiens
gttttgcttgggcctccctg

SEQ ID NO: 4394514 - DNA, 18 bp, Homo sapiens
gttttgctttggaaacac

SEQ ID NO: 4394515 - DNA, 15 bp, Homo sapiens
gttttgtaaaagaaa

SEQ ID NO: 4394516 - DNA, 15 bp, Homo sapiens
gttttgtaccagtga

SEQ ID NO: 4394517 - DNA, 17 bp, Homo sapiens
gttttgtaccagtgaat

SEQ ID NO: 4394518 - DNA, 12 bp, Homo sapiens
gttttgtattct

SEQ ID NO: 4394519 - DNA, 14 bp, Homo sapiens
gttttgttcccctc

SEQ ID NO: 4394520 - DNA, 17 bp, Homo sapiens
gttttgttcccctcctc

SEQ ID NO: 4394521 - DNA, 20 bp, Homo sapiens
gttttgttcccctcctccac

SEQ ID NO: 4394522 - DNA, 22 bp, Homo sapiens
gttttgttcccctcctccactc

SEQ ID NO: 4394523 - DNA, 19 bp, Homo sapiens
gttttgttggctttttgaa

SEQ ID NO: 4394524 - DNA, 16 bp, Homo sapiens
gttttgtttcactttg

SEQ ID NO: 4394525 - DNA, 19 bp, Homo sapiens
gtttttaaaaagagtaatt

SEQ ID NO: 4394526 - DNA, 20 bp, Homo sapiens
gtttttaaaatttatttgca

SEQ ID NO: 4394527 - DNA, 21 bp, Homo sapiens
gtttttaaaatttatttgcaa

SEQ ID NO: 4394528 - DNA, 16 bp, Homo sapiens
gtttttaaattttgta

SEQ ID NO: 4394529 - DNA, 20 bp, Homo sapiens
gtttttaaattttgtaatga

SEQ ID NO: 4394530 - DNA, 14 bp, Homo sapiens
gtttttaactctac

SEQ ID NO: 4394531 - DNA, 21 bp, Homo sapiens
gtttttaactctactgtgtaa

SEQ ID NO: 4394532 - DNA, 18 bp, Homo sapiens
gtttttaatgtatagtaa

SEQ ID NO: 4394533 - DNA, 18 bp, Homo sapiens
gtttttatagttattaaa

SEQ ID NO: 4394534 - DNA, 17 bp, Homo sapiens
gtttttatgagaaactt

SEQ ID NO: 4394535 - DNA, 21 bp, Homo sapiens
gtttttattaatctactgtat

SEQ ID NO: 4394536 - DNA, 14 bp, Homo sapiens
gtttttcacatttt

SEQ ID NO: 4394537 - DNA, 16 bp, Homo sapiens
gtttttcacattttcc

SEQ ID NO: 4394538 - DNA, 12 bp, Homo sapiens
gtttttcagttt

SEQ ID NO: 4394539 - DNA, 14 bp, Homo sapiens
gtttttcatactgt

SEQ ID NO: 4394540 - DNA, 20 bp, Homo sapiens
gtttttcatactgtacacat

SEQ ID NO: 4394541 - DNA, 12 bp, Homo sapiens
gtttttccctaa

SEQ ID NO: 4394542 - DNA, 19 bp, Homo sapiens
gtttttcctgttcttaaga

SEQ ID NO: 4394543 - DNA, 14 bp, Homo sapiens
gtttttcttcagca

SEQ ID NO: 4394544 - DNA, 15 bp, Homo sapiens
gtttttcttgcatgg

SEQ ID NO: 4394545 - DNA, 19 bp, Homo sapiens
gtttttgaaaaaaagtgct

SEQ ID NO: 4394546 - DNA, 15 bp, Homo sapiens
gtttttgcatgaaat

SEQ ID NO: 4394547 - DNA, 12 bp, Homo sapiens
gtttttgctctc

SEQ ID NO: 4394548 - DNA, 19 bp, Homo sapiens
gtttttggattgtcaaaga

SEQ ID NO: 4394549 - DNA, 17 bp, Homo sapiens
gtttttgggatgtctta

SEQ ID NO: 4394550 - DNA, 20 bp, Homo sapiens
gtttttggtcttttataatt

SEQ ID NO: 4394551 - DNA, 17 bp, Homo sapiens
gtttttgtgctgtgggc

SEQ ID NO: 4394552 - DNA, 14 bp, Homo sapiens
gtttttgttttaag

SEQ ID NO: 4394553 - DNA, 15 bp, Homo sapiens
gttttttaaatgact

SEQ ID NO: 4394554 - DNA, 19 bp, Homo sapiens
gttttttaagatagtgtaa

SEQ ID NO: 4394555 - DNA, 23 bp, Homo sapiens
gttttttagtataaatgtacatc

SEQ ID NO: 4394556 - DNA, 15 bp, Homo sapiens
gttttttcaaaatag

SEQ ID NO: 4394557 - DNA, 14 bp, Homo sapiens
gttttttcatggtt

SEQ ID NO: 4394558 - DNA, 15 bp, Homo sapiens
gttttttcctcagtg

SEQ ID NO: 4394559 - DNA, 18 bp, Homo sapiens
gttttttctgtaatgtaa

SEQ ID NO: 4394560 - DNA, 19 bp, Homo sapiens
gttttttctttcccatgta

SEQ ID NO: 4394561 - DNA, 13 bp, Homo sapiens
gtttttttaatga

SEQ ID NO: 4394562 - DNA, 15 bp, Homo sapiens
gttttttttcagttg

SEQ ID NO: 4394563 - DNA, 20 bp, Homo sapiens
taaaaaaaaaaaaaagcttt

SEQ ID NO: 4394564 - DNA, 22 bp, Homo sapiens
taaaaaaaaaaaagtctaccaa

SEQ ID NO: 4394565 - DNA, 20 bp, Homo sapiens
taaaaaaaaaactgctttat

SEQ ID NO: 4394566 - DNA, 21 bp, Homo sapiens
taaaaaaaaacctgagcccca

SEQ ID NO: 4394567 - DNA, 15 bp, Homo sapiens
taaaaaaaagatgaa

SEQ ID NO: 4394568 - DNA, 21 bp, Homo sapiens
taaaaaaactggccttttgat

SEQ ID NO: 4394569 - DNA, 17 bp, Homo sapiens
taaaaaactaaaaacta

SEQ ID NO: 4394570 - DNA, 19 bp, Homo sapiens
taaaaaactaaaaactaga

SEQ ID NO: 4394571 - DNA, 19 bp, Homo sapiens
taaaaaagcttaaaacttt

SEQ ID NO: 4394572 - DNA, 13 bp, Homo sapiens
taaaaaagtctct

SEQ ID NO: 4394573 - DNA, 17 bp, Homo sapiens
taaaaaagtctctattt

SEQ ID NO: 4394574 - DNA, 19 bp, Homo sapiens
taaaaaagtctctatttaa

SEQ ID NO: 4394575 - DNA, 21 bp, Homo sapiens
taaaaaagtctctatttaaat

SEQ ID NO: 4394576 - DNA, 17 bp, Homo sapiens
taaaaaattatggaata

SEQ ID NO: 4394577 - DNA, 23 bp, Homo sapiens
taaaaaattatggaatatcatct

SEQ ID NO: 4394578 - DNA, 15 bp, Homo sapiens
taaaaacaaaatctg

SEQ ID NO: 4394579 - DNA, 14 bp, Homo sapiens
taaaaacatttttt

SEQ ID NO: 4394580 - DNA, 22 bp, Homo sapiens
taaaaacattttttatacattt

SEQ ID NO: 4394581 - DNA, 17 bp, Homo sapiens
taaaaaccttaagtgct

SEQ ID NO: 4394582 - DNA, 20 bp, Homo sapiens
taaaaaccttaagtgctgca

SEQ ID NO: 4394583 - DNA, 23 bp, Homo sapiens
taaaaactaacagctacaaactt

SEQ ID NO: 4394584 - DNA, 14 bp, Homo sapiens
taaaaactatctga

SEQ ID NO: 4394585 - DNA, 23 bp, Homo sapiens
taaaaagaaaatattaaattaca

SEQ ID NO: 4394586 - DNA, 22 bp, Homo sapiens
taaaaagaggatgatttcagaa

SEQ ID NO: 4394587 - DNA, 15 bp, Homo sapiens
taaaaagagtaattt

SEQ ID NO: 4394588 - DNA, 17 bp, Homo sapiens
taaaaagagtaatttca

SEQ ID NO: 4394589 - DNA, 18 bp, Homo sapiens
taaaaagagtaatttcat

SEQ ID NO: 4394590 - DNA, 12 bp, Homo sapiens
taaaaagataat

SEQ ID NO: 4394591 - DNA, 16 bp, Homo sapiens
taaaaagataatctca

SEQ ID NO: 4394592 - DNA, 23 bp, Homo sapiens
taaaaagataatctcagtgcttt

SEQ ID NO: 4394593 - DNA, 18 bp, Homo sapiens
taaaaagattgaagtatt

SEQ ID NO: 4394594 - DNA, 11 bp, Homo sapiens
taaaaaggaca

SEQ ID NO: 4394595 - DNA, 21 bp, Homo sapiens
taaaaagtaatgacttagaaa

SEQ ID NO: 4394596 - DNA, 22 bp, Homo sapiens
taaaaagtccataccttatata

SEQ ID NO: 4394597 - DNA, 15 bp, Homo sapiens
taaaaataaaggaaa

SEQ ID NO: 4394598 - DNA, 13 bp, Homo sapiens
taaaaataaattt

SEQ ID NO: 4394599 - DNA, 15 bp, Homo sapiens
taaaaataactgaga

SEQ ID NO: 4394600 - DNA, 16 bp, Homo sapiens
taaaaatacatagcat

SEQ ID NO: 4394601 - DNA, 18 bp, Homo sapiens
taaaaatataaattgtac

SEQ ID NO: 4394602 - DNA, 20 bp, Homo sapiens
taaaaatcaagttatttcct

SEQ ID NO: 4394603 - DNA, 15 bp, Homo sapiens
taaaaatctccatta

SEQ ID NO: 4394604 - DNA, 18 bp, Homo sapiens
taaaaatgagtcatttgt

SEQ ID NO: 4394605 - DNA, 14 bp, Homo sapiens
taaaaatgctgctc

SEQ ID NO: 4394606 - DNA, 23 bp, Homo sapiens
taaaaatggcagggggtggaatt

SEQ ID NO: 4394607 - DNA, 20 bp, Homo sapiens
taaaaatggtatcaaaatta

SEQ ID NO: 4394608 - DNA, 12 bp, Homo sapiens
taaaaatgtata

SEQ ID NO: 4394609 - DNA, 23 bp, Homo sapiens
taaaaatgtcttgctgttgacat

SEQ ID NO: 4394610 - DNA, 23 bp, Homo sapiens
taaaaattaaattggaaagcagg

SEQ ID NO: 4394611 - DNA, 14 bp, Homo sapiens
taaaaattatcaaa

SEQ ID NO: 4394612 - DNA, 12 bp, Homo sapiens
taaaacaaaaca

SEQ ID NO: 4394613 - DNA, 17 bp, Homo sapiens
taaaacaaaacaaaaca

SEQ ID NO: 4394614 - DNA, 15 bp, Homo sapiens
taaaacaaaatttga

SEQ ID NO: 4394615 - DNA, 17 bp, Homo sapiens
taaaacaaataaatatg

SEQ ID NO: 4394616 - DNA, 12 bp, Homo sapiens
taaaacacatga

SEQ ID NO: 4394617 - DNA, 14 bp, Homo sapiens
taaaacacatgata

SEQ ID NO: 4394618 - DNA, 17 bp, Homo sapiens
taaaacagacactggca

SEQ ID NO: 4394619 - DNA, 18 bp, Homo sapiens
taaaacagacactggcat

SEQ ID NO: 4394620 - DNA, 21 bp, Homo sapiens
taaaacaggcaaagttttaca

SEQ ID NO: 4394621 - DNA, 22 bp, Homo sapiens
taaaacagtcatctagaattca

SEQ ID NO: 4394622 - DNA, 20 bp, Homo sapiens
taaaacatcactatcaattt

SEQ ID NO: 4394623 - DNA, 13 bp, Homo sapiens
taaaacattactt

SEQ ID NO: 4394624 - DNA, 19 bp, Homo sapiens
taaaacattacttatttaa

SEQ ID NO: 4394625 - DNA, 20 bp, Homo sapiens
taaaacatttattttgacat

SEQ ID NO: 4394626 - DNA, 13 bp, Homo sapiens
taaaaccacagca

SEQ ID NO: 4394627 - DNA, 22 bp, Homo sapiens
taaaacctaaaggttatagtag

SEQ ID NO: 4394628 - DNA, 13 bp, Homo sapiens
taaaacctgggat

SEQ ID NO: 4394629 - DNA, 23 bp, Homo sapiens
taaaacggtgctgtgagggaggg

SEQ ID NO: 4394630 - DNA, 21 bp, Homo sapiens
taaaactaaggcttttatttc

SEQ ID NO: 4394631 - DNA, 15 bp, Homo sapiens
taaaactatttgtat

SEQ ID NO: 4394632 - DNA, 21 bp, Homo sapiens
taaaactgtttgacttctcaa

SEQ ID NO: 4394633 - DNA, 18 bp, Homo sapiens
gtgcctgagaccagggtg

SEQ ID NO: 4394634 - DNA, 19 bp, Homo sapiens
gtgcctgagaccagggtgg

SEQ ID NO: 4394635 - DNA, 15 bp, Homo sapiens
gtgcctgattatttt

SEQ ID NO: 4394636 - DNA, 23 bp, Homo sapiens
gtgcctgcacacagagtgaggga

SEQ ID NO: 4394637 - DNA, 15 bp, Homo sapiens
gtgcctggcacagcc

SEQ ID NO: 4394638 - DNA, 14 bp, Homo sapiens
gtgcctggccagat

SEQ ID NO: 4394639 - DNA, 20 bp, Homo sapiens
gtgcctggccccagcctggg

SEQ ID NO: 4394640 - DNA, 22 bp, Homo sapiens
gtgcctggccgcagggcggggc

SEQ ID NO: 4394641 - DNA, 11 bp, Homo sapiens
gtgcctgggag

SEQ ID NO: 4394642 - DNA, 21 bp, Homo sapiens
gtgcctgggtggggctgctcc

SEQ ID NO: 4394643 - DNA, 23 bp, Homo sapiens
gtgcctgtgagcatggggccagg

SEQ ID NO: 4394644 - DNA, 14 bp, Homo sapiens
gtgccttacctcct

SEQ ID NO: 4394645 - DNA, 19 bp, Homo sapiens
gtgccttacctcctgccca

SEQ ID NO: 4394646 - DNA, 21 bp, Homo sapiens
gtgccttacctcctgcccagg

SEQ ID NO: 4394647 - DNA, 18 bp, Homo sapiens
gtgccttatgttgaaaaa

SEQ ID NO: 4394648 - DNA, 15 bp, Homo sapiens
gtgccttcactgggc

SEQ ID NO: 4394649 - DNA, 17 bp, Homo sapiens
gtgccttcactgggcca

SEQ ID NO: 4394650 - DNA, 23 bp, Homo sapiens
gtgccttcctgtttttcacattt

SEQ ID NO: 4394651 - DNA, 23 bp, Homo sapiens
gtgccttggagggtcccaagctg

SEQ ID NO: 4394652 - DNA, 19 bp, Homo sapiens
gtgccttgtcacgccagac

SEQ ID NO: 4394653 - DNA, 18 bp, Homo sapiens
gtgcctttatttccactg

SEQ ID NO: 4394654 - DNA, 17 bp, Homo sapiens
gtgcctttcctgttcag

SEQ ID NO: 4394655 - DNA, 15 bp, Homo sapiens
gtgcgcactgcatgg

SEQ ID NO: 4394656 - DNA, 16 bp, Homo sapiens
gtgcgcactgcatggg

SEQ ID NO: 4394657 - DNA, 22 bp, Homo sapiens
gtgcgctgctctgcaggctggg

SEQ ID NO: 4394658 - DNA, 18 bp, Homo sapiens
gtgcgggatacagctgag

SEQ ID NO: 4394659 - DNA, 17 bp, Homo sapiens
gtgcgggctgaggccag

SEQ ID NO: 4394660 - DNA, 15 bp, Homo sapiens
gtgcgtccacgagct

SEQ ID NO: 4394661 - DNA, 14 bp, Homo sapiens
gtgctaaaggaggc

SEQ ID NO: 4394662 - DNA, 22 bp, Homo sapiens
gtgctaacaacaaagttccact

SEQ ID NO: 4394663 - DNA, 13 bp, Homo sapiens
gtgctaagtgctt

SEQ ID NO: 4394664 - DNA, 22 bp, Homo sapiens
gtgctacaaaaacacagcaagg

SEQ ID NO: 4394665 - DNA, 21 bp, Homo sapiens
gtgctacacccttttccagct

SEQ ID NO: 4394666 - DNA, 18 bp, Homo sapiens
gtgctactccatgcaggg

SEQ ID NO: 4394667 - DNA, 14 bp, Homo sapiens
gtgctacttcttct

SEQ ID NO: 4394668 - DNA, 16 bp, Homo sapiens
gtgctaggggatgagg

SEQ ID NO: 4394669 - DNA, 16 bp, Homo sapiens
gtggcctcagccctca

SEQ ID NO: 4394670 - DNA, 19 bp, Homo sapiens
gtggcctcagccctcagaa

SEQ ID NO: 4394671 - DNA, 16 bp, Homo sapiens
gtggcctggccaggag

SEQ ID NO: 4394672 - DNA, 21 bp, Homo sapiens
gtggcctggccaggagctctt

SEQ ID NO: 4394673 - DNA, 13 bp, Homo sapiens
gtggcctgtgctt

SEQ ID NO: 4394674 - DNA, 23 bp, Homo sapiens
gtggcgggtgatggccagcccct

SEQ ID NO: 4394675 - DNA, 13 bp, Homo sapiens
gtggcggtgcctg

SEQ ID NO: 4394676 - DNA, 22 bp, Homo sapiens
gtggctcagtgccacctatgcc

SEQ ID NO: 4394677 - DNA, 21 bp, Homo sapiens
gtggctcccctgcccagcctg

SEQ ID NO: 4394678 - DNA, 15 bp, Homo sapiens
gtggctcctcccagc

SEQ ID NO: 4394679 - DNA, 16 bp, Homo sapiens
gtggctcgggaggcga

SEQ ID NO: 4394680 - DNA, 15 bp, Homo sapiens
gtggctctgccctgg

SEQ ID NO: 4394681 - DNA, 15 bp, Homo sapiens
gtggctgacccagtc

SEQ ID NO: 4394682 - DNA, 17 bp, Homo sapiens
gtggctgacccagtccc

SEQ ID NO: 4394683 - DNA, 19 bp, Homo sapiens
gtggctgacccagtccctg

SEQ ID NO: 4394684 - DNA, 18 bp, Homo sapiens
gtggctgaggaggcctcc

SEQ ID NO: 4394685 - DNA, 15 bp, Homo sapiens
gtggctgccccggcc

SEQ ID NO: 4394686 - DNA, 13 bp, Homo sapiens
gtggctgctctgg

SEQ ID NO: 4394687 - DNA, 15 bp, Homo sapiens
gtggctgctctggga

SEQ ID NO: 4394688 - DNA, 17 bp, Homo sapiens
gtggctggatctgtgag

SEQ ID NO: 4394689 - DNA, 12 bp, Homo sapiens
gtggctggctct

SEQ ID NO: 4394690 - DNA, 11 bp, Homo sapiens
gtggctggggg

SEQ ID NO: 4394691 - DNA, 15 bp, Homo sapiens
gtggctggtgtcccc

SEQ ID NO: 4394692 - DNA, 16 bp, Homo sapiens
gtggctggtgtcccct

SEQ ID NO: 4394693 - DNA, 16 bp, Homo sapiens
gtggctgtccctgtgg

SEQ ID NO: 4394694 - DNA, 23 bp, Homo sapiens
gtggcttcccttttctttgttca

SEQ ID NO: 4394695 - DNA, 12 bp, Homo sapiens
gtggcttctcca

SEQ ID NO: 4394696 - DNA, 18 bp, Homo sapiens
gtggctttttgttcagaa

SEQ ID NO: 4394697 - DNA, 17 bp, Homo sapiens
gtgggaagcgtctgtcc

SEQ ID NO: 4394698 - DNA, 21 bp, Homo sapiens
gtgggaccctcagcagctctg

SEQ ID NO: 4394699 - DNA, 20 bp, Homo sapiens
gtgggacgggatggttctgg

SEQ ID NO: 4394700 - DNA, 18 bp, Homo sapiens
gtgggagccgcagagcct

SEQ ID NO: 4394701 - DNA, 19 bp, Homo sapiens
gtgggagccgcagagcctg

SEQ ID NO: 4394702 - DNA, 20 bp, Homo sapiens
gtgggagccgcagagcctga

SEQ ID NO: 4394703 - DNA, 15 bp, Homo sapiens
gtgggaggagatgaa

SEQ ID NO: 4394704 - DNA, 14 bp, Homo sapiens
gtgggagggaggag

SEQ ID NO: 4394705 - DNA, 16 bp, Homo sapiens
gtgggagggaggaggg

SEQ ID NO: 4394706 - DNA, 17 bp, Homo sapiens
gtgggagtgtgtgcctg

SEQ ID NO: 4394707 - DNA, 15 bp, Homo sapiens
gtgggatcctccctc

SEQ ID NO: 4394708 - DNA, 16 bp, Homo sapiens
gtgggatcctccctca

SEQ ID NO: 4394709 - DNA, 20 bp, Homo sapiens
gtgggatcctccctcatggc

SEQ ID NO: 4394710 - DNA, 17 bp, Homo sapiens
gtgggatggaggagaag

SEQ ID NO: 4394711 - DNA, 15 bp, Homo sapiens
gtgggcaatttagaa

SEQ ID NO: 4394712 - DNA, 14 bp, Homo sapiens
gtgggcagcaccct

SEQ ID NO: 4394713 - DNA, 21 bp, Homo sapiens
gtgggccacacccaggaaggg

SEQ ID NO: 4394714 - DNA, 18 bp, Homo sapiens
gtgggccaggacaggccc

SEQ ID NO: 4394715 - DNA, 17 bp, Homo sapiens
gtgggccttgctgggga

SEQ ID NO: 4394716 - DNA, 14 bp, Homo sapiens
gtgggcggctcctg

SEQ ID NO: 4394717 - DNA, 14 bp, Homo sapiens
gtgggcttgattct

SEQ ID NO: 4394718 - DNA, 16 bp, Homo sapiens
gtggggaacaggtccc

SEQ ID NO: 4394719 - DNA, 15 bp, Homo sapiens
gtggggactgaacct

SEQ ID NO: 4394720 - DNA, 18 bp, Homo sapiens
gtggggcctcaggctccg

SEQ ID NO: 4394721 - DNA, 22 bp, Homo sapiens
gtggggcctcaggctccgggca

SEQ ID NO: 4394722 - DNA, 22 bp, Homo sapiens
gtggggcctttgccagcagagc

SEQ ID NO: 4394723 - DNA, 14 bp, Homo sapiens
gtggggctgctcct

SEQ ID NO: 4394724 - DNA, 14 bp, Homo sapiens
gtgggggcagaggg

SEQ ID NO: 4394725 - DNA, 14 bp, Homo sapiens
gtgggggtctgtgt

SEQ ID NO: 4394726 - DNA, 15 bp, Homo sapiens
gtgggggtggaggct

SEQ ID NO: 4394727 - DNA, 14 bp, Homo sapiens
gtgggggtggccat

SEQ ID NO: 4394728 - DNA, 21 bp, Homo sapiens
gtgggggtggccatccctggg

SEQ ID NO: 4394729 - DNA, 18 bp, Homo sapiens
gtggggtacatttctctg

SEQ ID NO: 4394730 - DNA, 14 bp, Homo sapiens
gtggggtctccctc

SEQ ID NO: 4394731 - DNA, 19 bp, Homo sapiens
gtggggtctccctctcctg

SEQ ID NO: 4394732 - DNA, 18 bp, Homo sapiens
gtggggtgacgggactca

SEQ ID NO: 4394733 - DNA, 15 bp, Homo sapiens
gtggggtgctgccct

SEQ ID NO: 4394734 - DNA, 12 bp, Homo sapiens
gtggggtggggt

SEQ ID NO: 4394735 - DNA, 18 bp, Homo sapiens
gtgggtcccggctctgtg

SEQ ID NO: 4394736 - DNA, 13 bp, Homo sapiens
gtgggtgagagag

SEQ ID NO: 4394737 - DNA, 15 bp, Homo sapiens
gtgggtgagagagac

SEQ ID NO: 4394738 - DNA, 12 bp, Homo sapiens
gtgggtgctgcc

SEQ ID NO: 4394739 - DNA, 13 bp, Homo sapiens
gtgggtgctgcca

SEQ ID NO: 4394740 - DNA, 15 bp, Homo sapiens
gtggtaactgaaggt

SEQ ID NO: 4394741 - DNA, 14 bp, Homo sapiens
gtggtacttgatca

SEQ ID NO: 4394742 - DNA, 21 bp, Homo sapiens
gtggtagccatcaagcacttc

SEQ ID NO: 4394743 - DNA, 14 bp, Homo sapiens
gtggtagctccagc

SEQ ID NO: 4394744 - DNA, 15 bp, Homo sapiens
gtggtagctccagcg

SEQ ID NO: 4394745 - DNA, 14 bp, Homo sapiens
gtggtatagaaatg

SEQ ID NO: 4394746 - DNA, 15 bp, Homo sapiens
gtggtattttccagc

SEQ ID NO: 4394747 - DNA, 17 bp, Homo sapiens
gtggtcagcaggtgtct

SEQ ID NO: 4394748 - DNA, 18 bp, Homo sapiens
gtggtcgtcaactttcct

SEQ ID NO: 4394749 - DNA, 20 bp, Homo sapiens
gtggtcgtcaactttcctca

SEQ ID NO: 4394750 - DNA, 21 bp, Homo sapiens
gtggtgcctgcacacagagtg

SEQ ID NO: 4394751 - DNA, 13 bp, Homo sapiens
gtggtggcctggt

SEQ ID NO: 4394752 - DNA, 12 bp, Homo sapiens
gtggtgggactc

SEQ ID NO: 4394753 - DNA, 14 bp, Homo sapiens
gtggtgtggagaag

SEQ ID NO: 4394754 - DNA, 22 bp, Homo sapiens
gtggtgtggagaagccacaggc

SEQ ID NO: 4394755 - DNA, 17 bp, Homo sapiens
gtggttcaagcacactg

SEQ ID NO: 4394756 - DNA, 13 bp, Homo sapiens
gtggttcctctgc

SEQ ID NO: 4394757 - DNA, 22 bp, Homo sapiens
gtggtttgtacatatcaaatag

SEQ ID NO: 4394758 - DNA, 17 bp, Homo sapiens
gtgtaaaatattttgaa

SEQ ID NO: 4394759 - DNA, 18 bp, Homo sapiens
gtgtaaaatattttgaat

SEQ ID NO: 4394760 - DNA, 12 bp, Homo sapiens
gtgtaaaattaa

SEQ ID NO: 4394761 - DNA, 22 bp, Homo sapiens
gtgtaaaattaatgtaataaag

SEQ ID NO: 4394762 - DNA, 12 bp, Homo sapiens
gtgtaaagactg

SEQ ID NO: 4394763 - DNA, 20 bp, Homo sapiens
gtgtaaatattagtgcagtt

SEQ ID NO: 4394764 - DNA, 13 bp, Homo sapiens
gtgtaagaactgt

SEQ ID NO: 4394765 - DNA, 21 bp, Homo sapiens
gtgtaagaactgtacattgtg

SEQ ID NO: 4394766 - DNA, 21 bp, Homo sapiens
gtgtaataaagtgttttcaga

SEQ ID NO: 4394767 - DNA, 19 bp, Homo sapiens
gtgtaatccaggggtgtag

SEQ ID NO: 4394768 - DNA, 22 bp, Homo sapiens
gtgtaatttaaaattgtgatgt

SEQ ID NO: 4394769 - DNA, 23 bp, Homo sapiens
gtgtaatttaaaattgtgatgtg

SEQ ID NO: 4394770 - DNA, 14 bp, Homo sapiens
gtgtacaatgtaca

SEQ ID NO: 4394771 - DNA, 14 bp, Homo sapiens
gtgtacataactga

SEQ ID NO: 4394772 - DNA, 16 bp, Homo sapiens
gtgtacataactgaaa

SEQ ID NO: 4394773 - DNA, 17 bp, Homo sapiens
gtgtaccatttgcctcc

SEQ ID NO: 4394774 - DNA, 15 bp, Homo sapiens
gtgtactggagcctg

SEQ ID NO: 4394775 - DNA, 13 bp, Homo sapiens
gtgtactgtgtca

SEQ ID NO: 4394776 - DNA, 23 bp, Homo sapiens
gtgtagctaacagttgccacatc

SEQ ID NO: 4394777 - DNA, 20 bp, Homo sapiens
gtgtatatatgtgtgccctg

SEQ ID NO: 4394778 - DNA, 22 bp, Homo sapiens
gtgtatatatgtgtgccctgga

SEQ ID NO: 4394779 - DNA, 15 bp, Homo sapiens
gtgtatatctcttgg

SEQ ID NO: 4394780 - DNA, 14 bp, Homo sapiens
gtgtatatgtattt

SEQ ID NO: 4394781 - DNA, 14 bp, Homo sapiens
gtgtatattttaat

SEQ ID NO: 4394782 - DNA, 19 bp, Homo sapiens
gtgtatctgtgcttctaat

SEQ ID NO: 4394783 - DNA, 13 bp, Homo sapiens
gtgtatgtggggg

SEQ ID NO: 4394784 - DNA, 22 bp, Homo sapiens
gtgtattaacatgcaataacaa

SEQ ID NO: 4394785 - DNA, 13 bp, Homo sapiens
gtgtattccaaga

SEQ ID NO: 4394786 - DNA, 21 bp, Homo sapiens
gtgtattcttaaaatgcaata

SEQ ID NO: 4394787 - DNA, 19 bp, Homo sapiens
gtgtatttaattgtaaact

SEQ ID NO: 4394788 - DNA, 20 bp, Homo sapiens
gtcctccagaagcctctggc

SEQ ID NO: 4394789 - DNA, 15 bp, Homo sapiens
gtcctcccctatttt

SEQ ID NO: 4394790 - DNA, 18 bp, Homo sapiens
gtcctcccctattttaag

SEQ ID NO: 4394791 - DNA, 14 bp, Homo sapiens
gtcctcccctctct

SEQ ID NO: 4394792 - DNA, 20 bp, Homo sapiens
gtcctccctcaccccctcct

SEQ ID NO: 4394793 - DNA, 21 bp, Homo sapiens
gtcctcctcggatcaccgaga

SEQ ID NO: 4394794 - DNA, 22 bp, Homo sapiens
gtcctcctcggatcaccgagag

SEQ ID NO: 4394795 - DNA, 21 bp, Homo sapiens
gtcctcctggtgggtccaggg

SEQ ID NO: 4394796 - DNA, 23 bp, Homo sapiens
gtcctcctggtgggtccaggggc

SEQ ID NO: 4394797 - DNA, 19 bp, Homo sapiens
gtcctctcagttctctccc

SEQ ID NO: 4394798 - DNA, 17 bp, Homo sapiens
gtcctctcgagcccaga

SEQ ID NO: 4394799 - DNA, 19 bp, Homo sapiens
gtcctctctcttggggcgc

SEQ ID NO: 4394800 - DNA, 18 bp, Homo sapiens
gtcctcttccctctctgc

SEQ ID NO: 4394801 - DNA, 13 bp, Homo sapiens
gtcctcttctggg

SEQ ID NO: 4394802 - DNA, 21 bp, Homo sapiens
gtcctcttttcctggcagctg

SEQ ID NO: 4394803 - DNA, 22 bp, Homo sapiens
gtcctcttttcctggcagctgc

SEQ ID NO: 4394804 - DNA, 20 bp, Homo sapiens
gtcctgagcaccacacccag

SEQ ID NO: 4394805 - DNA, 18 bp, Homo sapiens
gtcctgcacaccctgggc

SEQ ID NO: 4394806 - DNA, 19 bp, Homo sapiens
gtcctgcaccggggcctgg

SEQ ID NO: 4394807 - DNA, 14 bp, Homo sapiens
gtcctgccagctgg

SEQ ID NO: 4394808 - DNA, 14 bp, Homo sapiens
gtcctgcccatgcc

SEQ ID NO: 4394809 - DNA, 13 bp, Homo sapiens
gtcctgcccatgt

SEQ ID NO: 4394810 - DNA, 13 bp, Homo sapiens
gtcctgcctggcc

SEQ ID NO: 4394811 - DNA, 15 bp, Homo sapiens
gtcctgcctggccag

SEQ ID NO: 4394812 - DNA, 20 bp, Homo sapiens
gtcctgctgcctctctttca

SEQ ID NO: 4394813 - DNA, 15 bp, Homo sapiens
gtcctgctttcctat

SEQ ID NO: 4394814 - DNA, 14 bp, Homo sapiens
gtcctggaggggct

SEQ ID NO: 4394815 - DNA, 11 bp, Homo sapiens
gtcctggctcc

SEQ ID NO: 4394816 - DNA, 17 bp, Homo sapiens
gtcctggctcctgaggg

SEQ ID NO: 4394817 - DNA, 14 bp, Homo sapiens
gtcctggtgctgcc

SEQ ID NO: 4394818 - DNA, 18 bp, Homo sapiens
gtcctgtaagaagcggca

SEQ ID NO: 4394819 - DNA, 18 bp, Homo sapiens
gtcctgtccacacccagc

SEQ ID NO: 4394820 - DNA, 21 bp, Homo sapiens
gtcctgtgatgtcagcggtgc

SEQ ID NO: 4394821 - DNA, 18 bp, Homo sapiens
gtcctgtgttaaacacta

SEQ ID NO: 4394822 - DNA, 16 bp, Homo sapiens
gtcctgttccctaccc

SEQ ID NO: 4394823 - DNA, 19 bp, Homo sapiens
gtccttaacccacctctcc

SEQ ID NO: 4394824 - DNA, 17 bp, Homo sapiens
gtccttaggcctctgag

SEQ ID NO: 4394825 - DNA, 15 bp, Homo sapiens
gtccttatgtcctgt

SEQ ID NO: 4394826 - DNA, 20 bp, Homo sapiens
gtccttcagtgagcccctcc

SEQ ID NO: 4394827 - DNA, 16 bp, Homo sapiens
gtccttccctcaaaga

SEQ ID NO: 4394828 - DNA, 15 bp, Homo sapiens
gtccttccctgatgg

SEQ ID NO: 4394829 - DNA, 18 bp, Homo sapiens
gtccttccctgatggcct

SEQ ID NO: 4394830 - DNA, 20 bp, Homo sapiens
gtccttccctgttctccctt

SEQ ID NO: 4394831 - DNA, 23 bp, Homo sapiens
gtccttcctttaggtctggttgt

SEQ ID NO: 4394832 - DNA, 16 bp, Homo sapiens
gtccttgaatgccata

SEQ ID NO: 4394833 - DNA, 17 bp, Homo sapiens
gtccttgcacctgcatc

SEQ ID NO: 4394834 - DNA, 12 bp, Homo sapiens
gtccttgcctga

SEQ ID NO: 4394835 - DNA, 20 bp, Homo sapiens
gtccttgcctgaactccaga

SEQ ID NO: 4394836 - DNA, 21 bp, Homo sapiens
gtccttttgacactgctctaa

SEQ ID NO: 4394837 - DNA, 19 bp, Homo sapiens
gtcctttttttccatcttt

SEQ ID NO: 4394838 - DNA, 23 bp, Homo sapiens
gtcgagctggatgtcccacctct

SEQ ID NO: 4394839 - DNA, 19 bp, Homo sapiens
gtcgcagaccagagctgtc

SEQ ID NO: 4394840 - DNA, 13 bp, Homo sapiens
gtcgccccaggcc

SEQ ID NO: 4394841 - DNA, 16 bp, Homo sapiens
gtcgccccaggccctc

SEQ ID NO: 4394842 - DNA, 22 bp, Homo sapiens
gtcgccccaggccctccctgac

SEQ ID NO: 4394843 - DNA, 20 bp, Homo sapiens
gtcgcctgcctgcagcaggc

SEQ ID NO: 4394844 - DNA, 14 bp, Homo sapiens
gtcgctcagtctgt

SEQ ID NO: 4394845 - DNA, 19 bp, Homo sapiens
gtcggccccaccagtgcct

SEQ ID NO: 4394846 - DNA, 16 bp, Homo sapiens
gtcgggacagctgtgc

SEQ ID NO: 4394847 - DNA, 13 bp, Homo sapiens
gtcgggcagccag

SEQ ID NO: 4394848 - DNA, 15 bp, Homo sapiens
gtcgggcagccagca

SEQ ID NO: 4394849 - DNA, 23 bp, Homo sapiens
gtcgggttttattgtttaaaatc

SEQ ID NO: 4394850 - DNA, 14 bp, Homo sapiens
gtcgtaaagatttg

SEQ ID NO: 4394851 - DNA, 19 bp, Homo sapiens
gtcgtgggccagtccccga

SEQ ID NO: 4394852 - DNA, 16 bp, Homo sapiens
gtcgttgttgtggaag

SEQ ID NO: 4394853 - DNA, 17 bp, Homo sapiens
gtcgttttccaaactga

SEQ ID NO: 4394854 - DNA, 16 bp, Homo sapiens
gtcgttttccaaagag

SEQ ID NO: 4394855 - DNA, 13 bp, Homo sapiens
gtctaaaaacatt

SEQ ID NO: 4394856 - DNA, 21 bp, Homo sapiens
gtctaaagctggtttaatgtt

SEQ ID NO: 4394857 - DNA, 22 bp, Homo sapiens
gtctaatgattcaaatgtttta

SEQ ID NO: 4394858 - DNA, 23 bp, Homo sapiens
gtctacattcttggttgttaatt

SEQ ID NO: 4394859 - DNA, 12 bp, Homo sapiens
gtctacatttct

SEQ ID NO: 4394860 - DNA, 13 bp, Homo sapiens
gtctacccagaga

SEQ ID NO: 4394861 - DNA, 21 bp, Homo sapiens
gtctacccagagaagcccctt

SEQ ID NO: 4394862 - DNA, 17 bp, Homo sapiens
gtctacctgagcattca

SEQ ID NO: 4394863 - DNA, 18 bp, Homo sapiens
gtctactcctagaagaac

SEQ ID NO: 4394864 - DNA, 22 bp, Homo sapiens
gtctagaatgttattgtgtata

SEQ ID NO: 4394865 - DNA, 22 bp, Homo sapiens
gtctagctatgctgtatctgtg

SEQ ID NO: 4394866 - DNA, 15 bp, Homo sapiens
gtctaggtctcctca

SEQ ID NO: 4394867 - DNA, 18 bp, Homo sapiens
gtctaggtctcctcaggg

SEQ ID NO: 4394868 - DNA, 19 bp, Homo sapiens
gtctaggtctcctcagggt

SEQ ID NO: 4394869 - DNA, 21 bp, Homo sapiens
gtctaggttaaagctaaactg

SEQ ID NO: 4394870 - DNA, 18 bp, Homo sapiens
gtctatatcataactata

SEQ ID NO: 4394871 - DNA, 13 bp, Homo sapiens
gtctattcagctt

SEQ ID NO: 4394872 - DNA, 17 bp, Homo sapiens
gtctattctccagctga

SEQ ID NO: 4394873 - DNA, 11 bp, Homo sapiens
gtctattgtct

SEQ ID NO: 4394874 - DNA, 22 bp, Homo sapiens
gtctcaaaatatttttttaaga

SEQ ID NO: 4394875 - DNA, 22 bp, Homo sapiens
gtctcaaaatggtgtgctataa

SEQ ID NO: 4394876 - DNA, 16 bp, Homo sapiens
gtctcaaaccctggct

SEQ ID NO: 4394877 - DNA, 20 bp, Homo sapiens
gtctcaaacttgtggcctca

SEQ ID NO: 4394878 - DNA, 14 bp, Homo sapiens
gtctcactgcttga

SEQ ID NO: 4394879 - DNA, 23 bp, Homo sapiens
gtctcactgtgggaaggccagct

SEQ ID NO: 4394880 - DNA, 21 bp, Homo sapiens
gtctcagacactaaatgcaga

SEQ ID NO: 4394881 - DNA, 21 bp, Homo sapiens
gtctcagcagcgaccacccct

SEQ ID NO: 4394882 - DNA, 14 bp, Homo sapiens
gtctcagcctctgc

SEQ ID NO: 4394883 - DNA, 15 bp, Homo sapiens
gtctcagcctctgcc

SEQ ID NO: 4394884 - DNA, 20 bp, Homo sapiens
gtctcagcctctgccagcgc

SEQ ID NO: 4394885 - DNA, 17 bp, Homo sapiens
gtctcaggctcaagttt

SEQ ID NO: 4394886 - DNA, 18 bp, Homo sapiens
gtctcaggctcaagtttt

SEQ ID NO: 4394887 - DNA, 18 bp, Homo sapiens
gtctcagtggcttcatct

SEQ ID NO: 4394888 - DNA, 18 bp, Homo sapiens
gtctcataggttaaaaaa

SEQ ID NO: 4394889 - DNA, 19 bp, Homo sapiens
gtctcatccacataagcac

SEQ ID NO: 4394890 - DNA, 14 bp, Homo sapiens
gtctcatccccagg

SEQ ID NO: 4394891 - DNA, 16 bp, Homo sapiens
gtctcatccccagggg

SEQ ID NO: 4394892 - DNA, 18 bp, Homo sapiens
gtctcatcctcccattgc

SEQ ID NO: 4394893 - DNA, 13 bp, Homo sapiens
gtctcatctccca

SEQ ID NO: 4394894 - DNA, 16 bp, Homo sapiens
gtctcatctcccaggc

SEQ ID NO: 4394895 - DNA, 18 bp, Homo sapiens
gtctcattgcttctgact

SEQ ID NO: 4394896 - DNA, 20 bp, Homo sapiens
gtctccaaccccccagcact

SEQ ID NO: 4394897 - DNA, 18 bp, Homo sapiens
gtctccacctgagaccct

SEQ ID NO: 4394898 - DNA, 13 bp, Homo sapiens
gtctccacctgca

SEQ ID NO: 4394899 - DNA, 20 bp, Homo sapiens
gtctccacttgtatatatgg

SEQ ID NO: 4394900 - DNA, 14 bp, Homo sapiens
gtctccagctgctg

SEQ ID NO: 4394901 - DNA, 20 bp, Homo sapiens
gtctccagggcccccaccga

SEQ ID NO: 4394902 - DNA, 20 bp, Homo sapiens
gtctccagggccccccaact

SEQ ID NO: 4394903 - DNA, 22 bp, Homo sapiens
gtctccatgtgtgtgccaagcc

SEQ ID NO: 4394904 - DNA, 14 bp, Homo sapiens
gtctccccaaagct

SEQ ID NO: 4394905 - DNA, 13 bp, Homo sapiens
gtctccccttcct

SEQ ID NO: 4394906 - DNA, 16 bp, Homo sapiens
gtctccctctcctgcc

SEQ ID NO: 4394907 - DNA, 17 bp, Homo sapiens
gtctccctctcctgcct

SEQ ID NO: 4394908 - DNA, 22 bp, Homo sapiens
gtcccagcccctcctccctcag

SEQ ID NO: 4394909 - DNA, 13 bp, Homo sapiens
gtcccagctcccc

SEQ ID NO: 4394910 - DNA, 14 bp, Homo sapiens
gtcccagctcccct

SEQ ID NO: 4394911 - DNA, 16 bp, Homo sapiens
gtcccagctcccctct

SEQ ID NO: 4394912 - DNA, 14 bp, Homo sapiens
gtcccaggggcagc

SEQ ID NO: 4394913 - DNA, 18 bp, Homo sapiens
gtcccaggggcagccaca

SEQ ID NO: 4394914 - DNA, 16 bp, Homo sapiens
gtcccagtgaactcgg

SEQ ID NO: 4394915 - DNA, 18 bp, Homo sapiens
gtcccagtgaactcggcc

SEQ ID NO: 4394916 - DNA, 20 bp, Homo sapiens
gtcccataagggtagccccc

SEQ ID NO: 4394917 - DNA, 13 bp, Homo sapiens
gtcccatgctggc

SEQ ID NO: 4394918 - DNA, 21 bp, Homo sapiens
gtcccattctagatcctgcac

SEQ ID NO: 4394919 - DNA, 19 bp, Homo sapiens
gtcccatttttctcttgcc

SEQ ID NO: 4394920 - DNA, 16 bp, Homo sapiens
gtccccaatgaatata

SEQ ID NO: 4394921 - DNA, 12 bp, Homo sapiens
gtccccatttct

SEQ ID NO: 4394922 - DNA, 14 bp, Homo sapiens
gtccccatttctgc

SEQ ID NO: 4394923 - DNA, 21 bp, Homo sapiens
gtcccccagagcatctgcccc

SEQ ID NO: 4394924 - DNA, 23 bp, Homo sapiens
gtcccccagagcatctgccccag

SEQ ID NO: 4394925 - DNA, 20 bp, Homo sapiens
gtcccccatcatgtggccca

SEQ ID NO: 4394926 - DNA, 17 bp, Homo sapiens
gtccccgaggagctggg

SEQ ID NO: 4394927 - DNA, 19 bp, Homo sapiens
gtccccgaggagctgggcc

SEQ ID NO: 4394928 - DNA, 20 bp, Homo sapiens
gtcccctcaaactcattgca

SEQ ID NO: 4394929 - DNA, 13 bp, Homo sapiens
gtcccctcactct

SEQ ID NO: 4394930 - DNA, 16 bp, Homo sapiens
gtcccctcactctgtc

SEQ ID NO: 4394931 - DNA, 17 bp, Homo sapiens
gtcccctcactctgtca

SEQ ID NO: 4394932 - DNA, 20 bp, Homo sapiens
gtcccctgctactcctgtgc

SEQ ID NO: 4394933 - DNA, 13 bp, Homo sapiens
gtccccttctctc

SEQ ID NO: 4394934 - DNA, 20 bp, Homo sapiens
gtccccttctctcatctctt

SEQ ID NO: 4394935 - DNA, 17 bp, Homo sapiens
gtcccgcactctgcccc

SEQ ID NO: 4394936 - DNA, 12 bp, Homo sapiens
gtcccgctgctg

SEQ ID NO: 4394937 - DNA, 16 bp, Homo sapiens
gtcccggctctgtggg

SEQ ID NO: 4394938 - DNA, 22 bp, Homo sapiens
gtcccggggccagcacttccat

SEQ ID NO: 4394939 - DNA, 22 bp, Homo sapiens
gtcccggttcagacccctgcct

SEQ ID NO: 4394940 - DNA, 20 bp, Homo sapiens
gtcccgtctggacctgggga

SEQ ID NO: 4394941 - DNA, 23 bp, Homo sapiens
gtccctaagcatgtgtcccagga

SEQ ID NO: 4394942 - DNA, 16 bp, Homo sapiens
gtccctacttaggaaa

SEQ ID NO: 4394943 - DNA, 17 bp, Homo sapiens
gtccctccctgcctgag

SEQ ID NO: 4394944 - DNA, 21 bp, Homo sapiens
gtccctgcctggaccagcctc

SEQ ID NO: 4394945 - DNA, 12 bp, Homo sapiens
gtccctgctggg

SEQ ID NO: 4394946 - DNA, 22 bp, Homo sapiens
gtccctggagatcatcctaaca

SEQ ID NO: 4394947 - DNA, 16 bp, Homo sapiens
gtccctggagggcaag

SEQ ID NO: 4394948 - DNA, 21 bp, Homo sapiens
gtccctggagggcaagccctg

SEQ ID NO: 4394949 - DNA, 17 bp, Homo sapiens
gtccctggcgcaggtgg

SEQ ID NO: 4394950 - DNA, 23 bp, Homo sapiens
gtccctgggggaagccctggatt

SEQ ID NO: 4394951 - DNA, 14 bp, Homo sapiens
gtccctgtcacctc

SEQ ID NO: 4394952 - DNA, 16 bp, Homo sapiens
gtccctgtccttccct

SEQ ID NO: 4394953 - DNA, 19 bp, Homo sapiens
gtcccttccaatgctgtgg

SEQ ID NO: 4394954 - DNA, 13 bp, Homo sapiens
gtcccttgcctct

SEQ ID NO: 4394955 - DNA, 18 bp, Homo sapiens
gtcccttgcctctgccct

SEQ ID NO: 4394956 - DNA, 23 bp, Homo sapiens
gtcccttgcctctgccctggatt

SEQ ID NO: 4394957 - DNA, 21 bp, Homo sapiens
gtccctttcccctagatccag

SEQ ID NO: 4394958 - DNA, 22 bp, Homo sapiens
gtccctttcccctagatccaga

SEQ ID NO: 4394959 - DNA, 15 bp, Homo sapiens
gtccgcaccctgtcc

SEQ ID NO: 4394960 - DNA, 13 bp, Homo sapiens
gtccggcccagtg

SEQ ID NO: 4394961 - DNA, 18 bp, Homo sapiens
gtccggcctctccctgcc

SEQ ID NO: 4394962 - DNA, 19 bp, Homo sapiens
gtccggcctctccctgcct

SEQ ID NO: 4394963 - DNA, 21 bp, Homo sapiens
gtccggcctctccctgcctgt

SEQ ID NO: 4394964 - DNA, 14 bp, Homo sapiens
gtccgtttactcca

SEQ ID NO: 4394965 - DNA, 18 bp, Homo sapiens
gtcctaaggaaccttcct

SEQ ID NO: 4394966 - DNA, 18 bp, Homo sapiens
gtcctagaatgtttcatt

SEQ ID NO: 4394967 - DNA, 13 bp, Homo sapiens
gtcctatgcaata

SEQ ID NO: 4394968 - DNA, 14 bp, Homo sapiens
gtcctatgcaataa

SEQ ID NO: 4394969 - DNA, 21 bp, Homo sapiens
gtcctatgcaataaaattatt

SEQ ID NO: 4394970 - DNA, 22 bp, Homo sapiens
gtcctcacttctagatctcagc

SEQ ID NO: 4394971 - DNA, 16 bp, Homo sapiens
gtcctcagggagcagg

SEQ ID NO: 4394972 - DNA, 13 bp, Homo sapiens
gtcctcatggaga

SEQ ID NO: 4394973 - DNA, 14 bp, Homo sapiens
gtcctccagaagcc

SEQ ID NO: 4394974 - DNA, 17 bp, Homo sapiens
ggttcagacccctgcct

SEQ ID NO: 4394975 - DNA, 18 bp, Homo sapiens
ggttcagacccctgcctg

SEQ ID NO: 4394976 - DNA, 14 bp, Homo sapiens
ggttcagcccctcc

SEQ ID NO: 4394977 - DNA, 21 bp, Homo sapiens
ggttcagcccctcctctgcca

SEQ ID NO: 4394978 - DNA, 12 bp, Homo sapiens
ggttcaggcccg

SEQ ID NO: 4394979 - DNA, 13 bp, Homo sapiens
ggttcaggcccgg

SEQ ID NO: 4394980 - DNA, 13 bp, Homo sapiens
ggttcatatttat

SEQ ID NO: 4394981 - DNA, 14 bp, Homo sapiens
ggttcatgatgcag

SEQ ID NO: 4394982 - DNA, 12 bp, Homo sapiens
ggttccccaccg

SEQ ID NO: 4394983 - DNA, 21 bp, Homo sapiens
ggttccctcctagctctccca

SEQ ID NO: 4394984 - DNA, 16 bp, Homo sapiens
ggttcccttcctattc

SEQ ID NO: 4394985 - DNA, 17 bp, Homo sapiens
ggttccctttccttcca

SEQ ID NO: 4394986 - DNA, 15 bp, Homo sapiens
ggttccttttattag

SEQ ID NO: 4394987 - DNA, 13 bp, Homo sapiens
ggttcgagactcc

SEQ ID NO: 4394988 - DNA, 17 bp, Homo sapiens
ggttcgagactccatct

SEQ ID NO: 4394989 - DNA, 17 bp, Homo sapiens
ggttctaaatgcaataa

SEQ ID NO: 4394990 - DNA, 19 bp, Homo sapiens
ggttctagacgcccctccc

SEQ ID NO: 4394991 - DNA, 22 bp, Homo sapiens
ggttctcattaggttttgcttg

SEQ ID NO: 4394992 - DNA, 12 bp, Homo sapiens
ggttctgcctct

SEQ ID NO: 4394993 - DNA, 11 bp, Homo sapiens
ggttcttgctt

SEQ ID NO: 4394994 - DNA, 15 bp, Homo sapiens
ggttgagagccagtg

SEQ ID NO: 4394995 - DNA, 12 bp, Homo sapiens
ggttgcacagca

SEQ ID NO: 4394996 - DNA, 14 bp, Homo sapiens
ggttgccagaggcc

SEQ ID NO: 4394997 - DNA, 15 bp, Homo sapiens
ggttgccagaggccc

SEQ ID NO: 4394998 - DNA, 16 bp, Homo sapiens
ggttgccagaggccct

SEQ ID NO: 4394999 - DNA, 13 bp, Homo sapiens
ggttgcctccccc

SEQ ID NO: 4395000 - DNA, 19 bp, Homo sapiens
ggttgggcgtgctacctgc

SEQ ID NO: 4395001 - DNA, 18 bp, Homo sapiens
ggttggggcttcacagcc

SEQ ID NO: 4395002 - DNA, 16 bp, Homo sapiens
ggttgggggaatgcac

SEQ ID NO: 4395003 - DNA, 23 bp, Homo sapiens
ggttgggttgattgtatgttgag

SEQ ID NO: 4395004 - DNA, 14 bp, Homo sapiens
ggttgttccttttt

SEQ ID NO: 4395005 - DNA, 21 bp, Homo sapiens
ggttgttgatattgtttgctg

SEQ ID NO: 4395006 - DNA, 18 bp, Homo sapiens
ggtttaaagaaagtgtat

SEQ ID NO: 4395007 - DNA, 17 bp, Homo sapiens
ggtttaagaaatagaat

SEQ ID NO: 4395008 - DNA, 16 bp, Homo sapiens
ggtttaagtagatttc

SEQ ID NO: 4395009 - DNA, 13 bp, Homo sapiens
ggtttaatattac

SEQ ID NO: 4395010 - DNA, 18 bp, Homo sapiens
ggtttactcactgctgca

SEQ ID NO: 4395011 - DNA, 14 bp, Homo sapiens
ggtttatattttca

SEQ ID NO: 4395012 - DNA, 20 bp, Homo sapiens
ggtttcaccatgttggtcag

SEQ ID NO: 4395013 - DNA, 14 bp, Homo sapiens
ggtttcagatgagg

SEQ ID NO: 4395014 - DNA, 15 bp, Homo sapiens
ggtttcatttcttat

SEQ ID NO: 4395015 - DNA, 14 bp, Homo sapiens
ggtttctaagcagt

SEQ ID NO: 4395016 - DNA, 23 bp, Homo sapiens
ggtttgcatttaaacatgtttaa

SEQ ID NO: 4395017 - DNA, 21 bp, Homo sapiens
ggtttgccaaaattcatttct

SEQ ID NO: 4395018 - DNA, 13 bp, Homo sapiens
ggtttggagctga

SEQ ID NO: 4395019 - DNA, 20 bp, Homo sapiens
ggtttgtacatatcaaatag

SEQ ID NO: 4395020 - DNA, 14 bp, Homo sapiens
ggttttaaactttc

SEQ ID NO: 4395021 - DNA, 16 bp, Homo sapiens
ggttttacacagagaa

SEQ ID NO: 4395022 - DNA, 22 bp, Homo sapiens
ggttttatctgagtgaaatact

SEQ ID NO: 4395023 - DNA, 15 bp, Homo sapiens
ggttttcctcagctc

SEQ ID NO: 4395024 - DNA, 18 bp, Homo sapiens
ggttttcctcagctctag

SEQ ID NO: 4395025 - DNA, 13 bp, Homo sapiens
ggttttgaaatgt

SEQ ID NO: 4395026 - DNA, 16 bp, Homo sapiens
ggtttttaaaacccag

SEQ ID NO: 4395027 - DNA, 20 bp, Homo sapiens
ggtttttaaatatatatttt

SEQ ID NO: 4395028 - DNA, 16 bp, Homo sapiens
ggtttttatttctcgg

SEQ ID NO: 4395029 - DNA, 21 bp, Homo sapiens
ggtttttatttctcgggtgca

SEQ ID NO: 4395030 - DNA, 15 bp, Homo sapiens
ggtttttgaaatcca

SEQ ID NO: 4395031 - DNA, 12 bp, Homo sapiens
ggtttttgctct

SEQ ID NO: 4395032 - DNA, 22 bp, Homo sapiens
ggttttttttcagttgttcttt

SEQ ID NO: 4395033 - DNA, 19 bp, Homo sapiens
gtaaaaagtattttttcaa

SEQ ID NO: 4395034 - DNA, 18 bp, Homo sapiens
gtaaaaatgaaggaatta

SEQ ID NO: 4395035 - DNA, 19 bp, Homo sapiens
gtaaaaatgagtcatttgt

SEQ ID NO: 4395036 - DNA, 18 bp, Homo sapiens
gtaaaaatgctgctctca

SEQ ID NO: 4395037 - DNA, 14 bp, Homo sapiens
gtaaaacaaaattt

SEQ ID NO: 4395038 - DNA, 22 bp, Homo sapiens
gtaaaacaataataataataaa

SEQ ID NO: 4395039 - DNA, 18 bp, Homo sapiens
gtaaaacatttattttga

SEQ ID NO: 4395040 - DNA, 14 bp, Homo sapiens
gtaaaagaaatcat

SEQ ID NO: 4395041 - DNA, 20 bp, Homo sapiens
gtaaaagaaatcatgtccat

SEQ ID NO: 4395042 - DNA, 15 bp, Homo sapiens
gtaaaatattttgaa

SEQ ID NO: 4395043 - DNA, 19 bp, Homo sapiens
gtaaaatattttgaatcaa

SEQ ID NO: 4395044 - DNA, 21 bp, Homo sapiens
gtaaaatattttgaatcaata

SEQ ID NO: 4395045 - DNA, 21 bp, Homo sapiens
gtaaaatgaggccggacagag

SEQ ID NO: 4395046 - DNA, 19 bp, Homo sapiens
gtaaaatgtattatgtcct

SEQ ID NO: 4395047 - DNA, 18 bp, Homo sapiens
gtaaaatgtatttttcta

SEQ ID NO: 4395048 - DNA, 15 bp, Homo sapiens
gtaaaatgtctttcc

SEQ ID NO: 4395049 - DNA, 15 bp, Homo sapiens
gtaaaattaatgtaa

SEQ ID NO: 4395050 - DNA, 18 bp, Homo sapiens
gtaaaattaatgtaataa

SEQ ID NO: 4395051 - DNA, 18 bp, Homo sapiens
gtaaaatttgtgtaaatt

SEQ ID NO: 4395052 - DNA, 20 bp, Homo sapiens
gtaaacactccacattcttc

SEQ ID NO: 4395053 - DNA, 12 bp, Homo sapiens
gtaaacagattt

SEQ ID NO: 4395054 - DNA, 17 bp, Homo sapiens
gtaaacaggtatttttt

SEQ ID NO: 4395055 - DNA, 21 bp, Homo sapiens
gtaaacaggtatttttttaaa

SEQ ID NO: 4395056 - DNA, 13 bp, Homo sapiens
gtaaacagtgcct

SEQ ID NO: 4395057 - DNA, 18 bp, Homo sapiens
gtaaacagtgcctgctga

SEQ ID NO: 4395058 - DNA, 20 bp, Homo sapiens
gtaaacagtgcctgctgaat

SEQ ID NO: 4395059 - DNA, 18 bp, Homo sapiens
gtaaaccactgaaaaaat

SEQ ID NO: 4395060 - DNA, 19 bp, Homo sapiens
gtaaaccactgaaaaaata

SEQ ID NO: 4395061 - DNA, 17 bp, Homo sapiens
gtaaacgaaggcataat

SEQ ID NO: 4395062 - DNA, 18 bp, Homo sapiens
gtaaactggaattaaaag

SEQ ID NO: 4395063 - DNA, 17 bp, Homo sapiens
gtaaacttggaatcaag

SEQ ID NO: 4395064 - DNA, 15 bp, Homo sapiens
gtaaacttgtgtatt

SEQ ID NO: 4395065 - DNA, 14 bp, Homo sapiens
gtaaagactggttt

SEQ ID NO: 4395066 - DNA, 19 bp, Homo sapiens
gtaaagagaaactttgtgc

SEQ ID NO: 4395067 - DNA, 21 bp, Homo sapiens
gtaaagatgtttatttcaggc

SEQ ID NO: 4395068 - DNA, 15 bp, Homo sapiens
gtaaaggcctttaat

SEQ ID NO: 4395069 - DNA, 23 bp, Homo sapiens
gtaaaggtttatttttctgttac

SEQ ID NO: 4395070 - DNA, 22 bp, Homo sapiens
gtaaagtatgtattatttacat

SEQ ID NO: 4395071 - DNA, 23 bp, Homo sapiens
gtaaagtatgtattatttacatt

SEQ ID NO: 4395072 - DNA, 20 bp, Homo sapiens
gtaaagtatttgatgtacat

SEQ ID NO: 4395073 - DNA, 21 bp, Homo sapiens
gtaaagtatttgatgtacatt

SEQ ID NO: 4395074 - DNA, 22 bp, Homo sapiens
gtaaagtgcaatgggtaaggga

SEQ ID NO: 4395075 - DNA, 15 bp, Homo sapiens
gtaaagtggttctct

SEQ ID NO: 4395076 - DNA, 19 bp, Homo sapiens
gtaaagttatgtatttaaa

SEQ ID NO: 4395077 - DNA, 14 bp, Homo sapiens
gtaaataaaaagaa

SEQ ID NO: 4395078 - DNA, 14 bp, Homo sapiens
gtaaataaaacatc

SEQ ID NO: 4395079 - DNA, 14 bp, Homo sapiens
gtaaataaaccact

SEQ ID NO: 4395080 - DNA, 16 bp, Homo sapiens
gtaaataaactattta

SEQ ID NO: 4395081 - DNA, 21 bp, Homo sapiens
gtaaataaactatttatatca

SEQ ID NO: 4395082 - DNA, 21 bp, Homo sapiens
gtaaataggtttctaaaaagt

SEQ ID NO: 4395083 - DNA, 11 bp, Homo sapiens
gtaaatatata

SEQ ID NO: 4395084 - DNA, 15 bp, Homo sapiens
gtaaatatccctccc

SEQ ID NO: 4395085 - DNA, 13 bp, Homo sapiens
gtaaatattttaa

SEQ ID NO: 4395086 - DNA, 23 bp, Homo sapiens
gtaaatattttaaagaattgtgt

SEQ ID NO: 4395087 - DNA, 13 bp, Homo sapiens
gtaaatcctgtgt

SEQ ID NO: 4395088 - DNA, 21 bp, Homo sapiens
gtaaatctaacattattactt

SEQ ID NO: 4395089 - DNA, 18 bp, Homo sapiens
gtaaatgtggattttgta

SEQ ID NO: 4395090 - DNA, 17 bp, Homo sapiens
gtaaatgttcttggtgt

SEQ ID NO: 4395091 - DNA, 17 bp, Homo sapiens
gtaaattacaaatgtgg

SEQ ID NO: 4395092 - DNA, 15 bp, Homo sapiens
gtaaattattttaaa

SEQ ID NO: 4395093 - DNA, 18 bp, Homo sapiens
gtaacaatacatgagaaa

SEQ ID NO: 4395094 - DNA, 20 bp, Homo sapiens
gtaacacgggaatcacaggt

SEQ ID NO: 4395095 - DNA, 12 bp, Homo sapiens
gggctgagggag

SEQ ID NO: 4395096 - DNA, 20 bp, Homo sapiens
gggctgctcacccacctctt

SEQ ID NO: 4395097 - DNA, 18 bp, Homo sapiens
gggctgctcccacctggc

SEQ ID NO: 4395098 - DNA, 21 bp, Homo sapiens
gggctgctcccacctggctct

SEQ ID NO: 4395099 - DNA, 19 bp, Homo sapiens
gggctgctcctccagggcc

SEQ ID NO: 4395100 - DNA, 14 bp, Homo sapiens
gggctggactgagg

SEQ ID NO: 4395101 - DNA, 19 bp, Homo sapiens
gggctggactgaggcctga

SEQ ID NO: 4395102 - DNA, 18 bp, Homo sapiens
gggctggacttctacctg

SEQ ID NO: 4395103 - DNA, 19 bp, Homo sapiens
gggctggaggcccaggctg

SEQ ID NO: 4395104 - DNA, 12 bp, Homo sapiens
gggctggcccag

SEQ ID NO: 4395105 - DNA, 19 bp, Homo sapiens
gggctggcccagccctgct

SEQ ID NO: 4395106 - DNA, 16 bp, Homo sapiens
gggctggccgggactg

SEQ ID NO: 4395107 - DNA, 22 bp, Homo sapiens
gggctgggcctcggaccccact

SEQ ID NO: 4395108 - DNA, 11 bp, Homo sapiens
gggctggggcc

SEQ ID NO: 4395109 - DNA, 14 bp, Homo sapiens
gggctggggccacc

SEQ ID NO: 4395110 - DNA, 18 bp, Homo sapiens
gggctgggggctgccgag

SEQ ID NO: 4395111 - DNA, 13 bp, Homo sapiens
gggctggggttgc

SEQ ID NO: 4395112 - DNA, 16 bp, Homo sapiens
gggctggggttgccag

SEQ ID NO: 4395113 - DNA, 17 bp, Homo sapiens
gggctggggttgccaga

SEQ ID NO: 4395114 - DNA, 19 bp, Homo sapiens
gggctggggttgccagagg

SEQ ID NO: 4395115 - DNA, 20 bp, Homo sapiens
gggctggggttgccagaggc

SEQ ID NO: 4395116 - DNA, 24 bp, Homo sapiens
gggctggggttgccagaggccctg

SEQ ID NO: 4395117 - DNA, 16 bp, Homo sapiens
gggctggtccttattt

SEQ ID NO: 4395118 - DNA, 14 bp, Homo sapiens
gggctgtctgtcac

SEQ ID NO: 4395119 - DNA, 19 bp, Homo sapiens
gggcttatatctggcctct

SEQ ID NO: 4395120 - DNA, 14 bp, Homo sapiens
gggcttccatgcct

SEQ ID NO: 4395121 - DNA, 18 bp, Homo sapiens
gggcttccatgcctgtag

SEQ ID NO: 4395122 - DNA, 17 bp, Homo sapiens
gggcttcctgggtcctg

SEQ ID NO: 4395123 - DNA, 14 bp, Homo sapiens
gggcttctcctcct

SEQ ID NO: 4395124 - DNA, 22 bp, Homo sapiens
gggcttctgcggggctgagacg

SEQ ID NO: 4395125 - DNA, 12 bp, Homo sapiens
gggcttggccca

SEQ ID NO: 4395126 - DNA, 21 bp, Homo sapiens
gggcttgtttttcttcagcat

SEQ ID NO: 4395127 - DNA, 14 bp, Homo sapiens
gggcttttttcttt

SEQ ID NO: 4395128 - DNA, 14 bp, Homo sapiens
ggggaaaaaaatgt

SEQ ID NO: 4395129 - DNA, 21 bp, Homo sapiens
ggggaaaaagaccaggtctac

SEQ ID NO: 4395130 - DNA, 23 bp, Homo sapiens
ggggaaaacgggcagtctgctct

SEQ ID NO: 4395131 - DNA, 17 bp, Homo sapiens
ggggaaaattattttga

SEQ ID NO: 4395132 - DNA, 23 bp, Homo sapiens
ggggaagaacagccccggggccc

SEQ ID NO: 4395133 - DNA, 23 bp, Homo sapiens
ggggaagagggaaatgtacactt

SEQ ID NO: 4395134 - DNA, 13 bp, Homo sapiens
ggggaagccctgg

SEQ ID NO: 4395135 - DNA, 15 bp, Homo sapiens
ggggaaggccctgag

SEQ ID NO: 4395136 - DNA, 18 bp, Homo sapiens
ggggaattccctccccct

SEQ ID NO: 4395137 - DNA, 20 bp, Homo sapiens
ggggacacacattctgcctt

SEQ ID NO: 4395138 - DNA, 22 bp, Homo sapiens
ggggacagagactcagatgagg

SEQ ID NO: 4395139 - DNA, 24 bp, Homo sapiens
ggggacagggctggcccagccctg

SEQ ID NO: 4395140 - DNA, 11 bp, Homo sapiens
ggggaccctgt

SEQ ID NO: 4395141 - DNA, 23 bp, Homo sapiens
ggggaccgggcccctctctaggg

SEQ ID NO: 4395142 - DNA, 20 bp, Homo sapiens
ggggaccttttgggggaggg

SEQ ID NO: 4395143 - DNA, 19 bp, Homo sapiens
ggggacttcaactgcccag

SEQ ID NO: 4395144 - DNA, 17 bp, Homo sapiens
ggggagaaaattaaaag

SEQ ID NO: 4395145 - DNA, 18 bp, Homo sapiens
ggggagactgggctgagg

SEQ ID NO: 4395146 - DNA, 17 bp, Homo sapiens
ggggagagacaggcagc

SEQ ID NO: 4395147 - DNA, 17 bp, Homo sapiens
ggggagctcctgggacc

SEQ ID NO: 4395148 - DNA, 12 bp, Homo sapiens
ggggaggcaaga

SEQ ID NO: 4395149 - DNA, 14 bp, Homo sapiens
ggggagggctgcga

SEQ ID NO: 4395150 - DNA, 18 bp, Homo sapiens
ggggagtttagggtgggg

SEQ ID NO: 4395151 - DNA, 13 bp, Homo sapiens
ggggatagatgtg

SEQ ID NO: 4395152 - DNA, 15 bp, Homo sapiens
ggggattgcccctgg

SEQ ID NO: 4395153 - DNA, 21 bp, Homo sapiens
ggggcaaccaactgccccagg

SEQ ID NO: 4395154 - DNA, 14 bp, Homo sapiens
ggggcagagcctcc

SEQ ID NO: 4395155 - DNA, 15 bp, Homo sapiens
ggggcaggctgggcc

SEQ ID NO: 4395156 - DNA, 15 bp, Homo sapiens
ggggcagtctgagag

SEQ ID NO: 4395157 - DNA, 18 bp, Homo sapiens
ggggcagtctgagagagg

SEQ ID NO: 4395158 - DNA, 17 bp, Homo sapiens
ggggcagtgctcaccca

SEQ ID NO: 4395159 - DNA, 17 bp, Homo sapiens
ggggccaacctcaggct

SEQ ID NO: 4395160 - DNA, 20 bp, Homo sapiens
ggggccaacctcaggctcct

SEQ ID NO: 4395161 - DNA, 21 bp, Homo sapiens
ggggccacttggtagtgtccc

SEQ ID NO: 4395162 - DNA, 16 bp, Homo sapiens
ggggccagaggctggg

SEQ ID NO: 4395163 - DNA, 12 bp, Homo sapiens
ggggccaggaaa

SEQ ID NO: 4395164 - DNA, 14 bp, Homo sapiens
ggggccagggagga

SEQ ID NO: 4395165 - DNA, 16 bp, Homo sapiens
ggggccccagtcagcc

SEQ ID NO: 4395166 - DNA, 14 bp, Homo sapiens
ggggccctgggcct

SEQ ID NO: 4395167 - DNA, 21 bp, Homo sapiens
ggggccgggcaggtcctgccc

SEQ ID NO: 4395168 - DNA, 18 bp, Homo sapiens
ggggccgggccaggagaa

SEQ ID NO: 4395169 - DNA, 22 bp, Homo sapiens
ggggccggttttcctcagctct

SEQ ID NO: 4395170 - DNA, 21 bp, Homo sapiens
ggggcctagcgatctctcctg

SEQ ID NO: 4395171 - DNA, 19 bp, Homo sapiens
ggggcctttgccagcagag

SEQ ID NO: 4395172 - DNA, 21 bp, Homo sapiens
ggggcctttgccagcagagcc

SEQ ID NO: 4395173 - DNA, 22 bp, Homo sapiens
ggggcctttgccagcagagcca

SEQ ID NO: 4395174 - DNA, 13 bp, Homo sapiens
ggggcgggctcag

SEQ ID NO: 4395175 - DNA, 14 bp, Homo sapiens
ggggctaatttaac

SEQ ID NO: 4395176 - DNA, 14 bp, Homo sapiens
ggggctagaaccta

SEQ ID NO: 4395177 - DNA, 13 bp, Homo sapiens
ggggctcctgccc

SEQ ID NO: 4395178 - DNA, 19 bp, Homo sapiens
ggggctcctgcccaggcca

SEQ ID NO: 4395179 - DNA, 22 bp, Homo sapiens
ggggctcctgcccaggccacag

SEQ ID NO: 4395180 - DNA, 23 bp, Homo sapiens
ggggctcctgcccaggccacaga

SEQ ID NO: 4395181 - DNA, 14 bp, Homo sapiens
ggggctcctgggag

SEQ ID NO: 4395182 - DNA, 18 bp, Homo sapiens
ggggctgacacccaggcc

SEQ ID NO: 4395183 - DNA, 19 bp, Homo sapiens
gggttggctgttccagact

SEQ ID NO: 4395184 - DNA, 12 bp, Homo sapiens
gggttgggccca

SEQ ID NO: 4395185 - DNA, 14 bp, Homo sapiens
gggttgggcccaga

SEQ ID NO: 4395186 - DNA, 18 bp, Homo sapiens
gggttttgtattctctga

SEQ ID NO: 4395187 - DNA, 22 bp, Homo sapiens
ggtaaaaaaaaattactgttta

SEQ ID NO: 4395188 - DNA, 14 bp, Homo sapiens
ggtaaaaaatttat

SEQ ID NO: 4395189 - DNA, 18 bp, Homo sapiens
ggtaaaaagtattttttc

SEQ ID NO: 4395190 - DNA, 16 bp, Homo sapiens
ggtaaaaatgctgctc

SEQ ID NO: 4395191 - DNA, 17 bp, Homo sapiens
ggtaaaaatgctgctct

SEQ ID NO: 4395192 - DNA, 14 bp, Homo sapiens
ggtaaaacagtttc

SEQ ID NO: 4395193 - DNA, 19 bp, Homo sapiens
ggtaaaactcactgtgatc

SEQ ID NO: 4395194 - DNA, 15 bp, Homo sapiens
ggtaaaatgtatttt

SEQ ID NO: 4395195 - DNA, 15 bp, Homo sapiens
ggtaaagactggctt

SEQ ID NO: 4395196 - DNA, 16 bp, Homo sapiens
ggtaaagactggcttt

SEQ ID NO: 4395197 - DNA, 19 bp, Homo sapiens
ggtaaagtgcaatgggtaa

SEQ ID NO: 4395198 - DNA, 15 bp, Homo sapiens
ggtaaataaaaagaa

SEQ ID NO: 4395199 - DNA, 15 bp, Homo sapiens
ggtaaataaaccact

SEQ ID NO: 4395200 - DNA, 15 bp, Homo sapiens
ggtaaatcccacatc

SEQ ID NO: 4395201 - DNA, 23 bp, Homo sapiens
ggtaagattgcactgttctgatt

SEQ ID NO: 4395202 - DNA, 17 bp, Homo sapiens
ggtaaggtgtgtactca

SEQ ID NO: 4395203 - DNA, 14 bp, Homo sapiens
ggtaagtaaacaga

SEQ ID NO: 4395204 - DNA, 14 bp, Homo sapiens
ggtaagtgaattta

SEQ ID NO: 4395205 - DNA, 17 bp, Homo sapiens
ggtaataaatgtgactc

SEQ ID NO: 4395206 - DNA, 15 bp, Homo sapiens
ggtacaaaaataaat

SEQ ID NO: 4395207 - DNA, 15 bp, Homo sapiens
ggtacaactgtattt

SEQ ID NO: 4395208 - DNA, 15 bp, Homo sapiens
ggtacacctccccct

SEQ ID NO: 4395209 - DNA, 18 bp, Homo sapiens
ggtacacctccccctgcg

SEQ ID NO: 4395210 - DNA, 22 bp, Homo sapiens
ggtacactacgcactggacagc

SEQ ID NO: 4395211 - DNA, 16 bp, Homo sapiens
ggtacagatccccagc

SEQ ID NO: 4395212 - DNA, 18 bp, Homo sapiens
ggtacatggtgtttgtgg

SEQ ID NO: 4395213 - DNA, 16 bp, Homo sapiens
ggtacatttatcactg

SEQ ID NO: 4395214 - DNA, 18 bp, Homo sapiens
ggtacatttctctgagca

SEQ ID NO: 4395215 - DNA, 17 bp, Homo sapiens
ggtacatttttcaactt

SEQ ID NO: 4395216 - DNA, 15 bp, Homo sapiens
ggtaccagctgcgct

SEQ ID NO: 4395217 - DNA, 16 bp, Homo sapiens
ggtacccaattcaatt

SEQ ID NO: 4395218 - DNA, 21 bp, Homo sapiens
ggtacttagagtttctgtttg

SEQ ID NO: 4395219 - DNA, 14 bp, Homo sapiens
ggtacttcctctgt

SEQ ID NO: 4395220 - DNA, 16 bp, Homo sapiens
ggtagaaaaagggtca

SEQ ID NO: 4395221 - DNA, 20 bp, Homo sapiens
ggtagaaaaattattagaac

SEQ ID NO: 4395222 - DNA, 18 bp, Homo sapiens
ggtagaagctgaagagca

SEQ ID NO: 4395223 - DNA, 14 bp, Homo sapiens
ggtagagaccccca

SEQ ID NO: 4395224 - DNA, 12 bp, Homo sapiens
ggtagctccagc

SEQ ID NO: 4395225 - DNA, 16 bp, Homo sapiens
ggtaggaactgctggg

SEQ ID NO: 4395226 - DNA, 18 bp, Homo sapiens
ggtaggaactgctgggct

SEQ ID NO: 4395227 - DNA, 23 bp, Homo sapiens
ggtaggggggaaacaggttggga

SEQ ID NO: 4395228 - DNA, 20 bp, Homo sapiens
ggtagttctgtgcctccccc

SEQ ID NO: 4395229 - DNA, 18 bp, Homo sapiens
ggtagttgggtagaaaaa

SEQ ID NO: 4395230 - DNA, 14 bp, Homo sapiens
ggtatattgataaa

SEQ ID NO: 4395231 - DNA, 13 bp, Homo sapiens
ggtatgctggcca

SEQ ID NO: 4395232 - DNA, 14 bp, Homo sapiens
ggtatgctggccag

SEQ ID NO: 4395233 - DNA, 16 bp, Homo sapiens
ggtatgtagccagctg

SEQ ID NO: 4395234 - DNA, 18 bp, Homo sapiens
ggtattaaaggttaaatt

SEQ ID NO: 4395235 - DNA, 16 bp, Homo sapiens
ggtattaataaaaaga

SEQ ID NO: 4395236 - DNA, 17 bp, Homo sapiens
ggtattagcaaagcaaa

SEQ ID NO: 4395237 - DNA, 14 bp, Homo sapiens
ggtcaacagagaag

SEQ ID NO: 4395238 - DNA, 18 bp, Homo sapiens
ggtcaataacactgtatt

SEQ ID NO: 4395239 - DNA, 19 bp, Homo sapiens
ggtcaataacactgtattt

SEQ ID NO: 4395240 - DNA, 20 bp, Homo sapiens
ggtcaataacactgtatttt

SEQ ID NO: 4395241 - DNA, 16 bp, Homo sapiens
ggtcaatgctattttt

SEQ ID NO: 4395242 - DNA, 19 bp, Homo sapiens
ggtcacagacttctggcct

SEQ ID NO: 4395243 - DNA, 15 bp, Homo sapiens
ggtcacagcctcctc

SEQ ID NO: 4395244 - DNA, 13 bp, Homo sapiens
ggtcacatgcttt

SEQ ID NO: 4395245 - DNA, 22 bp, Homo sapiens
ggtcaccgagactcagcctctg

SEQ ID NO: 4395246 - DNA, 17 bp, Homo sapiens
ggtcacctgccgccctg

SEQ ID NO: 4395247 - DNA, 20 bp, Homo sapiens
ggtcacctgccgccctgtgg

SEQ ID NO: 4395248 - DNA, 22 bp, Homo sapiens
ggtcacctgccgccctgtggga

SEQ ID NO: 4395249 - DNA, 13 bp, Homo sapiens
ggtcactggaaag

SEQ ID NO: 4395250 - DNA, 15 bp, Homo sapiens
ggtcactggaaaggg

SEQ ID NO: 4395251 - DNA, 13 bp, Homo sapiens
ggtcacttcattt

SEQ ID NO: 4395252 - DNA, 17 bp, Homo sapiens
ggtcagagagacctcat

SEQ ID NO: 4395253 - DNA, 19 bp, Homo sapiens
ggtcagaggacctgtattt

SEQ ID NO: 4395254 - DNA, 16 bp, Homo sapiens
ggtcagagtgccactg

SEQ ID NO: 4395255 - DNA, 22 bp, Homo sapiens
ggtcaggatgtaggggttaact

SEQ ID NO: 4395256 - DNA, 15 bp, Homo sapiens
ggtcaggggggagaa

SEQ ID NO: 4395257 - DNA, 18 bp, Homo sapiens
ggtcagtggccaggtgcc

SEQ ID NO: 4395258 - DNA, 15 bp, Homo sapiens
ggtcagttgtaataa

SEQ ID NO: 4395259 - DNA, 23 bp, Homo sapiens
ggtcatatacatattgtatatat

SEQ ID NO: 4395260 - DNA, 19 bp, Homo sapiens
ggtcatgaaggaggggacc

SEQ ID NO: 4395261 - DNA, 16 bp, Homo sapiens
ggtcatgggccactgc

SEQ ID NO: 4395262 - DNA, 17 bp, Homo sapiens
ggtccacaggtccaagg

SEQ ID NO: 4395263 - DNA, 21 bp, Homo sapiens
ggtccaggaatggtgctttat

SEQ ID NO: 4395264 - DNA, 11 bp, Homo sapiens
ggtccagggaa

SEQ ID NO: 4395265 - DNA, 21 bp, Homo sapiens
ggtccagggaggggtccctgc

SEQ ID NO: 4395266 - DNA, 15 bp, Homo sapiens
ggtccaggggcccct

SEQ ID NO: 4395267 - DNA, 16 bp, Homo sapiens
ggtccaggtcccagcc

SEQ ID NO: 4395268 - DNA, 21 bp, Homo sapiens
ggtccatagagatgagcccac

SEQ ID NO: 4395269 - DNA, 14 bp, Homo sapiens
ggtccatgggcaga

SEQ ID NO: 4395270 - DNA, 17 bp, Homo sapiens
ggtccatgggcagagcc

SEQ ID NO: 4395271 - DNA, 19 bp, Homo sapiens
ggtcccaagctgggcccca

SEQ ID NO: 4395272 - DNA, 14 bp, Homo sapiens
ggtcccacgccagg

SEQ ID NO: 4395273 - DNA, 15 bp, Homo sapiens
ggtcccagcccctcc

SEQ ID NO: 4395274 - DNA, 17 bp, Homo sapiens
ggtcccagcccctcctc

SEQ ID NO: 4395275 - DNA, 19 bp, Homo sapiens
ggtcccagcccctcctccc

SEQ ID NO: 4395276 - DNA, 15 bp, Homo sapiens
ggtcccccagagcat

SEQ ID NO: 4395277 - DNA, 18 bp, Homo sapiens
ggtcccccaggaggcagc

SEQ ID NO: 4395278 - DNA, 19 bp, Homo sapiens
ggtcccccaggaggcagct

SEQ ID NO: 4395279 - DNA, 10 bp, Homo sapiens
ggtcccctcc

SEQ ID NO: 4395280 - DNA, 20 bp, Homo sapiens
ggtcccctcccccatcccca

SEQ ID NO: 4395281 - DNA, 16 bp, Homo sapiens
ggtcccggctctgtgg

SEQ ID NO: 4395282 - DNA, 20 bp, Homo sapiens
ggtccctcacccccatggcc

SEQ ID NO: 4395283 - DNA, 17 bp, Homo sapiens
ggtccctccaccccaca

SEQ ID NO: 4395284 - DNA, 17 bp, Homo sapiens
ggtccggacactcctag

SEQ ID NO: 4395285 - DNA, 17 bp, Homo sapiens
ggtccggcctctccctg

SEQ ID NO: 4395286 - DNA, 21 bp, Homo sapiens
ggtccggcctctccctgcctg

SEQ ID NO: 4395287 - DNA, 17 bp, Homo sapiens
ggtccgtagctcccctg

SEQ ID NO: 4395288 - DNA, 18 bp, Homo sapiens
ggtccgtagctcccctgg

SEQ ID NO: 4395289 - DNA, 20 bp, Homo sapiens
ggtccgtagctcccctggct

SEQ ID NO: 4395290 - DNA, 16 bp, Homo sapiens
ggtcctaaaagcaaaa

SEQ ID NO: 4395291 - DNA, 16 bp, Homo sapiens
ggtcctcccctctctt

SEQ ID NO: 4395292 - DNA, 13 bp, Homo sapiens
ggtcctctcttcc

SEQ ID NO: 4395293 - DNA, 12 bp, Homo sapiens
ggtcctgccagc

SEQ ID NO: 4395294 - DNA, 13 bp, Homo sapiens
ggtcctgccagct

SEQ ID NO: 4395295 - DNA, 22 bp, Homo sapiens
ggtcctgctgaaactgcccact

SEQ ID NO: 4395296 - DNA, 14 bp, Homo sapiens
ggtcctggctcctg

SEQ ID NO: 4395297 - DNA, 16 bp, Homo sapiens
ggtcctggctcctgag

SEQ ID NO: 4395298 - DNA, 20 bp, Homo sapiens
ggtccttccactgtgcacct

SEQ ID NO: 4395299 - DNA, 22 bp, Homo sapiens
ggtccttcctttaggtctggtt

SEQ ID NO: 4395300 - DNA, 16 bp, Homo sapiens
ggtcctttctggaagt

SEQ ID NO: 4395301 - DNA, 16 bp, Homo sapiens
ggtccttttgacactg

SEQ ID NO: 4395302 - DNA, 18 bp, Homo sapiens
ggtcgggcagccagcaga

SEQ ID NO: 4395303 - DNA, 17 bp, Homo sapiens
ggtcgttttccaaagag

SEQ ID NO: 4395304 - DNA, 17 bp, Homo sapiens
ggtctcatctcccaggc

SEQ ID NO: 4395305 - DNA, 18 bp, Homo sapiens
ggtctcatgctccttaat

SEQ ID NO: 4395306 - DNA, 19 bp, Homo sapiens
ggtctcattgcttctgact

SEQ ID NO: 4395307 - DNA, 15 bp, Homo sapiens
ggtctccccaattct

SEQ ID NO: 4395308 - DNA, 14 bp, Homo sapiens
ggtctccctctcct

SEQ ID NO: 4395309 - DNA, 17 bp, Homo sapiens
ggtctccctctcctgcc

SEQ ID NO: 4395310 - DNA, 11 bp, Homo sapiens
ggtctccctgg

SEQ ID NO: 4395311 - DNA, 16 bp, Homo sapiens
ggtctccctggctccc

SEQ ID NO: 4395312 - DNA, 14 bp, Homo sapiens
ggtctcctcagggt

SEQ ID NO: 4395313 - DNA, 18 bp, Homo sapiens
ggtctcctcagggtgggg

SEQ ID NO: 4395314 - DNA, 16 bp, Homo sapiens
ggtctcgctctgtcac

SEQ ID NO: 4395315 - DNA, 21 bp, Homo sapiens
ggtctctctcggcccctgtct

SEQ ID NO: 4395316 - DNA, 12 bp, Homo sapiens
ggtctctgaagg

SEQ ID NO: 4395317 - DNA, 20 bp, Homo sapiens
ggtctctgaagggacccccc

SEQ ID NO: 4395318 - DNA, 10 bp, Homo sapiens
ggtctctggt

SEQ ID NO: 4395319 - DNA, 22 bp, Homo sapiens
ggtctcttctgaataaagcaat

SEQ ID NO: 4395320 - DNA, 23 bp, Homo sapiens
ggtctgagccacagcagcatttt

SEQ ID NO: 4395321 - DNA, 14 bp, Homo sapiens
ggtctgagccctgg

SEQ ID NO: 4395322 - DNA, 19 bp, Homo sapiens
ggtctgaggcccctgcctc

SEQ ID NO: 4395323 - DNA, 22 bp, Homo sapiens
ggtctgcctggttccctcccca

SEQ ID NO: 4395324 - DNA, 19 bp, Homo sapiens
ggtctgggagtcacacagt

SEQ ID NO: 4395325 - DNA, 20 bp, Homo sapiens
ggtctgggatatggctgccc

SEQ ID NO: 4395326 - DNA, 15 bp, Homo sapiens
ggtctggttcctgtg

SEQ ID NO: 4395327 - DNA, 16 bp, Homo sapiens
ggtctgtgtcatttct

SEQ ID NO: 4395328 - DNA, 18 bp, Homo sapiens
ggtctgtgtgctgtttga

SEQ ID NO: 4395329 - DNA, 17 bp, Homo sapiens
ggtctgtgtgtgtgtat

SEQ ID NO: 4395330 - DNA, 10 bp, Homo sapiens
ggtcttcctt

SEQ ID NO: 4395331 - DNA, 13 bp, Homo sapiens
ggtcttgctctgt

SEQ ID NO: 4395332 - DNA, 15 bp, Homo sapiens
ggtcttgctctgtcc

SEQ ID NO: 4395333 - DNA, 23 bp, Homo sapiens
ggtctttaaatcattttaggaaa

SEQ ID NO: 4395334 - DNA, 22 bp, Homo sapiens
ggtctttaaccacttttcaatg

SEQ ID NO: 4395335 - DNA, 14 bp, Homo sapiens
ggtctttctctcag

SEQ ID NO: 4395336 - DNA, 16 bp, Homo sapiens
ggtcttttataattct

SEQ ID NO: 4395337 - DNA, 19 bp, Homo sapiens
ggtcttttgagggctaaaa

SEQ ID NO: 4395338 - DNA, 14 bp, Homo sapiens
ggtgaaatcttgtt

SEQ ID NO: 4395339 - DNA, 15 bp, Homo sapiens
ggtgaagtgtggctg

SEQ ID NO: 4395340 - DNA, 17 bp, Homo sapiens
ggtgacacctccccctt

SEQ ID NO: 4395341 - DNA, 12 bp, Homo sapiens
ggtgacagtggc

SEQ ID NO: 4395342 - DNA, 17 bp, Homo sapiens
ggtgacatcggaaaaat

SEQ ID NO: 4395343 - DNA, 23 bp, Homo sapiens
ggtgactgtgtaactttctctta

SEQ ID NO: 4395344 - DNA, 20 bp, Homo sapiens
ggtgacttttcctgctgcct

SEQ ID NO: 4395345 - DNA, 17 bp, Homo sapiens
ggtgagagtcaaagctg

SEQ ID NO: 4395346 - DNA, 13 bp, Homo sapiens
ggtgagctctcag

SEQ ID NO: 4395347 - DNA, 19 bp, Homo sapiens
ggtgagctctcaggccgag

SEQ ID NO: 4395348 - DNA, 18 bp, Homo sapiens
ggtgagtccattctccca

SEQ ID NO: 4395349 - DNA, 19 bp, Homo sapiens
ggtgagtttgagctgcctt

SEQ ID NO: 4395350 - DNA, 14 bp, Homo sapiens
ggtgataaaatttt

SEQ ID NO: 4395351 - DNA, 20 bp, Homo sapiens
ggtgatccgcctacctcagc

SEQ ID NO: 4395352 - DNA, 18 bp, Homo sapiens
ggtgatttaagggcccag

SEQ ID NO: 4395353 - DNA, 17 bp, Homo sapiens
ggtgcaaagtattgtaa

SEQ ID NO: 4395354 - DNA, 15 bp, Homo sapiens
ggtgcaaattcagaa

SEQ ID NO: 4395355 - DNA, 16 bp, Homo sapiens
ggtgcaacccttaccc

SEQ ID NO: 4395356 - DNA, 14 bp, Homo sapiens
ggtgcaagcactcg

SEQ ID NO: 4395357 - DNA, 15 bp, Homo sapiens
ggtgcagccttcccc

SEQ ID NO: 4395358 - DNA, 21 bp, Homo sapiens
ggtgcagcgtgtgtgccacct

SEQ ID NO: 4395359 - DNA, 21 bp, Homo sapiens
ggtgcagggagacatctgcac

SEQ ID NO: 4395360 - DNA, 13 bp, Homo sapiens
ggtgcatgggctc

SEQ ID NO: 4395361 - DNA, 20 bp, Homo sapiens
ggtgccacccagtagcccag

SEQ ID NO: 4395362 - DNA, 12 bp, Homo sapiens
ggtgccagctgc

SEQ ID NO: 4395363 - DNA, 15 bp, Homo sapiens
ggtgccagctgccct

SEQ ID NO: 4395364 - DNA, 15 bp, Homo sapiens
ggtgcccatcctgcc

SEQ ID NO: 4395365 - DNA, 23 bp, Homo sapiens
ggtgcccctgctcactgggcccg

SEQ ID NO: 4395366 - DNA, 19 bp, Homo sapiens
ggtgcccgtaatcccagct

SEQ ID NO: 4395367 - DNA, 17 bp, Homo sapiens
ggtgcctgtgaggcagg

SEQ ID NO: 4395368 - DNA, 18 bp, Homo sapiens
ggtgcctttcaaatttag

SEQ ID NO: 4395369 - DNA, 19 bp, Homo sapiens
ggtgctaaaggaggccata

SEQ ID NO: 4395370 - DNA, 18 bp, Homo sapiens
ggtgctccatctccgcct

SEQ ID NO: 4395371 - DNA, 16 bp, Homo sapiens
ggtgctctctttctgt

SEQ ID NO: 4395372 - DNA, 19 bp, Homo sapiens
ggtgctgactggcttcagc

SEQ ID NO: 4395373 - DNA, 12 bp, Homo sapiens
ggtgctgcagga

SEQ ID NO: 4395374 - DNA, 12 bp, Homo sapiens
ggtgctgccgag

SEQ ID NO: 4395375 - DNA, 14 bp, Homo sapiens
ggtgctgccgaggg

SEQ ID NO: 4395376 - DNA, 15 bp, Homo sapiens
ggtgctgccgagggc

SEQ ID NO: 4395377 - DNA, 22 bp, Homo sapiens
ggtgcttcctcctcaggcccag

SEQ ID NO: 4395378 - DNA, 22 bp, Homo sapiens
ggtgcttctagttctgccagga

SEQ ID NO: 4395379 - DNA, 19 bp, Homo sapiens
ggtgcttgatctatctaca

SEQ ID NO: 4395380 - DNA, 13 bp, Homo sapiens
ggtgcttgctccc

SEQ ID NO: 4395381 - DNA, 21 bp, Homo sapiens
ggtgctttttataaaaagata

SEQ ID NO: 4395382 - DNA, 19 bp, Homo sapiens
ggtggaagaagggagaaga

SEQ ID NO: 4395383 - DNA, 15 bp, Homo sapiens
ggtggaagcagaggc

SEQ ID NO: 4395384 - DNA, 17 bp, Homo sapiens
ggtggaagcagaggccc

SEQ ID NO: 4395385 - DNA, 22 bp, Homo sapiens
ggtggaagcagaggccctgccc

SEQ ID NO: 4395386 - DNA, 20 bp, Homo sapiens
ggtggaagccctccttccac

SEQ ID NO: 4395387 - DNA, 12 bp, Homo sapiens
ggtggacagcag

SEQ ID NO: 4395388 - DNA, 13 bp, Homo sapiens
ggtggaggaaggg

SEQ ID NO: 4395389 - DNA, 18 bp, Homo sapiens
ggtggaggaagggctggg

SEQ ID NO: 4395390 - DNA, 21 bp, Homo sapiens
ggtggaggaagggctgggcca

SEQ ID NO: 4395391 - DNA, 15 bp, Homo sapiens
ggtggaggcttcctg

SEQ ID NO: 4395392 - DNA, 13 bp, Homo sapiens
ggtggagggccac

SEQ ID NO: 4395393 - DNA, 20 bp, Homo sapiens
ggtggaggttgcagtgagct

SEQ ID NO: 4395394 - DNA, 15 bp, Homo sapiens
ggtggatcacagagg

SEQ ID NO: 4395395 - DNA, 22 bp, Homo sapiens
ggtggatgtgctggaggggtgg

SEQ ID NO: 4395396 - DNA, 23 bp, Homo sapiens
ggtggatgtgctggaggggtggc

SEQ ID NO: 4395397 - DNA, 12 bp, Homo sapiens
ggtggcaccaga

SEQ ID NO: 4395398 - DNA, 20 bp, Homo sapiens
ggtggcaccagatgcaacct

SEQ ID NO: 4395399 - DNA, 21 bp, Homo sapiens
ggtggcaccagatgcaacctc

SEQ ID NO: 4395400 - DNA, 19 bp, Homo sapiens
ggtggcacctgcagcggct

SEQ ID NO: 4395401 - DNA, 21 bp, Homo sapiens
ggtggcaggcacacagcagcc

SEQ ID NO: 4395402 - DNA, 18 bp, Homo sapiens
ggtggccacacaggcagg

SEQ ID NO: 4395403 - DNA, 23 bp, Homo sapiens
ggtggccacacaggcagggcctg

SEQ ID NO: 4395404 - DNA, 22 bp, Homo sapiens
ggtggccatccctgggcccctc

SEQ ID NO: 4395405 - DNA, 12 bp, Homo sapiens
ggtggcccagag

SEQ ID NO: 4395406 - DNA, 13 bp, Homo sapiens
ggtggcccagagc

SEQ ID NO: 4395407 - DNA, 17 bp, Homo sapiens
ggtggctagtcagagag

SEQ ID NO: 4395408 - DNA, 13 bp, Homo sapiens
ggtggctgaccca

SEQ ID NO: 4395409 - DNA, 22 bp, Homo sapiens
ggtggctgacccagtccctggg

SEQ ID NO: 4395410 - DNA, 20 bp, Homo sapiens
ggtgggaggagatgaaaata

SEQ ID NO: 4395411 - DNA, 18 bp, Homo sapiens
ggtgggcctggccctgct

SEQ ID NO: 4395412 - DNA, 18 bp, Homo sapiens
ggtgggtcccggctctgt

SEQ ID NO: 4395413 - DNA, 19 bp, Homo sapiens
ggtgggtcccggctctgtg

SEQ ID NO: 4395414 - DNA, 18 bp, Homo sapiens
ggtgggtgagctctcagg

SEQ ID NO: 4395415 - DNA, 22 bp, Homo sapiens
ggtgggtgagctctcaggccga

SEQ ID NO: 4395416 - DNA, 17 bp, Homo sapiens
ggtggtcttccttctac

SEQ ID NO: 4395417 - DNA, 12 bp, Homo sapiens
ggtggtgctaaa

SEQ ID NO: 4395418 - DNA, 14 bp, Homo sapiens
ggtggtggcctggt

SEQ ID NO: 4395419 - DNA, 21 bp, Homo sapiens
ggtggtgtctccaacccccca

SEQ ID NO: 4395420 - DNA, 19 bp, Homo sapiens
ggtggtttacgcctataat

SEQ ID NO: 4395421 - DNA, 20 bp, Homo sapiens
ggtgtcaggctgctggcgcc

SEQ ID NO: 4395422 - DNA, 17 bp, Homo sapiens
ggtgtcagtatccaggc

SEQ ID NO: 4395423 - DNA, 17 bp, Homo sapiens
ggtgtcatttcattcca

SEQ ID NO: 4395424 - DNA, 19 bp, Homo sapiens
ggtgtccccttcccctgct

SEQ ID NO: 4395425 - DNA, 13 bp, Homo sapiens
ggtgtcctgagca

SEQ ID NO: 4395426 - DNA, 14 bp, Homo sapiens
ggtgtctcccaaca

SEQ ID NO: 4395427 - DNA, 16 bp, Homo sapiens
ggtgtcttccctgcct

SEQ ID NO: 4395428 - DNA, 22 bp, Homo sapiens
ggtgtcttccctgcctgtggca

SEQ ID NO: 4395429 - DNA, 16 bp, Homo sapiens
ggtgtgaacccgggag

SEQ ID NO: 4395430 - DNA, 13 bp, Homo sapiens
ggtgtgaactttt

SEQ ID NO: 4395431 - DNA, 15 bp, Homo sapiens
ggtgtgatcgtctga

SEQ ID NO: 4395432 - DNA, 12 bp, Homo sapiens
ggtgtgctctga

SEQ ID NO: 4395433 - DNA, 14 bp, Homo sapiens
ggtgtgctgccaac

SEQ ID NO: 4395434 - DNA, 12 bp, Homo sapiens
ggtgtggcctca

SEQ ID NO: 4395435 - DNA, 12 bp, Homo sapiens
ggtgtggctctg

SEQ ID NO: 4395436 - DNA, 16 bp, Homo sapiens
ggtgtgtactcagggc

SEQ ID NO: 4395437 - DNA, 22 bp, Homo sapiens
ggtgtgttcaagaccagcctgg

SEQ ID NO: 4395438 - DNA, 22 bp, Homo sapiens
ggtgtgtttttgggatgtctta

SEQ ID NO: 4395439 - DNA, 19 bp, Homo sapiens
ggtgttactagaaggcgtc

SEQ ID NO: 4395440 - DNA, 21 bp, Homo sapiens
ggtgttatcaccgtgggctcc

SEQ ID NO: 4395441 - DNA, 16 bp, Homo sapiens
ggtgttctttcctgcc

SEQ ID NO: 4395442 - DNA, 17 bp, Homo sapiens
ggtgttctttcctgccc

SEQ ID NO: 4395443 - DNA, 19 bp, Homo sapiens
ggtgttctttcctgccctg

SEQ ID NO: 4395444 - DNA, 22 bp, Homo sapiens
ggtgttctttcctgccctgtcc

SEQ ID NO: 4395445 - DNA, 21 bp, Homo sapiens
ggtgtttctagcactggcctg

SEQ ID NO: 4395446 - DNA, 16 bp, Homo sapiens
ggtgtttgactgtaat

SEQ ID NO: 4395447 - DNA, 14 bp, Homo sapiens
ggtgttttgtcaga

SEQ ID NO: 4395448 - DNA, 22 bp, Homo sapiens
ggttaaacggtgcccatcctgc

SEQ ID NO: 4395449 - DNA, 16 bp, Homo sapiens
ggttaaacgtagcatg

SEQ ID NO: 4395450 - DNA, 13 bp, Homo sapiens
ggttacactgtta

SEQ ID NO: 4395451 - DNA, 14 bp, Homo sapiens
ggttaccaggcact

SEQ ID NO: 4395452 - DNA, 18 bp, Homo sapiens
ggttactacttaatgctt

SEQ ID NO: 4395453 - DNA, 15 bp, Homo sapiens
ggttacttcttctct

SEQ ID NO: 4395454 - DNA, 17 bp, Homo sapiens
ggttacttcttctctta

SEQ ID NO: 4395455 - DNA, 18 bp, Homo sapiens
ggttagattcaaggcccc

SEQ ID NO: 4395456 - DNA, 21 bp, Homo sapiens
ggttagcaagactgcaagaga

SEQ ID NO: 4395457 - DNA, 17 bp, Homo sapiens
ggttatggagtcttgtg

SEQ ID NO: 4395458 - DNA, 15 bp, Homo sapiens
ggttatttttctctt

SEQ ID NO: 4395459 - DNA, 16 bp, Homo sapiens
ggttcagaaaattaaa

SEQ ID NO: 4395460 - DNA, 20 bp, Homo sapiens
ggttcagaaatagctcctca

SEQ ID NO: 4395461 - DNA, 20 bp, Homo sapiens
gggcagagggcagaggctgg

SEQ ID NO: 4395462 - DNA, 16 bp, Homo sapiens
gggcagagggctggag

SEQ ID NO: 4395463 - DNA, 23 bp, Homo sapiens
gggcagattcggaccactaggcc

SEQ ID NO: 4395464 - DNA, 13 bp, Homo sapiens
gggcagcaccctc

SEQ ID NO: 4395465 - DNA, 15 bp, Homo sapiens
gggcagcaccctccc

SEQ ID NO: 4395466 - DNA, 12 bp, Homo sapiens
gggcagccacac

SEQ ID NO: 4395467 - DNA, 15 bp, Homo sapiens
gggcagccacccaag

SEQ ID NO: 4395468 - DNA, 11 bp, Homo sapiens
gggcagccagc

SEQ ID NO: 4395469 - DNA, 23 bp, Homo sapiens
gggcagccccgttttggggacgt

SEQ ID NO: 4395470 - DNA, 18 bp, Homo sapiens
gggcagctgggcccaacc

SEQ ID NO: 4395471 - DNA, 16 bp, Homo sapiens
gggcaggaaggagagc

SEQ ID NO: 4395472 - DNA, 19 bp, Homo sapiens
gggcaggaaggagagcctg

SEQ ID NO: 4395473 - DNA, 21 bp, Homo sapiens
gggcaggaaggagagcctgct

SEQ ID NO: 4395474 - DNA, 14 bp, Homo sapiens
gggcaggctgggcc

SEQ ID NO: 4395475 - DNA, 15 bp, Homo sapiens
gggcaggctgggcca

SEQ ID NO: 4395476 - DNA, 15 bp, Homo sapiens
gggcagggcgagctg

SEQ ID NO: 4395477 - DNA, 20 bp, Homo sapiens
gggcagtctccccttcctgg

SEQ ID NO: 4395478 - DNA, 17 bp, Homo sapiens
gggcagtctgagagagg

SEQ ID NO: 4395479 - DNA, 21 bp, Homo sapiens
gggcagtctgagagaggccat

SEQ ID NO: 4395480 - DNA, 17 bp, Homo sapiens
gggcagtctgctctgct

SEQ ID NO: 4395481 - DNA, 18 bp, Homo sapiens
gggcagtgccccagggag

SEQ ID NO: 4395482 - DNA, 20 bp, Homo sapiens
gggcagtggtgtggagaagc

SEQ ID NO: 4395483 - DNA, 13 bp, Homo sapiens
gggcatctcttcc

SEQ ID NO: 4395484 - DNA, 20 bp, Homo sapiens
gggcatctgagtccagctcc

SEQ ID NO: 4395485 - DNA, 14 bp, Homo sapiens
gggcatctgcccct

SEQ ID NO: 4395486 - DNA, 17 bp, Homo sapiens
gggcatctgcccctccc

SEQ ID NO: 4395487 - DNA, 15 bp, Homo sapiens
gggcatcttctggct

SEQ ID NO: 4395488 - DNA, 19 bp, Homo sapiens
gggcatggtggcaggcgcc

SEQ ID NO: 4395489 - DNA, 17 bp, Homo sapiens
gggcattttcctcctct

SEQ ID NO: 4395490 - DNA, 13 bp, Homo sapiens
gggccaaaaggaa

SEQ ID NO: 4395491 - DNA, 17 bp, Homo sapiens
gggccaaaaggaaaaag

SEQ ID NO: 4395492 - DNA, 13 bp, Homo sapiens
gggccaagcccag

SEQ ID NO: 4395493 - DNA, 21 bp, Homo sapiens
gggccaattcaatacaaacaa

SEQ ID NO: 4395494 - DNA, 20 bp, Homo sapiens
gggccacacccaggaaggga

SEQ ID NO: 4395495 - DNA, 18 bp, Homo sapiens
gggccaccacctttggct

SEQ ID NO: 4395496 - DNA, 17 bp, Homo sapiens
gggccacgctccagctg

SEQ ID NO: 4395497 - DNA, 12 bp, Homo sapiens
gggccaggaggc

SEQ ID NO: 4395498 - DNA, 12 bp, Homo sapiens
gggccagggagg

SEQ ID NO: 4395499 - DNA, 20 bp, Homo sapiens
gggccagtcaacggggggct

SEQ ID NO: 4395500 - DNA, 20 bp, Homo sapiens
gggccagtcctgcctggcca

SEQ ID NO: 4395501 - DNA, 21 bp, Homo sapiens
gggccagtcctgcctggccag

SEQ ID NO: 4395502 - DNA, 22 bp, Homo sapiens
gggccagtcctgcctggccagg

SEQ ID NO: 4395503 - DNA, 15 bp, Homo sapiens
gggccatgtccaaag

SEQ ID NO: 4395504 - DNA, 16 bp, Homo sapiens
gggccatgtccaaaga

SEQ ID NO: 4395505 - DNA, 19 bp, Homo sapiens
gggcccaaagaattggaat

SEQ ID NO: 4395506 - DNA, 19 bp, Homo sapiens
gggcccaagacagatgccc

SEQ ID NO: 4395507 - DNA, 18 bp, Homo sapiens
gggcccacccatgtcacc

SEQ ID NO: 4395508 - DNA, 19 bp, Homo sapiens
gggcccagcccagagccac

SEQ ID NO: 4395509 - DNA, 11 bp, Homo sapiens
gggcccaggga

SEQ ID NO: 4395510 - DNA, 22 bp, Homo sapiens
gggcccagggacaccagccagg

SEQ ID NO: 4395511 - DNA, 13 bp, Homo sapiens
gggcccatctctt

SEQ ID NO: 4395512 - DNA, 12 bp, Homo sapiens
gggccccagccc

SEQ ID NO: 4395513 - DNA, 14 bp, Homo sapiens
gggccccagtcagc

SEQ ID NO: 4395514 - DNA, 17 bp, Homo sapiens
gggccccagtcagcctc

SEQ ID NO: 4395515 - DNA, 21 bp, Homo sapiens
gggccccatcctcatccctga

SEQ ID NO: 4395516 - DNA, 21 bp, Homo sapiens
gggcccccaataaaccagtgt

SEQ ID NO: 4395517 - DNA, 15 bp, Homo sapiens
gggccccctggtcac

SEQ ID NO: 4395518 - DNA, 16 bp, Homo sapiens
gggccccgccagggct

SEQ ID NO: 4395519 - DNA, 19 bp, Homo sapiens
gggccccgccagggctggg

SEQ ID NO: 4395520 - DNA, 20 bp, Homo sapiens
gggccccgccagggctgggg

SEQ ID NO: 4395521 - DNA, 21 bp, Homo sapiens
gggccccgccagggctgggga

SEQ ID NO: 4395522 - DNA, 10 bp, Homo sapiens
gggcccctcc

SEQ ID NO: 4395523 - DNA, 12 bp, Homo sapiens
gggcccctccac

SEQ ID NO: 4395524 - DNA, 15 bp, Homo sapiens
gggcccctccagctt

SEQ ID NO: 4395525 - DNA, 18 bp, Homo sapiens
gggcccctccctacctca

SEQ ID NO: 4395526 - DNA, 19 bp, Homo sapiens
gggcccctctctagggacc

SEQ ID NO: 4395527 - DNA, 21 bp, Homo sapiens
gggcccctgggcttggcctgc

SEQ ID NO: 4395528 - DNA, 16 bp, Homo sapiens
gggcccggccacaccc

SEQ ID NO: 4395529 - DNA, 15 bp, Homo sapiens
gggcccggtccacag

SEQ ID NO: 4395530 - DNA, 21 bp, Homo sapiens
gggccctgccccaccccatcc

SEQ ID NO: 4395531 - DNA, 23 bp, Homo sapiens
gggccctgcctgcagccagggct

SEQ ID NO: 4395532 - DNA, 24 bp, Homo sapiens
gggccctgcctgcagccagggctg

SEQ ID NO: 4395533 - DNA, 11 bp, Homo sapiens
gggccctgggc

SEQ ID NO: 4395534 - DNA, 14 bp, Homo sapiens
gggccctgggctgg

SEQ ID NO: 4395535 - DNA, 20 bp, Homo sapiens
gggccgggcaggtcctgccc

SEQ ID NO: 4395536 - DNA, 18 bp, Homo sapiens
gggccggttttcctcagc

SEQ ID NO: 4395537 - DNA, 21 bp, Homo sapiens
gggcctaaggagggtctccac

SEQ ID NO: 4395538 - DNA, 15 bp, Homo sapiens
gggcctcaggctccg

SEQ ID NO: 4395539 - DNA, 18 bp, Homo sapiens
gggcctcccataattgct

SEQ ID NO: 4395540 - DNA, 18 bp, Homo sapiens
gggcctctccttggaagg

SEQ ID NO: 4395541 - DNA, 19 bp, Homo sapiens
gggcctctctcctgcctgc

SEQ ID NO: 4395542 - DNA, 22 bp, Homo sapiens
gggcctgaaacccgccctcagg

SEQ ID NO: 4395543 - DNA, 14 bp, Homo sapiens
gggcctggacaggc

SEQ ID NO: 4395544 - DNA, 14 bp, Homo sapiens
gggcctggctccag

SEQ ID NO: 4395545 - DNA, 14 bp, Homo sapiens
gggccttgcccaga

SEQ ID NO: 4395546 - DNA, 21 bp, Homo sapiens
gggccttgcggtatccgcccc

SEQ ID NO: 4395547 - DNA, 14 bp, Homo sapiens
gggcctttgccagc

SEQ ID NO: 4395548 - DNA, 20 bp, Homo sapiens
gggcgcaccccacagctggg

SEQ ID NO: 4395549 - DNA, 15 bp, Homo sapiens
gggcgcggccagccc

SEQ ID NO: 4395550 - DNA, 18 bp, Homo sapiens
gggcgcggccagccccgg

SEQ ID NO: 4395551 - DNA, 14 bp, Homo sapiens
gggcgcggctggga

SEQ ID NO: 4395552 - DNA, 17 bp, Homo sapiens
gggcggctcctggtgct

SEQ ID NO: 4395553 - DNA, 14 bp, Homo sapiens
gggcggggccttgc

SEQ ID NO: 4395554 - DNA, 21 bp, Homo sapiens
ggctgggaggagggcaggcat

SEQ ID NO: 4395555 - DNA, 20 bp, Homo sapiens
ggctgggatggtgactcctg

SEQ ID NO: 4395556 - DNA, 17 bp, Homo sapiens
ggctgggccaccaggga

SEQ ID NO: 4395557 - DNA, 19 bp, Homo sapiens
ggctgggccaccagggatc

SEQ ID NO: 4395558 - DNA, 17 bp, Homo sapiens
ggctgggccatgtccaa

SEQ ID NO: 4395559 - DNA, 13 bp, Homo sapiens
ggctgggcccctc

SEQ ID NO: 4395560 - DNA, 18 bp, Homo sapiens
ggctgggccctctttccc

SEQ ID NO: 4395561 - DNA, 21 bp, Homo sapiens
ggctgggccctctttccctgc

SEQ ID NO: 4395562 - DNA, 15 bp, Homo sapiens
ggctggggaggtgct

SEQ ID NO: 4395563 - DNA, 15 bp, Homo sapiens
ggctggggccacctt

SEQ ID NO: 4395564 - DNA, 14 bp, Homo sapiens
ggctgggggcagga

SEQ ID NO: 4395565 - DNA, 20 bp, Homo sapiens
ggctggggtcacagaggcat

SEQ ID NO: 4395566 - DNA, 19 bp, Homo sapiens
ggctggggttgccagaggc

SEQ ID NO: 4395567 - DNA, 21 bp, Homo sapiens
ggctggggttgccagaggccc

SEQ ID NO: 4395568 - DNA, 22 bp, Homo sapiens
ggctggggttgccagaggccct

SEQ ID NO: 4395569 - DNA, 12 bp, Homo sapiens
ggctgggtcctg

SEQ ID NO: 4395570 - DNA, 16 bp, Homo sapiens
ggctgggtcctgccag

SEQ ID NO: 4395571 - DNA, 21 bp, Homo sapiens
ggctgggtcctgccagctgga

SEQ ID NO: 4395572 - DNA, 15 bp, Homo sapiens
ggctgggtgctggga

SEQ ID NO: 4395573 - DNA, 21 bp, Homo sapiens
ggctggtcttggggaggcagg

SEQ ID NO: 4395574 - DNA, 18 bp, Homo sapiens
ggctggtgtccccttccc

SEQ ID NO: 4395575 - DNA, 20 bp, Homo sapiens
ggctgtcctaccatcagctc

SEQ ID NO: 4395576 - DNA, 22 bp, Homo sapiens
ggctgtcctaccatcagctctg

SEQ ID NO: 4395577 - DNA, 14 bp, Homo sapiens
ggctgtctgtcacc

SEQ ID NO: 4395578 - DNA, 19 bp, Homo sapiens
ggctgtgaatgccaaagcc

SEQ ID NO: 4395579 - DNA, 20 bp, Homo sapiens
ggctgtgaatgccaaagcca

SEQ ID NO: 4395580 - DNA, 12 bp, Homo sapiens
ggctgtgctggg

SEQ ID NO: 4395581 - DNA, 17 bp, Homo sapiens
ggctgtgctgtattttg

SEQ ID NO: 4395582 - DNA, 20 bp, Homo sapiens
ggctgtgtcctaaggcccat

SEQ ID NO: 4395583 - DNA, 15 bp, Homo sapiens
ggctgtgtgtctgct

SEQ ID NO: 4395584 - DNA, 14 bp, Homo sapiens
ggctgttaccattt

SEQ ID NO: 4395585 - DNA, 20 bp, Homo sapiens
ggctgttccagactcaggtt

SEQ ID NO: 4395586 - DNA, 16 bp, Homo sapiens
ggctgttccatgttct

SEQ ID NO: 4395587 - DNA, 18 bp, Homo sapiens
ggctgttctgtggttcct

SEQ ID NO: 4395588 - DNA, 17 bp, Homo sapiens
ggctgtttcaaaaaaat

SEQ ID NO: 4395589 - DNA, 19 bp, Homo sapiens
ggctgttttccctctgctg

SEQ ID NO: 4395590 - DNA, 18 bp, Homo sapiens
ggctgttttgcctcccca

SEQ ID NO: 4395591 - DNA, 12 bp, Homo sapiens
ggcttaaaccag

SEQ ID NO: 4395592 - DNA, 15 bp, Homo sapiens
ggcttagtgccaccc

SEQ ID NO: 4395593 - DNA, 18 bp, Homo sapiens
ggcttatatctggcctct

SEQ ID NO: 4395594 - DNA, 14 bp, Homo sapiens
ggcttatgtcatca

SEQ ID NO: 4395595 - DNA, 16 bp, Homo sapiens
ggcttcacagccacac

SEQ ID NO: 4395596 - DNA, 17 bp, Homo sapiens
ggcttcaggttgcattg

SEQ ID NO: 4395597 - DNA, 19 bp, Homo sapiens
ggcttccagattttaaatt

SEQ ID NO: 4395598 - DNA, 17 bp, Homo sapiens
ggcttccaggctgagag

SEQ ID NO: 4395599 - DNA, 22 bp, Homo sapiens
ggcttcctccttccagatgccc

SEQ ID NO: 4395600 - DNA, 22 bp, Homo sapiens
ggcttcctgcccttccctctgg

SEQ ID NO: 4395601 - DNA, 20 bp, Homo sapiens
ggcttcctgcgtcctcctca

SEQ ID NO: 4395602 - DNA, 17 bp, Homo sapiens
ggcttcggagtgaatgt

SEQ ID NO: 4395603 - DNA, 23 bp, Homo sapiens
ggcttctcacgctttgtttactc

SEQ ID NO: 4395604 - DNA, 16 bp, Homo sapiens
ggcttctccgccagcc

SEQ ID NO: 4395605 - DNA, 17 bp, Homo sapiens
ggcttctccgccagcct

SEQ ID NO: 4395606 - DNA, 16 bp, Homo sapiens
ggcttctcctcctctg

SEQ ID NO: 4395607 - DNA, 19 bp, Homo sapiens
ggcttctgtggggcccctc

SEQ ID NO: 4395608 - DNA, 20 bp, Homo sapiens
ggcttgaagccaaagaaaaa

SEQ ID NO: 4395609 - DNA, 14 bp, Homo sapiens
ggcttgactggatg

SEQ ID NO: 4395610 - DNA, 17 bp, Homo sapiens
ggcttgataaacataat

SEQ ID NO: 4395611 - DNA, 20 bp, Homo sapiens
ggcttggatttcgtgtgccg

SEQ ID NO: 4395612 - DNA, 13 bp, Homo sapiens
ggcttggcctgct

SEQ ID NO: 4395613 - DNA, 17 bp, Homo sapiens
ggcttgggatttgctgt

SEQ ID NO: 4395614 - DNA, 17 bp, Homo sapiens
ggcttgggcctgcaccc

SEQ ID NO: 4395615 - DNA, 16 bp, Homo sapiens
ggcttggtgtctgcgg

SEQ ID NO: 4395616 - DNA, 17 bp, Homo sapiens
ggcttgtaactccacca

SEQ ID NO: 4395617 - DNA, 13 bp, Homo sapiens
ggcttgtcacagt

SEQ ID NO: 4395618 - DNA, 20 bp, Homo sapiens
ggcttgtgggcactgtgcca

SEQ ID NO: 4395619 - DNA, 19 bp, Homo sapiens
ggcttgtttttcttcagca

SEQ ID NO: 4395620 - DNA, 20 bp, Homo sapiens
ggctttacatactttatcaa

SEQ ID NO: 4395621 - DNA, 14 bp, Homo sapiens
ggctttccaggcac

SEQ ID NO: 4395622 - DNA, 20 bp, Homo sapiens
ggctttgcagctgctgtctg

SEQ ID NO: 4395623 - DNA, 13 bp, Homo sapiens
ggctttggcactc

SEQ ID NO: 4395624 - DNA, 18 bp, Homo sapiens
ggctttggcactctctgc

SEQ ID NO: 4395625 - DNA, 15 bp, Homo sapiens
ggctttggggtccta

SEQ ID NO: 4395626 - DNA, 17 bp, Homo sapiens
ggctttttgttcagaat

SEQ ID NO: 4395627 - DNA, 16 bp, Homo sapiens
gggaaaaaaatcatct

SEQ ID NO: 4395628 - DNA, 22 bp, Homo sapiens
gggaaaacgggcagtctgctct

SEQ ID NO: 4395629 - DNA, 18 bp, Homo sapiens
gggaaaattatttgcata

SEQ ID NO: 4395630 - DNA, 19 bp, Homo sapiens
gggaaacaatgaaaacaaa

SEQ ID NO: 4395631 - DNA, 18 bp, Homo sapiens
gggaaagcgggcagcccc

SEQ ID NO: 4395632 - DNA, 16 bp, Homo sapiens
gggaaatgtacacttt

SEQ ID NO: 4395633 - DNA, 18 bp, Homo sapiens
gggaaatgtacacttttt

SEQ ID NO: 4395634 - DNA, 22 bp, Homo sapiens
gggaaattgtaaatcctgtgtt

SEQ ID NO: 4395635 - DNA, 15 bp, Homo sapiens
gggaacagacaggag

SEQ ID NO: 4395636 - DNA, 22 bp, Homo sapiens
gggaacccccaaatttaattaa

SEQ ID NO: 4395637 - DNA, 18 bp, Homo sapiens
gggaacgtgactgcccca

SEQ ID NO: 4395638 - DNA, 15 bp, Homo sapiens
gggaactgcagacct

SEQ ID NO: 4395639 - DNA, 22 bp, Homo sapiens
gggaagaacagccccggggccc

SEQ ID NO: 4395640 - DNA, 18 bp, Homo sapiens
gggaagactcaggagtct

SEQ ID NO: 4395641 - DNA, 18 bp, Homo sapiens
gggaagagacagcccagg

SEQ ID NO: 4395642 - DNA, 17 bp, Homo sapiens
gggaagccagtcagggc

SEQ ID NO: 4395643 - DNA, 15 bp, Homo sapiens
gggaagcctgggtgt

SEQ ID NO: 4395644 - DNA, 15 bp, Homo sapiens
gggaagctggcctga

SEQ ID NO: 4395645 - DNA, 21 bp, Homo sapiens
gggaagcttctgtctccagct

SEQ ID NO: 4395646 - DNA, 20 bp, Homo sapiens
gggaaggacagtccctgctg

SEQ ID NO: 4395647 - DNA, 15 bp, Homo sapiens
gggaaggatcccatg

SEQ ID NO: 4395648 - DNA, 12 bp, Homo sapiens
gggaaggccagc

SEQ ID NO: 4395649 - DNA, 14 bp, Homo sapiens
gggaaggccctgag

SEQ ID NO: 4395650 - DNA, 13 bp, Homo sapiens
gggaaggcctgac

SEQ ID NO: 4395651 - DNA, 16 bp, Homo sapiens
gggaaggcgagtctgg

SEQ ID NO: 4395652 - DNA, 13 bp, Homo sapiens
gggaagggagagc

SEQ ID NO: 4395653 - DNA, 16 bp, Homo sapiens
gggaagtagtccttgg

SEQ ID NO: 4395654 - DNA, 20 bp, Homo sapiens
ggctcagagggtgtcctgca

SEQ ID NO: 4395655 - DNA, 15 bp, Homo sapiens
ggctcaggaggaggg

SEQ ID NO: 4395656 - DNA, 14 bp, Homo sapiens
ggctcagtgccacc

SEQ ID NO: 4395657 - DNA, 15 bp, Homo sapiens
ggctcagtgccacct

SEQ ID NO: 4395658 - DNA, 12 bp, Homo sapiens
ggctcatgcctg

SEQ ID NO: 4395659 - DNA, 16 bp, Homo sapiens
ggctcatttaaaacag

SEQ ID NO: 4395660 - DNA, 20 bp, Homo sapiens
ggctccagctctggcacagt

SEQ ID NO: 4395661 - DNA, 17 bp, Homo sapiens
ggctccagtctcatcct

SEQ ID NO: 4395662 - DNA, 21 bp, Homo sapiens
ggctccagtctcatcctccca

SEQ ID NO: 4395663 - DNA, 18 bp, Homo sapiens
ggctccatgctgggtctg

SEQ ID NO: 4395664 - DNA, 19 bp, Homo sapiens
ggctccatgctgggtctga

SEQ ID NO: 4395665 - DNA, 20 bp, Homo sapiens
ggctccatgctgggtctgag

SEQ ID NO: 4395666 - DNA, 21 bp, Homo sapiens
ggctcccaggggtctccctgg

SEQ ID NO: 4395667 - DNA, 22 bp, Homo sapiens
ggctcccagggtccctgcccac

SEQ ID NO: 4395668 - DNA, 19 bp, Homo sapiens
ggctccccctccagccaga

SEQ ID NO: 4395669 - DNA, 16 bp, Homo sapiens
ggctccccctccccag

SEQ ID NO: 4395670 - DNA, 16 bp, Homo sapiens
ggctccccgcctccac

SEQ ID NO: 4395671 - DNA, 17 bp, Homo sapiens
ggctccccgcctccact

SEQ ID NO: 4395672 - DNA, 18 bp, Homo sapiens
ggctccccgcctccactc

SEQ ID NO: 4395673 - DNA, 16 bp, Homo sapiens
ggctcccctctgcttc

SEQ ID NO: 4395674 - DNA, 20 bp, Homo sapiens
ggctcccctctgcttctcat

SEQ ID NO: 4395675 - DNA, 16 bp, Homo sapiens
ggctcccggggcctgg

SEQ ID NO: 4395676 - DNA, 16 bp, Homo sapiens
ggctccctcctccagg

SEQ ID NO: 4395677 - DNA, 20 bp, Homo sapiens
ggctccctcctccaggcctg

SEQ ID NO: 4395678 - DNA, 15 bp, Homo sapiens
ggctcctaggggaag

SEQ ID NO: 4395679 - DNA, 20 bp, Homo sapiens
ggctcctatctgtgttttga

SEQ ID NO: 4395680 - DNA, 12 bp, Homo sapiens
ggctcctccttg

SEQ ID NO: 4395681 - DNA, 23 bp, Homo sapiens
ggctcctgcaaaaggaggtgaaa

SEQ ID NO: 4395682 - DNA, 11 bp, Homo sapiens
ggctcctgccc

SEQ ID NO: 4395683 - DNA, 12 bp, Homo sapiens
ggctcctgccca

SEQ ID NO: 4395684 - DNA, 14 bp, Homo sapiens
ggctcctgcccagg

SEQ ID NO: 4395685 - DNA, 19 bp, Homo sapiens
ggctcctgcccaggccaca

SEQ ID NO: 4395686 - DNA, 23 bp, Homo sapiens
ggctcctgcccaggccacagaga

SEQ ID NO: 4395687 - DNA, 14 bp, Homo sapiens
ggctcctgttttgc

SEQ ID NO: 4395688 - DNA, 17 bp, Homo sapiens
ggctcgccgtgtctcag

SEQ ID NO: 4395689 - DNA, 23 bp, Homo sapiens
ggctcgctccctgtagctctgcc

SEQ ID NO: 4395690 - DNA, 15 bp, Homo sapiens
ggctcggacccaccc

SEQ ID NO: 4395691 - DNA, 17 bp, Homo sapiens
ggctcggaggctgcccc

SEQ ID NO: 4395692 - DNA, 21 bp, Homo sapiens
ggctctcacccccatccctgg

SEQ ID NO: 4395693 - DNA, 13 bp, Homo sapiens
ggctctccacctc

SEQ ID NO: 4395694 - DNA, 15 bp, Homo sapiens
ggctctccacctcag

SEQ ID NO: 4395695 - DNA, 16 bp, Homo sapiens
ggctctccacctcagc

SEQ ID NO: 4395696 - DNA, 18 bp, Homo sapiens
ggctctccacctcagcct

SEQ ID NO: 4395697 - DNA, 19 bp, Homo sapiens
ggctctccacctcagcctt

SEQ ID NO: 4395698 - DNA, 20 bp, Homo sapiens
ggctctccacctcagccttg

SEQ ID NO: 4395699 - DNA, 13 bp, Homo sapiens
ggctctcccctct

SEQ ID NO: 4395700 - DNA, 23 bp, Homo sapiens
ggctctcgctgccctgtggacag

SEQ ID NO: 4395701 - DNA, 19 bp, Homo sapiens
ggctctgccccctccccca

SEQ ID NO: 4395702 - DNA, 20 bp, Homo sapiens
ggctctgccccctcccccat

SEQ ID NO: 4395703 - DNA, 16 bp, Homo sapiens
ggctctgccctggaaa

SEQ ID NO: 4395704 - DNA, 23 bp, Homo sapiens
ggctctgggggtgggaagtgggg

SEQ ID NO: 4395705 - DNA, 20 bp, Homo sapiens
ggctctgtgctgaccctcct

SEQ ID NO: 4395706 - DNA, 20 bp, Homo sapiens
ggctcttatgtgtgcctttg

SEQ ID NO: 4395707 - DNA, 17 bp, Homo sapiens
ggctgaagaggaccaga

SEQ ID NO: 4395708 - DNA, 18 bp, Homo sapiens
ggctgaagaggaccagag

SEQ ID NO: 4395709 - DNA, 16 bp, Homo sapiens
ggctgaatagcagaag

SEQ ID NO: 4395710 - DNA, 17 bp, Homo sapiens
ggctgacccagtccctg

SEQ ID NO: 4395711 - DNA, 10 bp, Homo sapiens
ggctgagaag

SEQ ID NO: 4395712 - DNA, 13 bp, Homo sapiens
ggctgagaaggaa

SEQ ID NO: 4395713 - DNA, 14 bp, Homo sapiens
ggctgagaaggaac

SEQ ID NO: 4395714 - DNA, 20 bp, Homo sapiens
ggctgagctctctgtgggct

SEQ ID NO: 4395715 - DNA, 16 bp, Homo sapiens
ggctgaggaggcctcc

SEQ ID NO: 4395716 - DNA, 15 bp, Homo sapiens
ggctgaggcaggaga

SEQ ID NO: 4395717 - DNA, 13 bp, Homo sapiens
ggctgaggccaga

SEQ ID NO: 4395718 - DNA, 16 bp, Homo sapiens
ggctgagggagcctgg

SEQ ID NO: 4395719 - DNA, 19 bp, Homo sapiens
ggctgaggttcctctgcct

SEQ ID NO: 4395720 - DNA, 22 bp, Homo sapiens
ggctgagtcatgatctccctgc

SEQ ID NO: 4395721 - DNA, 15 bp, Homo sapiens
ggctgataattttaa

SEQ ID NO: 4395722 - DNA, 20 bp, Homo sapiens
ggctgatggattccaaacca

SEQ ID NO: 4395723 - DNA, 13 bp, Homo sapiens
ggctgcaaaatta

SEQ ID NO: 4395724 - DNA, 17 bp, Homo sapiens
ggctgcaaaattaaatc

SEQ ID NO: 4395725 - DNA, 20 bp, Homo sapiens
ggctgcacctcctaccctcc

SEQ ID NO: 4395726 - DNA, 18 bp, Homo sapiens
ggctgccacacggaagca

SEQ ID NO: 4395727 - DNA, 15 bp, Homo sapiens
ggctgccagtgcctg

SEQ ID NO: 4395728 - DNA, 13 bp, Homo sapiens
ggctgcccaggag

SEQ ID NO: 4395729 - DNA, 15 bp, Homo sapiens
ggctgcccctctcac

SEQ ID NO: 4395730 - DNA, 18 bp, Homo sapiens
ggctgccctctggggcca

SEQ ID NO: 4395731 - DNA, 18 bp, Homo sapiens
ggctgccgagccaccatg

SEQ ID NO: 4395732 - DNA, 13 bp, Homo sapiens
ggctgcctcccaa

SEQ ID NO: 4395733 - DNA, 16 bp, Homo sapiens
ggctgccttctggcct

SEQ ID NO: 4395734 - DNA, 18 bp, Homo sapiens
ggctgccttctttccatc

SEQ ID NO: 4395735 - DNA, 15 bp, Homo sapiens
ggctgcgctaacccc

SEQ ID NO: 4395736 - DNA, 11 bp, Homo sapiens
ggctgctccca

SEQ ID NO: 4395737 - DNA, 13 bp, Homo sapiens
ggctgctcccacc

SEQ ID NO: 4395738 - DNA, 18 bp, Homo sapiens
ggctgctcccacctggct

SEQ ID NO: 4395739 - DNA, 19 bp, Homo sapiens
ggctgctcccacctggctc

SEQ ID NO: 4395740 - DNA, 15 bp, Homo sapiens
ggctgctcctccagg

SEQ ID NO: 4395741 - DNA, 18 bp, Homo sapiens
ggctgctcctccagggcc

SEQ ID NO: 4395742 - DNA, 23 bp, Homo sapiens
ggctgctcctccagggccacgtg

SEQ ID NO: 4395743 - DNA, 13 bp, Homo sapiens
ggctgctgccccc

SEQ ID NO: 4395744 - DNA, 18 bp, Homo sapiens
ggctggaagatagctgtg

SEQ ID NO: 4395745 - DNA, 15 bp, Homo sapiens
ggctggaaggcagca

SEQ ID NO: 4395746 - DNA, 16 bp, Homo sapiens
ggctggaatctggaga

SEQ ID NO: 4395747 - DNA, 18 bp, Homo sapiens
ggctggaatctggagagc

SEQ ID NO: 4395748 - DNA, 16 bp, Homo sapiens
ggctggactgaggcct

SEQ ID NO: 4395749 - DNA, 20 bp, Homo sapiens
ggctggacttctacctgccc

SEQ ID NO: 4395750 - DNA, 14 bp, Homo sapiens
ggctggagctcctc

SEQ ID NO: 4395751 - DNA, 17 bp, Homo sapiens
ggctggagctcctccct

SEQ ID NO: 4395752 - DNA, 20 bp, Homo sapiens
ggctggagctcctccctcca

SEQ ID NO: 4395753 - DNA, 17 bp, Homo sapiens
ggctggaggcagggcct

SEQ ID NO: 4395754 - DNA, 19 bp, Homo sapiens
ggctggaggcagggccttg

SEQ ID NO: 4395755 - DNA, 23 bp, Homo sapiens
ggctggaggcagggccttgccca

SEQ ID NO: 4395756 - DNA, 20 bp, Homo sapiens
ggctggagtgcagtggcgca

SEQ ID NO: 4395757 - DNA, 20 bp, Homo sapiens
ggctggagtgcagtggtgcc

SEQ ID NO: 4395758 - DNA, 21 bp, Homo sapiens
gcctgtactaaggagcatgat

SEQ ID NO: 4395759 - DNA, 22 bp, Homo sapiens
gcctgtagcaatggccagagcc

SEQ ID NO: 4395760 - DNA, 21 bp, Homo sapiens
gcctgtatcctccctggcaga

SEQ ID NO: 4395761 - DNA, 13 bp, Homo sapiens
gcctgtcacaata

SEQ ID NO: 4395762 - DNA, 20 bp, Homo sapiens
gcctgtcccaattctgcccg

SEQ ID NO: 4395763 - DNA, 22 bp, Homo sapiens
gcctgtcccaattctgcccgct

SEQ ID NO: 4395764 - DNA, 13 bp, Homo sapiens
gcctgtccctggg

SEQ ID NO: 4395765 - DNA, 14 bp, Homo sapiens
gcctgtccctggga

SEQ ID NO: 4395766 - DNA, 16 bp, Homo sapiens
gcctgtccctgggagt

SEQ ID NO: 4395767 - DNA, 16 bp, Homo sapiens
gcctgtcccttgcctc

SEQ ID NO: 4395768 - DNA, 18 bp, Homo sapiens
gcctgtcccttgcctctg

SEQ ID NO: 4395769 - DNA, 19 bp, Homo sapiens
gcctgtcccttgcctctgc

SEQ ID NO: 4395770 - DNA, 22 bp, Homo sapiens
gcctgtctcatccccaggggtc

SEQ ID NO: 4395771 - DNA, 14 bp, Homo sapiens
gcctgtgaggcagg

SEQ ID NO: 4395772 - DNA, 18 bp, Homo sapiens
gcctgtgaggcaggggcg

SEQ ID NO: 4395773 - DNA, 15 bp, Homo sapiens
gcctgtggaggggct

SEQ ID NO: 4395774 - DNA, 18 bp, Homo sapiens
gcctgtggcagtaaagag

SEQ ID NO: 4395775 - DNA, 16 bp, Homo sapiens
gcctgtggcccctccc

SEQ ID NO: 4395776 - DNA, 22 bp, Homo sapiens
gcctgtggcccctcccctgcag

SEQ ID NO: 4395777 - DNA, 20 bp, Homo sapiens
gcctgtggggactgaacctg

SEQ ID NO: 4395778 - DNA, 23 bp, Homo sapiens
gcctgtggggactgaacctggaa

SEQ ID NO: 4395779 - DNA, 13 bp, Homo sapiens
gcctgtgggtctc

SEQ ID NO: 4395780 - DNA, 21 bp, Homo sapiens
gcctgtggtgaagtgtggctg

SEQ ID NO: 4395781 - DNA, 23 bp, Homo sapiens
gcctgtggtgaagtgtggctggt

SEQ ID NO: 4395782 - DNA, 23 bp, Homo sapiens
gcctgttaatttataatgtattt

SEQ ID NO: 4395783 - DNA, 19 bp, Homo sapiens
gcctgttataactctgcac

SEQ ID NO: 4395784 - DNA, 18 bp, Homo sapiens
gcctgttggcaggcccac

SEQ ID NO: 4395785 - DNA, 19 bp, Homo sapiens
gcctgttggcaggcccact

SEQ ID NO: 4395786 - DNA, 17 bp, Homo sapiens
gccttaaaaccaaagag

SEQ ID NO: 4395787 - DNA, 15 bp, Homo sapiens
gccttaaacacacat

SEQ ID NO: 4395788 - DNA, 15 bp, Homo sapiens
gccttaagaactgtg

SEQ ID NO: 4395789 - DNA, 21 bp, Homo sapiens
gccttaatttcctttttgaca

SEQ ID NO: 4395790 - DNA, 21 bp, Homo sapiens
gccttacctcctgcccaggag

SEQ ID NO: 4395791 - DNA, 16 bp, Homo sapiens
gccttactcacctctc

SEQ ID NO: 4395792 - DNA, 15 bp, Homo sapiens
gccttagagccaggc

SEQ ID NO: 4395793 - DNA, 23 bp, Homo sapiens
gccttagagccaggcacacactg

SEQ ID NO: 4395794 - DNA, 17 bp, Homo sapiens
gccttagcagccctgga

SEQ ID NO: 4395795 - DNA, 16 bp, Homo sapiens
gccttagcttcaggaa

SEQ ID NO: 4395796 - DNA, 18 bp, Homo sapiens
gccttagcttcaggaacc

SEQ ID NO: 4395797 - DNA, 19 bp, Homo sapiens
gccttagcttcaggaacct

SEQ ID NO: 4395798 - DNA, 23 bp, Homo sapiens
gccttatgtgttacattattcca

SEQ ID NO: 4395799 - DNA, 14 bp, Homo sapiens
gccttattacccag

SEQ ID NO: 4395800 - DNA, 19 bp, Homo sapiens
gccttattagagtgtcttt

SEQ ID NO: 4395801 - DNA, 14 bp, Homo sapiens
gccttattttgagt

SEQ ID NO: 4395802 - DNA, 20 bp, Homo sapiens
gccttccagatcctctctgg

SEQ ID NO: 4395803 - DNA, 19 bp, Homo sapiens
gccttccatgtcggcctct

SEQ ID NO: 4395804 - DNA, 20 bp, Homo sapiens
gccttcccaagttgtgcttg

SEQ ID NO: 4395805 - DNA, 12 bp, Homo sapiens
gccttcccctcc

SEQ ID NO: 4395806 - DNA, 13 bp, Homo sapiens
gccttcccctccc

SEQ ID NO: 4395807 - DNA, 20 bp, Homo sapiens
gccttcctcagctgcctcct

SEQ ID NO: 4395808 - DNA, 16 bp, Homo sapiens
gcctgacgctcagccc

SEQ ID NO: 4395809 - DNA, 20 bp, Homo sapiens
gcctgacgctcagccccagg

SEQ ID NO: 4395810 - DNA, 21 bp, Homo sapiens
gcctgactaatttttgtattt

SEQ ID NO: 4395811 - DNA, 16 bp, Homo sapiens
gcctgacttctgctgg

SEQ ID NO: 4395812 - DNA, 18 bp, Homo sapiens
gcctgagaagaagtggct

SEQ ID NO: 4395813 - DNA, 19 bp, Homo sapiens
gcctgagaccagggtggcc

SEQ ID NO: 4395814 - DNA, 21 bp, Homo sapiens
gcctgagaccagggtggccac

SEQ ID NO: 4395815 - DNA, 14 bp, Homo sapiens
gcctgagaggcagg

SEQ ID NO: 4395816 - DNA, 22 bp, Homo sapiens
gcctgagaggcaggcatagagg

SEQ ID NO: 4395817 - DNA, 23 bp, Homo sapiens
gcctgagatacaaggcccagaag

SEQ ID NO: 4395818 - DNA, 16 bp, Homo sapiens
gcctgagatttcatct

SEQ ID NO: 4395819 - DNA, 12 bp, Homo sapiens
gcctgagcccct

SEQ ID NO: 4395820 - DNA, 17 bp, Homo sapiens
gcctgagcgacagtgag

SEQ ID NO: 4395821 - DNA, 23 bp, Homo sapiens
gcctgagcgctcctgccgcagag

SEQ ID NO: 4395822 - DNA, 13 bp, Homo sapiens
gcctgaggctgta

SEQ ID NO: 4395823 - DNA, 13 bp, Homo sapiens
gcctgagggcagt

SEQ ID NO: 4395824 - DNA, 20 bp, Homo sapiens
gcctgaggtgggagaatcac

SEQ ID NO: 4395825 - DNA, 17 bp, Homo sapiens
gcctgagtgacagagcg

SEQ ID NO: 4395826 - DNA, 18 bp, Homo sapiens
gcctgagtgacagagcga

SEQ ID NO: 4395827 - DNA, 20 bp, Homo sapiens
gcctgagtgacagagcgaga

SEQ ID NO: 4395828 - DNA, 14 bp, Homo sapiens
gcctgatactttag

SEQ ID NO: 4395829 - DNA, 20 bp, Homo sapiens
gcctgatgagatttttaaaa

SEQ ID NO: 4395830 - DNA, 12 bp, Homo sapiens
gcctgcacctgc

SEQ ID NO: 4395831 - DNA, 13 bp, Homo sapiens
gcctgcacctgcc

SEQ ID NO: 4395832 - DNA, 15 bp, Homo sapiens
gcctgcacctgcccc

SEQ ID NO: 4395833 - DNA, 16 bp, Homo sapiens
gcctgcacctgccccg

SEQ ID NO: 4395834 - DNA, 17 bp, Homo sapiens
gcctgcacctgccccgt

SEQ ID NO: 4395835 - DNA, 22 bp, Homo sapiens
gcctgcacggtgggccttgctg

SEQ ID NO: 4395836 - DNA, 21 bp, Homo sapiens
gcctgcagaagtaagcctcat

SEQ ID NO: 4395837 - DNA, 14 bp, Homo sapiens
gcctgcagcaggca

SEQ ID NO: 4395838 - DNA, 17 bp, Homo sapiens
gcctgcagcaggcagct

SEQ ID NO: 4395839 - DNA, 16 bp, Homo sapiens
gcctgcagccagggct

SEQ ID NO: 4395840 - DNA, 18 bp, Homo sapiens
gcctgcagccagggctgg

SEQ ID NO: 4395841 - DNA, 20 bp, Homo sapiens
gcctgcaggagagagcagca

SEQ ID NO: 4395842 - DNA, 21 bp, Homo sapiens
gcctgcaggcagagctggagc

SEQ ID NO: 4395843 - DNA, 18 bp, Homo sapiens
gcctgcaggtcagttgta

SEQ ID NO: 4395844 - DNA, 17 bp, Homo sapiens
gcctgcagtttcttgtg

SEQ ID NO: 4395845 - DNA, 21 bp, Homo sapiens
gcctgcattgagcttgcatgc

SEQ ID NO: 4395846 - DNA, 16 bp, Homo sapiens
gcctgccaccggaggt

SEQ ID NO: 4395847 - DNA, 18 bp, Homo sapiens
gcctgccagtcctagctg

SEQ ID NO: 4395848 - DNA, 13 bp, Homo sapiens
gcctgccagtctg

SEQ ID NO: 4395849 - DNA, 21 bp, Homo sapiens
gcctgccccgcccccagtccc

SEQ ID NO: 4395850 - DNA, 18 bp, Homo sapiens
gcctgcccgtctctctcc

SEQ ID NO: 4395851 - DNA, 11 bp, Homo sapiens
gcctgccctgc

SEQ ID NO: 4395852 - DNA, 17 bp, Homo sapiens
gcctgccctgcctcagc

SEQ ID NO: 4395853 - DNA, 12 bp, Homo sapiens
gcctgccgtgca

SEQ ID NO: 4395854 - DNA, 11 bp, Homo sapiens
gcctgcctcca

SEQ ID NO: 4395855 - DNA, 16 bp, Homo sapiens
gcctgcctccagggct

SEQ ID NO: 4395856 - DNA, 17 bp, Homo sapiens
gcctgcctccagggctg

SEQ ID NO: 4395857 - DNA, 13 bp, Homo sapiens
gcctgcctcccac

SEQ ID NO: 4395858 - DNA, 16 bp, Homo sapiens
gcctgcctgcagcagg

SEQ ID NO: 4395859 - DNA, 17 bp, Homo sapiens
gcctgcctgcagcaggc

SEQ ID NO: 4395860 - DNA, 18 bp, Homo sapiens
gcctgcctgcagcaggca

SEQ ID NO: 4395861 - DNA, 20 bp, Homo sapiens
gcctgcctgcagcaggcagc

SEQ ID NO: 4395862 - DNA, 21 bp, Homo sapiens
gcctgcctgcagcaggcagct

SEQ ID NO: 4395863 - DNA, 13 bp, Homo sapiens
gcctgcctgcatg

SEQ ID NO: 4395864 - DNA, 22 bp, Homo sapiens
gcctcagcgtcctgggctcaaa

SEQ ID NO: 4395865 - DNA, 13 bp, Homo sapiens
gcctcaggctccg

SEQ ID NO: 4395866 - DNA, 17 bp, Homo sapiens
gcctcaggctccgggca

SEQ ID NO: 4395867 - DNA, 16 bp, Homo sapiens
gcctcatactcctggg

SEQ ID NO: 4395868 - DNA, 17 bp, Homo sapiens
gcctcatccagcctcag

SEQ ID NO: 4395869 - DNA, 21 bp, Homo sapiens
gcctcatctcagaccctgctt

SEQ ID NO: 4395870 - DNA, 21 bp, Homo sapiens
gcctccaagatttaacctgca

SEQ ID NO: 4395871 - DNA, 16 bp, Homo sapiens
gcctccaagcacagag

SEQ ID NO: 4395872 - DNA, 20 bp, Homo sapiens
gcctccaagcacagagcctg

SEQ ID NO: 4395873 - DNA, 23 bp, Homo sapiens
gcctccaagcacagagcctggcc

SEQ ID NO: 4395874 - DNA, 13 bp, Homo sapiens
gcctccaagcctg

SEQ ID NO: 4395875 - DNA, 16 bp, Homo sapiens
gcctccaagcctgcct

SEQ ID NO: 4395876 - DNA, 17 bp, Homo sapiens
gcctccaagcctgcctc

SEQ ID NO: 4395877 - DNA, 22 bp, Homo sapiens
gcctccaaggaggggctgtaaa

SEQ ID NO: 4395878 - DNA, 12 bp, Homo sapiens
gcctccaccctc

SEQ ID NO: 4395879 - DNA, 19 bp, Homo sapiens
gcctccaccctctgagctt

SEQ ID NO: 4395880 - DNA, 14 bp, Homo sapiens
gcctccagcctctg

SEQ ID NO: 4395881 - DNA, 14 bp, Homo sapiens
gcctccagggctgg

SEQ ID NO: 4395882 - DNA, 18 bp, Homo sapiens
gcctccagggctggactg

SEQ ID NO: 4395883 - DNA, 22 bp, Homo sapiens
gcctccagggctggactgaggc

SEQ ID NO: 4395884 - DNA, 18 bp, Homo sapiens
gcctccagtcatggtact

SEQ ID NO: 4395885 - DNA, 13 bp, Homo sapiens
gcctcccaaagtg

SEQ ID NO: 4395886 - DNA, 23 bp, Homo sapiens
gcctcccaacagtggggaagagt

SEQ ID NO: 4395887 - DNA, 20 bp, Homo sapiens
gcctcccaaggagaacaaat

SEQ ID NO: 4395888 - DNA, 19 bp, Homo sapiens
gcctcccaaggtcctctca

SEQ ID NO: 4395889 - DNA, 21 bp, Homo sapiens
gcctcccaaggtcctctcagt

SEQ ID NO: 4395890 - DNA, 13 bp, Homo sapiens
gcctcccacggca

SEQ ID NO: 4395891 - DNA, 14 bp, Homo sapiens
gcctcccacggcac

SEQ ID NO: 4395892 - DNA, 16 bp, Homo sapiens
gcctcccatagctggg

SEQ ID NO: 4395893 - DNA, 14 bp, Homo sapiens
gcctcccattctgc

SEQ ID NO: 4395894 - DNA, 20 bp, Homo sapiens
gcctcccattctgcaccaca

SEQ ID NO: 4395895 - DNA, 13 bp, Homo sapiens
gcctccccatctg

SEQ ID NO: 4395896 - DNA, 17 bp, Homo sapiens
gcctccccatctgtcca

SEQ ID NO: 4395897 - DNA, 19 bp, Homo sapiens
gcctccccatctgtccagc

SEQ ID NO: 4395898 - DNA, 18 bp, Homo sapiens
gcctccccatttcccatc

SEQ ID NO: 4395899 - DNA, 19 bp, Homo sapiens
gcctccccatttcccatct

SEQ ID NO: 4395900 - DNA, 21 bp, Homo sapiens
gcctccccatttcccatctgc

SEQ ID NO: 4395901 - DNA, 23 bp, Homo sapiens
gcctccccatttcccatctgcac

SEQ ID NO: 4395902 - DNA, 20 bp, Homo sapiens
gcctccccccagaccccgcc

SEQ ID NO: 4395903 - DNA, 14 bp, Homo sapiens
gcctcccccgcctc

SEQ ID NO: 4395904 - DNA, 21 bp, Homo sapiens
gcctccccctcccccattccc

SEQ ID NO: 4395905 - DNA, 16 bp, Homo sapiens
gcctcccctcccctgg

SEQ ID NO: 4395906 - DNA, 19 bp, Homo sapiens
gcctcccctcccctgggga

SEQ ID NO: 4395907 - DNA, 22 bp, Homo sapiens
gcctcccctcccctggggacgc

SEQ ID NO: 4395908 - DNA, 14 bp, Homo sapiens
gcctcccctgccag

SEQ ID NO: 4395909 - DNA, 16 bp, Homo sapiens
gcctccctccacccca

SEQ ID NO: 4395910 - DNA, 23 bp, Homo sapiens
gcctccctctccatatctccttc

SEQ ID NO: 4395911 - DNA, 22 bp, Homo sapiens
gcctccctctctcttctgctcc

SEQ ID NO: 4395912 - DNA, 11 bp, Homo sapiens
gcctccctgaa

SEQ ID NO: 4395913 - DNA, 11 bp, Homo sapiens
gcctccctgct

SEQ ID NO: 4395914 - DNA, 19 bp, Homo sapiens
gcctccgcctgggtcatgg

SEQ ID NO: 4395915 - DNA, 20 bp, Homo sapiens
gcctccggcgtcagcctcca

SEQ ID NO: 4395916 - DNA, 15 bp, Homo sapiens
gcctcctcctgggct

SEQ ID NO: 4395917 - DNA, 23 bp, Homo sapiens
gcctcctcggagagcagcagcac

SEQ ID NO: 4395918 - DNA, 15 bp, Homo sapiens
gcctcctgccccctg

SEQ ID NO: 4395919 - DNA, 12 bp, Homo sapiens
gcctcctgcgcc

SEQ ID NO: 4395920 - DNA, 20 bp, Homo sapiens
gcctcctggccaagcaggct

SEQ ID NO: 4395921 - DNA, 22 bp, Homo sapiens
gcctcctggccaagcaggctgg

SEQ ID NO: 4395922 - DNA, 19 bp, Homo sapiens
gcctcctggccagacgctg

SEQ ID NO: 4395923 - DNA, 18 bp, Homo sapiens
gcctcctgtgcctggccc

SEQ ID NO: 4395924 - DNA, 20 bp, Homo sapiens
gcctcctgtgcctggcccca

SEQ ID NO: 4395925 - DNA, 21 bp, Homo sapiens
gcctcctgtgcctggccccag

SEQ ID NO: 4395926 - DNA, 15 bp, Homo sapiens
gcctccttgtgagag

SEQ ID NO: 4395927 - DNA, 16 bp, Homo sapiens
gcctcgaaacacagaa

SEQ ID NO: 4395928 - DNA, 20 bp, Homo sapiens
gcctcgcctccccaccctcc

SEQ ID NO: 4395929 - DNA, 15 bp, Homo sapiens
gcctctaaccccagg

SEQ ID NO: 4395930 - DNA, 16 bp, Homo sapiens
gcctctaaccccaggc

SEQ ID NO: 4395931 - DNA, 23 bp, Homo sapiens
gcctctacctgacactcccttgg

SEQ ID NO: 4395932 - DNA, 22 bp, Homo sapiens
gcctctagtgtaccaagtgctt

SEQ ID NO: 4395933 - DNA, 21 bp, Homo sapiens
gcctctatcctacaaggccta

SEQ ID NO: 4395934 - DNA, 19 bp, Homo sapiens
gcctctcattccagaggaa

SEQ ID NO: 4395935 - DNA, 20 bp, Homo sapiens
gcctctcattccagaggaag

SEQ ID NO: 4395936 - DNA, 21 bp, Homo sapiens
gcctctccactcatgtgactc

SEQ ID NO: 4395937 - DNA, 18 bp, Homo sapiens
gcctctccccgctctgga

SEQ ID NO: 4395938 - DNA, 19 bp, Homo sapiens
gcctctccccgctctggat

SEQ ID NO: 4395939 - DNA, 21 bp, Homo sapiens
gcctctccctaggagaagagt

SEQ ID NO: 4395940 - DNA, 14 bp, Homo sapiens
gcctctccctgcct

SEQ ID NO: 4395941 - DNA, 17 bp, Homo sapiens
gcctctccctgctgctc

SEQ ID NO: 4395942 - DNA, 21 bp, Homo sapiens
gcctctccctgctgctcctag

SEQ ID NO: 4395943 - DNA, 23 bp, Homo sapiens
gcctctccgactctgcacccgcc

SEQ ID NO: 4395944 - DNA, 14 bp, Homo sapiens
gcctctctctgctc

SEQ ID NO: 4395945 - DNA, 15 bp, Homo sapiens
gcctctctctgctcc

SEQ ID NO: 4395946 - DNA, 17 bp, Homo sapiens
gcctctctggaaagagg

SEQ ID NO: 4395947 - DNA, 23 bp, Homo sapiens
gcctctgccgctgccatgctttg

SEQ ID NO: 4395948 - DNA, 12 bp, Homo sapiens
gcctctgctccc

SEQ ID NO: 4395949 - DNA, 13 bp, Homo sapiens
gcctctgctccct

SEQ ID NO: 4395950 - DNA, 15 bp, Homo sapiens
gcctctgctggctca

SEQ ID NO: 4395951 - DNA, 16 bp, Homo sapiens
gcctctggacagccag

SEQ ID NO: 4395952 - DNA, 17 bp, Homo sapiens
gcctctggacagccagt

SEQ ID NO: 4395953 - DNA, 18 bp, Homo sapiens
gcctctggacagccagtg

SEQ ID NO: 4395954 - DNA, 19 bp, Homo sapiens
gcctctggacagccagtga

SEQ ID NO: 4395955 - DNA, 20 bp, Homo sapiens
gcctctggacagccagtgac

SEQ ID NO: 4395956 - DNA, 12 bp, Homo sapiens
gcctctggcccc

SEQ ID NO: 4395957 - DNA, 14 bp, Homo sapiens
gcctctggcccctc

SEQ ID NO: 4395958 - DNA, 19 bp, Homo sapiens
gcctctggctagaggccag

SEQ ID NO: 4395959 - DNA, 21 bp, Homo sapiens
gcctctggctagaggccagcc

SEQ ID NO: 4395960 - DNA, 22 bp, Homo sapiens
gcctctggctagaggccagccc

SEQ ID NO: 4395961 - DNA, 12 bp, Homo sapiens
gcctctggttgc

SEQ ID NO: 4395962 - DNA, 14 bp, Homo sapiens
gcctctggttgcct

SEQ ID NO: 4395963 - DNA, 19 bp, Homo sapiens
gcctctggttgcctccccc

SEQ ID NO: 4395964 - DNA, 18 bp, Homo sapiens
gcctctgtccccttctct

SEQ ID NO: 4395965 - DNA, 15 bp, Homo sapiens
gcctcttacttgcca

SEQ ID NO: 4395966 - DNA, 20 bp, Homo sapiens
gcctcttaggactggtgcct

SEQ ID NO: 4395967 - DNA, 14 bp, Homo sapiens
gcctcttcaggcct

SEQ ID NO: 4395968 - DNA, 15 bp, Homo sapiens
gcctcttctacttgt

SEQ ID NO: 4395969 - DNA, 20 bp, Homo sapiens
gcctcttctcttgacagtct

SEQ ID NO: 4395970 - DNA, 15 bp, Homo sapiens
gcctcttctgggagg

SEQ ID NO: 4395971 - DNA, 15 bp, Homo sapiens
gcctcttctttgtgc

SEQ ID NO: 4395972 - DNA, 20 bp, Homo sapiens
gcctcttctttgtgcctttg

SEQ ID NO: 4395973 - DNA, 20 bp, Homo sapiens
gcctcttctttttcttcttg

SEQ ID NO: 4395974 - DNA, 20 bp, Homo sapiens
gcctgaaacccgccctcagg

SEQ ID NO: 4395975 - DNA, 19 bp, Homo sapiens
gcctgaaatgacatttcac

SEQ ID NO: 4395976 - DNA, 22 bp, Homo sapiens
gcctgaacagccctctctctca

SEQ ID NO: 4395977 - DNA, 13 bp, Homo sapiens
gcctgaactccag

SEQ ID NO: 4395978 - DNA, 16 bp, Homo sapiens
gcctgaactgagcccc

SEQ ID NO: 4395979 - DNA, 19 bp, Homo sapiens
gcctgaactgagccccagc

SEQ ID NO: 4395980 - DNA, 21 bp, Homo sapiens
gcctgaagaagcacttctgct

SEQ ID NO: 4395981 - DNA, 22 bp, Homo sapiens
gcctgaagaagcacttctgctg

SEQ ID NO: 4395982 - DNA, 15 bp, Homo sapiens
gcctgaaggcacagc

SEQ ID NO: 4395983 - DNA, 15 bp, Homo sapiens
gcctgacagctctgt

SEQ ID NO: 4395984 - DNA, 12 bp, Homo sapiens
gccctggcctgc

SEQ ID NO: 4395985 - DNA, 15 bp, Homo sapiens
gccctggcctgctgg

SEQ ID NO: 4395986 - DNA, 17 bp, Homo sapiens
gccctggcctgctgggc

SEQ ID NO: 4395987 - DNA, 19 bp, Homo sapiens
gccctggctccagtgaaac

SEQ ID NO: 4395988 - DNA, 10 bp, Homo sapiens
gccctggctg

SEQ ID NO: 4395989 - DNA, 15 bp, Homo sapiens
gccctggctgctgcc

SEQ ID NO: 4395990 - DNA, 17 bp, Homo sapiens
gccctggctgctgcccc

SEQ ID NO: 4395991 - DNA, 15 bp, Homo sapiens
gccctgggccccacc

SEQ ID NO: 4395992 - DNA, 15 bp, Homo sapiens
gccctgggcctcagt

SEQ ID NO: 4395993 - DNA, 23 bp, Homo sapiens
gccctgggcctcagttcaacctg

SEQ ID NO: 4395994 - DNA, 15 bp, Homo sapiens
gccctgggctcggag

SEQ ID NO: 4395995 - DNA, 11 bp, Homo sapiens
gccctgggctg

SEQ ID NO: 4395996 - DNA, 14 bp, Homo sapiens
gccctgggctggca

SEQ ID NO: 4395997 - DNA, 16 bp, Homo sapiens
gccctgggctggcaca

SEQ ID NO: 4395998 - DNA, 22 bp, Homo sapiens
gccctgggctggcacagcccct

SEQ ID NO: 4395999 - DNA, 15 bp, Homo sapiens
gccctgggctgggtg

SEQ ID NO: 4396000 - DNA, 21 bp, Homo sapiens
gccctgggctgtctgtcacca

SEQ ID NO: 4396001 - DNA, 23 bp, Homo sapiens
gccctgggctgtctgtcaccagc

SEQ ID NO: 4396002 - DNA, 22 bp, Homo sapiens
gccctggggatcttcccacagg

SEQ ID NO: 4396003 - DNA, 21 bp, Homo sapiens
gccctgggtctaaggggttgg

SEQ ID NO: 4396004 - DNA, 13 bp, Homo sapiens
gccctggtccagg

SEQ ID NO: 4396005 - DNA, 18 bp, Homo sapiens
gccctggtccagggaagc

SEQ ID NO: 4396006 - DNA, 20 bp, Homo sapiens
gccctggtccagggaagctg

SEQ ID NO: 4396007 - DNA, 16 bp, Homo sapiens
gccctggtctcagcag

SEQ ID NO: 4396008 - DNA, 14 bp, Homo sapiens
gccctggttcccag

SEQ ID NO: 4396009 - DNA, 15 bp, Homo sapiens
gccctgtccaaaagc

SEQ ID NO: 4396010 - DNA, 20 bp, Homo sapiens
gccctgtccaaaagcgccct

SEQ ID NO: 4396011 - DNA, 22 bp, Homo sapiens
gccctgtccaaaagcgccctca

SEQ ID NO: 4396012 - DNA, 13 bp, Homo sapiens
gccctgtcccagg

SEQ ID NO: 4396013 - DNA, 23 bp, Homo sapiens
gccctgtcccaggccggcccaga

SEQ ID NO: 4396014 - DNA, 15 bp, Homo sapiens
gccctgtcgcccctc

SEQ ID NO: 4396015 - DNA, 20 bp, Homo sapiens
gccctgtgggagccgcagag

SEQ ID NO: 4396016 - DNA, 21 bp, Homo sapiens
gccctgtgggagccgcagagc

SEQ ID NO: 4396017 - DNA, 22 bp, Homo sapiens
gccctgtgggagccgcagagcc

SEQ ID NO: 4396018 - DNA, 24 bp, Homo sapiens
gccctgtgggagccgcagagcctg

SEQ ID NO: 4396019 - DNA, 21 bp, Homo sapiens
gcccttcaccccagtggccac

SEQ ID NO: 4396020 - DNA, 15 bp, Homo sapiens
gcccttcccagggca

SEQ ID NO: 4396021 - DNA, 16 bp, Homo sapiens
gcccttccctctgggc

SEQ ID NO: 4396022 - DNA, 11 bp, Homo sapiens
gcccttccctg

SEQ ID NO: 4396023 - DNA, 13 bp, Homo sapiens
gcccttccctgag

SEQ ID NO: 4396024 - DNA, 20 bp, Homo sapiens
gcccttctatacccacccag

SEQ ID NO: 4396025 - DNA, 15 bp, Homo sapiens
gcccttgcagggtgg

SEQ ID NO: 4396026 - DNA, 13 bp, Homo sapiens
gcccttgcctccc

SEQ ID NO: 4396027 - DNA, 14 bp, Homo sapiens
gcccttgctgcccg

SEQ ID NO: 4396028 - DNA, 19 bp, Homo sapiens
gcccttgggtccccccgag

SEQ ID NO: 4396029 - DNA, 18 bp, Homo sapiens
gccctttgagtgcagtcc

SEQ ID NO: 4396030 - DNA, 19 bp, Homo sapiens
gccgaatttggtacacatg

SEQ ID NO: 4396031 - DNA, 20 bp, Homo sapiens
gccgaatttggtacacatgt

SEQ ID NO: 4396032 - DNA, 22 bp, Homo sapiens
gccgaatttggtacacatgtgt

SEQ ID NO: 4396033 - DNA, 13 bp, Homo sapiens
gccgaccttccct

SEQ ID NO: 4396034 - DNA, 16 bp, Homo sapiens
gccgagagcctgctcc

SEQ ID NO: 4396035 - DNA, 20 bp, Homo sapiens
gccgagctcctggggagctc

SEQ ID NO: 4396036 - DNA, 21 bp, Homo sapiens
gcccctcccaagcgttcctgg

SEQ ID NO: 4396037 - DNA, 12 bp, Homo sapiens
gcccctccccag

SEQ ID NO: 4396038 - DNA, 22 bp, Homo sapiens
gcccctccccagactctcaggt

SEQ ID NO: 4396039 - DNA, 14 bp, Homo sapiens
gcccctccccagcc

SEQ ID NO: 4396040 - DNA, 15 bp, Homo sapiens
gcccctccccagcca

SEQ ID NO: 4396041 - DNA, 22 bp, Homo sapiens
gcccctccccagccagcccttc

SEQ ID NO: 4396042 - DNA, 21 bp, Homo sapiens
gcccctcccccaacccccacc

SEQ ID NO: 4396043 - DNA, 13 bp, Homo sapiens
gcccctcccccac

SEQ ID NO: 4396044 - DNA, 14 bp, Homo sapiens
gcccctcccccact

SEQ ID NO: 4396045 - DNA, 16 bp, Homo sapiens
gcccctccccctgcca

SEQ ID NO: 4396046 - DNA, 14 bp, Homo sapiens
gcccctcccctgca

SEQ ID NO: 4396047 - DNA, 21 bp, Homo sapiens
gcccctccctacctcaacctg

SEQ ID NO: 4396048 - DNA, 20 bp, Homo sapiens
gcccctcctaccccggctgc

SEQ ID NO: 4396049 - DNA, 18 bp, Homo sapiens
gcccctcctccctcaaac

SEQ ID NO: 4396050 - DNA, 16 bp, Homo sapiens
gcccctcctccctcag

SEQ ID NO: 4396051 - DNA, 18 bp, Homo sapiens
gcccctcctccctcagac

SEQ ID NO: 4396052 - DNA, 19 bp, Homo sapiens
gcccctcctccctcagacc

SEQ ID NO: 4396053 - DNA, 23 bp, Homo sapiens
gcccctcctccctcagacccagc

SEQ ID NO: 4396054 - DNA, 18 bp, Homo sapiens
gcccctcctccctcaggc

SEQ ID NO: 4396055 - DNA, 23 bp, Homo sapiens
gcccctcctctgccacctcccct

SEQ ID NO: 4396056 - DNA, 21 bp, Homo sapiens
gcccctctctagggacccctc

SEQ ID NO: 4396057 - DNA, 13 bp, Homo sapiens
gcccctctgcctt

SEQ ID NO: 4396058 - DNA, 23 bp, Homo sapiens
gcccctgatgacgggatgctctt

SEQ ID NO: 4396059 - DNA, 14 bp, Homo sapiens
gcccctgcacagca

SEQ ID NO: 4396060 - DNA, 19 bp, Homo sapiens
gcccctgcactccagcctg

SEQ ID NO: 4396061 - DNA, 11 bp, Homo sapiens
gcccctggagg

SEQ ID NO: 4396062 - DNA, 20 bp, Homo sapiens
gcccctggaggctgcctccc

SEQ ID NO: 4396063 - DNA, 21 bp, Homo sapiens
gcccctggaggctgcctccca

SEQ ID NO: 4396064 - DNA, 15 bp, Homo sapiens
gcccctggctttgcc

SEQ ID NO: 4396065 - DNA, 20 bp, Homo sapiens
gcccctgggatgggaccagg

SEQ ID NO: 4396066 - DNA, 22 bp, Homo sapiens
gcccctgggcttggcctgctgt

SEQ ID NO: 4396067 - DNA, 19 bp, Homo sapiens
gcccctggggaaatagcct

SEQ ID NO: 4396068 - DNA, 15 bp, Homo sapiens
gcccctggggcccag

SEQ ID NO: 4396069 - DNA, 21 bp, Homo sapiens
gcccctgggtcagtctggtgg

SEQ ID NO: 4396070 - DNA, 19 bp, Homo sapiens
gcccctggtaagcagaggc

SEQ ID NO: 4396071 - DNA, 21 bp, Homo sapiens
gcccctgtctgttcccagccc

SEQ ID NO: 4396072 - DNA, 23 bp, Homo sapiens
gcccctgtctgttcccagcccct

SEQ ID NO: 4396073 - DNA, 19 bp, Homo sapiens
gccccttaaacacaggctg

SEQ ID NO: 4396074 - DNA, 16 bp, Homo sapiens
gccccttccccatggg

SEQ ID NO: 4396075 - DNA, 18 bp, Homo sapiens
gcccgaaactaagccagg

SEQ ID NO: 4396076 - DNA, 14 bp, Homo sapiens
gcccgagcgcctgc

SEQ ID NO: 4396077 - DNA, 17 bp, Homo sapiens
gcccgatattctccctg

SEQ ID NO: 4396078 - DNA, 21 bp, Homo sapiens
gcccgatattctccctgacct

SEQ ID NO: 4396079 - DNA, 13 bp, Homo sapiens
gcccgcacacctg

SEQ ID NO: 4396080 - DNA, 23 bp, Homo sapiens
gcccgcaggaactgggctgggcc

SEQ ID NO: 4396081 - DNA, 14 bp, Homo sapiens
gcccgcatgtgtgc

SEQ ID NO: 4396082 - DNA, 21 bp, Homo sapiens
gcccgcatgtgtgcctggccg

SEQ ID NO: 4396083 - DNA, 19 bp, Homo sapiens
gcccacccagtccatgctc

SEQ ID NO: 4396084 - DNA, 19 bp, Homo sapiens
gcccacccccctccccaac

SEQ ID NO: 4396085 - DNA, 20 bp, Homo sapiens
gcccacccccctccccaact

SEQ ID NO: 4396086 - DNA, 17 bp, Homo sapiens
gcccaccccctgccctg

SEQ ID NO: 4396087 - DNA, 20 bp, Homo sapiens
gcccaccccctgccctgcac

SEQ ID NO: 4396088 - DNA, 22 bp, Homo sapiens
gcccaccccctgccctgcacgt

SEQ ID NO: 4396089 - DNA, 17 bp, Homo sapiens
gcccaccccgctctgca

SEQ ID NO: 4396090 - DNA, 17 bp, Homo sapiens
gcccacccgccttgtga

SEQ ID NO: 4396091 - DNA, 15 bp, Homo sapiens
gcccacccggcccgg

SEQ ID NO: 4396092 - DNA, 22 bp, Homo sapiens
gcccacccggcccggctgagcc

SEQ ID NO: 4396093 - DNA, 23 bp, Homo sapiens
gcccacccggcccggctgagccc

SEQ ID NO: 4396094 - DNA, 18 bp, Homo sapiens
gcccaccctcctgtcttc

SEQ ID NO: 4396095 - DNA, 19 bp, Homo sapiens
gcccacgtcaggcctggcc

SEQ ID NO: 4396096 - DNA, 13 bp, Homo sapiens
gcccactccccag

SEQ ID NO: 4396097 - DNA, 13 bp, Homo sapiens
gcccactcctggg

SEQ ID NO: 4396098 - DNA, 14 bp, Homo sapiens
gcccactcctggga

SEQ ID NO: 4396099 - DNA, 18 bp, Homo sapiens
gcccactgaggggccagg

SEQ ID NO: 4396100 - DNA, 20 bp, Homo sapiens
gcccactggccgctgagcgc

SEQ ID NO: 4396101 - DNA, 16 bp, Homo sapiens
gcccagaaagtggggg

SEQ ID NO: 4396102 - DNA, 23 bp, Homo sapiens
gcccagaaagtgggggtggagga

SEQ ID NO: 4396103 - DNA, 16 bp, Homo sapiens
gcccagaataagttat

SEQ ID NO: 4396104 - DNA, 15 bp, Homo sapiens
gcccagactacaggg

SEQ ID NO: 4396105 - DNA, 17 bp, Homo sapiens
gcccagagatgcctcca

SEQ ID NO: 4396106 - DNA, 22 bp, Homo sapiens
gcccagagatgcctccaccgct

SEQ ID NO: 4396107 - DNA, 11 bp, Homo sapiens
gcccagagcca

SEQ ID NO: 4396108 - DNA, 17 bp, Homo sapiens
gcccagagccacctgga

SEQ ID NO: 4396109 - DNA, 23 bp, Homo sapiens
gcccagaggagggcagcagaagg

SEQ ID NO: 4396110 - DNA, 19 bp, Homo sapiens
gcccagcagcccctgagag

SEQ ID NO: 4396111 - DNA, 14 bp, Homo sapiens
gcccagcaggagag

SEQ ID NO: 4396112 - DNA, 11 bp, Homo sapiens
gcccagcccag

SEQ ID NO: 4396113 - DNA, 15 bp, Homo sapiens
gcccagcccagctgg

SEQ ID NO: 4396114 - DNA, 13 bp, Homo sapiens
gcccagcccagga

SEQ ID NO: 4396115 - DNA, 16 bp, Homo sapiens
gcccagcccctgttta

SEQ ID NO: 4396116 - DNA, 11 bp, Homo sapiens
gcccagccctg

SEQ ID NO: 4396117 - DNA, 12 bp, Homo sapiens
gcccagccctgc

SEQ ID NO: 4396118 - DNA, 15 bp, Homo sapiens
gcccagccctggccc

SEQ ID NO: 4396119 - DNA, 19 bp, Homo sapiens
gcccagccgggcacagtgg

SEQ ID NO: 4396120 - DNA, 23 bp, Homo sapiens
gcccagccgggcacagtggcgca

SEQ ID NO: 4396121 - DNA, 13 bp, Homo sapiens
gcccagcctggaa

SEQ ID NO: 4396122 - DNA, 16 bp, Homo sapiens
gcccagcctggatgcc

SEQ ID NO: 4396123 - DNA, 14 bp, Homo sapiens
gcccagcctgggag

SEQ ID NO: 4396124 - DNA, 22 bp, Homo sapiens
gcccagcctgggagcccagagg

SEQ ID NO: 4396125 - DNA, 17 bp, Homo sapiens
gcccagcgtcagaagtc

SEQ ID NO: 4396126 - DNA, 22 bp, Homo sapiens
gcccagctgtgggcggctcctg

SEQ ID NO: 4396127 - DNA, 18 bp, Homo sapiens
gcccagctttcaaaggac

SEQ ID NO: 4396128 - DNA, 22 bp, Homo sapiens
gcccaggagacagaccacttgc

SEQ ID NO: 4396129 - DNA, 18 bp, Homo sapiens
gcccaggagagccagccc

SEQ ID NO: 4396130 - DNA, 19 bp, Homo sapiens
gcccaggagagccagccct

SEQ ID NO: 4396131 - DNA, 15 bp, Homo sapiens
gcccaggatactggc

SEQ ID NO: 4396132 - DNA, 20 bp, Homo sapiens
gcccaggatactggcacaga

SEQ ID NO: 4396133 - DNA, 14 bp, Homo sapiens
gcccaggcagcctc

SEQ ID NO: 4396134 - DNA, 14 bp, Homo sapiens
gcccaggccacaga

SEQ ID NO: 4396135 - DNA, 19 bp, Homo sapiens
gcccaggccacagagaacc

SEQ ID NO: 4396136 - DNA, 21 bp, Homo sapiens
gcccaggccacagagaacctg

SEQ ID NO: 4396137 - DNA, 16 bp, Homo sapiens
gcccaggccacagcca

SEQ ID NO: 4396138 - DNA, 20 bp, Homo sapiens
gcccaggccaggtgcccagg

SEQ ID NO: 4396139 - DNA, 17 bp, Homo sapiens
gcccaggctggactgca

SEQ ID NO: 4396140 - DNA, 17 bp, Homo sapiens
gcccagggacaccagcc

SEQ ID NO: 4396141 - DNA, 21 bp, Homo sapiens
gcccagggacaccagccaggc

SEQ ID NO: 4396142 - DNA, 24 bp, Homo sapiens
gcccagggacaccagccaggctct

SEQ ID NO: 4396143 - DNA, 15 bp, Homo sapiens
gcccagggcatctgg

SEQ ID NO: 4396144 - DNA, 17 bp, Homo sapiens
gcccagggcctgaaacc

SEQ ID NO: 4396145 - DNA, 23 bp, Homo sapiens
gcccaggggctgtggccgtctcc

SEQ ID NO: 4396146 - DNA, 20 bp, Homo sapiens
gcccaggttggagtgcagtg

SEQ ID NO: 4396147 - DNA, 15 bp, Homo sapiens
gcccagtgaagcctc

SEQ ID NO: 4396148 - DNA, 14 bp, Homo sapiens
gcccagtgagccct

SEQ ID NO: 4396149 - DNA, 15 bp, Homo sapiens
gcccagtgagccctg

SEQ ID NO: 4396150 - DNA, 16 bp, Homo sapiens
gcccagtgagccctgc

SEQ ID NO: 4396151 - DNA, 17 bp, Homo sapiens
gcccagtgccactgccc

SEQ ID NO: 4396152 - DNA, 23 bp, Homo sapiens
gcccagtgcttctccaacactga

SEQ ID NO: 4396153 - DNA, 18 bp, Homo sapiens
gcccagttcatcaccatt

SEQ ID NO: 4396154 - DNA, 13 bp, Homo sapiens
gcccatcacaggg

SEQ ID NO: 4396155 - DNA, 18 bp, Homo sapiens
gcccatcctgaccagctg

SEQ ID NO: 4396156 - DNA, 13 bp, Homo sapiens
gcccatcctgcca

SEQ ID NO: 4396157 - DNA, 13 bp, Homo sapiens
gcccatgcccacc

SEQ ID NO: 4396158 - DNA, 14 bp, Homo sapiens
gcccatgcccacct

SEQ ID NO: 4396159 - DNA, 15 bp, Homo sapiens
gcccatgcccacctg

SEQ ID NO: 4396160 - DNA, 14 bp, Homo sapiens
gcccatggccccca

SEQ ID NO: 4396161 - DNA, 15 bp, Homo sapiens
gcccatggcccccaa

SEQ ID NO: 4396162 - DNA, 20 bp, Homo sapiens
gcccatggcccccaataaag

SEQ ID NO: 4396163 - DNA, 21 bp, Homo sapiens
gcccatggcccccaataaagg

SEQ ID NO: 4396164 - DNA, 17 bp, Homo sapiens
gcccatgtgtcccctca

SEQ ID NO: 4396165 - DNA, 22 bp, Homo sapiens
gcccatgtgtcccctcactctg

SEQ ID NO: 4396166 - DNA, 13 bp, Homo sapiens
gcccattactccg

SEQ ID NO: 4396167 - DNA, 15 bp, Homo sapiens
gcccattcctgcctg

SEQ ID NO: 4396168 - DNA, 17 bp, Homo sapiens
gcccattcctgcctggt

SEQ ID NO: 4396169 - DNA, 21 bp, Homo sapiens
gcccattctctctcctgtcca

SEQ ID NO: 4396170 - DNA, 23 bp, Homo sapiens
gcccattggccgagctcctgggg

SEQ ID NO: 4396171 - DNA, 15 bp, Homo sapiens
gccccaactcctgga

SEQ ID NO: 4396172 - DNA, 18 bp, Homo sapiens
gccccaactcctggaagc

SEQ ID NO: 4396173 - DNA, 22 bp, Homo sapiens
gccccaactcctggaagctgtg

SEQ ID NO: 4396174 - DNA, 15 bp, Homo sapiens
gccccaatcttgccc

SEQ ID NO: 4396175 - DNA, 18 bp, Homo sapiens
gccccaatcttgcccact

SEQ ID NO: 4396176 - DNA, 19 bp, Homo sapiens
gccccacactggggtgccg

SEQ ID NO: 4396177 - DNA, 23 bp, Homo sapiens
gccccacactggggtgccgcctg

SEQ ID NO: 4396178 - DNA, 18 bp, Homo sapiens
gccccacagccccatctg

SEQ ID NO: 4396179 - DNA, 11 bp, Homo sapiens
gccccaccacc

SEQ ID NO: 4396180 - DNA, 15 bp, Homo sapiens
gccccaccacctagg

SEQ ID NO: 4396181 - DNA, 23 bp, Homo sapiens
gccccaccacctaggccactcct

SEQ ID NO: 4396182 - DNA, 16 bp, Homo sapiens
gccccaccagtgcctc

SEQ ID NO: 4396183 - DNA, 19 bp, Homo sapiens
gccccagagagaccctgca

SEQ ID NO: 4396184 - DNA, 11 bp, Homo sapiens
gccccagccag

SEQ ID NO: 4396185 - DNA, 18 bp, Homo sapiens
gccccagcccaccctcct

SEQ ID NO: 4396186 - DNA, 20 bp, Homo sapiens
gccccagcccaccctcctgt

SEQ ID NO: 4396187 - DNA, 18 bp, Homo sapiens
gccccagcctgggccatc

SEQ ID NO: 4396188 - DNA, 16 bp, Homo sapiens
gccccagcgggctggc

SEQ ID NO: 4396189 - DNA, 18 bp, Homo sapiens
gccccagcgggctggcgg

SEQ ID NO: 4396190 - DNA, 23 bp, Homo sapiens
gccccagcgggctggcgggcctt

SEQ ID NO: 4396191 - DNA, 18 bp, Homo sapiens
gccccaggccagctgcgg

SEQ ID NO: 4396192 - DNA, 15 bp, Homo sapiens
gccccaggccccaga

SEQ ID NO: 4396193 - DNA, 17 bp, Homo sapiens
gccccaggccccagaca

SEQ ID NO: 4396194 - DNA, 16 bp, Homo sapiens
gccccaggccctccct

SEQ ID NO: 4396195 - DNA, 17 bp, Homo sapiens
gccccaggccctccctg

SEQ ID NO: 4396196 - DNA, 19 bp, Homo sapiens
gccccaggctcgtggactg

SEQ ID NO: 4396197 - DNA, 17 bp, Homo sapiens
gccccagggtcttccct

SEQ ID NO: 4396198 - DNA, 20 bp, Homo sapiens
gccccaggtacacctccccc

SEQ ID NO: 4396199 - DNA, 22 bp, Homo sapiens
gccccaggtacacctccccctg

SEQ ID NO: 4396200 - DNA, 15 bp, Homo sapiens
gccccagtcagcctc

SEQ ID NO: 4396201 - DNA, 17 bp, Homo sapiens
gccccagtcagcctctc

SEQ ID NO: 4396202 - DNA, 20 bp, Homo sapiens
gccccagtcagcctctctcc

SEQ ID NO: 4396203 - DNA, 23 bp, Homo sapiens
gccacgtcccagcatccctggag

SEQ ID NO: 4396204 - DNA, 17 bp, Homo sapiens
gccactaggtgtcccca

SEQ ID NO: 4396205 - DNA, 18 bp, Homo sapiens
gccactaggtgtccccaa

SEQ ID NO: 4396206 - DNA, 20 bp, Homo sapiens
gccactcacacagccaggtg

SEQ ID NO: 4396207 - DNA, 20 bp, Homo sapiens
gccactcatttcatctcatt

SEQ ID NO: 4396208 - DNA, 14 bp, Homo sapiens
gccactcctctgac

SEQ ID NO: 4396209 - DNA, 21 bp, Homo sapiens
gccactcctctgactcagggc

SEQ ID NO: 4396210 - DNA, 15 bp, Homo sapiens
gccactcgccttctt

SEQ ID NO: 4396211 - DNA, 16 bp, Homo sapiens
gccactcgccttctta

SEQ ID NO: 4396212 - DNA, 21 bp, Homo sapiens
gccactctatgagttggactt

SEQ ID NO: 4396213 - DNA, 15 bp, Homo sapiens
gccactgccccccga

SEQ ID NO: 4396214 - DNA, 18 bp, Homo sapiens
gccactgccccccgaggc

SEQ ID NO: 4396215 - DNA, 15 bp, Homo sapiens
gccactggatcctgc

SEQ ID NO: 4396216 - DNA, 16 bp, Homo sapiens
gccactggatcctgct

SEQ ID NO: 4396217 - DNA, 19 bp, Homo sapiens
gccactggatcctgctgct

SEQ ID NO: 4396218 - DNA, 21 bp, Homo sapiens
gccactggatcctgctgcttt

SEQ ID NO: 4396219 - DNA, 20 bp, Homo sapiens
gccactggggtgccttcact

SEQ ID NO: 4396220 - DNA, 21 bp, Homo sapiens
gccactggggtgccttcactg

SEQ ID NO: 4396221 - DNA, 14 bp, Homo sapiens
gccactgtcacagg

SEQ ID NO: 4396222 - DNA, 17 bp, Homo sapiens
gccactgtcacaggcat

SEQ ID NO: 4396223 - DNA, 17 bp, Homo sapiens
gccactgttcagcggag

SEQ ID NO: 4396224 - DNA, 16 bp, Homo sapiens
gccactgttgttttgg

SEQ ID NO: 4396225 - DNA, 18 bp, Homo sapiens
gccacttaatgtatgtta

SEQ ID NO: 4396226 - DNA, 21 bp, Homo sapiens
gccacttctcactcaccacta

SEQ ID NO: 4396227 - DNA, 23 bp, Homo sapiens
gccacttctgggtggggcagtgg

SEQ ID NO: 4396228 - DNA, 18 bp, Homo sapiens
gccagaatctagagcaaa

SEQ ID NO: 4396229 - DNA, 19 bp, Homo sapiens
gccagaatctagagcaaag

SEQ ID NO: 4396230 - DNA, 21 bp, Homo sapiens
gccagacccacgggctcatgc

SEQ ID NO: 4396231 - DNA, 19 bp, Homo sapiens
gccagacctagcaggctgt

SEQ ID NO: 4396232 - DNA, 18 bp, Homo sapiens
gccagacgctgccgctgc

SEQ ID NO: 4396233 - DNA, 18 bp, Homo sapiens
gccagactggcacagttt

SEQ ID NO: 4396234 - DNA, 13 bp, Homo sapiens
gccagactgtcca

SEQ ID NO: 4396235 - DNA, 12 bp, Homo sapiens
gccagagcctgg

SEQ ID NO: 4396236 - DNA, 13 bp, Homo sapiens
gccagagcctggg

SEQ ID NO: 4396237 - DNA, 16 bp, Homo sapiens
gccagaggagggcaga

SEQ ID NO: 4396238 - DNA, 20 bp, Homo sapiens
gccagaggagggcagaggga

SEQ ID NO: 4396239 - DNA, 22 bp, Homo sapiens
gccagaggagggcagagggaga

SEQ ID NO: 4396240 - DNA, 13 bp, Homo sapiens
gccagaggccctg

SEQ ID NO: 4396241 - DNA, 15 bp, Homo sapiens
gccagaggccctgga

SEQ ID NO: 4396242 - DNA, 21 bp, Homo sapiens
gccagaggctcgaggggctca

SEQ ID NO: 4396243 - DNA, 13 bp, Homo sapiens
gccagagtcacct

SEQ ID NO: 4396244 - DNA, 17 bp, Homo sapiens
gccagagtggcctggcc

SEQ ID NO: 4396245 - DNA, 24 bp, Homo sapiens
gccagagtggcctggccaggagct

SEQ ID NO: 4396246 - DNA, 21 bp, Homo sapiens
gccagatataactgtcttgtt

SEQ ID NO: 4396247 - DNA, 22 bp, Homo sapiens
gccagatataactgtcttgttt

SEQ ID NO: 4396248 - DNA, 23 bp, Homo sapiens
gccagattacaggaatgaagaac

SEQ ID NO: 4396249 - DNA, 15 bp, Homo sapiens
gccagattctgcctc

SEQ ID NO: 4396250 - DNA, 18 bp, Homo sapiens
gccagattctgcctctct

SEQ ID NO: 4396251 - DNA, 20 bp, Homo sapiens
gccagatttgtctttttgtt

SEQ ID NO: 4396252 - DNA, 14 bp, Homo sapiens
gccagcaccctctc

SEQ ID NO: 4396253 - DNA, 13 bp, Homo sapiens
gccagcagagcca

SEQ ID NO: 4396254 - DNA, 20 bp, Homo sapiens
gccagcagagccagggcagg

SEQ ID NO: 4396255 - DNA, 22 bp, Homo sapiens
gccagcagagccagggcagggc

SEQ ID NO: 4396256 - DNA, 23 bp, Homo sapiens
gccagcagagccagggcagggcg

SEQ ID NO: 4396257 - DNA, 19 bp, Homo sapiens
gccagcagctgtcagaaca

SEQ ID NO: 4396258 - DNA, 13 bp, Homo sapiens
gccagcccacccc

SEQ ID NO: 4396259 - DNA, 15 bp, Homo sapiens
gccagcccaccccct

SEQ ID NO: 4396260 - DNA, 11 bp, Homo sapiens
gccagcccagc

SEQ ID NO: 4396261 - DNA, 12 bp, Homo sapiens
gccagcccagcc

SEQ ID NO: 4396262 - DNA, 13 bp, Homo sapiens
gccagcccagcca

SEQ ID NO: 4396263 - DNA, 14 bp, Homo sapiens
gccagcccagccag

SEQ ID NO: 4396264 - DNA, 19 bp, Homo sapiens
gccagcccatggcccccaa

SEQ ID NO: 4396265 - DNA, 13 bp, Homo sapiens
gccagccccaccc

SEQ ID NO: 4396266 - DNA, 14 bp, Homo sapiens
gccagccccaccca

SEQ ID NO: 4396267 - DNA, 15 bp, Homo sapiens
gccagccccacccag

SEQ ID NO: 4396268 - DNA, 17 bp, Homo sapiens
gccagccccacccagga

SEQ ID NO: 4396269 - DNA, 18 bp, Homo sapiens
gccagccccacccaggag

SEQ ID NO: 4396270 - DNA, 18 bp, Homo sapiens
gccagccccggccctggg

SEQ ID NO: 4396271 - DNA, 21 bp, Homo sapiens
gccagccccggccctgggctc

SEQ ID NO: 4396272 - DNA, 14 bp, Homo sapiens
gccagccctccctg

SEQ ID NO: 4396273 - DNA, 22 bp, Homo sapiens
gccagccctccctgtcctcctc

SEQ ID NO: 4396274 - DNA, 15 bp, Homo sapiens
gccagcccttccctg

SEQ ID NO: 4396275 - DNA, 19 bp, Homo sapiens
gccagccgcccacccccac

SEQ ID NO: 4396276 - DNA, 20 bp, Homo sapiens
gccagccgccctgggctgtc

SEQ ID NO: 4396277 - DNA, 15 bp, Homo sapiens
gccagccgtggccag

SEQ ID NO: 4396278 - DNA, 13 bp, Homo sapiens
gccagcctcagaa

SEQ ID NO: 4396279 - DNA, 23 bp, Homo sapiens
gccagcctcagaaggccccagag

SEQ ID NO: 4396280 - DNA, 18 bp, Homo sapiens
gccagcctccgagaggga

SEQ ID NO: 4396281 - DNA, 13 bp, Homo sapiens
gccagcctcctct

SEQ ID NO: 4396282 - DNA, 14 bp, Homo sapiens
gccagcctcctctg

SEQ ID NO: 4396283 - DNA, 17 bp, Homo sapiens
gccagcctcctctggac

SEQ ID NO: 4396284 - DNA, 19 bp, Homo sapiens
gccagcctgctccttccca

SEQ ID NO: 4396285 - DNA, 11 bp, Homo sapiens
gccagcctggc

SEQ ID NO: 4396286 - DNA, 15 bp, Homo sapiens
gccagcctggctctg

SEQ ID NO: 4396287 - DNA, 15 bp, Homo sapiens
gccagcgcctccctc

SEQ ID NO: 4396288 - DNA, 22 bp, Homo sapiens
gccagcgcctccctccacccca

SEQ ID NO: 4396289 - DNA, 13 bp, Homo sapiens
gccagcggctcca

SEQ ID NO: 4396290 - DNA, 15 bp, Homo sapiens
gccagcggctccaac

SEQ ID NO: 4396291 - DNA, 15 bp, Homo sapiens
gccagcggggctgct

SEQ ID NO: 4396292 - DNA, 13 bp, Homo sapiens
gccagctcaggaa

SEQ ID NO: 4396293 - DNA, 21 bp, Homo sapiens
gccagctctagttttcagcct

SEQ ID NO: 4396294 - DNA, 15 bp, Homo sapiens
gccagctctgtatca

SEQ ID NO: 4396295 - DNA, 12 bp, Homo sapiens
gccagctgcaga

SEQ ID NO: 4396296 - DNA, 17 bp, Homo sapiens
gccagctgcccttgcag

SEQ ID NO: 4396297 - DNA, 18 bp, Homo sapiens
gccagctgcccttgcagg

SEQ ID NO: 4396298 - DNA, 20 bp, Homo sapiens
gccagctgcccttgcagggt

SEQ ID NO: 4396299 - DNA, 15 bp, Homo sapiens
gccagctgcggccag

SEQ ID NO: 4396300 - DNA, 16 bp, Homo sapiens
gccagctgcggccagg

SEQ ID NO: 4396301 - DNA, 18 bp, Homo sapiens
gccagctgcggccaggcc

SEQ ID NO: 4396302 - DNA, 18 bp, Homo sapiens
gccagctggatcgctgca

SEQ ID NO: 4396303 - DNA, 14 bp, Homo sapiens
gccagctgggagca

SEQ ID NO: 4396304 - DNA, 14 bp, Homo sapiens
gccagctgtctccc

SEQ ID NO: 4396305 - DNA, 12 bp, Homo sapiens
gccagctgtgca

SEQ ID NO: 4396306 - DNA, 14 bp, Homo sapiens
gccaggaagccaga

SEQ ID NO: 4396307 - DNA, 18 bp, Homo sapiens
gccaggaagccagagccc

SEQ ID NO: 4396308 - DNA, 19 bp, Homo sapiens
gccaggaagccagagcccc

SEQ ID NO: 4396309 - DNA, 15 bp, Homo sapiens
gccaggacaggcccg

SEQ ID NO: 4396310 - DNA, 22 bp, Homo sapiens
gccaggaccagtcaacctgggc

SEQ ID NO: 4396311 - DNA, 18 bp, Homo sapiens
gccaggaccctgacctcc

SEQ ID NO: 4396312 - DNA, 22 bp, Homo sapiens
gccaggacgtctggggtgtggg

SEQ ID NO: 4396313 - DNA, 19 bp, Homo sapiens
gccaggagaatctccgctt

SEQ ID NO: 4396314 - DNA, 22 bp, Homo sapiens
gccaggagcagccctggccccc

SEQ ID NO: 4396315 - DNA, 22 bp, Homo sapiens
gccaggagctcttcaggcctcc

SEQ ID NO: 4396316 - DNA, 14 bp, Homo sapiens
gccaggaggctgcc

SEQ ID NO: 4396317 - DNA, 15 bp, Homo sapiens
gccaggcacacactg

SEQ ID NO: 4396318 - DNA, 14 bp, Homo sapiens
gccaggcaggggtg

SEQ ID NO: 4396319 - DNA, 13 bp, Homo sapiens
gccaggccagcag

SEQ ID NO: 4396320 - DNA, 12 bp, Homo sapiens
gccaggccagcc

SEQ ID NO: 4396321 - DNA, 13 bp, Homo sapiens
gccaggccagcct

SEQ ID NO: 4396322 - DNA, 14 bp, Homo sapiens
gccaggccagcctc

SEQ ID NO: 4396323 - DNA, 19 bp, Homo sapiens
gccaggccagcctccgaga

SEQ ID NO: 4396324 - DNA, 16 bp, Homo sapiens
gcacgcctgctggccg

SEQ ID NO: 4396325 - DNA, 20 bp, Homo sapiens
gcacgcgccctttctaccat

SEQ ID NO: 4396326 - DNA, 19 bp, Homo sapiens
gcacggcgggatcctccac

SEQ ID NO: 4396327 - DNA, 17 bp, Homo sapiens
gcacggtgggccttgct

SEQ ID NO: 4396328 - DNA, 18 bp, Homo sapiens
gcacggtgggccttgctg

SEQ ID NO: 4396329 - DNA, 13 bp, Homo sapiens
gcacgtcatggga

SEQ ID NO: 4396330 - DNA, 18 bp, Homo sapiens
gcacgtggagagctggtg

SEQ ID NO: 4396331 - DNA, 21 bp, Homo sapiens
gcacgtggagatagtgccagg

SEQ ID NO: 4396332 - DNA, 14 bp, Homo sapiens
gcacgtggggccca

SEQ ID NO: 4396333 - DNA, 18 bp, Homo sapiens
gcacgtggggcccactgc

SEQ ID NO: 4396334 - DNA, 20 bp, Homo sapiens
gcactaaggtggacagcaga

SEQ ID NO: 4396335 - DNA, 16 bp, Homo sapiens
gcactacattcattta

SEQ ID NO: 4396336 - DNA, 17 bp, Homo sapiens
gcactactctgtgccag

SEQ ID NO: 4396337 - DNA, 18 bp, Homo sapiens
gcactactgggtgtcatt

SEQ ID NO: 4396338 - DNA, 19 bp, Homo sapiens
gcactactgggtgtcattt

SEQ ID NO: 4396339 - DNA, 21 bp, Homo sapiens
gcactactgggtgtcatttca

SEQ ID NO: 4396340 - DNA, 20 bp, Homo sapiens
gcactagagaatgcacagat

SEQ ID NO: 4396341 - DNA, 21 bp, Homo sapiens
gcactaggcacccagctgcca

SEQ ID NO: 4396342 - DNA, 21 bp, Homo sapiens
gcactcagaagttgtgctaaa

SEQ ID NO: 4396343 - DNA, 19 bp, Homo sapiens
gcactccagcctgggggac

SEQ ID NO: 4396344 - DNA, 17 bp, Homo sapiens
gcactccagcctgggtc

SEQ ID NO: 4396345 - DNA, 22 bp, Homo sapiens
gcactcccacctgacacaccag

SEQ ID NO: 4396346 - DNA, 19 bp, Homo sapiens
gcactccctaatttatgtg

SEQ ID NO: 4396347 - DNA, 21 bp, Homo sapiens
gcactccgcgccgatgccacc

SEQ ID NO: 4396348 - DNA, 24 bp, Homo sapiens
gcactcctttatctgtaattgtaa

SEQ ID NO: 4396349 - DNA, 18 bp, Homo sapiens
gcactcggggtccctgga

SEQ ID NO: 4396350 - DNA, 18 bp, Homo sapiens
gcactctctgccattctg

SEQ ID NO: 4396351 - DNA, 15 bp, Homo sapiens
gcactgaactgcttt

SEQ ID NO: 4396352 - DNA, 14 bp, Homo sapiens
gcactgaagagctc

SEQ ID NO: 4396353 - DNA, 20 bp, Homo sapiens
gcactgagctcacatgggac

SEQ ID NO: 4396354 - DNA, 13 bp, Homo sapiens
gcactgaggaaga

SEQ ID NO: 4396355 - DNA, 13 bp, Homo sapiens
gcactgccccaca

SEQ ID NO: 4396356 - DNA, 15 bp, Homo sapiens
gcactgccccacatg

SEQ ID NO: 4396357 - DNA, 17 bp, Homo sapiens
gcactgccccacatgca

SEQ ID NO: 4396358 - DNA, 16 bp, Homo sapiens
gcactgcttgaggaaa

SEQ ID NO: 4396359 - DNA, 21 bp, Homo sapiens
gcactggccttctgatgaaat

SEQ ID NO: 4396360 - DNA, 11 bp, Homo sapiens
gcactgggagg

SEQ ID NO: 4396361 - DNA, 14 bp, Homo sapiens
gcacttaaacagaa

SEQ ID NO: 4396362 - DNA, 13 bp, Homo sapiens
gcacttcccagga

SEQ ID NO: 4396363 - DNA, 22 bp, Homo sapiens
gcacttcccaggatctgctcca

SEQ ID NO: 4396364 - DNA, 14 bp, Homo sapiens
gcacttctgctgca

SEQ ID NO: 4396365 - DNA, 15 bp, Homo sapiens
gcacttgatatttat

SEQ ID NO: 4396366 - DNA, 21 bp, Homo sapiens
gcacttggcaaaaagaatccc

SEQ ID NO: 4396367 - DNA, 21 bp, Homo sapiens
gcacttgtctcattttaatgt

SEQ ID NO: 4396368 - DNA, 22 bp, Homo sapiens
gcactttcattgccagtgtctt

SEQ ID NO: 4396369 - DNA, 20 bp, Homo sapiens
gcactttccaatgccacaga

SEQ ID NO: 4396370 - DNA, 20 bp, Homo sapiens
gcactttctatcctctgtaa

SEQ ID NO: 4396371 - DNA, 21 bp, Homo sapiens
gcactttgagaggctgaggtg

SEQ ID NO: 4396372 - DNA, 11 bp, Homo sapiens
gcactttgtag

SEQ ID NO: 4396373 - DNA, 14 bp, Homo sapiens
gcactttgtttaga

SEQ ID NO: 4396374 - DNA, 12 bp, Homo sapiens
gcacttttattt

SEQ ID NO: 4396375 - DNA, 17 bp, Homo sapiens
gcagaaaagcacctgcc

SEQ ID NO: 4396376 - DNA, 17 bp, Homo sapiens
gcagaaaatatttaata

SEQ ID NO: 4396377 - DNA, 17 bp, Homo sapiens
gcagaaaattctgtgcc

SEQ ID NO: 4396378 - DNA, 21 bp, Homo sapiens
gcagaaaggttctgcccggga

SEQ ID NO: 4396379 - DNA, 20 bp, Homo sapiens
gcagaaagtaagcatttcca

SEQ ID NO: 4396380 - DNA, 16 bp, Homo sapiens
gcagaaatacagtctt

SEQ ID NO: 4396381 - DNA, 16 bp, Homo sapiens
gcagaaatagacaaaa

SEQ ID NO: 4396382 - DNA, 12 bp, Homo sapiens
gcagaacagtga

SEQ ID NO: 4396383 - DNA, 16 bp, Homo sapiens
gcagaacatactgttc

SEQ ID NO: 4396384 - DNA, 15 bp, Homo sapiens
gcagaagccctgatg

SEQ ID NO: 4396385 - DNA, 12 bp, Homo sapiens
gcagaaggagag

SEQ ID NO: 4396386 - DNA, 16 bp, Homo sapiens
gcagaatgaatctatg

SEQ ID NO: 4396387 - DNA, 13 bp, Homo sapiens
gcagaattcattc

SEQ ID NO: 4396388 - DNA, 20 bp, Homo sapiens
gcagacaataaaccctcaga

SEQ ID NO: 4396389 - DNA, 15 bp, Homo sapiens
gcagacacctggact

SEQ ID NO: 4396390 - DNA, 17 bp, Homo sapiens
gcagacacctggactga

SEQ ID NO: 4396391 - DNA, 20 bp, Homo sapiens
gcagacacctggactgagcc

SEQ ID NO: 4396392 - DNA, 21 bp, Homo sapiens
gcagacacctggactgagcca

SEQ ID NO: 4396393 - DNA, 21 bp, Homo sapiens
gcagaccattggggctcccag

SEQ ID NO: 4396394 - DNA, 20 bp, Homo sapiens
gcagacctgtcctcctggtg

SEQ ID NO: 4396395 - DNA, 14 bp, Homo sapiens
gcagacgtccatca

SEQ ID NO: 4396396 - DNA, 19 bp, Homo sapiens
gcagacgtctgtcaggggc

SEQ ID NO: 4396397 - DNA, 22 bp, Homo sapiens
gcagacgtctgtcaggggcttg

SEQ ID NO: 4396398 - DNA, 12 bp, Homo sapiens
gcagactgtgaa

SEQ ID NO: 4396399 - DNA, 16 bp, Homo sapiens
gcagacttcccagcta

SEQ ID NO: 4396400 - DNA, 18 bp, Homo sapiens
gcagacttcccagctagg

SEQ ID NO: 4396401 - DNA, 17 bp, Homo sapiens
gcagagagcaaaggaga

SEQ ID NO: 4396402 - DNA, 15 bp, Homo sapiens
gcagagccagggcag

SEQ ID NO: 4396403 - DNA, 16 bp, Homo sapiens
gcagagcccaagggaa

SEQ ID NO: 4396404 - DNA, 16 bp, Homo sapiens
gcagagccttctcaga

SEQ ID NO: 4396405 - DNA, 19 bp, Homo sapiens
gcagagccttctcagaagc

SEQ ID NO: 4396406 - DNA, 14 bp, Homo sapiens
gcagagctctgccg

SEQ ID NO: 4396407 - DNA, 19 bp, Homo sapiens
gcagagctggagcccccag

SEQ ID NO: 4396408 - DNA, 22 bp, Homo sapiens
gcagagctggagcccccagcag

SEQ ID NO: 4396409 - DNA, 21 bp, Homo sapiens
gcagaggacagtctggagaag

SEQ ID NO: 4396410 - DNA, 16 bp, Homo sapiens
gcagaggcaggctggg

SEQ ID NO: 4396411 - DNA, 12 bp, Homo sapiens
gcagaggccctg

SEQ ID NO: 4396412 - DNA, 13 bp, Homo sapiens
gcagaggccctgc

SEQ ID NO: 4396413 - DNA, 14 bp, Homo sapiens
gcagaggccctgcc

SEQ ID NO: 4396414 - DNA, 16 bp, Homo sapiens
gcagaggccctgcccc

SEQ ID NO: 4396415 - DNA, 17 bp, Homo sapiens
gcagaggccctgccccc

SEQ ID NO: 4396416 - DNA, 18 bp, Homo sapiens
gcagaggccctgccccca

SEQ ID NO: 4396417 - DNA, 19 bp, Homo sapiens
gcagaggctggaggcaggg

SEQ ID NO: 4396418 - DNA, 21 bp, Homo sapiens
gcagaggctggaggcagggcc

SEQ ID NO: 4396419 - DNA, 22 bp, Homo sapiens
gcagaggctggaggcagggcct

SEQ ID NO: 4396420 - DNA, 22 bp, Homo sapiens
gcagaggttgcagtgagctgag

SEQ ID NO: 4396421 - DNA, 13 bp, Homo sapiens
gcagagttaaatc

SEQ ID NO: 4396422 - DNA, 17 bp, Homo sapiens
gcagagttacagttctg

SEQ ID NO: 4396423 - DNA, 15 bp, Homo sapiens
gcagagttcagactt

SEQ ID NO: 4396424 - DNA, 13 bp, Homo sapiens
gcagataactttt

SEQ ID NO: 4396425 - DNA, 18 bp, Homo sapiens
gcagatacctcaccctgc

SEQ ID NO: 4396426 - DNA, 14 bp, Homo sapiens
gcagatcacttgag

SEQ ID NO: 4396427 - DNA, 20 bp, Homo sapiens
gcagatctgtgccccatgcc

SEQ ID NO: 4396428 - DNA, 22 bp, Homo sapiens
gcagatcttccgtggtcagagt

SEQ ID NO: 4396429 - DNA, 22 bp, Homo sapiens
gcagatgtcttccctgggctgc

SEQ ID NO: 4396430 - DNA, 17 bp, Homo sapiens
gcagatgtgagccaccg

SEQ ID NO: 4396431 - DNA, 23 bp, Homo sapiens
gcagatgtgagccaccgtgcctg

SEQ ID NO: 4396432 - DNA, 13 bp, Homo sapiens
gcagattagcagg

SEQ ID NO: 4396433 - DNA, 16 bp, Homo sapiens
gcagattagcaggcca

SEQ ID NO: 4396434 - DNA, 19 bp, Homo sapiens
gcagattcggaccactagg

SEQ ID NO: 4396435 - DNA, 21 bp, Homo sapiens
gcagattcggaccactaggcc

SEQ ID NO: 4396436 - DNA, 18 bp, Homo sapiens
gcagattctgagcaaagg

SEQ ID NO: 4396437 - DNA, 19 bp, Homo sapiens
gcagattctgagcaaaggc

SEQ ID NO: 4396438 - DNA, 11 bp, Homo sapiens
gcagcaactcc

SEQ ID NO: 4396439 - DNA, 12 bp, Homo sapiens
gcagcaactccc

SEQ ID NO: 4396440 - DNA, 13 bp, Homo sapiens
gcagcaactgaaa

SEQ ID NO: 4396441 - DNA, 15 bp, Homo sapiens
gcagcaatttaaatg

SEQ ID NO: 4396442 - DNA, 16 bp, Homo sapiens
gcagggatattgcctt

SEQ ID NO: 4396443 - DNA, 13 bp, Homo sapiens
gcagggccaggcc

SEQ ID NO: 4396444 - DNA, 16 bp, Homo sapiens
gcagggcctggctcca

SEQ ID NO: 4396445 - DNA, 21 bp, Homo sapiens
gcagggccttgcccagagatg

SEQ ID NO: 4396446 - DNA, 22 bp, Homo sapiens
gcagggcgccaagtctggcacc

SEQ ID NO: 4396447 - DNA, 18 bp, Homo sapiens
gcagggcgggcagagggc

SEQ ID NO: 4396448 - DNA, 14 bp, Homo sapiens
gcagggcggggctg

SEQ ID NO: 4396449 - DNA, 17 bp, Homo sapiens
gcagggctaccctgagc

SEQ ID NO: 4396450 - DNA, 20 bp, Homo sapiens
gcagggctaccctgagctga

SEQ ID NO: 4396451 - DNA, 20 bp, Homo sapiens
gcaggggagacaggagccta

SEQ ID NO: 4396452 - DNA, 15 bp, Homo sapiens
gcaggggcaccttcc

SEQ ID NO: 4396453 - DNA, 15 bp, Homo sapiens
gcagggggccccgcc

SEQ ID NO: 4396454 - DNA, 18 bp, Homo sapiens
gcagggggccccgccagg

SEQ ID NO: 4396455 - DNA, 18 bp, Homo sapiens
gcagggggccctgcccca

SEQ ID NO: 4396456 - DNA, 17 bp, Homo sapiens
gcaggggtcagagcact

SEQ ID NO: 4396457 - DNA, 22 bp, Homo sapiens
gcaggggtcagtgcagcagagg

SEQ ID NO: 4396458 - DNA, 12 bp, Homo sapiens
gcaggggtcccc

SEQ ID NO: 4396459 - DNA, 16 bp, Homo sapiens
gcaggggtctgagcca

SEQ ID NO: 4396460 - DNA, 23 bp, Homo sapiens
gcaggggtgggggtggaggcttc

SEQ ID NO: 4396461 - DNA, 21 bp, Homo sapiens
gcagggtcctcttctgggcct

SEQ ID NO: 4396462 - DNA, 17 bp, Homo sapiens
gcatcactagtgacaag

SEQ ID NO: 4396463 - DNA, 20 bp, Homo sapiens
gcatcagaaatcctctgtta

SEQ ID NO: 4396464 - DNA, 22 bp, Homo sapiens
gcatcagctgctgaaacaacaa

SEQ ID NO: 4396465 - DNA, 18 bp, Homo sapiens
gcatcagtatgtcactct

SEQ ID NO: 4396466 - DNA, 21 bp, Homo sapiens
gcatccagagtccctgcctgg

SEQ ID NO: 4396467 - DNA, 22 bp, Homo sapiens
gcatccagagtccctgcctgga

SEQ ID NO: 4396468 - DNA, 14 bp, Homo sapiens
gcatccagcagcag

SEQ ID NO: 4396469 - DNA, 18 bp, Homo sapiens
gcatccagcagcagcact

SEQ ID NO: 4396470 - DNA, 11 bp, Homo sapiens
gcatccagcct

SEQ ID NO: 4396471 - DNA, 12 bp, Homo sapiens
gcatccaggctg

SEQ ID NO: 4396472 - DNA, 15 bp, Homo sapiens
gcatccattcctcag

SEQ ID NO: 4396473 - DNA, 18 bp, Homo sapiens
gcatccattcctcaggga

SEQ ID NO: 4396474 - DNA, 21 bp, Homo sapiens
gcatccattcctcagggacag

SEQ ID NO: 4396475 - DNA, 17 bp, Homo sapiens
gcatcccccctgctcag

SEQ ID NO: 4396476 - DNA, 13 bp, Homo sapiens
gcatccctggagc

SEQ ID NO: 4396477 - DNA, 19 bp, Homo sapiens
gcatccctggagcaggagc

SEQ ID NO: 4396478 - DNA, 20 bp, Homo sapiens
gcatccctggagcaggagcc

SEQ ID NO: 4396479 - DNA, 17 bp, Homo sapiens
gcatccgcaggtgctgg

SEQ ID NO: 4396480 - DNA, 21 bp, Homo sapiens
gcatcctgccttagagccagg

SEQ ID NO: 4396481 - DNA, 23 bp, Homo sapiens
gcatcctttagggttctgcctct

SEQ ID NO: 4396482 - DNA, 23 bp, Homo sapiens
gcatcgtcatgcacagtatttgt

SEQ ID NO: 4396483 - DNA, 20 bp, Homo sapiens
gcatcgtgtattccatatgt

SEQ ID NO: 4396484 - DNA, 14 bp, Homo sapiens
gcatctatctcatc

SEQ ID NO: 4396485 - DNA, 21 bp, Homo sapiens
gcatctcccagataatgtgaa

SEQ ID NO: 4396486 - DNA, 20 bp, Homo sapiens
gcatctcctcccgcccttcc

SEQ ID NO: 4396487 - DNA, 23 bp, Homo sapiens
gcatctctccccatatataaatt

SEQ ID NO: 4396488 - DNA, 17 bp, Homo sapiens
gcatctcttccccagag

SEQ ID NO: 4396489 - DNA, 19 bp, Homo sapiens
gcatctcttccccagagag

SEQ ID NO: 4396490 - DNA, 23 bp, Homo sapiens
gcatctcttccccagagaggcac

SEQ ID NO: 4396491 - DNA, 19 bp, Homo sapiens
gcatctgagtccagctccc

SEQ ID NO: 4396492 - DNA, 22 bp, Homo sapiens
gcatctttgccttgggctgctc

SEQ ID NO: 4396493 - DNA, 19 bp, Homo sapiens
gcatcttttctagagacac

SEQ ID NO: 4396494 - DNA, 14 bp, Homo sapiens
gcatgaataaaatt

SEQ ID NO: 4396495 - DNA, 20 bp, Homo sapiens
gcatgacataacagtgcagg

SEQ ID NO: 4396496 - DNA, 14 bp, Homo sapiens
gcatgatggagctg

SEQ ID NO: 4396497 - DNA, 17 bp, Homo sapiens
gcatgatttactcttag

SEQ ID NO: 4396498 - DNA, 23 bp, Homo sapiens
gcatgatttactcttagagatga

SEQ ID NO: 4396499 - DNA, 20 bp, Homo sapiens
gcatgattttaagaggcttt

SEQ ID NO: 4396500 - DNA, 12 bp, Homo sapiens
gcatgcaactaa

SEQ ID NO: 4396501 - DNA, 22 bp, Homo sapiens
gcatgcactgttccccctgtgc

SEQ ID NO: 4396502 - DNA, 16 bp, Homo sapiens
gcatgcattgaaaaat

SEQ ID NO: 4396503 - DNA, 21 bp, Homo sapiens
gcatgccaagtactaaagcac

SEQ ID NO: 4396504 - DNA, 23 bp, Homo sapiens
gcatgccgggcccctccatccac

SEQ ID NO: 4396505 - DNA, 22 bp, Homo sapiens
gcatgcctgtaatcccagaact

SEQ ID NO: 4396506 - DNA, 15 bp, Homo sapiens
gcatgcgcccgaggc

SEQ ID NO: 4396507 - DNA, 18 bp, Homo sapiens
gcatgcggcccagcccgg

SEQ ID NO: 4396508 - DNA, 13 bp, Homo sapiens
gcatgctctctgc

SEQ ID NO: 4396509 - DNA, 17 bp, Homo sapiens
gcatgctctctgcagcc

SEQ ID NO: 4396510 - DNA, 21 bp, Homo sapiens
gcatgctctctgcagccagcc

SEQ ID NO: 4396511 - DNA, 18 bp, Homo sapiens
gcatgcttaaattttaac

SEQ ID NO: 4396512 - DNA, 19 bp, Homo sapiens
gcatggaagtaattaaggt

SEQ ID NO: 4396513 - DNA, 20 bp, Homo sapiens
gcatggacatttagaagaaa

SEQ ID NO: 4396514 - DNA, 22 bp, Homo sapiens
gcatggagctgtcacctctcag

SEQ ID NO: 4396515 - DNA, 14 bp, Homo sapiens
gcatggatgcattt

SEQ ID NO: 4396516 - DNA, 17 bp, Homo sapiens
gcatggatgcatttcaa

SEQ ID NO: 4396517 - DNA, 22 bp, Homo sapiens
gcatggatgcatttcaaatgtt

SEQ ID NO: 4396518 - DNA, 13 bp, Homo sapiens
gcatgggctcgcc

SEQ ID NO: 4396519 - DNA, 16 bp, Homo sapiens
gcatggggccaggaaa

SEQ ID NO: 4396520 - DNA, 16 bp, Homo sapiens
gcatggtgcagggaga

SEQ ID NO: 4396521 - DNA, 16 bp, Homo sapiens
gcatggtttggagctg

SEQ ID NO: 4396522 - DNA, 22 bp, Homo sapiens
gcatgtagactgtgccagaggc

SEQ ID NO: 4396523 - DNA, 14 bp, Homo sapiens
gcatgtaggagaat

SEQ ID NO: 4396524 - DNA, 24 bp, Homo sapiens
gcatgtagtaacactaatatattt

SEQ ID NO: 4396525 - DNA, 17 bp, Homo sapiens
gcatgtcccacccaccc

SEQ ID NO: 4396526 - DNA, 19 bp, Homo sapiens
gcatgtcccacccacccgc

SEQ ID NO: 4396527 - DNA, 15 bp, Homo sapiens
gcatgtcttttaaaa

SEQ ID NO: 4396528 - DNA, 13 bp, Homo sapiens
gcatgtgatctcc

SEQ ID NO: 4396529 - DNA, 11 bp, Homo sapiens
gcatgtgtgcc

SEQ ID NO: 4396530 - DNA, 22 bp, Homo sapiens
gcatgtgttaatcttaatgtat

SEQ ID NO: 4396531 - DNA, 13 bp, Homo sapiens
gcatgttcctcct

SEQ ID NO: 4396532 - DNA, 18 bp, Homo sapiens
gcatgtttattctgttcc

SEQ ID NO: 4396533 - DNA, 15 bp, Homo sapiens
gcatgtttgaaatga

SEQ ID NO: 4396534 - DNA, 18 bp, Homo sapiens
gcatgtttgaaatgaggt

SEQ ID NO: 4396535 - DNA, 13 bp, Homo sapiens
gcatgttttaaaa

SEQ ID NO: 4396536 - DNA, 17 bp, Homo sapiens
gcattaactaaatgctc

SEQ ID NO: 4396537 - DNA, 18 bp, Homo sapiens
gcattaactaaatgctca

SEQ ID NO: 4396538 - DNA, 20 bp, Homo sapiens
gcattaactaaatgctcata

SEQ ID NO: 4396539 - DNA, 21 bp, Homo sapiens
gcattacccccaacctcattt

SEQ ID NO: 4396540 - DNA, 18 bp, Homo sapiens
gcattatataccctggtg

SEQ ID NO: 4396541 - DNA, 18 bp, Homo sapiens
gcattatccttttatctc

SEQ ID NO: 4396542 - DNA, 18 bp, Homo sapiens
gcattattaaattgtaaa

SEQ ID NO: 4396543 - DNA, 19 bp, Homo sapiens
gcattcacatttagaaaag

SEQ ID NO: 4396544 - DNA, 23 bp, Homo sapiens
gcattcaggcagcactgacaata

SEQ ID NO: 4396545 - DNA, 16 bp, Homo sapiens
gcattccagacttcaa

SEQ ID NO: 4396546 - DNA, 18 bp, Homo sapiens
gcattccagctctgcccc

SEQ ID NO: 4396547 - DNA, 16 bp, Homo sapiens
gcattcccagggacct

SEQ ID NO: 4396548 - DNA, 13 bp, Homo sapiens
gcattccctgagt

SEQ ID NO: 4396549 - DNA, 14 bp, Homo sapiens
gcattcctgtgccc

SEQ ID NO: 4396550 - DNA, 22 bp, Homo sapiens
gcattcgttgtgttttttaaga

SEQ ID NO: 4396551 - DNA, 23 bp, Homo sapiens
gcattcgttgtgttttttaagat

SEQ ID NO: 4396552 - DNA, 11 bp, Homo sapiens
gcattctttcc

SEQ ID NO: 4396553 - DNA, 21 bp, Homo sapiens
gcattgaacacaaactgtaaa

SEQ ID NO: 4396554 - DNA, 21 bp, Homo sapiens
gcattgaatggctatgttttt

SEQ ID NO: 4396555 - DNA, 17 bp, Homo sapiens
gcattgagcatattttc

SEQ ID NO: 4396556 - DNA, 20 bp, Homo sapiens
gcattgcctggccttcctgt

SEQ ID NO: 4396557 - DNA, 16 bp, Homo sapiens
gcattgctggactctg

SEQ ID NO: 4396558 - DNA, 18 bp, Homo sapiens
gcattggggggccgggca

SEQ ID NO: 4396559 - DNA, 21 bp, Homo sapiens
gcattggggttcctctgtaca

SEQ ID NO: 4396560 - DNA, 13 bp, Homo sapiens
gcattggtgactc

SEQ ID NO: 4396561 - DNA, 21 bp, Homo sapiens
gcattggtggcatcacagacc

SEQ ID NO: 4396562 - DNA, 10 bp, Homo sapiens
gcattgtaaa

SEQ ID NO: 4396563 - DNA, 12 bp, Homo sapiens
gcattgtaaata

SEQ ID NO: 4396564 - DNA, 20 bp, Homo sapiens
gcattgtatagatataatga

SEQ ID NO: 4396565 - DNA, 21 bp, Homo sapiens
gcattgtatagatataatgaa

SEQ ID NO: 4396566 - DNA, 13 bp, Homo sapiens
gcattgttgtaaa

SEQ ID NO: 4396567 - DNA, 23 bp, Homo sapiens
gcatttaatggcagctagtgcct

SEQ ID NO: 4396568 - DNA, 21 bp, Homo sapiens
gcatttaccactgtatatgca

SEQ ID NO: 4396569 - DNA, 14 bp, Homo sapiens
gcatttcaaatgtt

SEQ ID NO: 4396570 - DNA, 18 bp, Homo sapiens
gcatttcaggccagtgtg

SEQ ID NO: 4396571 - DNA, 23 bp, Homo sapiens
gcatttcatagcttcacaatgtt

SEQ ID NO: 4396572 - DNA, 15 bp, Homo sapiens
gcatttcattatgct

SEQ ID NO: 4396573 - DNA, 21 bp, Homo sapiens
gcatttcctatcacctatttc

SEQ ID NO: 4396574 - DNA, 20 bp, Homo sapiens
gcatttgataatgataaaac

SEQ ID NO: 4396575 - DNA, 21 bp, Homo sapiens
gcatttgataatgataaaaca

SEQ ID NO: 4396576 - DNA, 17 bp, Homo sapiens
gcatttgctaaggcagc

SEQ ID NO: 4396577 - DNA, 20 bp, Homo sapiens
gcatttgctaaggcagctga

SEQ ID NO: 4396578 - DNA, 22 bp, Homo sapiens
gcatttggtgagagtcaaagct

SEQ ID NO: 4396579 - DNA, 23 bp, Homo sapiens
gcatttgtctattctccagctga

SEQ ID NO: 4396580 - DNA, 21 bp, Homo sapiens
gcatttgtgctagaaattttc

SEQ ID NO: 4396581 - DNA, 22 bp, Homo sapiens
gcatttgtggtaatctacacca

SEQ ID NO: 4396582 - DNA, 15 bp, Homo sapiens
gcattttaagtaaaa

SEQ ID NO: 4396583 - DNA, 12 bp, Homo sapiens
gcattttataaa

SEQ ID NO: 4396584 - DNA, 22 bp, Homo sapiens
gcattttgggggtttttaatct

SEQ ID NO: 4396585 - DNA, 22 bp, Homo sapiens
gcattttgtaagttgaagcaaa

SEQ ID NO: 4396586 - DNA, 23 bp, Homo sapiens
gcatttttaaaactagcaactct

SEQ ID NO: 4396587 - DNA, 20 bp, Homo sapiens
gcatttttaaacttgaaata

SEQ ID NO: 4396588 - DNA, 21 bp, Homo sapiens
gcatttttaaacttgaaatat

SEQ ID NO: 4396589 - DNA, 19 bp, Homo sapiens
gcatttttatttcagattt

SEQ ID NO: 4396590 - DNA, 15 bp, Homo sapiens
gcatttttgttttga

SEQ ID NO: 4396591 - DNA, 18 bp, Homo sapiens
gcatttttgttttgaaag

SEQ ID NO: 4396592 - DNA, 23 bp, Homo sapiens
gcatttttttattagtagaaagt

SEQ ID NO: 4396593 - DNA, 19 bp, Homo sapiens
gccaaaacaagccaaagag

SEQ ID NO: 4396594 - DNA, 13 bp, Homo sapiens
gccaaaaggaaaa

SEQ ID NO: 4396595 - DNA, 18 bp, Homo sapiens
gccaaaataccagagcct

SEQ ID NO: 4396596 - DNA, 21 bp, Homo sapiens
gccaaaatcctgaactttctc

SEQ ID NO: 4396597 - DNA, 17 bp, Homo sapiens
gccaaaattcatttcta

SEQ ID NO: 4396598 - DNA, 14 bp, Homo sapiens
gccaaaccagcagg

SEQ ID NO: 4396599 - DNA, 17 bp, Homo sapiens
gccaaacccttgctttc

SEQ ID NO: 4396600 - DNA, 18 bp, Homo sapiens
gccaaacctcctgtcagt

SEQ ID NO: 4396601 - DNA, 13 bp, Homo sapiens
gccaaagaaatga

SEQ ID NO: 4396602 - DNA, 17 bp, Homo sapiens
gccaaagaaatgaacat

SEQ ID NO: 4396603 - DNA, 22 bp, Homo sapiens
gccaaagaaatgaacattccaa

SEQ ID NO: 4396604 - DNA, 23 bp, Homo sapiens
gccaaagagcctcccaccagagc

SEQ ID NO: 4396605 - DNA, 20 bp, Homo sapiens
gccaaagctagggtggccct

SEQ ID NO: 4396606 - DNA, 19 bp, Homo sapiens
gccaaaggttcagaaaatt

SEQ ID NO: 4396607 - DNA, 17 bp, Homo sapiens
gccaaagtacagaattt

SEQ ID NO: 4396608 - DNA, 16 bp, Homo sapiens
gccaaataatgtctct

SEQ ID NO: 4396609 - DNA, 21 bp, Homo sapiens
gccaaatttaaaactgttgga

SEQ ID NO: 4396610 - DNA, 21 bp, Homo sapiens
gccaacataagttaatagaaa

SEQ ID NO: 4396611 - DNA, 19 bp, Homo sapiens
gccaaccctgggctattgc

SEQ ID NO: 4396612 - DNA, 18 bp, Homo sapiens
gccaacctcaggctccta

SEQ ID NO: 4396613 - DNA, 20 bp, Homo sapiens
gccaactagcccctggggtg

SEQ ID NO: 4396614 - DNA, 18 bp, Homo sapiens
gccaactatgattattaa

SEQ ID NO: 4396615 - DNA, 17 bp, Homo sapiens
gccaactgccaggctgc

SEQ ID NO: 4396616 - DNA, 18 bp, Homo sapiens
gccaagaaaatgaaggga

SEQ ID NO: 4396617 - DNA, 16 bp, Homo sapiens
gccaagaagcagtggc

SEQ ID NO: 4396618 - DNA, 12 bp, Homo sapiens
gccaagactcct

SEQ ID NO: 4396619 - DNA, 19 bp, Homo sapiens
gccaagatcgcaccactgc

SEQ ID NO: 4396620 - DNA, 15 bp, Homo sapiens
gccaagattttcctc

SEQ ID NO: 4396621 - DNA, 12 bp, Homo sapiens
gccaagcctatc

SEQ ID NO: 4396622 - DNA, 15 bp, Homo sapiens
gccaaggacccaggc

SEQ ID NO: 4396623 - DNA, 18 bp, Homo sapiens
gccaaggacccaggcgct

SEQ ID NO: 4396624 - DNA, 14 bp, Homo sapiens
gccaaggaggcctg

SEQ ID NO: 4396625 - DNA, 18 bp, Homo sapiens
gccaaggaggcctgggga

SEQ ID NO: 4396626 - DNA, 14 bp, Homo sapiens
gccaaggaggtggg

SEQ ID NO: 4396627 - DNA, 21 bp, Homo sapiens
gccaaggccagagtggcctgg

SEQ ID NO: 4396628 - DNA, 19 bp, Homo sapiens
gccaaggctctcccctctc

SEQ ID NO: 4396629 - DNA, 16 bp, Homo sapiens
gccaaggctctctctg

SEQ ID NO: 4396630 - DNA, 14 bp, Homo sapiens
gccaagggaccagg

SEQ ID NO: 4396631 - DNA, 21 bp, Homo sapiens
gccaagggccgactaagagaa

SEQ ID NO: 4396632 - DNA, 16 bp, Homo sapiens
gccaagggctttgttt

SEQ ID NO: 4396633 - DNA, 19 bp, Homo sapiens
gccaagtaaacagggtacc

SEQ ID NO: 4396634 - DNA, 23 bp, Homo sapiens
gccaagtggccactggcatcgca

SEQ ID NO: 4396635 - DNA, 13 bp, Homo sapiens
gccaagtggggtg

SEQ ID NO: 4396636 - DNA, 23 bp, Homo sapiens
gccaagtgttttgtattttatag

SEQ ID NO: 4396637 - DNA, 18 bp, Homo sapiens
gccaatattaaatctgct

SEQ ID NO: 4396638 - DNA, 18 bp, Homo sapiens
gccaatgagtctgtaatt

SEQ ID NO: 4396639 - DNA, 18 bp, Homo sapiens
gccaattacttgaagtat

SEQ ID NO: 4396640 - DNA, 13 bp, Homo sapiens
gccaattcctata

SEQ ID NO: 4396641 - DNA, 17 bp, Homo sapiens
gccaattttggatgagc

SEQ ID NO: 4396642 - DNA, 20 bp, Homo sapiens
gccacaaaccaccaggactg

SEQ ID NO: 4396643 - DNA, 18 bp, Homo sapiens
gccacaaagccccccagc

SEQ ID NO: 4396644 - DNA, 19 bp, Homo sapiens
gccacaaagccccccagct

SEQ ID NO: 4396645 - DNA, 23 bp, Homo sapiens
gccacaaagccccccagctccca

SEQ ID NO: 4396646 - DNA, 16 bp, Homo sapiens
gccacaagctgcactg

SEQ ID NO: 4396647 - DNA, 21 bp, Homo sapiens
gccacaagctgcactgtgaac

SEQ ID NO: 4396648 - DNA, 21 bp, Homo sapiens
gccacaattatataaatcatt

SEQ ID NO: 4396649 - DNA, 14 bp, Homo sapiens
gccacacaggcagg

SEQ ID NO: 4396650 - DNA, 16 bp, Homo sapiens
gccacacaggcagggc

SEQ ID NO: 4396651 - DNA, 17 bp, Homo sapiens
gccacacaggcagggcc

SEQ ID NO: 4396652 - DNA, 18 bp, Homo sapiens
gccacacaggcagggcct

SEQ ID NO: 4396653 - DNA, 20 bp, Homo sapiens
gccacacaggcagggcctgg

SEQ ID NO: 4396654 - DNA, 17 bp, Homo sapiens
gccacacattgtgcttg

SEQ ID NO: 4396655 - DNA, 14 bp, Homo sapiens
gccacaccactgcc

SEQ ID NO: 4396656 - DNA, 15 bp, Homo sapiens
gccacaccactgcca

SEQ ID NO: 4396657 - DNA, 19 bp, Homo sapiens
gccacacccctctgctgca

SEQ ID NO: 4396658 - DNA, 22 bp, Homo sapiens
gccacacccctctgctgcaaca

SEQ ID NO: 4396659 - DNA, 14 bp, Homo sapiens
gccacacggaagca

SEQ ID NO: 4396660 - DNA, 16 bp, Homo sapiens
gccacacggaagcaag

SEQ ID NO: 4396661 - DNA, 12 bp, Homo sapiens
gccacactgggg

SEQ ID NO: 4396662 - DNA, 14 bp, Homo sapiens
gccacactggggct

SEQ ID NO: 4396663 - DNA, 15 bp, Homo sapiens
gccacactggggctg

SEQ ID NO: 4396664 - DNA, 15 bp, Homo sapiens
gccacagagaacctg

SEQ ID NO: 4396665 - DNA, 12 bp, Homo sapiens
gccacagaggcc

SEQ ID NO: 4396666 - DNA, 16 bp, Homo sapiens
gccacagaggccccac

SEQ ID NO: 4396667 - DNA, 18 bp, Homo sapiens
gccacagaggccccacct

SEQ ID NO: 4396668 - DNA, 15 bp, Homo sapiens
gccacagcagcattt

SEQ ID NO: 4396669 - DNA, 16 bp, Homo sapiens
gccacagcagcatttt

SEQ ID NO: 4396670 - DNA, 13 bp, Homo sapiens
gccacagccagag

SEQ ID NO: 4396671 - DNA, 16 bp, Homo sapiens
gccacagccagggctc

SEQ ID NO: 4396672 - DNA, 15 bp, Homo sapiens
gccacagctgctgga

SEQ ID NO: 4396673 - DNA, 16 bp, Homo sapiens
gccacagctgctgttc

SEQ ID NO: 4396674 - DNA, 17 bp, Homo sapiens
gccacagctgctgttct

SEQ ID NO: 4396675 - DNA, 18 bp, Homo sapiens
gccacagctgctgttctc

SEQ ID NO: 4396676 - DNA, 19 bp, Homo sapiens
gccacagctgctgttctca

SEQ ID NO: 4396677 - DNA, 21 bp, Homo sapiens
gccacaggcaggtcacagaaa

SEQ ID NO: 4396678 - DNA, 15 bp, Homo sapiens
gccacaggccaaatc

SEQ ID NO: 4396679 - DNA, 18 bp, Homo sapiens
gccacaggccaaatcctt

SEQ ID NO: 4396680 - DNA, 23 bp, Homo sapiens
gccacaggcctgagatttcatct

SEQ ID NO: 4396681 - DNA, 18 bp, Homo sapiens
gccacagggaagctcaca

SEQ ID NO: 4396682 - DNA, 15 bp, Homo sapiens
gccacagtagaactg

SEQ ID NO: 4396683 - DNA, 18 bp, Homo sapiens
gccacagtagtcttgatg

SEQ ID NO: 4396684 - DNA, 16 bp, Homo sapiens
gccacatacttgcagc

SEQ ID NO: 4396685 - DNA, 17 bp, Homo sapiens
gccacatgccccaggct

SEQ ID NO: 4396686 - DNA, 20 bp, Homo sapiens
gccacatggtgtctcccaac

SEQ ID NO: 4396687 - DNA, 23 bp, Homo sapiens
gccacatggtgtctcccaacatg

SEQ ID NO: 4396688 - DNA, 22 bp, Homo sapiens
gccacatttggaatactttttg

SEQ ID NO: 4396689 - DNA, 14 bp, Homo sapiens
gccaccaagaggga

SEQ ID NO: 4396690 - DNA, 19 bp, Homo sapiens
gccaccaagagggacgcct

SEQ ID NO: 4396691 - DNA, 14 bp, Homo sapiens
gccaccagccatcc

SEQ ID NO: 4396692 - DNA, 12 bp, Homo sapiens
gccaccagcccc

SEQ ID NO: 4396693 - DNA, 21 bp, Homo sapiens
gccaccaggtgcctttcaaat

SEQ ID NO: 4396694 - DNA, 13 bp, Homo sapiens
gccaccagttctc

SEQ ID NO: 4396695 - DNA, 20 bp, Homo sapiens
gccaccatgcttgcctgaag

SEQ ID NO: 4396696 - DNA, 22 bp, Homo sapiens
gccaccatgcttgcctgaagct

SEQ ID NO: 4396697 - DNA, 18 bp, Homo sapiens
gccacccaagcctgctgg

SEQ ID NO: 4396698 - DNA, 19 bp, Homo sapiens
gccacccaagcctgctggc

SEQ ID NO: 4396699 - DNA, 20 bp, Homo sapiens
gccacccaagcctgctggct

SEQ ID NO: 4396700 - DNA, 23 bp, Homo sapiens
gccaccccaaaccccagccccaa

SEQ ID NO: 4396701 - DNA, 18 bp, Homo sapiens
gccaccccaccctccctg

SEQ ID NO: 4396702 - DNA, 18 bp, Homo sapiens
gccaccccgggctctctg

SEQ ID NO: 4396703 - DNA, 19 bp, Homo sapiens
gccaccccgggctctctgc

SEQ ID NO: 4396704 - DNA, 21 bp, Homo sapiens
gccaccccgggctctctgctg

SEQ ID NO: 4396705 - DNA, 20 bp, Homo sapiens
gccacccctaaactccaggg

SEQ ID NO: 4396706 - DNA, 20 bp, Homo sapiens
gccacccgtggggtgctgcc

SEQ ID NO: 4396707 - DNA, 16 bp, Homo sapiens
gccaccgccttgccca

SEQ ID NO: 4396708 - DNA, 20 bp, Homo sapiens
gccaccgccttgcccagcct

SEQ ID NO: 4396709 - DNA, 15 bp, Homo sapiens
gccaccggcctgtgg

SEQ ID NO: 4396710 - DNA, 22 bp, Homo sapiens
gccaccggcctgtgggtctctg

SEQ ID NO: 4396711 - DNA, 18 bp, Homo sapiens
gccaccgtgcctggccag

SEQ ID NO: 4396712 - DNA, 21 bp, Homo sapiens
gccacctagactctccctgta

SEQ ID NO: 4396713 - DNA, 11 bp, Homo sapiens
gccacctcccc

SEQ ID NO: 4396714 - DNA, 13 bp, Homo sapiens
gccacctccccta

SEQ ID NO: 4396715 - DNA, 12 bp, Homo sapiens
gccacctgcaag

SEQ ID NO: 4396716 - DNA, 13 bp, Homo sapiens
gccacctgcaaga

SEQ ID NO: 4396717 - DNA, 13 bp, Homo sapiens
gccacctggatct

SEQ ID NO: 4396718 - DNA, 14 bp, Homo sapiens
gccaccttgttaca

SEQ ID NO: 4396719 - DNA, 16 bp, Homo sapiens
gccacctttcaccctc

SEQ ID NO: 4396720 - DNA, 23 bp, Homo sapiens
gccacctttgtgcagcttcgagg

SEQ ID NO: 4396721 - DNA, 14 bp, Homo sapiens
gccacgccctccct

SEQ ID NO: 4396722 - DNA, 15 bp, Homo sapiens
gccacgccggccaca

SEQ ID NO: 4396723 - DNA, 19 bp, Homo sapiens
gccacgccggccacacccc

SEQ ID NO: 4396724 - DNA, 17 bp, Homo sapiens
gccacgctccagctgcc

SEQ ID NO: 4396725 - DNA, 18 bp, Homo sapiens
gccacgtcccagcatccc

SEQ ID NO: 4396726 - DNA, 21 bp, Homo sapiens
gccacgtcccagcatccctgg

SEQ ID NO: 4396727 - DNA, 18 bp, Homo sapiens
gatatgcatgtagcatat

SEQ ID NO: 4396728 - DNA, 20 bp, Homo sapiens
gatatgcatgtagcatataa

SEQ ID NO: 4396729 - DNA, 19 bp, Homo sapiens
gatatggagaattgctgaa

SEQ ID NO: 4396730 - DNA, 15 bp, Homo sapiens
gatatggctgcccag

SEQ ID NO: 4396731 - DNA, 19 bp, Homo sapiens
gatatggctgcccaggaga

SEQ ID NO: 4396732 - DNA, 17 bp, Homo sapiens
gatatgtaaaacattta

SEQ ID NO: 4396733 - DNA, 22 bp, Homo sapiens
gatatgtctgctgagttggcct

SEQ ID NO: 4396734 - DNA, 15 bp, Homo sapiens
gatattatagaaaat

SEQ ID NO: 4396735 - DNA, 18 bp, Homo sapiens
gatattatattaaacata

SEQ ID NO: 4396736 - DNA, 20 bp, Homo sapiens
gatattccccccacttaaga

SEQ ID NO: 4396737 - DNA, 21 bp, Homo sapiens
gatattctaagaaatatctgt

SEQ ID NO: 4396738 - DNA, 14 bp, Homo sapiens
gatattctcctcgg

SEQ ID NO: 4396739 - DNA, 21 bp, Homo sapiens
gatattgaaggagaaaataga

SEQ ID NO: 4396740 - DNA, 21 bp, Homo sapiens
gatattgccttatttgtctgt

SEQ ID NO: 4396741 - DNA, 21 bp, Homo sapiens
gatattgctactataatcaaa

SEQ ID NO: 4396742 - DNA, 15 bp, Homo sapiens
gatattggaacttgc

SEQ ID NO: 4396743 - DNA, 17 bp, Homo sapiens
gatattgttataaataa

SEQ ID NO: 4396744 - DNA, 18 bp, Homo sapiens
gatattgttataaataaa

SEQ ID NO: 4396745 - DNA, 13 bp, Homo sapiens
gatatttcttgct

SEQ ID NO: 4396746 - DNA, 12 bp, Homo sapiens
gatatttttgta

SEQ ID NO: 4396747 - DNA, 18 bp, Homo sapiens
gatcaaagatgaaaagta

SEQ ID NO: 4396748 - DNA, 17 bp, Homo sapiens
gatcaacatcttttctt

SEQ ID NO: 4396749 - DNA, 13 bp, Homo sapiens
gatcaagtattac

SEQ ID NO: 4396750 - DNA, 19 bp, Homo sapiens
gatcaagttgttgactgtg

SEQ ID NO: 4396751 - DNA, 19 bp, Homo sapiens
gatcaatatttttatatca

SEQ ID NO: 4396752 - DNA, 14 bp, Homo sapiens
gatcaatcctttat

SEQ ID NO: 4396753 - DNA, 11 bp, Homo sapiens
gatcaatttgt

SEQ ID NO: 4396754 - DNA, 13 bp, Homo sapiens
gatcacacagtgt

SEQ ID NO: 4396755 - DNA, 14 bp, Homo sapiens
gatcacacagtgtt

SEQ ID NO: 4396756 - DNA, 21 bp, Homo sapiens
gatcacacagtgttagtgctg

SEQ ID NO: 4396757 - DNA, 13 bp, Homo sapiens
gatcacatctaaa

SEQ ID NO: 4396758 - DNA, 19 bp, Homo sapiens
gatcacatcttaaattcat

SEQ ID NO: 4396759 - DNA, 23 bp, Homo sapiens
gatcacgccattgtactccagcc

SEQ ID NO: 4396760 - DNA, 16 bp, Homo sapiens
gatcagaggagtaaat

SEQ ID NO: 4396761 - DNA, 23 bp, Homo sapiens
gatcagatgctgaattgagaata

SEQ ID NO: 4396762 - DNA, 18 bp, Homo sapiens
gatcagccccgcctgtca

SEQ ID NO: 4396763 - DNA, 21 bp, Homo sapiens
gatcagccccgcctgtcacaa

SEQ ID NO: 4396764 - DNA, 17 bp, Homo sapiens
gatcaggctagccctgc

SEQ ID NO: 4396765 - DNA, 23 bp, Homo sapiens
gatcaggtctttactgaatgtta

SEQ ID NO: 4396766 - DNA, 15 bp, Homo sapiens
gatcatagctcactg

SEQ ID NO: 4396767 - DNA, 17 bp, Homo sapiens
gatcatagctcactgca

SEQ ID NO: 4396768 - DNA, 20 bp, Homo sapiens
gatcatagctcactgcagcc

SEQ ID NO: 4396769 - DNA, 21 bp, Homo sapiens
gatcatcaacaagatttcctt

SEQ ID NO: 4396770 - DNA, 20 bp, Homo sapiens
gatcatgtactttttagtaa

SEQ ID NO: 4396771 - DNA, 18 bp, Homo sapiens
gatcattttccccccact

SEQ ID NO: 4396772 - DNA, 19 bp, Homo sapiens
gatccaaattgtgcttctc

SEQ ID NO: 4396773 - DNA, 19 bp, Homo sapiens
gatccaactaatgccttac

SEQ ID NO: 4396774 - DNA, 17 bp, Homo sapiens
gatccacgctgggccta

SEQ ID NO: 4396775 - DNA, 13 bp, Homo sapiens
gatccagaaatac

SEQ ID NO: 4396776 - DNA, 13 bp, Homo sapiens
gatccagaagagc

SEQ ID NO: 4396777 - DNA, 19 bp, Homo sapiens
gatccagagagcagctccc

SEQ ID NO: 4396778 - DNA, 16 bp, Homo sapiens
gatccatgtagcagga

SEQ ID NO: 4396779 - DNA, 12 bp, Homo sapiens
gatcccaacact

SEQ ID NO: 4396780 - DNA, 18 bp, Homo sapiens
gatcccaacactgccagc

SEQ ID NO: 4396781 - DNA, 15 bp, Homo sapiens
gatcccatgagctcc

SEQ ID NO: 4396782 - DNA, 22 bp, Homo sapiens
gatccccaactgctccagcctc

SEQ ID NO: 4396783 - DNA, 15 bp, Homo sapiens
gatccccagcccctc

SEQ ID NO: 4396784 - DNA, 18 bp, Homo sapiens
gatccctcatctgtccct

SEQ ID NO: 4396785 - DNA, 12 bp, Homo sapiens
gatcctaaactc

SEQ ID NO: 4396786 - DNA, 15 bp, Homo sapiens
gatcctaaactctct

SEQ ID NO: 4396787 - DNA, 17 bp, Homo sapiens
gatcctaaatatgacag

SEQ ID NO: 4396788 - DNA, 12 bp, Homo sapiens
gatcctaagaat

SEQ ID NO: 4396789 - DNA, 19 bp, Homo sapiens
gatcctctcacctcagcct

SEQ ID NO: 4396790 - DNA, 15 bp, Homo sapiens
gatcctgctgctttg

SEQ ID NO: 4396791 - DNA, 18 bp, Homo sapiens
gatcctggattcactcac

SEQ ID NO: 4396792 - DNA, 16 bp, Homo sapiens
gatccttcaaagtctc

SEQ ID NO: 4396793 - DNA, 16 bp, Homo sapiens
gatcgagaccatcctg

SEQ ID NO: 4396794 - DNA, 14 bp, Homo sapiens
gatcgcgttagcca

SEQ ID NO: 4396795 - DNA, 23 bp, Homo sapiens
gatcgctgcacatggcctgagca

SEQ ID NO: 4396796 - DNA, 16 bp, Homo sapiens
gatcggactctgcccc

SEQ ID NO: 4396797 - DNA, 18 bp, Homo sapiens
gatcgtctgactggtgtt

SEQ ID NO: 4396798 - DNA, 22 bp, Homo sapiens
gatcgtgctactgcactccagc

SEQ ID NO: 4396799 - DNA, 12 bp, Homo sapiens
gatctacacatg

SEQ ID NO: 4396800 - DNA, 16 bp, Homo sapiens
gatctcacaggctgag

SEQ ID NO: 4396801 - DNA, 11 bp, Homo sapiens
gatctcagcca

SEQ ID NO: 4396802 - DNA, 13 bp, Homo sapiens
gatctccctgccg

SEQ ID NO: 4396803 - DNA, 15 bp, Homo sapiens
gatctcctgaccttg

SEQ ID NO: 4396804 - DNA, 14 bp, Homo sapiens
gatctcggtttgcc

SEQ ID NO: 4396805 - DNA, 13 bp, Homo sapiens
gatctctcttgtc

SEQ ID NO: 4396806 - DNA, 16 bp, Homo sapiens
gatctctcttgtcctc

SEQ ID NO: 4396807 - DNA, 18 bp, Homo sapiens
gatctctcttgtcctctt

SEQ ID NO: 4396808 - DNA, 20 bp, Homo sapiens
gatctctcttgtcctcttct

SEQ ID NO: 4396809 - DNA, 20 bp, Homo sapiens
gatctctgctccctgcaagc

SEQ ID NO: 4396810 - DNA, 22 bp, Homo sapiens
gatctctgggatttatgctcat

SEQ ID NO: 4396811 - DNA, 16 bp, Homo sapiens
gatctgcacagtcaga

SEQ ID NO: 4396812 - DNA, 13 bp, Homo sapiens
gatctggctgcag

SEQ ID NO: 4396813 - DNA, 21 bp, Homo sapiens
gatctgggcattttcctcctc

SEQ ID NO: 4396814 - DNA, 18 bp, Homo sapiens
gatctgtcacaccagcca

SEQ ID NO: 4396815 - DNA, 19 bp, Homo sapiens
gatctgtcacaccagccat

SEQ ID NO: 4396816 - DNA, 20 bp, Homo sapiens
gatctgtcacaccagccata

SEQ ID NO: 4396817 - DNA, 15 bp, Homo sapiens
gatctgtctgtgcac

SEQ ID NO: 4396818 - DNA, 20 bp, Homo sapiens
gatctgtctgtgcacatgcc

SEQ ID NO: 4396819 - DNA, 15 bp, Homo sapiens
gatctgttttacagg

SEQ ID NO: 4396820 - DNA, 19 bp, Homo sapiens
gatctgttttacaggaaac

SEQ ID NO: 4396821 - DNA, 18 bp, Homo sapiens
gatctgttttgaaggcaa

SEQ ID NO: 4396822 - DNA, 16 bp, Homo sapiens
gatcttaatataaatt

SEQ ID NO: 4396823 - DNA, 18 bp, Homo sapiens
gatcttagggatgattaa

SEQ ID NO: 4396824 - DNA, 23 bp, Homo sapiens
gatcttagggatgattaaaggca

SEQ ID NO: 4396825 - DNA, 17 bp, Homo sapiens
gatcttcagaactgccc

SEQ ID NO: 4396826 - DNA, 18 bp, Homo sapiens
gatcttcagaactgccct

SEQ ID NO: 4396827 - DNA, 19 bp, Homo sapiens
gatcttcagaactgccctt

SEQ ID NO: 4396828 - DNA, 20 bp, Homo sapiens
gatcttcagaactgcccttg

SEQ ID NO: 4396829 - DNA, 21 bp, Homo sapiens
gatcttcagaactgcccttgc

SEQ ID NO: 4396830 - DNA, 14 bp, Homo sapiens
gatctttaaaatac

SEQ ID NO: 4396831 - DNA, 19 bp, Homo sapiens
gatctttctttccaaaaca

SEQ ID NO: 4396832 - DNA, 13 bp, Homo sapiens
gatctttgagccc

SEQ ID NO: 4396833 - DNA, 15 bp, Homo sapiens
gatctttgagcccat

SEQ ID NO: 4396834 - DNA, 20 bp, Homo sapiens
gatctttgtttaaatgccaa

SEQ ID NO: 4396835 - DNA, 19 bp, Homo sapiens
gatgaaaaaaagggaaaac

SEQ ID NO: 4396836 - DNA, 23 bp, Homo sapiens
gatgaaaagtatattgataacct

SEQ ID NO: 4396837 - DNA, 20 bp, Homo sapiens
gatgaaactggttcctacat

SEQ ID NO: 4396838 - DNA, 13 bp, Homo sapiens
gatgaaataattt

SEQ ID NO: 4396839 - DNA, 14 bp, Homo sapiens
gatgaacaatgtat

SEQ ID NO: 4396840 - DNA, 15 bp, Homo sapiens
gatgaacatattcat

SEQ ID NO: 4396841 - DNA, 16 bp, Homo sapiens
gatgaagttttacatt

SEQ ID NO: 4396842 - DNA, 14 bp, Homo sapiens
gatgaatgtactat

SEQ ID NO: 4396843 - DNA, 16 bp, Homo sapiens
gatgacaccctggcct

SEQ ID NO: 4396844 - DNA, 20 bp, Homo sapiens
gatgacaggcgcctgccatc

SEQ ID NO: 4396845 - DNA, 19 bp, Homo sapiens
gatgtcttaacctcaggga

SEQ ID NO: 4396846 - DNA, 16 bp, Homo sapiens
gagtgtcctgcccatg

SEQ ID NO: 4396847 - DNA, 19 bp, Homo sapiens
gagtgtcctgcccatgccc

SEQ ID NO: 4396848 - DNA, 19 bp, Homo sapiens
gagtgtcttaattaaaaga

SEQ ID NO: 4396849 - DNA, 13 bp, Homo sapiens
gagtgtctttcca

SEQ ID NO: 4396850 - DNA, 15 bp, Homo sapiens
gagtgtctttccacg

SEQ ID NO: 4396851 - DNA, 18 bp, Homo sapiens
gagtgtgggggaggcgca

SEQ ID NO: 4396852 - DNA, 16 bp, Homo sapiens
gagtgtgtgtttgtgt

SEQ ID NO: 4396853 - DNA, 22 bp, Homo sapiens
gagtgtgtttgtgtgcatgaaa

SEQ ID NO: 4396854 - DNA, 13 bp, Homo sapiens
gagttaagtctat

SEQ ID NO: 4396855 - DNA, 21 bp, Homo sapiens
gagttagaaccacagcagaca

SEQ ID NO: 4396856 - DNA, 14 bp, Homo sapiens
gagttatcaggtgc

SEQ ID NO: 4396857 - DNA, 17 bp, Homo sapiens
gagttatcttctttatt

SEQ ID NO: 4396858 - DNA, 17 bp, Homo sapiens
gagttattttttgtatt

SEQ ID NO: 4396859 - DNA, 17 bp, Homo sapiens
gagttcaagaccagcct

SEQ ID NO: 4396860 - DNA, 18 bp, Homo sapiens
gagttcaagcctgtggga

SEQ ID NO: 4396861 - DNA, 15 bp, Homo sapiens
gagttcccaagaaag

SEQ ID NO: 4396862 - DNA, 17 bp, Homo sapiens
gagttcccgggagctgg

SEQ ID NO: 4396863 - DNA, 18 bp, Homo sapiens
gagttcccgggagctggg

SEQ ID NO: 4396864 - DNA, 20 bp, Homo sapiens
gagttcccgggagctgggcc

SEQ ID NO: 4396865 - DNA, 12 bp, Homo sapiens
gagttctgctga

SEQ ID NO: 4396866 - DNA, 14 bp, Homo sapiens
gagttcttgttttt

SEQ ID NO: 4396867 - DNA, 22 bp, Homo sapiens
gagttctttgctgcccctgtct

SEQ ID NO: 4396868 - DNA, 14 bp, Homo sapiens
gagttgcatgtttt

SEQ ID NO: 4396869 - DNA, 20 bp, Homo sapiens
gagttgggggtgtggctctg

SEQ ID NO: 4396870 - DNA, 21 bp, Homo sapiens
gagttgggggtgtggctctgc

SEQ ID NO: 4396871 - DNA, 15 bp, Homo sapiens
gagttgttgccctgg

SEQ ID NO: 4396872 - DNA, 22 bp, Homo sapiens
gagttgttttcagactcagact

SEQ ID NO: 4396873 - DNA, 20 bp, Homo sapiens
gagtttattacaatgtatct

SEQ ID NO: 4396874 - DNA, 15 bp, Homo sapiens
gagtttcatgtacaa

SEQ ID NO: 4396875 - DNA, 15 bp, Homo sapiens
gagtttcctaaaagt

SEQ ID NO: 4396876 - DNA, 23 bp, Homo sapiens
gagtttctggtaagactgctggt

SEQ ID NO: 4396877 - DNA, 12 bp, Homo sapiens
gagtttctgttt

SEQ ID NO: 4396878 - DNA, 13 bp, Homo sapiens
gagtttctgtttg

SEQ ID NO: 4396879 - DNA, 14 bp, Homo sapiens
gagtttctgtttga

SEQ ID NO: 4396880 - DNA, 22 bp, Homo sapiens
gagtttgggctggagctcctcc

SEQ ID NO: 4396881 - DNA, 15 bp, Homo sapiens
gagtttgtattatta

SEQ ID NO: 4396882 - DNA, 18 bp, Homo sapiens
gagttttaacaatccatt

SEQ ID NO: 4396883 - DNA, 15 bp, Homo sapiens
gagttttactgcctg

SEQ ID NO: 4396884 - DNA, 18 bp, Homo sapiens
gagttttattcctttcct

SEQ ID NO: 4396885 - DNA, 16 bp, Homo sapiens
gagtttttaatagaac

SEQ ID NO: 4396886 - DNA, 19 bp, Homo sapiens
gagtttttatggggctgaa

SEQ ID NO: 4396887 - DNA, 15 bp, Homo sapiens
gagtttttcctccca

SEQ ID NO: 4396888 - DNA, 19 bp, Homo sapiens
gagtttttgtttggagagc

SEQ ID NO: 4396889 - DNA, 16 bp, Homo sapiens
gataaaaataaagctg

SEQ ID NO: 4396890 - DNA, 22 bp, Homo sapiens
gataaaaggtggagtttctctg

SEQ ID NO: 4396891 - DNA, 16 bp, Homo sapiens
gataaacaacaaggtg

SEQ ID NO: 4396892 - DNA, 22 bp, Homo sapiens
gataaacacaaaatccattcca

SEQ ID NO: 4396893 - DNA, 12 bp, Homo sapiens
gataaacataat

SEQ ID NO: 4396894 - DNA, 16 bp, Homo sapiens
gataaaccaataaatc

SEQ ID NO: 4396895 - DNA, 14 bp, Homo sapiens
gataaagagacagt

SEQ ID NO: 4396896 - DNA, 22 bp, Homo sapiens
gataaatagtttatgattccac

SEQ ID NO: 4396897 - DNA, 19 bp, Homo sapiens
gataaatcataaagtcagt

SEQ ID NO: 4396898 - DNA, 15 bp, Homo sapiens
gataaatgatagaca

SEQ ID NO: 4396899 - DNA, 16 bp, Homo sapiens
gataacaacctggaga

SEQ ID NO: 4396900 - DNA, 18 bp, Homo sapiens
gataacaagcaaggatat

SEQ ID NO: 4396901 - DNA, 17 bp, Homo sapiens
gataacccttattccat

SEQ ID NO: 4396902 - DNA, 16 bp, Homo sapiens
gataaccttgtttatt

SEQ ID NO: 4396903 - DNA, 19 bp, Homo sapiens
gataaccttgtttattagc

SEQ ID NO: 4396904 - DNA, 22 bp, Homo sapiens
gataacttcttgaaaaagatgg

SEQ ID NO: 4396905 - DNA, 16 bp, Homo sapiens
gataacttggggaggc

SEQ ID NO: 4396906 - DNA, 16 bp, Homo sapiens
gataactttacagaaa

SEQ ID NO: 4396907 - DNA, 21 bp, Homo sapiens
gataagacattttgtttttac

SEQ ID NO: 4396908 - DNA, 17 bp, Homo sapiens
gataataatattgtttt

SEQ ID NO: 4396909 - DNA, 18 bp, Homo sapiens
gataataatattgttttt

SEQ ID NO: 4396910 - DNA, 19 bp, Homo sapiens
gataataatattgtttttc

SEQ ID NO: 4396911 - DNA, 20 bp, Homo sapiens
gataataatattgtttttct

SEQ ID NO: 4396912 - DNA, 18 bp, Homo sapiens
gataatgccaccaaagga

SEQ ID NO: 4396913 - DNA, 22 bp, Homo sapiens
gataatgttcattttgaaaata

SEQ ID NO: 4396914 - DNA, 16 bp, Homo sapiens
gataattagcagttta

SEQ ID NO: 4396915 - DNA, 22 bp, Homo sapiens
gataatttagtggattaaccag

SEQ ID NO: 4396916 - DNA, 12 bp, Homo sapiens
gataattttaaa

SEQ ID NO: 4396917 - DNA, 12 bp, Homo sapiens
gataattttgaa

SEQ ID NO: 4396918 - DNA, 11 bp, Homo sapiens
gataatttttc

SEQ ID NO: 4396919 - DNA, 20 bp, Homo sapiens
gatacaacttcaagtgcatg

SEQ ID NO: 4396920 - DNA, 23 bp, Homo sapiens
gatacaaggcccagaagcctgat

SEQ ID NO: 4396921 - DNA, 11 bp, Homo sapiens
gatacaataaa

SEQ ID NO: 4396922 - DNA, 12 bp, Homo sapiens
gatacaataaat

SEQ ID NO: 4396923 - DNA, 18 bp, Homo sapiens
gatacactcaagcatgaa

SEQ ID NO: 4396924 - DNA, 19 bp, Homo sapiens
gatacagctgagtgggaac

SEQ ID NO: 4396925 - DNA, 13 bp, Homo sapiens
gatacatttttat

SEQ ID NO: 4396926 - DNA, 20 bp, Homo sapiens
gataccagcagcaactgaaa

SEQ ID NO: 4396927 - DNA, 22 bp, Homo sapiens
gataccagcgaggaggctccag

SEQ ID NO: 4396928 - DNA, 22 bp, Homo sapiens
gataccataaaaagaggatgat

SEQ ID NO: 4396929 - DNA, 16 bp, Homo sapiens
gatacccaacagttta

SEQ ID NO: 4396930 - DNA, 23 bp, Homo sapiens
gatacccaacagtttatttttat

SEQ ID NO: 4396931 - DNA, 12 bp, Homo sapiens
gatacctggagc

SEQ ID NO: 4396932 - DNA, 20 bp, Homo sapiens
gataccttcttatttaatct

SEQ ID NO: 4396933 - DNA, 22 bp, Homo sapiens
gatacctttccccaaatagcct

SEQ ID NO: 4396934 - DNA, 23 bp, Homo sapiens
gatactccgctgtcggcacattc

SEQ ID NO: 4396935 - DNA, 23 bp, Homo sapiens
gatactgaaatgtgaaaagagca

SEQ ID NO: 4396936 - DNA, 17 bp, Homo sapiens
gatactgattatgaaat

SEQ ID NO: 4396937 - DNA, 17 bp, Homo sapiens
gatactgcaactttaaa

SEQ ID NO: 4396938 - DNA, 19 bp, Homo sapiens
gatacttgaaaccagtatt

SEQ ID NO: 4396939 - DNA, 20 bp, Homo sapiens
gatacttggatttagtttca

SEQ ID NO: 4396940 - DNA, 23 bp, Homo sapiens
gatacttggatttagtttcagta

SEQ ID NO: 4396941 - DNA, 15 bp, Homo sapiens
gatagagcaaagcat

SEQ ID NO: 4396942 - DNA, 14 bp, Homo sapiens
gatagaggggctgc

SEQ ID NO: 4396943 - DNA, 14 bp, Homo sapiens
gatagatgtgtgga

SEQ ID NO: 4396944 - DNA, 22 bp, Homo sapiens
gatagattttctgctactttgc

SEQ ID NO: 4396945 - DNA, 13 bp, Homo sapiens
gataggaaactga

SEQ ID NO: 4396946 - DNA, 23 bp, Homo sapiens
gatagtcttggaagctgtttgga

SEQ ID NO: 4396947 - DNA, 21 bp, Homo sapiens
gatagttgaatgttgcaatgt

SEQ ID NO: 4396948 - DNA, 16 bp, Homo sapiens
gatataactgtcttgt

SEQ ID NO: 4396949 - DNA, 20 bp, Homo sapiens
gatataactgtcttgtttca

SEQ ID NO: 4396950 - DNA, 20 bp, Homo sapiens
gatataagagggctttttaa

SEQ ID NO: 4396951 - DNA, 13 bp, Homo sapiens
gatataatgtgtg

SEQ ID NO: 4396952 - DNA, 13 bp, Homo sapiens
gatataccaaatt

SEQ ID NO: 4396953 - DNA, 16 bp, Homo sapiens
gatataccaaattaaa

SEQ ID NO: 4396954 - DNA, 17 bp, Homo sapiens
gatatactctagatgaa

SEQ ID NO: 4396955 - DNA, 14 bp, Homo sapiens
gatatactttgtgg

SEQ ID NO: 4396956 - DNA, 21 bp, Homo sapiens
gatatatgtgtatacatacat

SEQ ID NO: 4396957 - DNA, 13 bp, Homo sapiens
gatatatttgaaa

SEQ ID NO: 4396958 - DNA, 15 bp, Homo sapiens
gagcagtcgcctgcc

SEQ ID NO: 4396959 - DNA, 16 bp, Homo sapiens
gagcagtcgcctgcct

SEQ ID NO: 4396960 - DNA, 15 bp, Homo sapiens
gagcataaaacctaa

SEQ ID NO: 4396961 - DNA, 21 bp, Homo sapiens
gagcataataaatggatgagg

SEQ ID NO: 4396962 - DNA, 21 bp, Homo sapiens
gagcatacatcttaaatcttt

SEQ ID NO: 4396963 - DNA, 16 bp, Homo sapiens
gagcatcaatcttgtt

SEQ ID NO: 4396964 - DNA, 14 bp, Homo sapiens
gagcatgcacatgc

SEQ ID NO: 4396965 - DNA, 17 bp, Homo sapiens
gagcatggggccaggaa

SEQ ID NO: 4396966 - DNA, 13 bp, Homo sapiens
gagcatgggtgtg

SEQ ID NO: 4396967 - DNA, 15 bp, Homo sapiens
gagcatgtcgtggac

SEQ ID NO: 4396968 - DNA, 21 bp, Homo sapiens
gagcattaactaaatgctcat

SEQ ID NO: 4396969 - DNA, 18 bp, Homo sapiens
gagcattagaatggagga

SEQ ID NO: 4396970 - DNA, 15 bp, Homo sapiens
gagcatttctcatca

SEQ ID NO: 4396971 - DNA, 17 bp, Homo sapiens
gagccaaggaggcctgg

SEQ ID NO: 4396972 - DNA, 20 bp, Homo sapiens
gagccacaagctgcactgtg

SEQ ID NO: 4396973 - DNA, 21 bp, Homo sapiens
gagccacaagctgcactgtga

SEQ ID NO: 4396974 - DNA, 23 bp, Homo sapiens
gagccacaagctgcactgtgaac

SEQ ID NO: 4396975 - DNA, 16 bp, Homo sapiens
gagccacagcagcatt

SEQ ID NO: 4396976 - DNA, 17 bp, Homo sapiens
gagccacagcagcattt

SEQ ID NO: 4396977 - DNA, 15 bp, Homo sapiens
gagccacagtcactg

SEQ ID NO: 4396978 - DNA, 17 bp, Homo sapiens
gagccacagtcactgga

SEQ ID NO: 4396979 - DNA, 13 bp, Homo sapiens
gagccaccagttc

SEQ ID NO: 4396980 - DNA, 23 bp, Homo sapiens
gagccaccatgcttgcctgaagc

SEQ ID NO: 4396981 - DNA, 20 bp, Homo sapiens
gagccaccgtgcctggccag

SEQ ID NO: 4396982 - DNA, 12 bp, Homo sapiens
gagccacctcac

SEQ ID NO: 4396983 - DNA, 19 bp, Homo sapiens
gagccacctgcaagatgga

SEQ ID NO: 4396984 - DNA, 14 bp, Homo sapiens
gagccacctggatc

SEQ ID NO: 4396985 - DNA, 15 bp, Homo sapiens
gagccactcctctga

SEQ ID NO: 4396986 - DNA, 13 bp, Homo sapiens
gagccactccttc

SEQ ID NO: 4396987 - DNA, 21 bp, Homo sapiens
gagccactctatgagttggac

SEQ ID NO: 4396988 - DNA, 16 bp, Homo sapiens
gagccacttctcccca

SEQ ID NO: 4396989 - DNA, 19 bp, Homo sapiens
gagccacttctccccagaa

SEQ ID NO: 4396990 - DNA, 16 bp, Homo sapiens
gagccagactgtccag

SEQ ID NO: 4396991 - DNA, 15 bp, Homo sapiens
gagccagattacagg

SEQ ID NO: 4396992 - DNA, 19 bp, Homo sapiens
gagccagccctccctgtcc

SEQ ID NO: 4396993 - DNA, 21 bp, Homo sapiens
gagccagccctccctgtcctc

SEQ ID NO: 4396994 - DNA, 16 bp, Homo sapiens
gagccagcctggctct

SEQ ID NO: 4396995 - DNA, 19 bp, Homo sapiens
gagccagcggctccaactc

SEQ ID NO: 4396996 - DNA, 20 bp, Homo sapiens
gagccagcggctccaactcc

SEQ ID NO: 4396997 - DNA, 13 bp, Homo sapiens
gagccaggcacac

SEQ ID NO: 4396998 - DNA, 13 bp, Homo sapiens
gagccagggcagg

SEQ ID NO: 4396999 - DNA, 16 bp, Homo sapiens
gagccagggcagggcg

SEQ ID NO: 4397000 - DNA, 23 bp, Homo sapiens
gagccagtctttgaactgcagca

SEQ ID NO: 4397001 - DNA, 19 bp, Homo sapiens
gagccatactgcgtccacc

SEQ ID NO: 4397002 - DNA, 17 bp, Homo sapiens
gagccatcttggcaggg

SEQ ID NO: 4397003 - DNA, 18 bp, Homo sapiens
gagccatcttggcagggt

SEQ ID NO: 4397004 - DNA, 15 bp, Homo sapiens
gagccatttgtccca

SEQ ID NO: 4397005 - DNA, 16 bp, Homo sapiens
gagccatttgtcccaa

SEQ ID NO: 4397006 - DNA, 23 bp, Homo sapiens
gagccatttgtcccaagtgccaa

SEQ ID NO: 4397007 - DNA, 23 bp, Homo sapiens
gagcccagcctgggagcccagag

SEQ ID NO: 4397008 - DNA, 18 bp, Homo sapiens
gagcccagcgtcagaagt

SEQ ID NO: 4397009 - DNA, 14 bp, Homo sapiens
gagcccagctctga

SEQ ID NO: 4397010 - DNA, 19 bp, Homo sapiens
gagcccagtgaagcctctg

SEQ ID NO: 4397011 - DNA, 14 bp, Homo sapiens
gagcccattctcat

SEQ ID NO: 4397012 - DNA, 12 bp, Homo sapiens
gagccccacagc

SEQ ID NO: 4397013 - DNA, 20 bp, Homo sapiens
gagccccacagccccatctg

SEQ ID NO: 4397014 - DNA, 19 bp, Homo sapiens
gagccccagccccctttgg

SEQ ID NO: 4397015 - DNA, 14 bp, Homo sapiens
gagccccagggtct

SEQ ID NO: 4397016 - DNA, 17 bp, Homo sapiens
gagccccattcctggga

SEQ ID NO: 4397017 - DNA, 22 bp, Homo sapiens
gagcccccctagtggtatgggg

SEQ ID NO: 4397018 - DNA, 20 bp, Homo sapiens
gagcccctttgcctgtcaag

SEQ ID NO: 4397019 - DNA, 21 bp, Homo sapiens
gagcccctttgcctgtcaagt

SEQ ID NO: 4397020 - DNA, 17 bp, Homo sapiens
gagcccgatattctccc

SEQ ID NO: 4397021 - DNA, 16 bp, Homo sapiens
gagccctgactcctgg

SEQ ID NO: 4397022 - DNA, 13 bp, Homo sapiens
gagccctgcccca

SEQ ID NO: 4397023 - DNA, 12 bp, Homo sapiens
gagccctggctc

SEQ ID NO: 4397024 - DNA, 15 bp, Homo sapiens
gagcccttcccaggg

SEQ ID NO: 4397025 - DNA, 16 bp, Homo sapiens
gagcccttcccagggc

SEQ ID NO: 4397026 - DNA, 16 bp, Homo sapiens
gagcccttgcctcccc

SEQ ID NO: 4397027 - DNA, 15 bp, Homo sapiens
gagccgcagagcctg

SEQ ID NO: 4397028 - DNA, 15 bp, Homo sapiens
gagccgggcccctgg

SEQ ID NO: 4397029 - DNA, 19 bp, Homo sapiens
gagccgggtccggcctctc

SEQ ID NO: 4397030 - DNA, 20 bp, Homo sapiens
gagccgggtggatcgcctga

SEQ ID NO: 4397031 - DNA, 17 bp, Homo sapiens
gagcctagcggagccca

SEQ ID NO: 4397032 - DNA, 23 bp, Homo sapiens
gagcctagcggagcccagcctgg

SEQ ID NO: 4397033 - DNA, 14 bp, Homo sapiens
gagcctcactgggg

SEQ ID NO: 4397034 - DNA, 23 bp, Homo sapiens
gagcctcactggggcagacaata

SEQ ID NO: 4397035 - DNA, 18 bp, Homo sapiens
gagcctcatccagcctca

SEQ ID NO: 4397036 - DNA, 16 bp, Homo sapiens
gagcctccccctcaga

SEQ ID NO: 4397037 - DNA, 15 bp, Homo sapiens
gagcctcctgtgcct

SEQ ID NO: 4397038 - DNA, 19 bp, Homo sapiens
gagcctcctgtgcctggcc

SEQ ID NO: 4397039 - DNA, 21 bp, Homo sapiens
gagcctcctgtgcctggcccc

SEQ ID NO: 4397040 - DNA, 13 bp, Homo sapiens
gagcctctggccc

SEQ ID NO: 4397041 - DNA, 12 bp, Homo sapiens
gagcctgaactg

SEQ ID NO: 4397042 - DNA, 18 bp, Homo sapiens
gagcctgacgctcagccc

SEQ ID NO: 4397043 - DNA, 13 bp, Homo sapiens
gagcctgctcccc

SEQ ID NO: 4397044 - DNA, 19 bp, Homo sapiens
gagcctgctcccccacccc

SEQ ID NO: 4397045 - DNA, 12 bp, Homo sapiens
gagcctgctggt

SEQ ID NO: 4397046 - DNA, 21 bp, Homo sapiens
gagcctgctggtcacagcctc

SEQ ID NO: 4397047 - DNA, 12 bp, Homo sapiens
gagcctggcccc

SEQ ID NO: 4397048 - DNA, 15 bp, Homo sapiens
gagcctggccccagg

SEQ ID NO: 4397049 - DNA, 20 bp, Homo sapiens
gagcctggccccaggcccca

SEQ ID NO: 4397050 - DNA, 16 bp, Homo sapiens
gagcctgtggccagca

SEQ ID NO: 4397051 - DNA, 18 bp, Homo sapiens
gagcctgtggccagcagc

SEQ ID NO: 4397052 - DNA, 17 bp, Homo sapiens
gagccttcaagtgccaa

SEQ ID NO: 4397053 - DNA, 17 bp, Homo sapiens
gagccttcagccttaat

SEQ ID NO: 4397054 - DNA, 20 bp, Homo sapiens
gagccttggtgtccacctgg

SEQ ID NO: 4397055 - DNA, 13 bp, Homo sapiens
gagccttttgctc

SEQ ID NO: 4397056 - DNA, 14 bp, Homo sapiens
gagccttttgctct

SEQ ID NO: 4397057 - DNA, 20 bp, Homo sapiens
gacgagacaacagcacacag

SEQ ID NO: 4397058 - DNA, 17 bp, Homo sapiens
gacgaggccctcgggcc

SEQ ID NO: 4397059 - DNA, 21 bp, Homo sapiens
gacgaggccctcgggcccagc

SEQ ID NO: 4397060 - DNA, 12 bp, Homo sapiens
gacgcaccgcct

SEQ ID NO: 4397061 - DNA, 15 bp, Homo sapiens
gacgcatatgagtaa

SEQ ID NO: 4397062 - DNA, 17 bp, Homo sapiens
gacgcattttggttttt

SEQ ID NO: 4397063 - DNA, 20 bp, Homo sapiens
gacgccactccctgggacac

SEQ ID NO: 4397064 - DNA, 12 bp, Homo sapiens
gacgcctggggg

SEQ ID NO: 4397065 - DNA, 20 bp, Homo sapiens
gacgccttcatctgggacaa

SEQ ID NO: 4397066 - DNA, 18 bp, Homo sapiens
gacgctaataaaaattta

SEQ ID NO: 4397067 - DNA, 20 bp, Homo sapiens
gacgctcagccccaggccag

SEQ ID NO: 4397068 - DNA, 22 bp, Homo sapiens
gacgctcagccccaggccagct

SEQ ID NO: 4397069 - DNA, 19 bp, Homo sapiens
gacggaaaatgcttaaaaa

SEQ ID NO: 4397070 - DNA, 14 bp, Homo sapiens
gacggaaatgaaat

SEQ ID NO: 4397071 - DNA, 18 bp, Homo sapiens
gacggaaatgaaattgtc

SEQ ID NO: 4397072 - DNA, 20 bp, Homo sapiens
gacggagcccacactgccac

SEQ ID NO: 4397073 - DNA, 15 bp, Homo sapiens
gacggagtgggggga

SEQ ID NO: 4397074 - DNA, 21 bp, Homo sapiens
gacggagtggggggacagaga

SEQ ID NO: 4397075 - DNA, 23 bp, Homo sapiens
gacggatgcccattcctgcctgg

SEQ ID NO: 4397076 - DNA, 11 bp, Homo sapiens
gacggcaggct

SEQ ID NO: 4397077 - DNA, 22 bp, Homo sapiens
gacggcctgatgctccctcccc

SEQ ID NO: 4397078 - DNA, 23 bp, Homo sapiens
gacggcctgatgctccctcccct

SEQ ID NO: 4397079 - DNA, 13 bp, Homo sapiens
gacggctcctcag

SEQ ID NO: 4397080 - DNA, 15 bp, Homo sapiens
gacggctcctcagag

SEQ ID NO: 4397081 - DNA, 22 bp, Homo sapiens
gacggctcctcagagcgccagg

SEQ ID NO: 4397082 - DNA, 23 bp, Homo sapiens
gacggctgggtgtttcagtttga

SEQ ID NO: 4397083 - DNA, 13 bp, Homo sapiens
gacgggaccctgc

SEQ ID NO: 4397084 - DNA, 23 bp, Homo sapiens
gacgggaccctgcccagagctga

SEQ ID NO: 4397085 - DNA, 17 bp, Homo sapiens
gacggggtttcaccatg

SEQ ID NO: 4397086 - DNA, 18 bp, Homo sapiens
gacggtccccacccctct

SEQ ID NO: 4397087 - DNA, 13 bp, Homo sapiens
gacgtcaggccct

SEQ ID NO: 4397088 - DNA, 19 bp, Homo sapiens
gacgtcaggccctgactcc

SEQ ID NO: 4397089 - DNA, 21 bp, Homo sapiens
gacgtcatcggaggctgggcc

SEQ ID NO: 4397090 - DNA, 20 bp, Homo sapiens
gacgtctgtcaggggcttgg

SEQ ID NO: 4397091 - DNA, 17 bp, Homo sapiens
gacgtggtagtcacttg

SEQ ID NO: 4397092 - DNA, 15 bp, Homo sapiens
gacgtgtcaggtggt

SEQ ID NO: 4397093 - DNA, 17 bp, Homo sapiens
gacgttgctgagccagc

SEQ ID NO: 4397094 - DNA, 13 bp, Homo sapiens
gagcgacagtgag

SEQ ID NO: 4397095 - DNA, 17 bp, Homo sapiens
gagcgagcaagccggca

SEQ ID NO: 4397096 - DNA, 15 bp, Homo sapiens
gagcgccaggaagcc

SEQ ID NO: 4397097 - DNA, 19 bp, Homo sapiens
gagcgcccccgagccctga

SEQ ID NO: 4397098 - DNA, 23 bp, Homo sapiens
gagcgcccccgagccctgactcc

SEQ ID NO: 4397099 - DNA, 15 bp, Homo sapiens
gagcgctcctgccgc

SEQ ID NO: 4397100 - DNA, 23 bp, Homo sapiens
gagcgctcctgccgcagagctgg

SEQ ID NO: 4397101 - DNA, 14 bp, Homo sapiens
gagctaataaatct

SEQ ID NO: 4397102 - DNA, 23 bp, Homo sapiens
gagctacactcattgaaatgtaa

SEQ ID NO: 4397103 - DNA, 15 bp, Homo sapiens
gagctagaagctgga

SEQ ID NO: 4397104 - DNA, 18 bp, Homo sapiens
gagctagaagctggagga

SEQ ID NO: 4397105 - DNA, 23 bp, Homo sapiens
gagctagcgctgccgcaccccag

SEQ ID NO: 4397106 - DNA, 14 bp, Homo sapiens
gagctattaaaact

SEQ ID NO: 4397107 - DNA, 15 bp, Homo sapiens
gagctattttcctct

SEQ ID NO: 4397108 - DNA, 17 bp, Homo sapiens
gagctattttcctctgg

SEQ ID NO: 4397109 - DNA, 18 bp, Homo sapiens
gagctcagacccccactc

SEQ ID NO: 4397110 - DNA, 21 bp, Homo sapiens
gagctcagacccccactctca

SEQ ID NO: 4397111 - DNA, 21 bp, Homo sapiens
gagctcaggaaccgaggcagg

SEQ ID NO: 4397112 - DNA, 15 bp, Homo sapiens
gaggcccaggctggg

SEQ ID NO: 4397113 - DNA, 16 bp, Homo sapiens
gaggcccaggctggga

SEQ ID NO: 4397114 - DNA, 13 bp, Homo sapiens
gaggccccacctg

SEQ ID NO: 4397115 - DNA, 21 bp, Homo sapiens
gaggccccacctgaagggtgg

SEQ ID NO: 4397116 - DNA, 20 bp, Homo sapiens
gaggcccccgcagagactgt

SEQ ID NO: 4397117 - DNA, 17 bp, Homo sapiens
gaggccctcgctgccag

SEQ ID NO: 4397118 - DNA, 18 bp, Homo sapiens
gaggccctcgggcccagc

SEQ ID NO: 4397119 - DNA, 20 bp, Homo sapiens
gaggccctcgggcccagccc

SEQ ID NO: 4397120 - DNA, 12 bp, Homo sapiens
gaggccctgccc

SEQ ID NO: 4397121 - DNA, 15 bp, Homo sapiens
gaggccctgccccca

SEQ ID NO: 4397122 - DNA, 17 bp, Homo sapiens
gaggccctgcccccacc

SEQ ID NO: 4397123 - DNA, 15 bp, Homo sapiens
gaggccctggaggga

SEQ ID NO: 4397124 - DNA, 18 bp, Homo sapiens
gaggccctgggctgggtg

SEQ ID NO: 4397125 - DNA, 20 bp, Homo sapiens
gaggcctgagcgctcctgcc

SEQ ID NO: 4397126 - DNA, 20 bp, Homo sapiens
gaggcctgcctccagggctg

SEQ ID NO: 4397127 - DNA, 21 bp, Homo sapiens
gaggcctgctgccagtgcagc

SEQ ID NO: 4397128 - DNA, 21 bp, Homo sapiens
gaggcgaagcgttgtcctcag

SEQ ID NO: 4397129 - DNA, 13 bp, Homo sapiens
gaggcggaggctg

SEQ ID NO: 4397130 - DNA, 21 bp, Homo sapiens
gaggctaattcagtgtcacat

SEQ ID NO: 4397131 - DNA, 21 bp, Homo sapiens
gaggctagaaccaagaagggc

SEQ ID NO: 4397132 - DNA, 14 bp, Homo sapiens
gaggctccagaggg

SEQ ID NO: 4397133 - DNA, 20 bp, Homo sapiens
gaggctccccgcctccactc

SEQ ID NO: 4397134 - DNA, 21 bp, Homo sapiens
gaggctgagacaggagaatca

SEQ ID NO: 4397135 - DNA, 16 bp, Homo sapiens
gaggctgaggcagaag

SEQ ID NO: 4397136 - DNA, 15 bp, Homo sapiens
gaggctgaggcagga

SEQ ID NO: 4397137 - DNA, 18 bp, Homo sapiens
gaggctgaggcaggagaa

SEQ ID NO: 4397138 - DNA, 21 bp, Homo sapiens
gaggctgaggcaggagaatca

SEQ ID NO: 4397139 - DNA, 16 bp, Homo sapiens
gaggctgcacccctgg

SEQ ID NO: 4397140 - DNA, 19 bp, Homo sapiens
gaggctgcacccctgggcc

SEQ ID NO: 4397141 - DNA, 15 bp, Homo sapiens
gaggctgcagtcagc

SEQ ID NO: 4397142 - DNA, 19 bp, Homo sapiens
gaggctgcagtcagccctg

SEQ ID NO: 4397143 - DNA, 19 bp, Homo sapiens
gaggctgcccccggccccc

SEQ ID NO: 4397144 - DNA, 21 bp, Homo sapiens
gaggctgcccccggccccctg

SEQ ID NO: 4397145 - DNA, 18 bp, Homo sapiens
gaggctgcccctctcacc

SEQ ID NO: 4397146 - DNA, 17 bp, Homo sapiens
gaggctggaggcagggc

SEQ ID NO: 4397147 - DNA, 13 bp, Homo sapiens
gaggctggcaggt

SEQ ID NO: 4397148 - DNA, 15 bp, Homo sapiens
gaggctgggagtccc

SEQ ID NO: 4397149 - DNA, 15 bp, Homo sapiens
gaggctgggcccctg

SEQ ID NO: 4397150 - DNA, 20 bp, Homo sapiens
gaggctggggccccatcttg

SEQ ID NO: 4397151 - DNA, 21 bp, Homo sapiens
gaggctgtaactgagagaaag

SEQ ID NO: 4397152 - DNA, 20 bp, Homo sapiens
gaggctgtttttggctgttt

SEQ ID NO: 4397153 - DNA, 15 bp, Homo sapiens
gaggcttcctgcgtc

SEQ ID NO: 4397154 - DNA, 21 bp, Homo sapiens
gaggcttctccgccagcctcc

SEQ ID NO: 4397155 - DNA, 13 bp, Homo sapiens
gaggcttctcctg

SEQ ID NO: 4397156 - DNA, 16 bp, Homo sapiens
gaggcttcttcagatc

SEQ ID NO: 4397157 - DNA, 14 bp, Homo sapiens
gaggcttgaaggcc

SEQ ID NO: 4397158 - DNA, 15 bp, Homo sapiens
gaggctttggcccaa

SEQ ID NO: 4397159 - DNA, 13 bp, Homo sapiens
gagggaaaacaga

SEQ ID NO: 4397160 - DNA, 10 bp, Homo sapiens
gagggaaaag

SEQ ID NO: 4397161 - DNA, 12 bp, Homo sapiens
gagggaaacctt

SEQ ID NO: 4397162 - DNA, 14 bp, Homo sapiens
gagggaagaacatt

SEQ ID NO: 4397163 - DNA, 21 bp, Homo sapiens
gagggaagccagtcagggccc

SEQ ID NO: 4397164 - DNA, 17 bp, Homo sapiens
gagggaaggacagtccc

SEQ ID NO: 4397165 - DNA, 17 bp, Homo sapiens
gagggaccaactgggcc

SEQ ID NO: 4397166 - DNA, 19 bp, Homo sapiens
gagggaccaactgggccca

SEQ ID NO: 4397167 - DNA, 15 bp, Homo sapiens
gagggacgcctgggg

SEQ ID NO: 4397168 - DNA, 18 bp, Homo sapiens
gagggactctgaagcctc

SEQ ID NO: 4397169 - DNA, 21 bp, Homo sapiens
gagggactctgaagcctctgg

SEQ ID NO: 4397170 - DNA, 13 bp, Homo sapiens
gagggagagagag

SEQ ID NO: 4397171 - DNA, 22 bp, Homo sapiens
gagggagagagagagagagagg

SEQ ID NO: 4397172 - DNA, 13 bp, Homo sapiens
gagggagagggag

SEQ ID NO: 4397173 - DNA, 18 bp, Homo sapiens
gagggaggaacacctgat

SEQ ID NO: 4397174 - DNA, 13 bp, Homo sapiens
gagggagggggct

SEQ ID NO: 4397175 - DNA, 22 bp, Homo sapiens
gagggagtttaatacaggaaat

SEQ ID NO: 4397176 - DNA, 19 bp, Homo sapiens
gagggatcagttgcccccc

SEQ ID NO: 4397177 - DNA, 18 bp, Homo sapiens
gagggatttccctgcaga

SEQ ID NO: 4397178 - DNA, 15 bp, Homo sapiens
gagggcaagccctgc

SEQ ID NO: 4397179 - DNA, 21 bp, Homo sapiens
gagggcaagccctgcccacag

SEQ ID NO: 4397180 - DNA, 19 bp, Homo sapiens
gagggcaagcctctagtgt

SEQ ID NO: 4397181 - DNA, 16 bp, Homo sapiens
gagggcacatgaacag

SEQ ID NO: 4397182 - DNA, 21 bp, Homo sapiens
gagggcagaaaggttctgccc

SEQ ID NO: 4397183 - DNA, 14 bp, Homo sapiens
gagggcagaggctg

SEQ ID NO: 4397184 - DNA, 15 bp, Homo sapiens
gagggcagaggctgg

SEQ ID NO: 4397185 - DNA, 12 bp, Homo sapiens
gagggcagcagg

SEQ ID NO: 4397186 - DNA, 14 bp, Homo sapiens
gagggcagcagggc

SEQ ID NO: 4397187 - DNA, 15 bp, Homo sapiens
gagggcagcagggct

SEQ ID NO: 4397188 - DNA, 16 bp, Homo sapiens
gagggcagcagggcta

SEQ ID NO: 4397189 - DNA, 13 bp, Homo sapiens
gagggcagcccgt

SEQ ID NO: 4397190 - DNA, 16 bp, Homo sapiens
gagggcagtaccctcc

SEQ ID NO: 4397191 - DNA, 16 bp, Homo sapiens
gagggccacatgggag

SEQ ID NO: 4397192 - DNA, 20 bp, Homo sapiens
gagggcccagcccagagcca

SEQ ID NO: 4397193 - DNA, 21 bp, Homo sapiens
gagggcccagcccagagccac

SEQ ID NO: 4397194 - DNA, 23 bp, Homo sapiens
gagggcccagcccagagccacct

SEQ ID NO: 4397195 - DNA, 20 bp, Homo sapiens
gagggcccctgcgtgggggc

SEQ ID NO: 4397196 - DNA, 12 bp, Homo sapiens
gagggccctggt

SEQ ID NO: 4397197 - DNA, 17 bp, Homo sapiens
gagggctagaacctaga

SEQ ID NO: 4397198 - DNA, 16 bp, Homo sapiens
gagggctagaacctgg

SEQ ID NO: 4397199 - DNA, 19 bp, Homo sapiens
gagggctagaatctggaga

SEQ ID NO: 4397200 - DNA, 21 bp, Homo sapiens
gagggctagaatctggagagc

SEQ ID NO: 4397201 - DNA, 14 bp, Homo sapiens
gagggctctgtttg

SEQ ID NO: 4397202 - DNA, 16 bp, Homo sapiens
gagggctggaggccca

SEQ ID NO: 4397203 - DNA, 17 bp, Homo sapiens
gagggctggaggcccag

SEQ ID NO: 4397204 - DNA, 19 bp, Homo sapiens
gagggctggaggcccaggc

SEQ ID NO: 4397205 - DNA, 20 bp, Homo sapiens
gagggctggaggcccaggct

SEQ ID NO: 4397206 - DNA, 23 bp, Homo sapiens
gagggctggaggcccaggctggg

SEQ ID NO: 4397207 - DNA, 11 bp, Homo sapiens
gagggctggcc

SEQ ID NO: 4397208 - DNA, 14 bp, Homo sapiens
gagggctggctggc

SEQ ID NO: 4397209 - DNA, 19 bp, Homo sapiens
gagggcttcctctagaagc

SEQ ID NO: 4397210 - DNA, 16 bp, Homo sapiens
gagggcttggcccagc

SEQ ID NO: 4397211 - DNA, 17 bp, Homo sapiens
gagggcttggcccagcg

SEQ ID NO: 4397212 - DNA, 20 bp, Homo sapiens
gaggggaaacaatgaaaaca

SEQ ID NO: 4397213 - DNA, 14 bp, Homo sapiens
gaggggagagacag

SEQ ID NO: 4397214 - DNA, 23 bp, Homo sapiens
gaggggagagacaggcagcccag

SEQ ID NO: 4397215 - DNA, 12 bp, Homo sapiens
gaggggagggta

SEQ ID NO: 4397216 - DNA, 22 bp, Homo sapiens
gaggggcaaccaactgccccag

SEQ ID NO: 4397217 - DNA, 21 bp, Homo sapiens
gaggggcgttctcccaaagat

SEQ ID NO: 4397218 - DNA, 17 bp, Homo sapiens
gaggggctgcagggcca

SEQ ID NO: 4397219 - DNA, 14 bp, Homo sapiens
gaggggctgttagg

SEQ ID NO: 4397220 - DNA, 16 bp, Homo sapiens
gaggggcttgggcctg

SEQ ID NO: 4397221 - DNA, 17 bp, Homo sapiens
gagggggagtagccaag

SEQ ID NO: 4397222 - DNA, 15 bp, Homo sapiens
gagggggcctggatg

SEQ ID NO: 4397223 - DNA, 15 bp, Homo sapiens
gagggggctgctccc

SEQ ID NO: 4397224 - DNA, 22 bp, Homo sapiens
gaggggggccaaggtcctgctc

SEQ ID NO: 4397225 - DNA, 17 bp, Homo sapiens
gagggggtgtctgcacc

SEQ ID NO: 4397226 - DNA, 13 bp, Homo sapiens
gaggggtggccca

SEQ ID NO: 4397227 - DNA, 14 bp, Homo sapiens
gaggggtggcccag

SEQ ID NO: 4397228 - DNA, 15 bp, Homo sapiens
gaggggtggcccaga

SEQ ID NO: 4397229 - DNA, 20 bp, Homo sapiens
gaggggtggcccagagccat

SEQ ID NO: 4397230 - DNA, 23 bp, Homo sapiens
gaggggtggtggggggcagggcc

SEQ ID NO: 4397231 - DNA, 15 bp, Homo sapiens
gagggtaaataaacc

SEQ ID NO: 4397232 - DNA, 19 bp, Homo sapiens
gagggtcccaagctgggcc

SEQ ID NO: 4397233 - DNA, 15 bp, Homo sapiens
gagggtcctggctcc

SEQ ID NO: 4397234 - DNA, 18 bp, Homo sapiens
gagggtggctttgctgtt

SEQ ID NO: 4397235 - DNA, 13 bp, Homo sapiens
gagggtgggaagg

SEQ ID NO: 4397236 - DNA, 15 bp, Homo sapiens
gagggtgggggaggg

SEQ ID NO: 4397237 - DNA, 16 bp, Homo sapiens
gagggtgtttcctcta

SEQ ID NO: 4397238 - DNA, 21 bp, Homo sapiens
gagggtttctgatctgtactt

SEQ ID NO: 4397239 - DNA, 12 bp, Homo sapiens
gaggtaagtttt

SEQ ID NO: 4397240 - DNA, 15 bp, Homo sapiens
gaggtcaacagagaa

SEQ ID NO: 4397241 - DNA, 22 bp, Homo sapiens
gaggtcaacagagaaggcagga

SEQ ID NO: 4397242 - DNA, 16 bp, Homo sapiens
gaggtcactggaaagg

SEQ ID NO: 4397243 - DNA, 18 bp, Homo sapiens
gaggtcaggacggctcct

SEQ ID NO: 4397244 - DNA, 19 bp, Homo sapiens
gaggtctcatctcccaggc

SEQ ID NO: 4397245 - DNA, 20 bp, Homo sapiens
gaggtctgagccctggtgtg

SEQ ID NO: 4397246 - DNA, 15 bp, Homo sapiens
gaggtgaaagggagc

SEQ ID NO: 4397247 - DNA, 23 bp, Homo sapiens
gaggtgctgtccccactgcccca

SEQ ID NO: 4397248 - DNA, 23 bp, Homo sapiens
gaggtgcttctagttctgccagg

SEQ ID NO: 4397249 - DNA, 16 bp, Homo sapiens
gaggtgcttgatctat

SEQ ID NO: 4397250 - DNA, 13 bp, Homo sapiens
gaggtggaagaag

SEQ ID NO: 4397251 - DNA, 16 bp, Homo sapiens
gaggtggaagaaggga

SEQ ID NO: 4397252 - DNA, 19 bp, Homo sapiens
gaggtggaagaagggagaa

SEQ ID NO: 4397253 - DNA, 15 bp, Homo sapiens
gaggtggaagcagag

SEQ ID NO: 4397254 - DNA, 16 bp, Homo sapiens
gaggtggagggaggga

SEQ ID NO: 4397255 - DNA, 14 bp, Homo sapiens
gaggtgggagggcc

SEQ ID NO: 4397256 - DNA, 15 bp, Homo sapiens
gaggtgggaggtgga

SEQ ID NO: 4397257 - DNA, 18 bp, Homo sapiens
gaggtgggaggtggaaga

SEQ ID NO: 4397258 - DNA, 15 bp, Homo sapiens
gaggtgtcaggctgc

SEQ ID NO: 4397259 - DNA, 18 bp, Homo sapiens
gaggtgtcaggctgctgg

SEQ ID NO: 4397260 - DNA, 13 bp, Homo sapiens
gaggttgcagtga

SEQ ID NO: 4397261 - DNA, 15 bp, Homo sapiens
gaggttgcattctag

SEQ ID NO: 4397262 - DNA, 14 bp, Homo sapiens
gaggttgtggggcc

SEQ ID NO: 4397263 - DNA, 21 bp, Homo sapiens
gaggttgtggggcctcaggct

SEQ ID NO: 4397264 - DNA, 18 bp, Homo sapiens
gaggttttattctgactt

SEQ ID NO: 4397265 - DNA, 15 bp, Homo sapiens
gagtaacagggcaga

SEQ ID NO: 4397266 - DNA, 14 bp, Homo sapiens
gagtaataggacca

SEQ ID NO: 4397267 - DNA, 13 bp, Homo sapiens
gagtaatttcatt

SEQ ID NO: 4397268 - DNA, 16 bp, Homo sapiens
gagtacactcagccac

SEQ ID NO: 4397269 - DNA, 18 bp, Homo sapiens
gagtacactcagccactg

SEQ ID NO: 4397270 - DNA, 16 bp, Homo sapiens
gagtagatgagccggg

SEQ ID NO: 4397271 - DNA, 19 bp, Homo sapiens
gagtagccgagagcctgct

SEQ ID NO: 4397272 - DNA, 15 bp, Homo sapiens
gagtagtggccactg

SEQ ID NO: 4397273 - DNA, 16 bp, Homo sapiens
gagtagtggccactgg

SEQ ID NO: 4397274 - DNA, 23 bp, Homo sapiens
gagtagttatataattgttgaac

SEQ ID NO: 4397275 - DNA, 20 bp, Homo sapiens
gagtataaaataaagcaaat

SEQ ID NO: 4397276 - DNA, 12 bp, Homo sapiens
gagtatttttgg

SEQ ID NO: 4397277 - DNA, 22 bp, Homo sapiens
gagtcagaatgtgaaaaaggaa

SEQ ID NO: 4397278 - DNA, 14 bp, Homo sapiens
gagtcagaggagaa

SEQ ID NO: 4397279 - DNA, 23 bp, Homo sapiens
gagtcaggagttttactgcctgt

SEQ ID NO: 4397280 - DNA, 17 bp, Homo sapiens
gagtcagggacctgctg

SEQ ID NO: 4397281 - DNA, 21 bp, Homo sapiens
gagtcagggacctgctgctca

SEQ ID NO: 4397282 - DNA, 18 bp, Homo sapiens
gagtcatgatctccctgc

SEQ ID NO: 4397283 - DNA, 16 bp, Homo sapiens
gagtcattaccacgcc

SEQ ID NO: 4397284 - DNA, 19 bp, Homo sapiens
gagtcattcaggtgacctc

SEQ ID NO: 4397285 - DNA, 15 bp, Homo sapiens
gagtcattgacttca

SEQ ID NO: 4397286 - DNA, 15 bp, Homo sapiens
gagtcatttaaatgt

SEQ ID NO: 4397287 - DNA, 20 bp, Homo sapiens
gagtcatttgtttaaacaat

SEQ ID NO: 4397288 - DNA, 13 bp, Homo sapiens
gagtccagacccc

SEQ ID NO: 4397289 - DNA, 19 bp, Homo sapiens
gagtccagaccccccagcc

SEQ ID NO: 4397290 - DNA, 17 bp, Homo sapiens
gagtccagcccctcctc

SEQ ID NO: 4397291 - DNA, 21 bp, Homo sapiens
gagtccagcccctcctccctc

SEQ ID NO: 4397292 - DNA, 23 bp, Homo sapiens
gagtccaggcccccagcccctcc

SEQ ID NO: 4397293 - DNA, 14 bp, Homo sapiens
gagtccagtgctct

SEQ ID NO: 4397294 - DNA, 16 bp, Homo sapiens
gagtccagtgctctgc

SEQ ID NO: 4397295 - DNA, 22 bp, Homo sapiens
gagtccagtgctctgcctcaga

SEQ ID NO: 4397296 - DNA, 17 bp, Homo sapiens
gagtccatcagcctcca

SEQ ID NO: 4397297 - DNA, 16 bp, Homo sapiens
gagtccattctcccag

SEQ ID NO: 4397298 - DNA, 21 bp, Homo sapiens
gagtcccaggggcagccacac

SEQ ID NO: 4397299 - DNA, 14 bp, Homo sapiens
gagtccctgccatc

SEQ ID NO: 4397300 - DNA, 14 bp, Homo sapiens
gagtccctgcctgg

SEQ ID NO: 4397301 - DNA, 15 bp, Homo sapiens
gagtccctgcctgga

SEQ ID NO: 4397302 - DNA, 23 bp, Homo sapiens
gagtccctgcctggaccagcctc

SEQ ID NO: 4397303 - DNA, 16 bp, Homo sapiens
gagtcctcactcccag

SEQ ID NO: 4397304 - DNA, 14 bp, Homo sapiens
gagtcctgtctctg

SEQ ID NO: 4397305 - DNA, 15 bp, Homo sapiens
gagtcctgtctctgc

SEQ ID NO: 4397306 - DNA, 20 bp, Homo sapiens
gagtcctgtctctgcctgcg

SEQ ID NO: 4397307 - DNA, 18 bp, Homo sapiens
gagtcctttccaggggcc

SEQ ID NO: 4397308 - DNA, 17 bp, Homo sapiens
gagtcgtacagaaagct

SEQ ID NO: 4397309 - DNA, 19 bp, Homo sapiens
gagtctacctgagcattca

SEQ ID NO: 4397310 - DNA, 21 bp, Homo sapiens
gagtctcgctctgtcgcccag

SEQ ID NO: 4397311 - DNA, 22 bp, Homo sapiens
gagtctcgctctgtcgcccagg

SEQ ID NO: 4397312 - DNA, 13 bp, Homo sapiens
gagtctgagtcct

SEQ ID NO: 4397313 - DNA, 15 bp, Homo sapiens
gagtctgagtcctgt

SEQ ID NO: 4397314 - DNA, 14 bp, Homo sapiens
gagtctgagtctga

SEQ ID NO: 4397315 - DNA, 12 bp, Homo sapiens
gagtctgccact

SEQ ID NO: 4397316 - DNA, 21 bp, Homo sapiens
gagtcttgctcttgtcgccca

SEQ ID NO: 4397317 - DNA, 15 bp, Homo sapiens
gagtcttgtgaaagt

SEQ ID NO: 4397318 - DNA, 20 bp, Homo sapiens
gagtctttgagactaaattc

SEQ ID NO: 4397319 - DNA, 21 bp, Homo sapiens
gagtgaactggtcttcctttt

SEQ ID NO: 4397320 - DNA, 21 bp, Homo sapiens
gagtgacagagcgagactcca

SEQ ID NO: 4397321 - DNA, 16 bp, Homo sapiens
gagtgacctcggacag

SEQ ID NO: 4397322 - DNA, 16 bp, Homo sapiens
gagtgactacacacag

SEQ ID NO: 4397323 - DNA, 13 bp, Homo sapiens
gagtgactctcca

SEQ ID NO: 4397324 - DNA, 22 bp, Homo sapiens
gagtgagacccagccctcatcc

SEQ ID NO: 4397325 - DNA, 13 bp, Homo sapiens
gagtgagactcca

SEQ ID NO: 4397326 - DNA, 18 bp, Homo sapiens
gagtgagggagacaggaa

SEQ ID NO: 4397327 - DNA, 13 bp, Homo sapiens
gagtgcagagaaa

SEQ ID NO: 4397328 - DNA, 15 bp, Homo sapiens
gagtgcagccttctc

SEQ ID NO: 4397329 - DNA, 14 bp, Homo sapiens
gagtgcccccggga

SEQ ID NO: 4397330 - DNA, 14 bp, Homo sapiens
gagtgccttctgtg

SEQ ID NO: 4397331 - DNA, 20 bp, Homo sapiens
gagtgcgggctgaggccaga

SEQ ID NO: 4397332 - DNA, 23 bp, Homo sapiens
gagtgcgggctgaggccagagtc

SEQ ID NO: 4397333 - DNA, 14 bp, Homo sapiens
gagtgctggactgt

SEQ ID NO: 4397334 - DNA, 16 bp, Homo sapiens
gagtggacctgtgctg

SEQ ID NO: 4397335 - DNA, 17 bp, Homo sapiens
gagtggacctgtgctgt

SEQ ID NO: 4397336 - DNA, 12 bp, Homo sapiens
gagtggagtctg

SEQ ID NO: 4397337 - DNA, 15 bp, Homo sapiens
gagtggagtctgagt

SEQ ID NO: 4397338 - DNA, 16 bp, Homo sapiens
gagtggcctccctgct

SEQ ID NO: 4397339 - DNA, 17 bp, Homo sapiens
gagtggcctccctgctg

SEQ ID NO: 4397340 - DNA, 17 bp, Homo sapiens
gactttttttgtatgtg

SEQ ID NO: 4397341 - DNA, 20 bp, Homo sapiens
gagaaaacatctcatcatgt

SEQ ID NO: 4397342 - DNA, 18 bp, Homo sapiens
gagaaaagacagggtggg

SEQ ID NO: 4397343 - DNA, 18 bp, Homo sapiens
gagaaaatataaggactt

SEQ ID NO: 4397344 - DNA, 18 bp, Homo sapiens
gagaaaatatatgtattt

SEQ ID NO: 4397345 - DNA, 19 bp, Homo sapiens
gagaaaatatatgtatttt

SEQ ID NO: 4397346 - DNA, 16 bp, Homo sapiens
gagaaacaaaatcctc

SEQ ID NO: 4397347 - DNA, 21 bp, Homo sapiens
gagaaacagttggtaactttt

SEQ ID NO: 4397348 - DNA, 22 bp, Homo sapiens
gagaaacagttggtaacttttg

SEQ ID NO: 4397349 - DNA, 18 bp, Homo sapiens
gagaaagaaagtacccag

SEQ ID NO: 4397350 - DNA, 19 bp, Homo sapiens
gagaaagaaagtacccagc

SEQ ID NO: 4397351 - DNA, 13 bp, Homo sapiens
gagaaagactatt

SEQ ID NO: 4397352 - DNA, 15 bp, Homo sapiens
gagaaagactattca

SEQ ID NO: 4397353 - DNA, 17 bp, Homo sapiens
gagaaagactattcaaa

SEQ ID NO: 4397354 - DNA, 15 bp, Homo sapiens
gagaaagactgatta

SEQ ID NO: 4397355 - DNA, 19 bp, Homo sapiens
gagaaagaggcaccaggaa

SEQ ID NO: 4397356 - DNA, 20 bp, Homo sapiens
gagaaagccacgccctccct

SEQ ID NO: 4397357 - DNA, 21 bp, Homo sapiens
gagaaagccacgccctccctg

SEQ ID NO: 4397358 - DNA, 22 bp, Homo sapiens
gagaaagccacgccctccctgc

SEQ ID NO: 4397359 - DNA, 18 bp, Homo sapiens
gagaaaggacaaccagga

SEQ ID NO: 4397360 - DNA, 18 bp, Homo sapiens
gagaaagtgtgagcaaac

SEQ ID NO: 4397361 - DNA, 20 bp, Homo sapiens
gagaaatatggacacttaat

SEQ ID NO: 4397362 - DNA, 19 bp, Homo sapiens
gagaaatgaatgctgagac

SEQ ID NO: 4397363 - DNA, 23 bp, Homo sapiens
gagaaatgtgtagctgcaaaaat

SEQ ID NO: 4397364 - DNA, 19 bp, Homo sapiens
gagaaccactacatgcagc

SEQ ID NO: 4397365 - DNA, 19 bp, Homo sapiens
gagaaccagtctcctcact

SEQ ID NO: 4397366 - DNA, 21 bp, Homo sapiens
gagaaccagtctcctcactct

SEQ ID NO: 4397367 - DNA, 12 bp, Homo sapiens
gagaacctgagt

SEQ ID NO: 4397368 - DNA, 24 bp, Homo sapiens
gagaacgcagccctagagcctgcc

SEQ ID NO: 4397369 - DNA, 17 bp, Homo sapiens
gagaactaaagctggag

SEQ ID NO: 4397370 - DNA, 21 bp, Homo sapiens
gagaactgaattttgggactt

SEQ ID NO: 4397371 - DNA, 23 bp, Homo sapiens
gagaagaatagcctagatatgaa

SEQ ID NO: 4397372 - DNA, 18 bp, Homo sapiens
gagaagacaacagaaaga

SEQ ID NO: 4397373 - DNA, 22 bp, Homo sapiens
gagaagagctgttcacagccag

SEQ ID NO: 4397374 - DNA, 21 bp, Homo sapiens
gagaagagcttgcacagccaa

SEQ ID NO: 4397375 - DNA, 21 bp, Homo sapiens
gagaagagggaaaacagaaaa

SEQ ID NO: 4397376 - DNA, 14 bp, Homo sapiens
gagaagcagtgagc

SEQ ID NO: 4397377 - DNA, 18 bp, Homo sapiens
gagaagcagtgagccgca

SEQ ID NO: 4397378 - DNA, 21 bp, Homo sapiens
gagaagccccttccccatggg

SEQ ID NO: 4397379 - DNA, 22 bp, Homo sapiens
gagaagccccttccccatggga

SEQ ID NO: 4397380 - DNA, 18 bp, Homo sapiens
gagaagctctcgagggaa

SEQ ID NO: 4397381 - DNA, 20 bp, Homo sapiens
gagaagctctcgagggaagc

SEQ ID NO: 4397382 - DNA, 15 bp, Homo sapiens
gagaaggaaaaagaa

SEQ ID NO: 4397383 - DNA, 21 bp, Homo sapiens
gagaaggaaggagactcacct

SEQ ID NO: 4397384 - DNA, 20 bp, Homo sapiens
gagaaggaggccgccagact

SEQ ID NO: 4397385 - DNA, 11 bp, Homo sapiens
gagaaggcagc

SEQ ID NO: 4397386 - DNA, 12 bp, Homo sapiens
gagaaggcagcc

SEQ ID NO: 4397387 - DNA, 16 bp, Homo sapiens
gagaaggcagccacca

SEQ ID NO: 4397388 - DNA, 23 bp, Homo sapiens
gagaaggcaggaatgtgtggcag

SEQ ID NO: 4397389 - DNA, 19 bp, Homo sapiens
gagaaggtaaggtgtgaac

SEQ ID NO: 4397390 - DNA, 19 bp, Homo sapiens
gagaaggtattagcaaagc

SEQ ID NO: 4397391 - DNA, 16 bp, Homo sapiens
gagaagttgtaaagta

SEQ ID NO: 4397392 - DNA, 21 bp, Homo sapiens
gagaagtttcgaggggtcctc

SEQ ID NO: 4397393 - DNA, 19 bp, Homo sapiens
gagaataggggagccaagg

SEQ ID NO: 4397394 - DNA, 23 bp, Homo sapiens
gagaatcacctgaaccccagagg

SEQ ID NO: 4397395 - DNA, 18 bp, Homo sapiens
gagaatcactgctccagg

SEQ ID NO: 4397396 - DNA, 19 bp, Homo sapiens
gagaatcactgctccaggc

SEQ ID NO: 4397397 - DNA, 14 bp, Homo sapiens
gagaatcacttgaa

SEQ ID NO: 4397398 - DNA, 17 bp, Homo sapiens
gagaatggtgctgttta

SEQ ID NO: 4397399 - DNA, 20 bp, Homo sapiens
gagaatggtgtgaacccggg

SEQ ID NO: 4397400 - DNA, 23 bp, Homo sapiens
gagaatggtgtgaacccgggagc

SEQ ID NO: 4397401 - DNA, 15 bp, Homo sapiens
gagaatgtaagaact

SEQ ID NO: 4397402 - DNA, 22 bp, Homo sapiens
gagaatgtgtgtgtgtggcagg

SEQ ID NO: 4397403 - DNA, 16 bp, Homo sapiens
gagacaacagcacaca

SEQ ID NO: 4397404 - DNA, 17 bp, Homo sapiens
gagacaacagcacacag

SEQ ID NO: 4397405 - DNA, 15 bp, Homo sapiens
gagacacattgcctt

SEQ ID NO: 4397406 - DNA, 22 bp, Homo sapiens
gagacacattggaccagatgag

SEQ ID NO: 4397407 - DNA, 18 bp, Homo sapiens
gagacacctgcacctccc

SEQ ID NO: 4397408 - DNA, 21 bp, Homo sapiens
gagacacctgcacctcccccc

SEQ ID NO: 4397409 - DNA, 15 bp, Homo sapiens
gagacactgagccag

SEQ ID NO: 4397410 - DNA, 16 bp, Homo sapiens
gagacactgagccagt

SEQ ID NO: 4397411 - DNA, 14 bp, Homo sapiens
gagacactgtctct

SEQ ID NO: 4397412 - DNA, 17 bp, Homo sapiens
gagacagatgctggtgg

SEQ ID NO: 4397413 - DNA, 23 bp, Homo sapiens
gagacagccaggtggcacctgca

SEQ ID NO: 4397414 - DNA, 14 bp, Homo sapiens
gagacagcttctct

SEQ ID NO: 4397415 - DNA, 21 bp, Homo sapiens
gagacagcttctctgcagtaa

SEQ ID NO: 4397416 - DNA, 20 bp, Homo sapiens
gagacaggaaaatcctctgg

SEQ ID NO: 4397417 - DNA, 13 bp, Homo sapiens
gagacaggacaga

SEQ ID NO: 4397418 - DNA, 16 bp, Homo sapiens
gagacaggagcctagc

SEQ ID NO: 4397419 - DNA, 19 bp, Homo sapiens
gagacaggcagcccagcag

SEQ ID NO: 4397420 - DNA, 16 bp, Homo sapiens
gagacaggctgggtcc

SEQ ID NO: 4397421 - DNA, 15 bp, Homo sapiens
gagacagtctcactc

SEQ ID NO: 4397422 - DNA, 15 bp, Homo sapiens
gagacagttgcccga

SEQ ID NO: 4397423 - DNA, 12 bp, Homo sapiens
gagacatccagc

SEQ ID NO: 4397424 - DNA, 16 bp, Homo sapiens
gagacattagaaaaaa

SEQ ID NO: 4397425 - DNA, 15 bp, Homo sapiens
gagaccaacctgacc

SEQ ID NO: 4397426 - DNA, 17 bp, Homo sapiens
gagaccaacctgaccaa

SEQ ID NO: 4397427 - DNA, 23 bp, Homo sapiens
gagaccacccaacctcaccctcc

SEQ ID NO: 4397428 - DNA, 18 bp, Homo sapiens
gagaccacccatatcatg

SEQ ID NO: 4397429 - DNA, 14 bp, Homo sapiens
gagaccagggtggc

SEQ ID NO: 4397430 - DNA, 19 bp, Homo sapiens
gagaccagggtggccacac

SEQ ID NO: 4397431 - DNA, 21 bp, Homo sapiens
gagaccagggtggccacacag

SEQ ID NO: 4397432 - DNA, 22 bp, Homo sapiens
gagaccagggtggccacacagg

SEQ ID NO: 4397433 - DNA, 15 bp, Homo sapiens
gagaccatcctggct

SEQ ID NO: 4397434 - DNA, 17 bp, Homo sapiens
gagacccaaaggaagaa

SEQ ID NO: 4397435 - DNA, 14 bp, Homo sapiens
gagacccaaggagg

SEQ ID NO: 4397436 - DNA, 20 bp, Homo sapiens
gagaccccagtcgtgatgtg

SEQ ID NO: 4397437 - DNA, 16 bp, Homo sapiens
gagacccctggcctcc

SEQ ID NO: 4397438 - DNA, 17 bp, Homo sapiens
gagacccctggcctccg

SEQ ID NO: 4397439 - DNA, 23 bp, Homo sapiens
gagaccctgcaagaccacggagg

SEQ ID NO: 4397440 - DNA, 17 bp, Homo sapiens
gagaccctgtctcaata

SEQ ID NO: 4397441 - DNA, 13 bp, Homo sapiens
gagacctcatcct

SEQ ID NO: 4397442 - DNA, 22 bp, Homo sapiens
gagacctccaataaagtgcctt

SEQ ID NO: 4397443 - DNA, 21 bp, Homo sapiens
gagacgcacacagctgagcac

SEQ ID NO: 4397444 - DNA, 16 bp, Homo sapiens
gagacgccactccctg

SEQ ID NO: 4397445 - DNA, 21 bp, Homo sapiens
gagacgccactccctgggaca

SEQ ID NO: 4397446 - DNA, 16 bp, Homo sapiens
gagactagattgcctt

SEQ ID NO: 4397447 - DNA, 17 bp, Homo sapiens
gagactcacctctgcct

SEQ ID NO: 4397448 - DNA, 18 bp, Homo sapiens
gagactcacctctgcctc

SEQ ID NO: 4397449 - DNA, 23 bp, Homo sapiens
gagactcacctctgcctcaatgt

SEQ ID NO: 4397450 - DNA, 16 bp, Homo sapiens
gagactcagcctctgc

SEQ ID NO: 4397451 - DNA, 17 bp, Homo sapiens
gagactcagcctctgct

SEQ ID NO: 4397452 - DNA, 20 bp, Homo sapiens
gagactcagccttcctcctc

SEQ ID NO: 4397453 - DNA, 14 bp, Homo sapiens
gagactccatctct

SEQ ID NO: 4397454 - DNA, 23 bp, Homo sapiens
gagactcctggtctgtgaagagc

SEQ ID NO: 4397455 - DNA, 16 bp, Homo sapiens
gagactcgagaacttt

SEQ ID NO: 4397456 - DNA, 20 bp, Homo sapiens
gagactcgagaactttcatt

SEQ ID NO: 4397457 - DNA, 19 bp, Homo sapiens
gagactctcttaggagcag

SEQ ID NO: 4397458 - DNA, 15 bp, Homo sapiens
gagactgagcagccg

SEQ ID NO: 4397459 - DNA, 17 bp, Homo sapiens
gagactgagcagccgcc

SEQ ID NO: 4397460 - DNA, 11 bp, Homo sapiens
gagactgcccc

SEQ ID NO: 4397461 - DNA, 16 bp, Homo sapiens
gagactgcgttctgca

SEQ ID NO: 4397462 - DNA, 15 bp, Homo sapiens
gagactgggctgagg

SEQ ID NO: 4397463 - DNA, 18 bp, Homo sapiens
gagactttacaaaccttt

SEQ ID NO: 4397464 - DNA, 19 bp, Homo sapiens
gagactttacaaacctttg

SEQ ID NO: 4397465 - DNA, 11 bp, Homo sapiens
gagagaaagaa

SEQ ID NO: 4397466 - DNA, 12 bp, Homo sapiens
gagagaaagaga

SEQ ID NO: 4397467 - DNA, 16 bp, Homo sapiens
gagagaagccacgctg

SEQ ID NO: 4397468 - DNA, 22 bp, Homo sapiens
gagagaatgtgtgtgtgtggca

SEQ ID NO: 4397469 - DNA, 17 bp, Homo sapiens
gagagaccacacatttt

SEQ ID NO: 4397470 - DNA, 20 bp, Homo sapiens
gagagacccaaggaggaaaa

SEQ ID NO: 4397471 - DNA, 20 bp, Homo sapiens
gagagactcccatgaagcct

SEQ ID NO: 4397472 - DNA, 21 bp, Homo sapiens
gagagactcccatgaagcctt

SEQ ID NO: 4397473 - DNA, 12 bp, Homo sapiens
gagagagaaaga

SEQ ID NO: 4397474 - DNA, 14 bp, Homo sapiens
gagagagagagaga

SEQ ID NO: 4397475 - DNA, 12 bp, Homo sapiens
gagagagaggac

SEQ ID NO: 4397476 - DNA, 13 bp, Homo sapiens
gagagagaggaca

SEQ ID NO: 4397477 - DNA, 15 bp, Homo sapiens
gagagagagtgtgtg

SEQ ID NO: 4397478 - DNA, 16 bp, Homo sapiens
gagagagagtgtgtgt

SEQ ID NO: 4397479 - DNA, 16 bp, Homo sapiens
gagagcagaggtctcc

SEQ ID NO: 4397480 - DNA, 23 bp, Homo sapiens
gagagcagcattcccagggacct

SEQ ID NO: 4397481 - DNA, 15 bp, Homo sapiens
gagagcagctccctt

SEQ ID NO: 4397482 - DNA, 20 bp, Homo sapiens
gagagcagctccctttctca

SEQ ID NO: 4397483 - DNA, 16 bp, Homo sapiens
gagagccaccaagagg

SEQ ID NO: 4397484 - DNA, 20 bp, Homo sapiens
gagagccagccctccctgtc

SEQ ID NO: 4397485 - DNA, 17 bp, Homo sapiens
gagagccagtggcgggt

SEQ ID NO: 4397486 - DNA, 14 bp, Homo sapiens
gagagccctgaggc

SEQ ID NO: 4397487 - DNA, 14 bp, Homo sapiens
gagagcccttccca

SEQ ID NO: 4397488 - DNA, 16 bp, Homo sapiens
gagagcccttcccagg

SEQ ID NO: 4397489 - DNA, 14 bp, Homo sapiens
gagagcctgctggc

SEQ ID NO: 4397490 - DNA, 17 bp, Homo sapiens
gagagcttggactacac

SEQ ID NO: 4397491 - DNA, 19 bp, Homo sapiens
gagagcttggactacacaa

SEQ ID NO: 4397492 - DNA, 10 bp, Homo sapiens
gagaggacag

SEQ ID NO: 4397493 - DNA, 14 bp, Homo sapiens
gagaggcaatgatt

SEQ ID NO: 4397494 - DNA, 13 bp, Homo sapiens
gagaggcaccagt

SEQ ID NO: 4397495 - DNA, 18 bp, Homo sapiens
gagaggcaccagtccagc

SEQ ID NO: 4397496 - DNA, 12 bp, Homo sapiens
gagaggcaggca

SEQ ID NO: 4397497 - DNA, 16 bp, Homo sapiens
gagaggcggcctcgtg

SEQ ID NO: 4397498 - DNA, 10 bp, Homo sapiens
gagagggaga

SEQ ID NO: 4397499 - DNA, 23 bp, Homo sapiens
gagagggaggtcactggaaaggg

SEQ ID NO: 4397500 - DNA, 23 bp, Homo sapiens
gagagggatttccctgcagacct

SEQ ID NO: 4397501 - DNA, 19 bp, Homo sapiens
gagagggcccaggtcccaa

SEQ ID NO: 4397502 - DNA, 15 bp, Homo sapiens
gagagggctggtcct

SEQ ID NO: 4397503 - DNA, 17 bp, Homo sapiens
gagaggtggatcctgta

SEQ ID NO: 4397504 - DNA, 23 bp, Homo sapiens
gagaggtgggaggaactccttgc

SEQ ID NO: 4397505 - DNA, 20 bp, Homo sapiens
gagagtagccgagagcctgc

SEQ ID NO: 4397506 - DNA, 14 bp, Homo sapiens
gagagtcaaagctg

SEQ ID NO: 4397507 - DNA, 16 bp, Homo sapiens
gagagtcaaagctgac

SEQ ID NO: 4397508 - DNA, 20 bp, Homo sapiens
gagagtcattcaggtgacct

SEQ ID NO: 4397509 - DNA, 19 bp, Homo sapiens
gagagtgaacaaatttaca

SEQ ID NO: 4397510 - DNA, 15 bp, Homo sapiens
gagagtgagtgcctt

SEQ ID NO: 4397511 - DNA, 18 bp, Homo sapiens
gagagtggacctgtgctg

SEQ ID NO: 4397512 - DNA, 20 bp, Homo sapiens
gagagttaataggagtattt

SEQ ID NO: 4397513 - DNA, 20 bp, Homo sapiens
gagagttcaagcctgtggga

SEQ ID NO: 4397514 - DNA, 18 bp, Homo sapiens
gagagttctttgctgccc

SEQ ID NO: 4397515 - DNA, 20 bp, Homo sapiens
gagagttctttgctgcccct

SEQ ID NO: 4397516 - DNA, 22 bp, Homo sapiens
gagagtttctatggattcactt

SEQ ID NO: 4397517 - DNA, 17 bp, Homo sapiens
gagataaaagcaattct

SEQ ID NO: 4397518 - DNA, 20 bp, Homo sapiens
gagataaaccaataaatcca

SEQ ID NO: 4397519 - DNA, 15 bp, Homo sapiens
gagataccagcgagg

SEQ ID NO: 4397520 - DNA, 16 bp, Homo sapiens
gagatatggcagcgaa

SEQ ID NO: 4397521 - DNA, 16 bp, Homo sapiens
gagatattattttaaa

SEQ ID NO: 4397522 - DNA, 14 bp, Homo sapiens
gagatattttgtaa

SEQ ID NO: 4397523 - DNA, 14 bp, Homo sapiens
gagatcaaagatga

SEQ ID NO: 4397524 - DNA, 17 bp, Homo sapiens
gagatcgagaccatcct

SEQ ID NO: 4397525 - DNA, 21 bp, Homo sapiens
gagatcgtgccgttactctcc

SEQ ID NO: 4397526 - DNA, 15 bp, Homo sapiens
gagatctcccttctc

SEQ ID NO: 4397527 - DNA, 18 bp, Homo sapiens
gagatctgcacagtcaga

SEQ ID NO: 4397528 - DNA, 18 bp, Homo sapiens
gagatgaaactggttcct

SEQ ID NO: 4397529 - DNA, 17 bp, Homo sapiens
gagatgaccagggatgc

SEQ ID NO: 4397530 - DNA, 12 bp, Homo sapiens
gagatgagaaag

SEQ ID NO: 4397531 - DNA, 20 bp, Homo sapiens
gagatgagaaagcttttatt

SEQ ID NO: 4397532 - DNA, 20 bp, Homo sapiens
gagatgaggagtaaaattca

SEQ ID NO: 4397533 - DNA, 17 bp, Homo sapiens
gagatgagtgggcttcg

SEQ ID NO: 4397534 - DNA, 16 bp, Homo sapiens
gagatgattcagaggt

SEQ ID NO: 4397535 - DNA, 12 bp, Homo sapiens
gagatgatttcc

SEQ ID NO: 4397536 - DNA, 20 bp, Homo sapiens
gagatgcctccaccgctgcc

SEQ ID NO: 4397537 - DNA, 23 bp, Homo sapiens
gagatgcctccaccgctgcctaa

SEQ ID NO: 4397538 - DNA, 15 bp, Homo sapiens
gagatgcttctctcc

SEQ ID NO: 4397539 - DNA, 22 bp, Homo sapiens
gagatggaattgtaataaacca

SEQ ID NO: 4397540 - DNA, 14 bp, Homo sapiens
gagatggagggctt

SEQ ID NO: 4397541 - DNA, 15 bp, Homo sapiens
gagatggagggcttg

SEQ ID NO: 4397542 - DNA, 17 bp, Homo sapiens
gagatggagggcttggc

SEQ ID NO: 4397543 - DNA, 16 bp, Homo sapiens
gagatggccatgctca

SEQ ID NO: 4397544 - DNA, 20 bp, Homo sapiens
gagatgggaatgaggtggga

SEQ ID NO: 4397545 - DNA, 15 bp, Homo sapiens
gagatgggagctcct

SEQ ID NO: 4397546 - DNA, 23 bp, Homo sapiens
gagatgggagctcctctcctgga

SEQ ID NO: 4397547 - DNA, 15 bp, Homo sapiens
gagattacctcctga

SEQ ID NO: 4397548 - DNA, 23 bp, Homo sapiens
gagattatttacaagaagaactc

SEQ ID NO: 4397549 - DNA, 17 bp, Homo sapiens
gagattcagttttcatt

SEQ ID NO: 4397550 - DNA, 13 bp, Homo sapiens
gagattcattttc

SEQ ID NO: 4397551 - DNA, 21 bp, Homo sapiens
gagattcattttctagataca

SEQ ID NO: 4397552 - DNA, 21 bp, Homo sapiens
gagattgcaccactgcactcc

SEQ ID NO: 4397553 - DNA, 21 bp, Homo sapiens
gagattgcgccattgcactcc

SEQ ID NO: 4397554 - DNA, 21 bp, Homo sapiens
gagattggatcaagtattact

SEQ ID NO: 4397555 - DNA, 17 bp, Homo sapiens
gagattggatttgctgt

SEQ ID NO: 4397556 - DNA, 18 bp, Homo sapiens
gagattggatttgctgtg

SEQ ID NO: 4397557 - DNA, 21 bp, Homo sapiens
gagattgtgcccctgcactcc

SEQ ID NO: 4397558 - DNA, 21 bp, Homo sapiens
gagatttcatctgctctcctt

SEQ ID NO: 4397559 - DNA, 23 bp, Homo sapiens
gagatttcatctgctctccttcc

SEQ ID NO: 4397560 - DNA, 13 bp, Homo sapiens
gagcaaaactccg

SEQ ID NO: 4397561 - DNA, 13 bp, Homo sapiens
gagcaaaataatg

SEQ ID NO: 4397562 - DNA, 14 bp, Homo sapiens
gagcaaaggagaaa

SEQ ID NO: 4397563 - DNA, 14 bp, Homo sapiens
gagcaaaggccctg

SEQ ID NO: 4397564 - DNA, 18 bp, Homo sapiens
gagcaactccctctcagc

SEQ ID NO: 4397565 - DNA, 20 bp, Homo sapiens
gagcaagccggcaagcgagc

SEQ ID NO: 4397566 - DNA, 15 bp, Homo sapiens
gagcacatctctctg

SEQ ID NO: 4397567 - DNA, 17 bp, Homo sapiens
gagcacatctctctgcc

SEQ ID NO: 4397568 - DNA, 19 bp, Homo sapiens
gagcacatctctctgccct

SEQ ID NO: 4397569 - DNA, 13 bp, Homo sapiens
gagcacccagagc

SEQ ID NO: 4397570 - DNA, 14 bp, Homo sapiens
gagcaccccctgct

SEQ ID NO: 4397571 - DNA, 15 bp, Homo sapiens
gagcaccccctgctc

SEQ ID NO: 4397572 - DNA, 20 bp, Homo sapiens
gagcaccccctgctccacca

SEQ ID NO: 4397573 - DNA, 22 bp, Homo sapiens
gagcaccccctgctccaccagc

SEQ ID NO: 4397574 - DNA, 14 bp, Homo sapiens
gagcacctccacat

SEQ ID NO: 4397575 - DNA, 19 bp, Homo sapiens
gagcacgtggagatagtgc

SEQ ID NO: 4397576 - DNA, 21 bp, Homo sapiens
gagcacgtggagatagtgcca

SEQ ID NO: 4397577 - DNA, 23 bp, Homo sapiens
gagcacgtggagatagtgccagg

SEQ ID NO: 4397578 - DNA, 14 bp, Homo sapiens
gagcacttagcagg

SEQ ID NO: 4397579 - DNA, 20 bp, Homo sapiens
gagcactttaaaaacaggcc

SEQ ID NO: 4397580 - DNA, 22 bp, Homo sapiens
gactctgcgggaggctggggcc

SEQ ID NO: 4397581 - DNA, 20 bp, Homo sapiens
gactctggggtgcagcttca

SEQ ID NO: 4397582 - DNA, 15 bp, Homo sapiens
gactctgtgtggctg

SEQ ID NO: 4397583 - DNA, 16 bp, Homo sapiens
gactctgtgtggctgt

SEQ ID NO: 4397584 - DNA, 19 bp, Homo sapiens
gactctgtgtggctgtgca

SEQ ID NO: 4397585 - DNA, 22 bp, Homo sapiens
gactctttattgtctgtaaatc

SEQ ID NO: 4397586 - DNA, 19 bp, Homo sapiens
gactctttccgactgccca

SEQ ID NO: 4397587 - DNA, 21 bp, Homo sapiens
gactctttccgactgcccaga

SEQ ID NO: 4397588 - DNA, 21 bp, Homo sapiens
gactctttctgaaggaagaga

SEQ ID NO: 4397589 - DNA, 16 bp, Homo sapiens
gactctttctgagtgc

SEQ ID NO: 4397590 - DNA, 23 bp, Homo sapiens
gactgaaaaaaaaaaagaagaag

SEQ ID NO: 4397591 - DNA, 20 bp, Homo sapiens
gactgaaacaaaatgttttt

SEQ ID NO: 4397592 - DNA, 16 bp, Homo sapiens
gactgaatggactttg

SEQ ID NO: 4397593 - DNA, 13 bp, Homo sapiens
gactgacactact

SEQ ID NO: 4397594 - DNA, 13 bp, Homo sapiens
gactgagcagccg

SEQ ID NO: 4397595 - DNA, 15 bp, Homo sapiens
gactgagcagccgcc

SEQ ID NO: 4397596 - DNA, 14 bp, Homo sapiens
gactgagcccccac

SEQ ID NO: 4397597 - DNA, 15 bp, Homo sapiens
gactgagcccccacc

SEQ ID NO: 4397598 - DNA, 15 bp, Homo sapiens
gactgagggactctg

SEQ ID NO: 4397599 - DNA, 16 bp, Homo sapiens
gactgagggggcctgg

SEQ ID NO: 4397600 - DNA, 17 bp, Homo sapiens
gactgagggggcctgga

SEQ ID NO: 4397601 - DNA, 21 bp, Homo sapiens
gactgagtgagccttttgcag

SEQ ID NO: 4397602 - DNA, 15 bp, Homo sapiens
gactgagtgggaagc

SEQ ID NO: 4397603 - DNA, 19 bp, Homo sapiens
gactgagtgtgggagtgca

SEQ ID NO: 4397604 - DNA, 17 bp, Homo sapiens
gactgatgattttcctt

SEQ ID NO: 4397605 - DNA, 23 bp, Homo sapiens
gactgcaagagatggaaaaaaag

SEQ ID NO: 4397606 - DNA, 19 bp, Homo sapiens
gactgcaagcatttttcca

SEQ ID NO: 4397607 - DNA, 20 bp, Homo sapiens
gactgcaagcatttttccat

SEQ ID NO: 4397608 - DNA, 23 bp, Homo sapiens
gactgcagaggggaaagacttcc

SEQ ID NO: 4397609 - DNA, 17 bp, Homo sapiens
gactgcatggtaattta

SEQ ID NO: 4397610 - DNA, 15 bp, Homo sapiens
gactgcattgccgct

SEQ ID NO: 4397611 - DNA, 11 bp, Homo sapiens
gactgccaaat

SEQ ID NO: 4397612 - DNA, 19 bp, Homo sapiens
gactgcccagaaagtgggg

SEQ ID NO: 4397613 - DNA, 18 bp, Homo sapiens
gactgccccaactcctgg

SEQ ID NO: 4397614 - DNA, 22 bp, Homo sapiens
gactgcccccagaaagcctcct

SEQ ID NO: 4397615 - DNA, 17 bp, Homo sapiens
gactgccctctcgactg

SEQ ID NO: 4397616 - DNA, 14 bp, Homo sapiens
gactgcgctggacg

SEQ ID NO: 4397617 - DNA, 17 bp, Homo sapiens
gactgcgggagccagac

SEQ ID NO: 4397618 - DNA, 14 bp, Homo sapiens
gactgcgttctgca

SEQ ID NO: 4397619 - DNA, 14 bp, Homo sapiens
gactgctacctctg

SEQ ID NO: 4397620 - DNA, 19 bp, Homo sapiens
gactgctacctctgagaag

SEQ ID NO: 4397621 - DNA, 21 bp, Homo sapiens
gactgctcccggcccgcctgc

SEQ ID NO: 4397622 - DNA, 15 bp, Homo sapiens
gactgctgctctccc

SEQ ID NO: 4397623 - DNA, 20 bp, Homo sapiens
gactgctggttgacatcaga

SEQ ID NO: 4397624 - DNA, 20 bp, Homo sapiens
gactggaagctaatttgcat

SEQ ID NO: 4397625 - DNA, 15 bp, Homo sapiens
gactggaggaggcct

SEQ ID NO: 4397626 - DNA, 15 bp, Homo sapiens
gactggccagggcca

SEQ ID NO: 4397627 - DNA, 22 bp, Homo sapiens
gactggcccctgggtcagtctg

SEQ ID NO: 4397628 - DNA, 22 bp, Homo sapiens
gactggcgttcacctccctgct

SEQ ID NO: 4397629 - DNA, 20 bp, Homo sapiens
gactggctagagtcctcact

SEQ ID NO: 4397630 - DNA, 20 bp, Homo sapiens
gactggcttttattaatgca

SEQ ID NO: 4397631 - DNA, 22 bp, Homo sapiens
gactggcttttattaatgcact

SEQ ID NO: 4397632 - DNA, 23 bp, Homo sapiens
gactggcttttattaatgcactt

SEQ ID NO: 4397633 - DNA, 19 bp, Homo sapiens
gactgggagccacttctcc

SEQ ID NO: 4397634 - DNA, 20 bp, Homo sapiens
gactgggccccacatggctt

SEQ ID NO: 4397635 - DNA, 22 bp, Homo sapiens
gactggttcagaaatagctcct

SEQ ID NO: 4397636 - DNA, 15 bp, Homo sapiens
gactggtttctcctg

SEQ ID NO: 4397637 - DNA, 20 bp, Homo sapiens
gactgtacataattgcatga

SEQ ID NO: 4397638 - DNA, 21 bp, Homo sapiens
gactgtacataattgcatgaa

SEQ ID NO: 4397639 - DNA, 23 bp, Homo sapiens
gactgtaccatggtttgatatgt

SEQ ID NO: 4397640 - DNA, 19 bp, Homo sapiens
gactgtagccacagctgct

SEQ ID NO: 4397641 - DNA, 21 bp, Homo sapiens
gactgtagccacagctgctgt

SEQ ID NO: 4397642 - DNA, 15 bp, Homo sapiens
gactgtatattgcta

SEQ ID NO: 4397643 - DNA, 17 bp, Homo sapiens
gactgtatattgctaag

SEQ ID NO: 4397644 - DNA, 23 bp, Homo sapiens
gactgtcacggggttccctccta

SEQ ID NO: 4397645 - DNA, 22 bp, Homo sapiens
gactgtcagtggggcagcctct

SEQ ID NO: 4397646 - DNA, 11 bp, Homo sapiens
gactgtcccac

SEQ ID NO: 4397647 - DNA, 18 bp, Homo sapiens
gactgtgcctggctccct

SEQ ID NO: 4397648 - DNA, 15 bp, Homo sapiens
gactgtgggactcag

SEQ ID NO: 4397649 - DNA, 21 bp, Homo sapiens
gactgtgtctgcctgtcccca

SEQ ID NO: 4397650 - DNA, 21 bp, Homo sapiens
gactgttccaggccctccagt

SEQ ID NO: 4397651 - DNA, 14 bp, Homo sapiens
gactgttcctgtct

SEQ ID NO: 4397652 - DNA, 15 bp, Homo sapiens
gactgtttcacattg

SEQ ID NO: 4397653 - DNA, 23 bp, Homo sapiens
gacttaaagggcccaatgaatta

SEQ ID NO: 4397654 - DNA, 20 bp, Homo sapiens
gacttaagcatctggctcta

SEQ ID NO: 4397655 - DNA, 13 bp, Homo sapiens
gacttactgcagt

SEQ ID NO: 4397656 - DNA, 17 bp, Homo sapiens
gacttatagtacatgat

SEQ ID NO: 4397657 - DNA, 19 bp, Homo sapiens
gacttatttctgctctgga

SEQ ID NO: 4397658 - DNA, 14 bp, Homo sapiens
gacttcaactgccc

SEQ ID NO: 4397659 - DNA, 18 bp, Homo sapiens
gacttcaactgcccagca

SEQ ID NO: 4397660 - DNA, 22 bp, Homo sapiens
gacttcacactgcaagagcctt

SEQ ID NO: 4397661 - DNA, 24 bp, Homo sapiens
gacttcaggtggagagcactagaa

SEQ ID NO: 4397662 - DNA, 15 bp, Homo sapiens
gacttcagtcttgcc

SEQ ID NO: 4397663 - DNA, 16 bp, Homo sapiens
gacttcagtcttgcct

SEQ ID NO: 4397664 - DNA, 12 bp, Homo sapiens
gacttcccagct

SEQ ID NO: 4397665 - DNA, 15 bp, Homo sapiens
gacttccccatcccg

SEQ ID NO: 4397666 - DNA, 14 bp, Homo sapiens
gacttccttatttc

SEQ ID NO: 4397667 - DNA, 16 bp, Homo sapiens
gacttctaagtaaaac

SEQ ID NO: 4397668 - DNA, 14 bp, Homo sapiens
gacttctacccaga

SEQ ID NO: 4397669 - DNA, 17 bp, Homo sapiens
gacttctattttaaaga

SEQ ID NO: 4397670 - DNA, 12 bp, Homo sapiens
gacttctgctgc

SEQ ID NO: 4397671 - DNA, 13 bp, Homo sapiens
gacttctgctgct

SEQ ID NO: 4397672 - DNA, 20 bp, Homo sapiens
gacttgaagcacagagggct

SEQ ID NO: 4397673 - DNA, 13 bp, Homo sapiens
gacttgagatgaa

SEQ ID NO: 4397674 - DNA, 14 bp, Homo sapiens
gacttgagccactc

SEQ ID NO: 4397675 - DNA, 16 bp, Homo sapiens
gacttgcacagggatt

SEQ ID NO: 4397676 - DNA, 18 bp, Homo sapiens
gacttgcacagggattct

SEQ ID NO: 4397677 - DNA, 17 bp, Homo sapiens
gacttgctccctctcca

SEQ ID NO: 4397678 - DNA, 22 bp, Homo sapiens
gacttgctttaaatagatttca

SEQ ID NO: 4397679 - DNA, 15 bp, Homo sapiens
gacttggacttttga

SEQ ID NO: 4397680 - DNA, 18 bp, Homo sapiens
gacttggagactcctggt

SEQ ID NO: 4397681 - DNA, 20 bp, Homo sapiens
gacttggagactcctggtct

SEQ ID NO: 4397682 - DNA, 19 bp, Homo sapiens
gacttggatcccaaagcaa

SEQ ID NO: 4397683 - DNA, 22 bp, Homo sapiens
gacttgtacaaacagtatttct

SEQ ID NO: 4397684 - DNA, 22 bp, Homo sapiens
gactttacaaacctttgtttca

SEQ ID NO: 4397685 - DNA, 17 bp, Homo sapiens
gactttatgtagttttt

SEQ ID NO: 4397686 - DNA, 14 bp, Homo sapiens
gactttatttattt

SEQ ID NO: 4397687 - DNA, 19 bp, Homo sapiens
gactttatttatttctagt

SEQ ID NO: 4397688 - DNA, 11 bp, Homo sapiens
gactttcttct

SEQ ID NO: 4397689 - DNA, 14 bp, Homo sapiens
gactttctttttct

SEQ ID NO: 4397690 - DNA, 16 bp, Homo sapiens
gactttctttttctac

SEQ ID NO: 4397691 - DNA, 19 bp, Homo sapiens
gactttgtgttcatttcat

SEQ ID NO: 4397692 - DNA, 13 bp, Homo sapiens
gacttttaaaatt

SEQ ID NO: 4397693 - DNA, 16 bp, Homo sapiens
gacttttatgtgagat

SEQ ID NO: 4397694 - DNA, 18 bp, Homo sapiens
gacttttcaataaatcag

SEQ ID NO: 4397695 - DNA, 17 bp, Homo sapiens
gacttttcctgctgcct

SEQ ID NO: 4397696 - DNA, 13 bp, Homo sapiens
gactttttataaa

SEQ ID NO: 4397697 - DNA, 16 bp, Homo sapiens
gactttttgcatttaa

SEQ ID NO: 4397698 - DNA, 18 bp, Homo sapiens
gactttttggtggatgta

SEQ ID NO: 4397699 - DNA, 23 bp, Homo sapiens
gactttttggtggatgtaaataa

SEQ ID NO: 4397700 - DNA, 16 bp, Homo sapiens
gaccagggtggccaca

SEQ ID NO: 4397701 - DNA, 20 bp, Homo sapiens
gaccagggtggccacacagg

SEQ ID NO: 4397702 - DNA, 18 bp, Homo sapiens
gaccagtcaacctgggca

SEQ ID NO: 4397703 - DNA, 15 bp, Homo sapiens
gaccagtgcctgtga

SEQ ID NO: 4397704 - DNA, 13 bp, Homo sapiens
gaccagtttcttt

SEQ ID NO: 4397705 - DNA, 18 bp, Homo sapiens
gaccatattacctggatt

SEQ ID NO: 4397706 - DNA, 13 bp, Homo sapiens
gaccatcactgag

SEQ ID NO: 4397707 - DNA, 21 bp, Homo sapiens
gaccatccagaggaataaaaa

SEQ ID NO: 4397708 - DNA, 14 bp, Homo sapiens
gaccatccattctc

SEQ ID NO: 4397709 - DNA, 17 bp, Homo sapiens
gaccatccattctcctc

SEQ ID NO: 4397710 - DNA, 19 bp, Homo sapiens
gaccatccattctcctcag

SEQ ID NO: 4397711 - DNA, 14 bp, Homo sapiens
gaccatcctggcta

SEQ ID NO: 4397712 - DNA, 13 bp, Homo sapiens
gaccatgccagat

SEQ ID NO: 4397713 - DNA, 13 bp, Homo sapiens
gaccattattcac

SEQ ID NO: 4397714 - DNA, 20 bp, Homo sapiens
gacccaaaaggcagaagcaa

SEQ ID NO: 4397715 - DNA, 14 bp, Homo sapiens
gacccaaggaggaa

SEQ ID NO: 4397716 - DNA, 12 bp, Homo sapiens
gacccaccccaa

SEQ ID NO: 4397717 - DNA, 15 bp, Homo sapiens
gacccaccccaactc

SEQ ID NO: 4397718 - DNA, 22 bp, Homo sapiens
gacccacccccagccttgccca

SEQ ID NO: 4397719 - DNA, 23 bp, Homo sapiens
gacccacccccagccttgcccag

SEQ ID NO: 4397720 - DNA, 21 bp, Homo sapiens
gacccacctgtggggcctggg

SEQ ID NO: 4397721 - DNA, 16 bp, Homo sapiens
gacccagaatggagcc

SEQ ID NO: 4397722 - DNA, 16 bp, Homo sapiens
gacccagacccagtgg

SEQ ID NO: 4397723 - DNA, 14 bp, Homo sapiens
gacccagaggtcca

SEQ ID NO: 4397724 - DNA, 18 bp, Homo sapiens
gacccagaggtccaggtc

SEQ ID NO: 4397725 - DNA, 19 bp, Homo sapiens
gacccagagtggagtctga

SEQ ID NO: 4397726 - DNA, 16 bp, Homo sapiens
gacccaggagtccaga

SEQ ID NO: 4397727 - DNA, 17 bp, Homo sapiens
gacccaggagtccagac

SEQ ID NO: 4397728 - DNA, 21 bp, Homo sapiens
gacccagggcctgacttgagc

SEQ ID NO: 4397729 - DNA, 16 bp, Homo sapiens
gacccaggggtccagg

SEQ ID NO: 4397730 - DNA, 13 bp, Homo sapiens
gacccaggtggct

SEQ ID NO: 4397731 - DNA, 16 bp, Homo sapiens
gacccagtccctgggg

SEQ ID NO: 4397732 - DNA, 20 bp, Homo sapiens
gacccagtggtcagcaggtg

SEQ ID NO: 4397733 - DNA, 13 bp, Homo sapiens
gacccatggtcat

SEQ ID NO: 4397734 - DNA, 19 bp, Homo sapiens
gacccccactctcattccc

SEQ ID NO: 4397735 - DNA, 11 bp, Homo sapiens
gacccccaggc

SEQ ID NO: 4397736 - DNA, 17 bp, Homo sapiens
gacccccaggcagaggg

SEQ ID NO: 4397737 - DNA, 24 bp, Homo sapiens
gacccccaggcctgtccaccctgc

SEQ ID NO: 4397738 - DNA, 18 bp, Homo sapiens
gacccccatttgtcccag

SEQ ID NO: 4397739 - DNA, 20 bp, Homo sapiens
gaccccccaccaccagccgg

SEQ ID NO: 4397740 - DNA, 20 bp, Homo sapiens
gaccccccagcccctcctcc

SEQ ID NO: 4397741 - DNA, 17 bp, Homo sapiens
cttgaagaaacagagtg

SEQ ID NO: 4397742 - DNA, 18 bp, Homo sapiens
cttgaagcacagagggct

SEQ ID NO: 4397743 - DNA, 14 bp, Homo sapiens
cttgaagccaaaga

SEQ ID NO: 4397744 - DNA, 17 bp, Homo sapiens
cttgaatagtattgtgt

SEQ ID NO: 4397745 - DNA, 18 bp, Homo sapiens
cttgaatagtattgtgtt

SEQ ID NO: 4397746 - DNA, 15 bp, Homo sapiens
cttgaatataaaaaa

SEQ ID NO: 4397747 - DNA, 16 bp, Homo sapiens
cttgaatcctatgtat

SEQ ID NO: 4397748 - DNA, 17 bp, Homo sapiens
cttgaattgtaactgtt

SEQ ID NO: 4397749 - DNA, 16 bp, Homo sapiens
cttgacaatcatctcc

SEQ ID NO: 4397750 - DNA, 13 bp, Homo sapiens
cttgacagtctga

SEQ ID NO: 4397751 - DNA, 14 bp, Homo sapiens
cttgacatacctac

SEQ ID NO: 4397752 - DNA, 20 bp, Homo sapiens
cttgacatacctaccagtat

SEQ ID NO: 4397753 - DNA, 17 bp, Homo sapiens
cttgaccattggctgcg

SEQ ID NO: 4397754 - DNA, 23 bp, Homo sapiens
cttgactccactactttactgtt

SEQ ID NO: 4397755 - DNA, 13 bp, Homo sapiens
cttgactctaata

SEQ ID NO: 4397756 - DNA, 22 bp, Homo sapiens
cttgagaaatatggacacttaa

SEQ ID NO: 4397757 - DNA, 13 bp, Homo sapiens
cttgagaaccttt

SEQ ID NO: 4397758 - DNA, 16 bp, Homo sapiens
cttgagacctcagcca

SEQ ID NO: 4397759 - DNA, 14 bp, Homo sapiens
cttgagcaggatta

SEQ ID NO: 4397760 - DNA, 23 bp, Homo sapiens
cttgagcatcaatcttgttactg

SEQ ID NO: 4397761 - DNA, 15 bp, Homo sapiens
cttgagccactcctt

SEQ ID NO: 4397762 - DNA, 12 bp, Homo sapiens
cttgagccctgg

SEQ ID NO: 4397763 - DNA, 14 bp, Homo sapiens
cttgagccctggct

SEQ ID NO: 4397764 - DNA, 19 bp, Homo sapiens
cttgagccgggcccctggg

SEQ ID NO: 4397765 - DNA, 20 bp, Homo sapiens
cttgagccgggcccctgggc

SEQ ID NO: 4397766 - DNA, 14 bp, Homo sapiens
cttgagcggagccc

SEQ ID NO: 4397767 - DNA, 13 bp, Homo sapiens
cttgagcttggga

SEQ ID NO: 4397768 - DNA, 13 bp, Homo sapiens
cttgaggacagac

SEQ ID NO: 4397769 - DNA, 23 bp, Homo sapiens
cttgaggaggagctggcctgcgg

SEQ ID NO: 4397770 - DNA, 15 bp, Homo sapiens
cttgagtaagtgaag

SEQ ID NO: 4397771 - DNA, 21 bp, Homo sapiens
cttgagtataagataaaataa

SEQ ID NO: 4397772 - DNA, 17 bp, Homo sapiens
cttgagttcccagatgg

SEQ ID NO: 4397773 - DNA, 13 bp, Homo sapiens
cttgatctatcta

SEQ ID NO: 4397774 - DNA, 15 bp, Homo sapiens
cttgatctatctaca

SEQ ID NO: 4397775 - DNA, 17 bp, Homo sapiens
cttgatctctcttgtcc

SEQ ID NO: 4397776 - DNA, 18 bp, Homo sapiens
cttgatgaccaaagtcct

SEQ ID NO: 4397777 - DNA, 21 bp, Homo sapiens
cttgatgcatgcactgttccc

SEQ ID NO: 4397778 - DNA, 22 bp, Homo sapiens
cttgatgtacataactcctgtc

SEQ ID NO: 4397779 - DNA, 18 bp, Homo sapiens
cttgatgttccacctgcc

SEQ ID NO: 4397780 - DNA, 20 bp, Homo sapiens
cttgatgttccacctgccac

SEQ ID NO: 4397781 - DNA, 21 bp, Homo sapiens
cttgatgttccacctgccaca

SEQ ID NO: 4397782 - DNA, 13 bp, Homo sapiens
cttgattctgcag

SEQ ID NO: 4397783 - DNA, 20 bp, Homo sapiens
cttgattctgcagtaaatct

SEQ ID NO: 4397784 - DNA, 19 bp, Homo sapiens
cttgcaacctcaccttcct

SEQ ID NO: 4397785 - DNA, 21 bp, Homo sapiens
cttgcaagggaagagccttta

SEQ ID NO: 4397786 - DNA, 15 bp, Homo sapiens
cttgcaatagtttgc

SEQ ID NO: 4397787 - DNA, 17 bp, Homo sapiens
cttgcaatccaggctgt

SEQ ID NO: 4397788 - DNA, 13 bp, Homo sapiens
cttgcaatctaat

SEQ ID NO: 4397789 - DNA, 17 bp, Homo sapiens
cttgcaatctaatctga

SEQ ID NO: 4397790 - DNA, 18 bp, Homo sapiens
cttgcaatctaatctgaa

SEQ ID NO: 4397791 - DNA, 22 bp, Homo sapiens
cttgcacagccaacgagacaca

SEQ ID NO: 4397792 - DNA, 13 bp, Homo sapiens
cttgcacctgcat

SEQ ID NO: 4397793 - DNA, 21 bp, Homo sapiens
cttgcacgcgccctttctacc

SEQ ID NO: 4397794 - DNA, 13 bp, Homo sapiens
cttgcactgtggt

SEQ ID NO: 4397795 - DNA, 21 bp, Homo sapiens
cttgcaggggtcccccctcaa

SEQ ID NO: 4397796 - DNA, 22 bp, Homo sapiens
cttgcagttcagcaccacccta

SEQ ID NO: 4397797 - DNA, 17 bp, Homo sapiens
cttgcatccattgttgt

SEQ ID NO: 4397798 - DNA, 13 bp, Homo sapiens
cttgcatgcttgc

SEQ ID NO: 4397799 - DNA, 18 bp, Homo sapiens
cttgcatggtttggagct

SEQ ID NO: 4397800 - DNA, 20 bp, Homo sapiens
cttgcatggtttggagctga

SEQ ID NO: 4397801 - DNA, 21 bp, Homo sapiens
cttgcatttgtggtaatctac

SEQ ID NO: 4397802 - DNA, 21 bp, Homo sapiens
cttgccaaagtacagaatttg

SEQ ID NO: 4397803 - DNA, 23 bp, Homo sapiens
cttgccaagtaatcctgcacaga

SEQ ID NO: 4397804 - DNA, 13 bp, Homo sapiens
cttgccaccccac

SEQ ID NO: 4397805 - DNA, 21 bp, Homo sapiens
cttgccaccccaccctccctg

SEQ ID NO: 4397806 - DNA, 16 bp, Homo sapiens
cttgccaggctccctt

SEQ ID NO: 4397807 - DNA, 18 bp, Homo sapiens
cttgccatttgtagcttt

SEQ ID NO: 4397808 - DNA, 18 bp, Homo sapiens
cttgcccatcctgactga

SEQ ID NO: 4397809 - DNA, 20 bp, Homo sapiens
cttgccccccgccctcatgg

SEQ ID NO: 4397810 - DNA, 17 bp, Homo sapiens
cttgcccgctcccacag

SEQ ID NO: 4397811 - DNA, 16 bp, Homo sapiens
cttgccctcctgggcc

SEQ ID NO: 4397812 - DNA, 17 bp, Homo sapiens
cttgccctcctgggccc

SEQ ID NO: 4397813 - DNA, 21 bp, Homo sapiens
cttgccctgagcactcctggt

SEQ ID NO: 4397814 - DNA, 18 bp, Homo sapiens
cttgccctggtgcctcac

SEQ ID NO: 4397815 - DNA, 14 bp, Homo sapiens
cttgccctgttaaa

SEQ ID NO: 4397816 - DNA, 23 bp, Homo sapiens
cttgccggctccccctccagcca

SEQ ID NO: 4397817 - DNA, 24 bp, Homo sapiens
cttgcctctgcacaccctccagag

SEQ ID NO: 4397818 - DNA, 19 bp, Homo sapiens
cttgcctctgccctggatt

SEQ ID NO: 4397819 - DNA, 16 bp, Homo sapiens
cttgcctgaactccag

SEQ ID NO: 4397820 - DNA, 18 bp, Homo sapiens
cttgcctgaactccagag

SEQ ID NO: 4397821 - DNA, 19 bp, Homo sapiens
cttgcctgaactccagagg

SEQ ID NO: 4397822 - DNA, 20 bp, Homo sapiens
cttgcctgaactccagaggt

SEQ ID NO: 4397823 - DNA, 18 bp, Homo sapiens
cttgccttattagagtgt

SEQ ID NO: 4397824 - DNA, 20 bp, Homo sapiens
cttgccttgaaatttacaca

SEQ ID NO: 4397825 - DNA, 16 bp, Homo sapiens
cttgccttttgttaat

SEQ ID NO: 4397826 - DNA, 20 bp, Homo sapiens
cttgccttttgttaatgcat

SEQ ID NO: 4397827 - DNA, 22 bp, Homo sapiens
cttgccttttgttaatgcattg

SEQ ID NO: 4397828 - DNA, 23 bp, Homo sapiens
cttgccttttgttaatgcattgt

SEQ ID NO: 4397829 - DNA, 13 bp, Homo sapiens
cttgcgagtccaa

SEQ ID NO: 4397830 - DNA, 15 bp, Homo sapiens
cttgcgagtccaagg

SEQ ID NO: 4397831 - DNA, 21 bp, Homo sapiens
cttgcgcctcagccctcagtt

SEQ ID NO: 4397832 - DNA, 17 bp, Homo sapiens
cttgctaccagtattta

SEQ ID NO: 4397833 - DNA, 20 bp, Homo sapiens
cttgctaccagtatttagaa

SEQ ID NO: 4397834 - DNA, 16 bp, Homo sapiens
cttgctcccaacccat

SEQ ID NO: 4397835 - DNA, 14 bp, Homo sapiens
cttgctccctctcc

SEQ ID NO: 4397836 - DNA, 17 bp, Homo sapiens
cttgctcgcttgctgga

SEQ ID NO: 4397837 - DNA, 15 bp, Homo sapiens
cttgctctcttcaat

SEQ ID NO: 4397838 - DNA, 21 bp, Homo sapiens
cttgctctcttcaataaacca

SEQ ID NO: 4397839 - DNA, 13 bp, Homo sapiens
cttgctctgtccc

SEQ ID NO: 4397840 - DNA, 14 bp, Homo sapiens
cttgctctgtcccc

SEQ ID NO: 4397841 - DNA, 19 bp, Homo sapiens
cttgctctgttacccaggc

SEQ ID NO: 4397842 - DNA, 16 bp, Homo sapiens
cttgctgacttagcct

SEQ ID NO: 4397843 - DNA, 19 bp, Homo sapiens
cttgctgacttagcctcct

SEQ ID NO: 4397844 - DNA, 20 bp, Homo sapiens
cttgctgcaagcacagccct

SEQ ID NO: 4397845 - DNA, 21 bp, Homo sapiens
cttgctgcaagcacagccctt

SEQ ID NO: 4397846 - DNA, 17 bp, Homo sapiens
cttgctgcactcttgca

SEQ ID NO: 4397847 - DNA, 19 bp, Homo sapiens
cttgctggaacacaggggc

SEQ ID NO: 4397848 - DNA, 23 bp, Homo sapiens
cttgctggggacggggggcccca

SEQ ID NO: 4397849 - DNA, 15 bp, Homo sapiens
cttgctgtgaattaa

SEQ ID NO: 4397850 - DNA, 19 bp, Homo sapiens
cttgctgttgacatattta

SEQ ID NO: 4397851 - DNA, 17 bp, Homo sapiens
cttgcttaaatttctta

SEQ ID NO: 4397852 - DNA, 11 bp, Homo sapiens
cttgcttctgc

SEQ ID NO: 4397853 - DNA, 12 bp, Homo sapiens
cttgcttctgca

SEQ ID NO: 4397854 - DNA, 16 bp, Homo sapiens
cttgcttctgcagcaa

SEQ ID NO: 4397855 - DNA, 23 bp, Homo sapiens
cttgcttctgcagcaactcccac

SEQ ID NO: 4397856 - DNA, 14 bp, Homo sapiens
cttgcttctttcta

SEQ ID NO: 4397857 - DNA, 15 bp, Homo sapiens
cttgcttctttctag

SEQ ID NO: 4397858 - DNA, 19 bp, Homo sapiens
cttgcttctttctagaaag

SEQ ID NO: 4397859 - DNA, 23 bp, Homo sapiens
cttgcttgccctccaaatgtcct

SEQ ID NO: 4397860 - DNA, 18 bp, Homo sapiens
cttgcttggggaacttgt

SEQ ID NO: 4397861 - DNA, 13 bp, Homo sapiens
cttccccagaccc

SEQ ID NO: 4397862 - DNA, 14 bp, Homo sapiens
cttccccagaccca

SEQ ID NO: 4397863 - DNA, 22 bp, Homo sapiens
cttccccagacccagaggtcca

SEQ ID NO: 4397864 - DNA, 23 bp, Homo sapiens
cttccccagacccagaggtccag

SEQ ID NO: 4397865 - DNA, 13 bp, Homo sapiens
cttccccatcccg

SEQ ID NO: 4397866 - DNA, 14 bp, Homo sapiens
cttccccatcccga

SEQ ID NO: 4397867 - DNA, 14 bp, Homo sapiens
cttcccccatccct

SEQ ID NO: 4397868 - DNA, 15 bp, Homo sapiens
cttcccccatcccta

SEQ ID NO: 4397869 - DNA, 20 bp, Homo sapiens
cttcccctccctggctccca

SEQ ID NO: 4397870 - DNA, 14 bp, Homo sapiens
cttcccctccctgt

SEQ ID NO: 4397871 - DNA, 20 bp, Homo sapiens
cttcccctgaggacctttct

SEQ ID NO: 4397872 - DNA, 16 bp, Homo sapiens
cttcccctgctgacct

SEQ ID NO: 4397873 - DNA, 17 bp, Homo sapiens
cttccccttagaaacac

SEQ ID NO: 4397874 - DNA, 13 bp, Homo sapiens
cttccccttccct

SEQ ID NO: 4397875 - DNA, 19 bp, Homo sapiens
cttcccgcctccctctcag

SEQ ID NO: 4397876 - DNA, 22 bp, Homo sapiens
cttccctagctttagaccctgg

SEQ ID NO: 4397877 - DNA, 11 bp, Homo sapiens
cttccctccaa

SEQ ID NO: 4397878 - DNA, 17 bp, Homo sapiens
cttccctccgccttctc

SEQ ID NO: 4397879 - DNA, 17 bp, Homo sapiens
cttccctctctccctgc

SEQ ID NO: 4397880 - DNA, 20 bp, Homo sapiens
cttccctctctccctgcctc

SEQ ID NO: 4397881 - DNA, 23 bp, Homo sapiens
cttccctctctgatgtcccagtg

SEQ ID NO: 4397882 - DNA, 13 bp, Homo sapiens
cttccctgatggc

SEQ ID NO: 4397883 - DNA, 12 bp, Homo sapiens
cttccctgcctg

SEQ ID NO: 4397884 - DNA, 16 bp, Homo sapiens
cttccctgcctgtggc

SEQ ID NO: 4397885 - DNA, 20 bp, Homo sapiens
cttccctgcttcacgattct

SEQ ID NO: 4397886 - DNA, 15 bp, Homo sapiens
cttccctgctttgca

SEQ ID NO: 4397887 - DNA, 21 bp, Homo sapiens
cttccctgctttgcatctttg

SEQ ID NO: 4397888 - DNA, 17 bp, Homo sapiens
cttccctgtcagcctga

SEQ ID NO: 4397889 - DNA, 12 bp, Homo sapiens
cttccctgtccc

SEQ ID NO: 4397890 - DNA, 18 bp, Homo sapiens
cttcccttagcctctccc

SEQ ID NO: 4397891 - DNA, 19 bp, Homo sapiens
cttcccttagcctctccca

SEQ ID NO: 4397892 - DNA, 16 bp, Homo sapiens
cttcccttttctgttc

SEQ ID NO: 4397893 - DNA, 13 bp, Homo sapiens
cttccgctgaggg

SEQ ID NO: 4397894 - DNA, 21 bp, Homo sapiens
cttccgtggtcagagtgccac

SEQ ID NO: 4397895 - DNA, 21 bp, Homo sapiens
cttcctacaagagcagcctgt

SEQ ID NO: 4397896 - DNA, 22 bp, Homo sapiens
cttcctacaagagcagcctgtg

SEQ ID NO: 4397897 - DNA, 24 bp, Homo sapiens
cttcctacaagagcagcctgtggc

SEQ ID NO: 4397898 - DNA, 17 bp, Homo sapiens
cttcctaccaagtcaaa

SEQ ID NO: 4397899 - DNA, 16 bp, Homo sapiens
cttcctacccacacct

SEQ ID NO: 4397900 - DNA, 17 bp, Homo sapiens
cttcctaccctgcctcc

SEQ ID NO: 4397901 - DNA, 20 bp, Homo sapiens
cttcctaggccacgtccagg

SEQ ID NO: 4397902 - DNA, 18 bp, Homo sapiens
cttcctcaaatacatgca

SEQ ID NO: 4397903 - DNA, 21 bp, Homo sapiens
cttcctcacagtcccactgtg

SEQ ID NO: 4397904 - DNA, 16 bp, Homo sapiens
cttcctcccagcattg

SEQ ID NO: 4397905 - DNA, 13 bp, Homo sapiens
cttcctcctgcag

SEQ ID NO: 4397906 - DNA, 22 bp, Homo sapiens
cttcctcctgggccctctctgc

SEQ ID NO: 4397907 - DNA, 22 bp, Homo sapiens
cttcctctcaagctagccagag

SEQ ID NO: 4397908 - DNA, 15 bp, Homo sapiens
cttcctctcctgtct

SEQ ID NO: 4397909 - DNA, 17 bp, Homo sapiens
cttcctctgtgaactgt

SEQ ID NO: 4397910 - DNA, 17 bp, Homo sapiens
cttcctgacactttaat

SEQ ID NO: 4397911 - DNA, 18 bp, Homo sapiens
cttcctgacactttaatt

SEQ ID NO: 4397912 - DNA, 23 bp, Homo sapiens
cttcctgagggctaattctggga

SEQ ID NO: 4397913 - DNA, 19 bp, Homo sapiens
cttcctgattaccagtctg

SEQ ID NO: 4397914 - DNA, 22 bp, Homo sapiens
cttcctgattaccagtctgatt

SEQ ID NO: 4397915 - DNA, 21 bp, Homo sapiens
cttcctgcaggcaggaacaaa

SEQ ID NO: 4397916 - DNA, 17 bp, Homo sapiens
cttcctgccccccttgg

SEQ ID NO: 4397917 - DNA, 15 bp, Homo sapiens
cttcctgcccttccc

SEQ ID NO: 4397918 - DNA, 22 bp, Homo sapiens
cttcctggagcccagaggaggg

SEQ ID NO: 4397919 - DNA, 14 bp, Homo sapiens
cttcctgtctgttt

SEQ ID NO: 4397920 - DNA, 16 bp, Homo sapiens
cttcctgtgccctgca

SEQ ID NO: 4397921 - DNA, 19 bp, Homo sapiens
cttcctgtgcctttcctat

SEQ ID NO: 4397922 - DNA, 17 bp, Homo sapiens
cttcctgtggcctgaag

SEQ ID NO: 4397923 - DNA, 21 bp, Homo sapiens
cttcctgtggcctgaagaagc

SEQ ID NO: 4397924 - DNA, 19 bp, Homo sapiens
cttcctgtgtaacatctgc

SEQ ID NO: 4397925 - DNA, 15 bp, Homo sapiens
cttcctgtttctcgt

SEQ ID NO: 4397926 - DNA, 17 bp, Homo sapiens
cttccttcaggactctg

SEQ ID NO: 4397927 - DNA, 13 bp, Homo sapiens
cttccttccctgg

SEQ ID NO: 4397928 - DNA, 14 bp, Homo sapiens
cttccttcctgctt

SEQ ID NO: 4397929 - DNA, 15 bp, Homo sapiens
cttccttctacccca

SEQ ID NO: 4397930 - DNA, 20 bp, Homo sapiens
cttccttctttattgcccct

SEQ ID NO: 4397931 - DNA, 19 bp, Homo sapiens
cttcctttaggtctggttg

SEQ ID NO: 4397932 - DNA, 12 bp, Homo sapiens
cttcctttgaaa

SEQ ID NO: 4397933 - DNA, 19 bp, Homo sapiens
cttccttttccctgcttcc

SEQ ID NO: 4397934 - DNA, 22 bp, Homo sapiens
cttccttttccctgcttccagg

SEQ ID NO: 4397935 - DNA, 22 bp, Homo sapiens
cttccttttttaaaataaaata

SEQ ID NO: 4397936 - DNA, 12 bp, Homo sapiens
cttcgcacacac

SEQ ID NO: 4397937 - DNA, 17 bp, Homo sapiens
cttcgctggactattgt

SEQ ID NO: 4397938 - DNA, 22 bp, Homo sapiens
cttcggagatgaggagtaaaat

SEQ ID NO: 4397939 - DNA, 22 bp, Homo sapiens
cttcggagggcccctgcgtggg

SEQ ID NO: 4397940 - DNA, 17 bp, Homo sapiens
cttcgggcccttcccac

SEQ ID NO: 4397941 - DNA, 19 bp, Homo sapiens
cttcgtgcctgagaccagg

SEQ ID NO: 4397942 - DNA, 15 bp, Homo sapiens
cttcgtttattttca

SEQ ID NO: 4397943 - DNA, 14 bp, Homo sapiens
cttctaaaaatgaa

SEQ ID NO: 4397944 - DNA, 15 bp, Homo sapiens
cttctaaaatagcaa

SEQ ID NO: 4397945 - DNA, 18 bp, Homo sapiens
cttctaaacttccccatc

SEQ ID NO: 4397946 - DNA, 23 bp, Homo sapiens
cttctaaagcactggtttcaaga

SEQ ID NO: 4397947 - DNA, 24 bp, Homo sapiens
cttctaaatgagtcactgagcatc

SEQ ID NO: 4397948 - DNA, 17 bp, Homo sapiens
cttctaagtaaaaccac

SEQ ID NO: 4397949 - DNA, 17 bp, Homo sapiens
cttctaagtcattcata

SEQ ID NO: 4397950 - DNA, 15 bp, Homo sapiens
cttctacactagggg

SEQ ID NO: 4397951 - DNA, 17 bp, Homo sapiens
cttctacactctcctgg

SEQ ID NO: 4397952 - DNA, 19 bp, Homo sapiens
cttctacatgatgctaaag

SEQ ID NO: 4397953 - DNA, 18 bp, Homo sapiens
cttctaccccaaggccag

SEQ ID NO: 4397954 - DNA, 12 bp, Homo sapiens
cttctacctgcc

SEQ ID NO: 4397955 - DNA, 15 bp, Homo sapiens
cttctacctgccact

SEQ ID NO: 4397956 - DNA, 13 bp, Homo sapiens
cttctactcccct

SEQ ID NO: 4397957 - DNA, 14 bp, Homo sapiens
cttctactcctgcc

SEQ ID NO: 4397958 - DNA, 15 bp, Homo sapiens
cttctactcctgcct

SEQ ID NO: 4397959 - DNA, 17 bp, Homo sapiens
cttctacttttaactaa

SEQ ID NO: 4397960 - DNA, 20 bp, Homo sapiens
cttctagaacacctgccttc

SEQ ID NO: 4397961 - DNA, 19 bp, Homo sapiens
cttctagaatgtaaagtta

SEQ ID NO: 4397962 - DNA, 18 bp, Homo sapiens
cttctagatctcagccat

SEQ ID NO: 4397963 - DNA, 18 bp, Homo sapiens
cttctagatggaccccag

SEQ ID NO: 4397964 - DNA, 22 bp, Homo sapiens
cttctaggagtcaactggctgg

SEQ ID NO: 4397965 - DNA, 13 bp, Homo sapiens
cttctagtgcttt

SEQ ID NO: 4397966 - DNA, 12 bp, Homo sapiens
cttctataaaat

SEQ ID NO: 4397967 - DNA, 15 bp, Homo sapiens
cttctatacccaccc

SEQ ID NO: 4397968 - DNA, 16 bp, Homo sapiens
cttctattaatcaaga

SEQ ID NO: 4397969 - DNA, 13 bp, Homo sapiens
cttctcaccagct

SEQ ID NO: 4397970 - DNA, 20 bp, Homo sapiens
cttctcaccagctgcaaagt

SEQ ID NO: 4397971 - DNA, 13 bp, Homo sapiens
cttctcacgcttt

SEQ ID NO: 4397972 - DNA, 22 bp, Homo sapiens
cttctcacgctttgtttactct

SEQ ID NO: 4397973 - DNA, 15 bp, Homo sapiens
cttctcatctcccca

SEQ ID NO: 4397974 - DNA, 14 bp, Homo sapiens
cttctcatgatcca

SEQ ID NO: 4397975 - DNA, 18 bp, Homo sapiens
cttctccaattctgaaat

SEQ ID NO: 4397976 - DNA, 22 bp, Homo sapiens
cttctccagggaattcttacag

SEQ ID NO: 4397977 - DNA, 23 bp, Homo sapiens
cttctccagggaattcttacagc

SEQ ID NO: 4397978 - DNA, 12 bp, Homo sapiens
cttctcccaagc

SEQ ID NO: 4397979 - DNA, 17 bp, Homo sapiens
cttctcccacatgaggc

SEQ ID NO: 4397980 - DNA, 15 bp, Homo sapiens
cttctcccccacggt

SEQ ID NO: 4397981 - DNA, 22 bp, Homo sapiens
cttccatgttctgggtgatgga

SEQ ID NO: 4397982 - DNA, 17 bp, Homo sapiens
cttccattttcctacag

SEQ ID NO: 4397983 - DNA, 22 bp, Homo sapiens
cttcccaacgtactcctcagac

SEQ ID NO: 4397984 - DNA, 22 bp, Homo sapiens
cttcccaaggttactcagcagc

SEQ ID NO: 4397985 - DNA, 23 bp, Homo sapiens
cttcccaagtagctgggattaca

SEQ ID NO: 4397986 - DNA, 14 bp, Homo sapiens
cttcccacaggagg

SEQ ID NO: 4397987 - DNA, 10 bp, Homo sapiens
cttcccaggg

SEQ ID NO: 4397988 - DNA, 18 bp, Homo sapiens
cttcccagggcacccagg

SEQ ID NO: 4397989 - DNA, 11 bp, Homo sapiens
cttcccagggt

SEQ ID NO: 4397990 - DNA, 19 bp, Homo sapiens
cttcccagggtagcccgcc

SEQ ID NO: 4397991 - DNA, 17 bp, Homo sapiens
cttcccatcactggagc

SEQ ID NO: 4397992 - DNA, 18 bp, Homo sapiens
cttcccatcactggagca

SEQ ID NO: 4397993 - DNA, 23 bp, Homo sapiens
cttcccatgccggtacacagcca

SEQ ID NO: 4397994 - DNA, 24 bp, Homo sapiens
cttcccatgccggtacacagccag

SEQ ID NO: 4397995 - DNA, 14 bp, Homo sapiens
cttcccattaaaaa

SEQ ID NO: 4397996 - DNA, 15 bp, Homo sapiens
cttcccattgtggct

SEQ ID NO: 4397997 - DNA, 14 bp, Homo sapiens
cttcccatttcttc

SEQ ID NO: 4397998 - DNA, 19 bp, Homo sapiens
cttcccatttcttcccact

SEQ ID NO: 4397999 - DNA, 18 bp, Homo sapiens
cttccccaagctttaggt

SEQ ID NO: 4398000 - DNA, 15 bp, Homo sapiens
ctgggccctgcctgc

SEQ ID NO: 4398001 - DNA, 18 bp, Homo sapiens
ctgggccctgcctgcagc

SEQ ID NO: 4398002 - DNA, 22 bp, Homo sapiens
ctgggccctgcctgcagccagg

SEQ ID NO: 4398003 - DNA, 14 bp, Homo sapiens
ctgggccctgggct

SEQ ID NO: 4398004 - DNA, 18 bp, Homo sapiens
ctgggccctgtcgcccct

SEQ ID NO: 4398005 - DNA, 19 bp, Homo sapiens
ctggctctgcctcaggagg

SEQ ID NO: 4398006 - DNA, 12 bp, Homo sapiens
ctggctctgtga

SEQ ID NO: 4398007 - DNA, 14 bp, Homo sapiens
ctggctctgtggcg

SEQ ID NO: 4398008 - DNA, 16 bp, Homo sapiens
ctggctcttctgccca

SEQ ID NO: 4398009 - DNA, 17 bp, Homo sapiens
ctggctcttctgcccaa

SEQ ID NO: 4398010 - DNA, 15 bp, Homo sapiens
ctggctgaagaggac

SEQ ID NO: 4398011 - DNA, 20 bp, Homo sapiens
ctggctgaggttcctctgcc

SEQ ID NO: 4398012 - DNA, 21 bp, Homo sapiens
ctggctgaggttcctctgcct

SEQ ID NO: 4398013 - DNA, 13 bp, Homo sapiens
ctggctgctgccc

SEQ ID NO: 4398014 - DNA, 17 bp, Homo sapiens
ctggctgctgcccccac

SEQ ID NO: 4398015 - DNA, 17 bp, Homo sapiens
ctggctggaggagcagc

SEQ ID NO: 4398016 - DNA, 18 bp, Homo sapiens
ctggctggaggagcagca

SEQ ID NO: 4398017 - DNA, 16 bp, Homo sapiens
ctggctggccagtctg

SEQ ID NO: 4398018 - DNA, 21 bp, Homo sapiens
ctggctggtgggcccccaatg

SEQ ID NO: 4398019 - DNA, 23 bp, Homo sapiens
ctggctgtcctaccatcagctct

SEQ ID NO: 4398020 - DNA, 19 bp, Homo sapiens
ctggctgtgaatgccaaag

SEQ ID NO: 4398021 - DNA, 18 bp, Homo sapiens
ctggctgtgatcttaaaa

SEQ ID NO: 4398022 - DNA, 18 bp, Homo sapiens
ctggctgtggcctaacct

SEQ ID NO: 4398023 - DNA, 14 bp, Homo sapiens
ctggcttagtgcca

SEQ ID NO: 4398024 - DNA, 15 bp, Homo sapiens
ctggcttagtgccac

SEQ ID NO: 4398025 - DNA, 16 bp, Homo sapiens
ctggcttctgtggggc

SEQ ID NO: 4398026 - DNA, 17 bp, Homo sapiens
ctggcttctgtggggcc

SEQ ID NO: 4398027 - DNA, 23 bp, Homo sapiens
ctggcttctgtggggcccctcac

SEQ ID NO: 4398028 - DNA, 14 bp, Homo sapiens
ctggctttgcctct

SEQ ID NO: 4398029 - DNA, 16 bp, Homo sapiens
ctggctttgcctcttc

SEQ ID NO: 4398030 - DNA, 21 bp, Homo sapiens
ctggctttgcctcttctttgt

SEQ ID NO: 4398031 - DNA, 20 bp, Homo sapiens
ctggctttggcactctctgc

SEQ ID NO: 4398032 - DNA, 23 bp, Homo sapiens
ctggcttttattaatgcactttc

SEQ ID NO: 4398033 - DNA, 19 bp, Homo sapiens
ctggcttttgcctgtaaga

SEQ ID NO: 4398034 - DNA, 20 bp, Homo sapiens
ctgggaaatgagaaggcagc

SEQ ID NO: 4398035 - DNA, 15 bp, Homo sapiens
ctgggaactgcagac

SEQ ID NO: 4398036 - DNA, 18 bp, Homo sapiens
ctgggaactgcagacctg

SEQ ID NO: 4398037 - DNA, 19 bp, Homo sapiens
ctgggaacttgcgagtcca

SEQ ID NO: 4398038 - DNA, 20 bp, Homo sapiens
ctgggaagctgagggcaaat

SEQ ID NO: 4398039 - DNA, 14 bp, Homo sapiens
ctgggaagggagag

SEQ ID NO: 4398040 - DNA, 18 bp, Homo sapiens
ctgggacacagacccagg

SEQ ID NO: 4398041 - DNA, 22 bp, Homo sapiens
ctgggacaccattaccaaaata

SEQ ID NO: 4398042 - DNA, 13 bp, Homo sapiens
ctgggacccttgg

SEQ ID NO: 4398043 - DNA, 14 bp, Homo sapiens
ctgggaccctttcc

SEQ ID NO: 4398044 - DNA, 19 bp, Homo sapiens
ctgggaccctttccttcct

SEQ ID NO: 4398045 - DNA, 23 bp, Homo sapiens
ctgggaccctttccttccttccc

SEQ ID NO: 4398046 - DNA, 17 bp, Homo sapiens
ctgggacctgccaggca

SEQ ID NO: 4398047 - DNA, 18 bp, Homo sapiens
ctgggacctgccaggcag

SEQ ID NO: 4398048 - DNA, 22 bp, Homo sapiens
ctgggacggaccagcatctgga

SEQ ID NO: 4398049 - DNA, 13 bp, Homo sapiens
ctgggactctcct

SEQ ID NO: 4398050 - DNA, 20 bp, Homo sapiens
ctgggactctcctcctcccc

SEQ ID NO: 4398051 - DNA, 22 bp, Homo sapiens
ctgggactgtgcctggctccct

SEQ ID NO: 4398052 - DNA, 19 bp, Homo sapiens
ctgggacttgaacaaagac

SEQ ID NO: 4398053 - DNA, 22 bp, Homo sapiens
ctgggagccacttctccccaga

SEQ ID NO: 4398054 - DNA, 13 bp, Homo sapiens
ctgggagcccaga

SEQ ID NO: 4398055 - DNA, 12 bp, Homo sapiens
ctgggaggaacc

SEQ ID NO: 4398056 - DNA, 12 bp, Homo sapiens
ctgggaggacag

SEQ ID NO: 4398057 - DNA, 15 bp, Homo sapiens
ctgggaggacaggca

SEQ ID NO: 4398058 - DNA, 19 bp, Homo sapiens
ctgggaggacaggcaggcc

SEQ ID NO: 4398059 - DNA, 20 bp, Homo sapiens
ctgggaggacaggcaggcca

SEQ ID NO: 4398060 - DNA, 19 bp, Homo sapiens
ctgggagggcagcagggct

SEQ ID NO: 4398061 - DNA, 20 bp, Homo sapiens
ctgggagggcagcagggcta

SEQ ID NO: 4398062 - DNA, 22 bp, Homo sapiens
ctgggagggcagcagggctacc

SEQ ID NO: 4398063 - DNA, 20 bp, Homo sapiens
ctgggagtccctacctgctt

SEQ ID NO: 4398064 - DNA, 22 bp, Homo sapiens
ctgggagtgttcccgtgcctgg

SEQ ID NO: 4398065 - DNA, 23 bp, Homo sapiens
ctgggagtgttcccgtgcctggg

SEQ ID NO: 4398066 - DNA, 18 bp, Homo sapiens
ctgggatatggctgccca

SEQ ID NO: 4398067 - DNA, 18 bp, Homo sapiens
ctgggatcagctggtgtc

SEQ ID NO: 4398068 - DNA, 20 bp, Homo sapiens
ctgggatcctgactaagcct

SEQ ID NO: 4398069 - DNA, 16 bp, Homo sapiens
ctgggatgcttttgaa

SEQ ID NO: 4398070 - DNA, 19 bp, Homo sapiens
ctgggatgggaccagggat

SEQ ID NO: 4398071 - DNA, 23 bp, Homo sapiens
ctgggattaagaaaccttgctct

SEQ ID NO: 4398072 - DNA, 20 bp, Homo sapiens
ctgggattaaggcgtgagcc

SEQ ID NO: 4398073 - DNA, 21 bp, Homo sapiens
ctgggattacaggcgtgagcc

SEQ ID NO: 4398074 - DNA, 21 bp, Homo sapiens
ctgggatttatgctcatgaac

SEQ ID NO: 4398075 - DNA, 14 bp, Homo sapiens
ctgggcaaggaaaa

SEQ ID NO: 4398076 - DNA, 19 bp, Homo sapiens
ctgggcaaggaaaaagaaa

SEQ ID NO: 4398077 - DNA, 19 bp, Homo sapiens
ctgggcactggatgcatga

SEQ ID NO: 4398078 - DNA, 14 bp, Homo sapiens
ctgggcactggggc

SEQ ID NO: 4398079 - DNA, 17 bp, Homo sapiens
ctgggcagcacctctgg

SEQ ID NO: 4398080 - DNA, 21 bp, Homo sapiens
ctgggcagcacctctggtcag

SEQ ID NO: 4398081 - DNA, 16 bp, Homo sapiens
ctgggcagccaggctg

SEQ ID NO: 4398082 - DNA, 22 bp, Homo sapiens
ctgggcagtgagtgccatgctt

SEQ ID NO: 4398083 - DNA, 16 bp, Homo sapiens
ctgggcatcttctggc

SEQ ID NO: 4398084 - DNA, 19 bp, Homo sapiens
ctgggcatcttctggcttg

SEQ ID NO: 4398085 - DNA, 20 bp, Homo sapiens
ctgggcatggcagggccagg

SEQ ID NO: 4398086 - DNA, 23 bp, Homo sapiens
ctgggcatggcagggccaggcct

SEQ ID NO: 4398087 - DNA, 15 bp, Homo sapiens
ctgggcattttcctc

SEQ ID NO: 4398088 - DNA, 16 bp, Homo sapiens
ctgggcattttcctcc

SEQ ID NO: 4398089 - DNA, 21 bp, Homo sapiens
ctgggcattttcctcctctgc

SEQ ID NO: 4398090 - DNA, 23 bp, Homo sapiens
ctgggcattttcctcctctgcct

SEQ ID NO: 4398091 - DNA, 20 bp, Homo sapiens
ctgggccaattcaatacaaa

SEQ ID NO: 4398092 - DNA, 14 bp, Homo sapiens
ctgggccaccaggg

SEQ ID NO: 4398093 - DNA, 21 bp, Homo sapiens
ctgggccaccagggatcacag

SEQ ID NO: 4398094 - DNA, 16 bp, Homo sapiens
ctgggccacgccggcc

SEQ ID NO: 4398095 - DNA, 22 bp, Homo sapiens
ctgggccacgccggccacaccc

SEQ ID NO: 4398096 - DNA, 17 bp, Homo sapiens
ctgggccactggggact

SEQ ID NO: 4398097 - DNA, 17 bp, Homo sapiens
ctgggccagcggggctg

SEQ ID NO: 4398098 - DNA, 19 bp, Homo sapiens
ctgggccagcggggctgct

SEQ ID NO: 4398099 - DNA, 23 bp, Homo sapiens
ctgggccagtcaacggggggctc

SEQ ID NO: 4398100 - DNA, 19 bp, Homo sapiens
ctgggccatgtccaaagag

SEQ ID NO: 4398101 - DNA, 17 bp, Homo sapiens
ctgggcccaaccctgtc

SEQ ID NO: 4398102 - DNA, 18 bp, Homo sapiens
ctgggcccaaccctgtct

SEQ ID NO: 4398103 - DNA, 19 bp, Homo sapiens
ctgggccccacatggctta

SEQ ID NO: 4398104 - DNA, 13 bp, Homo sapiens
ctgggccccacca

SEQ ID NO: 4398105 - DNA, 13 bp, Homo sapiens
ctgggccccagcc

SEQ ID NO: 4398106 - DNA, 19 bp, Homo sapiens
ctgggcccctccacgcctc

SEQ ID NO: 4398107 - DNA, 22 bp, Homo sapiens
ctgggcccctccctacctcaac

SEQ ID NO: 4398108 - DNA, 14 bp, Homo sapiens
ctgggcccctgcac

SEQ ID NO: 4398109 - DNA, 18 bp, Homo sapiens
ctgggcccgagcctgaac

SEQ ID NO: 4398110 - DNA, 18 bp, Homo sapiens
ctgggccctctttccctg

SEQ ID NO: 4398111 - DNA, 22 bp, Homo sapiens
ctgggccctctttccctgcgag

SEQ ID NO: 4398112 - DNA, 11 bp, Homo sapiens
ctgggccctgc

SEQ ID NO: 4398113 - DNA, 23 bp, Homo sapiens
ctggatcagtaaaattatactgt

SEQ ID NO: 4398114 - DNA, 16 bp, Homo sapiens
ctggatccagcactgg

SEQ ID NO: 4398115 - DNA, 14 bp, Homo sapiens
ctggatcctgctgc

SEQ ID NO: 4398116 - DNA, 15 bp, Homo sapiens
ctggatcctgctgct

SEQ ID NO: 4398117 - DNA, 21 bp, Homo sapiens
ctggatcctgctgctttgggc

SEQ ID NO: 4398118 - DNA, 14 bp, Homo sapiens
ctggatgatatttt

SEQ ID NO: 4398119 - DNA, 12 bp, Homo sapiens
ctggatgccatc

SEQ ID NO: 4398120 - DNA, 16 bp, Homo sapiens
ctggatggtggccaga

SEQ ID NO: 4398121 - DNA, 18 bp, Homo sapiens
ctggatggtgtgccttcc

SEQ ID NO: 4398122 - DNA, 20 bp, Homo sapiens
ctggattttttatgtacaac

SEQ ID NO: 4398123 - DNA, 16 bp, Homo sapiens
ctggcaaacagggcct

SEQ ID NO: 4398124 - DNA, 17 bp, Homo sapiens
ctggcaaacagggcctc

SEQ ID NO: 4398125 - DNA, 20 bp, Homo sapiens
ctggcaaacagggcctctgc

SEQ ID NO: 4398126 - DNA, 21 bp, Homo sapiens
ctggcaaacagggcctctgcg

SEQ ID NO: 4398127 - DNA, 20 bp, Homo sapiens
ctggcaaacttttctttctt

SEQ ID NO: 4398128 - DNA, 20 bp, Homo sapiens
ctggcaaagaactcatttga

SEQ ID NO: 4398129 - DNA, 15 bp, Homo sapiens
ctggcaacacagagg

SEQ ID NO: 4398130 - DNA, 19 bp, Homo sapiens
ctggcaagctagaacctgg

SEQ ID NO: 4398131 - DNA, 22 bp, Homo sapiens
ctggcaagctagaacctggagg

SEQ ID NO: 4398132 - DNA, 21 bp, Homo sapiens
ctggcacacagtaggtgctca

SEQ ID NO: 4398133 - DNA, 17 bp, Homo sapiens
ctggcacagcccctgga

SEQ ID NO: 4398134 - DNA, 20 bp, Homo sapiens
ctggcacagcccctggagcc

SEQ ID NO: 4398135 - DNA, 21 bp, Homo sapiens
ctggcacagcctggctgtggc

SEQ ID NO: 4398136 - DNA, 22 bp, Homo sapiens
ctggcacagttttctgagaaag

SEQ ID NO: 4398137 - DNA, 16 bp, Homo sapiens
ctggcacattgcccct

SEQ ID NO: 4398138 - DNA, 19 bp, Homo sapiens
ctggcacattgcccctctg

SEQ ID NO: 4398139 - DNA, 22 bp, Homo sapiens
ctggcacattgcccctctgcct

SEQ ID NO: 4398140 - DNA, 14 bp, Homo sapiens
ctggcaccacacta

SEQ ID NO: 4398141 - DNA, 18 bp, Homo sapiens
ctggcaccacactaggga

SEQ ID NO: 4398142 - DNA, 19 bp, Homo sapiens
ctggcacccaccgtggagg

SEQ ID NO: 4398143 - DNA, 15 bp, Homo sapiens
ctggcacgaaggccc

SEQ ID NO: 4398144 - DNA, 18 bp, Homo sapiens
ctggcactgggaggcagg

SEQ ID NO: 4398145 - DNA, 13 bp, Homo sapiens
ctggcagacacaa

SEQ ID NO: 4398146 - DNA, 15 bp, Homo sapiens
ctggcagctgagagc

SEQ ID NO: 4398147 - DNA, 19 bp, Homo sapiens
ctggcagctgagagccctg

SEQ ID NO: 4398148 - DNA, 15 bp, Homo sapiens
ctggcagctgctgtg

SEQ ID NO: 4398149 - DNA, 21 bp, Homo sapiens
ctggcaggggagacaggagcc

SEQ ID NO: 4398150 - DNA, 17 bp, Homo sapiens
ctggcagggtgggatgg

SEQ ID NO: 4398151 - DNA, 18 bp, Homo sapiens
ctggcagggtgggatgga

SEQ ID NO: 4398152 - DNA, 16 bp, Homo sapiens
ctggcagtccgtggga

SEQ ID NO: 4398153 - DNA, 21 bp, Homo sapiens
ctggcatgtcatttgcacaca

SEQ ID NO: 4398154 - DNA, 14 bp, Homo sapiens
ctggccaccagcca

SEQ ID NO: 4398155 - DNA, 17 bp, Homo sapiens
ctggccaggagctcttc

SEQ ID NO: 4398156 - DNA, 21 bp, Homo sapiens
ctggccaggcagatctgtgcc

SEQ ID NO: 4398157 - DNA, 22 bp, Homo sapiens
ctggccaggcagatctgtgccc

SEQ ID NO: 4398158 - DNA, 17 bp, Homo sapiens
ctggccagggccacgct

SEQ ID NO: 4398159 - DNA, 20 bp, Homo sapiens
ctggccagtgctgcccatga

SEQ ID NO: 4398160 - DNA, 20 bp, Homo sapiens
ctggccagtgtttaaaactt

SEQ ID NO: 4398161 - DNA, 19 bp, Homo sapiens
ctggccatctccctcccca

SEQ ID NO: 4398162 - DNA, 13 bp, Homo sapiens
ctggcccaccagg

SEQ ID NO: 4398163 - DNA, 15 bp, Homo sapiens
ctggcccagccctgc

SEQ ID NO: 4398164 - DNA, 18 bp, Homo sapiens
ctggcccagccctgctgg

SEQ ID NO: 4398165 - DNA, 22 bp, Homo sapiens
ctggcccagccctgctggccgc

SEQ ID NO: 4398166 - DNA, 14 bp, Homo sapiens
ctggcccagggcat

SEQ ID NO: 4398167 - DNA, 14 bp, Homo sapiens
ctggcccaggtgcc

SEQ ID NO: 4398168 - DNA, 16 bp, Homo sapiens
ctggccccagcctggg

SEQ ID NO: 4398169 - DNA, 12 bp, Homo sapiens
ctggccccaggc

SEQ ID NO: 4398170 - DNA, 18 bp, Homo sapiens
ctggccccaggccccaga

SEQ ID NO: 4398171 - DNA, 19 bp, Homo sapiens
ctggccccaggccccagac

SEQ ID NO: 4398172 - DNA, 17 bp, Homo sapiens
ctggccccatggtcagc

SEQ ID NO: 4398173 - DNA, 17 bp, Homo sapiens
ctggcccccaacctcag

SEQ ID NO: 4398174 - DNA, 18 bp, Homo sapiens
ctggcccccaacctcagg

SEQ ID NO: 4398175 - DNA, 22 bp, Homo sapiens
ctggcccccaacctcagggctc

SEQ ID NO: 4398176 - DNA, 23 bp, Homo sapiens
ctggcccccaacctcagggctcc

SEQ ID NO: 4398177 - DNA, 18 bp, Homo sapiens
ctggccccgcccctgccc

SEQ ID NO: 4398178 - DNA, 13 bp, Homo sapiens
ctggcccctgggt

SEQ ID NO: 4398179 - DNA, 14 bp, Homo sapiens
ctggccctatttag

SEQ ID NO: 4398180 - DNA, 12 bp, Homo sapiens
ctggccctccac

SEQ ID NO: 4398181 - DNA, 12 bp, Homo sapiens
ctggccctgcct

SEQ ID NO: 4398182 - DNA, 11 bp, Homo sapiens
ctggccctgct

SEQ ID NO: 4398183 - DNA, 14 bp, Homo sapiens
ctggccctggggat

SEQ ID NO: 4398184 - DNA, 13 bp, Homo sapiens
ctggccctgtgcc

SEQ ID NO: 4398185 - DNA, 19 bp, Homo sapiens
ctggccgagggtcctggct

SEQ ID NO: 4398186 - DNA, 15 bp, Homo sapiens
ctggccgcagaggtg

SEQ ID NO: 4398187 - DNA, 13 bp, Homo sapiens
ctggccgcagggc

SEQ ID NO: 4398188 - DNA, 16 bp, Homo sapiens
ctggccgcctcacccc

SEQ ID NO: 4398189 - DNA, 18 bp, Homo sapiens
ctggccgcctcaccccct

SEQ ID NO: 4398190 - DNA, 14 bp, Homo sapiens
ctggccgctgagcg

SEQ ID NO: 4398191 - DNA, 16 bp, Homo sapiens
ctggccgctgagcgcc

SEQ ID NO: 4398192 - DNA, 13 bp, Homo sapiens
ctggccgggactg

SEQ ID NO: 4398193 - DNA, 17 bp, Homo sapiens
ctggccgggactgctgc

SEQ ID NO: 4398194 - DNA, 17 bp, Homo sapiens
ctggcctcatctcagac

SEQ ID NO: 4398195 - DNA, 20 bp, Homo sapiens
ctggcctccggcgtcagcct

SEQ ID NO: 4398196 - DNA, 21 bp, Homo sapiens
ctggcctccggcgtcagcctc

SEQ ID NO: 4398197 - DNA, 15 bp, Homo sapiens
ctggcctctgctttc

SEQ ID NO: 4398198 - DNA, 19 bp, Homo sapiens
ctggcctgagaggggaagc

SEQ ID NO: 4398199 - DNA, 14 bp, Homo sapiens
ctggccttgtactt

SEQ ID NO: 4398200 - DNA, 23 bp, Homo sapiens
ctggcgacacactccgtccatcc

SEQ ID NO: 4398201 - DNA, 14 bp, Homo sapiens
ctggcgcaggtggg

SEQ ID NO: 4398202 - DNA, 13 bp, Homo sapiens
ctggcgcctctgc

SEQ ID NO: 4398203 - DNA, 17 bp, Homo sapiens
ctggcgctcagcagccc

SEQ ID NO: 4398204 - DNA, 18 bp, Homo sapiens
ctggcgctcagcagccct

SEQ ID NO: 4398205 - DNA, 20 bp, Homo sapiens
ctggcgcttggatctggggt

SEQ ID NO: 4398206 - DNA, 20 bp, Homo sapiens
ctggcggctactcagcagcc

SEQ ID NO: 4398207 - DNA, 21 bp, Homo sapiens
ctggcgggcctttttcctgcg

SEQ ID NO: 4398208 - DNA, 22 bp, Homo sapiens
ctggcgttcacctccctgctca

SEQ ID NO: 4398209 - DNA, 16 bp, Homo sapiens
ctggcgttctcaagaa

SEQ ID NO: 4398210 - DNA, 20 bp, Homo sapiens
ctggcgttctcaagaatcta

SEQ ID NO: 4398211 - DNA, 16 bp, Homo sapiens
ctggctaacagtctag

SEQ ID NO: 4398212 - DNA, 15 bp, Homo sapiens
ctggctacctgtttg

SEQ ID NO: 4398213 - DNA, 20 bp, Homo sapiens
ctggctagaggccagcccca

SEQ ID NO: 4398214 - DNA, 21 bp, Homo sapiens
ctggctagaggccagccccac

SEQ ID NO: 4398215 - DNA, 18 bp, Homo sapiens
ctggctagagtcctcact

SEQ ID NO: 4398216 - DNA, 21 bp, Homo sapiens
ctggctagagtcctcactccc

SEQ ID NO: 4398217 - DNA, 14 bp, Homo sapiens
ctggctcacccagt

SEQ ID NO: 4398218 - DNA, 21 bp, Homo sapiens
ctgtctgagtagtggccactg

SEQ ID NO: 4398219 - DNA, 22 bp, Homo sapiens
ctgtctgagtagtggccactgg

SEQ ID NO: 4398220 - DNA, 21 bp, Homo sapiens
ctgtctgatctgtgctttcca

SEQ ID NO: 4398221 - DNA, 23 bp, Homo sapiens
ctgtctggaagacgtggctctgg

SEQ ID NO: 4398222 - DNA, 19 bp, Homo sapiens
ctgtctgtagagggccctg

SEQ ID NO: 4398223 - DNA, 21 bp, Homo sapiens
ctgtctgtatctttggttatc

SEQ ID NO: 4398224 - DNA, 19 bp, Homo sapiens
ctgtctgtcaccagctatc

SEQ ID NO: 4398225 - DNA, 14 bp, Homo sapiens
ctgtctgtgaacag

SEQ ID NO: 4398226 - DNA, 15 bp, Homo sapiens
ctgtctgtgcacatg

SEQ ID NO: 4398227 - DNA, 18 bp, Homo sapiens
ctgtctgtgcacatgcct

SEQ ID NO: 4398228 - DNA, 14 bp, Homo sapiens
ctgtctgttcccag

SEQ ID NO: 4398229 - DNA, 15 bp, Homo sapiens
ctgtctgttcccagc

SEQ ID NO: 4398230 - DNA, 18 bp, Homo sapiens
ctgtctgttcccagcccc

SEQ ID NO: 4398231 - DNA, 19 bp, Homo sapiens
ctgtctgttcccagcccct

SEQ ID NO: 4398232 - DNA, 20 bp, Homo sapiens
ctgtctgttcccagcccctg

SEQ ID NO: 4398233 - DNA, 23 bp, Homo sapiens
ctgtctgttcccagcccctgcag

SEQ ID NO: 4398234 - DNA, 19 bp, Homo sapiens
ctgtcttaaactaaatgtg

SEQ ID NO: 4398235 - DNA, 13 bp, Homo sapiens
ctgtcttcccagg

SEQ ID NO: 4398236 - DNA, 15 bp, Homo sapiens
ctgtcttcccagggt

SEQ ID NO: 4398237 - DNA, 18 bp, Homo sapiens
ctgtcttcccagggtagc

SEQ ID NO: 4398238 - DNA, 23 bp, Homo sapiens
ctgtcttcccagggtagcccgcc

SEQ ID NO: 4398239 - DNA, 20 bp, Homo sapiens
ctgtcttcctcaaaataaag

SEQ ID NO: 4398240 - DNA, 17 bp, Homo sapiens
ctgtcttgtccccaccc

SEQ ID NO: 4398241 - DNA, 22 bp, Homo sapiens
ctgtcttgtccccacccatgcg

SEQ ID NO: 4398242 - DNA, 17 bp, Homo sapiens
ctgtgaaaaaaaatttg

SEQ ID NO: 4398243 - DNA, 15 bp, Homo sapiens
ctgtgaaatatcatc

SEQ ID NO: 4398244 - DNA, 19 bp, Homo sapiens
ctgtgaaccaacccccatc

SEQ ID NO: 4398245 - DNA, 22 bp, Homo sapiens
ctgtgaaccaacccccatctcc

SEQ ID NO: 4398246 - DNA, 19 bp, Homo sapiens
ctgtgaacctgggcactcc

SEQ ID NO: 4398247 - DNA, 15 bp, Homo sapiens
ctgtgaactgtgtgt

SEQ ID NO: 4398248 - DNA, 17 bp, Homo sapiens
ctgtgaatgccaaagcc

SEQ ID NO: 4398249 - DNA, 12 bp, Homo sapiens
ctgtgaatggag

SEQ ID NO: 4398250 - DNA, 16 bp, Homo sapiens
ctgtgaatggaggcag

SEQ ID NO: 4398251 - DNA, 22 bp, Homo sapiens
ctgtgaatggaggcagagacct

SEQ ID NO: 4398252 - DNA, 18 bp, Homo sapiens
ctgtgacatggtgcctga

SEQ ID NO: 4398253 - DNA, 22 bp, Homo sapiens
ctgtgacatggtgcctgagagg

SEQ ID NO: 4398254 - DNA, 17 bp, Homo sapiens
ctgtgaccacaacatga

SEQ ID NO: 4398255 - DNA, 14 bp, Homo sapiens
ctgtgacccatctg

SEQ ID NO: 4398256 - DNA, 17 bp, Homo sapiens
ctgtgacctgtcagaat

SEQ ID NO: 4398257 - DNA, 17 bp, Homo sapiens
ctgtgagcatggggcca

SEQ ID NO: 4398258 - DNA, 18 bp, Homo sapiens
ctgtgagcatggggccag

SEQ ID NO: 4398259 - DNA, 14 bp, Homo sapiens
ctgtgaggcagggg

SEQ ID NO: 4398260 - DNA, 15 bp, Homo sapiens
ctgtgagggagggga

SEQ ID NO: 4398261 - DNA, 22 bp, Homo sapiens
ctgtgagggaggggaaaagcat

SEQ ID NO: 4398262 - DNA, 23 bp, Homo sapiens
ctgtgatacagttttgagtaaaa

SEQ ID NO: 4398263 - DNA, 15 bp, Homo sapiens
ctgtgatcttaaaat

SEQ ID NO: 4398264 - DNA, 17 bp, Homo sapiens
ctgtgatcttaaaataa

SEQ ID NO: 4398265 - DNA, 19 bp, Homo sapiens
ctgtgattactctttgctt

SEQ ID NO: 4398266 - DNA, 23 bp, Homo sapiens
ctgtgattactctttgctttgta

SEQ ID NO: 4398267 - DNA, 12 bp, Homo sapiens
ctgtgattagat

SEQ ID NO: 4398268 - DNA, 18 bp, Homo sapiens
ctgtgattttaagacaag

SEQ ID NO: 4398269 - DNA, 16 bp, Homo sapiens
ctgtgcaaacagtaac

SEQ ID NO: 4398270 - DNA, 20 bp, Homo sapiens
ctgtgcacatctgtgtcttg

SEQ ID NO: 4398271 - DNA, 21 bp, Homo sapiens
ctgtgcacatctgtgtcttgt

SEQ ID NO: 4398272 - DNA, 20 bp, Homo sapiens
ctgtgcaggcctgtccctgg

SEQ ID NO: 4398273 - DNA, 14 bp, Homo sapiens
ctgtgcaggctgca

SEQ ID NO: 4398274 - DNA, 16 bp, Homo sapiens
ctgtgcaggctgcagt

SEQ ID NO: 4398275 - DNA, 17 bp, Homo sapiens
ctgtgcaggttcccact

SEQ ID NO: 4398276 - DNA, 16 bp, Homo sapiens
ctgtgcagtcactgga

SEQ ID NO: 4398277 - DNA, 21 bp, Homo sapiens
ctgtgccaagatttaaaatta

SEQ ID NO: 4398278 - DNA, 14 bp, Homo sapiens
ctgtgccagaggcc

SEQ ID NO: 4398279 - DNA, 14 bp, Homo sapiens
ctgtgccatgctgg

SEQ ID NO: 4398280 - DNA, 16 bp, Homo sapiens
ctgtgccatgctgggc

SEQ ID NO: 4398281 - DNA, 22 bp, Homo sapiens
ctgtgccatggatgattctttt

SEQ ID NO: 4398282 - DNA, 17 bp, Homo sapiens
ctgtgccccatgcctgt

SEQ ID NO: 4398283 - DNA, 16 bp, Homo sapiens
ctgtgccctccaaaga

SEQ ID NO: 4398284 - DNA, 13 bp, Homo sapiens
ctgtgcctccccc

SEQ ID NO: 4398285 - DNA, 15 bp, Homo sapiens
ctgtgcctcccccca

SEQ ID NO: 4398286 - DNA, 19 bp, Homo sapiens
ctgtgcctccccccagacc

SEQ ID NO: 4398287 - DNA, 16 bp, Homo sapiens
ctgtgcctggccccag

SEQ ID NO: 4398288 - DNA, 19 bp, Homo sapiens
ctgtgcctggccccagcct

SEQ ID NO: 4398289 - DNA, 12 bp, Homo sapiens
ctgtgcctggct

SEQ ID NO: 4398290 - DNA, 18 bp, Homo sapiens
ctgtgcctggctccctga

SEQ ID NO: 4398291 - DNA, 16 bp, Homo sapiens
ctgtgcctttcctatc

SEQ ID NO: 4398292 - DNA, 17 bp, Homo sapiens
ctgtgcctttcctatca

SEQ ID NO: 4398293 - DNA, 21 bp, Homo sapiens
ctgtgcgtcttggtgtaattt

SEQ ID NO: 4398294 - DNA, 16 bp, Homo sapiens
ctgtgctcaccctctc

SEQ ID NO: 4398295 - DNA, 15 bp, Homo sapiens
ctgtgctctggggat

SEQ ID NO: 4398296 - DNA, 15 bp, Homo sapiens
ctgtgctgtggaagc

SEQ ID NO: 4398297 - DNA, 17 bp, Homo sapiens
ctgtgcttcgggccctt

SEQ ID NO: 4398298 - DNA, 13 bp, Homo sapiens
ctgtgcttctaat

SEQ ID NO: 4398299 - DNA, 13 bp, Homo sapiens
ctgtgctttctat

SEQ ID NO: 4398300 - DNA, 16 bp, Homo sapiens
ctgtgctttctattgt

SEQ ID NO: 4398301 - DNA, 15 bp, Homo sapiens
ctgtggaaatgccaa

SEQ ID NO: 4398302 - DNA, 21 bp, Homo sapiens
ctgtggaacataaaaaggaca

SEQ ID NO: 4398303 - DNA, 19 bp, Homo sapiens
ctgtggaaggcagagaaat

SEQ ID NO: 4398304 - DNA, 22 bp, Homo sapiens
ctgtggacaggatgaggacaga

SEQ ID NO: 4398305 - DNA, 16 bp, Homo sapiens
ctgtggatgctgctgc

SEQ ID NO: 4398306 - DNA, 17 bp, Homo sapiens
ctgtggcagagttacag

SEQ ID NO: 4398307 - DNA, 19 bp, Homo sapiens
ctgtggcagagttacagtt

SEQ ID NO: 4398308 - DNA, 23 bp, Homo sapiens
ctgtggcagagttacagttctgt

SEQ ID NO: 4398309 - DNA, 18 bp, Homo sapiens
ctgtggcaggaggagctg

SEQ ID NO: 4398310 - DNA, 21 bp, Homo sapiens
ctgtggcagtaaagagaaact

SEQ ID NO: 4398311 - DNA, 23 bp, Homo sapiens
ctgtggcagtaaagagaaacttt

SEQ ID NO: 4398312 - DNA, 16 bp, Homo sapiens
ctgtggccaagttctt

SEQ ID NO: 4398313 - DNA, 18 bp, Homo sapiens
ctgtggccaagttcttag

SEQ ID NO: 4398314 - DNA, 15 bp, Homo sapiens
ctgtggccccaagag

SEQ ID NO: 4398315 - DNA, 17 bp, Homo sapiens
ctgtggccccaagaggg

SEQ ID NO: 4398316 - DNA, 12 bp, Homo sapiens
ctgtggcccctc

SEQ ID NO: 4398317 - DNA, 17 bp, Homo sapiens
ctgtggccggtgccagc

SEQ ID NO: 4398318 - DNA, 20 bp, Homo sapiens
ctgtggccggtgccagctgc

SEQ ID NO: 4398319 - DNA, 21 bp, Homo sapiens
ctgtggccggtgccagctgcc

SEQ ID NO: 4398320 - DNA, 15 bp, Homo sapiens
ctgtggcggtgcctg

SEQ ID NO: 4398321 - DNA, 13 bp, Homo sapiens
ctgtggctggctc

SEQ ID NO: 4398322 - DNA, 20 bp, Homo sapiens
ctgtgggaaggccagctgcc

SEQ ID NO: 4398323 - DNA, 20 bp, Homo sapiens
ctgtgggagccgcagagcct

SEQ ID NO: 4398324 - DNA, 18 bp, Homo sapiens
ctgtgggcaatttagaaa

SEQ ID NO: 4398325 - DNA, 19 bp, Homo sapiens
ctgtgggcagcaccctccc

SEQ ID NO: 4398326 - DNA, 13 bp, Homo sapiens
ctgtggggactcc

SEQ ID NO: 4398327 - DNA, 23 bp, Homo sapiens
ctgtggggactgaacctggaaga

SEQ ID NO: 4398328 - DNA, 20 bp, Homo sapiens
ctgtggggcctggggagccc

SEQ ID NO: 4398329 - DNA, 16 bp, Homo sapiens
ctgtgggggtggccat

SEQ ID NO: 4398330 - DNA, 16 bp, Homo sapiens
ctgtgggtctctgaag

SEQ ID NO: 4398331 - DNA, 17 bp, Homo sapiens
ctgtggtagctccagcg

SEQ ID NO: 4398332 - DNA, 22 bp, Homo sapiens
ctgtggtcgtcaactttcctca

SEQ ID NO: 4398333 - DNA, 17 bp, Homo sapiens
ctgtggtgaagtgtggc

SEQ ID NO: 4398334 - DNA, 21 bp, Homo sapiens
ctgtggtgaagtgtggctggt

SEQ ID NO: 4398335 - DNA, 22 bp, Homo sapiens
ctgtggtgaagtgtggctggtg

SEQ ID NO: 4398336 - DNA, 15 bp, Homo sapiens
ctgttggttcaaact

SEQ ID NO: 4398337 - DNA, 22 bp, Homo sapiens
ctgttgtaactaggctcagaga

SEQ ID NO: 4398338 - DNA, 12 bp, Homo sapiens
ctgttgtacaag

SEQ ID NO: 4398339 - DNA, 18 bp, Homo sapiens
ctgtttaaaaaaccacat

SEQ ID NO: 4398340 - DNA, 15 bp, Homo sapiens
ctgtttactggttct

SEQ ID NO: 4398341 - DNA, 15 bp, Homo sapiens
ctgtttagttttaca

SEQ ID NO: 4398342 - DNA, 13 bp, Homo sapiens
ctgtttatggcct

SEQ ID NO: 4398343 - DNA, 17 bp, Homo sapiens
ctgtttatggcctcagc

SEQ ID NO: 4398344 - DNA, 19 bp, Homo sapiens
ctgtttatggcctcagctg

SEQ ID NO: 4398345 - DNA, 21 bp, Homo sapiens
ctgtttatggcctcagctgcc

SEQ ID NO: 4398346 - DNA, 19 bp, Homo sapiens
ctgtttcaaaaaaatctat

SEQ ID NO: 4398347 - DNA, 17 bp, Homo sapiens
ctgtttcaagccctcct

SEQ ID NO: 4398348 - DNA, 22 bp, Homo sapiens
ctgtttcaagccctcctcccca

SEQ ID NO: 4398349 - DNA, 16 bp, Homo sapiens
ctgtttcagaaaacat

SEQ ID NO: 4398350 - DNA, 17 bp, Homo sapiens
ctgtttcctagctgtgt

SEQ ID NO: 4398351 - DNA, 20 bp, Homo sapiens
ctgtttcctgacattgtctc

SEQ ID NO: 4398352 - DNA, 15 bp, Homo sapiens
ctgtttctctgctgt

SEQ ID NO: 4398353 - DNA, 21 bp, Homo sapiens
ctgtttctgtcaagctggtgc

SEQ ID NO: 4398354 - DNA, 16 bp, Homo sapiens
ctgtttgacttctcaa

SEQ ID NO: 4398355 - DNA, 13 bp, Homo sapiens
ctgtttgattctt

SEQ ID NO: 4398356 - DNA, 18 bp, Homo sapiens
ctgtttgcatttgataca

SEQ ID NO: 4398357 - DNA, 16 bp, Homo sapiens
ctgtttggacccatgg

SEQ ID NO: 4398358 - DNA, 15 bp, Homo sapiens
ctgtttgtaatcatt

SEQ ID NO: 4398359 - DNA, 23 bp, Homo sapiens
ctgtttgtaatcattatctcact

SEQ ID NO: 4398360 - DNA, 17 bp, Homo sapiens
ctgttttagaaattggt

SEQ ID NO: 4398361 - DNA, 22 bp, Homo sapiens
ctgttttccctctgctgctttt

SEQ ID NO: 4398362 - DNA, 15 bp, Homo sapiens
ctgttttctctctgt

SEQ ID NO: 4398363 - DNA, 16 bp, Homo sapiens
ctgttttctctctgtt

SEQ ID NO: 4398364 - DNA, 17 bp, Homo sapiens
ctgttttctctctgtta

SEQ ID NO: 4398365 - DNA, 17 bp, Homo sapiens
ctgttttctgtaaattc

SEQ ID NO: 4398366 - DNA, 17 bp, Homo sapiens
ctgttttgaaggcaaaa

SEQ ID NO: 4398367 - DNA, 20 bp, Homo sapiens
ctgttttgaataaattttca

SEQ ID NO: 4398368 - DNA, 16 bp, Homo sapiens
ctgttttgttaatata

SEQ ID NO: 4398369 - DNA, 22 bp, Homo sapiens
cttaaaaaatttatacttaaaa

SEQ ID NO: 4398370 - DNA, 12 bp, Homo sapiens
cttaaaaaggaa

SEQ ID NO: 4398371 - DNA, 15 bp, Homo sapiens
cttaaaaatacttct

SEQ ID NO: 4398372 - DNA, 17 bp, Homo sapiens
cttaaaaatacttctat

SEQ ID NO: 4398373 - DNA, 13 bp, Homo sapiens
cttaaaaatggtt

SEQ ID NO: 4398374 - DNA, 14 bp, Homo sapiens
cttaaaacacatga

SEQ ID NO: 4398375 - DNA, 11 bp, Homo sapiens
cttaaaacatg

SEQ ID NO: 4398376 - DNA, 15 bp, Homo sapiens
cttaaaaccaaagag

SEQ ID NO: 4398377 - DNA, 21 bp, Homo sapiens
cttaaaagcatttttattata

SEQ ID NO: 4398378 - DNA, 20 bp, Homo sapiens
cttaaaatgcaatatttgta

SEQ ID NO: 4398379 - DNA, 17 bp, Homo sapiens
cttaaaattaagatttc

SEQ ID NO: 4398380 - DNA, 18 bp, Homo sapiens
cttaaaattgatattata

SEQ ID NO: 4398381 - DNA, 23 bp, Homo sapiens
cttaaacccatacaatgtatgta

SEQ ID NO: 4398382 - DNA, 15 bp, Homo sapiens
cttaaaccttcagtt

SEQ ID NO: 4398383 - DNA, 23 bp, Homo sapiens
cttaaaccttcagttatgatttt

SEQ ID NO: 4398384 - DNA, 21 bp, Homo sapiens
cttaaactctggacactctat

SEQ ID NO: 4398385 - DNA, 14 bp, Homo sapiens
cttaaacttgaccc

SEQ ID NO: 4398386 - DNA, 15 bp, Homo sapiens
cttaaacttgtgaat

SEQ ID NO: 4398387 - DNA, 15 bp, Homo sapiens
cttaaactttgtcac

SEQ ID NO: 4398388 - DNA, 19 bp, Homo sapiens
cttaaactttgtcacttct

SEQ ID NO: 4398389 - DNA, 13 bp, Homo sapiens
cttaaagcagaag

SEQ ID NO: 4398390 - DNA, 20 bp, Homo sapiens
cttaaagcatttcaggccag

SEQ ID NO: 4398391 - DNA, 17 bp, Homo sapiens
cttaaagcttgatttga

SEQ ID NO: 4398392 - DNA, 16 bp, Homo sapiens
cttaaaggtgtcttcc

SEQ ID NO: 4398393 - DNA, 18 bp, Homo sapiens
cttaaagttgacatttaa

SEQ ID NO: 4398394 - DNA, 20 bp, Homo sapiens
cttaaagttggtattaataa

SEQ ID NO: 4398395 - DNA, 13 bp, Homo sapiens
cttaaataagaaa

SEQ ID NO: 4398396 - DNA, 19 bp, Homo sapiens
cttaaatatatatttctaa

SEQ ID NO: 4398397 - DNA, 20 bp, Homo sapiens
cttaaattatatatttattt

SEQ ID NO: 4398398 - DNA, 13 bp, Homo sapiens
cttaaattatttt

SEQ ID NO: 4398399 - DNA, 15 bp, Homo sapiens
cttaaattattttat

SEQ ID NO: 4398400 - DNA, 23 bp, Homo sapiens
cttaaattcatttctagactcaa

SEQ ID NO: 4398401 - DNA, 20 bp, Homo sapiens
cttaaattccaaactatgac

SEQ ID NO: 4398402 - DNA, 23 bp, Homo sapiens
cttaaattgggttcatgatgcag

SEQ ID NO: 4398403 - DNA, 12 bp, Homo sapiens
cttaaatttcag

SEQ ID NO: 4398404 - DNA, 14 bp, Homo sapiens
cttaaatttcttat

SEQ ID NO: 4398405 - DNA, 19 bp, Homo sapiens
cttaaatttcttatgtgac

SEQ ID NO: 4398406 - DNA, 17 bp, Homo sapiens
cttaacagttgtattta

SEQ ID NO: 4398407 - DNA, 19 bp, Homo sapiens
cttaacattcctaaaatgc

SEQ ID NO: 4398408 - DNA, 11 bp, Homo sapiens
cttaacatttc

SEQ ID NO: 4398409 - DNA, 22 bp, Homo sapiens
cttaaccctgacaaattttaat

SEQ ID NO: 4398410 - DNA, 13 bp, Homo sapiens
cttaacctcaggg

SEQ ID NO: 4398411 - DNA, 14 bp, Homo sapiens
cttaacctcaggga

SEQ ID NO: 4398412 - DNA, 18 bp, Homo sapiens
cttaacctttgctatgta

SEQ ID NO: 4398413 - DNA, 21 bp, Homo sapiens
cttaacgttctataaatgaat

SEQ ID NO: 4398414 - DNA, 20 bp, Homo sapiens
cttaactgtatttcagtatt

SEQ ID NO: 4398415 - DNA, 18 bp, Homo sapiens
cttaacttattacctcag

SEQ ID NO: 4398416 - DNA, 18 bp, Homo sapiens
cttaacttcttgcttctt

SEQ ID NO: 4398417 - DNA, 13 bp, Homo sapiens
cttaagaaaattt

SEQ ID NO: 4398418 - DNA, 13 bp, Homo sapiens
cttaagaactgtg

SEQ ID NO: 4398419 - DNA, 15 bp, Homo sapiens
cttaagaactgtgtc

SEQ ID NO: 4398420 - DNA, 16 bp, Homo sapiens
cttaagaactgtgtct

SEQ ID NO: 4398421 - DNA, 17 bp, Homo sapiens
cttaagaattcaaattt

SEQ ID NO: 4398422 - DNA, 15 bp, Homo sapiens
cttaagacagcatgt

SEQ ID NO: 4398423 - DNA, 18 bp, Homo sapiens
cttaagacagcatgtgtt

SEQ ID NO: 4398424 - DNA, 15 bp, Homo sapiens
cttaagattaatttt

SEQ ID NO: 4398425 - DNA, 17 bp, Homo sapiens
cttaagcagtaatctgt

SEQ ID NO: 4398426 - DNA, 23 bp, Homo sapiens
cttaagcatctggctctaattca

SEQ ID NO: 4398427 - DNA, 16 bp, Homo sapiens
cttaagcctggaaggt

SEQ ID NO: 4398428 - DNA, 16 bp, Homo sapiens
cttaagcctgtgtata

SEQ ID NO: 4398429 - DNA, 15 bp, Homo sapiens
cttaagtatttacag

SEQ ID NO: 4398430 - DNA, 16 bp, Homo sapiens
cttaagtgctgcaatt

SEQ ID NO: 4398431 - DNA, 15 bp, Homo sapiens
cttaataactgtgta

SEQ ID NO: 4398432 - DNA, 23 bp, Homo sapiens
cttaataataatgccaatgaaca

SEQ ID NO: 4398433 - DNA, 14 bp, Homo sapiens
cttaatagcaacag

SEQ ID NO: 4398434 - DNA, 15 bp, Homo sapiens
cttaatagctgtagt

SEQ ID NO: 4398435 - DNA, 13 bp, Homo sapiens
cttaatatattcc

SEQ ID NO: 4398436 - DNA, 21 bp, Homo sapiens
cttaatatgctgcaacaaaat

SEQ ID NO: 4398437 - DNA, 11 bp, Homo sapiens
cttaatatttc

SEQ ID NO: 4398438 - DNA, 22 bp, Homo sapiens
cttaatcaagatttttttcctg

SEQ ID NO: 4398439 - DNA, 14 bp, Homo sapiens
cttaatcattttca

SEQ ID NO: 4398440 - DNA, 22 bp, Homo sapiens
cttaatccaatattttgccttt

SEQ ID NO: 4398441 - DNA, 14 bp, Homo sapiens
cttaatgacaacac

SEQ ID NO: 4398442 - DNA, 14 bp, Homo sapiens
cttaatgaccatgt

SEQ ID NO: 4398443 - DNA, 18 bp, Homo sapiens
cttaatgaccatgttata

SEQ ID NO: 4398444 - DNA, 22 bp, Homo sapiens
cttaatggctgataattttaaa

SEQ ID NO: 4398445 - DNA, 14 bp, Homo sapiens
cttaatgtatgtta

SEQ ID NO: 4398446 - DNA, 17 bp, Homo sapiens
cttaattacttaaaaaa

SEQ ID NO: 4398447 - DNA, 14 bp, Homo sapiens
cttaattattataa

SEQ ID NO: 4398448 - DNA, 19 bp, Homo sapiens
cttaattattataaaaata

SEQ ID NO: 4398449 - DNA, 20 bp, Homo sapiens
cttaattattataaaaatat

SEQ ID NO: 4398450 - DNA, 15 bp, Homo sapiens
cttaattgcaagtct

SEQ ID NO: 4398451 - DNA, 14 bp, Homo sapiens
cttaattgtgttta

SEQ ID NO: 4398452 - DNA, 18 bp, Homo sapiens
cttaattgttctgctttt

SEQ ID NO: 4398453 - DNA, 16 bp, Homo sapiens
cttaatttaattgctt

SEQ ID NO: 4398454 - DNA, 18 bp, Homo sapiens
cttaatttaattgctttg

SEQ ID NO: 4398455 - DNA, 21 bp, Homo sapiens
cttatttttcctgtcctgccc

SEQ ID NO: 4398456 - DNA, 22 bp, Homo sapiens
cttcaaaaataaaaaatctgaa

SEQ ID NO: 4398457 - DNA, 18 bp, Homo sapiens
cttcaaacctaaaaatca

SEQ ID NO: 4398458 - DNA, 23 bp, Homo sapiens
cttcaaactagggccaagcccag

SEQ ID NO: 4398459 - DNA, 16 bp, Homo sapiens
cttcaaagtttaataa

SEQ ID NO: 4398460 - DNA, 17 bp, Homo sapiens
cttcaaagtttatatgc

SEQ ID NO: 4398461 - DNA, 20 bp, Homo sapiens
cttcaacaattctaaaatga

SEQ ID NO: 4398462 - DNA, 15 bp, Homo sapiens
cttcaacccagtggg

SEQ ID NO: 4398463 - DNA, 15 bp, Homo sapiens
cttcaactgcccagc

SEQ ID NO: 4398464 - DNA, 16 bp, Homo sapiens
cttcaactgcccagca

SEQ ID NO: 4398465 - DNA, 22 bp, Homo sapiens
cttcaagaatcagaagaaaggc

SEQ ID NO: 4398466 - DNA, 22 bp, Homo sapiens
cttcaagctgttatttcttccc

SEQ ID NO: 4398467 - DNA, 23 bp, Homo sapiens
cttcaagctgttatttcttccct

SEQ ID NO: 4398468 - DNA, 17 bp, Homo sapiens
cttcaaggactgtttca

SEQ ID NO: 4398469 - DNA, 18 bp, Homo sapiens
cttcaaggactgtttcag

SEQ ID NO: 4398470 - DNA, 12 bp, Homo sapiens
ctgctccctgcc

SEQ ID NO: 4398471 - DNA, 18 bp, Homo sapiens
ctgctccctgcctcctgc

SEQ ID NO: 4398472 - DNA, 21 bp, Homo sapiens
ctgctccctgcctcctgccta

SEQ ID NO: 4398473 - DNA, 13 bp, Homo sapiens
ctgctcctcatgg

SEQ ID NO: 4398474 - DNA, 14 bp, Homo sapiens
ctgctcctcatggt

SEQ ID NO: 4398475 - DNA, 16 bp, Homo sapiens
ctgctccttggcaccc

SEQ ID NO: 4398476 - DNA, 21 bp, Homo sapiens
ctgctccttggcacccccatg

SEQ ID NO: 4398477 - DNA, 23 bp, Homo sapiens
ctgctccttggcacccccatgct

SEQ ID NO: 4398478 - DNA, 14 bp, Homo sapiens
ctgctcgccttatt

SEQ ID NO: 4398479 - DNA, 19 bp, Homo sapiens
ctgctctagaaagtataga

SEQ ID NO: 4398480 - DNA, 20 bp, Homo sapiens
ctgctctccaagtctcagtg

SEQ ID NO: 4398481 - DNA, 11 bp, Homo sapiens
ctgctctccct

SEQ ID NO: 4398482 - DNA, 18 bp, Homo sapiens
ctgctctccttcactctg

SEQ ID NO: 4398483 - DNA, 22 bp, Homo sapiens
ctgctctgaccttccagagccc

SEQ ID NO: 4398484 - DNA, 11 bp, Homo sapiens
ctgctctgctg

SEQ ID NO: 4398485 - DNA, 13 bp, Homo sapiens
ctgctctgggaag

SEQ ID NO: 4398486 - DNA, 18 bp, Homo sapiens
ctgctctggttgtttctg

SEQ ID NO: 4398487 - DNA, 17 bp, Homo sapiens
ctgctctgtccccaaag

SEQ ID NO: 4398488 - DNA, 13 bp, Homo sapiens
ctgctcttttcct

SEQ ID NO: 4398489 - DNA, 14 bp, Homo sapiens
ctgctcttttcctg

SEQ ID NO: 4398490 - DNA, 14 bp, Homo sapiens
ctgctgaaactgcc

SEQ ID NO: 4398491 - DNA, 18 bp, Homo sapiens
ctgctgaaactgcccact

SEQ ID NO: 4398492 - DNA, 20 bp, Homo sapiens
ctgctgaaagtcctgctttc

SEQ ID NO: 4398493 - DNA, 22 bp, Homo sapiens
ctgctgagaggcaccagtccag

SEQ ID NO: 4398494 - DNA, 17 bp, Homo sapiens
ctgctgagatcctggac

SEQ ID NO: 4398495 - DNA, 18 bp, Homo sapiens
ctgctgagatcctggact

SEQ ID NO: 4398496 - DNA, 14 bp, Homo sapiens
ctgctgagtgacag

SEQ ID NO: 4398497 - DNA, 17 bp, Homo sapiens
ctgctgagttggcctgg

SEQ ID NO: 4398498 - DNA, 21 bp, Homo sapiens
ctgctgagttggcctggccat

SEQ ID NO: 4398499 - DNA, 18 bp, Homo sapiens
ctgctgattcttgtaaat

SEQ ID NO: 4398500 - DNA, 19 bp, Homo sapiens
ctgctgattcttgtaaatc

SEQ ID NO: 4398501 - DNA, 17 bp, Homo sapiens
ctgctgcaacaagctca

SEQ ID NO: 4398502 - DNA, 18 bp, Homo sapiens
ctgctgcagcatgaaggc

SEQ ID NO: 4398503 - DNA, 15 bp, Homo sapiens
ctgctgcatcgctgt

SEQ ID NO: 4398504 - DNA, 22 bp, Homo sapiens
ctgctgcatcgctgttctgggc

SEQ ID NO: 4398505 - DNA, 13 bp, Homo sapiens
ctgctgccagtgc

SEQ ID NO: 4398506 - DNA, 14 bp, Homo sapiens
ctgctgcccccacc

SEQ ID NO: 4398507 - DNA, 15 bp, Homo sapiens
ctgctgcccccaccc

SEQ ID NO: 4398508 - DNA, 23 bp, Homo sapiens
ctgctgccctagttttctttcct

SEQ ID NO: 4398509 - DNA, 23 bp, Homo sapiens
ctgctgcccttaggccacatggg

SEQ ID NO: 4398510 - DNA, 14 bp, Homo sapiens
ctgctgcctaataa

SEQ ID NO: 4398511 - DNA, 22 bp, Homo sapiens
ctgctgcctaataaagagactg

SEQ ID NO: 4398512 - DNA, 11 bp, Homo sapiens
ctgctgcctgc

SEQ ID NO: 4398513 - DNA, 23 bp, Homo sapiens
ctgctgctaaggctctatttcct

SEQ ID NO: 4398514 - DNA, 17 bp, Homo sapiens
ctgctgctctcccaagg

SEQ ID NO: 4398515 - DNA, 19 bp, Homo sapiens
ctgctgctctgaccttcca

SEQ ID NO: 4398516 - DNA, 15 bp, Homo sapiens
ctgctgcttttgggg

SEQ ID NO: 4398517 - DNA, 16 bp, Homo sapiens
ctgctggagaaagcca

SEQ ID NO: 4398518 - DNA, 19 bp, Homo sapiens
ctgctggagaaagccacgc

SEQ ID NO: 4398519 - DNA, 20 bp, Homo sapiens
ctgctggagtttcatgtaca

SEQ ID NO: 4398520 - DNA, 19 bp, Homo sapiens
ctgctggatgacttgagat

SEQ ID NO: 4398521 - DNA, 14 bp, Homo sapiens
ctgctggccgaccc

SEQ ID NO: 4398522 - DNA, 22 bp, Homo sapiens
ctgctggccgacccactgaccc

SEQ ID NO: 4398523 - DNA, 20 bp, Homo sapiens
ctgctggccgcctcaccccc

SEQ ID NO: 4398524 - DNA, 18 bp, Homo sapiens
ctgctggcgcctctgcaa

SEQ ID NO: 4398525 - DNA, 19 bp, Homo sapiens
ctgctggctcttctgccca

SEQ ID NO: 4398526 - DNA, 14 bp, Homo sapiens
ctgctggctgcggc

SEQ ID NO: 4398527 - DNA, 14 bp, Homo sapiens
ctgctggcttgcag

SEQ ID NO: 4398528 - DNA, 14 bp, Homo sapiens
ctgctgggctctcc

SEQ ID NO: 4398529 - DNA, 17 bp, Homo sapiens
ctgctgggctctccacc

SEQ ID NO: 4398530 - DNA, 20 bp, Homo sapiens
ctgctggggagataaaaaga

SEQ ID NO: 4398531 - DNA, 22 bp, Homo sapiens
ctgctgggggtgagctgtactc

SEQ ID NO: 4398532 - DNA, 15 bp, Homo sapiens
ctgctggtcacagcc

SEQ ID NO: 4398533 - DNA, 20 bp, Homo sapiens
ctgctggtcacagcctcctc

SEQ ID NO: 4398534 - DNA, 15 bp, Homo sapiens
ctgctgtccagacag

SEQ ID NO: 4398535 - DNA, 16 bp, Homo sapiens
ctgctgtccagacagc

SEQ ID NO: 4398536 - DNA, 18 bp, Homo sapiens
ctgctgtccagacagcct

SEQ ID NO: 4398537 - DNA, 19 bp, Homo sapiens
ctgctgtccagacagcctg

SEQ ID NO: 4398538 - DNA, 22 bp, Homo sapiens
ctgctgtgattccactacacct

SEQ ID NO: 4398539 - DNA, 19 bp, Homo sapiens
ctgctgtgctctggggatt

SEQ ID NO: 4398540 - DNA, 16 bp, Homo sapiens
ctgctgtgtgtgagca

SEQ ID NO: 4398541 - DNA, 20 bp, Homo sapiens
ctgctgttctcaggacagca

SEQ ID NO: 4398542 - DNA, 22 bp, Homo sapiens
ctgctgttctcaggacagcatc

SEQ ID NO: 4398543 - DNA, 23 bp, Homo sapiens
ctgctgttctcaggacagcatcc

SEQ ID NO: 4398544 - DNA, 14 bp, Homo sapiens
ctgcttccagtgta

SEQ ID NO: 4398545 - DNA, 22 bp, Homo sapiens
ctgcttctccaaaaatctgcct

SEQ ID NO: 4398546 - DNA, 14 bp, Homo sapiens
ctgcttctctttgt

SEQ ID NO: 4398547 - DNA, 14 bp, Homo sapiens
ctgcttctttccag

SEQ ID NO: 4398548 - DNA, 18 bp, Homo sapiens
ctgcttctttccagaaac

SEQ ID NO: 4398549 - DNA, 12 bp, Homo sapiens
ctgcttgaggaa

SEQ ID NO: 4398550 - DNA, 16 bp, Homo sapiens
ctgcttgaggaaaaca

SEQ ID NO: 4398551 - DNA, 13 bp, Homo sapiens
ctgcttgattttt

SEQ ID NO: 4398552 - DNA, 20 bp, Homo sapiens
ctgcttgatttttgcctctt

SEQ ID NO: 4398553 - DNA, 17 bp, Homo sapiens
ctgcttgcatctgcaca

SEQ ID NO: 4398554 - DNA, 23 bp, Homo sapiens
ctgcttggtctttcattgctaag

SEQ ID NO: 4398555 - DNA, 14 bp, Homo sapiens
ctgctttctttgat

SEQ ID NO: 4398556 - DNA, 15 bp, Homo sapiens
ctgctttctttgatt

SEQ ID NO: 4398557 - DNA, 21 bp, Homo sapiens
ctgcttttaaaagtgcacatt

SEQ ID NO: 4398558 - DNA, 17 bp, Homo sapiens
ctgcttttatctcagat

SEQ ID NO: 4398559 - DNA, 19 bp, Homo sapiens
ctgcttttctgccctggct

SEQ ID NO: 4398560 - DNA, 18 bp, Homo sapiens
ctgcttttgcagaaatca

SEQ ID NO: 4398561 - DNA, 22 bp, Homo sapiens
ctgctttttccaactcagaaat

SEQ ID NO: 4398562 - DNA, 21 bp, Homo sapiens
ctggaaaaaaatacaaaaagc

SEQ ID NO: 4398563 - DNA, 22 bp, Homo sapiens
ctggaaaaaaatacaaaaagca

SEQ ID NO: 4398564 - DNA, 22 bp, Homo sapiens
ctggaaaagtgatgtattttca

SEQ ID NO: 4398565 - DNA, 21 bp, Homo sapiens
ctggaaacaaaacagaagggg

SEQ ID NO: 4398566 - DNA, 18 bp, Homo sapiens
ctccccaagacacatcct

SEQ ID NO: 4398567 - DNA, 17 bp, Homo sapiens
ctccccaattctcccct

SEQ ID NO: 4398568 - DNA, 20 bp, Homo sapiens
ctccccaccctcctcttgga

SEQ ID NO: 4398569 - DNA, 21 bp, Homo sapiens
ctccccacgcccgtctctttc

SEQ ID NO: 4398570 - DNA, 20 bp, Homo sapiens
ctccccacgtcagctgggac

SEQ ID NO: 4398571 - DNA, 11 bp, Homo sapiens
ctccccactcc

SEQ ID NO: 4398572 - DNA, 21 bp, Homo sapiens
ctccccacttcactttcttca

SEQ ID NO: 4398573 - DNA, 13 bp, Homo sapiens
ctccccagactct

SEQ ID NO: 4398574 - DNA, 12 bp, Homo sapiens
ctccccagagct

SEQ ID NO: 4398575 - DNA, 13 bp, Homo sapiens
ctccccagagctg

SEQ ID NO: 4398576 - DNA, 21 bp, Homo sapiens
ctccccagagctggcgctcag

SEQ ID NO: 4398577 - DNA, 22 bp, Homo sapiens
ctccccagagctggcgctcagc

SEQ ID NO: 4398578 - DNA, 18 bp, Homo sapiens
ctccccagccagcccttc

SEQ ID NO: 4398579 - DNA, 19 bp, Homo sapiens
ctccccaggaagtggctca

SEQ ID NO: 4398580 - DNA, 21 bp, Homo sapiens
ctccccaggggagagggtctg

SEQ ID NO: 4398581 - DNA, 17 bp, Homo sapiens
ctccccagtgcctgcca

SEQ ID NO: 4398582 - DNA, 18 bp, Homo sapiens
ctccccagtgcctgccac

SEQ ID NO: 4398583 - DNA, 15 bp, Homo sapiens
ctccccatctgtcca

SEQ ID NO: 4398584 - DNA, 17 bp, Homo sapiens
ctccccatctgtccagc

SEQ ID NO: 4398585 - DNA, 21 bp, Homo sapiens
ctccccatttcccatctgcac

SEQ ID NO: 4398586 - DNA, 22 bp, Homo sapiens
ctccccatttcccatctgcacc

SEQ ID NO: 4398587 - DNA, 21 bp, Homo sapiens
ctcccccaacccccaccccac

SEQ ID NO: 4398588 - DNA, 14 bp, Homo sapiens
ctcccccaccccct

SEQ ID NO: 4398589 - DNA, 15 bp, Homo sapiens
ctccccccactgcag

SEQ ID NO: 4398590 - DNA, 18 bp, Homo sapiens
ctcccccctcctctgaaa

SEQ ID NO: 4398591 - DNA, 11 bp, Homo sapiens
ctcccccgcct

SEQ ID NO: 4398592 - DNA, 13 bp, Homo sapiens
ctccccctcccca

SEQ ID NO: 4398593 - DNA, 14 bp, Homo sapiens
ctccccctcctcca

SEQ ID NO: 4398594 - DNA, 16 bp, Homo sapiens
ctccccctcctccagg

SEQ ID NO: 4398595 - DNA, 12 bp, Homo sapiens
ctccccctgcaa

SEQ ID NO: 4398596 - DNA, 13 bp, Homo sapiens
ctccccctgccag

SEQ ID NO: 4398597 - DNA, 18 bp, Homo sapiens
ctccccctgccagtgcct

SEQ ID NO: 4398598 - DNA, 22 bp, Homo sapiens
ctccccgcagcccgcctgccgt

SEQ ID NO: 4398599 - DNA, 16 bp, Homo sapiens
ctccccgcctccactc

SEQ ID NO: 4398600 - DNA, 21 bp, Homo sapiens
ctcccctcaaccgcacatgtg

SEQ ID NO: 4398601 - DNA, 15 bp, Homo sapiens
ctcccctcccctggg

SEQ ID NO: 4398602 - DNA, 16 bp, Homo sapiens
ctcccctcctcttccc

SEQ ID NO: 4398603 - DNA, 23 bp, Homo sapiens
ctcccctctcctccccttcctgt

SEQ ID NO: 4398604 - DNA, 19 bp, Homo sapiens
ctcccctctcgccccatcc

SEQ ID NO: 4398605 - DNA, 16 bp, Homo sapiens
ctgccgctgccatgct

SEQ ID NO: 4398606 - DNA, 20 bp, Homo sapiens
ctgccgctgccgctgcacca

SEQ ID NO: 4398607 - DNA, 16 bp, Homo sapiens
ctgccggtcgggcagc

SEQ ID NO: 4398608 - DNA, 22 bp, Homo sapiens
ctgccggtcgggcagccagcag

SEQ ID NO: 4398609 - DNA, 14 bp, Homo sapiens
ctgccggtgggacc

SEQ ID NO: 4398610 - DNA, 15 bp, Homo sapiens
ctgccggtgggaccc

SEQ ID NO: 4398611 - DNA, 22 bp, Homo sapiens
ctgccggtgggaccctgtccgg

SEQ ID NO: 4398612 - DNA, 14 bp, Homo sapiens
ctgccgtgcatggc

SEQ ID NO: 4398613 - DNA, 21 bp, Homo sapiens
ctgccgtgcatggctcctgtc

SEQ ID NO: 4398614 - DNA, 16 bp, Homo sapiens
ctgcctaagtggctgc

SEQ ID NO: 4398615 - DNA, 19 bp, Homo sapiens
ctgcctaagtggctgctga

SEQ ID NO: 4398616 - DNA, 16 bp, Homo sapiens
ctgcctaataaagaga

SEQ ID NO: 4398617 - DNA, 23 bp, Homo sapiens
ctgcctaattttgccaaaatcct

SEQ ID NO: 4398618 - DNA, 13 bp, Homo sapiens
ctgcctacagcca

SEQ ID NO: 4398619 - DNA, 22 bp, Homo sapiens
ctgcctatgcactgaagagctc

SEQ ID NO: 4398620 - DNA, 21 bp, Homo sapiens
ctgcctcaatgtgaatcagac

SEQ ID NO: 4398621 - DNA, 16 bp, Homo sapiens
ctgcctcactcctccg

SEQ ID NO: 4398622 - DNA, 18 bp, Homo sapiens
ctgcctcagacgttgcct

SEQ ID NO: 4398623 - DNA, 21 bp, Homo sapiens
ctgcctcagacgttgcctgag

SEQ ID NO: 4398624 - DNA, 22 bp, Homo sapiens
ctgcctcagacgttgcctgaga

SEQ ID NO: 4398625 - DNA, 18 bp, Homo sapiens
ctgcctcagccaggccct

SEQ ID NO: 4398626 - DNA, 12 bp, Homo sapiens
ctgcctcagcct

SEQ ID NO: 4398627 - DNA, 13 bp, Homo sapiens
ctgcctcaggcca

SEQ ID NO: 4398628 - DNA, 12 bp, Homo sapiens
ctgcctccaccc

SEQ ID NO: 4398629 - DNA, 16 bp, Homo sapiens
ctgcctccaccctctg

SEQ ID NO: 4398630 - DNA, 19 bp, Homo sapiens
ctgcctccagggctggact

SEQ ID NO: 4398631 - DNA, 22 bp, Homo sapiens
ctgcctccagggctggactgag

SEQ ID NO: 4398632 - DNA, 21 bp, Homo sapiens
ctgcctcccaacagtggggaa

SEQ ID NO: 4398633 - DNA, 14 bp, Homo sapiens
ctgcctcccaggtt

SEQ ID NO: 4398634 - DNA, 20 bp, Homo sapiens
ctgcctcccattctgcacca

SEQ ID NO: 4398635 - DNA, 18 bp, Homo sapiens
ctgcctccctctccatat

SEQ ID NO: 4398636 - DNA, 16 bp, Homo sapiens
ctgcctcccttgtggc

SEQ ID NO: 4398637 - DNA, 15 bp, Homo sapiens
ctgcctcctgcctat

SEQ ID NO: 4398638 - DNA, 12 bp, Homo sapiens
ctgcctcctgcg

SEQ ID NO: 4398639 - DNA, 14 bp, Homo sapiens
ctgcctcctggcca

SEQ ID NO: 4398640 - DNA, 18 bp, Homo sapiens
ctgcctcgctcaccgctg

SEQ ID NO: 4398641 - DNA, 22 bp, Homo sapiens
ctgcctcgctcaccgctggccc

SEQ ID NO: 4398642 - DNA, 19 bp, Homo sapiens
ctgcctcgtagagtgacct

SEQ ID NO: 4398643 - DNA, 15 bp, Homo sapiens
ctgcctctccaggca

SEQ ID NO: 4398644 - DNA, 12 bp, Homo sapiens
ctgcctctctgg

SEQ ID NO: 4398645 - DNA, 18 bp, Homo sapiens
ctgcctctgaccccagca

SEQ ID NO: 4398646 - DNA, 16 bp, Homo sapiens
ctgcctctgctccctc

SEQ ID NO: 4398647 - DNA, 22 bp, Homo sapiens
ctgcctcttctgggagggcagc

SEQ ID NO: 4398648 - DNA, 23 bp, Homo sapiens
ctgcctgacatttggagtgttcc

SEQ ID NO: 4398649 - DNA, 11 bp, Homo sapiens
ctgcctgaggg

SEQ ID NO: 4398650 - DNA, 14 bp, Homo sapiens
ctgcctgcagcagg

SEQ ID NO: 4398651 - DNA, 13 bp, Homo sapiens
ctgcctgcagcca

SEQ ID NO: 4398652 - DNA, 14 bp, Homo sapiens
ctgcctgcagccag

SEQ ID NO: 4398653 - DNA, 15 bp, Homo sapiens
ctgcctgcagccagg

SEQ ID NO: 4398654 - DNA, 21 bp, Homo sapiens
ctgcctgcagccagggctggg

SEQ ID NO: 4398655 - DNA, 14 bp, Homo sapiens
ctgcctgccccgcc

SEQ ID NO: 4398656 - DNA, 18 bp, Homo sapiens
ctgcctgccccgccccca

SEQ ID NO: 4398657 - DNA, 22 bp, Homo sapiens
ctgcctgccccgcccccagtcc

SEQ ID NO: 4398658 - DNA, 17 bp, Homo sapiens
ctgcctgccctgcctca

SEQ ID NO: 4398659 - DNA, 18 bp, Homo sapiens
ctgcctgccctgcctcag

SEQ ID NO: 4398660 - DNA, 19 bp, Homo sapiens
ctgcctgccctgcctcagc

SEQ ID NO: 4398661 - DNA, 24 bp, Homo sapiens
ctgcctgctccttggcacccccat

SEQ ID NO: 4398662 - DNA, 16 bp, Homo sapiens
ctgcctgctgagatga

SEQ ID NO: 4398663 - DNA, 22 bp, Homo sapiens
ctgcctggagacaaggtgctaa

SEQ ID NO: 4398664 - DNA, 23 bp, Homo sapiens
ctgcctggagacaaggtgctaac

SEQ ID NO: 4398665 - DNA, 17 bp, Homo sapiens
ctgcctggccaggcaga

SEQ ID NO: 4398666 - DNA, 15 bp, Homo sapiens
ctgcctggcccccaa

SEQ ID NO: 4398667 - DNA, 13 bp, Homo sapiens
ctgcctgggaagg

SEQ ID NO: 4398668 - DNA, 12 bp, Homo sapiens
ctgcctgggttt

SEQ ID NO: 4398669 - DNA, 19 bp, Homo sapiens
ctgcctggttccctcccca

SEQ ID NO: 4398670 - DNA, 15 bp, Homo sapiens
ctgcctggttttatt

SEQ ID NO: 4398671 - DNA, 22 bp, Homo sapiens
ctgcctgtaattaaactagttt

SEQ ID NO: 4398672 - DNA, 17 bp, Homo sapiens
ctgcctgtagcaatggc

SEQ ID NO: 4398673 - DNA, 21 bp, Homo sapiens
ctgcctgtagcaatggccaga

SEQ ID NO: 4398674 - DNA, 12 bp, Homo sapiens
ctgcctgtggcc

SEQ ID NO: 4398675 - DNA, 15 bp, Homo sapiens
ctgcctgtgggcttc

SEQ ID NO: 4398676 - DNA, 20 bp, Homo sapiens
ctgcctgttataactctgca

SEQ ID NO: 4398677 - DNA, 18 bp, Homo sapiens
ctgcctgttggcaggccc

SEQ ID NO: 4398678 - DNA, 16 bp, Homo sapiens
ctgccttaaaaccaaa

SEQ ID NO: 4398679 - DNA, 17 bp, Homo sapiens
ctgccttaaaaccaaag

SEQ ID NO: 4398680 - DNA, 18 bp, Homo sapiens
ctgccttaaaaccaaaga

SEQ ID NO: 4398681 - DNA, 15 bp, Homo sapiens
ctgccttagagccag

SEQ ID NO: 4398682 - DNA, 16 bp, Homo sapiens
ctgccttcacaaatgt

SEQ ID NO: 4398683 - DNA, 13 bp, Homo sapiens
ctgccttcaggga

SEQ ID NO: 4398684 - DNA, 16 bp, Homo sapiens
ctgccttccctagctt

SEQ ID NO: 4398685 - DNA, 17 bp, Homo sapiens
ctgccttccctagcttt

SEQ ID NO: 4398686 - DNA, 14 bp, Homo sapiens
ctgccttcctcctg

SEQ ID NO: 4398687 - DNA, 21 bp, Homo sapiens
ctgccttcctcctgggccctc

SEQ ID NO: 4398688 - DNA, 22 bp, Homo sapiens
ctgccttgccctcctgggccct

SEQ ID NO: 4398689 - DNA, 23 bp, Homo sapiens
ctgccttgccctcctgggccctg

SEQ ID NO: 4398690 - DNA, 15 bp, Homo sapiens
ctgcctttagaaaat

SEQ ID NO: 4398691 - DNA, 17 bp, Homo sapiens
ctgcctttagaaaatat

SEQ ID NO: 4398692 - DNA, 20 bp, Homo sapiens
ctgcgaatgggatcctgatg

SEQ ID NO: 4398693 - DNA, 23 bp, Homo sapiens
ctgcgacgcttgctctgtttgtg

SEQ ID NO: 4398694 - DNA, 22 bp, Homo sapiens
ctgcgagacgcacacagctgag

SEQ ID NO: 4398695 - DNA, 23 bp, Homo sapiens
ctgcgagacgcacacagctgagc

SEQ ID NO: 4398696 - DNA, 17 bp, Homo sapiens
ctgcgcagcctccaggg

SEQ ID NO: 4398697 - DNA, 18 bp, Homo sapiens
ctgcgcagcctccagggc

SEQ ID NO: 4398698 - DNA, 15 bp, Homo sapiens
ctgcgccacccacca

SEQ ID NO: 4398699 - DNA, 18 bp, Homo sapiens
ctgcgcccaccccgctct

SEQ ID NO: 4398700 - DNA, 22 bp, Homo sapiens
ctgcgcccttaactgcatccag

SEQ ID NO: 4398701 - DNA, 21 bp, Homo sapiens
ctgcgcctgcaggcagagctg

SEQ ID NO: 4398702 - DNA, 15 bp, Homo sapiens
ctgcgcctgctgcct

SEQ ID NO: 4398703 - DNA, 13 bp, Homo sapiens
ctgcgcttgcttt

SEQ ID NO: 4398704 - DNA, 14 bp, Homo sapiens
ctgcggccaggcct

SEQ ID NO: 4398705 - DNA, 18 bp, Homo sapiens
ctgcggccaggcctgcgg

SEQ ID NO: 4398706 - DNA, 15 bp, Homo sapiens
ctgcgggagccagac

SEQ ID NO: 4398707 - DNA, 18 bp, Homo sapiens
ctgcggggctgagacgcc

SEQ ID NO: 4398708 - DNA, 21 bp, Homo sapiens
ctgcgggggcagtgctcaccc

SEQ ID NO: 4398709 - DNA, 23 bp, Homo sapiens
ctgcggggggtgtcttccctgcc

SEQ ID NO: 4398710 - DNA, 18 bp, Homo sapiens
ctgcgtagaagatatgga

SEQ ID NO: 4398711 - DNA, 13 bp, Homo sapiens
ctgcgtcccagcc

SEQ ID NO: 4398712 - DNA, 14 bp, Homo sapiens
ctgcgtcccagcct

SEQ ID NO: 4398713 - DNA, 15 bp, Homo sapiens
ctgcgtcccagcctg

SEQ ID NO: 4398714 - DNA, 19 bp, Homo sapiens
ctgcgtcctcctcacctca

SEQ ID NO: 4398715 - DNA, 22 bp, Homo sapiens
ctgcgtgggtgtgtgcgtgttt

SEQ ID NO: 4398716 - DNA, 15 bp, Homo sapiens
ctgcgttctgcaagc

SEQ ID NO: 4398717 - DNA, 23 bp, Homo sapiens
ctgctaaataaaatttgttgcat

SEQ ID NO: 4398718 - DNA, 16 bp, Homo sapiens
ctgctaaggctcctcc

SEQ ID NO: 4398719 - DNA, 16 bp, Homo sapiens
ctgctaagtaatttag

SEQ ID NO: 4398720 - DNA, 15 bp, Homo sapiens
ctgctacctctgaga

SEQ ID NO: 4398721 - DNA, 16 bp, Homo sapiens
ctgctacctctgagaa

SEQ ID NO: 4398722 - DNA, 17 bp, Homo sapiens
ctgctacctctgagaag

SEQ ID NO: 4398723 - DNA, 19 bp, Homo sapiens
ctgctactcctgtgctctg

SEQ ID NO: 4398724 - DNA, 16 bp, Homo sapiens
ctgctagacgcaccgc

SEQ ID NO: 4398725 - DNA, 19 bp, Homo sapiens
ctctgggccctgtcgcccc

SEQ ID NO: 4398726 - DNA, 16 bp, Homo sapiens
ctctggggcagaggaa

SEQ ID NO: 4398727 - DNA, 17 bp, Homo sapiens
ctctgggggtgggaagt

SEQ ID NO: 4398728 - DNA, 18 bp, Homo sapiens
ctctggggtgcagcttca

SEQ ID NO: 4398729 - DNA, 22 bp, Homo sapiens
ctctggtccctttaaagagcaa

SEQ ID NO: 4398730 - DNA, 22 bp, Homo sapiens
ctctggtccggacactcctaga

SEQ ID NO: 4398731 - DNA, 23 bp, Homo sapiens
ctctggtgagtcaccacttcagg

SEQ ID NO: 4398732 - DNA, 15 bp, Homo sapiens
ctctggttatttttc

SEQ ID NO: 4398733 - DNA, 20 bp, Homo sapiens
ctctggttatttttctcttg

SEQ ID NO: 4398734 - DNA, 15 bp, Homo sapiens
ctctgtaaaatgcac

SEQ ID NO: 4398735 - DNA, 20 bp, Homo sapiens
ctctgtacttttcattctct

SEQ ID NO: 4398736 - DNA, 22 bp, Homo sapiens
ctctgtacttttcattctcttt

SEQ ID NO: 4398737 - DNA, 14 bp, Homo sapiens
ctctgtagtttatg

SEQ ID NO: 4398738 - DNA, 21 bp, Homo sapiens
ctctgtataatagagataagt

SEQ ID NO: 4398739 - DNA, 15 bp, Homo sapiens
ctctgtcagccagcc

SEQ ID NO: 4398740 - DNA, 14 bp, Homo sapiens
ctctgtccaggcac

SEQ ID NO: 4398741 - DNA, 14 bp, Homo sapiens
ctctgtccccttct

SEQ ID NO: 4398742 - DNA, 21 bp, Homo sapiens
ctctgtccccttctctcatct

SEQ ID NO: 4398743 - DNA, 14 bp, Homo sapiens
ctctgtctcatcca

SEQ ID NO: 4398744 - DNA, 11 bp, Homo sapiens
ctctgtgaaag

SEQ ID NO: 4398745 - DNA, 17 bp, Homo sapiens
ctctgtgaactgtgtgt

SEQ ID NO: 4398746 - DNA, 14 bp, Homo sapiens
ctctgtgaccaatg

SEQ ID NO: 4398747 - DNA, 15 bp, Homo sapiens
ctctgtgaccaatgt

SEQ ID NO: 4398748 - DNA, 19 bp, Homo sapiens
ctctgtgaccaatgtcttg

SEQ ID NO: 4398749 - DNA, 16 bp, Homo sapiens
ctctgtgcccagcctg

SEQ ID NO: 4398750 - DNA, 15 bp, Homo sapiens
ctctgtgctgaccct

SEQ ID NO: 4398751 - DNA, 19 bp, Homo sapiens
ctctgtgctgaccctcctg

SEQ ID NO: 4398752 - DNA, 17 bp, Homo sapiens
ctctgtgggtgatgggg

SEQ ID NO: 4398753 - DNA, 23 bp, Homo sapiens
ctctgtgtatatctcttggaaaa

SEQ ID NO: 4398754 - DNA, 17 bp, Homo sapiens
ctctgtgtggctgtgca

SEQ ID NO: 4398755 - DNA, 15 bp, Homo sapiens
ctctgttacccaggc

SEQ ID NO: 4398756 - DNA, 21 bp, Homo sapiens
ctctgttcccccaccctccat

SEQ ID NO: 4398757 - DNA, 21 bp, Homo sapiens
ctctgttgtcgtaaagatttg

SEQ ID NO: 4398758 - DNA, 16 bp, Homo sapiens
ctctgtttgtgggact

SEQ ID NO: 4398759 - DNA, 16 bp, Homo sapiens
ctctgtttgtggggtg

SEQ ID NO: 4398760 - DNA, 14 bp, Homo sapiens
ctcttaaatcattt

SEQ ID NO: 4398761 - DNA, 14 bp, Homo sapiens
ctcttaaattatat

SEQ ID NO: 4398762 - DNA, 18 bp, Homo sapiens
ctcttaatggtccaaagg

SEQ ID NO: 4398763 - DNA, 20 bp, Homo sapiens
ctcttacatcagtagcattt

SEQ ID NO: 4398764 - DNA, 13 bp, Homo sapiens
ctcttacatctcc

SEQ ID NO: 4398765 - DNA, 22 bp, Homo sapiens
ctcttagggacagtcaaaacca

SEQ ID NO: 4398766 - DNA, 14 bp, Homo sapiens
ctcttagtcccaag

SEQ ID NO: 4398767 - DNA, 16 bp, Homo sapiens
ctcttagtcccaagct

SEQ ID NO: 4398768 - DNA, 20 bp, Homo sapiens
ctcttatagaagcttcagca

SEQ ID NO: 4398769 - DNA, 14 bp, Homo sapiens
ctcttattgttctt

SEQ ID NO: 4398770 - DNA, 13 bp, Homo sapiens
ctcttcacctgac

SEQ ID NO: 4398771 - DNA, 23 bp, Homo sapiens
ctcttcagactctcagcccagaa

SEQ ID NO: 4398772 - DNA, 13 bp, Homo sapiens
ctcttcagaggcc

SEQ ID NO: 4398773 - DNA, 13 bp, Homo sapiens
ctcttcaggcctc

SEQ ID NO: 4398774 - DNA, 14 bp, Homo sapiens
ctcttcatctaata

SEQ ID NO: 4398775 - DNA, 22 bp, Homo sapiens
ctcttcatgcttgacataccta

SEQ ID NO: 4398776 - DNA, 12 bp, Homo sapiens
ctcttccacagt

SEQ ID NO: 4398777 - DNA, 20 bp, Homo sapiens
ctcttcccatgtcccaccct

SEQ ID NO: 4398778 - DNA, 16 bp, Homo sapiens
ctcttccccagagagg

SEQ ID NO: 4398779 - DNA, 22 bp, Homo sapiens
ctcttccccttagaaacactgc

SEQ ID NO: 4398780 - DNA, 15 bp, Homo sapiens
ctcttccccttccct

SEQ ID NO: 4398781 - DNA, 18 bp, Homo sapiens
ctgaactcagaaggctgt

SEQ ID NO: 4398782 - DNA, 19 bp, Homo sapiens
ctgaactccatacagcctc

SEQ ID NO: 4398783 - DNA, 13 bp, Homo sapiens
ctgaactccattt

SEQ ID NO: 4398784 - DNA, 16 bp, Homo sapiens
ctgaactgagccccag

SEQ ID NO: 4398785 - DNA, 23 bp, Homo sapiens
ctgaactgaggagatgaccaggg

SEQ ID NO: 4398786 - DNA, 23 bp, Homo sapiens
ctgaactgcttttaaaagtgcac

SEQ ID NO: 4398787 - DNA, 24 bp, Homo sapiens
ctgaactgcttttaaaagtgcaca

SEQ ID NO: 4398788 - DNA, 17 bp, Homo sapiens
ctgaacttccaagctcc

SEQ ID NO: 4398789 - DNA, 16 bp, Homo sapiens
ctgaacttgaagctaa

SEQ ID NO: 4398790 - DNA, 14 bp, Homo sapiens
ctgaactttctccc

SEQ ID NO: 4398791 - DNA, 19 bp, Homo sapiens
ctgaactttctccctcatc

SEQ ID NO: 4398792 - DNA, 17 bp, Homo sapiens
ctgaagaactctctgga

SEQ ID NO: 4398793 - DNA, 18 bp, Homo sapiens
ctgaagaagcacttctgc

SEQ ID NO: 4398794 - DNA, 22 bp, Homo sapiens
ctgaagaagcacttctgctgca

SEQ ID NO: 4398795 - DNA, 19 bp, Homo sapiens
ctgaagaaggaaggcctga

SEQ ID NO: 4398796 - DNA, 21 bp, Homo sapiens
ctgaagaaggaaggcctgagc

SEQ ID NO: 4398797 - DNA, 12 bp, Homo sapiens
ctgaagaagttt

SEQ ID NO: 4398798 - DNA, 21 bp, Homo sapiens
ctgaagagaagggcagggctg

SEQ ID NO: 4398799 - DNA, 17 bp, Homo sapiens
ctgaagagctcttggcc

SEQ ID NO: 4398800 - DNA, 16 bp, Homo sapiens
ctgaagatccccaact

SEQ ID NO: 4398801 - DNA, 18 bp, Homo sapiens
ctgaagatccccaactgc

SEQ ID NO: 4398802 - DNA, 20 bp, Homo sapiens
ctgaagatccccaactgctc

SEQ ID NO: 4398803 - DNA, 22 bp, Homo sapiens
ctgaagatgaaatatatattgt

SEQ ID NO: 4398804 - DNA, 14 bp, Homo sapiens
ctgaagatggaggg

SEQ ID NO: 4398805 - DNA, 14 bp, Homo sapiens
ctgaagcctctggg

SEQ ID NO: 4398806 - DNA, 13 bp, Homo sapiens
ctgaagctgctgt

SEQ ID NO: 4398807 - DNA, 18 bp, Homo sapiens
ctgaagcttcggccgcgc

SEQ ID NO: 4398808 - DNA, 16 bp, Homo sapiens
ctgaaggaaaaacaca

SEQ ID NO: 4398809 - DNA, 17 bp, Homo sapiens
ctgaaggaaaaacacaa

SEQ ID NO: 4398810 - DNA, 14 bp, Homo sapiens
ctgaaggaagagaa

SEQ ID NO: 4398811 - DNA, 13 bp, Homo sapiens
ctgaaggagcccc

SEQ ID NO: 4398812 - DNA, 18 bp, Homo sapiens
ctgaagggcattctttcc

SEQ ID NO: 4398813 - DNA, 12 bp, Homo sapiens
ctgaagggtgga

SEQ ID NO: 4398814 - DNA, 24 bp, Homo sapiens
ctgaagggtggatgtgctggaggg

SEQ ID NO: 4398815 - DNA, 15 bp, Homo sapiens
ctgaagtacaaacat

SEQ ID NO: 4398816 - DNA, 18 bp, Homo sapiens
ctgaagtacaaacatgaa

SEQ ID NO: 4398817 - DNA, 19 bp, Homo sapiens
ctgaagtacaaacatgaaa

SEQ ID NO: 4398818 - DNA, 13 bp, Homo sapiens
ctgaagttcttgg

SEQ ID NO: 4398819 - DNA, 15 bp, Homo sapiens
ctgaagttgaacatg

SEQ ID NO: 4398820 - DNA, 13 bp, Homo sapiens
ctgaataaagcaa

SEQ ID NO: 4398821 - DNA, 18 bp, Homo sapiens
ctgaataaagcctttgat

SEQ ID NO: 4398822 - DNA, 17 bp, Homo sapiens
ctgaatacacagtattc

SEQ ID NO: 4398823 - DNA, 19 bp, Homo sapiens
ctgaatacacagtattcag

SEQ ID NO: 4398824 - DNA, 22 bp, Homo sapiens
ctgaatagttaaaaattaaata

SEQ ID NO: 4398825 - DNA, 19 bp, Homo sapiens
ctgaatcaccaattaaaaa

SEQ ID NO: 4398826 - DNA, 19 bp, Homo sapiens
ctgaatccaaactaatcca

SEQ ID NO: 4398827 - DNA, 20 bp, Homo sapiens
ctgaatccaaactaatccat

SEQ ID NO: 4398828 - DNA, 20 bp, Homo sapiens
ctgaatcccccttgccaccc

SEQ ID NO: 4398829 - DNA, 12 bp, Homo sapiens
ctgaatctagag

SEQ ID NO: 4398830 - DNA, 17 bp, Homo sapiens
ctgaatctatggcttta

SEQ ID NO: 4398831 - DNA, 18 bp, Homo sapiens
ctgaatctgtgcaaacag

SEQ ID NO: 4398832 - DNA, 20 bp, Homo sapiens
ctgaatgaggtcagcatgtc

SEQ ID NO: 4398833 - DNA, 16 bp, Homo sapiens
ctgaatgatcctgtct

SEQ ID NO: 4398834 - DNA, 18 bp, Homo sapiens
ctgaatgatcctgtctct

SEQ ID NO: 4398835 - DNA, 15 bp, Homo sapiens
ctgaatgatctattc

SEQ ID NO: 4398836 - DNA, 16 bp, Homo sapiens
ctgaatgatcttgtgt

SEQ ID NO: 4398837 - DNA, 14 bp, Homo sapiens
ctgaatgtaatttg

SEQ ID NO: 4398838 - DNA, 17 bp, Homo sapiens
ctgaatgtaatttgtgt

SEQ ID NO: 4398839 - DNA, 18 bp, Homo sapiens
ctgaatgtaatttgtgta

SEQ ID NO: 4398840 - DNA, 22 bp, Homo sapiens
ctgaatgtaatttgtgtaataa

SEQ ID NO: 4398841 - DNA, 13 bp, Homo sapiens
ctgaatgtatgta

SEQ ID NO: 4398842 - DNA, 16 bp, Homo sapiens
ctgaatgtatgtaaat

SEQ ID NO: 4398843 - DNA, 13 bp, Homo sapiens
ctgaatgtgccta

SEQ ID NO: 4398844 - DNA, 14 bp, Homo sapiens
ctgaattaattaat

SEQ ID NO: 4398845 - DNA, 17 bp, Homo sapiens
ctgaattatctatttca

SEQ ID NO: 4398846 - DNA, 17 bp, Homo sapiens
ctgaattctatttgctg

SEQ ID NO: 4398847 - DNA, 15 bp, Homo sapiens
ctgaattgctttctg

SEQ ID NO: 4398848 - DNA, 16 bp, Homo sapiens
ctgaattgctttctgc

SEQ ID NO: 4398849 - DNA, 18 bp, Homo sapiens
ctgaattggcttccagat

SEQ ID NO: 4398850 - DNA, 19 bp, Homo sapiens
ctgaattggcttccagatt

SEQ ID NO: 4398851 - DNA, 20 bp, Homo sapiens
ctgaattggcttccagattt

SEQ ID NO: 4398852 - DNA, 18 bp, Homo sapiens
ctgaatttaattctttca

SEQ ID NO: 4398853 - DNA, 14 bp, Homo sapiens
ctgaatttgcaaag

SEQ ID NO: 4398854 - DNA, 15 bp, Homo sapiens
ctgaatttgcaaagt

SEQ ID NO: 4398855 - DNA, 19 bp, Homo sapiens
ctgaatttgcaaagtactg

SEQ ID NO: 4398856 - DNA, 22 bp, Homo sapiens
ctgaatttgcaaagtactgtaa

SEQ ID NO: 4398857 - DNA, 12 bp, Homo sapiens
ctgaatttggag

SEQ ID NO: 4398858 - DNA, 21 bp, Homo sapiens
ctgaatttttaaacaagtatt

SEQ ID NO: 4398859 - DNA, 19 bp, Homo sapiens
ctgaatttttttgtaataa

SEQ ID NO: 4398860 - DNA, 20 bp, Homo sapiens
ctgaatttttttgtaataag

SEQ ID NO: 4398861 - DNA, 20 bp, Homo sapiens
ctgacaactgtttaattgaa

SEQ ID NO: 4398862 - DNA, 16 bp, Homo sapiens
ctgacaatgaagggaa

SEQ ID NO: 4398863 - DNA, 18 bp, Homo sapiens
ctgacaattaacatacat

SEQ ID NO: 4398864 - DNA, 23 bp, Homo sapiens
ctgacacaccaggcgctaattca

SEQ ID NO: 4398865 - DNA, 19 bp, Homo sapiens
ctgacacccaggcccgagc

SEQ ID NO: 4398866 - DNA, 19 bp, Homo sapiens
ctgacactcaataaacagt

SEQ ID NO: 4398867 - DNA, 20 bp, Homo sapiens
ctgacactcaataaacagtc

SEQ ID NO: 4398868 - DNA, 19 bp, Homo sapiens
ctgacactttaattaccaa

SEQ ID NO: 4398869 - DNA, 14 bp, Homo sapiens
ctgacagaaagcag

SEQ ID NO: 4398870 - DNA, 21 bp, Homo sapiens
ctgacagatgcctggtgagca

SEQ ID NO: 4398871 - DNA, 19 bp, Homo sapiens
ctgacagggacatgccctg

SEQ ID NO: 4398872 - DNA, 14 bp, Homo sapiens
ctgacagggagcag

SEQ ID NO: 4398873 - DNA, 16 bp, Homo sapiens
ctgacagggagcagcc

SEQ ID NO: 4398874 - DNA, 23 bp, Homo sapiens
ctgacatgaagctgttgtgtgag

SEQ ID NO: 4398875 - DNA, 19 bp, Homo sapiens
ctgacatgtaagaaaatgt

SEQ ID NO: 4398876 - DNA, 14 bp, Homo sapiens
ctgacattgccaaa

SEQ ID NO: 4398877 - DNA, 21 bp, Homo sapiens
ctgacattgccaaaaaggata

SEQ ID NO: 4398878 - DNA, 18 bp, Homo sapiens
ctgacatttggagtgttc

SEQ ID NO: 4398879 - DNA, 21 bp, Homo sapiens
ctgacatttggagtgttcccc

SEQ ID NO: 4398880 - DNA, 20 bp, Homo sapiens
ctgacatttgtttatttttt

SEQ ID NO: 4398881 - DNA, 21 bp, Homo sapiens
ctgacatttgtttattttttg

SEQ ID NO: 4398882 - DNA, 21 bp, Homo sapiens
ctgaccaagtgctggcccacc

SEQ ID NO: 4398883 - DNA, 20 bp, Homo sapiens
ctgaccaatattgtacagtt

SEQ ID NO: 4398884 - DNA, 21 bp, Homo sapiens
ctgaccaatattgtacagttt

SEQ ID NO: 4398885 - DNA, 12 bp, Homo sapiens
ctgaccagtcag

SEQ ID NO: 4398886 - DNA, 17 bp, Homo sapiens
ctgaccagtcagatggt

SEQ ID NO: 4398887 - DNA, 16 bp, Homo sapiens
ctgaccatccactcta

SEQ ID NO: 4398888 - DNA, 22 bp, Homo sapiens
ctgaccatccactctaccctcc

SEQ ID NO: 4398889 - DNA, 23 bp, Homo sapiens
ctgaccatccactctaccctccc

SEQ ID NO: 4398890 - DNA, 23 bp, Homo sapiens
ctgaccatgcgtcaggggcctag

SEQ ID NO: 4398891 - DNA, 22 bp, Homo sapiens
ctgacccagagtggagtctgag

SEQ ID NO: 4398892 - DNA, 17 bp, Homo sapiens
ctgacccagtccctggg

SEQ ID NO: 4398893 - DNA, 13 bp, Homo sapiens
ctgacccccatgt

SEQ ID NO: 4398894 - DNA, 17 bp, Homo sapiens
ctgacccccatgtaaat

SEQ ID NO: 4398895 - DNA, 13 bp, Homo sapiens
ctgacccctgcct

SEQ ID NO: 4398896 - DNA, 19 bp, Homo sapiens
ctgacccctgcctgttggc

SEQ ID NO: 4398897 - DNA, 23 bp, Homo sapiens
ctgacccctgcctgttggcaggc

SEQ ID NO: 4398898 - DNA, 15 bp, Homo sapiens
ctgaggcagaagaat

SEQ ID NO: 4398899 - DNA, 22 bp, Homo sapiens
ctgaggcagcagtgtgaggcca

SEQ ID NO: 4398900 - DNA, 14 bp, Homo sapiens
ctgaggccagagtc

SEQ ID NO: 4398901 - DNA, 15 bp, Homo sapiens
ctgaggcctagactc

SEQ ID NO: 4398902 - DNA, 16 bp, Homo sapiens
ctgaggcctccaagga

SEQ ID NO: 4398903 - DNA, 21 bp, Homo sapiens
ctgaggcggaggctgtgctcc

SEQ ID NO: 4398904 - DNA, 19 bp, Homo sapiens
ctgagggaccaactgggcc

SEQ ID NO: 4398905 - DNA, 12 bp, Homo sapiens
ctgagggagcct

SEQ ID NO: 4398906 - DNA, 17 bp, Homo sapiens
ctgagggagcctggccc

SEQ ID NO: 4398907 - DNA, 19 bp, Homo sapiens
ctgagggcaaatccagtcc

SEQ ID NO: 4398908 - DNA, 23 bp, Homo sapiens
ctgagggcagaaaggttctgccc

SEQ ID NO: 4398909 - DNA, 15 bp, Homo sapiens
ctgagggcagtaccc

SEQ ID NO: 4398910 - DNA, 22 bp, Homo sapiens
ctgagggctctgtttgtgggac

SEQ ID NO: 4398911 - DNA, 19 bp, Homo sapiens
ctgaggggcatctgcccct

SEQ ID NO: 4398912 - DNA, 20 bp, Homo sapiens
ctgaggggcatctgcccctc

SEQ ID NO: 4398913 - DNA, 13 bp, Homo sapiens
ctgaggggccagg

SEQ ID NO: 4398914 - DNA, 19 bp, Homo sapiens
ctgaggtcaggagttcaag

SEQ ID NO: 4398915 - DNA, 21 bp, Homo sapiens
ctgaggtccttatgtcctgtc

SEQ ID NO: 4398916 - DNA, 19 bp, Homo sapiens
ctgaggtgaaagggagcta

SEQ ID NO: 4398917 - DNA, 21 bp, Homo sapiens
ctgaggtggtaggatcacctg

SEQ ID NO: 4398918 - DNA, 14 bp, Homo sapiens
ctgaggttcctctg

SEQ ID NO: 4398919 - DNA, 19 bp, Homo sapiens
ctgaggttcctctgcctgc

SEQ ID NO: 4398920 - DNA, 16 bp, Homo sapiens
ctgagtagtggccact

SEQ ID NO: 4398921 - DNA, 17 bp, Homo sapiens
ctgagtagtggccactg

SEQ ID NO: 4398922 - DNA, 18 bp, Homo sapiens
ctgagtcatgatctccct

SEQ ID NO: 4398923 - DNA, 19 bp, Homo sapiens
ctgagtcatgatctccctg

SEQ ID NO: 4398924 - DNA, 20 bp, Homo sapiens
ctgagtcatgatctccctgc

SEQ ID NO: 4398925 - DNA, 20 bp, Homo sapiens
ctgagtccagctccccccaa

SEQ ID NO: 4398926 - DNA, 19 bp, Homo sapiens
ctgagtccctccatgcaaa

SEQ ID NO: 4398927 - DNA, 19 bp, Homo sapiens
ctgagtcctgtctctgcct

SEQ ID NO: 4398928 - DNA, 20 bp, Homo sapiens
ctgagtcctgtctctgcctg

SEQ ID NO: 4398929 - DNA, 23 bp, Homo sapiens
ctgagtcgtacagaaagctgcct

SEQ ID NO: 4398930 - DNA, 16 bp, Homo sapiens
ctgagtctccagggcc

SEQ ID NO: 4398931 - DNA, 13 bp, Homo sapiens
ctgagtctcggca

SEQ ID NO: 4398932 - DNA, 21 bp, Homo sapiens
ctgagtctcggcatagtcccc

SEQ ID NO: 4398933 - DNA, 14 bp, Homo sapiens
ctgagtctgagtcc

SEQ ID NO: 4398934 - DNA, 16 bp, Homo sapiens
ctgagtctgagtcctg

SEQ ID NO: 4398935 - DNA, 22 bp, Homo sapiens
ctgagtctgagtcctgtctctg

SEQ ID NO: 4398936 - DNA, 16 bp, Homo sapiens
ctgagtgagttttact

SEQ ID NO: 4398937 - DNA, 17 bp, Homo sapiens
ctgagtgccttctgtgg

SEQ ID NO: 4398938 - DNA, 21 bp, Homo sapiens
ctgagtgggaaccggaaacct

SEQ ID NO: 4398939 - DNA, 12 bp, Homo sapiens
ctgagtgtggga

SEQ ID NO: 4398940 - DNA, 15 bp, Homo sapiens
ctgagtgtttggaaa

SEQ ID NO: 4398941 - DNA, 16 bp, Homo sapiens
ctgagttcccgggagc

SEQ ID NO: 4398942 - DNA, 17 bp, Homo sapiens
ctgagttcccgggagct

SEQ ID NO: 4398943 - DNA, 24 bp, Homo sapiens
ctgagttcccgggagctgggccct

SEQ ID NO: 4398944 - DNA, 18 bp, Homo sapiens
ctgagttggcctggccat

SEQ ID NO: 4398945 - DNA, 18 bp, Homo sapiens
ctgagttgggcagccagg

SEQ ID NO: 4398946 - DNA, 24 bp, Homo sapiens
ctgagtttgtggtaaccagccctg

SEQ ID NO: 4398947 - DNA, 20 bp, Homo sapiens
ctgagttttgtgtttgttgt

SEQ ID NO: 4398948 - DNA, 19 bp, Homo sapiens
ctgataaaacaacagctcg

SEQ ID NO: 4398949 - DNA, 23 bp, Homo sapiens
ctgataaaaccatgtagaaaatt

SEQ ID NO: 4398950 - DNA, 18 bp, Homo sapiens
ctgataaaagatggccat

SEQ ID NO: 4398951 - DNA, 14 bp, Homo sapiens
ctgataaactgacg

SEQ ID NO: 4398952 - DNA, 18 bp, Homo sapiens
ctgataacttggggaggc

SEQ ID NO: 4398953 - DNA, 19 bp, Homo sapiens
ctgataacttggggaggca

SEQ ID NO: 4398954 - DNA, 17 bp, Homo sapiens
ctgataattttaaattc

SEQ ID NO: 4398955 - DNA, 18 bp, Homo sapiens
ctgatactttagccatca

SEQ ID NO: 4398956 - DNA, 21 bp, Homo sapiens
ctgatagctgtttcaaatgtg

SEQ ID NO: 4398957 - DNA, 16 bp, Homo sapiens
ctgatatattttacaa

SEQ ID NO: 4398958 - DNA, 18 bp, Homo sapiens
ctgatatattttacaatt

SEQ ID NO: 4398959 - DNA, 22 bp, Homo sapiens
ctgatcaaattggctacaatct

SEQ ID NO: 4398960 - DNA, 14 bp, Homo sapiens
ctgatcagagccgt

SEQ ID NO: 4398961 - DNA, 20 bp, Homo sapiens
ctgatccagtaacctcggag

SEQ ID NO: 4398962 - DNA, 17 bp, Homo sapiens
ctgatcccccagatgca

SEQ ID NO: 4398963 - DNA, 22 bp, Homo sapiens
ctgatcccccagatgcagggct

SEQ ID NO: 4398964 - DNA, 12 bp, Homo sapiens
ctgatccctcta

SEQ ID NO: 4398965 - DNA, 15 bp, Homo sapiens
ctgatccctctacag

SEQ ID NO: 4398966 - DNA, 14 bp, Homo sapiens
ctgatcgcttctcc

SEQ ID NO: 4398967 - DNA, 17 bp, Homo sapiens
ctgatctctgctccctg

SEQ ID NO: 4398968 - DNA, 21 bp, Homo sapiens
ctgatctgaggctaagacaca

SEQ ID NO: 4398969 - DNA, 15 bp, Homo sapiens
ctgatctggctgcag

SEQ ID NO: 4398970 - DNA, 14 bp, Homo sapiens
ctgatctgtacttt

SEQ ID NO: 4398971 - DNA, 14 bp, Homo sapiens
ctctctcccatgga

SEQ ID NO: 4398972 - DNA, 12 bp, Homo sapiens
ctctctccctgc

SEQ ID NO: 4398973 - DNA, 14 bp, Homo sapiens
ctctctccctgcct

SEQ ID NO: 4398974 - DNA, 12 bp, Homo sapiens
ctctctcctctc

SEQ ID NO: 4398975 - DNA, 17 bp, Homo sapiens
ctctctcctctctgctt

SEQ ID NO: 4398976 - DNA, 15 bp, Homo sapiens
ctctctcctgtccaa

SEQ ID NO: 4398977 - DNA, 16 bp, Homo sapiens
ctctctcctttttgct

SEQ ID NO: 4398978 - DNA, 16 bp, Homo sapiens
ctctctcggcccctgt

SEQ ID NO: 4398979 - DNA, 23 bp, Homo sapiens
ctctctcggcccctgtctgttcc

SEQ ID NO: 4398980 - DNA, 12 bp, Homo sapiens
ctctctctgctc

SEQ ID NO: 4398981 - DNA, 15 bp, Homo sapiens
ctctctctgtccctg

SEQ ID NO: 4398982 - DNA, 18 bp, Homo sapiens
ctctctcttctgctccac

SEQ ID NO: 4398983 - DNA, 19 bp, Homo sapiens
ctctctgatgtcccagtgc

SEQ ID NO: 4398984 - DNA, 17 bp, Homo sapiens
ctctctgcagccagccc

SEQ ID NO: 4398985 - DNA, 20 bp, Homo sapiens
ctctctgcagccagcccagc

SEQ ID NO: 4398986 - DNA, 21 bp, Homo sapiens
ctctctgccattctgtgcagg

SEQ ID NO: 4398987 - DNA, 13 bp, Homo sapiens
ctctctgccctct

SEQ ID NO: 4398988 - DNA, 12 bp, Homo sapiens
ctctctgctctg

SEQ ID NO: 4398989 - DNA, 22 bp, Homo sapiens
ctctctgctctgcgtgtcacct

SEQ ID NO: 4398990 - DNA, 22 bp, Homo sapiens
ctctctggaaagaggctctgga

SEQ ID NO: 4398991 - DNA, 20 bp, Homo sapiens
ctctctggaagcccctgggc

SEQ ID NO: 4398992 - DNA, 19 bp, Homo sapiens
ctctctggggccctgggcc

SEQ ID NO: 4398993 - DNA, 19 bp, Homo sapiens
ctctctgtgggctggcagt

SEQ ID NO: 4398994 - DNA, 14 bp, Homo sapiens
ctctctgtggtccc

SEQ ID NO: 4398995 - DNA, 20 bp, Homo sapiens
ctctcttaggagcagagctc

SEQ ID NO: 4398996 - DNA, 13 bp, Homo sapiens
ctctcttcaataa

SEQ ID NO: 4398997 - DNA, 14 bp, Homo sapiens
ctctcttcaataaa

SEQ ID NO: 4398998 - DNA, 15 bp, Homo sapiens
ctctcttcagactct

SEQ ID NO: 4398999 - DNA, 14 bp, Homo sapiens
ctctcttccacagt

SEQ ID NO: 4399000 - DNA, 14 bp, Homo sapiens
ctctcttctgctcc

SEQ ID NO: 4399001 - DNA, 15 bp, Homo sapiens
ctctcttctgctcca

SEQ ID NO: 4399002 - DNA, 16 bp, Homo sapiens
ctctcttggacccacc

SEQ ID NO: 4399003 - DNA, 18 bp, Homo sapiens
ctctcttggacccacctg

SEQ ID NO: 4399004 - DNA, 21 bp, Homo sapiens
ctctcttggacccacctgtgg

SEQ ID NO: 4399005 - DNA, 23 bp, Homo sapiens
ctctcttggacccacctgtgggg

SEQ ID NO: 4399006 - DNA, 15 bp, Homo sapiens
ctctcttggggcgcc

SEQ ID NO: 4399007 - DNA, 18 bp, Homo sapiens
ctctcttgtcctcttctg

SEQ ID NO: 4399008 - DNA, 23 bp, Homo sapiens
ctctcttgtcctcttctgctctt

SEQ ID NO: 4399009 - DNA, 17 bp, Homo sapiens
ctctctttaaccctccc

SEQ ID NO: 4399010 - DNA, 12 bp, Homo sapiens
ctctcttttctg

SEQ ID NO: 4399011 - DNA, 18 bp, Homo sapiens
ctctcttttctgtacttc

SEQ ID NO: 4399012 - DNA, 22 bp, Homo sapiens
ctctcttttctgtacttcctga

SEQ ID NO: 4399013 - DNA, 12 bp, Homo sapiens
ctctcttttgtt

SEQ ID NO: 4399014 - DNA, 9 bp, Homo sapiens
ctctgaaac

SEQ ID NO: 4399015 - DNA, 11 bp, Homo sapiens
ctctgaaacag

SEQ ID NO: 4399016 - DNA, 15 bp, Homo sapiens
ctctgaaacagctgc

SEQ ID NO: 4399017 - DNA, 17 bp, Homo sapiens
ctctgaaacagctgcct

SEQ ID NO: 4399018 - DNA, 20 bp, Homo sapiens
ctctgaaacagctgccttag

SEQ ID NO: 4399019 - DNA, 12 bp, Homo sapiens
ctctgaaaccag

SEQ ID NO: 4399020 - DNA, 20 bp, Homo sapiens
ctctgaactggtagaaaaac

SEQ ID NO: 4399021 - DNA, 22 bp, Homo sapiens
ctctgaaggagttacagggaag

SEQ ID NO: 4399022 - DNA, 22 bp, Homo sapiens
ctctgaatttaattctttcaac

SEQ ID NO: 4399023 - DNA, 23 bp, Homo sapiens
ctctgaatttaattctttcaact

SEQ ID NO: 4399024 - DNA, 13 bp, Homo sapiens
ctctgacagctcc

SEQ ID NO: 4399025 - DNA, 17 bp, Homo sapiens
ctctgacagtccacagg

SEQ ID NO: 4399026 - DNA, 20 bp, Homo sapiens
ctctgacagtccacaggggc

SEQ ID NO: 4399027 - DNA, 18 bp, Homo sapiens
ctctgaccttccagagcc

SEQ ID NO: 4399028 - DNA, 14 bp, Homo sapiens
ctctgacttgggga

SEQ ID NO: 4399029 - DNA, 13 bp, Homo sapiens
ctctgagcagtga

SEQ ID NO: 4399030 - DNA, 14 bp, Homo sapiens
ctctgagccacaga

SEQ ID NO: 4399031 - DNA, 19 bp, Homo sapiens
ctctgagccagattacagg

SEQ ID NO: 4399032 - DNA, 14 bp, Homo sapiens
ctctgatacacagt

SEQ ID NO: 4399033 - DNA, 13 bp, Homo sapiens
ctctgatgtccca

SEQ ID NO: 4399034 - DNA, 14 bp, Homo sapiens
ctctgatgtcccag

SEQ ID NO: 4399035 - DNA, 17 bp, Homo sapiens
ctctgcaaaaggagaga

SEQ ID NO: 4399036 - DNA, 17 bp, Homo sapiens
ctctgcaagaagaaatc

SEQ ID NO: 4399037 - DNA, 22 bp, Homo sapiens
ctctgcactactcctctgcagt

SEQ ID NO: 4399038 - DNA, 17 bp, Homo sapiens
ctctgcagacttcccag

SEQ ID NO: 4399039 - DNA, 18 bp, Homo sapiens
ctctgcagacttcccagc

SEQ ID NO: 4399040 - DNA, 14 bp, Homo sapiens
ctctgcagccagcc

SEQ ID NO: 4399041 - DNA, 15 bp, Homo sapiens
ctctgcaggctgggg

SEQ ID NO: 4399042 - DNA, 19 bp, Homo sapiens
ctctgcaggctggggaggt

SEQ ID NO: 4399043 - DNA, 19 bp, Homo sapiens
ctctgcagtaaaacacatt

SEQ ID NO: 4399044 - DNA, 23 bp, Homo sapiens
ctctgcattgagcatattttctt

SEQ ID NO: 4399045 - DNA, 18 bp, Homo sapiens
ctctgccacctcccctat

SEQ ID NO: 4399046 - DNA, 16 bp, Homo sapiens
ctctgccattctgtgc

SEQ ID NO: 4399047 - DNA, 21 bp, Homo sapiens
ctctgccattctgtgcaggct

SEQ ID NO: 4399048 - DNA, 21 bp, Homo sapiens
ctctgccccaatcgggtccag

SEQ ID NO: 4399049 - DNA, 20 bp, Homo sapiens
ctctgcccccgcgggttcta

SEQ ID NO: 4399050 - DNA, 22 bp, Homo sapiens
ctctgcccccgcgggttctaga

SEQ ID NO: 4399051 - DNA, 19 bp, Homo sapiens
ctctgccccctcccccatg

SEQ ID NO: 4399052 - DNA, 13 bp, Homo sapiens
ctctgcccctgca

SEQ ID NO: 4399053 - DNA, 16 bp, Homo sapiens
ctctgcccctgcagct

SEQ ID NO: 4399054 - DNA, 20 bp, Homo sapiens
ctctgcccctgcagctggaa

SEQ ID NO: 4399055 - DNA, 11 bp, Homo sapiens
ctctgccctgg

SEQ ID NO: 4399056 - DNA, 20 bp, Homo sapiens
ctctgccctggaaagggggt

SEQ ID NO: 4399057 - DNA, 22 bp, Homo sapiens
ctctgccgctgccatgctttga

SEQ ID NO: 4399058 - DNA, 22 bp, Homo sapiens
ctctgccggtcgggcagccagc

SEQ ID NO: 4399059 - DNA, 16 bp, Homo sapiens
ctctgcctacagccag

SEQ ID NO: 4399060 - DNA, 15 bp, Homo sapiens
ctctgcctgccccgc

SEQ ID NO: 4399061 - DNA, 13 bp, Homo sapiens
ctctgccttgccc

SEQ ID NO: 4399062 - DNA, 22 bp, Homo sapiens
ctctgcctttgtgatcctgagt

SEQ ID NO: 4399063 - DNA, 17 bp, Homo sapiens
ctctgcggagcacactg

SEQ ID NO: 4399064 - DNA, 23 bp, Homo sapiens
ctctgctatatataaaacggtgc

SEQ ID NO: 4399065 - DNA, 12 bp, Homo sapiens
ctctgctccacc

SEQ ID NO: 4399066 - DNA, 13 bp, Homo sapiens
ctctgctccacca

SEQ ID NO: 4399067 - DNA, 13 bp, Homo sapiens
ctctgctgctcat

SEQ ID NO: 4399068 - DNA, 15 bp, Homo sapiens
ctctgctgctcatgg

SEQ ID NO: 4399069 - DNA, 16 bp, Homo sapiens
ctctgctggaatagga

SEQ ID NO: 4399070 - DNA, 16 bp, Homo sapiens
ctctgctggagaaagc

SEQ ID NO: 4399071 - DNA, 23 bp, Homo sapiens
ctctgctgtacatatttgagact

SEQ ID NO: 4399072 - DNA, 22 bp, Homo sapiens
ctctggaaagaggctctggaca

SEQ ID NO: 4399073 - DNA, 20 bp, Homo sapiens
ctctggaataaagttgcaga

SEQ ID NO: 4399074 - DNA, 17 bp, Homo sapiens
ctctggaatgtttttcc

SEQ ID NO: 4399075 - DNA, 19 bp, Homo sapiens
ctctggacagcagaagcct

SEQ ID NO: 4399076 - DNA, 17 bp, Homo sapiens
ctctggacggcaggctc

SEQ ID NO: 4399077 - DNA, 18 bp, Homo sapiens
ctctggacggcaggctca

SEQ ID NO: 4399078 - DNA, 14 bp, Homo sapiens
ctctggagcatttc

SEQ ID NO: 4399079 - DNA, 16 bp, Homo sapiens
ctctggatcctgcact

SEQ ID NO: 4399080 - DNA, 17 bp, Homo sapiens
ctctggatcctgcactc

SEQ ID NO: 4399081 - DNA, 21 bp, Homo sapiens
ctctggctagaggccagcccc

SEQ ID NO: 4399082 - DNA, 22 bp, Homo sapiens
ctctggctagaggccagcccca

SEQ ID NO: 4399083 - DNA, 16 bp, Homo sapiens
ctctggctctgcctca

SEQ ID NO: 4399084 - DNA, 22 bp, Homo sapiens
ctctggctttcccaggagatgg

SEQ ID NO: 4399085 - DNA, 20 bp, Homo sapiens
ctctgggaaatgagaaggca

SEQ ID NO: 4399086 - DNA, 22 bp, Homo sapiens
ctctgggaaatgagaaggcagc

SEQ ID NO: 4399087 - DNA, 13 bp, Homo sapiens
ctctgggaagggg

SEQ ID NO: 4399088 - DNA, 17 bp, Homo sapiens
ctctgggactctcctcc

SEQ ID NO: 4399089 - DNA, 14 bp, Homo sapiens
ctctgggccacttg

SEQ ID NO: 4399090 - DNA, 18 bp, Homo sapiens
ctctgggccacttggagt

SEQ ID NO: 4399091 - DNA, 13 bp, Homo sapiens
ctctgggccctgt

SEQ ID NO: 4399092 - DNA, 17 bp, Homo sapiens
ctcgtggtaggactgta

SEQ ID NO: 4399093 - DNA, 15 bp, Homo sapiens
ctcgtgtctggcaca

SEQ ID NO: 4399094 - DNA, 14 bp, Homo sapiens
ctcgtgtgtttcta

SEQ ID NO: 4399095 - DNA, 14 bp, Homo sapiens
ctcgtgtttgctta

SEQ ID NO: 4399096 - DNA, 15 bp, Homo sapiens
ctctaaaattataaa

SEQ ID NO: 4399097 - DNA, 16 bp, Homo sapiens
ctctaacccagtggct

SEQ ID NO: 4399098 - DNA, 16 bp, Homo sapiens
ctctaaccccaggccc

SEQ ID NO: 4399099 - DNA, 20 bp, Homo sapiens
ctctaactgtatatttgtat

SEQ ID NO: 4399100 - DNA, 18 bp, Homo sapiens
ctctaatattgcttcttg

SEQ ID NO: 4399101 - DNA, 22 bp, Homo sapiens
ctctaatcagattgcttaaaag

SEQ ID NO: 4399102 - DNA, 23 bp, Homo sapiens
ctctaatgttgtatcatactctt

SEQ ID NO: 4399103 - DNA, 17 bp, Homo sapiens
ctctaattcacagtgct

SEQ ID NO: 4399104 - DNA, 20 bp, Homo sapiens
ctctaattcacagtgctctt

SEQ ID NO: 4399105 - DNA, 15 bp, Homo sapiens
ctctacactcttgta

SEQ ID NO: 4399106 - DNA, 18 bp, Homo sapiens
ctctacagagcttccctg

SEQ ID NO: 4399107 - DNA, 20 bp, Homo sapiens
ctctacagagcttccctgac

SEQ ID NO: 4399108 - DNA, 21 bp, Homo sapiens
ctctacaggcctcttcctgtt

SEQ ID NO: 4399109 - DNA, 16 bp, Homo sapiens
ctctaccaaaaaaagg

SEQ ID NO: 4399110 - DNA, 19 bp, Homo sapiens
ctctaccaaaaaaaggaag

SEQ ID NO: 4399111 - DNA, 20 bp, Homo sapiens
ctctaccatggttctgcctc

SEQ ID NO: 4399112 - DNA, 16 bp, Homo sapiens
ctctacccctgctccc

SEQ ID NO: 4399113 - DNA, 18 bp, Homo sapiens
ctctaccctcccaccccc

SEQ ID NO: 4399114 - DNA, 12 bp, Homo sapiens
ctctaccttcct

SEQ ID NO: 4399115 - DNA, 16 bp, Homo sapiens
ctctaccttcctgtcc

SEQ ID NO: 4399116 - DNA, 18 bp, Homo sapiens
ctctaccttttaaaattg

SEQ ID NO: 4399117 - DNA, 14 bp, Homo sapiens
ctctactgtgtaat

SEQ ID NO: 4399118 - DNA, 18 bp, Homo sapiens
ctctacttgctgaaggag

SEQ ID NO: 4399119 - DNA, 23 bp, Homo sapiens
ctctagaaagtatagatggccaa

SEQ ID NO: 4399120 - DNA, 18 bp, Homo sapiens
ctctagaagccaagggaa

SEQ ID NO: 4399121 - DNA, 20 bp, Homo sapiens
ctctaggctgttctgtagct

SEQ ID NO: 4399122 - DNA, 21 bp, Homo sapiens
ctctagggacccctcgcccca

SEQ ID NO: 4399123 - DNA, 23 bp, Homo sapiens
ctctagggacccctcgccccagc

SEQ ID NO: 4399124 - DNA, 13 bp, Homo sapiens
ctctagttctaga

SEQ ID NO: 4399125 - DNA, 14 bp, Homo sapiens
ctctagttctagat

SEQ ID NO: 4399126 - DNA, 15 bp, Homo sapiens
ctctagttctagatg

SEQ ID NO: 4399127 - DNA, 20 bp, Homo sapiens
ctctagttttcagccttggg

SEQ ID NO: 4399128 - DNA, 21 bp, Homo sapiens
ctctagttttcagccttggga

SEQ ID NO: 4399129 - DNA, 13 bp, Homo sapiens
ctctataaagggt

SEQ ID NO: 4399130 - DNA, 17 bp, Homo sapiens
ctctataaagggtcagg

SEQ ID NO: 4399131 - DNA, 22 bp, Homo sapiens
ctctataaagggtcaggcccgt

SEQ ID NO: 4399132 - DNA, 12 bp, Homo sapiens
ctctatcatgca

SEQ ID NO: 4399133 - DNA, 13 bp, Homo sapiens
ctctatgaaaagc

SEQ ID NO: 4399134 - DNA, 22 bp, Homo sapiens
ctctatggaaggaggcctccac

SEQ ID NO: 4399135 - DNA, 16 bp, Homo sapiens
ctctatgtctgccttc

SEQ ID NO: 4399136 - DNA, 17 bp, Homo sapiens
ctctatttgaattattt

SEQ ID NO: 4399137 - DNA, 18 bp, Homo sapiens
ctctattttacttttctg

SEQ ID NO: 4399138 - DNA, 21 bp, Homo sapiens
ctctcaaaacaatattacttt

SEQ ID NO: 4399139 - DNA, 23 bp, Homo sapiens
ctctcaaaacaatattactttgt

SEQ ID NO: 4399140 - DNA, 23 bp, Homo sapiens
ctctcaaaagagaaaaacaaaac

SEQ ID NO: 4399141 - DNA, 15 bp, Homo sapiens
ctctcaaattcagct

SEQ ID NO: 4399142 - DNA, 18 bp, Homo sapiens
ctctcaaattcagctctg

SEQ ID NO: 4399143 - DNA, 22 bp, Homo sapiens
ctctcaagtcaaggaagctggg

SEQ ID NO: 4399144 - DNA, 13 bp, Homo sapiens
ctctcacctcagc

SEQ ID NO: 4399145 - DNA, 15 bp, Homo sapiens
ctctcacctgctccc

SEQ ID NO: 4399146 - DNA, 16 bp, Homo sapiens
ctctcacttctaaatt

SEQ ID NO: 4399147 - DNA, 12 bp, Homo sapiens
ctctcagagtga

SEQ ID NO: 4399148 - DNA, 23 bp, Homo sapiens
ctctcagcatttccttgtcccgt

SEQ ID NO: 4399149 - DNA, 16 bp, Homo sapiens
ctctcagcctcccaca

SEQ ID NO: 4399150 - DNA, 14 bp, Homo sapiens
ctctcagctgctgg

SEQ ID NO: 4399151 - DNA, 14 bp, Homo sapiens
ctctcaggccgaga

SEQ ID NO: 4399152 - DNA, 18 bp, Homo sapiens
ctctcagtctctgagcag

SEQ ID NO: 4399153 - DNA, 15 bp, Homo sapiens
ctctcagttctctcc

SEQ ID NO: 4399154 - DNA, 17 bp, Homo sapiens
ctctcagttctctccct

SEQ ID NO: 4399155 - DNA, 21 bp, Homo sapiens
ctctcagttctctcccttcct

SEQ ID NO: 4399156 - DNA, 15 bp, Homo sapiens
ctctcataccctccc

SEQ ID NO: 4399157 - DNA, 17 bp, Homo sapiens
ctctcatctcttagctc

SEQ ID NO: 4399158 - DNA, 20 bp, Homo sapiens
ctctcatgcctcctgaggct

SEQ ID NO: 4399159 - DNA, 20 bp, Homo sapiens
ctctcatggtacttcctctg

SEQ ID NO: 4399160 - DNA, 21 bp, Homo sapiens
ctctcatggtacttcctctgt

SEQ ID NO: 4399161 - DNA, 15 bp, Homo sapiens
ctctcattccccagg

SEQ ID NO: 4399162 - DNA, 20 bp, Homo sapiens
ctctcattccccaggtggct

SEQ ID NO: 4399163 - DNA, 18 bp, Homo sapiens
ctctccaagacagcagca

SEQ ID NO: 4399164 - DNA, 19 bp, Homo sapiens
ctctccaagacagcagcag

SEQ ID NO: 4399165 - DNA, 23 bp, Homo sapiens
ctctccaagtctcagtggcttca

SEQ ID NO: 4399166 - DNA, 16 bp, Homo sapiens
ctctccacacaggtgt

SEQ ID NO: 4399167 - DNA, 13 bp, Homo sapiens
ctctccacctcag

SEQ ID NO: 4399168 - DNA, 14 bp, Homo sapiens
ctctccacctcagc

SEQ ID NO: 4399169 - DNA, 18 bp, Homo sapiens
ctctccacctcagccttg

SEQ ID NO: 4399170 - DNA, 21 bp, Homo sapiens
ctctccattcccgtggaacgt

SEQ ID NO: 4399171 - DNA, 13 bp, Homo sapiens
ctctcccaggacc

SEQ ID NO: 4399172 - DNA, 21 bp, Homo sapiens
ctctcccagtctacccagaga

SEQ ID NO: 4399173 - DNA, 23 bp, Homo sapiens
ctctcccagtgaactcctgccag

SEQ ID NO: 4399174 - DNA, 21 bp, Homo sapiens
ctctcccatggagccccagcc

SEQ ID NO: 4399175 - DNA, 18 bp, Homo sapiens
ctctccccacgagggctg

SEQ ID NO: 4399176 - DNA, 20 bp, Homo sapiens
ctctccccagccccctccca

SEQ ID NO: 4399177 - DNA, 21 bp, Homo sapiens
ctctccccaggaagtggctca

SEQ ID NO: 4399178 - DNA, 12 bp, Homo sapiens
ctctccccagtg

SEQ ID NO: 4399179 - DNA, 13 bp, Homo sapiens
ctctccccagtgc

SEQ ID NO: 4399180 - DNA, 17 bp, Homo sapiens
ctctccccagtgcctgc

SEQ ID NO: 4399181 - DNA, 19 bp, Homo sapiens
ctctccccagtgcctgcca

SEQ ID NO: 4399182 - DNA, 21 bp, Homo sapiens
ctctccccagtgcctgccact

SEQ ID NO: 4399183 - DNA, 13 bp, Homo sapiens
ctctcccccaccc

SEQ ID NO: 4399184 - DNA, 18 bp, Homo sapiens
ctctcccctcctctgaat

SEQ ID NO: 4399185 - DNA, 23 bp, Homo sapiens
ctctcccctctcgccccatccct

SEQ ID NO: 4399186 - DNA, 21 bp, Homo sapiens
ctctccctctggccctgcctt

SEQ ID NO: 4399187 - DNA, 15 bp, Homo sapiens
ctctccctgccaagt

SEQ ID NO: 4399188 - DNA, 15 bp, Homo sapiens
ctctccctgcctcac

SEQ ID NO: 4399189 - DNA, 14 bp, Homo sapiens
ctctccctgcctgt

SEQ ID NO: 4399190 - DNA, 16 bp, Homo sapiens
ctctccctgctgctcc

SEQ ID NO: 4399191 - DNA, 15 bp, Homo sapiens
ctctcctccccttcc

SEQ ID NO: 4399192 - DNA, 20 bp, Homo sapiens
ctctcctcccgccccgcccc

SEQ ID NO: 4399193 - DNA, 15 bp, Homo sapiens
ctctcctctgcctca

SEQ ID NO: 4399194 - DNA, 12 bp, Homo sapiens
ctctcctgaccc

SEQ ID NO: 4399195 - DNA, 13 bp, Homo sapiens
ctctcctgacccc

SEQ ID NO: 4399196 - DNA, 13 bp, Homo sapiens
ctctcctggctgt

SEQ ID NO: 4399197 - DNA, 20 bp, Homo sapiens
ctctcctgggcccctcccta

SEQ ID NO: 4399198 - DNA, 23 bp, Homo sapiens
ctctcctgggggtggcaggcaca

SEQ ID NO: 4399199 - DNA, 21 bp, Homo sapiens
ctctcctttctttttcttctt

SEQ ID NO: 4399200 - DNA, 22 bp, Homo sapiens
ctctcgactgtcagtggggcag

SEQ ID NO: 4399201 - DNA, 16 bp, Homo sapiens
ctctcgccccatccct

SEQ ID NO: 4399202 - DNA, 23 bp, Homo sapiens
ctctcggcccctgtctgttccca

SEQ ID NO: 4399203 - DNA, 16 bp, Homo sapiens
ctctctaagtttagaa

SEQ ID NO: 4399204 - DNA, 23 bp, Homo sapiens
ctctctacaggtccgtttcctta

SEQ ID NO: 4399205 - DNA, 15 bp, Homo sapiens
ctctctagaatgagc

SEQ ID NO: 4399206 - DNA, 19 bp, Homo sapiens
ctctctagaatgagcaaga

SEQ ID NO: 4399207 - DNA, 14 bp, Homo sapiens
ctctctagggaccc

SEQ ID NO: 4399208 - DNA, 14 bp, Homo sapiens
ctctctcaaaagag

SEQ ID NO: 4399209 - DNA, 17 bp, Homo sapiens
ctctctcacctgctccc

SEQ ID NO: 4399210 - DNA, 17 bp, Homo sapiens
ctctctcactcccctct

SEQ ID NO: 4399211 - DNA, 13 bp, Homo sapiens
ctctctcccagga

SEQ ID NO: 4399212 - DNA, 15 bp, Homo sapiens
ctcctgggggtggca

SEQ ID NO: 4399213 - DNA, 19 bp, Homo sapiens
ctcctgggggtggcaggca

SEQ ID NO: 4399214 - DNA, 21 bp, Homo sapiens
ctcctgggggtggcaggcaca

SEQ ID NO: 4399215 - DNA, 22 bp, Homo sapiens
ctcctggtgcaggtctccacct

SEQ ID NO: 4399216 - DNA, 20 bp, Homo sapiens
ctcctggtgggtccaggggc

SEQ ID NO: 4399217 - DNA, 17 bp, Homo sapiens
ctcctgtaagccaaaga

SEQ ID NO: 4399218 - DNA, 16 bp, Homo sapiens
ctcctgtacctcagtg

SEQ ID NO: 4399219 - DNA, 15 bp, Homo sapiens
ctcctgtcagtgagg

SEQ ID NO: 4399220 - DNA, 17 bp, Homo sapiens
ctcctgtcttcccaggg

SEQ ID NO: 4399221 - DNA, 11 bp, Homo sapiens
ctcctgtgcct

SEQ ID NO: 4399222 - DNA, 17 bp, Homo sapiens
ctcctgtgcctcccttt

SEQ ID NO: 4399223 - DNA, 14 bp, Homo sapiens
ctcctgtgcctggc

SEQ ID NO: 4399224 - DNA, 18 bp, Homo sapiens
ctcctgtgcctggcccca

SEQ ID NO: 4399225 - DNA, 14 bp, Homo sapiens
ctcctgtgctcacc

SEQ ID NO: 4399226 - DNA, 15 bp, Homo sapiens
ctcctgtgctcaccc

SEQ ID NO: 4399227 - DNA, 22 bp, Homo sapiens
ctcctgtgctcaccctctcttg

SEQ ID NO: 4399228 - DNA, 16 bp, Homo sapiens
ctcctgtggcctgctc

SEQ ID NO: 4399229 - DNA, 20 bp, Homo sapiens
ctcctgtggcctgctcatca

SEQ ID NO: 4399230 - DNA, 23 bp, Homo sapiens
ctcctgttgcacccagccctggt

SEQ ID NO: 4399231 - DNA, 18 bp, Homo sapiens
ctcctgttggccttggaa

SEQ ID NO: 4399232 - DNA, 13 bp, Homo sapiens
ctcctgttttata

SEQ ID NO: 4399233 - DNA, 22 bp, Homo sapiens
ctccttaaggctcttttgtaag

SEQ ID NO: 4399234 - DNA, 23 bp, Homo sapiens
ctccttaatttaattgctttgaa

SEQ ID NO: 4399235 - DNA, 19 bp, Homo sapiens
ctccttagacactttggaa

SEQ ID NO: 4399236 - DNA, 18 bp, Homo sapiens
ctccttaggtgcccagaa

SEQ ID NO: 4399237 - DNA, 21 bp, Homo sapiens
ctccttatagacacttgctcc

SEQ ID NO: 4399238 - DNA, 13 bp, Homo sapiens
ctccttcagccct

SEQ ID NO: 4399239 - DNA, 17 bp, Homo sapiens
ctccttcagccctcacc

SEQ ID NO: 4399240 - DNA, 19 bp, Homo sapiens
ctccttcatgacagcctcc

SEQ ID NO: 4399241 - DNA, 14 bp, Homo sapiens
ctccttccagatgc

SEQ ID NO: 4399242 - DNA, 19 bp, Homo sapiens
ctccttccatctcttcctt

SEQ ID NO: 4399243 - DNA, 13 bp, Homo sapiens
ctccttcctggag

SEQ ID NO: 4399244 - DNA, 17 bp, Homo sapiens
ctccttccttcaggact

SEQ ID NO: 4399245 - DNA, 14 bp, Homo sapiens
ctccttgcccagac

SEQ ID NO: 4399246 - DNA, 22 bp, Homo sapiens
ctccttgccccccgccctcatg

SEQ ID NO: 4399247 - DNA, 13 bp, Homo sapiens
ctccttggaaggt

SEQ ID NO: 4399248 - DNA, 13 bp, Homo sapiens
ctccttggcaccc

SEQ ID NO: 4399249 - DNA, 16 bp, Homo sapiens
ctccttggcaccccca

SEQ ID NO: 4399250 - DNA, 16 bp, Homo sapiens
ctccttggccacagac

SEQ ID NO: 4399251 - DNA, 13 bp, Homo sapiens
ctccttggtgcct

SEQ ID NO: 4399252 - DNA, 14 bp, Homo sapiens
ctccttggtgcctc

SEQ ID NO: 4399253 - DNA, 17 bp, Homo sapiens
ctccttggtgcctctgg

SEQ ID NO: 4399254 - DNA, 15 bp, Homo sapiens
ctccttgtccaccca

SEQ ID NO: 4399255 - DNA, 22 bp, Homo sapiens
ctccttgtgttgcactgaacag

SEQ ID NO: 4399256 - DNA, 23 bp, Homo sapiens
ctccttgtgttgcactgaacagg

SEQ ID NO: 4399257 - DNA, 15 bp, Homo sapiens
ctcctttaattgtaa

SEQ ID NO: 4399258 - DNA, 12 bp, Homo sapiens
ctcctttaccag

SEQ ID NO: 4399259 - DNA, 15 bp, Homo sapiens
ctcctttcagccaca

SEQ ID NO: 4399260 - DNA, 18 bp, Homo sapiens
ctcctttcatcacactgg

SEQ ID NO: 4399261 - DNA, 15 bp, Homo sapiens
ctcctttcctacagt

SEQ ID NO: 4399262 - DNA, 14 bp, Homo sapiens
ctcctttctcctgt

SEQ ID NO: 4399263 - DNA, 13 bp, Homo sapiens
ctcctttcttttt

SEQ ID NO: 4399264 - DNA, 19 bp, Homo sapiens
ctcctttctttttcttctt

SEQ ID NO: 4399265 - DNA, 20 bp, Homo sapiens
ctcctttctttttcttcttc

SEQ ID NO: 4399266 - DNA, 20 bp, Homo sapiens
ctcctttgcaatagcagtta

SEQ ID NO: 4399267 - DNA, 11 bp, Homo sapiens
ctccttttaaa

SEQ ID NO: 4399268 - DNA, 14 bp, Homo sapiens
ctccttttaaaatt

SEQ ID NO: 4399269 - DNA, 18 bp, Homo sapiens
ctccttttaaaattttgt

SEQ ID NO: 4399270 - DNA, 15 bp, Homo sapiens
ctccttttggcctgg

SEQ ID NO: 4399271 - DNA, 15 bp, Homo sapiens
ctcgaaacacagaaa

SEQ ID NO: 4399272 - DNA, 18 bp, Homo sapiens
ctcgacaaaggccacagg

SEQ ID NO: 4399273 - DNA, 13 bp, Homo sapiens
ctcgacccagaat

SEQ ID NO: 4399274 - DNA, 16 bp, Homo sapiens
ctcgacctccccaccc

SEQ ID NO: 4399275 - DNA, 22 bp, Homo sapiens
ctcgacctccccacccgctccc

SEQ ID NO: 4399276 - DNA, 12 bp, Homo sapiens
ctcgagaggcac

SEQ ID NO: 4399277 - DNA, 23 bp, Homo sapiens
ctcgagagggctggtccttattt

SEQ ID NO: 4399278 - DNA, 23 bp, Homo sapiens
ctcgagatcccaacactgccagc

SEQ ID NO: 4399279 - DNA, 15 bp, Homo sapiens
ctcgagcccagatgg

SEQ ID NO: 4399280 - DNA, 23 bp, Homo sapiens
ctcgaggggcccagggaagcctg

SEQ ID NO: 4399281 - DNA, 20 bp, Homo sapiens
ctcgagtactgtgggcaatt

SEQ ID NO: 4399282 - DNA, 16 bp, Homo sapiens
ctcgatggacctcagc

SEQ ID NO: 4399283 - DNA, 19 bp, Homo sapiens
ctcgatgtggtcacagctg

SEQ ID NO: 4399284 - DNA, 21 bp, Homo sapiens
ctcgcagggaatgcagcagga

SEQ ID NO: 4399285 - DNA, 15 bp, Homo sapiens
ctcgcatccagacag

SEQ ID NO: 4399286 - DNA, 12 bp, Homo sapiens
ctcgccccagcc

SEQ ID NO: 4399287 - DNA, 13 bp, Homo sapiens
ctcgccccagcct

SEQ ID NO: 4399288 - DNA, 13 bp, Homo sapiens
ctcgccccatccc

SEQ ID NO: 4399289 - DNA, 18 bp, Homo sapiens
ctcgccgtgtctcagcct

SEQ ID NO: 4399290 - DNA, 20 bp, Homo sapiens
ctcgccgtgtctcagcctct

SEQ ID NO: 4399291 - DNA, 22 bp, Homo sapiens
ctcgccgtgtctcagcctctgc

SEQ ID NO: 4399292 - DNA, 18 bp, Homo sapiens
ctcgctcaccgctggccc

SEQ ID NO: 4399293 - DNA, 22 bp, Homo sapiens
ctcgctccctgtagctctgcct

SEQ ID NO: 4399294 - DNA, 13 bp, Homo sapiens
ctcgctgccagct

SEQ ID NO: 4399295 - DNA, 20 bp, Homo sapiens
ctcgctgcgcagcctccagg

SEQ ID NO: 4399296 - DNA, 16 bp, Homo sapiens
ctcgctggactctcag

SEQ ID NO: 4399297 - DNA, 14 bp, Homo sapiens
ctcgcttgctggaa

SEQ ID NO: 4399298 - DNA, 20 bp, Homo sapiens
ctcgcttgctggaacacagg

SEQ ID NO: 4399299 - DNA, 12 bp, Homo sapiens
ctcggacacagt

SEQ ID NO: 4399300 - DNA, 14 bp, Homo sapiens
ctcggacagagccc

SEQ ID NO: 4399301 - DNA, 16 bp, Homo sapiens
ctcggacccaccccaa

SEQ ID NO: 4399302 - DNA, 21 bp, Homo sapiens
ctcggaccccactccggccct

SEQ ID NO: 4399303 - DNA, 12 bp, Homo sapiens
ctcggagaagag

SEQ ID NO: 4399304 - DNA, 13 bp, Homo sapiens
ctcggagaagagc

SEQ ID NO: 4399305 - DNA, 18 bp, Homo sapiens
ctcggagacgggaccctg

SEQ ID NO: 4399306 - DNA, 22 bp, Homo sapiens
ctcggaggctacccgctgtggc

SEQ ID NO: 4399307 - DNA, 12 bp, Homo sapiens
ctcggaggctgc

SEQ ID NO: 4399308 - DNA, 16 bp, Homo sapiens
ctcggaggctgccccc

SEQ ID NO: 4399309 - DNA, 17 bp, Homo sapiens
ctcggatgacaccctgg

SEQ ID NO: 4399310 - DNA, 20 bp, Homo sapiens
ctcggatgacaccctggcct

SEQ ID NO: 4399311 - DNA, 20 bp, Homo sapiens
ctcggatgaccatactcaga

SEQ ID NO: 4399312 - DNA, 20 bp, Homo sapiens
ctcggcatagtccccagagc

SEQ ID NO: 4399313 - DNA, 23 bp, Homo sapiens
ctcggcatagtccccagagctcc

SEQ ID NO: 4399314 - DNA, 13 bp, Homo sapiens
ctcggccaggcat

SEQ ID NO: 4399315 - DNA, 16 bp, Homo sapiens
ctcggccaggcattgg

SEQ ID NO: 4399316 - DNA, 14 bp, Homo sapiens
ctcggcccctgtct

SEQ ID NO: 4399317 - DNA, 23 bp, Homo sapiens
ctcggcccctgtctgttcccagc

SEQ ID NO: 4399318 - DNA, 13 bp, Homo sapiens
ctcggcctcccaa

SEQ ID NO: 4399319 - DNA, 20 bp, Homo sapiens
ctcggcctcccaaagtgctg

SEQ ID NO: 4399320 - DNA, 18 bp, Homo sapiens
ctcgggcttgagtgagaa

SEQ ID NO: 4399321 - DNA, 18 bp, Homo sapiens
ctcggggacaccagagct

SEQ ID NO: 4399322 - DNA, 13 bp, Homo sapiens
ctcggggacaggt

SEQ ID NO: 4399323 - DNA, 15 bp, Homo sapiens
ctcgggtctgggcag

SEQ ID NO: 4399324 - DNA, 12 bp, Homo sapiens
ctcggtcgcccc

SEQ ID NO: 4399325 - DNA, 20 bp, Homo sapiens
ctcggtgaccactcttcttt

SEQ ID NO: 4399326 - DNA, 13 bp, Homo sapiens
ctcggtgctccat

SEQ ID NO: 4399327 - DNA, 14 bp, Homo sapiens
ctcgtagagtgacc

SEQ ID NO: 4399328 - DNA, 20 bp, Homo sapiens
ctcgtagagtgacctcggac

SEQ ID NO: 4399329 - DNA, 12 bp, Homo sapiens
ctcgtcctcccc

SEQ ID NO: 4399330 - DNA, 16 bp, Homo sapiens
ctcgtcctccccctgc

SEQ ID NO: 4399331 - DNA, 18 bp, Homo sapiens
ctcgtcctccccctgcca

SEQ ID NO: 4399332 - DNA, 24 bp, Homo sapiens
ctcgtcctccccctgccagtgcct

SEQ ID NO: 4399333 - DNA, 18 bp, Homo sapiens
ctccgggtgtggcctcag

SEQ ID NO: 4399334 - DNA, 20 bp, Homo sapiens
ctccggtaaaacaccggaga

SEQ ID NO: 4399335 - DNA, 15 bp, Homo sapiens
ctccgtccagccgcc

SEQ ID NO: 4399336 - DNA, 22 bp, Homo sapiens
ctccgtccagccgccattgcca

SEQ ID NO: 4399337 - DNA, 21 bp, Homo sapiens
ctccgtccatccgactgcccc

SEQ ID NO: 4399338 - DNA, 22 bp, Homo sapiens
ctccgtggccaaaaagtaccat

SEQ ID NO: 4399339 - DNA, 14 bp, Homo sapiens
ctccgttccatctg

SEQ ID NO: 4399340 - DNA, 17 bp, Homo sapiens
ctcctaaaactgggatt

SEQ ID NO: 4399341 - DNA, 21 bp, Homo sapiens
ctcctaaagctgaatcccggc

SEQ ID NO: 4399342 - DNA, 19 bp, Homo sapiens
ctcctaccctcccaccaga

SEQ ID NO: 4399343 - DNA, 12 bp, Homo sapiens
ctcctagaagaa

SEQ ID NO: 4399344 - DNA, 18 bp, Homo sapiens
ctcctagaagtcttaatt

SEQ ID NO: 4399345 - DNA, 18 bp, Homo sapiens
ctcctagcaccctggaga

SEQ ID NO: 4399346 - DNA, 20 bp, Homo sapiens
ctcctaggacccgtctccag

SEQ ID NO: 4399347 - DNA, 14 bp, Homo sapiens
ctcctatatatttc

SEQ ID NO: 4399348 - DNA, 18 bp, Homo sapiens
ctcctatatatttctatt

SEQ ID NO: 4399349 - DNA, 14 bp, Homo sapiens
ctcctatctgtgtt

SEQ ID NO: 4399350 - DNA, 15 bp, Homo sapiens
ctcctatctgtgttt

SEQ ID NO: 4399351 - DNA, 20 bp, Homo sapiens
ctcctattccttcacacagt

SEQ ID NO: 4399352 - DNA, 12 bp, Homo sapiens
ctcctatttcaa

SEQ ID NO: 4399353 - DNA, 16 bp, Homo sapiens
ctcctatttttgtaaa

SEQ ID NO: 4399354 - DNA, 19 bp, Homo sapiens
ctcctatttttgtaaactg

SEQ ID NO: 4399355 - DNA, 19 bp, Homo sapiens
ctcctcacaccccagcacc

SEQ ID NO: 4399356 - DNA, 20 bp, Homo sapiens
ctcctcacccttcccggccc

SEQ ID NO: 4399357 - DNA, 14 bp, Homo sapiens
ctcctcacctcatg

SEQ ID NO: 4399358 - DNA, 15 bp, Homo sapiens
ctcctcacctcatgc

SEQ ID NO: 4399359 - DNA, 16 bp, Homo sapiens
ctcctcacctcatgcc

SEQ ID NO: 4399360 - DNA, 18 bp, Homo sapiens
ctcctcacctctggactg

SEQ ID NO: 4399361 - DNA, 12 bp, Homo sapiens
ctcctcacctgt

SEQ ID NO: 4399362 - DNA, 15 bp, Homo sapiens
ctcctcacctgtcta

SEQ ID NO: 4399363 - DNA, 14 bp, Homo sapiens
ctcctcactccctt

SEQ ID NO: 4399364 - DNA, 14 bp, Homo sapiens
ctcctcactctgtc

SEQ ID NO: 4399365 - DNA, 21 bp, Homo sapiens
ctcctcaggcccagctgctcc

SEQ ID NO: 4399366 - DNA, 15 bp, Homo sapiens
ctcctcagggtgggg

SEQ ID NO: 4399367 - DNA, 18 bp, Homo sapiens
ctcctccaaaggccccct

SEQ ID NO: 4399368 - DNA, 14 bp, Homo sapiens
ctcctccacctcaa

SEQ ID NO: 4399369 - DNA, 15 bp, Homo sapiens
ctcctccacctcaac

SEQ ID NO: 4399370 - DNA, 13 bp, Homo sapiens
ctcctccaggcct

SEQ ID NO: 4399371 - DNA, 14 bp, Homo sapiens
ctcctccaggcctg

SEQ ID NO: 4399372 - DNA, 15 bp, Homo sapiens
ctcctccaggcctgc

SEQ ID NO: 4399373 - DNA, 18 bp, Homo sapiens
ctcctccaggcctgcctc

SEQ ID NO: 4399374 - DNA, 19 bp, Homo sapiens
ctcctccaggcctgcctcc

SEQ ID NO: 4399375 - DNA, 14 bp, Homo sapiens
ctcctccagggaag

SEQ ID NO: 4399376 - DNA, 24 bp, Homo sapiens
ctcctccagggaaggtggccacag

SEQ ID NO: 4399377 - DNA, 13 bp, Homo sapiens
ctcctccagggcc

SEQ ID NO: 4399378 - DNA, 21 bp, Homo sapiens
ctcctcccccctcctctgaaa

SEQ ID NO: 4399379 - DNA, 22 bp, Homo sapiens
ctcctcccccctcctctgaaac

SEQ ID NO: 4399380 - DNA, 14 bp, Homo sapiens
ctcctcccctcctc

SEQ ID NO: 4399381 - DNA, 19 bp, Homo sapiens
ctcctccccttttttttct

SEQ ID NO: 4399382 - DNA, 13 bp, Homo sapiens
ctcctcccgcccc

SEQ ID NO: 4399383 - DNA, 20 bp, Homo sapiens
ctcctcccgccccgcccctc

SEQ ID NO: 4399384 - DNA, 20 bp, Homo sapiens
ctcctcccgcccttccatgt

SEQ ID NO: 4399385 - DNA, 21 bp, Homo sapiens
ctcctcccgcccttccatgtg

SEQ ID NO: 4399386 - DNA, 15 bp, Homo sapiens
ctcctccctcagact

SEQ ID NO: 4399387 - DNA, 13 bp, Homo sapiens
ctcctccctcagg

SEQ ID NO: 4399388 - DNA, 14 bp, Homo sapiens
ctcctccctccagc

SEQ ID NO: 4399389 - DNA, 21 bp, Homo sapiens
ctcctcctcacccttcccggc

SEQ ID NO: 4399390 - DNA, 20 bp, Homo sapiens
ctcctcggagagcagcagca

SEQ ID NO: 4399391 - DNA, 23 bp, Homo sapiens
ctcctcggagagcagcagcacca

SEQ ID NO: 4399392 - DNA, 23 bp, Homo sapiens
ctcctcggtcgccccgtgtttgc

SEQ ID NO: 4399393 - DNA, 24 bp, Homo sapiens
ctcctctccccaatccatgcttca

SEQ ID NO: 4399394 - DNA, 14 bp, Homo sapiens
ctcctctcctggag

SEQ ID NO: 4399395 - DNA, 20 bp, Homo sapiens
ctcctctcctggaggattgc

SEQ ID NO: 4399396 - DNA, 12 bp, Homo sapiens
ctcctctctgct

SEQ ID NO: 4399397 - DNA, 22 bp, Homo sapiens
ctcctctgactcagggctcctg

SEQ ID NO: 4399398 - DNA, 18 bp, Homo sapiens
ctcctctgcagtgccttg

SEQ ID NO: 4399399 - DNA, 16 bp, Homo sapiens
ctcctctgccacctcc

SEQ ID NO: 4399400 - DNA, 18 bp, Homo sapiens
ctcctctgcctacagcca

SEQ ID NO: 4399401 - DNA, 22 bp, Homo sapiens
ctcctctgcctacagccaggtt

SEQ ID NO: 4399402 - DNA, 17 bp, Homo sapiens
ctcctctgggccctgtc

SEQ ID NO: 4399403 - DNA, 15 bp, Homo sapiens
ctcctctttaaaaca

SEQ ID NO: 4399404 - DNA, 19 bp, Homo sapiens
ctcctgaaacctcttccta

SEQ ID NO: 4399405 - DNA, 14 bp, Homo sapiens
ctcctgaatatttt

SEQ ID NO: 4399406 - DNA, 17 bp, Homo sapiens
ctcctgacccccatgta

SEQ ID NO: 4399407 - DNA, 22 bp, Homo sapiens
ctcctgagacccctggcctccg

SEQ ID NO: 4399408 - DNA, 23 bp, Homo sapiens
ctcctgagacccctggcctccgg

SEQ ID NO: 4399409 - DNA, 21 bp, Homo sapiens
ctcctgaggctgtttttggct

SEQ ID NO: 4399410 - DNA, 19 bp, Homo sapiens
ctcctgaggggcatctgcc

SEQ ID NO: 4399411 - DNA, 23 bp, Homo sapiens
ctcctgataaaacaacagctcga

SEQ ID NO: 4399412 - DNA, 22 bp, Homo sapiens
ctcctgcagacacctggactga

SEQ ID NO: 4399413 - DNA, 18 bp, Homo sapiens
ctcctgccacatggagcc

SEQ ID NO: 4399414 - DNA, 15 bp, Homo sapiens
ctcctgccaggcaca

SEQ ID NO: 4399415 - DNA, 15 bp, Homo sapiens
ctcctgcccaggaga

SEQ ID NO: 4399416 - DNA, 16 bp, Homo sapiens
ctcctgcccaggagag

SEQ ID NO: 4399417 - DNA, 22 bp, Homo sapiens
ctcctgcccaggagagccagcc

SEQ ID NO: 4399418 - DNA, 17 bp, Homo sapiens
ctcctgcccaggccaca

SEQ ID NO: 4399419 - DNA, 16 bp, Homo sapiens
ctcctgccgcagagct

SEQ ID NO: 4399420 - DNA, 17 bp, Homo sapiens
ctcctgccgcagagctg

SEQ ID NO: 4399421 - DNA, 14 bp, Homo sapiens
ctcctgcctcagcc

SEQ ID NO: 4399422 - DNA, 16 bp, Homo sapiens
ctcctgcctcagcctt

SEQ ID NO: 4399423 - DNA, 15 bp, Homo sapiens
ctcctgcctgccctg

SEQ ID NO: 4399424 - DNA, 16 bp, Homo sapiens
ctcctgcctgccctgc

SEQ ID NO: 4399425 - DNA, 18 bp, Homo sapiens
ctcctgccttcctcctgg

SEQ ID NO: 4399426 - DNA, 17 bp, Homo sapiens
ctcctgctgtctacctc

SEQ ID NO: 4399427 - DNA, 19 bp, Homo sapiens
ctcctggaaacttagcttt

SEQ ID NO: 4399428 - DNA, 11 bp, Homo sapiens
ctcctggaaat

SEQ ID NO: 4399429 - DNA, 17 bp, Homo sapiens
ctcctggaagctgtgtc

SEQ ID NO: 4399430 - DNA, 20 bp, Homo sapiens
ctcctggaagctgtgtcctt

SEQ ID NO: 4399431 - DNA, 23 bp, Homo sapiens
ctcctggaagctgtgtccttgca

SEQ ID NO: 4399432 - DNA, 20 bp, Homo sapiens
ctcctggacacattggaatg

SEQ ID NO: 4399433 - DNA, 16 bp, Homo sapiens
ctcctggaccaggccc

SEQ ID NO: 4399434 - DNA, 12 bp, Homo sapiens
ctcctggactcc

SEQ ID NO: 4399435 - DNA, 13 bp, Homo sapiens
ctcctggactccg

SEQ ID NO: 4399436 - DNA, 18 bp, Homo sapiens
ctcctggactccggagga

SEQ ID NO: 4399437 - DNA, 23 bp, Homo sapiens
ctcctggactccggaggactgag

SEQ ID NO: 4399438 - DNA, 24 bp, Homo sapiens
ctcctggactccggaggactgagc

SEQ ID NO: 4399439 - DNA, 10 bp, Homo sapiens
ctcctggagg

SEQ ID NO: 4399440 - DNA, 15 bp, Homo sapiens
ctcctggccagacgc

SEQ ID NO: 4399441 - DNA, 23 bp, Homo sapiens
ctcctggcctggccatctccctc

SEQ ID NO: 4399442 - DNA, 14 bp, Homo sapiens
ctcctggccttttg

SEQ ID NO: 4399443 - DNA, 14 bp, Homo sapiens
ctcctggctgtcct

SEQ ID NO: 4399444 - DNA, 23 bp, Homo sapiens
ctcctgggagggagactcagcct

SEQ ID NO: 4399445 - DNA, 22 bp, Homo sapiens
ctcctgggcccctccctacctc

SEQ ID NO: 4399446 - DNA, 15 bp, Homo sapiens
ctcctgggccctctc

SEQ ID NO: 4399447 - DNA, 20 bp, Homo sapiens
ctcctgggccctctctgctc

SEQ ID NO: 4399448 - DNA, 15 bp, Homo sapiens
ctcctgggccctggg

SEQ ID NO: 4399449 - DNA, 16 bp, Homo sapiens
ctcctggggagctcct

SEQ ID NO: 4399450 - DNA, 19 bp, Homo sapiens
ctcctggggagctcctggg

SEQ ID NO: 4399451 - DNA, 23 bp, Homo sapiens
ctcctggggagctcctgggaccc

SEQ ID NO: 4399452 - DNA, 14 bp, Homo sapiens
ctcctgggggtggc

SEQ ID NO: 4399453 - DNA, 20 bp, Homo sapiens
ctcccctctcgccccatccc

SEQ ID NO: 4399454 - DNA, 19 bp, Homo sapiens
ctcccctctgcttctcatc

SEQ ID NO: 4399455 - DNA, 16 bp, Homo sapiens
ctcccctcttttgtaa

SEQ ID NO: 4399456 - DNA, 13 bp, Homo sapiens
ctcccctgccccc

SEQ ID NO: 4399457 - DNA, 14 bp, Homo sapiens
ctcccctgccccca

SEQ ID NO: 4399458 - DNA, 15 bp, Homo sapiens
ctcccctgcccccag

SEQ ID NO: 4399459 - DNA, 19 bp, Homo sapiens
ctcccctgcccccaggact

SEQ ID NO: 4399460 - DNA, 21 bp, Homo sapiens
ctcccctgcccccaggactgg

SEQ ID NO: 4399461 - DNA, 22 bp, Homo sapiens
ctcccctgcccccaggactggg

SEQ ID NO: 4399462 - DNA, 12 bp, Homo sapiens
ctcccctgccct

SEQ ID NO: 4399463 - DNA, 14 bp, Homo sapiens
ctcccctgccctgg

SEQ ID NO: 4399464 - DNA, 23 bp, Homo sapiens
ctcccctgggcatcttctggctt

SEQ ID NO: 4399465 - DNA, 11 bp, Homo sapiens
ctccccttcct

SEQ ID NO: 4399466 - DNA, 14 bp, Homo sapiens
ctccccttcctggc

SEQ ID NO: 4399467 - DNA, 15 bp, Homo sapiens
ctccccttcctggca

SEQ ID NO: 4399468 - DNA, 17 bp, Homo sapiens
ctccccttcctgtttct

SEQ ID NO: 4399469 - DNA, 23 bp, Homo sapiens
ctcccgccactcgccttcttaga

SEQ ID NO: 4399470 - DNA, 15 bp, Homo sapiens
ctcccgcccttccat

SEQ ID NO: 4399471 - DNA, 19 bp, Homo sapiens
ctcccgcccttccatgtgc

SEQ ID NO: 4399472 - DNA, 16 bp, Homo sapiens
ctcccggcccgcctgc

SEQ ID NO: 4399473 - DNA, 20 bp, Homo sapiens
ctcccggggactcaagagga

SEQ ID NO: 4399474 - DNA, 20 bp, Homo sapiens
ctcccgttgcgtcaagtcta

SEQ ID NO: 4399475 - DNA, 20 bp, Homo sapiens
ctccctaaactttggccttt

SEQ ID NO: 4399476 - DNA, 18 bp, Homo sapiens
ctccctacctcaacctgt

SEQ ID NO: 4399477 - DNA, 21 bp, Homo sapiens
ctccctacctcaacctgtaaa

SEQ ID NO: 4399478 - DNA, 22 bp, Homo sapiens
ctccctacctcaacctgtaaat

SEQ ID NO: 4399479 - DNA, 18 bp, Homo sapiens
ctccctactcccctgggc

SEQ ID NO: 4399480 - DNA, 22 bp, Homo sapiens
ctccctagtagctgggattaca

SEQ ID NO: 4399481 - DNA, 22 bp, Homo sapiens
ctccctagttagcatccaggct

SEQ ID NO: 4399482 - DNA, 23 bp, Homo sapiens
ctccctatctaaccctcccatgg

SEQ ID NO: 4399483 - DNA, 21 bp, Homo sapiens
ctccctcaaatgacagaccta

SEQ ID NO: 4399484 - DNA, 18 bp, Homo sapiens
ctccctcaccccctcctt

SEQ ID NO: 4399485 - DNA, 13 bp, Homo sapiens
ctccctcagaccc

SEQ ID NO: 4399486 - DNA, 18 bp, Homo sapiens
ctccctcagacccaggag

SEQ ID NO: 4399487 - DNA, 13 bp, Homo sapiens
ctccctcagactc

SEQ ID NO: 4399488 - DNA, 22 bp, Homo sapiens
ctccctcagactcagaggtcca

SEQ ID NO: 4399489 - DNA, 19 bp, Homo sapiens
ctccctcagctctctggga

SEQ ID NO: 4399490 - DNA, 14 bp, Homo sapiens
ctccctcaggccca

SEQ ID NO: 4399491 - DNA, 15 bp, Homo sapiens
ctccctcaggcccag

SEQ ID NO: 4399492 - DNA, 19 bp, Homo sapiens
ctccctcatggctctggca

SEQ ID NO: 4399493 - DNA, 13 bp, Homo sapiens
ctccctccacccc

SEQ ID NO: 4399494 - DNA, 16 bp, Homo sapiens
ctccctccacctcaag

SEQ ID NO: 4399495 - DNA, 18 bp, Homo sapiens
ctccctccagctgcgact

SEQ ID NO: 4399496 - DNA, 15 bp, Homo sapiens
ctccctccagggtcc

SEQ ID NO: 4399497 - DNA, 18 bp, Homo sapiens
ctccctccagggtcctct

SEQ ID NO: 4399498 - DNA, 18 bp, Homo sapiens
ctccctccccctgcccct

SEQ ID NO: 4399499 - DNA, 14 bp, Homo sapiens
ctccctcctcacct

SEQ ID NO: 4399500 - DNA, 15 bp, Homo sapiens
ctccctcctcacctc

SEQ ID NO: 4399501 - DNA, 13 bp, Homo sapiens
ctccctcctctgc

SEQ ID NO: 4399502 - DNA, 14 bp, Homo sapiens
ctccctcctctgcc

SEQ ID NO: 4399503 - DNA, 20 bp, Homo sapiens
ctccctctccaagacagcag

SEQ ID NO: 4399504 - DNA, 12 bp, Homo sapiens
ctccctctcctg

SEQ ID NO: 4399505 - DNA, 17 bp, Homo sapiens
ctccctctcctgcctac

SEQ ID NO: 4399506 - DNA, 16 bp, Homo sapiens
ctccctctctcttctg

SEQ ID NO: 4399507 - DNA, 17 bp, Homo sapiens
ctccctgaccctgctcc

SEQ ID NO: 4399508 - DNA, 19 bp, Homo sapiens
ctccctgaccttagcgttc

SEQ ID NO: 4399509 - DNA, 16 bp, Homo sapiens
ctccctgactccctgt

SEQ ID NO: 4399510 - DNA, 17 bp, Homo sapiens
ctccctgactccctgtg

SEQ ID NO: 4399511 - DNA, 19 bp, Homo sapiens
ctccctgactccctgtggg

SEQ ID NO: 4399512 - DNA, 14 bp, Homo sapiens
ctccctgacttttc

SEQ ID NO: 4399513 - DNA, 20 bp, Homo sapiens
ctccctgatcccaccccctc

SEQ ID NO: 4399514 - DNA, 23 bp, Homo sapiens
ctccctgcaagctccgcctcccg

SEQ ID NO: 4399515 - DNA, 17 bp, Homo sapiens
ctccctgccaagtctca

SEQ ID NO: 4399516 - DNA, 18 bp, Homo sapiens
ctccctgccgcctcaatg

SEQ ID NO: 4399517 - DNA, 19 bp, Homo sapiens
ctccctgccgcctcaatgt

SEQ ID NO: 4399518 - DNA, 13 bp, Homo sapiens
ctccctgcctcct

SEQ ID NO: 4399519 - DNA, 15 bp, Homo sapiens
ctccctgcctcctgc

SEQ ID NO: 4399520 - DNA, 16 bp, Homo sapiens
ctccctgcctggcccc

SEQ ID NO: 4399521 - DNA, 19 bp, Homo sapiens
ctccctgcctgtggcccct

SEQ ID NO: 4399522 - DNA, 16 bp, Homo sapiens
ctccctgctagcacag

SEQ ID NO: 4399523 - DNA, 22 bp, Homo sapiens
ctccctgctagcacagaggcct

SEQ ID NO: 4399524 - DNA, 23 bp, Homo sapiens
ctccctgctagcacagaggcctg

SEQ ID NO: 4399525 - DNA, 18 bp, Homo sapiens
ctccctgctcagtgcttg

SEQ ID NO: 4399526 - DNA, 13 bp, Homo sapiens
ctccctgctgtgc

SEQ ID NO: 4399527 - DNA, 15 bp, Homo sapiens
ctccctgctgtgcca

SEQ ID NO: 4399528 - DNA, 12 bp, Homo sapiens
ctccctggagtg

SEQ ID NO: 4399529 - DNA, 23 bp, Homo sapiens
ctccctggagtgtggctgaggag

SEQ ID NO: 4399530 - DNA, 17 bp, Homo sapiens
cattttcctacaggcag

SEQ ID NO: 4399531 - DNA, 13 bp, Homo sapiens
cattttcctcctc

SEQ ID NO: 4399532 - DNA, 17 bp, Homo sapiens
cattttctagatacaat

SEQ ID NO: 4399533 - DNA, 21 bp, Homo sapiens
cattttctagatacaataaat

SEQ ID NO: 4399534 - DNA, 11 bp, Homo sapiens
cattttctata

SEQ ID NO: 4399535 - DNA, 23 bp, Homo sapiens
cattttctggccagtgtttaaaa

SEQ ID NO: 4399536 - DNA, 14 bp, Homo sapiens
cattttgaccatat

SEQ ID NO: 4399537 - DNA, 20 bp, Homo sapiens
cattttgggggtttttaatc

SEQ ID NO: 4399538 - DNA, 14 bp, Homo sapiens
cattttggtacttt

SEQ ID NO: 4399539 - DNA, 14 bp, Homo sapiens
cattttggtgctta

SEQ ID NO: 4399540 - DNA, 18 bp, Homo sapiens
cattttggtttttcctca

SEQ ID NO: 4399541 - DNA, 20 bp, Homo sapiens
cattttgtataatcacagtt

SEQ ID NO: 4399542 - DNA, 22 bp, Homo sapiens
cattttgtatggagttaaataa

SEQ ID NO: 4399543 - DNA, 15 bp, Homo sapiens
cattttgtttttact

SEQ ID NO: 4399544 - DNA, 19 bp, Homo sapiens
cattttgtttttactgtat

SEQ ID NO: 4399545 - DNA, 14 bp, Homo sapiens
catttttaaaacaa

SEQ ID NO: 4399546 - DNA, 13 bp, Homo sapiens
catttttaaaact

SEQ ID NO: 4399547 - DNA, 17 bp, Homo sapiens
catttttaaacttgaaa

SEQ ID NO: 4399548 - DNA, 15 bp, Homo sapiens
catttttaaccactt

SEQ ID NO: 4399549 - DNA, 18 bp, Homo sapiens
catttttaatgtatctat

SEQ ID NO: 4399550 - DNA, 21 bp, Homo sapiens
ctccagggaaggtggccacag

SEQ ID NO: 4399551 - DNA, 17 bp, Homo sapiens
ctccagggaattcttac

SEQ ID NO: 4399552 - DNA, 18 bp, Homo sapiens
ctccagggagattttgag

SEQ ID NO: 4399553 - DNA, 23 bp, Homo sapiens
ctccagggccacgtgccaggccc

SEQ ID NO: 4399554 - DNA, 15 bp, Homo sapiens
ctccagggcccccac

SEQ ID NO: 4399555 - DNA, 17 bp, Homo sapiens
ctccagggcccccaccg

SEQ ID NO: 4399556 - DNA, 15 bp, Homo sapiens
ctccagggcccccca

SEQ ID NO: 4399557 - DNA, 15 bp, Homo sapiens
ctccagggctggact

SEQ ID NO: 4399558 - DNA, 19 bp, Homo sapiens
ctccagggctggactgagg

SEQ ID NO: 4399559 - DNA, 20 bp, Homo sapiens
ctccagggctggactgaggc

SEQ ID NO: 4399560 - DNA, 17 bp, Homo sapiens
ctccaggggtttacagt

SEQ ID NO: 4399561 - DNA, 18 bp, Homo sapiens
ctccagggtcctctcttc

SEQ ID NO: 4399562 - DNA, 18 bp, Homo sapiens
ctccagtacgtcccgctg

SEQ ID NO: 4399563 - DNA, 24 bp, Homo sapiens
ctccagtacgtcccgctgctgtgc

SEQ ID NO: 4399564 - DNA, 19 bp, Homo sapiens
ctccagtattgccccctct

SEQ ID NO: 4399565 - DNA, 22 bp, Homo sapiens
ctccagtcatggtactacccca

SEQ ID NO: 4399566 - DNA, 22 bp, Homo sapiens
ctccagtcattatgttaatatt

SEQ ID NO: 4399567 - DNA, 21 bp, Homo sapiens
ctccagtgagacagctctgca

SEQ ID NO: 4399568 - DNA, 18 bp, Homo sapiens
ctccagtgctggatttga

SEQ ID NO: 4399569 - DNA, 14 bp, Homo sapiens
ctccagtgggctga

SEQ ID NO: 4399570 - DNA, 21 bp, Homo sapiens
ctccagtgggctgatgctggg

SEQ ID NO: 4399571 - DNA, 21 bp, Homo sapiens
ctccagtttgcccaccacaac

SEQ ID NO: 4399572 - DNA, 14 bp, Homo sapiens
ctccagtttttgtt

SEQ ID NO: 4399573 - DNA, 20 bp, Homo sapiens
ctccagtttttgtttttgca

SEQ ID NO: 4399574 - DNA, 15 bp, Homo sapiens
ctccatacagcctct

SEQ ID NO: 4399575 - DNA, 16 bp, Homo sapiens
ctccataccttttctc

SEQ ID NO: 4399576 - DNA, 17 bp, Homo sapiens
ctccataccttttctct

SEQ ID NO: 4399577 - DNA, 23 bp, Homo sapiens
ctccataccttttctcttttctt

SEQ ID NO: 4399578 - DNA, 14 bp, Homo sapiens
ctccatatctcctt

SEQ ID NO: 4399579 - DNA, 18 bp, Homo sapiens
ctccatcagaaaaccaaa

SEQ ID NO: 4399580 - DNA, 13 bp, Homo sapiens
ctccatcccctcc

SEQ ID NO: 4399581 - DNA, 18 bp, Homo sapiens
ctccatcccctccctgcc

SEQ ID NO: 4399582 - DNA, 20 bp, Homo sapiens
ctccatcccctccctgcctg

SEQ ID NO: 4399583 - DNA, 22 bp, Homo sapiens
ctccatcctaccccctgtgcct

SEQ ID NO: 4399584 - DNA, 13 bp, Homo sapiens
tttataaaggtct

SEQ ID NO: 4399585 - DNA, 14 bp, Homo sapiens
tttataaaggtctg

SEQ ID NO: 4399586 - DNA, 20 bp, Homo sapiens
tttataaataaaatcatgta

SEQ ID NO: 4399587 - DNA, 21 bp, Homo sapiens
tttataaatagcatttggaaa

SEQ ID NO: 4399588 - DNA, 16 bp, Homo sapiens
tttataaattaaatat

SEQ ID NO: 4399589 - DNA, 20 bp, Homo sapiens
tttataagcatttgtattat

SEQ ID NO: 4399590 - DNA, 13 bp, Homo sapiens
tttataaggtctg

SEQ ID NO: 4399591 - DNA, 21 bp, Homo sapiens
tttataatacagaatcttgtt

SEQ ID NO: 4399592 - DNA, 14 bp, Homo sapiens
tttataatactgtt

SEQ ID NO: 4399593 - DNA, 20 bp, Homo sapiens
tttataatataaatatatgt

SEQ ID NO: 4399594 - DNA, 14 bp, Homo sapiens
tttataatgatgaa

SEQ ID NO: 4399595 - DNA, 21 bp, Homo sapiens
tttataatgatgaacttataa

SEQ ID NO: 4399596 - DNA, 14 bp, Homo sapiens
tttataatgtattt

SEQ ID NO: 4399597 - DNA, 18 bp, Homo sapiens
tttatacaatggaataaa

SEQ ID NO: 4399598 - DNA, 21 bp, Homo sapiens
tttatacaatggaataaatta

SEQ ID NO: 4399599 - DNA, 20 bp, Homo sapiens
tttatactctttctgtatat

SEQ ID NO: 4399600 - DNA, 13 bp, Homo sapiens
tttatactttatt

SEQ ID NO: 4399601 - DNA, 15 bp, Homo sapiens
tttatactttattga

SEQ ID NO: 4399602 - DNA, 19 bp, Homo sapiens
tttatagcttccagattac

SEQ ID NO: 4399603 - DNA, 13 bp, Homo sapiens
tttatagtaatga

SEQ ID NO: 4399604 - DNA, 17 bp, Homo sapiens
tttatagtgaagtgtta

SEQ ID NO: 4399605 - DNA, 15 bp, Homo sapiens
tttatagtgcacaaa

SEQ ID NO: 4399606 - DNA, 17 bp, Homo sapiens
tttatagtgtgttgtgc

SEQ ID NO: 4399607 - DNA, 12 bp, Homo sapiens
tttatataataa

SEQ ID NO: 4399608 - DNA, 15 bp, Homo sapiens
tttatataataaagt

SEQ ID NO: 4399609 - DNA, 17 bp, Homo sapiens
tttatataatatctaaa

SEQ ID NO: 4399610 - DNA, 18 bp, Homo sapiens
tttatatactttttcatg

SEQ ID NO: 4399611 - DNA, 20 bp, Homo sapiens
tttatatactttttcatgaa

SEQ ID NO: 4399612 - DNA, 23 bp, Homo sapiens
tttatatattataagttgacctt

SEQ ID NO: 4399613 - DNA, 21 bp, Homo sapiens
tttatatattgaaagttgctt

SEQ ID NO: 4399614 - DNA, 14 bp, Homo sapiens
tttatatctggaat

SEQ ID NO: 4399615 - DNA, 13 bp, Homo sapiens
tttatatctgtaa

SEQ ID NO: 4399616 - DNA, 17 bp, Homo sapiens
tttatatcttgtttaca

SEQ ID NO: 4399617 - DNA, 20 bp, Homo sapiens
tttatatgcttactgatata

SEQ ID NO: 4399618 - DNA, 18 bp, Homo sapiens
tttatatgggtttatttt

SEQ ID NO: 4399619 - DNA, 17 bp, Homo sapiens
tttatatgtacatgaga

SEQ ID NO: 4399620 - DNA, 21 bp, Homo sapiens
tttatatgtaccgtaggcttt

SEQ ID NO: 4399621 - DNA, 21 bp, Homo sapiens
tttatattagttgctttgtta

SEQ ID NO: 4399622 - DNA, 23 bp, Homo sapiens
tttatattataactctgtataat

SEQ ID NO: 4399623 - DNA, 20 bp, Homo sapiens
tttatattgtttttatatat

SEQ ID NO: 4399624 - DNA, 15 bp, Homo sapiens
tttatatttattgtt

SEQ ID NO: 4399625 - DNA, 16 bp, Homo sapiens
tttatatttattgtta

SEQ ID NO: 4399626 - DNA, 17 bp, Homo sapiens
tttatatttcctttatg

SEQ ID NO: 4399627 - DNA, 19 bp, Homo sapiens
tttatatttcctttatgtg

SEQ ID NO: 4399628 - DNA, 21 bp, Homo sapiens
tttatatttcctttatgtgaa

SEQ ID NO: 4399629 - DNA, 19 bp, Homo sapiens
tttatcaatgtgtctttct

SEQ ID NO: 4399630 - DNA, 20 bp, Homo sapiens
tttatcaatgtgtctttcta

SEQ ID NO: 4399631 - DNA, 17 bp, Homo sapiens
tttatcacacttctgtg

SEQ ID NO: 4399632 - DNA, 19 bp, Homo sapiens
tttatcagggaaactaaga

SEQ ID NO: 4399633 - DNA, 16 bp, Homo sapiens
tttatcatgaagcctg

SEQ ID NO: 4399634 - DNA, 19 bp, Homo sapiens
tttatcatgaatgctttta

SEQ ID NO: 4399635 - DNA, 14 bp, Homo sapiens
tttatcccatttta

SEQ ID NO: 4399636 - DNA, 14 bp, Homo sapiens
tttatcctgtattc

SEQ ID NO: 4399637 - DNA, 23 bp, Homo sapiens
tttatcctgtattcttgtttgaa

SEQ ID NO: 4399638 - DNA, 19 bp, Homo sapiens
tttatctataatttaccta

SEQ ID NO: 4399639 - DNA, 20 bp, Homo sapiens
tttatctatataaaataact

SEQ ID NO: 4399640 - DNA, 21 bp, Homo sapiens
tttatctcagatgttaaaata

SEQ ID NO: 4399641 - DNA, 16 bp, Homo sapiens
tttatctgtaattgta

SEQ ID NO: 4399642 - DNA, 14 bp, Homo sapiens
tttatctttaccaa

SEQ ID NO: 4399643 - DNA, 13 bp, Homo sapiens
tttatctttgtgt

SEQ ID NO: 4399644 - DNA, 14 bp, Homo sapiens
tttatgaacattgt

SEQ ID NO: 4399645 - DNA, 16 bp, Homo sapiens
tttatgaacattgtac

SEQ ID NO: 4399646 - DNA, 17 bp, Homo sapiens
tttatgaacattgtact

SEQ ID NO: 4399647 - DNA, 19 bp, Homo sapiens
tttatgattttcataactt

SEQ ID NO: 4399648 - DNA, 17 bp, Homo sapiens
tttatgcagcaaatata

SEQ ID NO: 4399649 - DNA, 15 bp, Homo sapiens
tttatggatgattaa

SEQ ID NO: 4399650 - DNA, 12 bp, Homo sapiens
tttatgtacaac

SEQ ID NO: 4399651 - DNA, 19 bp, Homo sapiens
tttatgtagtaattgacat

SEQ ID NO: 4399652 - DNA, 11 bp, Homo sapiens
tttatgtctgg

SEQ ID NO: 4399653 - DNA, 20 bp, Homo sapiens
tttatgtgaaatgctttctg

SEQ ID NO: 4399654 - DNA, 15 bp, Homo sapiens
tttatgtgaattttt

SEQ ID NO: 4399655 - DNA, 16 bp, Homo sapiens
tttatgtgaattttta

SEQ ID NO: 4399656 - DNA, 22 bp, Homo sapiens
tttatgtgtgaggagctgctgg

SEQ ID NO: 4399657 - DNA, 15 bp, Homo sapiens
tttatgttatgagga

SEQ ID NO: 4399658 - DNA, 20 bp, Homo sapiens
tttattaagctttttggaat

SEQ ID NO: 4399659 - DNA, 19 bp, Homo sapiens
tttattaatcttagtgtat

SEQ ID NO: 4399660 - DNA, 12 bp, Homo sapiens
tttattaatgca

SEQ ID NO: 4399661 - DNA, 13 bp, Homo sapiens
tttattacaaatg

SEQ ID NO: 4399662 - DNA, 19 bp, Homo sapiens
tttattacaaatgcaaatt

SEQ ID NO: 4399663 - DNA, 16 bp, Homo sapiens
tttattacatatgatt

SEQ ID NO: 4399664 - DNA, 16 bp, Homo sapiens
tttattatgcattata

SEQ ID NO: 4399665 - DNA, 18 bp, Homo sapiens
tttattatggttagctgt

SEQ ID NO: 4399666 - DNA, 18 bp, Homo sapiens
tttattccagaatgctgt

SEQ ID NO: 4399667 - DNA, 14 bp, Homo sapiens
tttattccctgccc

SEQ ID NO: 4399668 - DNA, 16 bp, Homo sapiens
tttattccctgcccaa

SEQ ID NO: 4399669 - DNA, 21 bp, Homo sapiens
tttattccctgcccaaaccct

SEQ ID NO: 4399670 - DNA, 15 bp, Homo sapiens
tttattccttctgta

SEQ ID NO: 4399671 - DNA, 14 bp, Homo sapiens
tttattccttgtga

SEQ ID NO: 4399672 - DNA, 16 bp, Homo sapiens
tttattctatctgttt

SEQ ID NO: 4399673 - DNA, 18 bp, Homo sapiens
tttattgaatactgtctg

SEQ ID NO: 4399674 - DNA, 23 bp, Homo sapiens
tttattgaatactgtctgtatct

SEQ ID NO: 4399675 - DNA, 22 bp, Homo sapiens
tttattgacaggtcttttcaaa

SEQ ID NO: 4399676 - DNA, 18 bp, Homo sapiens
tttattgagattttccat

SEQ ID NO: 4399677 - DNA, 12 bp, Homo sapiens
tttattgccttc

SEQ ID NO: 4399678 - DNA, 14 bp, Homo sapiens
tttattgttagaaa

SEQ ID NO: 4399679 - DNA, 22 bp, Homo sapiens
tttattgtttaaaatcatttct

SEQ ID NO: 4399680 - DNA, 17 bp, Homo sapiens
tttattgtttgatgttt

SEQ ID NO: 4399681 - DNA, 22 bp, Homo sapiens
tttatttaaaaaactaaaaact

SEQ ID NO: 4399682 - DNA, 16 bp, Homo sapiens
tttatttaaaactctg

SEQ ID NO: 4399683 - DNA, 19 bp, Homo sapiens
tttatttcaataaatcttt

SEQ ID NO: 4399684 - DNA, 15 bp, Homo sapiens
tttatttcaatgtaa

SEQ ID NO: 4399685 - DNA, 23 bp, Homo sapiens
tttatttcatttacaaaagattt

SEQ ID NO: 4399686 - DNA, 20 bp, Homo sapiens
tttatttccaatgtttcaag

SEQ ID NO: 4399687 - DNA, 21 bp, Homo sapiens
tttatttcctcagctgtacaa

SEQ ID NO: 4399688 - DNA, 14 bp, Homo sapiens
tttcattacttgaa

SEQ ID NO: 4399689 - DNA, 16 bp, Homo sapiens
tttcattacttgaatg

SEQ ID NO: 4399690 - DNA, 21 bp, Homo sapiens
tttcattatgctttgaacttt

SEQ ID NO: 4399691 - DNA, 20 bp, Homo sapiens
tttcattcaacacattttta

SEQ ID NO: 4399692 - DNA, 16 bp, Homo sapiens
tttcattcggtgtgaa

SEQ ID NO: 4399693 - DNA, 21 bp, Homo sapiens
tttcattcggtgtgaactttt

SEQ ID NO: 4399694 - DNA, 15 bp, Homo sapiens
tttcattctcagaat

SEQ ID NO: 4399695 - DNA, 16 bp, Homo sapiens
tttcattgccagtgtc

SEQ ID NO: 4399696 - DNA, 16 bp, Homo sapiens
tttcattgctaagact

SEQ ID NO: 4399697 - DNA, 13 bp, Homo sapiens
tttcattgtgatt

SEQ ID NO: 4399698 - DNA, 18 bp, Homo sapiens
tttcattgtgatttatat

SEQ ID NO: 4399699 - DNA, 22 bp, Homo sapiens
tttcattgtgatttatatataa

SEQ ID NO: 4399700 - DNA, 13 bp, Homo sapiens
tttcatttccagc

SEQ ID NO: 4399701 - DNA, 12 bp, Homo sapiens
tttcatttgctg

SEQ ID NO: 4399702 - DNA, 13 bp, Homo sapiens
tttcatttgtaaa

SEQ ID NO: 4399703 - DNA, 17 bp, Homo sapiens
tttcatttgtaaaaatg

SEQ ID NO: 4399704 - DNA, 14 bp, Homo sapiens
tttcattttaaaaa

SEQ ID NO: 4399705 - DNA, 22 bp, Homo sapiens
tttcattttaatatataattta

SEQ ID NO: 4399706 - DNA, 23 bp, Homo sapiens
tttccaaaagtggctagtcctca

SEQ ID NO: 4399707 - DNA, 19 bp, Homo sapiens
tttccaaaatctcccattt

SEQ ID NO: 4399708 - DNA, 19 bp, Homo sapiens
tttccaactactaatagaa

SEQ ID NO: 4399709 - DNA, 16 bp, Homo sapiens
tttccaagaggctgta

SEQ ID NO: 4399710 - DNA, 20 bp, Homo sapiens
tttccaagtcatttttgttt

SEQ ID NO: 4399711 - DNA, 19 bp, Homo sapiens
tttccaatattttaataaa

SEQ ID NO: 4399712 - DNA, 15 bp, Homo sapiens
tttccaatgccacag

SEQ ID NO: 4399713 - DNA, 22 bp, Homo sapiens
tttccacaagattcccagagac

SEQ ID NO: 4399714 - DNA, 14 bp, Homo sapiens
tttccacacgcatt

SEQ ID NO: 4399715 - DNA, 13 bp, Homo sapiens
tttccacagattt

SEQ ID NO: 4399716 - DNA, 16 bp, Homo sapiens
tttccacataaatttt

SEQ ID NO: 4399717 - DNA, 20 bp, Homo sapiens
tttccacataaattttaatt

SEQ ID NO: 4399718 - DNA, 16 bp, Homo sapiens
tttccactaaaaatat

SEQ ID NO: 4399719 - DNA, 16 bp, Homo sapiens
tttccactccattgtc

SEQ ID NO: 4399720 - DNA, 21 bp, Homo sapiens
tttccactggcttttgcctgt

SEQ ID NO: 4399721 - DNA, 15 bp, Homo sapiens
tttccagcattttta

SEQ ID NO: 4399722 - DNA, 17 bp, Homo sapiens
tttccagccttatgtgt

SEQ ID NO: 4399723 - DNA, 15 bp, Homo sapiens
tttccaggctggttc

SEQ ID NO: 4399724 - DNA, 22 bp, Homo sapiens
tttccaggctggttcggatttg

SEQ ID NO: 4399725 - DNA, 18 bp, Homo sapiens
tttccagtgacttgcaat

SEQ ID NO: 4399726 - DNA, 17 bp, Homo sapiens
tttccagttcctctttt

SEQ ID NO: 4399727 - DNA, 15 bp, Homo sapiens
tttccataaatttgg

SEQ ID NO: 4399728 - DNA, 19 bp, Homo sapiens
tttccatagtgttaactgt

SEQ ID NO: 4399729 - DNA, 23 bp, Homo sapiens
tttccatcaactcccaacttctt

SEQ ID NO: 4399730 - DNA, 12 bp, Homo sapiens
tttccatcatgt

SEQ ID NO: 4399731 - DNA, 17 bp, Homo sapiens
tttccatcatgtctgta

SEQ ID NO: 4399732 - DNA, 15 bp, Homo sapiens
tttccattaactatt

SEQ ID NO: 4399733 - DNA, 18 bp, Homo sapiens
tttccatttggcactatg

SEQ ID NO: 4399734 - DNA, 19 bp, Homo sapiens
tttcccacctctctcccca

SEQ ID NO: 4399735 - DNA, 23 bp, Homo sapiens
tttcccactcattctgaattaat

SEQ ID NO: 4399736 - DNA, 17 bp, Homo sapiens
tttcccaggagaccatt

SEQ ID NO: 4399737 - DNA, 15 bp, Homo sapiens
tttcccagttaaaga

SEQ ID NO: 4399738 - DNA, 12 bp, Homo sapiens
tttcccatctgc

SEQ ID NO: 4399739 - DNA, 13 bp, Homo sapiens
tttcccatctgca

SEQ ID NO: 4399740 - DNA, 22 bp, Homo sapiens
tttcccatctgcaccccttctc

SEQ ID NO: 4399741 - DNA, 23 bp, Homo sapiens
tttccccacccccctctctttct

SEQ ID NO: 4399742 - DNA, 23 bp, Homo sapiens
tttccccagaccgatccttccca

SEQ ID NO: 4399743 - DNA, 13 bp, Homo sapiens
tttccccccactc

SEQ ID NO: 4399744 - DNA, 17 bp, Homo sapiens
tttccccccactctccc

SEQ ID NO: 4399745 - DNA, 19 bp, Homo sapiens
tttccccccactctcccca

SEQ ID NO: 4399746 - DNA, 23 bp, Homo sapiens
tttccccccactctccccacact

SEQ ID NO: 4399747 - DNA, 23 bp, Homo sapiens
tttcccccttcccatttcttccc

SEQ ID NO: 4399748 - DNA, 18 bp, Homo sapiens
tttccccggtcccttgag

SEQ ID NO: 4399749 - DNA, 20 bp, Homo sapiens
tttccctactgaaccctgcc

SEQ ID NO: 4399750 - DNA, 14 bp, Homo sapiens
tttccctatcttct

SEQ ID NO: 4399751 - DNA, 23 bp, Homo sapiens
tttccctcaaatgcgcgtgtgca

SEQ ID NO: 4399752 - DNA, 14 bp, Homo sapiens
tttccctcagtgaa

SEQ ID NO: 4399753 - DNA, 22 bp, Homo sapiens
tttccctcccaacagagctggg

SEQ ID NO: 4399754 - DNA, 14 bp, Homo sapiens
tttccctctgctgc

SEQ ID NO: 4399755 - DNA, 21 bp, Homo sapiens
tttccctggaactcctggcct

SEQ ID NO: 4399756 - DNA, 19 bp, Homo sapiens
tttccgcccactcctggga

SEQ ID NO: 4399757 - DNA, 24 bp, Homo sapiens
tttccgctgtcgccccaggccctc

SEQ ID NO: 4399758 - DNA, 19 bp, Homo sapiens
tttccgtgaactctggtgc

SEQ ID NO: 4399759 - DNA, 15 bp, Homo sapiens
tttcctaagacattt

SEQ ID NO: 4399760 - DNA, 21 bp, Homo sapiens
tttcctaagacatttttcatt

SEQ ID NO: 4399761 - DNA, 12 bp, Homo sapiens
tttcctaatact

SEQ ID NO: 4399762 - DNA, 21 bp, Homo sapiens
tttcctacaggcagtctctct

SEQ ID NO: 4399763 - DNA, 17 bp, Homo sapiens
tttcctatcatgttaac

SEQ ID NO: 4399764 - DNA, 23 bp, Homo sapiens
tttcctatctagcatttatttct

SEQ ID NO: 4399765 - DNA, 13 bp, Homo sapiens
tttcctatttaat

SEQ ID NO: 4399766 - DNA, 18 bp, Homo sapiens
tttcctatttaatacagc

SEQ ID NO: 4399767 - DNA, 11 bp, Homo sapiens
tttcctcagtg

SEQ ID NO: 4399768 - DNA, 10 bp, Homo sapiens
tttcctcctg

SEQ ID NO: 4399769 - DNA, 12 bp, Homo sapiens
tttcctcctttc

SEQ ID NO: 4399770 - DNA, 23 bp, Homo sapiens
tttcctctgaggatgatgtactt

SEQ ID NO: 4399771 - DNA, 15 bp, Homo sapiens
tttcctctgctggaa

SEQ ID NO: 4399772 - DNA, 17 bp, Homo sapiens
tttcctcttagaagaat

SEQ ID NO: 4399773 - DNA, 13 bp, Homo sapiens
tttcctcttgtga

SEQ ID NO: 4399774 - DNA, 23 bp, Homo sapiens
tttcctgatggggaagggacttt

SEQ ID NO: 4399775 - DNA, 12 bp, Homo sapiens
tttcctgccctg

SEQ ID NO: 4399776 - DNA, 16 bp, Homo sapiens
tttcctgccctgtcca

SEQ ID NO: 4399777 - DNA, 17 bp, Homo sapiens
tttcctgcgtcccagcc

SEQ ID NO: 4399778 - DNA, 18 bp, Homo sapiens
tttcctgcgtcccagcct

SEQ ID NO: 4399779 - DNA, 19 bp, Homo sapiens
tttcctgcgtcccagcctg

SEQ ID NO: 4399780 - DNA, 19 bp, Homo sapiens
tttcctggccctccactcc

SEQ ID NO: 4399781 - DNA, 15 bp, Homo sapiens
tttcctgggccagaa

SEQ ID NO: 4399782 - DNA, 19 bp, Homo sapiens
tttcctggtgccaatttca

SEQ ID NO: 4399783 - DNA, 19 bp, Homo sapiens
tttcctgtaatatatttat

SEQ ID NO: 4399784 - DNA, 12 bp, Homo sapiens
tttcctgtcctg

SEQ ID NO: 4399785 - DNA, 13 bp, Homo sapiens
tttcctgtcctgc

SEQ ID NO: 4399786 - DNA, 19 bp, Homo sapiens
tttcctgtggaataaagat

SEQ ID NO: 4399787 - DNA, 13 bp, Homo sapiens
tttcctgttcagc

SEQ ID NO: 4399788 - DNA, 13 bp, Homo sapiens
tttcctgtttgaa

SEQ ID NO: 4399789 - DNA, 22 bp, Homo sapiens
tttcctgtttgaaatatcatgt

SEQ ID NO: 4399790 - DNA, 16 bp, Homo sapiens
tttccttatttgcctt

SEQ ID NO: 4399791 - DNA, 17 bp, Homo sapiens
tttccttatttgccttc

SEQ ID NO: 4399792 - DNA, 14 bp, Homo sapiens
tttccttccatccc

SEQ ID NO: 4399793 - DNA, 11 bp, Homo sapiens
tttccttccct

SEQ ID NO: 4399794 - DNA, 19 bp, Homo sapiens
tttccttcccttttctgtt

SEQ ID NO: 4399795 - DNA, 13 bp, Homo sapiens
tttccttctggtt

SEQ ID NO: 4399796 - DNA, 12 bp, Homo sapiens
tttccttctttg

SEQ ID NO: 4399797 - DNA, 20 bp, Homo sapiens
tttccttgctatttcaataa

SEQ ID NO: 4399798 - DNA, 14 bp, Homo sapiens
tttccttgtcccgt

SEQ ID NO: 4399799 - DNA, 13 bp, Homo sapiens
tttccttgtgcaa

SEQ ID NO: 4399800 - DNA, 12 bp, Homo sapiens
tttcctttaaaa

SEQ ID NO: 4399801 - DNA, 17 bp, Homo sapiens
tttcctttatgtgaatt

SEQ ID NO: 4399802 - DNA, 18 bp, Homo sapiens
tttcctttttgacactga

SEQ ID NO: 4399803 - DNA, 19 bp, Homo sapiens
tttcctttttgacactgaa

SEQ ID NO: 4399804 - DNA, 20 bp, Homo sapiens
tttccttttttcccataaga

SEQ ID NO: 4399805 - DNA, 14 bp, Homo sapiens
tttcgaccctgggg

SEQ ID NO: 4399806 - DNA, 13 bp, Homo sapiens
tttctaaaagctt

SEQ ID NO: 4399807 - DNA, 22 bp, Homo sapiens
tttctatgcttgtaactgtctt

SEQ ID NO: 4399808 - DNA, 18 bp, Homo sapiens
tttctatggctttcaaag

SEQ ID NO: 4399809 - DNA, 19 bp, Homo sapiens
tttctatggctttcaaagc

SEQ ID NO: 4399810 - DNA, 20 bp, Homo sapiens
tttctattatggaaaactgt

SEQ ID NO: 4399811 - DNA, 17 bp, Homo sapiens
tttctatttctcctcca

SEQ ID NO: 4399812 - DNA, 16 bp, Homo sapiens
tttctcactaaatctt

SEQ ID NO: 4399813 - DNA, 20 bp, Homo sapiens
tttctcaggagcttcaatga

SEQ ID NO: 4399814 - DNA, 15 bp, Homo sapiens
tttctccagtgctgt

SEQ ID NO: 4399815 - DNA, 16 bp, Homo sapiens
tttctccatcccctcc

SEQ ID NO: 4399816 - DNA, 20 bp, Homo sapiens
tttctccatcccctccctgc

SEQ ID NO: 4399817 - DNA, 16 bp, Homo sapiens
tttctcccaagaaacc

SEQ ID NO: 4399818 - DNA, 17 bp, Homo sapiens
tttctcccctgccccca

SEQ ID NO: 4399819 - DNA, 20 bp, Homo sapiens
tttctcccctgcccccagga

SEQ ID NO: 4399820 - DNA, 14 bp, Homo sapiens
tttctcctcagaag

SEQ ID NO: 4399821 - DNA, 12 bp, Homo sapiens
tttctcctgtga

SEQ ID NO: 4399822 - DNA, 19 bp, Homo sapiens
tttctcctttaattgtaaa

SEQ ID NO: 4399823 - DNA, 14 bp, Homo sapiens
tttctcctttacca

SEQ ID NO: 4399824 - DNA, 20 bp, Homo sapiens
tttctcctttgcaatagcag

SEQ ID NO: 4399825 - DNA, 23 bp, Homo sapiens
tttctctaatgttgtatcatact

SEQ ID NO: 4399826 - DNA, 20 bp, Homo sapiens
tttctctctctctacctttt

SEQ ID NO: 4399827 - DNA, 14 bp, Homo sapiens
tttctctcttttgt

SEQ ID NO: 4399828 - DNA, 12 bp, Homo sapiens
tttctctgctgt

SEQ ID NO: 4399829 - DNA, 19 bp, Homo sapiens
tttctctggcagcataatt

SEQ ID NO: 4399830 - DNA, 16 bp, Homo sapiens
tttctctgtacttttc

SEQ ID NO: 4399831 - DNA, 20 bp, Homo sapiens
tttctcttccccttagaaac

SEQ ID NO: 4399832 - DNA, 16 bp, Homo sapiens
tttctgaactgttaca

SEQ ID NO: 4399833 - DNA, 13 bp, Homo sapiens
tttctgagaaaga

SEQ ID NO: 4399834 - DNA, 22 bp, Homo sapiens
tttctgagaaagactattcaaa

SEQ ID NO: 4399835 - DNA, 11 bp, Homo sapiens
tttctgaggag

SEQ ID NO: 4399836 - DNA, 21 bp, Homo sapiens
tttctgagtgagttttactct

SEQ ID NO: 4399837 - DNA, 19 bp, Homo sapiens
tttctgatggtataaacag

SEQ ID NO: 4399838 - DNA, 12 bp, Homo sapiens
tttctgattctt

SEQ ID NO: 4399839 - DNA, 14 bp, Homo sapiens
tttctgattctttt

SEQ ID NO: 4399840 - DNA, 20 bp, Homo sapiens
tttctgatttctgaagtgct

SEQ ID NO: 4399841 - DNA, 17 bp, Homo sapiens
tttctgcatatgttgaa

SEQ ID NO: 4399842 - DNA, 14 bp, Homo sapiens
tttctgccctggct

SEQ ID NO: 4399843 - DNA, 15 bp, Homo sapiens
tttctgccctggctg

SEQ ID NO: 4399844 - DNA, 20 bp, Homo sapiens
tttctgccctggctgctgcc

SEQ ID NO: 4399845 - DNA, 13 bp, Homo sapiens
tttctggaagact

SEQ ID NO: 4399846 - DNA, 12 bp, Homo sapiens
tttctggactgg

SEQ ID NO: 4399847 - DNA, 22 bp, Homo sapiens
tttctggcgcccctgcctgtgc

SEQ ID NO: 4399848 - DNA, 19 bp, Homo sapiens
tttctggctgtgatcttaa

SEQ ID NO: 4399849 - DNA, 14 bp, Homo sapiens
tttctggggcctag

SEQ ID NO: 4399850 - DNA, 11 bp, Homo sapiens
tttctgggggc

SEQ ID NO: 4399851 - DNA, 21 bp, Homo sapiens
tttctggtgctaagtctgatg

SEQ ID NO: 4399852 - DNA, 15 bp, Homo sapiens
tttctgtaaactctg

SEQ ID NO: 4399853 - DNA, 14 bp, Homo sapiens
tttctgtatttaat

SEQ ID NO: 4399854 - DNA, 17 bp, Homo sapiens
tttctgtggctggctct

SEQ ID NO: 4399855 - DNA, 16 bp, Homo sapiens
tttctgttatttttaa

SEQ ID NO: 4399856 - DNA, 21 bp, Homo sapiens
tttctgttatttttaagcttt

SEQ ID NO: 4399857 - DNA, 12 bp, Homo sapiens
tttctgttccaa

SEQ ID NO: 4399858 - DNA, 16 bp, Homo sapiens
tttctgttccaaattc

SEQ ID NO: 4399859 - DNA, 14 bp, Homo sapiens
tttctgttctagtt

SEQ ID NO: 4399860 - DNA, 12 bp, Homo sapiens
tttctgttttct

SEQ ID NO: 4399861 - DNA, 20 bp, Homo sapiens
tttctgttttgtttttttct

SEQ ID NO: 4399862 - DNA, 18 bp, Homo sapiens
tttcttaaataagaaact

SEQ ID NO: 4399863 - DNA, 13 bp, Homo sapiens
tttcttaacttct

SEQ ID NO: 4399864 - DNA, 21 bp, Homo sapiens
tttcttaacttcttgcttctt

SEQ ID NO: 4399865 - DNA, 23 bp, Homo sapiens
tttcttaattattataaaaatat

SEQ ID NO: 4399866 - DNA, 16 bp, Homo sapiens
tttcttatgtgacatt

SEQ ID NO: 4399867 - DNA, 17 bp, Homo sapiens
tttcttatttcatttct

SEQ ID NO: 4399868 - DNA, 16 bp, Homo sapiens
tttcttcaatggttct

SEQ ID NO: 4399869 - DNA, 14 bp, Homo sapiens
tttcttcattgtaa

SEQ ID NO: 4399870 - DNA, 17 bp, Homo sapiens
tttcttcatttctctgc

SEQ ID NO: 4399871 - DNA, 14 bp, Homo sapiens
tttcttcccatcac

SEQ ID NO: 4399872 - DNA, 13 bp, Homo sapiens
tttcttccctgct

SEQ ID NO: 4399873 - DNA, 21 bp, Homo sapiens
tttcttccctgctttgcatct

SEQ ID NO: 4399874 - DNA, 17 bp, Homo sapiens
tttcttcctaccaagtc

SEQ ID NO: 4399875 - DNA, 22 bp, Homo sapiens
tttcttcctaccaagtcaaact

SEQ ID NO: 4399876 - DNA, 23 bp, Homo sapiens
tttcttcctaccaagtcaaactt

SEQ ID NO: 4399877 - DNA, 14 bp, Homo sapiens
tttcttcgctggac

SEQ ID NO: 4399878 - DNA, 13 bp, Homo sapiens
tttcttctattaa

SEQ ID NO: 4399879 - DNA, 17 bp, Homo sapiens
tttcttctgaagattct

SEQ ID NO: 4399880 - DNA, 21 bp, Homo sapiens
tttcttcttttttaagttgtc

SEQ ID NO: 4399881 - DNA, 12 bp, Homo sapiens
tttcttgcctct

SEQ ID NO: 4399882 - DNA, 15 bp, Homo sapiens
tttcttgtgtagatt

SEQ ID NO: 4399883 - DNA, 12 bp, Homo sapiens
tttcttgtttat

SEQ ID NO: 4399884 - DNA, 13 bp, Homo sapiens
tttctttaactgc

SEQ ID NO: 4399885 - DNA, 17 bp, Homo sapiens
tttctttacttatctct

SEQ ID NO: 4399886 - DNA, 17 bp, Homo sapiens
tttctttcccatgtatt

SEQ ID NO: 4399887 - DNA, 22 bp, Homo sapiens
tttctttcccatgtatttgtta

SEQ ID NO: 4399888 - DNA, 18 bp, Homo sapiens
tttctttcctcctttcct

SEQ ID NO: 4399889 - DNA, 12 bp, Homo sapiens
tttctttccttt

SEQ ID NO: 4399890 - DNA, 13 bp, Homo sapiens
tttctttctagtt

SEQ ID NO: 4399891 - DNA, 10 bp, Homo sapiens
tttctttctt

SEQ ID NO: 4399892 - DNA, 14 bp, Homo sapiens
tttctttgcctctg

SEQ ID NO: 4399893 - DNA, 17 bp, Homo sapiens
tttctttggtgcctttc

SEQ ID NO: 4399894 - DNA, 19 bp, Homo sapiens
tttctttggtgcctttcct

SEQ ID NO: 4399895 - DNA, 12 bp, Homo sapiens
tttcttttaaaa

SEQ ID NO: 4399896 - DNA, 15 bp, Homo sapiens
tttcttttagaaaag

SEQ ID NO: 4399897 - DNA, 20 bp, Homo sapiens
tttctttttaactttaccaa

SEQ ID NO: 4399898 - DNA, 16 bp, Homo sapiens
tttcttttttaaatta

SEQ ID NO: 4399899 - DNA, 18 bp, Homo sapiens
tttctttttttttaagtt

SEQ ID NO: 4399900 - DNA, 19 bp, Homo sapiens
tttcttttttttttcgtct

SEQ ID NO: 4399901 - DNA, 14 bp, Homo sapiens
tttgaaaaaagctc

SEQ ID NO: 4399902 - DNA, 21 bp, Homo sapiens
tttgaaaaaagctcatttcat

SEQ ID NO: 4399903 - DNA, 18 bp, Homo sapiens
tttgcccatttacacttt

SEQ ID NO: 4399904 - DNA, 12 bp, Homo sapiens
tttgccctttga

SEQ ID NO: 4399905 - DNA, 17 bp, Homo sapiens
tttgcctcttccagtct

SEQ ID NO: 4399906 - DNA, 20 bp, Homo sapiens
tttgcctcttctttgtgcct

SEQ ID NO: 4399907 - DNA, 22 bp, Homo sapiens
tttgcctcttctttgtgccttt

SEQ ID NO: 4399908 - DNA, 16 bp, Homo sapiens
tttgcctgaggctgta

SEQ ID NO: 4399909 - DNA, 15 bp, Homo sapiens
tttgcctgcagtttc

SEQ ID NO: 4399910 - DNA, 13 bp, Homo sapiens
tttgcctgtaaga

SEQ ID NO: 4399911 - DNA, 18 bp, Homo sapiens
tttgctaatgtataatgt

SEQ ID NO: 4399912 - DNA, 13 bp, Homo sapiens
tttgctactgagt

SEQ ID NO: 4399913 - DNA, 16 bp, Homo sapiens
tttgctatctgggctg

SEQ ID NO: 4399914 - DNA, 12 bp, Homo sapiens
tttgctatgtaa

SEQ ID NO: 4399915 - DNA, 22 bp, Homo sapiens
tttgctctctgtgaccctaaga

SEQ ID NO: 4399916 - DNA, 15 bp, Homo sapiens
tttgctgaattcctt

SEQ ID NO: 4399917 - DNA, 17 bp, Homo sapiens
tttgctgaattccttta

SEQ ID NO: 4399918 - DNA, 18 bp, Homo sapiens
tttgctgaattcctttac

SEQ ID NO: 4399919 - DNA, 22 bp, Homo sapiens
tttgctgctgcccatgtttcaa

SEQ ID NO: 4399920 - DNA, 13 bp, Homo sapiens
tttgctgtagaag

SEQ ID NO: 4399921 - DNA, 21 bp, Homo sapiens
tttgctgtagaagatggcact

SEQ ID NO: 4399922 - DNA, 22 bp, Homo sapiens
tttgctgttgggtttttgctgt

SEQ ID NO: 4399923 - DNA, 13 bp, Homo sapiens
tttgcttaaaata

SEQ ID NO: 4399924 - DNA, 16 bp, Homo sapiens
tttgcttaaaatatgt

SEQ ID NO: 4399925 - DNA, 20 bp, Homo sapiens
tttgcttaaaatatgtgaag

SEQ ID NO: 4399926 - DNA, 14 bp, Homo sapiens
tttgcttctagagc

SEQ ID NO: 4399927 - DNA, 16 bp, Homo sapiens
tttgcttgaacacagt

SEQ ID NO: 4399928 - DNA, 17 bp, Homo sapiens
tttgcttgaacacagta

SEQ ID NO: 4399929 - DNA, 12 bp, Homo sapiens
tttgctttaatg

SEQ ID NO: 4399930 - DNA, 15 bp, Homo sapiens
tttgctttaatgaga

SEQ ID NO: 4399931 - DNA, 15 bp, Homo sapiens
tttgctttcttgtct

SEQ ID NO: 4399932 - DNA, 14 bp, Homo sapiens
tttgctttggaaac

SEQ ID NO: 4399933 - DNA, 17 bp, Homo sapiens
tttggaaactcaaggaa

SEQ ID NO: 4399934 - DNA, 13 bp, Homo sapiens
tttggaaagtaca

SEQ ID NO: 4399935 - DNA, 15 bp, Homo sapiens
tttggaaagtacact

SEQ ID NO: 4399936 - DNA, 21 bp, Homo sapiens
tttggaattgaacgactgtat

SEQ ID NO: 4399937 - DNA, 23 bp, Homo sapiens
tttggacagctgataaatttaat

SEQ ID NO: 4399938 - DNA, 15 bp, Homo sapiens
tttggactttgtata

SEQ ID NO: 4399939 - DNA, 15 bp, Homo sapiens
tttggatatgtaaaa

SEQ ID NO: 4399940 - DNA, 20 bp, Homo sapiens
tttggatctccaattgcctc

SEQ ID NO: 4399941 - DNA, 18 bp, Homo sapiens
tttggatgtctgtagcat

SEQ ID NO: 4399942 - DNA, 16 bp, Homo sapiens
tttggatttgacattg

SEQ ID NO: 4399943 - DNA, 17 bp, Homo sapiens
tttggcatgggacagac

SEQ ID NO: 4399944 - DNA, 13 bp, Homo sapiens
tttggcattatct

SEQ ID NO: 4399945 - DNA, 23 bp, Homo sapiens
tttggccaatgcacctaaagaaa

SEQ ID NO: 4399946 - DNA, 12 bp, Homo sapiens
tttggcccaggg

SEQ ID NO: 4399947 - DNA, 21 bp, Homo sapiens
tttggcctggggtgcatctcc

SEQ ID NO: 4399948 - DNA, 14 bp, Homo sapiens
tttggccttaagaa

SEQ ID NO: 4399949 - DNA, 15 bp, Homo sapiens
tttggccttaagaac

SEQ ID NO: 4399950 - DNA, 14 bp, Homo sapiens
tttggcttgctgtt

SEQ ID NO: 4399951 - DNA, 21 bp, Homo sapiens
tttgggaagaatccagtatta

SEQ ID NO: 4399952 - DNA, 19 bp, Homo sapiens
tttgggatagagaatgttc

SEQ ID NO: 4399953 - DNA, 12 bp, Homo sapiens
tttgggcccagg

SEQ ID NO: 4399954 - DNA, 19 bp, Homo sapiens
tttggtaaaaatgctgctc

SEQ ID NO: 4399955 - DNA, 17 bp, Homo sapiens
tttggtacacatgtgtt

SEQ ID NO: 4399956 - DNA, 14 bp, Homo sapiens
tttggtagatgaca

SEQ ID NO: 4399957 - DNA, 20 bp, Homo sapiens
tttggtagatgacaaatatt

SEQ ID NO: 4399958 - DNA, 13 bp, Homo sapiens
tttggtccctggg

SEQ ID NO: 4399959 - DNA, 23 bp, Homo sapiens
tttggtgaccccatacatttgtg

SEQ ID NO: 4399960 - DNA, 19 bp, Homo sapiens
tttggtgagagtcaaagct

SEQ ID NO: 4399961 - DNA, 18 bp, Homo sapiens
tttggtgcctttcctgtt

SEQ ID NO: 4399962 - DNA, 12 bp, Homo sapiens
tttggtgctttt

SEQ ID NO: 4399963 - DNA, 16 bp, Homo sapiens
tttggtggatgtaaat

SEQ ID NO: 4399964 - DNA, 15 bp, Homo sapiens
tttggttaagttggc

SEQ ID NO: 4399965 - DNA, 19 bp, Homo sapiens
tttggttaagttggcttct

SEQ ID NO: 4399966 - DNA, 22 bp, Homo sapiens
tttggttaagttggcttctgtt

SEQ ID NO: 4399967 - DNA, 19 bp, Homo sapiens
tttggttaatatgtctttt

SEQ ID NO: 4399968 - DNA, 20 bp, Homo sapiens
tttggttcattaattctata

SEQ ID NO: 4399969 - DNA, 19 bp, Homo sapiens
tttggtttcccaagagcta

SEQ ID NO: 4399970 - DNA, 14 bp, Homo sapiens
tttgtaaaaatgag

SEQ ID NO: 4399971 - DNA, 16 bp, Homo sapiens
tttgtaaataaaaaca

SEQ ID NO: 4399972 - DNA, 14 bp, Homo sapiens
tttgtaaataggat

SEQ ID NO: 4399973 - DNA, 23 bp, Homo sapiens
tttgtaaatgcatattaaataat

SEQ ID NO: 4399974 - DNA, 21 bp, Homo sapiens
tttgtaaatgcctcttaaatt

SEQ ID NO: 4399975 - DNA, 11 bp, Homo sapiens
tttgtaaattc

SEQ ID NO: 4399976 - DNA, 20 bp, Homo sapiens
tttgtaaccacaactttcac

SEQ ID NO: 4399977 - DNA, 13 bp, Homo sapiens
tttgtaacttcaa

SEQ ID NO: 4399978 - DNA, 15 bp, Homo sapiens
tttgtaacttcaaat

SEQ ID NO: 4399979 - DNA, 19 bp, Homo sapiens
tttgtaagcaacttgcttc

SEQ ID NO: 4399980 - DNA, 20 bp, Homo sapiens
tttgtaagcaacttgcttct

SEQ ID NO: 4399981 - DNA, 13 bp, Homo sapiens
tttgtaatacttt

SEQ ID NO: 4399982 - DNA, 22 bp, Homo sapiens
tttgtaatatggaaatctttta

SEQ ID NO: 4399983 - DNA, 17 bp, Homo sapiens
tttgtaatattctgttt

SEQ ID NO: 4399984 - DNA, 16 bp, Homo sapiens
tttgtaatattttcca

SEQ ID NO: 4399985 - DNA, 14 bp, Homo sapiens
tttgtaattaaaag

SEQ ID NO: 4399986 - DNA, 19 bp, Homo sapiens
tttgtacatatcaaataga

SEQ ID NO: 4399987 - DNA, 16 bp, Homo sapiens
tttgtaccaagtaaat

SEQ ID NO: 4399988 - DNA, 19 bp, Homo sapiens
tttgtaccagtgaattttt

SEQ ID NO: 4399989 - DNA, 22 bp, Homo sapiens
tttgtaccagtgaatttttgca

SEQ ID NO: 4399990 - DNA, 23 bp, Homo sapiens
tttgtaccagtgaatttttgcaa

SEQ ID NO: 4399991 - DNA, 19 bp, Homo sapiens
tttgtaccattttaaagtt

SEQ ID NO: 4399992 - DNA, 18 bp, Homo sapiens
tttgtagaataaatggtt

SEQ ID NO: 4399993 - DNA, 15 bp, Homo sapiens
tttgtaggtaaaatg

SEQ ID NO: 4399994 - DNA, 17 bp, Homo sapiens
tttgtaggtaaaatgta

SEQ ID NO: 4399995 - DNA, 15 bp, Homo sapiens
tttgtagtagcgttt

SEQ ID NO: 4399996 - DNA, 19 bp, Homo sapiens
tttgtagtagcgtttttta

SEQ ID NO: 4399997 - DNA, 13 bp, Homo sapiens
tttgtataattgg

SEQ ID NO: 4399998 - DNA, 21 bp, Homo sapiens
tttgtataattggatttccta

SEQ ID NO: 4399999 - DNA, 12 bp, Homo sapiens
tttgtatctttc

SEQ ID NO: 4400000 - DNA, 22 bp, Homo sapiens
tttgtatcttttatcctgggag

SEQ ID NO: 4400001 - DNA, 19 bp, Homo sapiens
tttgtatgaaatatatgtg

SEQ ID NO: 4400002 - DNA, 13 bp, Homo sapiens
tttgtattaccat

SEQ ID NO: 4400003 - DNA, 18 bp, Homo sapiens
tttgtattattacaaata

SEQ ID NO: 4400004 - DNA, 13 bp, Homo sapiens
tttgtattcaaaa

SEQ ID NO: 4400005 - DNA, 13 bp, Homo sapiens
tttgtattcttca

SEQ ID NO: 4400006 - DNA, 22 bp, Homo sapiens
tttgtattgcttcctgattacc

SEQ ID NO: 4400007 - DNA, 17 bp, Homo sapiens
tttgtattgtttctaca

SEQ ID NO: 4400008 - DNA, 14 bp, Homo sapiens
tttgtatttttagt

SEQ ID NO: 4400009 - DNA, 20 bp, Homo sapiens
tttgtatttttcatctttaa

SEQ ID NO: 4400010 - DNA, 23 bp, Homo sapiens
tttgtatttttcatctttaagaa

SEQ ID NO: 4400011 - DNA, 13 bp, Homo sapiens
tttgtatttttgt

SEQ ID NO: 4400012 - DNA, 14 bp, Homo sapiens
tttgtcaaactgta

SEQ ID NO: 4400013 - DNA, 16 bp, Homo sapiens
tttgtcaaactgtaga

SEQ ID NO: 4400014 - DNA, 23 bp, Homo sapiens
tttgtcaaactgtagaaatgatg

SEQ ID NO: 4400015 - DNA, 17 bp, Homo sapiens
tttgtcacttctgctgt

SEQ ID NO: 4400016 - DNA, 22 bp, Homo sapiens
tttgtcatgctgggatttccaa

SEQ ID NO: 4400017 - DNA, 16 bp, Homo sapiens
tttgtcccaagtgcca

SEQ ID NO: 4400018 - DNA, 11 bp, Homo sapiens
tttgtcccaga

SEQ ID NO: 4400019 - DNA, 18 bp, Homo sapiens
tttgtcctgcatcatctt

SEQ ID NO: 4400020 - DNA, 21 bp, Homo sapiens
tttgtcttgtgtttctttagt

SEQ ID NO: 4400021 - DNA, 15 bp, Homo sapiens
tttgtgaactggaag

SEQ ID NO: 4400022 - DNA, 12 bp, Homo sapiens
ttttaatagcac

SEQ ID NO: 4400023 - DNA, 15 bp, Homo sapiens
ttttaatatataatt

SEQ ID NO: 4400024 - DNA, 18 bp, Homo sapiens
ttttaatcattatttgag

SEQ ID NO: 4400025 - DNA, 16 bp, Homo sapiens
ttttaatctttgtgac

SEQ ID NO: 4400026 - DNA, 22 bp, Homo sapiens
ttttaatgaaaaggaatcacgt

SEQ ID NO: 4400027 - DNA, 20 bp, Homo sapiens
ttttaatgctatttgaacaa

SEQ ID NO: 4400028 - DNA, 12 bp, Homo sapiens
ttttaatgtgct

SEQ ID NO: 4400029 - DNA, 14 bp, Homo sapiens
ttttaatgtgctct

SEQ ID NO: 4400030 - DNA, 15 bp, Homo sapiens
ttttaattaaaaact

SEQ ID NO: 4400031 - DNA, 19 bp, Homo sapiens
ttttaattaaaaactttaa

SEQ ID NO: 4400032 - DNA, 14 bp, Homo sapiens
ttttaattcaagaa

SEQ ID NO: 4400033 - DNA, 15 bp, Homo sapiens
ttttaattcaagaaa

SEQ ID NO: 4400034 - DNA, 10 bp, Homo sapiens
ttttaattta

SEQ ID NO: 4400035 - DNA, 12 bp, Homo sapiens
ttttaatttagt

SEQ ID NO: 4400036 - DNA, 13 bp, Homo sapiens
ttttaatttcagg

SEQ ID NO: 4400037 - DNA, 15 bp, Homo sapiens
ttttaatttcaggaa

SEQ ID NO: 4400038 - DNA, 11 bp, Homo sapiens
ttttaatttga

SEQ ID NO: 4400039 - DNA, 19 bp, Homo sapiens
ttttaattttcaggtcaag

SEQ ID NO: 4400040 - DNA, 20 bp, Homo sapiens
ttttacaagtataacagttt

SEQ ID NO: 4400041 - DNA, 14 bp, Homo sapiens
ttttacacagagaa

SEQ ID NO: 4400042 - DNA, 23 bp, Homo sapiens
ttttacagagaggatacatttaa

SEQ ID NO: 4400043 - DNA, 16 bp, Homo sapiens
ttttacagctacttta

SEQ ID NO: 4400044 - DNA, 17 bp, Homo sapiens
ttttacagctactttaa

SEQ ID NO: 4400045 - DNA, 18 bp, Homo sapiens
ttttacagtatccaaaaa

SEQ ID NO: 4400046 - DNA, 12 bp, Homo sapiens
ttttacatttca

SEQ ID NO: 4400047 - DNA, 16 bp, Homo sapiens
ttttaccaaagcatca

SEQ ID NO: 4400048 - DNA, 17 bp, Homo sapiens
ttttaccaaagcatcaa

SEQ ID NO: 4400049 - DNA, 13 bp, Homo sapiens
ttttaccttgttt

SEQ ID NO: 4400050 - DNA, 17 bp, Homo sapiens
ttttactgaatgatcta

SEQ ID NO: 4400051 - DNA, 17 bp, Homo sapiens
ttttacttgaatcagat

SEQ ID NO: 4400052 - DNA, 18 bp, Homo sapiens
ttttacttgaatcagatg

SEQ ID NO: 4400053 - DNA, 11 bp, Homo sapiens
ttttactttgg

SEQ ID NO: 4400054 - DNA, 22 bp, Homo sapiens
ttttactttggtttagtctttt

SEQ ID NO: 4400055 - DNA, 18 bp, Homo sapiens
ttttacttttaaactgtg

SEQ ID NO: 4400056 - DNA, 20 bp, Homo sapiens
ttttacttttaaactgtgta

SEQ ID NO: 4400057 - DNA, 21 bp, Homo sapiens
ttttacttttctgccaaaata

SEQ ID NO: 4400058 - DNA, 22 bp, Homo sapiens
ttttagaaaaacatttaaactt

SEQ ID NO: 4400059 - DNA, 23 bp, Homo sapiens
ttttagaaaaggccaatatacct

SEQ ID NO: 4400060 - DNA, 16 bp, Homo sapiens
ttttagaattaaaatt

SEQ ID NO: 4400061 - DNA, 20 bp, Homo sapiens
ttttagcagttctgcaaata

SEQ ID NO: 4400062 - DNA, 13 bp, Homo sapiens
ttttaggcaaaga

SEQ ID NO: 4400063 - DNA, 16 bp, Homo sapiens
ttttagggttctaaat

SEQ ID NO: 4400064 - DNA, 14 bp, Homo sapiens
ttttagtaagttaa

SEQ ID NO: 4400065 - DNA, 18 bp, Homo sapiens
ttttagtaagttaatgta

SEQ ID NO: 4400066 - DNA, 14 bp, Homo sapiens
ttttagtaatttct

SEQ ID NO: 4400067 - DNA, 12 bp, Homo sapiens
ttttagtacatt

SEQ ID NO: 4400068 - DNA, 19 bp, Homo sapiens
ttttagtgtgtgcataata

SEQ ID NO: 4400069 - DNA, 13 bp, Homo sapiens
ttttataaatact

SEQ ID NO: 4400070 - DNA, 20 bp, Homo sapiens
ttttatacaagtaatttcct

SEQ ID NO: 4400071 - DNA, 13 bp, Homo sapiens
ttttatactcttt

SEQ ID NO: 4400072 - DNA, 18 bp, Homo sapiens
ttttatactctttctgta

SEQ ID NO: 4400073 - DNA, 15 bp, Homo sapiens
ttttatagtggaaaa

SEQ ID NO: 4400074 - DNA, 13 bp, Homo sapiens
ttttatagtgtgt

SEQ ID NO: 4400075 - DNA, 18 bp, Homo sapiens
ttttatagttattaaatg

SEQ ID NO: 4400076 - DNA, 22 bp, Homo sapiens
ttttatataataaagtattcca

SEQ ID NO: 4400077 - DNA, 22 bp, Homo sapiens
ttttatataatatctaaagtta

SEQ ID NO: 4400078 - DNA, 21 bp, Homo sapiens
ttttatatattatgtgaagaa

SEQ ID NO: 4400079 - DNA, 22 bp, Homo sapiens
ttttatatattatgtgaagaat

SEQ ID NO: 4400080 - DNA, 20 bp, Homo sapiens
ttttatatttattgttagaa

SEQ ID NO: 4400081 - DNA, 20 bp, Homo sapiens
ttttatatttcctttatgtg

SEQ ID NO: 4400082 - DNA, 23 bp, Homo sapiens
ttttatcccatttagtgtgaata

SEQ ID NO: 4400083 - DNA, 12 bp, Homo sapiens
ttttatcctgta

SEQ ID NO: 4400084 - DNA, 23 bp, Homo sapiens
ttttatctgaatttttaaacaag

SEQ ID NO: 4400085 - DNA, 18 bp, Homo sapiens
ttttatctggtgcctcct

SEQ ID NO: 4400086 - DNA, 16 bp, Homo sapiens
ttttatgaacattgta

SEQ ID NO: 4400087 - DNA, 22 bp, Homo sapiens
ttttatgatggagcaactgaaa

SEQ ID NO: 4400088 - DNA, 19 bp, Homo sapiens
ttttatggagacctctcct

SEQ ID NO: 4400089 - DNA, 12 bp, Homo sapiens
ttttatggatga

SEQ ID NO: 4400090 - DNA, 16 bp, Homo sapiens
ttttatggatgattaa

SEQ ID NO: 4400091 - DNA, 18 bp, Homo sapiens
ttttatggatgattaaat

SEQ ID NO: 4400092 - DNA, 19 bp, Homo sapiens
ttttatggatgattaaatt

SEQ ID NO: 4400093 - DNA, 16 bp, Homo sapiens
ttttatgggtgaaaat

SEQ ID NO: 4400094 - DNA, 23 bp, Homo sapiens
ttttatgtaatttctttaaatgt

SEQ ID NO: 4400095 - DNA, 18 bp, Homo sapiens
ttttatgtacaaccctga

SEQ ID NO: 4400096 - DNA, 19 bp, Homo sapiens
ttttatgtacaaccctgac

SEQ ID NO: 4400097 - DNA, 13 bp, Homo sapiens
ttttatgtgttct

SEQ ID NO: 4400098 - DNA, 18 bp, Homo sapiens
ttttatgttcttggcttt

SEQ ID NO: 4400099 - DNA, 22 bp, Homo sapiens
ttttattaatctactgtatcaa

SEQ ID NO: 4400100 - DNA, 19 bp, Homo sapiens
ttttattaatgcactttct

SEQ ID NO: 4400101 - DNA, 19 bp, Homo sapiens
ttttattaattttagtttt

SEQ ID NO: 4400102 - DNA, 13 bp, Homo sapiens
ttttattccctgc

SEQ ID NO: 4400103 - DNA, 15 bp, Homo sapiens
ttttattcctttcct

SEQ ID NO: 4400104 - DNA, 16 bp, Homo sapiens
ttttattcctttgaat

SEQ ID NO: 4400105 - DNA, 17 bp, Homo sapiens
ttttattcctttgaata

SEQ ID NO: 4400106 - DNA, 16 bp, Homo sapiens
ttttattgacacagaa

SEQ ID NO: 4400107 - DNA, 16 bp, Homo sapiens
ttttattgccttctca

SEQ ID NO: 4400108 - DNA, 21 bp, Homo sapiens
ttttattggggaattaaatag

SEQ ID NO: 4400109 - DNA, 23 bp, Homo sapiens
ttttattggggaattaaatagtg

SEQ ID NO: 4400110 - DNA, 13 bp, Homo sapiens
ttttatttctcgg

SEQ ID NO: 4400111 - DNA, 15 bp, Homo sapiens
ttttatttgcatgtg

SEQ ID NO: 4400112 - DNA, 16 bp, Homo sapiens
ttttattttatgttta

SEQ ID NO: 4400113 - DNA, 14 bp, Homo sapiens
ttttcaaaagataa

SEQ ID NO: 4400114 - DNA, 13 bp, Homo sapiens
ttttcaaagcaat

SEQ ID NO: 4400115 - DNA, 13 bp, Homo sapiens
ttttcaactttga

SEQ ID NO: 4400116 - DNA, 16 bp, Homo sapiens
ttttcaactttgaata

SEQ ID NO: 4400117 - DNA, 24 bp, Homo sapiens
ttttcaactttgaataaagaatac

SEQ ID NO: 4400118 - DNA, 14 bp, Homo sapiens
ttttcaagaaatga

SEQ ID NO: 4400119 - DNA, 18 bp, Homo sapiens
ttttcaatatattgaact

SEQ ID NO: 4400120 - DNA, 20 bp, Homo sapiens
ttttcaatatattgaacttt

SEQ ID NO: 4400121 - DNA, 16 bp, Homo sapiens
ttttcaatgtctaaaa

SEQ ID NO: 4400122 - DNA, 13 bp, Homo sapiens
ttttcaatttgga

SEQ ID NO: 4400123 - DNA, 18 bp, Homo sapiens
ttttcaccgagcagaggt

SEQ ID NO: 4400124 - DNA, 16 bp, Homo sapiens
ttttcactttctgtct

SEQ ID NO: 4400125 - DNA, 22 bp, Homo sapiens
ttttcagaacctcttccccaga

SEQ ID NO: 4400126 - DNA, 16 bp, Homo sapiens
ttttcagaatctgaat

SEQ ID NO: 4400127 - DNA, 17 bp, Homo sapiens
ttttcagaatctgaatg

SEQ ID NO: 4400128 - DNA, 16 bp, Homo sapiens
ttttcagacaaattac

SEQ ID NO: 4400129 - DNA, 21 bp, Homo sapiens
ttttcagatataaaagactga

SEQ ID NO: 4400130 - DNA, 22 bp, Homo sapiens
ttttcagatataaaagactgac

SEQ ID NO: 4400131 - DNA, 20 bp, Homo sapiens
ttttcagcagcaaaaccaaa

SEQ ID NO: 4400132 - DNA, 15 bp, Homo sapiens
ttttcagttgttctt

SEQ ID NO: 4400133 - DNA, 19 bp, Homo sapiens
ttttcatactgtacacatt

SEQ ID NO: 4400134 - DNA, 20 bp, Homo sapiens
ttttcatactgtacacattt

SEQ ID NO: 4400135 - DNA, 16 bp, Homo sapiens
ttttcatagatttgaa

SEQ ID NO: 4400136 - DNA, 18 bp, Homo sapiens
ttttcatcacagttgcct

SEQ ID NO: 4400137 - DNA, 16 bp, Homo sapiens
ttttcatcatttcagc

SEQ ID NO: 4400138 - DNA, 22 bp, Homo sapiens
ttttcatcccgtatcacagtgt

SEQ ID NO: 4400139 - DNA, 16 bp, Homo sapiens
ttttcattctgccaaa

SEQ ID NO: 4400140 - DNA, 20 bp, Homo sapiens
ttttcattgattatatgggt

SEQ ID NO: 4400141 - DNA, 15 bp, Homo sapiens
tttttggtggatgta

SEQ ID NO: 4400142 - DNA, 19 bp, Homo sapiens
tttttggtggatgtaaata

SEQ ID NO: 4400143 - DNA, 18 bp, Homo sapiens
tttttgtaacttcaaata

SEQ ID NO: 4400144 - DNA, 22 bp, Homo sapiens
tttttgtaataagcaatcaagg

SEQ ID NO: 4400145 - DNA, 14 bp, Homo sapiens
tttttgtaccattt

SEQ ID NO: 4400146 - DNA, 17 bp, Homo sapiens
tttttgtgtgtatttgc

SEQ ID NO: 4400147 - DNA, 13 bp, Homo sapiens
tttttgtttgatg

SEQ ID NO: 4400148 - DNA, 15 bp, Homo sapiens
tttttgtttgtttct

SEQ ID NO: 4400149 - DNA, 18 bp, Homo sapiens
tttttgttttgaaagttt

SEQ ID NO: 4400150 - DNA, 13 bp, Homo sapiens
ttttttaaaaaag

SEQ ID NO: 4400151 - DNA, 18 bp, Homo sapiens
ttttttaagttcttatga

SEQ ID NO: 4400152 - DNA, 23 bp, Homo sapiens
ttttttacaaagtttcaaaaact

SEQ ID NO: 4400153 - DNA, 13 bp, Homo sapiens
ttttttactcttt

SEQ ID NO: 4400154 - DNA, 12 bp, Homo sapiens
ttttttactttg

SEQ ID NO: 4400155 - DNA, 14 bp, Homo sapiens
ttttttacttttgt

SEQ ID NO: 4400156 - DNA, 17 bp, Homo sapiens
ttttttatgtacaaccc

SEQ ID NO: 4400157 - DNA, 14 bp, Homo sapiens
ttttttatgttcct

SEQ ID NO: 4400158 - DNA, 13 bp, Homo sapiens
ttttttcatttgt

SEQ ID NO: 4400159 - DNA, 13 bp, Homo sapiens
ttttttccatctt

SEQ ID NO: 4400160 - DNA, 15 bp, Homo sapiens
ttttttcccataaga

SEQ ID NO: 4400161 - DNA, 17 bp, Homo sapiens
ttttttctgtaatgtaa

SEQ ID NO: 4400162 - DNA, 13 bp, Homo sapiens
ttttttgagattt

SEQ ID NO: 4400163 - DNA, 13 bp, Homo sapiens
ttttttgagtcat

SEQ ID NO: 4400164 - DNA, 14 bp, Homo sapiens
ttttttgtaccatt

SEQ ID NO: 4400165 - DNA, 13 bp, Homo sapiens
ttttttgtatatt

SEQ ID NO: 4400166 - DNA, 13 bp, Homo sapiens
tttttttaaaatc

SEQ ID NO: 4400167 - DNA, 13 bp, Homo sapiens
tttttttccgtgt

SEQ ID NO: 4400168 - DNA, 14 bp, Homo sapiens
tttttttgtaactt

SEQ ID NO: 4400169 - DNA, 11 bp, Homo sapiens
ttttttttcca

SEQ ID NO: 4400170 - DNA, 13 bp, Homo sapiens
ttttttttgaaaa

SEQ ID NO: 4400171 - DNA, 19 bp, Homo sapiens
ttccgggaaaacagctatt

SEQ ID NO: 4400172 - DNA, 19 bp, Homo sapiens
ttcctaaaacacccttcag

SEQ ID NO: 4400173 - DNA, 13 bp, Homo sapiens
ttcctaaagaaaa

SEQ ID NO: 4400174 - DNA, 14 bp, Homo sapiens
ttcctaactgtgat

SEQ ID NO: 4400175 - DNA, 23 bp, Homo sapiens
ttcctaagacatttttcattcat

SEQ ID NO: 4400176 - DNA, 15 bp, Homo sapiens
ttcctaataaagttc

SEQ ID NO: 4400177 - DNA, 16 bp, Homo sapiens
ttcctaataaagttct

SEQ ID NO: 4400178 - DNA, 22 bp, Homo sapiens
ttcctacaagagcagcctgtgg

SEQ ID NO: 4400179 - DNA, 14 bp, Homo sapiens
ttcctacagcacta

SEQ ID NO: 4400180 - DNA, 17 bp, Homo sapiens
ttcctacagcactactg

SEQ ID NO: 4400181 - DNA, 22 bp, Homo sapiens
ttcctacagcactactgggtgt

SEQ ID NO: 4400182 - DNA, 23 bp, Homo sapiens
ttcctacagcactactgggtgtc

SEQ ID NO: 4400183 - DNA, 18 bp, Homo sapiens
ttcctacaggcagtctct

SEQ ID NO: 4400184 - DNA, 23 bp, Homo sapiens
ttcctacccacacctctgccaga

SEQ ID NO: 4400185 - DNA, 15 bp, Homo sapiens
ttcctaccctgcctc

SEQ ID NO: 4400186 - DNA, 21 bp, Homo sapiens
ttcctagattacatctgcctt

SEQ ID NO: 4400187 - DNA, 23 bp, Homo sapiens
ttcctagattacatctgccttaa

SEQ ID NO: 4400188 - DNA, 21 bp, Homo sapiens
ttcctagcactgccccacatg

SEQ ID NO: 4400189 - DNA, 22 bp, Homo sapiens
ttcctagcactgccccacatgc

SEQ ID NO: 4400190 - DNA, 13 bp, Homo sapiens
ttcctatacgcag

SEQ ID NO: 4400191 - DNA, 22 bp, Homo sapiens
ttcctatcacctcgagaagtaa

SEQ ID NO: 4400192 - DNA, 19 bp, Homo sapiens
ttcctattccaagcttcca

SEQ ID NO: 4400193 - DNA, 21 bp, Homo sapiens
ttcctattccaagcttccata

SEQ ID NO: 4400194 - DNA, 17 bp, Homo sapiens
ttcctcaaatacatgca

SEQ ID NO: 4400195 - DNA, 20 bp, Homo sapiens
ttcctcaaatcaaaaacagg

SEQ ID NO: 4400196 - DNA, 21 bp, Homo sapiens
ttcctcaaatcaaaaacaggc

SEQ ID NO: 4400197 - DNA, 20 bp, Homo sapiens
ttcctcaaattttttgactt

SEQ ID NO: 4400198 - DNA, 22 bp, Homo sapiens
ttcctcaaattttttgactttt

SEQ ID NO: 4400199 - DNA, 14 bp, Homo sapiens
ttcctcacagtccc

SEQ ID NO: 4400200 - DNA, 13 bp, Homo sapiens
ttcctcacatttg

SEQ ID NO: 4400201 - DNA, 15 bp, Homo sapiens
ttcctcagctctagg

SEQ ID NO: 4400202 - DNA, 20 bp, Homo sapiens
ttcctcatctatggttctaa

SEQ ID NO: 4400203 - DNA, 14 bp, Homo sapiens
ttcctccagagaca

SEQ ID NO: 4400204 - DNA, 22 bp, Homo sapiens
ttcctccagagacactgagcca

SEQ ID NO: 4400205 - DNA, 12 bp, Homo sapiens
ttcctccagcct

SEQ ID NO: 4400206 - DNA, 19 bp, Homo sapiens
ttcctccagcctcccctcc

SEQ ID NO: 4400207 - DNA, 21 bp, Homo sapiens
ttcctccagcctcccctcccc

SEQ ID NO: 4400208 - DNA, 15 bp, Homo sapiens
ttcctcccagcattg

SEQ ID NO: 4400209 - DNA, 23 bp, Homo sapiens
ttcctcccagtgagactgcccca

SEQ ID NO: 4400210 - DNA, 17 bp, Homo sapiens
ttcctccccctgcaact

SEQ ID NO: 4400211 - DNA, 10 bp, Homo sapiens
ttcctccctc

SEQ ID NO: 4400212 - DNA, 12 bp, Homo sapiens
ttcctcctcagg

SEQ ID NO: 4400213 - DNA, 23 bp, Homo sapiens
ttcctcctgcagacacctggact

SEQ ID NO: 4400214 - DNA, 11 bp, Homo sapiens
ttcctcctggg

SEQ ID NO: 4400215 - DNA, 15 bp, Homo sapiens
ttcctcctgggccct

SEQ ID NO: 4400216 - DNA, 11 bp, Homo sapiens
ttcctcctttc

SEQ ID NO: 4400217 - DNA, 15 bp, Homo sapiens
ttcctctagaagcca

SEQ ID NO: 4400218 - DNA, 21 bp, Homo sapiens
ttcctctattgatgtacagtc

SEQ ID NO: 4400219 - DNA, 11 bp, Homo sapiens
ttcctctgccc

SEQ ID NO: 4400220 - DNA, 12 bp, Homo sapiens
ttcctctgcctg

SEQ ID NO: 4400221 - DNA, 18 bp, Homo sapiens
ttcctctgggtttctaag

SEQ ID NO: 4400222 - DNA, 16 bp, Homo sapiens
ttcctctgtacagcaa

SEQ ID NO: 4400223 - DNA, 15 bp, Homo sapiens
ttcctctgtgaactg

SEQ ID NO: 4400224 - DNA, 21 bp, Homo sapiens
ttcctcttagaagaatattgt

SEQ ID NO: 4400225 - DNA, 22 bp, Homo sapiens
ttcctcttagaagaatattgta

SEQ ID NO: 4400226 - DNA, 12 bp, Homo sapiens
ttcctgaagctg

SEQ ID NO: 4400227 - DNA, 18 bp, Homo sapiens
ttcctgaatccaaactaa

SEQ ID NO: 4400228 - DNA, 13 bp, Homo sapiens
ttcctgagggcta

SEQ ID NO: 4400229 - DNA, 21 bp, Homo sapiens
ttcctgattaccagtctgatt

SEQ ID NO: 4400230 - DNA, 13 bp, Homo sapiens
ttcctgccctgtc

SEQ ID NO: 4400231 - DNA, 16 bp, Homo sapiens
ttcctgcccttccctc

SEQ ID NO: 4400232 - DNA, 11 bp, Homo sapiens
ttcctgcctgg

SEQ ID NO: 4400233 - DNA, 12 bp, Homo sapiens
ttcctgcctggt

SEQ ID NO: 4400234 - DNA, 13 bp, Homo sapiens
ttcctgcctttga

SEQ ID NO: 4400235 - DNA, 19 bp, Homo sapiens
ttcctgcgtcctcctcacc

SEQ ID NO: 4400236 - DNA, 19 bp, Homo sapiens
ttcctgcttaaacttgacc

SEQ ID NO: 4400237 - DNA, 17 bp, Homo sapiens
ttcctggccttctgaac

SEQ ID NO: 4400238 - DNA, 12 bp, Homo sapiens
ttcctgggagga

SEQ ID NO: 4400239 - DNA, 17 bp, Homo sapiens
ttcctgggccagaagta

SEQ ID NO: 4400240 - DNA, 15 bp, Homo sapiens
ttcctgtaatatatt

SEQ ID NO: 4400241 - DNA, 15 bp, Homo sapiens
ttcctgtctcactct

SEQ ID NO: 4400242 - DNA, 19 bp, Homo sapiens
ttcctgtctcactcttctg

SEQ ID NO: 4400243 - DNA, 20 bp, Homo sapiens
ttcctgtgggtgttctttcc

SEQ ID NO: 4400244 - DNA, 21 bp, Homo sapiens
ttcctgtgggtgttctttcct

SEQ ID NO: 4400245 - DNA, 23 bp, Homo sapiens
ttcctgtgtaacatctgccattt

SEQ ID NO: 4400246 - DNA, 20 bp, Homo sapiens
ttcctgttcttaagacgtga

SEQ ID NO: 4400247 - DNA, 19 bp, Homo sapiens
ttcctgtttttcacatttt

SEQ ID NO: 4400248 - DNA, 13 bp, Homo sapiens
ttccttacctttt

SEQ ID NO: 4400249 - DNA, 16 bp, Homo sapiens
ttccttactgcagaat

SEQ ID NO: 4400250 - DNA, 22 bp, Homo sapiens
ttccttagactcttttccttcc

SEQ ID NO: 4400251 - DNA, 22 bp, Homo sapiens
ttccttatcacagaaataaaat

SEQ ID NO: 4400252 - DNA, 18 bp, Homo sapiens
ttccttatccctctcttc

SEQ ID NO: 4400253 - DNA, 23 bp, Homo sapiens
ttccttatccctctcttcccctt

SEQ ID NO: 4400254 - DNA, 22 bp, Homo sapiens
ttccttatgtatcagtgtcctt

SEQ ID NO: 4400255 - DNA, 15 bp, Homo sapiens
ttccttatttgcctt

SEQ ID NO: 4400256 - DNA, 21 bp, Homo sapiens
ttccttcatttccaccaggcc

SEQ ID NO: 4400257 - DNA, 19 bp, Homo sapiens
ttccttccctccttttaaa

SEQ ID NO: 4400258 - DNA, 12 bp, Homo sapiens
ttccttccctgg

SEQ ID NO: 4400259 - DNA, 13 bp, Homo sapiens
ttccttccctggc

SEQ ID NO: 4400260 - DNA, 14 bp, Homo sapiens
ttccttccctggct

SEQ ID NO: 4400261 - DNA, 14 bp, Homo sapiens
ttccttcctccttt

SEQ ID NO: 4400262 - DNA, 14 bp, Homo sapiens
ttccttccttccct

SEQ ID NO: 4400263 - DNA, 13 bp, Homo sapiens
ttccttctcccat

SEQ ID NO: 4400264 - DNA, 15 bp, Homo sapiens
ttccttctcccatct

SEQ ID NO: 4400265 - DNA, 18 bp, Homo sapiens
ttccttctggttctaact

SEQ ID NO: 4400266 - DNA, 21 bp, Homo sapiens
ttccttgacctgcattgtaaa

SEQ ID NO: 4400267 - DNA, 13 bp, Homo sapiens
ttccttgtcccgt

SEQ ID NO: 4400268 - DNA, 17 bp, Homo sapiens
ttcatagttcagaattt

SEQ ID NO: 4400269 - DNA, 22 bp, Homo sapiens
ttcatatataagactgctgcag

SEQ ID NO: 4400270 - DNA, 15 bp, Homo sapiens
ttcatatctaacttt

SEQ ID NO: 4400271 - DNA, 21 bp, Homo sapiens
ttcatatgaaaggtgccatgg

SEQ ID NO: 4400272 - DNA, 23 bp, Homo sapiens
ttcatatgaaaggtgccatggaa

SEQ ID NO: 4400273 - DNA, 15 bp, Homo sapiens
ttcatatgtcacctt

SEQ ID NO: 4400274 - DNA, 18 bp, Homo sapiens
ttcatattattttagtgt

SEQ ID NO: 4400275 - DNA, 13 bp, Homo sapiens
ttcatatttaatt

SEQ ID NO: 4400276 - DNA, 20 bp, Homo sapiens
ttcatatttaatttgaaggt

SEQ ID NO: 4400277 - DNA, 16 bp, Homo sapiens
ttcatcaagagtttat

SEQ ID NO: 4400278 - DNA, 12 bp, Homo sapiens
ttcatcatttca

SEQ ID NO: 4400279 - DNA, 18 bp, Homo sapiens
ttcatcatttcagccaaa

SEQ ID NO: 4400280 - DNA, 23 bp, Homo sapiens
ttcatcatttcagccaaagtcct

SEQ ID NO: 4400281 - DNA, 23 bp, Homo sapiens
ttcatccactctgcctgcttaca

SEQ ID NO: 4400282 - DNA, 17 bp, Homo sapiens
ttcatcccgtatcacag

SEQ ID NO: 4400283 - DNA, 21 bp, Homo sapiens
ttcatcccgtatcacagtgtt

SEQ ID NO: 4400284 - DNA, 19 bp, Homo sapiens
ttcatccgttgtgactcta

SEQ ID NO: 4400285 - DNA, 13 bp, Homo sapiens
ttcatcctataag

SEQ ID NO: 4400286 - DNA, 18 bp, Homo sapiens
ttcatcctgactctgccc

SEQ ID NO: 4400287 - DNA, 18 bp, Homo sapiens
ttcatcgaatctactaat

SEQ ID NO: 4400288 - DNA, 23 bp, Homo sapiens
ttcatcgaatctactaattccac

SEQ ID NO: 4400289 - DNA, 22 bp, Homo sapiens
ttcatctaataaatcagtgaac

SEQ ID NO: 4400290 - DNA, 12 bp, Homo sapiens
ttcatctcattt

SEQ ID NO: 4400291 - DNA, 16 bp, Homo sapiens
ttcatctcatttaagg

SEQ ID NO: 4400292 - DNA, 19 bp, Homo sapiens
ttcatctggcaacatcttt

SEQ ID NO: 4400293 - DNA, 14 bp, Homo sapiens
ttcatcttaaacta

SEQ ID NO: 4400294 - DNA, 16 bp, Homo sapiens
ttcatcttttgaagag

SEQ ID NO: 4400295 - DNA, 14 bp, Homo sapiens
ttcatgaaatgtgt

SEQ ID NO: 4400296 - DNA, 15 bp, Homo sapiens
ttcatgaaatgtgtt

SEQ ID NO: 4400297 - DNA, 13 bp, Homo sapiens
ttcatgatgcagt

SEQ ID NO: 4400298 - DNA, 17 bp, Homo sapiens
ttcatgatgcagtctcc

SEQ ID NO: 4400299 - DNA, 15 bp, Homo sapiens
ttcatgattagaaat

SEQ ID NO: 4400300 - DNA, 14 bp, Homo sapiens
ttcatgcagctgtg

SEQ ID NO: 4400301 - DNA, 16 bp, Homo sapiens
ttcatgcccttctgat

SEQ ID NO: 4400302 - DNA, 15 bp, Homo sapiens
ttcatgctctgcaaa

SEQ ID NO: 4400303 - DNA, 14 bp, Homo sapiens
ttcatgcttgacat

SEQ ID NO: 4400304 - DNA, 18 bp, Homo sapiens
ttcatgcttgacatacct

SEQ ID NO: 4400305 - DNA, 17 bp, Homo sapiens
ttcatggcaatgaaaat

SEQ ID NO: 4400306 - DNA, 23 bp, Homo sapiens
ttcatggcaatgaaaattttaag

SEQ ID NO: 4400307 - DNA, 19 bp, Homo sapiens
ttcatggctacctcagaaa

SEQ ID NO: 4400308 - DNA, 15 bp, Homo sapiens
ttcatgggctgtgtg

SEQ ID NO: 4400309 - DNA, 18 bp, Homo sapiens
ttcatgtaataaacaggt

SEQ ID NO: 4400310 - DNA, 13 bp, Homo sapiens
ttcatgtaatttt

SEQ ID NO: 4400311 - DNA, 21 bp, Homo sapiens
ttcatgtaattttattttaaa

SEQ ID NO: 4400312 - DNA, 17 bp, Homo sapiens
ttcatgtagtaagattt

SEQ ID NO: 4400313 - DNA, 17 bp, Homo sapiens
ttcatgtatgtatataa

SEQ ID NO: 4400314 - DNA, 14 bp, Homo sapiens
ttcatgtcatcaaa

SEQ ID NO: 4400315 - DNA, 24 bp, Homo sapiens
ttcatgtggcagggagcagtacac

SEQ ID NO: 4400316 - DNA, 12 bp, Homo sapiens
ttcattaaataa

SEQ ID NO: 4400317 - DNA, 16 bp, Homo sapiens
ttcattaattcaggca

SEQ ID NO: 4400318 - DNA, 14 bp, Homo sapiens
ttcattagttttga

SEQ ID NO: 4400319 - DNA, 13 bp, Homo sapiens
ttcattatgcttt

SEQ ID NO: 4400320 - DNA, 21 bp, Homo sapiens
ttcattatttgtcaaattgtc

SEQ ID NO: 4400321 - DNA, 23 bp, Homo sapiens
ttcattcatgaatattttcaagt

SEQ ID NO: 4400322 - DNA, 15 bp, Homo sapiens
ttcattcattggtga

SEQ ID NO: 4400323 - DNA, 15 bp, Homo sapiens
ttcattccattgcct

SEQ ID NO: 4400324 - DNA, 16 bp, Homo sapiens
ttcattcctaaagaaa

SEQ ID NO: 4400325 - DNA, 14 bp, Homo sapiens
ttcattcctcacaa

SEQ ID NO: 4400326 - DNA, 20 bp, Homo sapiens
ttcattgggaagattctcta

SEQ ID NO: 4400327 - DNA, 18 bp, Homo sapiens
ttcattggtgaagtaaat

SEQ ID NO: 4400328 - DNA, 14 bp, Homo sapiens
ttcattgtgattta

SEQ ID NO: 4400329 - DNA, 13 bp, Homo sapiens
ttcatttaactct

SEQ ID NO: 4400330 - DNA, 17 bp, Homo sapiens
ttcatttaactctttga

SEQ ID NO: 4400331 - DNA, 13 bp, Homo sapiens
ttcatttctctgc

SEQ ID NO: 4400332 - DNA, 19 bp, Homo sapiens
ttcatttcttatcacataa

SEQ ID NO: 4400333 - DNA, 22 bp, Homo sapiens
ttcatttggttcattaattcta

SEQ ID NO: 4400334 - DNA, 17 bp, Homo sapiens
ttcatttgtatgtcaaa

SEQ ID NO: 4400335 - DNA, 18 bp, Homo sapiens
ttcatttgtatgtcaaag

SEQ ID NO: 4400336 - DNA, 12 bp, Homo sapiens
ttcattttactg

SEQ ID NO: 4400337 - DNA, 18 bp, Homo sapiens
ttcattttagtattttag

SEQ ID NO: 4400338 - DNA, 17 bp, Homo sapiens
ttcattttatatttaaa

SEQ ID NO: 4400339 - DNA, 19 bp, Homo sapiens
ttcattttctagatacaat

SEQ ID NO: 4400340 - DNA, 23 bp, Homo sapiens
ttcattttgaaaatatgtactgt

SEQ ID NO: 4400341 - DNA, 14 bp, Homo sapiens
ttcattttgtataa

SEQ ID NO: 4400342 - DNA, 20 bp, Homo sapiens
ttcattttgttttgctctga

SEQ ID NO: 4400343 - DNA, 21 bp, Homo sapiens
ttcatttttattaaacagtga

SEQ ID NO: 4400344 - DNA, 22 bp, Homo sapiens
ttcatttttgaaactgcatttg

SEQ ID NO: 4400345 - DNA, 17 bp, Homo sapiens
ttcatttttttccaggc

SEQ ID NO: 4400346 - DNA, 16 bp, Homo sapiens
ttccaaaacctaaaga

SEQ ID NO: 4400347 - DNA, 14 bp, Homo sapiens
ttccaaaatattat

SEQ ID NO: 4400348 - DNA, 12 bp, Homo sapiens
ttccaaagaaag

SEQ ID NO: 4400349 - DNA, 21 bp, Homo sapiens
ttccaaagagtagaattgcat

SEQ ID NO: 4400350 - DNA, 16 bp, Homo sapiens
ttccaaagctttatta

SEQ ID NO: 4400351 - DNA, 18 bp, Homo sapiens
ttccaaattcagtttcat

SEQ ID NO: 4400352 - DNA, 15 bp, Homo sapiens
ttccaacatttctca

SEQ ID NO: 4400353 - DNA, 14 bp, Homo sapiens
ttccaacttcctgt

SEQ ID NO: 4400354 - DNA, 15 bp, Homo sapiens
ttccaagaaaatatc

SEQ ID NO: 4400355 - DNA, 17 bp, Homo sapiens
ttccaagaaaatatcac

SEQ ID NO: 4400356 - DNA, 16 bp, Homo sapiens
ttccaagacatgtctg

SEQ ID NO: 4400357 - DNA, 16 bp, Homo sapiens
ttccaagagaactaaa

SEQ ID NO: 4400358 - DNA, 16 bp, Homo sapiens
ttccaagttgctaata

SEQ ID NO: 4400359 - DNA, 20 bp, Homo sapiens
ttccaatagaaagaaactaa

SEQ ID NO: 4400360 - DNA, 13 bp, Homo sapiens
ttcaccaccccct

SEQ ID NO: 4400361 - DNA, 18 bp, Homo sapiens
ttcaccaccccctgtccc

SEQ ID NO: 4400362 - DNA, 22 bp, Homo sapiens
ttcaccaccccctgtcccattc

SEQ ID NO: 4400363 - DNA, 15 bp, Homo sapiens
ttcaccagtgttcct

SEQ ID NO: 4400364 - DNA, 20 bp, Homo sapiens
ttcaccagtgttcctgaagc

SEQ ID NO: 4400365 - DNA, 22 bp, Homo sapiens
ttcaccagtgttcctgaagctg

SEQ ID NO: 4400366 - DNA, 19 bp, Homo sapiens
ttcaccatgttagccagga

SEQ ID NO: 4400367 - DNA, 21 bp, Homo sapiens
ttcacccaccaggccagctca

SEQ ID NO: 4400368 - DNA, 16 bp, Homo sapiens
ttcacccctccctttc

SEQ ID NO: 4400369 - DNA, 14 bp, Homo sapiens
ttcaccctgggcag

SEQ ID NO: 4400370 - DNA, 14 bp, Homo sapiens
ttcacctgtaaaac

SEQ ID NO: 4400371 - DNA, 16 bp, Homo sapiens
ttcacctgtaaacctg

SEQ ID NO: 4400372 - DNA, 16 bp, Homo sapiens
ttcacctgtatatttc

SEQ ID NO: 4400373 - DNA, 20 bp, Homo sapiens
ttcacctgtatatttctttt

SEQ ID NO: 4400374 - DNA, 23 bp, Homo sapiens
ttcacgattaactgtgaaatgta

SEQ ID NO: 4400375 - DNA, 20 bp, Homo sapiens
ttcacgccattctcctgcct

SEQ ID NO: 4400376 - DNA, 22 bp, Homo sapiens
ttcactagaagccgtgggaaga

SEQ ID NO: 4400377 - DNA, 16 bp, Homo sapiens
ttcactataatgtgaa

SEQ ID NO: 4400378 - DNA, 16 bp, Homo sapiens
ttcactcacatagcca

SEQ ID NO: 4400379 - DNA, 20 bp, Homo sapiens
ttcactcatgcaaactgctt

SEQ ID NO: 4400380 - DNA, 13 bp, Homo sapiens
ttcactgcaattt

SEQ ID NO: 4400381 - DNA, 13 bp, Homo sapiens
ttcactgtatata

SEQ ID NO: 4400382 - DNA, 14 bp, Homo sapiens
ttcactgtatataa

SEQ ID NO: 4400383 - DNA, 16 bp, Homo sapiens
ttcactgtatataaac

SEQ ID NO: 4400384 - DNA, 17 bp, Homo sapiens
ttcactgtatataaaca

SEQ ID NO: 4400385 - DNA, 19 bp, Homo sapiens
ttcactgtatataaacata

SEQ ID NO: 4400386 - DNA, 17 bp, Homo sapiens
ttcactgtcatcttcaa

SEQ ID NO: 4400387 - DNA, 16 bp, Homo sapiens
ttcactgtctttaatt

SEQ ID NO: 4400388 - DNA, 19 bp, Homo sapiens
ttcactgtctttaattctg

SEQ ID NO: 4400389 - DNA, 14 bp, Homo sapiens
ttcacttctcccaa

SEQ ID NO: 4400390 - DNA, 18 bp, Homo sapiens
ttcacttctcccaagact

SEQ ID NO: 4400391 - DNA, 14 bp, Homo sapiens
ttcactttgacact

SEQ ID NO: 4400392 - DNA, 17 bp, Homo sapiens
ttcacttttgacaaagg

SEQ ID NO: 4400393 - DNA, 12 bp, Homo sapiens
ttcagaacctct

SEQ ID NO: 4400394 - DNA, 17 bp, Homo sapiens
ttcagaacctcttcccc

SEQ ID NO: 4400395 - DNA, 19 bp, Homo sapiens
ttcagaactgcccttgctg

SEQ ID NO: 4400396 - DNA, 23 bp, Homo sapiens
ttcagaactgcccttgctgcccg

SEQ ID NO: 4400397 - DNA, 14 bp, Homo sapiens
ttcagaagaaaaag

SEQ ID NO: 4400398 - DNA, 17 bp, Homo sapiens
ttcagaagcaagccaga

SEQ ID NO: 4400399 - DNA, 21 bp, Homo sapiens
ttcagaatctgaatgtaattt

SEQ ID NO: 4400400 - DNA, 13 bp, Homo sapiens
ttcagaatttagt

SEQ ID NO: 4400401 - DNA, 21 bp, Homo sapiens
ttcagaatttagtgtatccat

SEQ ID NO: 4400402 - DNA, 20 bp, Homo sapiens
ttcagacatctgaggtttta

SEQ ID NO: 4400403 - DNA, 15 bp, Homo sapiens
ttcagaccccagcgg

SEQ ID NO: 4400404 - DNA, 16 bp, Homo sapiens
ttcagacccctgcctg

SEQ ID NO: 4400405 - DNA, 13 bp, Homo sapiens
ttcagactcagac

SEQ ID NO: 4400406 - DNA, 16 bp, Homo sapiens
ttcagagccagcctgg

SEQ ID NO: 4400407 - DNA, 22 bp, Homo sapiens
ttcagaggccctcgctgccagc

SEQ ID NO: 4400408 - DNA, 23 bp, Homo sapiens
ttcagagggtaagtaaacagatt

SEQ ID NO: 4400409 - DNA, 22 bp, Homo sapiens
ttcagatatcttggacaaatca

SEQ ID NO: 4400410 - DNA, 11 bp, Homo sapiens
ttcagatgagg

SEQ ID NO: 4400411 - DNA, 13 bp, Homo sapiens
ttcagatgtaatg

SEQ ID NO: 4400412 - DNA, 18 bp, Homo sapiens
ttcagatgtaatgttttc

SEQ ID NO: 4400413 - DNA, 22 bp, Homo sapiens
ttcagatgtttcatcaatgcag

SEQ ID NO: 4400414 - DNA, 20 bp, Homo sapiens
ttcagcaaactcttttccca

SEQ ID NO: 4400415 - DNA, 19 bp, Homo sapiens
ttcagcaaagtggttccct

SEQ ID NO: 4400416 - DNA, 14 bp, Homo sapiens
ttcagcaaccctac

SEQ ID NO: 4400417 - DNA, 17 bp, Homo sapiens
ttcagcagcaaattttc

SEQ ID NO: 4400418 - DNA, 19 bp, Homo sapiens
ttcagcatccgcaggtgct

SEQ ID NO: 4400419 - DNA, 22 bp, Homo sapiens
ttcagcattaagctgttcctgt

SEQ ID NO: 4400420 - DNA, 20 bp, Homo sapiens
ttcagcattcttagcctgtg

SEQ ID NO: 4400421 - DNA, 11 bp, Homo sapiens
ttcagcatttg

SEQ ID NO: 4400422 - DNA, 23 bp, Homo sapiens
ttcagccacatgccccaggctct

SEQ ID NO: 4400423 - DNA, 13 bp, Homo sapiens
ttcagcccatctc

SEQ ID NO: 4400424 - DNA, 13 bp, Homo sapiens
ttcagcccctcct

SEQ ID NO: 4400425 - DNA, 14 bp, Homo sapiens
ttcagcccctcctc

SEQ ID NO: 4400426 - DNA, 18 bp, Homo sapiens
ttcagctagaatttctgg

SEQ ID NO: 4400427 - DNA, 14 bp, Homo sapiens
ttcaggcactgaga

SEQ ID NO: 4400428 - DNA, 13 bp, Homo sapiens
ttcaggccagccc

SEQ ID NO: 4400429 - DNA, 15 bp, Homo sapiens
ttcaggccagcccag

SEQ ID NO: 4400430 - DNA, 13 bp, Homo sapiens
ttcaggcctgcta

SEQ ID NO: 4400431 - DNA, 16 bp, Homo sapiens
ttcaggctgcttggga

SEQ ID NO: 4400432 - DNA, 15 bp, Homo sapiens
ttcaggggaagagaa

SEQ ID NO: 4400433 - DNA, 16 bp, Homo sapiens
ttcaggggactcagcc

SEQ ID NO: 4400434 - DNA, 17 bp, Homo sapiens
ttcaggggactcagccc

SEQ ID NO: 4400435 - DNA, 18 bp, Homo sapiens
ttcaggtggagagcacta

SEQ ID NO: 4400436 - DNA, 20 bp, Homo sapiens
ttcaggtggagagcactaga

SEQ ID NO: 4400437 - DNA, 16 bp, Homo sapiens
ttcagtaatgttattt

SEQ ID NO: 4400438 - DNA, 13 bp, Homo sapiens
ttcagtattttcc

SEQ ID NO: 4400439 - DNA, 18 bp, Homo sapiens
ttcagtattttccagcct

SEQ ID NO: 4400440 - DNA, 13 bp, Homo sapiens
ttcagtcattaaa

SEQ ID NO: 4400441 - DNA, 16 bp, Homo sapiens
ttcagtcattaaatta

SEQ ID NO: 4400442 - DNA, 22 bp, Homo sapiens
ttcagtgagagacgccctattt

SEQ ID NO: 4400443 - DNA, 20 bp, Homo sapiens
ttcagtgagcccctccccag

SEQ ID NO: 4400444 - DNA, 23 bp, Homo sapiens
ttcagtgagcccctccccagcca

SEQ ID NO: 4400445 - DNA, 15 bp, Homo sapiens
ttcagtgatactcac

SEQ ID NO: 4400446 - DNA, 22 bp, Homo sapiens
ttcagtgatcttcactgtatat

SEQ ID NO: 4400447 - DNA, 19 bp, Homo sapiens
ttcagtggtgaaatcttgt

SEQ ID NO: 4400448 - DNA, 18 bp, Homo sapiens
tcagaggcctgctgccag

SEQ ID NO: 4400449 - DNA, 13 bp, Homo sapiens
tcagaggtccagg

SEQ ID NO: 4400450 - DNA, 16 bp, Homo sapiens
tcagaggtccaggccc

SEQ ID NO: 4400451 - DNA, 19 bp, Homo sapiens
tcagaggtgctaaattgtc

SEQ ID NO: 4400452 - DNA, 19 bp, Homo sapiens
tcagagtccagtgctctgc

SEQ ID NO: 4400453 - DNA, 16 bp, Homo sapiens
tcagagtgacagtcat

SEQ ID NO: 4400454 - DNA, 13 bp, Homo sapiens
tcagagtgccact

SEQ ID NO: 4400455 - DNA, 20 bp, Homo sapiens
tcagagttcccaagaaagga

SEQ ID NO: 4400456 - DNA, 18 bp, Homo sapiens
tcagagttctgaagaaaa

SEQ ID NO: 4400457 - DNA, 17 bp, Homo sapiens
tcagataatatgtttag

SEQ ID NO: 4400458 - DNA, 18 bp, Homo sapiens
tcagatataaaagactga

SEQ ID NO: 4400459 - DNA, 21 bp, Homo sapiens
tcagatatcttggacaaatca

SEQ ID NO: 4400460 - DNA, 13 bp, Homo sapiens
tcagatcagtgct

SEQ ID NO: 4400461 - DNA, 23 bp, Homo sapiens
tcagatcagtgtaccatttgcct

SEQ ID NO: 4400462 - DNA, 22 bp, Homo sapiens
tcagatcctgttacttgcttca

SEQ ID NO: 4400463 - DNA, 20 bp, Homo sapiens
tcagatcttaatataaattc

SEQ ID NO: 4400464 - DNA, 21 bp, Homo sapiens
tcagatcttaatataaattca

SEQ ID NO: 4400465 - DNA, 18 bp, Homo sapiens
tcagatctttctccttga

SEQ ID NO: 4400466 - DNA, 21 bp, Homo sapiens
tcagatgaggtcaacacaggt

SEQ ID NO: 4400467 - DNA, 17 bp, Homo sapiens
tcagatgatctctccac

SEQ ID NO: 4400468 - DNA, 21 bp, Homo sapiens
tcagatgatttcccccctccg

SEQ ID NO: 4400469 - DNA, 23 bp, Homo sapiens
tcagatgcaattgctcccatcag

SEQ ID NO: 4400470 - DNA, 16 bp, Homo sapiens
tcagatgcagtttgga

SEQ ID NO: 4400471 - DNA, 12 bp, Homo sapiens
tcagatggaaaa

SEQ ID NO: 4400472 - DNA, 17 bp, Homo sapiens
tcagatggtgtcattta

SEQ ID NO: 4400473 - DNA, 19 bp, Homo sapiens
tcagatggtgtcatttagt

SEQ ID NO: 4400474 - DNA, 22 bp, Homo sapiens
tcagatggtgtcatttagtaag

SEQ ID NO: 4400475 - DNA, 13 bp, Homo sapiens
tcagatgtaatgt

SEQ ID NO: 4400476 - DNA, 15 bp, Homo sapiens
tcagatgtaatgttt

SEQ ID NO: 4400477 - DNA, 16 bp, Homo sapiens
tcagatgtaatgtttt

SEQ ID NO: 4400478 - DNA, 17 bp, Homo sapiens
tcagatgtaatgttttc

SEQ ID NO: 4400479 - DNA, 13 bp, Homo sapiens
tcagatgtcttct

SEQ ID NO: 4400480 - DNA, 14 bp, Homo sapiens
tcagatgtcttctg

SEQ ID NO: 4400481 - DNA, 15 bp, Homo sapiens
tcagatgtcttctgc

SEQ ID NO: 4400482 - DNA, 16 bp, Homo sapiens
tcagatgtcttctgcc

SEQ ID NO: 4400483 - DNA, 17 bp, Homo sapiens
tcagatgtcttctgcct

SEQ ID NO: 4400484 - DNA, 21 bp, Homo sapiens
tcagatgtcttctgcctgtta

SEQ ID NO: 4400485 - DNA, 22 bp, Homo sapiens
tcagatgtcttctgcctgttat

SEQ ID NO: 4400486 - DNA, 15 bp, Homo sapiens
tcagatgtttcatca

SEQ ID NO: 4400487 - DNA, 17 bp, Homo sapiens
tcagatgtttcatcaat

SEQ ID NO: 4400488 - DNA, 18 bp, Homo sapiens
tcagatgtttcatcaatg

SEQ ID NO: 4400489 - DNA, 19 bp, Homo sapiens
tcagattgcttaaaagcat

SEQ ID NO: 4400490 - DNA, 21 bp, Homo sapiens
tcagattgcttaaaagcattt

SEQ ID NO: 4400491 - DNA, 22 bp, Homo sapiens
tcagattgcttaaaagcatttt

SEQ ID NO: 4400492 - DNA, 15 bp, Homo sapiens
tcagatttctgagga

SEQ ID NO: 4400493 - DNA, 17 bp, Homo sapiens
tcagatttgccttattg

SEQ ID NO: 4400494 - DNA, 22 bp, Homo sapiens
tcagatttgccttattggcagc

SEQ ID NO: 4400495 - DNA, 18 bp, Homo sapiens
tcagatttttatttatga

SEQ ID NO: 4400496 - DNA, 14 bp, Homo sapiens
tcagattttttaaa

SEQ ID NO: 4400497 - DNA, 20 bp, Homo sapiens
tcagcaaccctacagtatat

SEQ ID NO: 4400498 - DNA, 20 bp, Homo sapiens
tcagcaagctgcccagccct

SEQ ID NO: 4400499 - DNA, 23 bp, Homo sapiens
tcagcaagctgcccagccctggc

SEQ ID NO: 4400500 - DNA, 21 bp, Homo sapiens
tcagcacattcgggaccaata

SEQ ID NO: 4400501 - DNA, 13 bp, Homo sapiens
tcagcaccaccct

SEQ ID NO: 4400502 - DNA, 20 bp, Homo sapiens
tcagcacctacagtgtacag

SEQ ID NO: 4400503 - DNA, 18 bp, Homo sapiens
tcagcactctgtaaaacg

SEQ ID NO: 4400504 - DNA, 15 bp, Homo sapiens
tcagcagacactcca

SEQ ID NO: 4400505 - DNA, 20 bp, Homo sapiens
tcagcagacatttatctttg

SEQ ID NO: 4400506 - DNA, 22 bp, Homo sapiens
tcagcagcaaaaccaaactggg

SEQ ID NO: 4400507 - DNA, 15 bp, Homo sapiens
tcagcagcagctctg

SEQ ID NO: 4400508 - DNA, 12 bp, Homo sapiens
tcagcagccctc

SEQ ID NO: 4400509 - DNA, 17 bp, Homo sapiens
tcagcagccctcctcac

SEQ ID NO: 4400510 - DNA, 17 bp, Homo sapiens
tcagcagctctggctct

SEQ ID NO: 4400511 - DNA, 15 bp, Homo sapiens
tcagcagtattctat

SEQ ID NO: 4400512 - DNA, 13 bp, Homo sapiens
tcagcagtcatgc

SEQ ID NO: 4400513 - DNA, 11 bp, Homo sapiens
tcagcatatga

SEQ ID NO: 4400514 - DNA, 19 bp, Homo sapiens
tcagcatatgtgtaaagat

SEQ ID NO: 4400515 - DNA, 15 bp, Homo sapiens
tcagcatcactgatg

SEQ ID NO: 4400516 - DNA, 17 bp, Homo sapiens
tcagcatcactgatggg

SEQ ID NO: 4400517 - DNA, 18 bp, Homo sapiens
tcagcatcactgatggga

SEQ ID NO: 4400518 - DNA, 20 bp, Homo sapiens
tcagcatcactgatgggaat

SEQ ID NO: 4400519 - DNA, 15 bp, Homo sapiens
tcagcatgcaataca

SEQ ID NO: 4400520 - DNA, 16 bp, Homo sapiens
tcagcatgtctattca

SEQ ID NO: 4400521 - DNA, 19 bp, Homo sapiens
tcagcatgtctattcagct

SEQ ID NO: 4400522 - DNA, 11 bp, Homo sapiens
tcagcatttga

SEQ ID NO: 4400523 - DNA, 12 bp, Homo sapiens
tcagcatttgac

SEQ ID NO: 4400524 - DNA, 15 bp, Homo sapiens
tcagccaagtgcaga

SEQ ID NO: 4400525 - DNA, 19 bp, Homo sapiens
tcagccacaaagcccccca

SEQ ID NO: 4400526 - DNA, 22 bp, Homo sapiens
tcagccacatgccccaggctct

SEQ ID NO: 4400527 - DNA, 15 bp, Homo sapiens
tcagccagccgccct

SEQ ID NO: 4400528 - DNA, 18 bp, Homo sapiens
tcagccagccgccctggg

SEQ ID NO: 4400529 - DNA, 13 bp, Homo sapiens
tcagccagcctcc

SEQ ID NO: 4400530 - DNA, 16 bp, Homo sapiens
tcagccagcctccttg

SEQ ID NO: 4400531 - DNA, 12 bp, Homo sapiens
tcagccagctta

SEQ ID NO: 4400532 - DNA, 16 bp, Homo sapiens
tcagccagcttaaacc

SEQ ID NO: 4400533 - DNA, 18 bp, Homo sapiens
tcagccaggcgtggttac

SEQ ID NO: 4400534 - DNA, 16 bp, Homo sapiens
tcagccccagcccaga

SEQ ID NO: 4400535 - DNA, 14 bp, Homo sapiens
tcagccccaggcca

SEQ ID NO: 4400536 - DNA, 15 bp, Homo sapiens
tcagccccaggccag

SEQ ID NO: 4400537 - DNA, 16 bp, Homo sapiens
tcagccccaggccagc

SEQ ID NO: 4400538 - DNA, 19 bp, Homo sapiens
tcagccccaggccagctgc

SEQ ID NO: 4400539 - DNA, 18 bp, Homo sapiens
tcagcccccatcacccaa

SEQ ID NO: 4400540 - DNA, 17 bp, Homo sapiens
tcagccccgcctgtcac

SEQ ID NO: 4400541 - DNA, 22 bp, Homo sapiens
tcagcccctcctctgccacctc

SEQ ID NO: 4400542 - DNA, 23 bp, Homo sapiens
tcagcccctcctctgccacctcc

SEQ ID NO: 4400543 - DNA, 19 bp, Homo sapiens
tcagccctagggtggagag

SEQ ID NO: 4400544 - DNA, 19 bp, Homo sapiens
tcagccctcagttccttca

SEQ ID NO: 4400545 - DNA, 20 bp, Homo sapiens
ttattgccttctcaccagct

SEQ ID NO: 4400546 - DNA, 17 bp, Homo sapiens
ttattgcttagtaaaat

SEQ ID NO: 4400547 - DNA, 21 bp, Homo sapiens
ttattggatctattgatttga

SEQ ID NO: 4400548 - DNA, 22 bp, Homo sapiens
ttattggattagaccaattact

SEQ ID NO: 4400549 - DNA, 22 bp, Homo sapiens
ttattggctgagatatgaacat

SEQ ID NO: 4400550 - DNA, 19 bp, Homo sapiens
ttattggcttgataaacat

SEQ ID NO: 4400551 - DNA, 12 bp, Homo sapiens
ttattgtacttg

SEQ ID NO: 4400552 - DNA, 13 bp, Homo sapiens
ttattgtagtttg

SEQ ID NO: 4400553 - DNA, 21 bp, Homo sapiens
ttattgtctgtctacatttct

SEQ ID NO: 4400554 - DNA, 14 bp, Homo sapiens
ttattgttctttca

SEQ ID NO: 4400555 - DNA, 16 bp, Homo sapiens
ttattgtttgatgttt

SEQ ID NO: 4400556 - DNA, 15 bp, Homo sapiens
ttatttaaaactctg

SEQ ID NO: 4400557 - DNA, 16 bp, Homo sapiens
ttatttaaaactctgg

SEQ ID NO: 4400558 - DNA, 15 bp, Homo sapiens
ttatttaaaatagca

SEQ ID NO: 4400559 - DNA, 12 bp, Homo sapiens
ttatttaaatta

SEQ ID NO: 4400560 - DNA, 20 bp, Homo sapiens
ttatttaacaaaaaatgtaa

SEQ ID NO: 4400561 - DNA, 13 bp, Homo sapiens
ttatttaagcaat

SEQ ID NO: 4400562 - DNA, 12 bp, Homo sapiens
ttatttacaaaa

SEQ ID NO: 4400563 - DNA, 17 bp, Homo sapiens
ttatttacaagaagaac

SEQ ID NO: 4400564 - DNA, 17 bp, Homo sapiens
ttatttacccctcccct

SEQ ID NO: 4400565 - DNA, 14 bp, Homo sapiens
ttatttagacaaga

SEQ ID NO: 4400566 - DNA, 19 bp, Homo sapiens
ttatttatgacctgaaata

SEQ ID NO: 4400567 - DNA, 17 bp, Homo sapiens
ttatttattaaacttca

SEQ ID NO: 4400568 - DNA, 18 bp, Homo sapiens
ttatttcaatgtaattaa

SEQ ID NO: 4400569 - DNA, 24 bp, Homo sapiens
ttatttcaatgtaattaaactgtt

SEQ ID NO: 4400570 - DNA, 18 bp, Homo sapiens
ttatttcagattttgata

SEQ ID NO: 4400571 - DNA, 19 bp, Homo sapiens
ttatttcatgattagaaat

SEQ ID NO: 4400572 - DNA, 24 bp, Homo sapiens
ttatttcatgtggtgaatatgcaa

SEQ ID NO: 4400573 - DNA, 15 bp, Homo sapiens
ttatttccactaaaa

SEQ ID NO: 4400574 - DNA, 18 bp, Homo sapiens
ttatttccactaaaaata

SEQ ID NO: 4400575 - DNA, 19 bp, Homo sapiens
ttatttccactaaaaatat

SEQ ID NO: 4400576 - DNA, 13 bp, Homo sapiens
ttatttccccagc

SEQ ID NO: 4400577 - DNA, 17 bp, Homo sapiens
ttatttccccagccaca

SEQ ID NO: 4400578 - DNA, 18 bp, Homo sapiens
ttatttccccagccacag

SEQ ID NO: 4400579 - DNA, 19 bp, Homo sapiens
ttatttctagttctttcct

SEQ ID NO: 4400580 - DNA, 19 bp, Homo sapiens
ttatttctccatcccctcc

SEQ ID NO: 4400581 - DNA, 22 bp, Homo sapiens
ttatttctgatttcataattca

SEQ ID NO: 4400582 - DNA, 17 bp, Homo sapiens
ttatttctgctctggaa

SEQ ID NO: 4400583 - DNA, 19 bp, Homo sapiens
ttatttctgctctggaata

SEQ ID NO: 4400584 - DNA, 14 bp, Homo sapiens
ttatttctgtgaaa

SEQ ID NO: 4400585 - DNA, 20 bp, Homo sapiens
ttatttctgtgaaagaagta

SEQ ID NO: 4400586 - DNA, 11 bp, Homo sapiens
ttatttgcata

SEQ ID NO: 4400587 - DNA, 17 bp, Homo sapiens
ttatttgtaatagatgt

SEQ ID NO: 4400588 - DNA, 22 bp, Homo sapiens
ttatttgtcttaaaaaatgtga

SEQ ID NO: 4400589 - DNA, 16 bp, Homo sapiens
ttattttaaaatttca

SEQ ID NO: 4400590 - DNA, 12 bp, Homo sapiens
ttattttaaatt

SEQ ID NO: 4400591 - DNA, 15 bp, Homo sapiens
ttattttaaatttct

SEQ ID NO: 4400592 - DNA, 16 bp, Homo sapiens
ttattttaaatttctt

SEQ ID NO: 4400593 - DNA, 19 bp, Homo sapiens
ttattttagcaaatcagta

SEQ ID NO: 4400594 - DNA, 16 bp, Homo sapiens
ttattttagcagttct

SEQ ID NO: 4400595 - DNA, 20 bp, Homo sapiens
ttattttagcagttctgcaa

SEQ ID NO: 4400596 - DNA, 13 bp, Homo sapiens
ttattttagtata

SEQ ID NO: 4400597 - DNA, 17 bp, Homo sapiens
ttattttagtgtgtaaa

SEQ ID NO: 4400598 - DNA, 23 bp, Homo sapiens
ttattttagtgtgtaaaattaat

SEQ ID NO: 4400599 - DNA, 14 bp, Homo sapiens
ttattttatgttta

SEQ ID NO: 4400600 - DNA, 18 bp, Homo sapiens
ttattttattttagcagt

SEQ ID NO: 4400601 - DNA, 19 bp, Homo sapiens
ttattttcattctgccaaa

SEQ ID NO: 4400602 - DNA, 16 bp, Homo sapiens
ttattttcttccccaa

SEQ ID NO: 4400603 - DNA, 17 bp, Homo sapiens
ttattttgacataaagt

SEQ ID NO: 4400604 - DNA, 17 bp, Homo sapiens
ttatttttcctgtcctg

SEQ ID NO: 4400605 - DNA, 12 bp, Homo sapiens
ttatttttctga

SEQ ID NO: 4400606 - DNA, 16 bp, Homo sapiens
ttatttttgacagact

SEQ ID NO: 4400607 - DNA, 19 bp, Homo sapiens
ttattttttagtgatgaga

SEQ ID NO: 4400608 - DNA, 15 bp, Homo sapiens
ttcaaaaaaatctat

SEQ ID NO: 4400609 - DNA, 23 bp, Homo sapiens
ttcaaaaataaaaaatctgaaga

SEQ ID NO: 4400610 - DNA, 15 bp, Homo sapiens
ttcaaaagataatat

SEQ ID NO: 4400611 - DNA, 15 bp, Homo sapiens
ttcaaaatacttctt

SEQ ID NO: 4400612 - DNA, 19 bp, Homo sapiens
ttcaaaatagacaagtttt

SEQ ID NO: 4400613 - DNA, 13 bp, Homo sapiens
ttcaaaatattta

SEQ ID NO: 4400614 - DNA, 20 bp, Homo sapiens
ttcaaaatatttaaaaatgt

SEQ ID NO: 4400615 - DNA, 17 bp, Homo sapiens
ttcaaaatgctttttat

SEQ ID NO: 4400616 - DNA, 20 bp, Homo sapiens
ttcaaaatgctttttattat

SEQ ID NO: 4400617 - DNA, 18 bp, Homo sapiens
ttcaaacagtctcaggaa

SEQ ID NO: 4400618 - DNA, 17 bp, Homo sapiens
ttcaaacctaaaaatca

SEQ ID NO: 4400619 - DNA, 18 bp, Homo sapiens
ttcaaacttttgaaagat

SEQ ID NO: 4400620 - DNA, 17 bp, Homo sapiens
ttcaaagactcaaattt

SEQ ID NO: 4400621 - DNA, 18 bp, Homo sapiens
ttcaaagactcaaatttt

SEQ ID NO: 4400622 - DNA, 22 bp, Homo sapiens
ttcaaagaggtgaacattaaaa

SEQ ID NO: 4400623 - DNA, 16 bp, Homo sapiens
ttcaaagatgataatt

SEQ ID NO: 4400624 - DNA, 19 bp, Homo sapiens
ttcaaagcaattgaaatgc

SEQ ID NO: 4400625 - DNA, 22 bp, Homo sapiens
ttcaaagcaattgaaatgcatt

SEQ ID NO: 4400626 - DNA, 11 bp, Homo sapiens
ttcaaagtctc

SEQ ID NO: 4400627 - DNA, 19 bp, Homo sapiens
ttcaaagtctcaatgaaat

SEQ ID NO: 4400628 - DNA, 14 bp, Homo sapiens
ttcaaagtttaata

SEQ ID NO: 4400629 - DNA, 18 bp, Homo sapiens
ttcaaatagggtctaact

SEQ ID NO: 4400630 - DNA, 19 bp, Homo sapiens
ttcaaatagggtctaactc

SEQ ID NO: 4400631 - DNA, 16 bp, Homo sapiens
ttcaaatcctcttttg

SEQ ID NO: 4400632 - DNA, 13 bp, Homo sapiens
ttcaaatgcattt

SEQ ID NO: 4400633 - DNA, 11 bp, Homo sapiens
ttcaaatgtgc

SEQ ID NO: 4400634 - DNA, 16 bp, Homo sapiens
ttcaaatgttagatat

SEQ ID NO: 4400635 - DNA, 11 bp, Homo sapiens
ttcaaatttag

SEQ ID NO: 4400636 - DNA, 14 bp, Homo sapiens
ttcaaatttgtaat

SEQ ID NO: 4400637 - DNA, 21 bp, Homo sapiens
ttcaaatttgtaataaaacta

SEQ ID NO: 4400638 - DNA, 21 bp, Homo sapiens
ttcaacaaagaaacaaagatg

SEQ ID NO: 4400639 - DNA, 13 bp, Homo sapiens
ttcaacaattggt

SEQ ID NO: 4400640 - DNA, 21 bp, Homo sapiens
ttcaacaattggtgtcatttt

SEQ ID NO: 4400641 - DNA, 20 bp, Homo sapiens
ttcaacctcagccctgaaaa

SEQ ID NO: 4400642 - DNA, 19 bp, Homo sapiens
ttcaacctggtggcaccag

SEQ ID NO: 4400643 - DNA, 16 bp, Homo sapiens
ttcaacggaaagtgct

SEQ ID NO: 4400644 - DNA, 15 bp, Homo sapiens
ttcaactgtcttcct

SEQ ID NO: 4400645 - DNA, 15 bp, Homo sapiens
ttcaactttgaataa

SEQ ID NO: 4400646 - DNA, 12 bp, Homo sapiens
ttcaacttttct

SEQ ID NO: 4400647 - DNA, 13 bp, Homo sapiens
ttcaagaaaggaa

SEQ ID NO: 4400648 - DNA, 15 bp, Homo sapiens
ttcaagaagtaatca

SEQ ID NO: 4400649 - DNA, 18 bp, Homo sapiens
ttcaagaagtaatcagta

SEQ ID NO: 4400650 - DNA, 14 bp, Homo sapiens
ttcaagaccagcct

SEQ ID NO: 4400651 - DNA, 23 bp, Homo sapiens
ttcaagataaggagaaagaaagt

SEQ ID NO: 4400652 - DNA, 16 bp, Homo sapiens
ttcaagcagcatcttc

SEQ ID NO: 4400653 - DNA, 14 bp, Homo sapiens
ttcaagccattcca

SEQ ID NO: 4400654 - DNA, 20 bp, Homo sapiens
ttcaagcctgtgggagtaga

SEQ ID NO: 4400655 - DNA, 17 bp, Homo sapiens
ttcaaggactgtttcag

SEQ ID NO: 4400656 - DNA, 17 bp, Homo sapiens
ttcaaggaggcccactg

SEQ ID NO: 4400657 - DNA, 16 bp, Homo sapiens
ttcaaggcatttgtct

SEQ ID NO: 4400658 - DNA, 13 bp, Homo sapiens
ttcaaggctcaga

SEQ ID NO: 4400659 - DNA, 13 bp, Homo sapiens
ttcaaggctttaa

SEQ ID NO: 4400660 - DNA, 19 bp, Homo sapiens
ttcaaggctttaaaagtca

SEQ ID NO: 4400661 - DNA, 20 bp, Homo sapiens
ttcaagtgcttaaaaatact

SEQ ID NO: 4400662 - DNA, 19 bp, Homo sapiens
ttcaagtgtaaaatatttt

SEQ ID NO: 4400663 - DNA, 16 bp, Homo sapiens
ttcaagttttaaagtt

SEQ ID NO: 4400664 - DNA, 14 bp, Homo sapiens
ttcaagtttttcat

SEQ ID NO: 4400665 - DNA, 19 bp, Homo sapiens
ttcaagtttttcatactgt

SEQ ID NO: 4400666 - DNA, 15 bp, Homo sapiens
tgtgaggccagggca

SEQ ID NO: 4400667 - DNA, 17 bp, Homo sapiens
tgtgaggccagggcaga

SEQ ID NO: 4400668 - DNA, 15 bp, Homo sapiens
tgtgagggtgctgac

SEQ ID NO: 4400669 - DNA, 16 bp, Homo sapiens
tgtgagtcaatacata

SEQ ID NO: 4400670 - DNA, 21 bp, Homo sapiens
tgtgagtcaatacatagtgct

SEQ ID NO: 4400671 - DNA, 21 bp, Homo sapiens
tgtgagtggttctgagcaaat

SEQ ID NO: 4400672 - DNA, 17 bp, Homo sapiens
tgtgatatgtctgctga

SEQ ID NO: 4400673 - DNA, 16 bp, Homo sapiens
tgtgatattctgttgc

SEQ ID NO: 4400674 - DNA, 17 bp, Homo sapiens
tgtgatattctgttgct

SEQ ID NO: 4400675 - DNA, 22 bp, Homo sapiens
tgtgatcttaaaataattcata

SEQ ID NO: 4400676 - DNA, 11 bp, Homo sapiens
tgtgatgtgtc

SEQ ID NO: 4400677 - DNA, 22 bp, Homo sapiens
tgtgattactctttgctttgta

SEQ ID NO: 4400678 - DNA, 13 bp, Homo sapiens
tgtgattagatca

SEQ ID NO: 4400679 - DNA, 15 bp, Homo sapiens
tgtgattatttttct

SEQ ID NO: 4400680 - DNA, 15 bp, Homo sapiens
tgtgattcaatctgt

SEQ ID NO: 4400681 - DNA, 22 bp, Homo sapiens
tgtgattccactacacctggct

SEQ ID NO: 4400682 - DNA, 14 bp, Homo sapiens
tgtgattgtggaat

SEQ ID NO: 4400683 - DNA, 14 bp, Homo sapiens
tgtgatttatcttt

SEQ ID NO: 4400684 - DNA, 21 bp, Homo sapiens
tgtgatttctttaaaagaatg

SEQ ID NO: 4400685 - DNA, 22 bp, Homo sapiens
tgtgattttaagacaagctgta

SEQ ID NO: 4400686 - DNA, 16 bp, Homo sapiens
tgtgcaaacagtaacg

SEQ ID NO: 4400687 - DNA, 14 bp, Homo sapiens
tgtgcaacttttta

SEQ ID NO: 4400688 - DNA, 13 bp, Homo sapiens
tgtgcaatagaag

SEQ ID NO: 4400689 - DNA, 16 bp, Homo sapiens
tgtgcaatagaaggtg

SEQ ID NO: 4400690 - DNA, 17 bp, Homo sapiens
tgtgcaatgtaaatatt

SEQ ID NO: 4400691 - DNA, 18 bp, Homo sapiens
tgtgcaatgtaaatattt

SEQ ID NO: 4400692 - DNA, 18 bp, Homo sapiens
tgtgcaatttctgtacat

SEQ ID NO: 4400693 - DNA, 20 bp, Homo sapiens
tgtgcacatctgtgtcttgt

SEQ ID NO: 4400694 - DNA, 21 bp, Homo sapiens
tgtgcacatctgtgtcttgtt

SEQ ID NO: 4400695 - DNA, 18 bp, Homo sapiens
tgtgcacatgcctctgta

SEQ ID NO: 4400696 - DNA, 18 bp, Homo sapiens
tgtgcagaaaatatttaa

SEQ ID NO: 4400697 - DNA, 13 bp, Homo sapiens
tgtgcagatgaag

SEQ ID NO: 4400698 - DNA, 19 bp, Homo sapiens
tgtgcagccgctgagcgag

SEQ ID NO: 4400699 - DNA, 21 bp, Homo sapiens
tgtgcaggcctgtccctggga

SEQ ID NO: 4400700 - DNA, 21 bp, Homo sapiens
tgtgcaggctgcagtggctcc

SEQ ID NO: 4400701 - DNA, 19 bp, Homo sapiens
tgtgcagggatattgcctt

SEQ ID NO: 4400702 - DNA, 19 bp, Homo sapiens
tgtgcaggtgctattgtta

SEQ ID NO: 4400703 - DNA, 21 bp, Homo sapiens
tgtgcaggtgctattgttact

SEQ ID NO: 4400704 - DNA, 16 bp, Homo sapiens
tgtgcaggtggggaga

SEQ ID NO: 4400705 - DNA, 16 bp, Homo sapiens
tgtgcagtgtttttcc

SEQ ID NO: 4400706 - DNA, 16 bp, Homo sapiens
tgtgcagttgctgttt

SEQ ID NO: 4400707 - DNA, 13 bp, Homo sapiens
tgtgcataatgct

SEQ ID NO: 4400708 - DNA, 18 bp, Homo sapiens
tgtgcatatttgttactt

SEQ ID NO: 4400709 - DNA, 22 bp, Homo sapiens
tgtgcatgcataccacaagaca

SEQ ID NO: 4400710 - DNA, 13 bp, Homo sapiens
tgtgcatggaagt

SEQ ID NO: 4400711 - DNA, 19 bp, Homo sapiens
tgtgcattttgtggaattt

SEQ ID NO: 4400712 - DNA, 22 bp, Homo sapiens
tgtgccaactgccaggctgcct

SEQ ID NO: 4400713 - DNA, 23 bp, Homo sapiens
tgtgccaatcaatagcaccccta

SEQ ID NO: 4400714 - DNA, 20 bp, Homo sapiens
tgtgccacagaggccccacc

SEQ ID NO: 4400715 - DNA, 21 bp, Homo sapiens
tgtgccacagaggccccacct

SEQ ID NO: 4400716 - DNA, 14 bp, Homo sapiens
tgtgccacattttc

SEQ ID NO: 4400717 - DNA, 17 bp, Homo sapiens
tgtgccaccatgcctca

SEQ ID NO: 4400718 - DNA, 19 bp, Homo sapiens
tgtgccactgttcagcgga

SEQ ID NO: 4400719 - DNA, 21 bp, Homo sapiens
tgtgccactgttcagcggagc

SEQ ID NO: 4400720 - DNA, 21 bp, Homo sapiens
tgtgccagggcaatgatgaat

SEQ ID NO: 4400721 - DNA, 15 bp, Homo sapiens
tgtgccctccaaaga

SEQ ID NO: 4400722 - DNA, 16 bp, Homo sapiens
tgtgccctccaaagag

SEQ ID NO: 4400723 - DNA, 18 bp, Homo sapiens
tgtgccgctgccacccgc

SEQ ID NO: 4400724 - DNA, 16 bp, Homo sapiens
tgtgccgggaggcagc

SEQ ID NO: 4400725 - DNA, 16 bp, Homo sapiens
tgtgcctggccccagc

SEQ ID NO: 4400726 - DNA, 15 bp, Homo sapiens
tgtgcctggtagaaa

SEQ ID NO: 4400727 - DNA, 20 bp, Homo sapiens
tgtgcctggttaatattaat

SEQ ID NO: 4400728 - DNA, 19 bp, Homo sapiens
tgtgccttgtcacgccaga

SEQ ID NO: 4400729 - DNA, 20 bp, Homo sapiens
tgtgccttgtcacgccagac

SEQ ID NO: 4400730 - DNA, 10 bp, Homo sapiens
tgtgcctttc

SEQ ID NO: 4400731 - DNA, 17 bp, Homo sapiens
tgtgcctttcctatcac

SEQ ID NO: 4400732 - DNA, 16 bp, Homo sapiens
tgtgcctttctttgcc

SEQ ID NO: 4400733 - DNA, 20 bp, Homo sapiens
tgtgcctttctttgcctctg

SEQ ID NO: 4400734 - DNA, 21 bp, Homo sapiens
tgtgcctttctttgcctctgc

SEQ ID NO: 4400735 - DNA, 10 bp, Homo sapiens
tgtgcctttg

SEQ ID NO: 4400736 - DNA, 16 bp, Homo sapiens
tgtgcctttggcctgg

SEQ ID NO: 4400737 - DNA, 22 bp, Homo sapiens
tgtgctacaattcattgtgtta

SEQ ID NO: 4400738 - DNA, 20 bp, Homo sapiens
tgtgctatactgcatacttt

SEQ ID NO: 4400739 - DNA, 18 bp, Homo sapiens
tgtgctatagtatttgat

SEQ ID NO: 4400740 - DNA, 16 bp, Homo sapiens
tgtgctattaatattt

SEQ ID NO: 4400741 - DNA, 18 bp, Homo sapiens
tgtgctattaatatttgt

SEQ ID NO: 4400742 - DNA, 13 bp, Homo sapiens
tgtgctcagccaa

SEQ ID NO: 4400743 - DNA, 15 bp, Homo sapiens
tgtgctctattacca

SEQ ID NO: 4400744 - DNA, 13 bp, Homo sapiens
tgtgctctggagg

SEQ ID NO: 4400745 - DNA, 23 bp, Homo sapiens
tgtgctgaagcaaagtgcccatg

SEQ ID NO: 4400746 - DNA, 23 bp, Homo sapiens
tgtgttactaaaaaaaagatgaa

SEQ ID NO: 4400747 - DNA, 13 bp, Homo sapiens
tgtgttcaatatc

SEQ ID NO: 4400748 - DNA, 15 bp, Homo sapiens
tgtgttcatttcatt

SEQ ID NO: 4400749 - DNA, 18 bp, Homo sapiens
tgtgttccctttgtcttt

SEQ ID NO: 4400750 - DNA, 13 bp, Homo sapiens
tgtgttctatcca

SEQ ID NO: 4400751 - DNA, 22 bp, Homo sapiens
tgtgttctgggctggggccacc

SEQ ID NO: 4400752 - DNA, 23 bp, Homo sapiens
tgtgttctgggctggggccacct

SEQ ID NO: 4400753 - DNA, 17 bp, Homo sapiens
tgtgttctttaaataaa

SEQ ID NO: 4400754 - DNA, 14 bp, Homo sapiens
tgtgttcttttctc

SEQ ID NO: 4400755 - DNA, 15 bp, Homo sapiens
tgtgttgaaggaact

SEQ ID NO: 4400756 - DNA, 23 bp, Homo sapiens
tgtgttgatgactcactcataaa

SEQ ID NO: 4400757 - DNA, 17 bp, Homo sapiens
tgtgttgcactgaacag

SEQ ID NO: 4400758 - DNA, 22 bp, Homo sapiens
tgtgttgccacagtagaactgt

SEQ ID NO: 4400759 - DNA, 15 bp, Homo sapiens
tgtgtttatatggaa

SEQ ID NO: 4400760 - DNA, 19 bp, Homo sapiens
tgtgtttcattacttgaat

SEQ ID NO: 4400761 - DNA, 23 bp, Homo sapiens
tgtgtttgtttttcaagaaatga

SEQ ID NO: 4400762 - DNA, 16 bp, Homo sapiens
tgtgttttcagactgc

SEQ ID NO: 4400763 - DNA, 14 bp, Homo sapiens
tgtgttttcatcat

SEQ ID NO: 4400764 - DNA, 17 bp, Homo sapiens
tgtgttttcatcatttc

SEQ ID NO: 4400765 - DNA, 13 bp, Homo sapiens
tgtgttttctgta

SEQ ID NO: 4400766 - DNA, 15 bp, Homo sapiens
tgtgttttgtctttt

SEQ ID NO: 4400767 - DNA, 16 bp, Homo sapiens
tgtgtttttaaatttt

SEQ ID NO: 4400768 - DNA, 15 bp, Homo sapiens
tgtgtttttaacatg

SEQ ID NO: 4400769 - DNA, 18 bp, Homo sapiens
tgtgtttttctttttcca

SEQ ID NO: 4400770 - DNA, 15 bp, Homo sapiens
tgtgttttttaagat

SEQ ID NO: 4400771 - DNA, 16 bp, Homo sapiens
tgtgttttttaagata

SEQ ID NO: 4400772 - DNA, 17 bp, Homo sapiens
tgtgttttttaagatag

SEQ ID NO: 4400773 - DNA, 14 bp, Homo sapiens
tgttaaaaatgtca

SEQ ID NO: 4400774 - DNA, 21 bp, Homo sapiens
tgttaaaagatgaaaatattt

SEQ ID NO: 4400775 - DNA, 16 bp, Homo sapiens
tgttaaaattaatata

SEQ ID NO: 4400776 - DNA, 12 bp, Homo sapiens
tgttaaacacta

SEQ ID NO: 4400777 - DNA, 17 bp, Homo sapiens
tgttaacctttctaacc

SEQ ID NO: 4400778 - DNA, 19 bp, Homo sapiens
tgttaactgttcttggaaa

SEQ ID NO: 4400779 - DNA, 14 bp, Homo sapiens
tgttaacttattca

SEQ ID NO: 4400780 - DNA, 15 bp, Homo sapiens
tgttaacttattcaa

SEQ ID NO: 4400781 - DNA, 13 bp, Homo sapiens
tgttaataaaagt

SEQ ID NO: 4400782 - DNA, 18 bp, Homo sapiens
tgttaatacatcacatct

SEQ ID NO: 4400783 - DNA, 15 bp, Homo sapiens
tgttaatactgtatt

SEQ ID NO: 4400784 - DNA, 21 bp, Homo sapiens
tgttaatatcactcattaatt

SEQ ID NO: 4400785 - DNA, 13 bp, Homo sapiens
tgttaatatttta

SEQ ID NO: 4400786 - DNA, 17 bp, Homo sapiens
tgttaatcttaatgtat

SEQ ID NO: 4400787 - DNA, 18 bp, Homo sapiens
tgttaatgactctttctg

SEQ ID NO: 4400788 - DNA, 22 bp, Homo sapiens
tgttaatgcattgttgtaaagt

SEQ ID NO: 4400789 - DNA, 18 bp, Homo sapiens
tgttaatttataatgtat

SEQ ID NO: 4400790 - DNA, 23 bp, Homo sapiens
tgttaatttataggcgttttttg

SEQ ID NO: 4400791 - DNA, 13 bp, Homo sapiens
tgttaatttttga

SEQ ID NO: 4400792 - DNA, 16 bp, Homo sapiens
tgttaatttttgatac

SEQ ID NO: 4400793 - DNA, 19 bp, Homo sapiens
tgttaattttttggtacaa

SEQ ID NO: 4400794 - DNA, 20 bp, Homo sapiens
tgttacaaattttttaattt

SEQ ID NO: 4400795 - DNA, 22 bp, Homo sapiens
tgttacacaatggtttttaaat

SEQ ID NO: 4400796 - DNA, 19 bp, Homo sapiens
tgttaccaaaaataaatat

SEQ ID NO: 4400797 - DNA, 23 bp, Homo sapiens
tgttaccaaaaataaatatatct

SEQ ID NO: 4400798 - DNA, 14 bp, Homo sapiens
tgttacctgtagat

SEQ ID NO: 4400799 - DNA, 19 bp, Homo sapiens
tgttacgtttgaagtctga

SEQ ID NO: 4400800 - DNA, 18 bp, Homo sapiens
tgttactgacttggatcc

SEQ ID NO: 4400801 - DNA, 12 bp, Homo sapiens
tgttactgcctt

SEQ ID NO: 4400802 - DNA, 22 bp, Homo sapiens
tgttactgctgattcttgtaaa

SEQ ID NO: 4400803 - DNA, 12 bp, Homo sapiens
tgttactgcttc

SEQ ID NO: 4400804 - DNA, 21 bp, Homo sapiens
tgttactgcttctctttgtgc

SEQ ID NO: 4400805 - DNA, 14 bp, Homo sapiens
tgttacttccttat

SEQ ID NO: 4400806 - DNA, 22 bp, Homo sapiens
tgttagaaaatgacttatttct

SEQ ID NO: 4400807 - DNA, 23 bp, Homo sapiens
tgttagacttgctccctctccaa

SEQ ID NO: 4400808 - DNA, 13 bp, Homo sapiens
tgttagacttgtg

SEQ ID NO: 4400809 - DNA, 17 bp, Homo sapiens
tgttagacttgtgtgca

SEQ ID NO: 4400810 - DNA, 17 bp, Homo sapiens
tgttagagagaaagaga

SEQ ID NO: 4400811 - DNA, 13 bp, Homo sapiens
tgttagatattgc

SEQ ID NO: 4400812 - DNA, 14 bp, Homo sapiens
tgttagatattgct

SEQ ID NO: 4400813 - DNA, 17 bp, Homo sapiens
tgttagatgtttgttga

SEQ ID NO: 4400814 - DNA, 12 bp, Homo sapiens
tgttagcaaaga

SEQ ID NO: 4400815 - DNA, 23 bp, Homo sapiens
tgttagcaaatgacagatttctg

SEQ ID NO: 4400816 - DNA, 19 bp, Homo sapiens
tgttaggagatgtcatcaa

SEQ ID NO: 4400817 - DNA, 21 bp, Homo sapiens
tgttagggtataagttgctgt

SEQ ID NO: 4400818 - DNA, 23 bp, Homo sapiens
tgttagggtataagttgctgtaa

SEQ ID NO: 4400819 - DNA, 14 bp, Homo sapiens
tgttgcgttccttt

SEQ ID NO: 4400820 - DNA, 18 bp, Homo sapiens
tgttgctgctactgtctt

SEQ ID NO: 4400821 - DNA, 14 bp, Homo sapiens
tgttgcttcaaatt

SEQ ID NO: 4400822 - DNA, 19 bp, Homo sapiens
tgttgctttaatatgagct

SEQ ID NO: 4400823 - DNA, 16 bp, Homo sapiens
tgttgctttacagtta

SEQ ID NO: 4400824 - DNA, 14 bp, Homo sapiens
tgttggaaaaaatt

SEQ ID NO: 4400825 - DNA, 21 bp, Homo sapiens
tgttggataaggaattataga

SEQ ID NO: 4400826 - DNA, 17 bp, Homo sapiens
tgttggattccatgcta

SEQ ID NO: 4400827 - DNA, 20 bp, Homo sapiens
tgttggatttttgtcttgtg

SEQ ID NO: 4400828 - DNA, 13 bp, Homo sapiens
tgttggcaggccc

SEQ ID NO: 4400829 - DNA, 15 bp, Homo sapiens
tgttggcaggcccac

SEQ ID NO: 4400830 - DNA, 17 bp, Homo sapiens
tgttggcctcttcaggc

SEQ ID NO: 4400831 - DNA, 23 bp, Homo sapiens
tgttggcgtggggcctttgtcag

SEQ ID NO: 4400832 - DNA, 15 bp, Homo sapiens
tgttggctttttgaa

SEQ ID NO: 4400833 - DNA, 14 bp, Homo sapiens
tgttgggactgcta

SEQ ID NO: 4400834 - DNA, 18 bp, Homo sapiens
tgttgggagtgaggatgt

SEQ ID NO: 4400835 - DNA, 18 bp, Homo sapiens
tgttgggatcgcattgca

SEQ ID NO: 4400836 - DNA, 14 bp, Homo sapiens
tgttggtcatttta

SEQ ID NO: 4400837 - DNA, 15 bp, Homo sapiens
tgttggtctgtagca

SEQ ID NO: 4400838 - DNA, 17 bp, Homo sapiens
tgttgtaaaacaaaatt

SEQ ID NO: 4400839 - DNA, 23 bp, Homo sapiens
tgttgtccctactttctctctct

SEQ ID NO: 4400840 - DNA, 18 bp, Homo sapiens
tgttgtcgtaaagatttg

SEQ ID NO: 4400841 - DNA, 14 bp, Homo sapiens
tgttgtctccactt

SEQ ID NO: 4400842 - DNA, 17 bp, Homo sapiens
tgttgtgtgtatatgta

SEQ ID NO: 4400843 - DNA, 16 bp, Homo sapiens
tgttgtgtgtgggagt

SEQ ID NO: 4400844 - DNA, 16 bp, Homo sapiens
tgttgtttcttaaata

SEQ ID NO: 4400845 - DNA, 11 bp, Homo sapiens
tgttgtttgcc

SEQ ID NO: 4400846 - DNA, 12 bp, Homo sapiens
tgttgtttgtaa

SEQ ID NO: 4400847 - DNA, 12 bp, Homo sapiens
tgtttaaaataa

SEQ ID NO: 4400848 - DNA, 13 bp, Homo sapiens
tgtttaaaatcat

SEQ ID NO: 4400849 - DNA, 21 bp, Homo sapiens
tgtttaaacccaagtgctgca

SEQ ID NO: 4400850 - DNA, 14 bp, Homo sapiens
tgtttaaacctttt

SEQ ID NO: 4400851 - DNA, 22 bp, Homo sapiens
tgtttaaagtgtacttataaac

SEQ ID NO: 4400852 - DNA, 12 bp, Homo sapiens
tgtttaaagttc

SEQ ID NO: 4400853 - DNA, 23 bp, Homo sapiens
tgtttaaagttcaacatgttatt

SEQ ID NO: 4400854 - DNA, 20 bp, Homo sapiens
tgtttaagatatatttccaa

SEQ ID NO: 4400855 - DNA, 21 bp, Homo sapiens
tgtttacaaaaatttctgtaa

SEQ ID NO: 4400856 - DNA, 21 bp, Homo sapiens
tgtttacagcactactctgtg

SEQ ID NO: 4400857 - DNA, 23 bp, Homo sapiens
tgtttacagcactactctgtgcc

SEQ ID NO: 4400858 - DNA, 22 bp, Homo sapiens
tgtttacatcaaagcttcttca

SEQ ID NO: 4400859 - DNA, 17 bp, Homo sapiens
tgtttacatttgatgca

SEQ ID NO: 4400860 - DNA, 14 bp, Homo sapiens
tgtttaccattttt

SEQ ID NO: 4400861 - DNA, 13 bp, Homo sapiens
tgtttactaggga

SEQ ID NO: 4400862 - DNA, 19 bp, Homo sapiens
tgtttactagggatccctc

SEQ ID NO: 4400863 - DNA, 14 bp, Homo sapiens
tgtttactgtatca

SEQ ID NO: 4400864 - DNA, 22 bp, Homo sapiens
tgtttactgtatcaatttctaa

SEQ ID NO: 4400865 - DNA, 22 bp, Homo sapiens
tgtttacttgaatagtattgtg

SEQ ID NO: 4400866 - DNA, 19 bp, Homo sapiens
tgtttagaagaagtgtgtc

SEQ ID NO: 4400867 - DNA, 15 bp, Homo sapiens
tgtttagatgaatgt

SEQ ID NO: 4400868 - DNA, 11 bp, Homo sapiens
tgtttagatgt

SEQ ID NO: 4400869 - DNA, 13 bp, Homo sapiens
tgtttagtggaaa

SEQ ID NO: 4400870 - DNA, 23 bp, Homo sapiens
tgtttataaatagcatttggaaa

SEQ ID NO: 4400871 - DNA, 19 bp, Homo sapiens
tgtttataaatcttatgct

SEQ ID NO: 4400872 - DNA, 21 bp, Homo sapiens
tgtttataaatgttctggtat

SEQ ID NO: 4400873 - DNA, 14 bp, Homo sapiens
tgtttatagcaaaa

SEQ ID NO: 4400874 - DNA, 21 bp, Homo sapiens
tgtttatatacagtacacaga

SEQ ID NO: 4400875 - DNA, 16 bp, Homo sapiens
tgtttatatcactgtc

SEQ ID NO: 4400876 - DNA, 19 bp, Homo sapiens
tgtttatgatatttcttgc

SEQ ID NO: 4400877 - DNA, 22 bp, Homo sapiens
tgtttatggaaatattaagaac

SEQ ID NO: 4400878 - DNA, 14 bp, Homo sapiens
tgtttatggcctca

SEQ ID NO: 4400879 - DNA, 13 bp, Homo sapiens
tgtttatggtaaa

SEQ ID NO: 4400880 - DNA, 16 bp, Homo sapiens
tgtttatggtaaaaaa

SEQ ID NO: 4400881 - DNA, 14 bp, Homo sapiens
tgtttatgtaatag

SEQ ID NO: 4400882 - DNA, 22 bp, Homo sapiens
tgtttatgtgctattaatattt

SEQ ID NO: 4400883 - DNA, 14 bp, Homo sapiens
tgtttatgttttta

SEQ ID NO: 4400884 - DNA, 17 bp, Homo sapiens
tgtttattccttctgta

SEQ ID NO: 4400885 - DNA, 14 bp, Homo sapiens
tgtttattgttttt

SEQ ID NO: 4400886 - DNA, 12 bp, Homo sapiens
tgtttattttga

SEQ ID NO: 4400887 - DNA, 12 bp, Homo sapiens
tgtttatttttc

SEQ ID NO: 4400888 - DNA, 21 bp, Homo sapiens
tgtttattttttattattttt

SEQ ID NO: 4400889 - DNA, 21 bp, Homo sapiens
tgtttcaaaatagacaagttt

SEQ ID NO: 4400890 - DNA, 18 bp, Homo sapiens
tgtttcaaactgtaaaaa

SEQ ID NO: 4400891 - DNA, 15 bp, Homo sapiens
tgtttcagaaaacat

SEQ ID NO: 4400892 - DNA, 14 bp, Homo sapiens
tgtttcagagcata

SEQ ID NO: 4400893 - DNA, 13 bp, Homo sapiens
tgtttcatcaatg

SEQ ID NO: 4400894 - DNA, 18 bp, Homo sapiens
tgtttcattacttgaatg

SEQ ID NO: 4400895 - DNA, 20 bp, Homo sapiens
tgtttccatgttatgtttct

SEQ ID NO: 4400896 - DNA, 20 bp, Homo sapiens
tgtttccattttaaggatat

SEQ ID NO: 4400897 - DNA, 12 bp, Homo sapiens
tgtttcctgaca

SEQ ID NO: 4400898 - DNA, 13 bp, Homo sapiens
tgtttctacaata

SEQ ID NO: 4400899 - DNA, 16 bp, Homo sapiens
tgtttctagttgagga

SEQ ID NO: 4400900 - DNA, 13 bp, Homo sapiens
tgtttctctgctg

SEQ ID NO: 4400901 - DNA, 19 bp, Homo sapiens
tgtttctgactctgagcta

SEQ ID NO: 4400902 - DNA, 12 bp, Homo sapiens
tgtttctgattt

SEQ ID NO: 4400903 - DNA, 18 bp, Homo sapiens
tgtttctggcttagaaca

SEQ ID NO: 4400904 - DNA, 13 bp, Homo sapiens
tgtttctgtcaag

SEQ ID NO: 4400905 - DNA, 16 bp, Homo sapiens
tgtttctgttccaaat

SEQ ID NO: 4400906 - DNA, 15 bp, Homo sapiens
tgtttctttcttcct

SEQ ID NO: 4400907 - DNA, 13 bp, Homo sapiens
tgtttgactgtaa

SEQ ID NO: 4400908 - DNA, 12 bp, Homo sapiens
tgtttgatgcag

SEQ ID NO: 4400909 - DNA, 16 bp, Homo sapiens
tgtttgcccattttca

SEQ ID NO: 4400910 - DNA, 14 bp, Homo sapiens
tgtttgcttaaaat

SEQ ID NO: 4400911 - DNA, 22 bp, Homo sapiens
tgtttgcttcttgccatcactg

SEQ ID NO: 4400912 - DNA, 23 bp, Homo sapiens
tgtttgcttcttgccatcactgg

SEQ ID NO: 4400913 - DNA, 16 bp, Homo sapiens
tgtttggaaaagacag

SEQ ID NO: 4400914 - DNA, 21 bp, Homo sapiens
tgtttggtataaattaatttg

SEQ ID NO: 4400915 - DNA, 17 bp, Homo sapiens
tgtttgtaaatgcctct

SEQ ID NO: 4400916 - DNA, 20 bp, Homo sapiens
tgtttgtacacaacaatcct

SEQ ID NO: 4400917 - DNA, 14 bp, Homo sapiens
tgtttgtgctgtgg

SEQ ID NO: 4400918 - DNA, 15 bp, Homo sapiens
tgtttgtgctgtggt

SEQ ID NO: 4400919 - DNA, 12 bp, Homo sapiens
tgtttgtgtatt

SEQ ID NO: 4400920 - DNA, 16 bp, Homo sapiens
tgtttgtgtgcatgaa

SEQ ID NO: 4400921 - DNA, 20 bp, Homo sapiens
tgtttgtgtgcatgaaagag

SEQ ID NO: 4400922 - DNA, 19 bp, Homo sapiens
tgtttgtgttcaatatcag

SEQ ID NO: 4400923 - DNA, 21 bp, Homo sapiens
tgtttgtttatatcactgtct

SEQ ID NO: 4400924 - DNA, 13 bp, Homo sapiens
tgtttgtttcttt

SEQ ID NO: 4400925 - DNA, 12 bp, Homo sapiens
tgttttaaagaa

SEQ ID NO: 4400926 - DNA, 22 bp, Homo sapiens
tgttttaaagaatatgactttt

SEQ ID NO: 4400927 - DNA, 22 bp, Homo sapiens
tgttttacaatagttctgtggg

SEQ ID NO: 4400928 - DNA, 15 bp, Homo sapiens
tgttttactgtcaga

SEQ ID NO: 4400929 - DNA, 22 bp, Homo sapiens
tgttttactgtcagattaaatt

SEQ ID NO: 4400930 - DNA, 14 bp, Homo sapiens
tgttttatatatta

SEQ ID NO: 4400931 - DNA, 21 bp, Homo sapiens
tgttttatatattatgtgaag

SEQ ID NO: 4400932 - DNA, 23 bp, Homo sapiens
tgttttatatattatgtgaagaa

SEQ ID NO: 4400933 - DNA, 14 bp, Homo sapiens
tgttttcaaatgtt

SEQ ID NO: 4400934 - DNA, 14 bp, Homo sapiens
tgttttcatcattt

SEQ ID NO: 4400935 - DNA, 17 bp, Homo sapiens
tgttttcatcatttcag

SEQ ID NO: 4400936 - DNA, 18 bp, Homo sapiens
tgttttcatcatttcagc

SEQ ID NO: 4400937 - DNA, 22 bp, Homo sapiens
tgttttcatcatttcagccaaa

SEQ ID NO: 4400938 - DNA, 15 bp, Homo sapiens
ttaaacttgtgaatg

SEQ ID NO: 4400939 - DNA, 19 bp, Homo sapiens
ttaaactttgtcacttctg

SEQ ID NO: 4400940 - DNA, 14 bp, Homo sapiens
ttaaactttttaaa

SEQ ID NO: 4400941 - DNA, 17 bp, Homo sapiens
ttaaactttttaaaata

SEQ ID NO: 4400942 - DNA, 20 bp, Homo sapiens
ttaaactttttaaaatactt

SEQ ID NO: 4400943 - DNA, 15 bp, Homo sapiens
ttaaacttttttaac

SEQ ID NO: 4400944 - DNA, 17 bp, Homo sapiens
ttaaagaaaggaaaaga

SEQ ID NO: 4400945 - DNA, 17 bp, Homo sapiens
ttaaagaaagtgtattt

SEQ ID NO: 4400946 - DNA, 16 bp, Homo sapiens
ttaaagactacaataa

SEQ ID NO: 4400947 - DNA, 17 bp, Homo sapiens
ttaaagagatagcttct

SEQ ID NO: 4400948 - DNA, 22 bp, Homo sapiens
ttaaagataagtctacattaaa

SEQ ID NO: 4400949 - DNA, 18 bp, Homo sapiens
ttaaagccattctgatta

SEQ ID NO: 4400950 - DNA, 13 bp, Homo sapiens
ttaaagctaaact

SEQ ID NO: 4400951 - DNA, 16 bp, Homo sapiens
ttaaaggcagcatttg

SEQ ID NO: 4400952 - DNA, 20 bp, Homo sapiens
ttaaaggcagcatttgatga

SEQ ID NO: 4400953 - DNA, 15 bp, Homo sapiens
ttaaaggtgtcttcc

SEQ ID NO: 4400954 - DNA, 14 bp, Homo sapiens
ttaaagtaaacttg

SEQ ID NO: 4400955 - DNA, 20 bp, Homo sapiens
ttaaagtaaacttgtgtatt

SEQ ID NO: 4400956 - DNA, 23 bp, Homo sapiens
ttaaagtatgcattattaaattg

SEQ ID NO: 4400957 - DNA, 13 bp, Homo sapiens
ttaaagtattctt

SEQ ID NO: 4400958 - DNA, 11 bp, Homo sapiens
ttaaagttctg

SEQ ID NO: 4400959 - DNA, 15 bp, Homo sapiens
ttaaagttctgtgta

SEQ ID NO: 4400960 - DNA, 18 bp, Homo sapiens
ttaaagttctgtgtattt

SEQ ID NO: 4400961 - DNA, 20 bp, Homo sapiens
ttaaagttcttattttagta

SEQ ID NO: 4400962 - DNA, 13 bp, Homo sapiens
ttaaagtttaatg

SEQ ID NO: 4400963 - DNA, 17 bp, Homo sapiens
ttaaataaatagaaaga

SEQ ID NO: 4400964 - DNA, 13 bp, Homo sapiens
ttaaataaattaa

SEQ ID NO: 4400965 - DNA, 16 bp, Homo sapiens
ttaaataatttaacta

SEQ ID NO: 4400966 - DNA, 21 bp, Homo sapiens
ttaaataatttaactaccctt

SEQ ID NO: 4400967 - DNA, 10 bp, Homo sapiens
ttaaatacag

SEQ ID NO: 4400968 - DNA, 15 bp, Homo sapiens
ttaaatacaggaaac

SEQ ID NO: 4400969 - DNA, 20 bp, Homo sapiens
ttaaatacaggaaacagttg

SEQ ID NO: 4400970 - DNA, 14 bp, Homo sapiens
ttaaatagggaata

SEQ ID NO: 4400971 - DNA, 16 bp, Homo sapiens
ttaaatatatattttg

SEQ ID NO: 4400972 - DNA, 16 bp, Homo sapiens
ttaaatatatgtatgt

SEQ ID NO: 4400973 - DNA, 20 bp, Homo sapiens
ttaaatatatgtatgtaaaa

SEQ ID NO: 4400974 - DNA, 21 bp, Homo sapiens
ttaaatatctgaacatttact

SEQ ID NO: 4400975 - DNA, 16 bp, Homo sapiens
ttaaatattataatgt

SEQ ID NO: 4400976 - DNA, 13 bp, Homo sapiens
ttaaatatttagt

SEQ ID NO: 4400977 - DNA, 19 bp, Homo sapiens
ttaaatcattttaacttct

SEQ ID NO: 4400978 - DNA, 20 bp, Homo sapiens
ttaaatcattttaggaaagg

SEQ ID NO: 4400979 - DNA, 21 bp, Homo sapiens
ttaaatcattttaggaaagga

SEQ ID NO: 4400980 - DNA, 15 bp, Homo sapiens
ttaaatcatttttat

SEQ ID NO: 4400981 - DNA, 14 bp, Homo sapiens
ttaaatccaataaa

SEQ ID NO: 4400982 - DNA, 12 bp, Homo sapiens
ttaaatctagac

SEQ ID NO: 4400983 - DNA, 15 bp, Homo sapiens
ttaaatgagttactt

SEQ ID NO: 4400984 - DNA, 11 bp, Homo sapiens
ttaaatgattg

SEQ ID NO: 4400985 - DNA, 16 bp, Homo sapiens
ttaaatgatttaaatt

SEQ ID NO: 4400986 - DNA, 13 bp, Homo sapiens
ttaaatgtaaaga

SEQ ID NO: 4400987 - DNA, 17 bp, Homo sapiens
ttaaatgtaaagatatt

SEQ ID NO: 4400988 - DNA, 19 bp, Homo sapiens
ttaaatgtacagacatatt

SEQ ID NO: 4400989 - DNA, 12 bp, Homo sapiens
ttaaatgtatac

SEQ ID NO: 4400990 - DNA, 19 bp, Homo sapiens
ttaaatgtatactatagta

SEQ ID NO: 4400991 - DNA, 18 bp, Homo sapiens
ttaaatgtattttacata

SEQ ID NO: 4400992 - DNA, 16 bp, Homo sapiens
ttaaatgtgtatttct

SEQ ID NO: 4400993 - DNA, 12 bp, Homo sapiens
ttaaatgtttca

SEQ ID NO: 4400994 - DNA, 16 bp, Homo sapiens
ttaaattacaatttta

SEQ ID NO: 4400995 - DNA, 18 bp, Homo sapiens
ttaaattacaattttatc

SEQ ID NO: 4400996 - DNA, 15 bp, Homo sapiens
ttaaattacagcttt

SEQ ID NO: 4400997 - DNA, 19 bp, Homo sapiens
ttaaattacagcttttatg

SEQ ID NO: 4400998 - DNA, 17 bp, Homo sapiens
ttaaattagaaaatatt

SEQ ID NO: 4400999 - DNA, 17 bp, Homo sapiens
ttaaattagtttgtgaa

SEQ ID NO: 4401000 - DNA, 14 bp, Homo sapiens
ttaaattataagga

SEQ ID NO: 4401001 - DNA, 17 bp, Homo sapiens
ttaaattataaggactg

SEQ ID NO: 4401002 - DNA, 22 bp, Homo sapiens
ttaaattatatgatatgcatgt

SEQ ID NO: 4401003 - DNA, 13 bp, Homo sapiens
ttaaattatgaag

SEQ ID NO: 4401004 - DNA, 19 bp, Homo sapiens
ttaaattatgaagctcata

SEQ ID NO: 4401005 - DNA, 12 bp, Homo sapiens
ttaaattattat

SEQ ID NO: 4401006 - DNA, 20 bp, Homo sapiens
ttaaattattatcttcttaa

SEQ ID NO: 4401007 - DNA, 21 bp, Homo sapiens
ttaaattattatcttcttaac

SEQ ID NO: 4401008 - DNA, 14 bp, Homo sapiens
ttaaattcagtaat

SEQ ID NO: 4401009 - DNA, 19 bp, Homo sapiens
ttaaattcccgttttgtca

SEQ ID NO: 4401010 - DNA, 15 bp, Homo sapiens
ttaaattgctttcta

SEQ ID NO: 4401011 - DNA, 21 bp, Homo sapiens
ttaaattgctttctatatctt

SEQ ID NO: 4401012 - DNA, 16 bp, Homo sapiens
ttaaattggaaagcag

SEQ ID NO: 4401013 - DNA, 14 bp, Homo sapiens
ttaaattgggttca

SEQ ID NO: 4401014 - DNA, 22 bp, Homo sapiens
ttaaattgggttcatgatgcag

SEQ ID NO: 4401015 - DNA, 21 bp, Homo sapiens
ttaaatttatcacattgaata

SEQ ID NO: 4401016 - DNA, 18 bp, Homo sapiens
ttaaattttagtacattt

SEQ ID NO: 4401017 - DNA, 20 bp, Homo sapiens
ttaaattttagtacattttc

SEQ ID NO: 4401018 - DNA, 16 bp, Homo sapiens
ttaaattttcttcagt

SEQ ID NO: 4401019 - DNA, 14 bp, Homo sapiens
ttaaattttgtgtc

SEQ ID NO: 4401020 - DNA, 17 bp, Homo sapiens
ttaaattttttttacat

SEQ ID NO: 4401021 - DNA, 18 bp, Homo sapiens
ttaaattttttttacatt

SEQ ID NO: 4401022 - DNA, 16 bp, Homo sapiens
ttaacaaaaaatgtaa

SEQ ID NO: 4401023 - DNA, 21 bp, Homo sapiens
ttaacaaacgtaatttgttat

SEQ ID NO: 4401024 - DNA, 16 bp, Homo sapiens
ttaacaagatgtttca

SEQ ID NO: 4401025 - DNA, 15 bp, Homo sapiens
ttaacaatctaacaa

SEQ ID NO: 4401026 - DNA, 13 bp, Homo sapiens
ttaacacttccta

SEQ ID NO: 4401027 - DNA, 13 bp, Homo sapiens
ttaacagaaattg

SEQ ID NO: 4401028 - DNA, 18 bp, Homo sapiens
ttaacagtatttctcttt

SEQ ID NO: 4401029 - DNA, 22 bp, Homo sapiens
ttaacatagtaagttcagcact

SEQ ID NO: 4401030 - DNA, 15 bp, Homo sapiens
ttaacatgaactctt

SEQ ID NO: 4401031 - DNA, 21 bp, Homo sapiens
ttaacattctttttctgttga

SEQ ID NO: 4401032 - DNA, 16 bp, Homo sapiens
ttaacattgtttttgt

SEQ ID NO: 4401033 - DNA, 17 bp, Homo sapiens
ttaacatttcattgtac

SEQ ID NO: 4401034 - DNA, 19 bp, Homo sapiens
ttaacatttcattgtacaa

SEQ ID NO: 4401035 - DNA, 19 bp, Homo sapiens
ttaaccaaaaagaccagac

SEQ ID NO: 4401036 - DNA, 17 bp, Homo sapiens
ttaaccagtacttctaa

SEQ ID NO: 4401037 - DNA, 21 bp, Homo sapiens
ttaaccccttggtactgaaaa

SEQ ID NO: 4401038 - DNA, 20 bp, Homo sapiens
ttaacctatgatattttctg

SEQ ID NO: 4401039 - DNA, 15 bp, Homo sapiens
ttaacctctgctttt

SEQ ID NO: 4401040 - DNA, 23 bp, Homo sapiens
ttaaccttaaaattaagatttcc

SEQ ID NO: 4401041 - DNA, 15 bp, Homo sapiens
ttaaccttaaaattg

SEQ ID NO: 4401042 - DNA, 21 bp, Homo sapiens
ttaacctttgctatgtaaggg

SEQ ID NO: 4401043 - DNA, 19 bp, Homo sapiens
ttaacgacccactctgctt

SEQ ID NO: 4401044 - DNA, 13 bp, Homo sapiens
ttaacgctgccta

SEQ ID NO: 4401045 - DNA, 14 bp, Homo sapiens
ttaacggtgctaaa

SEQ ID NO: 4401046 - DNA, 14 bp, Homo sapiens
ttaactaaatgctc

SEQ ID NO: 4401047 - DNA, 18 bp, Homo sapiens
ttaactaaattttaaagc

SEQ ID NO: 4401048 - DNA, 20 bp, Homo sapiens
ttaactaaattttaaagcca

SEQ ID NO: 4401049 - DNA, 17 bp, Homo sapiens
ttaactacatctgcctc

SEQ ID NO: 4401050 - DNA, 21 bp, Homo sapiens
ttaactacccttaattactta

SEQ ID NO: 4401051 - DNA, 19 bp, Homo sapiens
ttaactacttatctctaaa

SEQ ID NO: 4401052 - DNA, 14 bp, Homo sapiens
ttaactattgcatt

SEQ ID NO: 4401053 - DNA, 21 bp, Homo sapiens
ttaactattgcatttatatgt

SEQ ID NO: 4401054 - DNA, 12 bp, Homo sapiens
ttaactcagtct

SEQ ID NO: 4401055 - DNA, 20 bp, Homo sapiens
ttaactccactgcttaccta

SEQ ID NO: 4401056 - DNA, 14 bp, Homo sapiens
ttaactccctgtaa

SEQ ID NO: 4401057 - DNA, 15 bp, Homo sapiens
ttaactctctttatg

SEQ ID NO: 4401058 - DNA, 12 bp, Homo sapiens
ttaactctgcat

SEQ ID NO: 4401059 - DNA, 18 bp, Homo sapiens
ttaactctttgaaactgt

SEQ ID NO: 4401060 - DNA, 13 bp, Homo sapiens
ttaactgacatgg

SEQ ID NO: 4401061 - DNA, 19 bp, Homo sapiens
ttaactgccgtaatttaac

SEQ ID NO: 4401062 - DNA, 21 bp, Homo sapiens
ttaactgggtaatgaaacaaa

SEQ ID NO: 4401063 - DNA, 23 bp, Homo sapiens
ttaactggtgcactttgtaaatt

SEQ ID NO: 4401064 - DNA, 11 bp, Homo sapiens
ttaactgtttt

SEQ ID NO: 4401065 - DNA, 15 bp, Homo sapiens
ttaacttaaatagta

SEQ ID NO: 4401066 - DNA, 17 bp, Homo sapiens
ttaacttccactgttaa

SEQ ID NO: 4401067 - DNA, 16 bp, Homo sapiens
ttaacttggtcagagc

SEQ ID NO: 4401068 - DNA, 18 bp, Homo sapiens
ttaagaaaaaaagcaaaa

SEQ ID NO: 4401069 - DNA, 22 bp, Homo sapiens
ttaagaaaaacaataaagatac

SEQ ID NO: 4401070 - DNA, 13 bp, Homo sapiens
ttaagaaaacaag

SEQ ID NO: 4401071 - DNA, 15 bp, Homo sapiens
ttaagaaaactatta

SEQ ID NO: 4401072 - DNA, 18 bp, Homo sapiens
ttaagaaggcaaaaatgt

SEQ ID NO: 4401073 - DNA, 18 bp, Homo sapiens
ttaagacatgatttcctt

SEQ ID NO: 4401074 - DNA, 16 bp, Homo sapiens
ttaagacgtgaatgtc

SEQ ID NO: 4401075 - DNA, 19 bp, Homo sapiens
ttaagaggctttggcccaa

SEQ ID NO: 4401076 - DNA, 13 bp, Homo sapiens
ttaagatattgaa

SEQ ID NO: 4401077 - DNA, 18 bp, Homo sapiens
ttaagatccagaaatact

SEQ ID NO: 4401078 - DNA, 15 bp, Homo sapiens
ttaagatcctaaact

SEQ ID NO: 4401079 - DNA, 20 bp, Homo sapiens
ttaagatcctaaactctcta

SEQ ID NO: 4401080 - DNA, 17 bp, Homo sapiens
ttaagatgtacatttaa

SEQ ID NO: 4401081 - DNA, 18 bp, Homo sapiens
ttaagattctctgcccag

SEQ ID NO: 4401082 - DNA, 17 bp, Homo sapiens
ttaagatttctttatgt

SEQ ID NO: 4401083 - DNA, 14 bp, Homo sapiens
ttaagcaaatactt

SEQ ID NO: 4401084 - DNA, 16 bp, Homo sapiens
ttaagcaggtttgttt

SEQ ID NO: 4401085 - DNA, 18 bp, Homo sapiens
ttaagcattaccactcag

SEQ ID NO: 4401086 - DNA, 21 bp, Homo sapiens
ttaagccacttaaaatgttca

SEQ ID NO: 4401087 - DNA, 13 bp, Homo sapiens
ttaagccctgagg

SEQ ID NO: 4401088 - DNA, 21 bp, Homo sapiens
ttaagctgttcctgttcagta

SEQ ID NO: 4401089 - DNA, 17 bp, Homo sapiens
ttaagctttaaatgaca

SEQ ID NO: 4401090 - DNA, 20 bp, Homo sapiens
ttaagctttaaatgacagta

SEQ ID NO: 4401091 - DNA, 13 bp, Homo sapiens
ttaagcttttatt

SEQ ID NO: 4401092 - DNA, 14 bp, Homo sapiens
ttaagctttttgga

SEQ ID NO: 4401093 - DNA, 17 bp, Homo sapiens
ttaaggacttctgcagc

SEQ ID NO: 4401094 - DNA, 23 bp, Homo sapiens
ttaaggatggggttatgaaccct

SEQ ID NO: 4401095 - DNA, 14 bp, Homo sapiens
ttaaggcagtagtt

SEQ ID NO: 4401096 - DNA, 15 bp, Homo sapiens
ttaagggaaaaatat

SEQ ID NO: 4401097 - DNA, 20 bp, Homo sapiens
ttaagggaggtttaaaaaaa

SEQ ID NO: 4401098 - DNA, 13 bp, Homo sapiens
ttaaggtacactg

SEQ ID NO: 4401099 - DNA, 22 bp, Homo sapiens
ttaaggtacactgtttccatgt

SEQ ID NO: 4401100 - DNA, 15 bp, Homo sapiens
ttaaggtacatcatt

SEQ ID NO: 4401101 - DNA, 18 bp, Homo sapiens
ttaaggtacatcattatt

SEQ ID NO: 4401102 - DNA, 19 bp, Homo sapiens
ttaaggtgagcataaatca

SEQ ID NO: 4401103 - DNA, 20 bp, Homo sapiens
ttaaggtgagcataaatcaa

SEQ ID NO: 4401104 - DNA, 23 bp, Homo sapiens
ttaaggtgtgcagtgtttttcct

SEQ ID NO: 4401105 - DNA, 14 bp, Homo sapiens
ttaagtaaaagtct

SEQ ID NO: 4401106 - DNA, 15 bp, Homo sapiens
ttaagtaaaagtcta

SEQ ID NO: 4401107 - DNA, 15 bp, Homo sapiens
ttaagtaacgtgctc

SEQ ID NO: 4401108 - DNA, 19 bp, Homo sapiens
ttaagtcattttttacttg

SEQ ID NO: 4401109 - DNA, 21 bp, Homo sapiens
ttaagtcattttttacttgaa

SEQ ID NO: 4401110 - DNA, 19 bp, Homo sapiens
ttaagtccctgtcacctct

SEQ ID NO: 4401111 - DNA, 17 bp, Homo sapiens
ttaagtgtaaatgaagt

SEQ ID NO: 4401112 - DNA, 13 bp, Homo sapiens
ttaagtgtgtata

SEQ ID NO: 4401113 - DNA, 22 bp, Homo sapiens
ttaagttacacatttttcagat

SEQ ID NO: 4401114 - DNA, 22 bp, Homo sapiens
ttaagttggcttctgtttctag

SEQ ID NO: 4401115 - DNA, 23 bp, Homo sapiens
ttaagttggcttctgtttctagt

SEQ ID NO: 4401116 - DNA, 16 bp, Homo sapiens
ttaagttgtcaaagaa

SEQ ID NO: 4401117 - DNA, 13 bp, Homo sapiens
ttaataaaaagac

SEQ ID NO: 4401118 - DNA, 21 bp, Homo sapiens
ttaataaaactcactcactgt

SEQ ID NO: 4401119 - DNA, 16 bp, Homo sapiens
tgtcatgtgttccctt

SEQ ID NO: 4401120 - DNA, 12 bp, Homo sapiens
tgtcattatatt

SEQ ID NO: 4401121 - DNA, 15 bp, Homo sapiens
tgtcattatattcta

SEQ ID NO: 4401122 - DNA, 20 bp, Homo sapiens
tgtcattatattctaattaa

SEQ ID NO: 4401123 - DNA, 22 bp, Homo sapiens
tgtcattatattctaattaaaa

SEQ ID NO: 4401124 - DNA, 17 bp, Homo sapiens
tgtcattggaagccatc

SEQ ID NO: 4401125 - DNA, 16 bp, Homo sapiens
tgtcatttcattccat

SEQ ID NO: 4401126 - DNA, 13 bp, Homo sapiens
tgtcatttcttca

SEQ ID NO: 4401127 - DNA, 19 bp, Homo sapiens
tgtccaaaagcgccctcac

SEQ ID NO: 4401128 - DNA, 16 bp, Homo sapiens
tgtccaaaatatttgt

SEQ ID NO: 4401129 - DNA, 17 bp, Homo sapiens
tgtccaaagaggctgcc

SEQ ID NO: 4401130 - DNA, 19 bp, Homo sapiens
tgtccaaaggaggctggca

SEQ ID NO: 4401131 - DNA, 14 bp, Homo sapiens
tgtccaacatggtg

SEQ ID NO: 4401132 - DNA, 21 bp, Homo sapiens
tgtccaacctaacccctttcc

SEQ ID NO: 4401133 - DNA, 22 bp, Homo sapiens
tgtccaacctaacccctttcct

SEQ ID NO: 4401134 - DNA, 12 bp, Homo sapiens
tgtccaagacag

SEQ ID NO: 4401135 - DNA, 23 bp, Homo sapiens
tgtccaagacaggggcctaagga

SEQ ID NO: 4401136 - DNA, 14 bp, Homo sapiens
tgtccaatcctatg

SEQ ID NO: 4401137 - DNA, 11 bp, Homo sapiens
tgtccacctgg

SEQ ID NO: 4401138 - DNA, 12 bp, Homo sapiens
tgtccacctggc

SEQ ID NO: 4401139 - DNA, 13 bp, Homo sapiens
tgtccacctggcc

SEQ ID NO: 4401140 - DNA, 14 bp, Homo sapiens
tgtccacctggccc

SEQ ID NO: 4401141 - DNA, 17 bp, Homo sapiens
tgtccacgactgtctcc

SEQ ID NO: 4401142 - DNA, 19 bp, Homo sapiens
tgtccacgactgtctccat

SEQ ID NO: 4401143 - DNA, 22 bp, Homo sapiens
tgtccacgtacttaatttactt

SEQ ID NO: 4401144 - DNA, 23 bp, Homo sapiens
tgtccactaaaccccatacctgg

SEQ ID NO: 4401145 - DNA, 14 bp, Homo sapiens
tgtccagacagcct

SEQ ID NO: 4401146 - DNA, 20 bp, Homo sapiens
tgtccagagtgagcaaggat

SEQ ID NO: 4401147 - DNA, 15 bp, Homo sapiens
tgtccagataattgg

SEQ ID NO: 4401148 - DNA, 23 bp, Homo sapiens
tgtccagctggggccagaggctg

SEQ ID NO: 4401149 - DNA, 19 bp, Homo sapiens
tgtccagggaaacagcctc

SEQ ID NO: 4401150 - DNA, 19 bp, Homo sapiens
tgtccagtggagggctcat

SEQ ID NO: 4401151 - DNA, 15 bp, Homo sapiens
tgtccatgcttctca

SEQ ID NO: 4401152 - DNA, 13 bp, Homo sapiens
tgtcccaagtgcc

SEQ ID NO: 4401153 - DNA, 12 bp, Homo sapiens
tgtcccacccac

SEQ ID NO: 4401154 - DNA, 21 bp, Homo sapiens
tgtcccagctaccaagtcaga

SEQ ID NO: 4401155 - DNA, 17 bp, Homo sapiens
tgtcccaggccggccca

SEQ ID NO: 4401156 - DNA, 24 bp, Homo sapiens
tgtccccaaaggacgcctgcagga

SEQ ID NO: 4401157 - DNA, 19 bp, Homo sapiens
tgtccccaacgtcccctcc

SEQ ID NO: 4401158 - DNA, 13 bp, Homo sapiens
tgtccccactgcc

SEQ ID NO: 4401159 - DNA, 14 bp, Homo sapiens
tgtccccagagaca

SEQ ID NO: 4401160 - DNA, 18 bp, Homo sapiens
tgtccccagcctacctct

SEQ ID NO: 4401161 - DNA, 15 bp, Homo sapiens
tgtcccccaggctgg

SEQ ID NO: 4401162 - DNA, 16 bp, Homo sapiens
tgtcccccaggctgga

SEQ ID NO: 4401163 - DNA, 16 bp, Homo sapiens
tgtcccctcactctgt

SEQ ID NO: 4401164 - DNA, 18 bp, Homo sapiens
tgtcccctcactctgtca

SEQ ID NO: 4401165 - DNA, 22 bp, Homo sapiens
tgtccccttctctcatctctta

SEQ ID NO: 4401166 - DNA, 17 bp, Homo sapiens
tgtcccggtaccttcca

SEQ ID NO: 4401167 - DNA, 15 bp, Homo sapiens
tgtccctactttctc

SEQ ID NO: 4401168 - DNA, 17 bp, Homo sapiens
tgtccctatgcatatca

SEQ ID NO: 4401169 - DNA, 22 bp, Homo sapiens
tgtccctgtccttccctgttct

SEQ ID NO: 4401170 - DNA, 16 bp, Homo sapiens
tgtcccttaaacaaaa

SEQ ID NO: 4401171 - DNA, 12 bp, Homo sapiens
tgtcccttgcct

SEQ ID NO: 4401172 - DNA, 16 bp, Homo sapiens
tgtcccttttccctta

SEQ ID NO: 4401173 - DNA, 14 bp, Homo sapiens
tgtccgcaaggggt

SEQ ID NO: 4401174 - DNA, 18 bp, Homo sapiens
tgtccggcccagtgccac

SEQ ID NO: 4401175 - DNA, 15 bp, Homo sapiens
tgtcctacgtccaag

SEQ ID NO: 4401176 - DNA, 12 bp, Homo sapiens
tgtcctatgcaa

SEQ ID NO: 4401177 - DNA, 22 bp, Homo sapiens
tgtcctattactgatgtgtgca

SEQ ID NO: 4401178 - DNA, 21 bp, Homo sapiens
tgtcctcagccccgcgtggaa

SEQ ID NO: 4401179 - DNA, 21 bp, Homo sapiens
tgtcctcctcggatcaccgag

SEQ ID NO: 4401180 - DNA, 21 bp, Homo sapiens
tgtcctcctggtgggtccagg

SEQ ID NO: 4401181 - DNA, 13 bp, Homo sapiens
tgtcctctcgagc

SEQ ID NO: 4401182 - DNA, 14 bp, Homo sapiens
tgtcctcttctgct

SEQ ID NO: 4401183 - DNA, 18 bp, Homo sapiens
tgtcctcttctgctcttt

SEQ ID NO: 4401184 - DNA, 19 bp, Homo sapiens
tgtcctgcacaccctgggc

SEQ ID NO: 4401185 - DNA, 18 bp, Homo sapiens
tgtcctgcaccggggcct

SEQ ID NO: 4401186 - DNA, 24 bp, Homo sapiens
tgtcctgcctattatctgtcagct

SEQ ID NO: 4401187 - DNA, 17 bp, Homo sapiens
tgtcctgggcctgcccc

SEQ ID NO: 4401188 - DNA, 20 bp, Homo sapiens
tgtcctgtaactgttacagt

SEQ ID NO: 4401189 - DNA, 20 bp, Homo sapiens
tgtcctgtgagatgtgtatc

SEQ ID NO: 4401190 - DNA, 12 bp, Homo sapiens
tgtcctgtgatg

SEQ ID NO: 4401191 - DNA, 18 bp, Homo sapiens
tgtcctgttaatttatag

SEQ ID NO: 4401192 - DNA, 16 bp, Homo sapiens
tgtccttaacccacct

SEQ ID NO: 4401193 - DNA, 21 bp, Homo sapiens
tgtccttaacccacctctcct

SEQ ID NO: 4401194 - DNA, 19 bp, Homo sapiens
tgtccttccattttcattc

SEQ ID NO: 4401195 - DNA, 17 bp, Homo sapiens
tgtccttccctcaaaga

SEQ ID NO: 4401196 - DNA, 17 bp, Homo sapiens
tgtccttgaatgccata

SEQ ID NO: 4401197 - DNA, 16 bp, Homo sapiens
tgtcctttctcagagg

SEQ ID NO: 4401198 - DNA, 14 bp, Homo sapiens
tgtccttttctccc

SEQ ID NO: 4401199 - DNA, 21 bp, Homo sapiens
tgtccttttctcccatttctt

SEQ ID NO: 4401200 - DNA, 16 bp, Homo sapiens
tgtcgccccaggccct

SEQ ID NO: 4401201 - DNA, 17 bp, Homo sapiens
tgtcgccccaggccctc

SEQ ID NO: 4401202 - DNA, 14 bp, Homo sapiens
tgtcggcacattca

SEQ ID NO: 4401203 - DNA, 21 bp, Homo sapiens
tgtcggccccaccagtgcctc

SEQ ID NO: 4401204 - DNA, 22 bp, Homo sapiens
tgtcggccccaccagtgcctct

SEQ ID NO: 4401205 - DNA, 21 bp, Homo sapiens
tgtcggcctctaaccccaggc

SEQ ID NO: 4401206 - DNA, 22 bp, Homo sapiens
tgtcggcctctaaccccaggcc

SEQ ID NO: 4401207 - DNA, 23 bp, Homo sapiens
tgtcggcctctaaccccaggccc

SEQ ID NO: 4401208 - DNA, 20 bp, Homo sapiens
tgtctacatatgatctgtct

SEQ ID NO: 4401209 - DNA, 15 bp, Homo sapiens
tgtctagctgtttca

SEQ ID NO: 4401210 - DNA, 17 bp, Homo sapiens
tgtctaggttaaagcta

SEQ ID NO: 4401211 - DNA, 19 bp, Homo sapiens
tgtctaggttaaagctaaa

SEQ ID NO: 4401212 - DNA, 19 bp, Homo sapiens
tgtctatgtagctgaaaat

SEQ ID NO: 4401213 - DNA, 18 bp, Homo sapiens
tgtctattgtccaaagtt

SEQ ID NO: 4401214 - DNA, 20 bp, Homo sapiens
tgtctatttttaatgtttgt

SEQ ID NO: 4401215 - DNA, 18 bp, Homo sapiens
tgtctcaacgcctccccc

SEQ ID NO: 4401216 - DNA, 16 bp, Homo sapiens
tgtctcacctggactt

SEQ ID NO: 4401217 - DNA, 18 bp, Homo sapiens
tgtctcactcttctgtct

SEQ ID NO: 4401218 - DNA, 20 bp, Homo sapiens
tgtctcagcgaggtgtaaag

SEQ ID NO: 4401219 - DNA, 16 bp, Homo sapiens
tgtctcaggctcaagt

SEQ ID NO: 4401220 - DNA, 19 bp, Homo sapiens
tgtctcaggctcaagtttt

SEQ ID NO: 4401221 - DNA, 21 bp, Homo sapiens
tgtctcagtccatgaagatgt

SEQ ID NO: 4401222 - DNA, 11 bp, Homo sapiens
tgtctcatcca

SEQ ID NO: 4401223 - DNA, 21 bp, Homo sapiens
tgtctcatccatcatcatgtg

SEQ ID NO: 4401224 - DNA, 16 bp, Homo sapiens
tgtctcatccccaggg

SEQ ID NO: 4401225 - DNA, 21 bp, Homo sapiens
tgtctccaaccccccagcact

SEQ ID NO: 4401226 - DNA, 12 bp, Homo sapiens
tgtctccagctt

SEQ ID NO: 4401227 - DNA, 19 bp, Homo sapiens
tgtctccagggcccccacc

SEQ ID NO: 4401228 - DNA, 18 bp, Homo sapiens
tgtctcctatatatttct

SEQ ID NO: 4401229 - DNA, 19 bp, Homo sapiens
tgtctcgtggtaggactgt

SEQ ID NO: 4401230 - DNA, 20 bp, Homo sapiens
tgtctcgtggtaggactgta

SEQ ID NO: 4401231 - DNA, 15 bp, Homo sapiens
tgtctctaaaaagaa

SEQ ID NO: 4401232 - DNA, 13 bp, Homo sapiens
tgtctctcagaat

SEQ ID NO: 4401233 - DNA, 19 bp, Homo sapiens
tgtctctcttcagactctc

SEQ ID NO: 4401234 - DNA, 20 bp, Homo sapiens
tgtctcttcatctaatatga

SEQ ID NO: 4401235 - DNA, 23 bp, Homo sapiens
tgtctctttggcgacctcctttc

SEQ ID NO: 4401236 - DNA, 13 bp, Homo sapiens
tgtctgaaacatt

SEQ ID NO: 4401237 - DNA, 15 bp, Homo sapiens
tgtctgaaatggaac

SEQ ID NO: 4401238 - DNA, 20 bp, Homo sapiens
tgtctgaccttccaaagact

SEQ ID NO: 4401239 - DNA, 17 bp, Homo sapiens
tgtctgacttttgttaa

SEQ ID NO: 4401240 - DNA, 17 bp, Homo sapiens
tgtctgagtagtggcca

SEQ ID NO: 4401241 - DNA, 20 bp, Homo sapiens
tgtctgatctgtgctttcca

SEQ ID NO: 4401242 - DNA, 15 bp, Homo sapiens
tgtctgccaaaatgc

SEQ ID NO: 4401243 - DNA, 19 bp, Homo sapiens
tgtctgccaacctaaaact

SEQ ID NO: 4401244 - DNA, 15 bp, Homo sapiens
tgtctgccttcacaa

SEQ ID NO: 4401245 - DNA, 17 bp, Homo sapiens
tgtctgccttcacaaat

SEQ ID NO: 4401246 - DNA, 21 bp, Homo sapiens
tgtctgctaggcgctggggag

SEQ ID NO: 4401247 - DNA, 23 bp, Homo sapiens
tgtctgctaggcgctggggagac

SEQ ID NO: 4401248 - DNA, 18 bp, Homo sapiens
tgtctgctgagttggcct

SEQ ID NO: 4401249 - DNA, 23 bp, Homo sapiens
tgtctgctgagttggcctggcca

SEQ ID NO: 4401250 - DNA, 21 bp, Homo sapiens
tgtctgcttgcatctgcacat

SEQ ID NO: 4401251 - DNA, 17 bp, Homo sapiens
tgtctggaagacgtggc

SEQ ID NO: 4401252 - DNA, 20 bp, Homo sapiens
tgtctggaagacgtggctct

SEQ ID NO: 4401253 - DNA, 14 bp, Homo sapiens
tgtctggatcagta

SEQ ID NO: 4401254 - DNA, 21 bp, Homo sapiens
tgtctggatcagtaaaattat

SEQ ID NO: 4401255 - DNA, 19 bp, Homo sapiens
tgtctggcgttctcaagaa

SEQ ID NO: 4401256 - DNA, 20 bp, Homo sapiens
tgtctggcgttctcaagaat

SEQ ID NO: 4401257 - DNA, 21 bp, Homo sapiens
tgtctggctcggacccacccc

SEQ ID NO: 4401258 - DNA, 17 bp, Homo sapiens
tgtctggctttggcact

SEQ ID NO: 4401259 - DNA, 14 bp, Homo sapiens
tgtctggggcagaa

SEQ ID NO: 4401260 - DNA, 19 bp, Homo sapiens
tgtctgtagagggccctgg

SEQ ID NO: 4401261 - DNA, 21 bp, Homo sapiens
tgtctgtagagggccctggtg

SEQ ID NO: 4401262 - DNA, 23 bp, Homo sapiens
tgtctgtagagggccctggtgtt

SEQ ID NO: 4401263 - DNA, 11 bp, Homo sapiens
tgtctgtcacc

SEQ ID NO: 4401264 - DNA, 14 bp, Homo sapiens
tgtctgtctacatt

SEQ ID NO: 4401265 - DNA, 19 bp, Homo sapiens
tgtctgtgaacagagagac

SEQ ID NO: 4401266 - DNA, 16 bp, Homo sapiens
tgtctgtgatctctgc

SEQ ID NO: 4401267 - DNA, 16 bp, Homo sapiens
tgtctgtgcacatgcc

SEQ ID NO: 4401268 - DNA, 19 bp, Homo sapiens
tgtctgtgcacatgcctct

SEQ ID NO: 4401269 - DNA, 20 bp, Homo sapiens
tgtctgtgcacatgcctctg

SEQ ID NO: 4401270 - DNA, 14 bp, Homo sapiens
tgtctgtgttgctt

SEQ ID NO: 4401271 - DNA, 20 bp, Homo sapiens
tgtctgtgttttgaaagaat

SEQ ID NO: 4401272 - DNA, 17 bp, Homo sapiens
tgtctgttcccagcccc

SEQ ID NO: 4401273 - DNA, 21 bp, Homo sapiens
tgtctgttcccagcccctgca

SEQ ID NO: 4401274 - DNA, 20 bp, Homo sapiens
tgtcttaaactaaatgtgca

SEQ ID NO: 4401275 - DNA, 22 bp, Homo sapiens
tgtcttaagatggaaatacagt

SEQ ID NO: 4401276 - DNA, 16 bp, Homo sapiens
tgtcttatttttagat

SEQ ID NO: 4401277 - DNA, 22 bp, Homo sapiens
tgtcttcattttttaatgtgct

SEQ ID NO: 4401278 - DNA, 13 bp, Homo sapiens
tgtcttcccaggg

SEQ ID NO: 4401279 - DNA, 14 bp, Homo sapiens
tgtcttcccagggt

SEQ ID NO: 4401280 - DNA, 15 bp, Homo sapiens
tgtcttccctgggct

SEQ ID NO: 4401281 - DNA, 16 bp, Homo sapiens
tgtcttccctgggctg

SEQ ID NO: 4401282 - DNA, 23 bp, Homo sapiens
tgtcttccctgggctgccaccag

SEQ ID NO: 4401283 - DNA, 16 bp, Homo sapiens
tgtcttcctcaaaata

SEQ ID NO: 4401284 - DNA, 13 bp, Homo sapiens
tgtcttctgcctg

SEQ ID NO: 4401285 - DNA, 17 bp, Homo sapiens
tgtcttctgcctgttat

SEQ ID NO: 4401286 - DNA, 18 bp, Homo sapiens
tgtcttctgcctgttata

SEQ ID NO: 4401287 - DNA, 18 bp, Homo sapiens
tgtcttcttcatgtcatc

SEQ ID NO: 4401288 - DNA, 22 bp, Homo sapiens
tgtcttgatgcatgcactgttc

SEQ ID NO: 4401289 - DNA, 21 bp, Homo sapiens
tgtcttgatgttttttctgta

SEQ ID NO: 4401290 - DNA, 17 bp, Homo sapiens
tgtcttgccttcatttc

SEQ ID NO: 4401291 - DNA, 16 bp, Homo sapiens
tgtcttgtatttaaaa

SEQ ID NO: 4401292 - DNA, 16 bp, Homo sapiens
tgtcttgttcctgtgc

SEQ ID NO: 4401293 - DNA, 14 bp, Homo sapiens
tgtctttaaaaact

SEQ ID NO: 4401294 - DNA, 13 bp, Homo sapiens
tgtctttctttgg

SEQ ID NO: 4401295 - DNA, 15 bp, Homo sapiens
tgtctttgtttaaaa

SEQ ID NO: 4401296 - DNA, 22 bp, Homo sapiens
tgtcttttcagaagcaagccag

SEQ ID NO: 4401297 - DNA, 15 bp, Homo sapiens
tgtctttttgttgta

SEQ ID NO: 4401298 - DNA, 12 bp, Homo sapiens
tgtcttttttct

SEQ ID NO: 4401299 - DNA, 21 bp, Homo sapiens
tgtgaaaatagtgtaagaact

SEQ ID NO: 4401300 - DNA, 18 bp, Homo sapiens
tgtgaaaatatacttgac

SEQ ID NO: 4401301 - DNA, 21 bp, Homo sapiens
tgtgaaaatatacttgactct

SEQ ID NO: 4401302 - DNA, 23 bp, Homo sapiens
tgtgaaagaagtatttaaacttt

SEQ ID NO: 4401303 - DNA, 14 bp, Homo sapiens
tgtgaaatgtaact

SEQ ID NO: 4401304 - DNA, 15 bp, Homo sapiens
tgtgaacagagagac

SEQ ID NO: 4401305 - DNA, 16 bp, Homo sapiens
tgtgaaccaaccccca

SEQ ID NO: 4401306 - DNA, 17 bp, Homo sapiens
tgtgaaccactgtgccc

SEQ ID NO: 4401307 - DNA, 15 bp, Homo sapiens
tgtgaacctacctgc

SEQ ID NO: 4401308 - DNA, 22 bp, Homo sapiens
tgtgaacctacctgccttggag

SEQ ID NO: 4401309 - DNA, 19 bp, Homo sapiens
tgtgaacctgggcactccg

SEQ ID NO: 4401310 - DNA, 17 bp, Homo sapiens
tgtgaacgcatgtggta

SEQ ID NO: 4401311 - DNA, 19 bp, Homo sapiens
tgtgaactggaagaaagca

SEQ ID NO: 4401312 - DNA, 12 bp, Homo sapiens
tgtgaactgtgt

SEQ ID NO: 4401313 - DNA, 13 bp, Homo sapiens
tgtgaactgtgtg

SEQ ID NO: 4401314 - DNA, 10 bp, Homo sapiens
tgtgaagaat

SEQ ID NO: 4401315 - DNA, 20 bp, Homo sapiens
tgtgaagaatttagatctta

SEQ ID NO: 4401316 - DNA, 20 bp, Homo sapiens
tgtgaagcaaactctaaaat

SEQ ID NO: 4401317 - DNA, 22 bp, Homo sapiens
tgtgaaggattatggaaaaata

SEQ ID NO: 4401318 - DNA, 17 bp, Homo sapiens
tgtgaaggtgatttaag

SEQ ID NO: 4401319 - DNA, 15 bp, Homo sapiens
tgtgaatagcctggc

SEQ ID NO: 4401320 - DNA, 19 bp, Homo sapiens
tgtgaataggttatatgca

SEQ ID NO: 4401321 - DNA, 17 bp, Homo sapiens
tgtgaatataaatgtgt

SEQ ID NO: 4401322 - DNA, 14 bp, Homo sapiens
tgtgaatattcctt

SEQ ID NO: 4401323 - DNA, 15 bp, Homo sapiens
tgtgaatcagaccct

SEQ ID NO: 4401324 - DNA, 22 bp, Homo sapiens
tgtgaattaggctgtaactact

SEQ ID NO: 4401325 - DNA, 24 bp, Homo sapiens
tgtgaattaggctgtaactacttt

SEQ ID NO: 4401326 - DNA, 15 bp, Homo sapiens
tgtgaattattgaca

SEQ ID NO: 4401327 - DNA, 19 bp, Homo sapiens
tgtgaattattgacactga

SEQ ID NO: 4401328 - DNA, 21 bp, Homo sapiens
tgtgaattattgacactgaac

SEQ ID NO: 4401329 - DNA, 15 bp, Homo sapiens
tgtgaatttttaagc

SEQ ID NO: 4401330 - DNA, 22 bp, Homo sapiens
tgtgacaatagggctaaatgtt

SEQ ID NO: 4401331 - DNA, 23 bp, Homo sapiens
tgtgacaggaaagccctccccct

SEQ ID NO: 4401332 - DNA, 18 bp, Homo sapiens
tgtgacagtcactgcatt

SEQ ID NO: 4401333 - DNA, 16 bp, Homo sapiens
tgtgacatggtgcctg

SEQ ID NO: 4401334 - DNA, 22 bp, Homo sapiens
tgtgacatggtgcctgagaggc

SEQ ID NO: 4401335 - DNA, 13 bp, Homo sapiens
tgtgacattcctt

SEQ ID NO: 4401336 - DNA, 15 bp, Homo sapiens
tgtgacattttacat

SEQ ID NO: 4401337 - DNA, 19 bp, Homo sapiens
tgtgaccaagtataaactt

SEQ ID NO: 4401338 - DNA, 16 bp, Homo sapiens
tgtgaccaatgtcttg

SEQ ID NO: 4401339 - DNA, 14 bp, Homo sapiens
tgtgaccctgggca

SEQ ID NO: 4401340 - DNA, 13 bp, Homo sapiens
tgtgacctgaggg

SEQ ID NO: 4401341 - DNA, 16 bp, Homo sapiens
tgtgactctagcaagg

SEQ ID NO: 4401342 - DNA, 19 bp, Homo sapiens
tgtgactcttactccttag

SEQ ID NO: 4401343 - DNA, 14 bp, Homo sapiens
tgtgactctttcca

SEQ ID NO: 4401344 - DNA, 17 bp, Homo sapiens
tgtgactggctaaagct

SEQ ID NO: 4401345 - DNA, 18 bp, Homo sapiens
tgtgactggctaaagctc

SEQ ID NO: 4401346 - DNA, 23 bp, Homo sapiens
tgtgacttctattttaaagacaa

SEQ ID NO: 4401347 - DNA, 16 bp, Homo sapiens
tgtgagacccccacac

SEQ ID NO: 4401348 - DNA, 19 bp, Homo sapiens
tgtgagacccccacacctc

SEQ ID NO: 4401349 - DNA, 19 bp, Homo sapiens
tgtgagactcgagaacttt

SEQ ID NO: 4401350 - DNA, 15 bp, Homo sapiens
tgtgagaggtttgac

SEQ ID NO: 4401351 - DNA, 19 bp, Homo sapiens
tgtgagatagttttcattt

SEQ ID NO: 4401352 - DNA, 17 bp, Homo sapiens
tgtgagcatggggccag

SEQ ID NO: 4401353 - DNA, 15 bp, Homo sapiens
tgtgagcgagcaagc

SEQ ID NO: 4401354 - DNA, 14 bp, Homo sapiens
tgtgagctctggtt

SEQ ID NO: 4401355 - DNA, 20 bp, Homo sapiens
tgtgagctctggttattttt

SEQ ID NO: 4401356 - DNA, 15 bp, Homo sapiens
tgtgagctcttccct

SEQ ID NO: 4401357 - DNA, 16 bp, Homo sapiens
tgtgagctcttccctt

SEQ ID NO: 4401358 - DNA, 14 bp, Homo sapiens
tgtgaggcaataag

SEQ ID NO: 4401359 - DNA, 19 bp, Homo sapiens
tgtatctgtgcttctaata

SEQ ID NO: 4401360 - DNA, 14 bp, Homo sapiens
tgtatctgtgcttt

SEQ ID NO: 4401361 - DNA, 14 bp, Homo sapiens
tgtatctttattaa

SEQ ID NO: 4401362 - DNA, 19 bp, Homo sapiens
tgtatctttattaaaacaa

SEQ ID NO: 4401363 - DNA, 22 bp, Homo sapiens
tgtatctttattaaaacaaaag

SEQ ID NO: 4401364 - DNA, 12 bp, Homo sapiens
tgtatctttctt

SEQ ID NO: 4401365 - DNA, 18 bp, Homo sapiens
tgtatctttctttctcta

SEQ ID NO: 4401366 - DNA, 19 bp, Homo sapiens
tgtatctttctttctctaa

SEQ ID NO: 4401367 - DNA, 19 bp, Homo sapiens
tgtatcttttttaaactgt

SEQ ID NO: 4401368 - DNA, 20 bp, Homo sapiens
tgtatgaaaaattggggagg

SEQ ID NO: 4401369 - DNA, 22 bp, Homo sapiens
tgtatgattactggcctttttc

SEQ ID NO: 4401370 - DNA, 16 bp, Homo sapiens
tgtatgccaagtgaga

SEQ ID NO: 4401371 - DNA, 22 bp, Homo sapiens
tgtatgccaatcttaaagacaa

SEQ ID NO: 4401372 - DNA, 20 bp, Homo sapiens
tgtatgcttttataggcctg

SEQ ID NO: 4401373 - DNA, 23 bp, Homo sapiens
tgtatggatatatttgaaatagt

SEQ ID NO: 4401374 - DNA, 12 bp, Homo sapiens
tgtatgtaaaaa

SEQ ID NO: 4401375 - DNA, 15 bp, Homo sapiens
tgtatgtaaataggt

SEQ ID NO: 4401376 - DNA, 13 bp, Homo sapiens
tgtatgtacaata

SEQ ID NO: 4401377 - DNA, 14 bp, Homo sapiens
tgtatgtacaatac

SEQ ID NO: 4401378 - DNA, 21 bp, Homo sapiens
tgtatgtgggggtctgtgtgt

SEQ ID NO: 4401379 - DNA, 15 bp, Homo sapiens
tgtatgtttttactg

SEQ ID NO: 4401380 - DNA, 16 bp, Homo sapiens
tgtatgtttttactga

SEQ ID NO: 4401381 - DNA, 17 bp, Homo sapiens
tgtatgtttttactgaa

SEQ ID NO: 4401382 - DNA, 16 bp, Homo sapiens
tgtattaagaaaggaa

SEQ ID NO: 4401383 - DNA, 13 bp, Homo sapiens
tgtattagatatc

SEQ ID NO: 4401384 - DNA, 18 bp, Homo sapiens
tgtattagatatcaatgt

SEQ ID NO: 4401385 - DNA, 15 bp, Homo sapiens
tgtattattacaaat

SEQ ID NO: 4401386 - DNA, 14 bp, Homo sapiens
tgtattcctttaaa

SEQ ID NO: 4401387 - DNA, 19 bp, Homo sapiens
tgtattcctttaaaatatt

SEQ ID NO: 4401388 - DNA, 13 bp, Homo sapiens
tgtattcttcatg

SEQ ID NO: 4401389 - DNA, 14 bp, Homo sapiens
tgtattcttcatga

SEQ ID NO: 4401390 - DNA, 15 bp, Homo sapiens
tgtattcttcatgaa

SEQ ID NO: 4401391 - DNA, 15 bp, Homo sapiens
tgtattcttgtttga

SEQ ID NO: 4401392 - DNA, 14 bp, Homo sapiens
tgtattctttataa

SEQ ID NO: 4401393 - DNA, 15 bp, Homo sapiens
tgtattgcttcctga

SEQ ID NO: 4401394 - DNA, 16 bp, Homo sapiens
tgtattgtaaatgtgg

SEQ ID NO: 4401395 - DNA, 21 bp, Homo sapiens
tgtattgtatattacaatgat

SEQ ID NO: 4401396 - DNA, 23 bp, Homo sapiens
tgtattgttgaaaaagtttgttt

SEQ ID NO: 4401397 - DNA, 15 bp, Homo sapiens
tgtattgtttctaca

SEQ ID NO: 4401398 - DNA, 19 bp, Homo sapiens
tgtattgtttctacaataa

SEQ ID NO: 4401399 - DNA, 14 bp, Homo sapiens
tgtatttaacagaa

SEQ ID NO: 4401400 - DNA, 21 bp, Homo sapiens
tgtatttaacagaaattgtat

SEQ ID NO: 4401401 - DNA, 18 bp, Homo sapiens
tgtatttaagatgtacat

SEQ ID NO: 4401402 - DNA, 21 bp, Homo sapiens
tgtatttaagatgtacattta

SEQ ID NO: 4401403 - DNA, 23 bp, Homo sapiens
tgtatttaagatgtacatttaat

SEQ ID NO: 4401404 - DNA, 20 bp, Homo sapiens
tgtatttaagcaaatactta

SEQ ID NO: 4401405 - DNA, 17 bp, Homo sapiens
tgtatttaattgtaaac

SEQ ID NO: 4401406 - DNA, 18 bp, Homo sapiens
tgtatttaattgtaaact

SEQ ID NO: 4401407 - DNA, 22 bp, Homo sapiens
tgtatttaattgtaaactgtac

SEQ ID NO: 4401408 - DNA, 17 bp, Homo sapiens
tgtatttatgtgtgagg

SEQ ID NO: 4401409 - DNA, 17 bp, Homo sapiens
tgtatttatttaaaact

SEQ ID NO: 4401410 - DNA, 15 bp, Homo sapiens
tgtatttcaaatatc

SEQ ID NO: 4401411 - DNA, 14 bp, Homo sapiens
tgtatttcagtatt

SEQ ID NO: 4401412 - DNA, 22 bp, Homo sapiens
tgtatttccaaacctggttcat

SEQ ID NO: 4401413 - DNA, 13 bp, Homo sapiens
tgtatttgctaat

SEQ ID NO: 4401414 - DNA, 17 bp, Homo sapiens
tgtatttgtagtgttat

SEQ ID NO: 4401415 - DNA, 17 bp, Homo sapiens
tgtatttgttatatata

SEQ ID NO: 4401416 - DNA, 19 bp, Homo sapiens
tgtatttgttatatataat

SEQ ID NO: 4401417 - DNA, 13 bp, Homo sapiens
tgtattttacata

SEQ ID NO: 4401418 - DNA, 19 bp, Homo sapiens
tgtattttatttagacaag

SEQ ID NO: 4401419 - DNA, 22 bp, Homo sapiens
tgtatttttacagctactttaa

SEQ ID NO: 4401420 - DNA, 20 bp, Homo sapiens
tgtcaaaaattttgaatgta

SEQ ID NO: 4401421 - DNA, 16 bp, Homo sapiens
tgtcaaactgtagaaa

SEQ ID NO: 4401422 - DNA, 14 bp, Homo sapiens
tgtcaaagaagctt

SEQ ID NO: 4401423 - DNA, 15 bp, Homo sapiens
tgtcaaataaacact

SEQ ID NO: 4401424 - DNA, 18 bp, Homo sapiens
tgtcaaataaacactgtg

SEQ ID NO: 4401425 - DNA, 22 bp, Homo sapiens
tgtcaacttcagttgaaaagag

SEQ ID NO: 4401426 - DNA, 20 bp, Homo sapiens
tgtcaacttcccatctggct

SEQ ID NO: 4401427 - DNA, 14 bp, Homo sapiens
tgtcaagacatttc

SEQ ID NO: 4401428 - DNA, 16 bp, Homo sapiens
tgtcaagcctgtgcaa

SEQ ID NO: 4401429 - DNA, 18 bp, Homo sapiens
tgtcaagctggtgctact

SEQ ID NO: 4401430 - DNA, 16 bp, Homo sapiens
tgtcaagtgcctgcac

SEQ ID NO: 4401431 - DNA, 18 bp, Homo sapiens
tgtcaagtgcctgcacca

SEQ ID NO: 4401432 - DNA, 18 bp, Homo sapiens
tgtcaagttcctttgggt

SEQ ID NO: 4401433 - DNA, 18 bp, Homo sapiens
tgtcaatagtattaacta

SEQ ID NO: 4401434 - DNA, 21 bp, Homo sapiens
tgtcacaacaattaaatatac

SEQ ID NO: 4401435 - DNA, 22 bp, Homo sapiens
tgtcacaacatggtgctacttc

SEQ ID NO: 4401436 - DNA, 17 bp, Homo sapiens
tgtcacaataaagttta

SEQ ID NO: 4401437 - DNA, 18 bp, Homo sapiens
tgtcacaataaagtttat

SEQ ID NO: 4401438 - DNA, 13 bp, Homo sapiens
tgtcacaccagcc

SEQ ID NO: 4401439 - DNA, 15 bp, Homo sapiens
tgtcacacccatggc

SEQ ID NO: 4401440 - DNA, 11 bp, Homo sapiens
tgtcacaggca

SEQ ID NO: 4401441 - DNA, 12 bp, Homo sapiens
tgtcacagttct

SEQ ID NO: 4401442 - DNA, 17 bp, Homo sapiens
tgtcacatacaactttt

SEQ ID NO: 4401443 - DNA, 19 bp, Homo sapiens
tgtcaccaccttcccagct

SEQ ID NO: 4401444 - DNA, 22 bp, Homo sapiens
tgtcacccttaggccagcacca

SEQ ID NO: 4401445 - DNA, 18 bp, Homo sapiens
tgtcaccggtcagtgcct

SEQ ID NO: 4401446 - DNA, 23 bp, Homo sapiens
tgtcacctcttccgactctttct

SEQ ID NO: 4401447 - DNA, 17 bp, Homo sapiens
tgtcacgagcccattct

SEQ ID NO: 4401448 - DNA, 18 bp, Homo sapiens
tgtcacggggttccctcc

SEQ ID NO: 4401449 - DNA, 14 bp, Homo sapiens
tgtcactatatctt

SEQ ID NO: 4401450 - DNA, 14 bp, Homo sapiens
tgtcacttgccaca

SEQ ID NO: 4401451 - DNA, 16 bp, Homo sapiens
tgtcacttgccacatg

SEQ ID NO: 4401452 - DNA, 15 bp, Homo sapiens
tgtcagaagcctcca

SEQ ID NO: 4401453 - DNA, 18 bp, Homo sapiens
tgtcagaagcctccaagc

SEQ ID NO: 4401454 - DNA, 19 bp, Homo sapiens
tgtcagattaaattacagc

SEQ ID NO: 4401455 - DNA, 22 bp, Homo sapiens
tgtcagcattcctattaatgtc

SEQ ID NO: 4401456 - DNA, 19 bp, Homo sapiens
tgtcagccatcgtcctggg

SEQ ID NO: 4401457 - DNA, 20 bp, Homo sapiens
tgtcagccatcgtcctggga

SEQ ID NO: 4401458 - DNA, 15 bp, Homo sapiens
tgtcagcggtgcagc

SEQ ID NO: 4401459 - DNA, 20 bp, Homo sapiens
tgtcagctcccctcggagaa

SEQ ID NO: 4401460 - DNA, 22 bp, Homo sapiens
tgtcagctgcaaggtactctgg

SEQ ID NO: 4401461 - DNA, 15 bp, Homo sapiens
tgtcagcttatccta

SEQ ID NO: 4401462 - DNA, 23 bp, Homo sapiens
tgtcaggctgctggcgcctctgc

SEQ ID NO: 4401463 - DNA, 24 bp, Homo sapiens
tgtcaggctgctggcgcctctgca

SEQ ID NO: 4401464 - DNA, 15 bp, Homo sapiens
tgtcagtgaggactc

SEQ ID NO: 4401465 - DNA, 20 bp, Homo sapiens
tgtcagtgttaaagattttg

SEQ ID NO: 4401466 - DNA, 22 bp, Homo sapiens
tgtcagttgttatttattgaaa

SEQ ID NO: 4401467 - DNA, 17 bp, Homo sapiens
tgtcagtttatcttaag

SEQ ID NO: 4401468 - DNA, 15 bp, Homo sapiens
tgtcataaactttct

SEQ ID NO: 4401469 - DNA, 22 bp, Homo sapiens
tgtcataaagtgagaaaactgt

SEQ ID NO: 4401470 - DNA, 20 bp, Homo sapiens
tgtcatagtcttgaaatgaa

SEQ ID NO: 4401471 - DNA, 19 bp, Homo sapiens
tgtcatcctcaaagaaagt

SEQ ID NO: 4401472 - DNA, 20 bp, Homo sapiens
tgtcatcctcaaagaaagtg

SEQ ID NO: 4401473 - DNA, 22 bp, Homo sapiens
tgtcatcctcaaagaaagtgta

SEQ ID NO: 4401474 - DNA, 14 bp, Homo sapiens
tgtcatctctctgg

SEQ ID NO: 4401475 - DNA, 16 bp, Homo sapiens
tgtcatctctctgggg

SEQ ID NO: 4401476 - DNA, 14 bp, Homo sapiens
tgtcatcttttcaa

SEQ ID NO: 4401477 - DNA, 20 bp, Homo sapiens
tgtcatggtcctttctggaa

SEQ ID NO: 4401478 - DNA, 21 bp, Homo sapiens
tgtcatgtactgacaactgtt

SEQ ID NO: 4401479 - DNA, 17 bp, Homo sapiens
tcagccttaagaaccat

SEQ ID NO: 4401480 - DNA, 16 bp, Homo sapiens
tcagccttcctcctca

SEQ ID NO: 4401481 - DNA, 13 bp, Homo sapiens
tcagcgctctgta

SEQ ID NO: 4401482 - DNA, 14 bp, Homo sapiens
tcagcggagctgac

SEQ ID NO: 4401483 - DNA, 15 bp, Homo sapiens
tcagcggagctgact

SEQ ID NO: 4401484 - DNA, 15 bp, Homo sapiens
tcagctaatgtcaca

SEQ ID NO: 4401485 - DNA, 22 bp, Homo sapiens
tcagctagttggggagctaagg

SEQ ID NO: 4401486 - DNA, 17 bp, Homo sapiens
tcagctcccctcggaga

SEQ ID NO: 4401487 - DNA, 15 bp, Homo sapiens
tcagctccttcctgg

SEQ ID NO: 4401488 - DNA, 16 bp, Homo sapiens
tcagctccttcctgga

SEQ ID NO: 4401489 - DNA, 18 bp, Homo sapiens
tcagctctctgggacctc

SEQ ID NO: 4401490 - DNA, 13 bp, Homo sapiens
tcagctctggggc

SEQ ID NO: 4401491 - DNA, 20 bp, Homo sapiens
tcagctgcaaggtactctgg

SEQ ID NO: 4401492 - DNA, 21 bp, Homo sapiens
tcagctgcaatccatttattt

SEQ ID NO: 4401493 - DNA, 12 bp, Homo sapiens
tcagctgcctca

SEQ ID NO: 4401494 - DNA, 21 bp, Homo sapiens
tcagctgcctcctgcgccctg

SEQ ID NO: 4401495 - DNA, 16 bp, Homo sapiens
tcagctgctgaaacaa

SEQ ID NO: 4401496 - DNA, 16 bp, Homo sapiens
tcagctgctggatgac

SEQ ID NO: 4401497 - DNA, 15 bp, Homo sapiens
tcagcttcctaccca

SEQ ID NO: 4401498 - DNA, 19 bp, Homo sapiens
tcagcttcgtttattttca

SEQ ID NO: 4401499 - DNA, 21 bp, Homo sapiens
tcagcttcgtttattttcaag

SEQ ID NO: 4401500 - DNA, 12 bp, Homo sapiens
tcagcttctccc

SEQ ID NO: 4401501 - DNA, 21 bp, Homo sapiens
tcagcttgcttagatgttcca

SEQ ID NO: 4401502 - DNA, 18 bp, Homo sapiens
tcagcttttgttctagac

SEQ ID NO: 4401503 - DNA, 19 bp, Homo sapiens
tcaggaaaaggttgaataa

SEQ ID NO: 4401504 - DNA, 18 bp, Homo sapiens
tcaggaaaattgaatgca

SEQ ID NO: 4401505 - DNA, 12 bp, Homo sapiens
tcaggaaagaat

SEQ ID NO: 4401506 - DNA, 14 bp, Homo sapiens
tcaggaaagaatag

SEQ ID NO: 4401507 - DNA, 22 bp, Homo sapiens
tcaggaaaggaatcatttctat

SEQ ID NO: 4401508 - DNA, 22 bp, Homo sapiens
tcaggaaatcaaatatgcaaag

SEQ ID NO: 4401509 - DNA, 16 bp, Homo sapiens
tcaggaattcttggag

SEQ ID NO: 4401510 - DNA, 20 bp, Homo sapiens
tcaggacagcatcccttccc

SEQ ID NO: 4401511 - DNA, 15 bp, Homo sapiens
tcaggacccagagga

SEQ ID NO: 4401512 - DNA, 19 bp, Homo sapiens
tcaggacccagaggaaggg

SEQ ID NO: 4401513 - DNA, 17 bp, Homo sapiens
tcaggacggctcctcag

SEQ ID NO: 4401514 - DNA, 22 bp, Homo sapiens
tcaggacggctcctcagagcgc

SEQ ID NO: 4401515 - DNA, 21 bp, Homo sapiens
tcaggactctgcgggaggctg

SEQ ID NO: 4401516 - DNA, 21 bp, Homo sapiens
tcaggagcttgggcagtgccc

SEQ ID NO: 4401517 - DNA, 17 bp, Homo sapiens
tcaggaggcgaataaat

SEQ ID NO: 4401518 - DNA, 20 bp, Homo sapiens
tcaggaggcgaataaatgtt

SEQ ID NO: 4401519 - DNA, 18 bp, Homo sapiens
tcaggaggctgaggcaga

SEQ ID NO: 4401520 - DNA, 15 bp, Homo sapiens
tcaggagtctgccac

SEQ ID NO: 4401521 - DNA, 21 bp, Homo sapiens
tcaggagttcaagaccagcct

SEQ ID NO: 4401522 - DNA, 14 bp, Homo sapiens
tcaggagtttgaga

SEQ ID NO: 4401523 - DNA, 23 bp, Homo sapiens
tcaggagtttgagaccaggctgg

SEQ ID NO: 4401524 - DNA, 22 bp, Homo sapiens
tcaggatatggcttaggaatga

SEQ ID NO: 4401525 - DNA, 15 bp, Homo sapiens
tcaggatccagtctg

SEQ ID NO: 4401526 - DNA, 21 bp, Homo sapiens
tcaggatgtaggggttaactt

SEQ ID NO: 4401527 - DNA, 16 bp, Homo sapiens
tcaggccagcccagcc

SEQ ID NO: 4401528 - DNA, 19 bp, Homo sapiens
tcaggccagcccagccagg

SEQ ID NO: 4401529 - DNA, 15 bp, Homo sapiens
tcaggcccaggagtc

SEQ ID NO: 4401530 - DNA, 19 bp, Homo sapiens
tcaggcccaggagtccagg

SEQ ID NO: 4401531 - DNA, 22 bp, Homo sapiens
tcaggccccgccccatgggccc

SEQ ID NO: 4401532 - DNA, 16 bp, Homo sapiens
tcaggcccggcagggc

SEQ ID NO: 4401533 - DNA, 21 bp, Homo sapiens
tcaggcccggcagggcgggca

SEQ ID NO: 4401534 - DNA, 16 bp, Homo sapiens
tcaggccctgactcct

SEQ ID NO: 4401535 - DNA, 19 bp, Homo sapiens
tcaggccctgactcctctg

SEQ ID NO: 4401536 - DNA, 22 bp, Homo sapiens
tcaggccctgactcctctggct

SEQ ID NO: 4401537 - DNA, 15 bp, Homo sapiens
tcaggccgagagcct

SEQ ID NO: 4401538 - DNA, 17 bp, Homo sapiens
tcaggcctccctctctc

SEQ ID NO: 4401539 - DNA, 14 bp, Homo sapiens
tcaggcctggcctc

SEQ ID NO: 4401540 - DNA, 16 bp, Homo sapiens
tcaggcggagctgctg

SEQ ID NO: 4401541 - DNA, 22 bp, Homo sapiens
tcaggctatcatatatactgta

SEQ ID NO: 4401542 - DNA, 12 bp, Homo sapiens
tcaggctcaacc

SEQ ID NO: 4401543 - DNA, 15 bp, Homo sapiens
tcaggctcaagtttt

SEQ ID NO: 4401544 - DNA, 16 bp, Homo sapiens
tcaggctcaagttttt

SEQ ID NO: 4401545 - DNA, 11 bp, Homo sapiens
tcaggctccta

SEQ ID NO: 4401546 - DNA, 17 bp, Homo sapiens
tcaggctgcagaggcac

SEQ ID NO: 4401547 - DNA, 13 bp, Homo sapiens
tcaggctgctggc

SEQ ID NO: 4401548 - DNA, 18 bp, Homo sapiens
tcagggacagagacacct

SEQ ID NO: 4401549 - DNA, 22 bp, Homo sapiens
tcagggaccggtgctgcaggag

SEQ ID NO: 4401550 - DNA, 13 bp, Homo sapiens
tcagggagcctcc

SEQ ID NO: 4401551 - DNA, 19 bp, Homo sapiens
tcagggcggcctcccaggt

SEQ ID NO: 4401552 - DNA, 20 bp, Homo sapiens
tcagggcggcctcccaggtc

SEQ ID NO: 4401553 - DNA, 21 bp, Homo sapiens
tcagggcggcctcccaggtcc

SEQ ID NO: 4401554 - DNA, 14 bp, Homo sapiens
tcagggctcccagg

SEQ ID NO: 4401555 - DNA, 14 bp, Homo sapiens
tcagggctgtccca

SEQ ID NO: 4401556 - DNA, 16 bp, Homo sapiens
tcaggggactcagccc

SEQ ID NO: 4401557 - DNA, 13 bp, Homo sapiens
tcaggggctccat

SEQ ID NO: 4401558 - DNA, 15 bp, Homo sapiens
tcaggggctccatgc

SEQ ID NO: 4401559 - DNA, 19 bp, Homo sapiens
tcagggtgggaagaaagaa

SEQ ID NO: 4401560 - DNA, 15 bp, Homo sapiens
tcaggtaatacaaac

SEQ ID NO: 4401561 - DNA, 18 bp, Homo sapiens
tcaggtaatcattttaat

SEQ ID NO: 4401562 - DNA, 18 bp, Homo sapiens
tcaggtgaggcatcttta

SEQ ID NO: 4401563 - DNA, 13 bp, Homo sapiens
tcaggttccagaa

SEQ ID NO: 4401564 - DNA, 15 bp, Homo sapiens
tcagtaaagtacctt

SEQ ID NO: 4401565 - DNA, 16 bp, Homo sapiens
tcagtaagctgtgtgg

SEQ ID NO: 4401566 - DNA, 18 bp, Homo sapiens
tcagtaatttagaaatca

SEQ ID NO: 4401567 - DNA, 23 bp, Homo sapiens
tcagtacttttttaaatattttc

SEQ ID NO: 4401568 - DNA, 13 bp, Homo sapiens
tcagtagaaagct

SEQ ID NO: 4401569 - DNA, 20 bp, Homo sapiens
tcagtagccatatcttccaa

SEQ ID NO: 4401570 - DNA, 20 bp, Homo sapiens
tcagtagtcacaaactgatc

SEQ ID NO: 4401571 - DNA, 17 bp, Homo sapiens
tcagtatattttctgta

SEQ ID NO: 4401572 - DNA, 18 bp, Homo sapiens
tcagtatattttctgtat

SEQ ID NO: 4401573 - DNA, 13 bp, Homo sapiens
tcagtatccaggc

SEQ ID NO: 4401574 - DNA, 14 bp, Homo sapiens
tcagtattctgaca

SEQ ID NO: 4401575 - DNA, 15 bp, Homo sapiens
tcagtattctgacat

SEQ ID NO: 4401576 - DNA, 13 bp, Homo sapiens
tcagtcattaaat

SEQ ID NO: 4401577 - DNA, 15 bp, Homo sapiens
tcagtcattttgggt

SEQ ID NO: 4401578 - DNA, 14 bp, Homo sapiens
tcagtctaaggtct

SEQ ID NO: 4401579 - DNA, 18 bp, Homo sapiens
tcagtctcagaatgtcat

SEQ ID NO: 4401580 - DNA, 13 bp, Homo sapiens
tcagtctctgagc

SEQ ID NO: 4401581 - DNA, 17 bp, Homo sapiens
tcagtctctgagcagtg

SEQ ID NO: 4401582 - DNA, 20 bp, Homo sapiens
tcagtctctgagcagtgaat

SEQ ID NO: 4401583 - DNA, 15 bp, Homo sapiens
tcagtctgctttctc

SEQ ID NO: 4401584 - DNA, 17 bp, Homo sapiens
tcagtctgctttctcta

SEQ ID NO: 4401585 - DNA, 16 bp, Homo sapiens
tcagtctggtgggagg

SEQ ID NO: 4401586 - DNA, 20 bp, Homo sapiens
tcagtgaagtctagaatcat

SEQ ID NO: 4401587 - DNA, 16 bp, Homo sapiens
tcagtgagcccctccc

SEQ ID NO: 4401588 - DNA, 18 bp, Homo sapiens
tcagtgagcccctcccca

SEQ ID NO: 4401589 - DNA, 21 bp, Homo sapiens
tcagtgagcctcctgtgcctg

SEQ ID NO: 4401590 - DNA, 14 bp, Homo sapiens
tcagtgatcttcac

SEQ ID NO: 4401591 - DNA, 17 bp, Homo sapiens
tcagtgcagcagaggac

SEQ ID NO: 4401592 - DNA, 14 bp, Homo sapiens
tcagtgcatttgtg

SEQ ID NO: 4401593 - DNA, 22 bp, Homo sapiens
tcagtgcccaccaacatcccat

SEQ ID NO: 4401594 - DNA, 12 bp, Homo sapiens
tcagtgctccct

SEQ ID NO: 4401595 - DNA, 13 bp, Homo sapiens
tcagtgcttgggc

SEQ ID NO: 4401596 - DNA, 16 bp, Homo sapiens
tcagtgcttgggctcc

SEQ ID NO: 4401597 - DNA, 19 bp, Homo sapiens
tcagtgcttgggctccacg

SEQ ID NO: 4401598 - DNA, 19 bp, Homo sapiens
tggtgctgccgagggctgg

SEQ ID NO: 4401599 - DNA, 22 bp, Homo sapiens
tggtgctgccgagggctggccg

SEQ ID NO: 4401600 - DNA, 23 bp, Homo sapiens
tggtgctgtcttttgttctctga

SEQ ID NO: 4401601 - DNA, 21 bp, Homo sapiens
tggtgctgtttaaagtcacat

SEQ ID NO: 4401602 - DNA, 23 bp, Homo sapiens
tggtgcttctcagatttctgagg

SEQ ID NO: 4401603 - DNA, 20 bp, Homo sapiens
tggtggaggaagggctgggc

SEQ ID NO: 4401604 - DNA, 23 bp, Homo sapiens
tggtggaggaagggctgggccac

SEQ ID NO: 4401605 - DNA, 15 bp, Homo sapiens
tggtggatgtaaata

SEQ ID NO: 4401606 - DNA, 21 bp, Homo sapiens
tggtggcaccagatgcaacct

SEQ ID NO: 4401607 - DNA, 18 bp, Homo sapiens
tggtggcatcacagaccc

SEQ ID NO: 4401608 - DNA, 20 bp, Homo sapiens
tggtggcctatttcagctgc

SEQ ID NO: 4401609 - DNA, 17 bp, Homo sapiens
tggtggcgcaagcctgt

SEQ ID NO: 4401610 - DNA, 23 bp, Homo sapiens
tggtggcggcgaagaagagaaag

SEQ ID NO: 4401611 - DNA, 14 bp, Homo sapiens
tggtgggatccacg

SEQ ID NO: 4401612 - DNA, 15 bp, Homo sapiens
tggtggggggcaggg

SEQ ID NO: 4401613 - DNA, 12 bp, Homo sapiens
tggtggtgcagc

SEQ ID NO: 4401614 - DNA, 17 bp, Homo sapiens
tggtggtttacgcctat

SEQ ID NO: 4401615 - DNA, 23 bp, Homo sapiens
tggtgtagtgtgtcagctctgtt

SEQ ID NO: 4401616 - DNA, 21 bp, Homo sapiens
tggtgtatatggtccactggt

SEQ ID NO: 4401617 - DNA, 18 bp, Homo sapiens
tggtgtcagtatccaggc

SEQ ID NO: 4401618 - DNA, 13 bp, Homo sapiens
tggtgtccacctg

SEQ ID NO: 4401619 - DNA, 14 bp, Homo sapiens
tggtgtccacctgg

SEQ ID NO: 4401620 - DNA, 18 bp, Homo sapiens
tggtgtccacctggcccc

SEQ ID NO: 4401621 - DNA, 13 bp, Homo sapiens
tggtgtccccttc

SEQ ID NO: 4401622 - DNA, 21 bp, Homo sapiens
tggtgtccccttcccctgctg

SEQ ID NO: 4401623 - DNA, 22 bp, Homo sapiens
tggtgtccccttcccctgctga

SEQ ID NO: 4401624 - DNA, 23 bp, Homo sapiens
tggtgtccccttcccctgctgac

SEQ ID NO: 4401625 - DNA, 23 bp, Homo sapiens
tggtgtcctgaggcctccaagga

SEQ ID NO: 4401626 - DNA, 23 bp, Homo sapiens
tggtgtgaccactgcagaagaca

SEQ ID NO: 4401627 - DNA, 17 bp, Homo sapiens
tggtgtgacctgagggc

SEQ ID NO: 4401628 - DNA, 21 bp, Homo sapiens
tggtgttacacagcccaagag

SEQ ID NO: 4401629 - DNA, 20 bp, Homo sapiens
tggtgttagggggatgagca

SEQ ID NO: 4401630 - DNA, 20 bp, Homo sapiens
tggtgttcgtttccatcatg

SEQ ID NO: 4401631 - DNA, 13 bp, Homo sapiens
tggtgtttgactg

SEQ ID NO: 4401632 - DNA, 17 bp, Homo sapiens
tggtgtttgactgtaat

SEQ ID NO: 4401633 - DNA, 15 bp, Homo sapiens
tggtgtttgtctgtg

SEQ ID NO: 4401634 - DNA, 13 bp, Homo sapiens
tggtgttttgtca

SEQ ID NO: 4401635 - DNA, 15 bp, Homo sapiens
tggttaaaatgtgat

SEQ ID NO: 4401636 - DNA, 18 bp, Homo sapiens
tggttaaaatgtgatttt

SEQ ID NO: 4401637 - DNA, 21 bp, Homo sapiens
tggttaacagagctaagaaat

SEQ ID NO: 4401638 - DNA, 21 bp, Homo sapiens
tggttaagttggcttctgttt

SEQ ID NO: 4401639 - DNA, 13 bp, Homo sapiens
tggttacactgtt

SEQ ID NO: 4401640 - DNA, 13 bp, Homo sapiens
tggttactttcaa

SEQ ID NO: 4401641 - DNA, 17 bp, Homo sapiens
tggttagtatttaacta

SEQ ID NO: 4401642 - DNA, 15 bp, Homo sapiens
tggttatagccctgc

SEQ ID NO: 4401643 - DNA, 13 bp, Homo sapiens
tggttatttttct

SEQ ID NO: 4401644 - DNA, 21 bp, Homo sapiens
tggttatttttctcttgtacc

SEQ ID NO: 4401645 - DNA, 23 bp, Homo sapiens
tggttatttttctcttgtaccat

SEQ ID NO: 4401646 - DNA, 19 bp, Homo sapiens
tggttccagatacttcagc

SEQ ID NO: 4401647 - DNA, 13 bp, Homo sapiens
tggttctcatctt

SEQ ID NO: 4401648 - DNA, 15 bp, Homo sapiens
tggttctcatctttc

SEQ ID NO: 4401649 - DNA, 17 bp, Homo sapiens
tggttctggctgtttga

SEQ ID NO: 4401650 - DNA, 12 bp, Homo sapiens
tggttctgtgac

SEQ ID NO: 4401651 - DNA, 13 bp, Homo sapiens
tggttctgtgacc

SEQ ID NO: 4401652 - DNA, 23 bp, Homo sapiens
tggttgaactctggtggcacagg

SEQ ID NO: 4401653 - DNA, 23 bp, Homo sapiens
tggttgacccaaaaatgttccct

SEQ ID NO: 4401654 - DNA, 12 bp, Homo sapiens
tggttgaggaaa

SEQ ID NO: 4401655 - DNA, 18 bp, Homo sapiens
tggttgatgccaaaaaaa

SEQ ID NO: 4401656 - DNA, 17 bp, Homo sapiens
tggttgcctcccccgcc

SEQ ID NO: 4401657 - DNA, 19 bp, Homo sapiens
tggttgggtggcaattcca

SEQ ID NO: 4401658 - DNA, 24 bp, Homo sapiens
tggttggttttgacttcagattga

SEQ ID NO: 4401659 - DNA, 15 bp, Homo sapiens
tggtttaaagaaagt

SEQ ID NO: 4401660 - DNA, 14 bp, Homo sapiens
tggtttagtctttt

SEQ ID NO: 4401661 - DNA, 19 bp, Homo sapiens
tggtttatcagcaaaaaag

SEQ ID NO: 4401662 - DNA, 15 bp, Homo sapiens
tggtttcaagaatat

SEQ ID NO: 4401663 - DNA, 12 bp, Homo sapiens
tggtttcatgtt

SEQ ID NO: 4401664 - DNA, 15 bp, Homo sapiens
tggtttcatgttagt

SEQ ID NO: 4401665 - DNA, 15 bp, Homo sapiens
tggtttccaaagaat

SEQ ID NO: 4401666 - DNA, 14 bp, Homo sapiens
tggtttccaatgtg

SEQ ID NO: 4401667 - DNA, 16 bp, Homo sapiens
tggtttccaatgtgtt

SEQ ID NO: 4401668 - DNA, 13 bp, Homo sapiens
tggtttcccaaga

SEQ ID NO: 4401669 - DNA, 17 bp, Homo sapiens
tggtttctcatgagctg

SEQ ID NO: 4401670 - DNA, 15 bp, Homo sapiens
tggtttctcctggta

SEQ ID NO: 4401671 - DNA, 13 bp, Homo sapiens
tggtttgagattg

SEQ ID NO: 4401672 - DNA, 17 bp, Homo sapiens
tggtttggaatattaaa

SEQ ID NO: 4401673 - DNA, 23 bp, Homo sapiens
tggtttgtgaatccatcttgctt

SEQ ID NO: 4401674 - DNA, 13 bp, Homo sapiens
tggttttacacag

SEQ ID NO: 4401675 - DNA, 17 bp, Homo sapiens
tggttttacacagagaa

SEQ ID NO: 4401676 - DNA, 17 bp, Homo sapiens
tggttttattacaaatg

SEQ ID NO: 4401677 - DNA, 13 bp, Homo sapiens
tggttttccatga

SEQ ID NO: 4401678 - DNA, 19 bp, Homo sapiens
tggttttctccaagagcta

SEQ ID NO: 4401679 - DNA, 20 bp, Homo sapiens
tggttttctccaagagctac

SEQ ID NO: 4401680 - DNA, 13 bp, Homo sapiens
tggttttctgcca

SEQ ID NO: 4401681 - DNA, 18 bp, Homo sapiens
tggttttctgccaatgac

SEQ ID NO: 4401682 - DNA, 12 bp, Homo sapiens
tggttttgaaat

SEQ ID NO: 4401683 - DNA, 16 bp, Homo sapiens
tggttttgttcccctc

SEQ ID NO: 4401684 - DNA, 15 bp, Homo sapiens
tggtttttaaatttt

SEQ ID NO: 4401685 - DNA, 21 bp, Homo sapiens
tggtttttcctcattgagaat

SEQ ID NO: 4401686 - DNA, 12 bp, Homo sapiens
tgtaaaaaagaa

SEQ ID NO: 4401687 - DNA, 18 bp, Homo sapiens
tgtaaaaaagaaaaaact

SEQ ID NO: 4401688 - DNA, 11 bp, Homo sapiens
tgtaaaaatga

SEQ ID NO: 4401689 - DNA, 14 bp, Homo sapiens
tgtaaaaatgcttc

SEQ ID NO: 4401690 - DNA, 22 bp, Homo sapiens
tgtaaaacaggtagaattatct

SEQ ID NO: 4401691 - DNA, 12 bp, Homo sapiens
tgtaaaacttta

SEQ ID NO: 4401692 - DNA, 12 bp, Homo sapiens
tgtaaaagaaat

SEQ ID NO: 4401693 - DNA, 16 bp, Homo sapiens
tgtaaaagtgtacaga

SEQ ID NO: 4401694 - DNA, 19 bp, Homo sapiens
tgtaaaagtgtacagactc

SEQ ID NO: 4401695 - DNA, 20 bp, Homo sapiens
tgtaaaagtgtacagactct

SEQ ID NO: 4401696 - DNA, 21 bp, Homo sapiens
tgtaaaatattttgaatcaat

SEQ ID NO: 4401697 - DNA, 22 bp, Homo sapiens
tgtaaaatgaattgaaaaacaa

SEQ ID NO: 4401698 - DNA, 20 bp, Homo sapiens
tgtaaaatgcacccatcagt

SEQ ID NO: 4401699 - DNA, 12 bp, Homo sapiens
tgtaaaatggtg

SEQ ID NO: 4401700 - DNA, 11 bp, Homo sapiens
tgtaaaattaa

SEQ ID NO: 4401701 - DNA, 14 bp, Homo sapiens
tgtaaaattaatgt

SEQ ID NO: 4401702 - DNA, 21 bp, Homo sapiens
tgtaaaattaatgtaataaag

SEQ ID NO: 4401703 - DNA, 19 bp, Homo sapiens
tgtaaacctgagtcgtaca

SEQ ID NO: 4401704 - DNA, 18 bp, Homo sapiens
tgtaaactgtactagtct

SEQ ID NO: 4401705 - DNA, 23 bp, Homo sapiens
tgtaaactgtactagtctgtgtg

SEQ ID NO: 4401706 - DNA, 15 bp, Homo sapiens
tgtaaactgtgcacc

SEQ ID NO: 4401707 - DNA, 18 bp, Homo sapiens
tgtaaactgtgtattcca

SEQ ID NO: 4401708 - DNA, 22 bp, Homo sapiens
tgtaaagactgagcagaactga

SEQ ID NO: 4401709 - DNA, 19 bp, Homo sapiens
tgtaaaggagtcaaaacta

SEQ ID NO: 4401710 - DNA, 12 bp, Homo sapiens
tgtaaagtattt

SEQ ID NO: 4401711 - DNA, 22 bp, Homo sapiens
tgtaaagtatttgatgtacatt

SEQ ID NO: 4401712 - DNA, 20 bp, Homo sapiens
tgtaaagtgtgtgattgaag

SEQ ID NO: 4401713 - DNA, 19 bp, Homo sapiens
tgtaaagttggttggataa

SEQ ID NO: 4401714 - DNA, 23 bp, Homo sapiens
tgtaaataaccccattctttgct

SEQ ID NO: 4401715 - DNA, 18 bp, Homo sapiens
tgtaaataggatttttag

SEQ ID NO: 4401716 - DNA, 13 bp, Homo sapiens
tgtaaatatccct

SEQ ID NO: 4401717 - DNA, 16 bp, Homo sapiens
tgtaaatatccctccc

SEQ ID NO: 4401718 - DNA, 19 bp, Homo sapiens
tgtaaatatccctcccctc

SEQ ID NO: 4401719 - DNA, 20 bp, Homo sapiens
tgtaaatattttaaagaatt

SEQ ID NO: 4401720 - DNA, 22 bp, Homo sapiens
tgtaaatattttaaagaattgt

SEQ ID NO: 4401721 - DNA, 21 bp, Homo sapiens
tgtaaatcatgttgatcatgt

SEQ ID NO: 4401722 - DNA, 13 bp, Homo sapiens
tgtaaatcctgtg

SEQ ID NO: 4401723 - DNA, 13 bp, Homo sapiens
tgtaaatccttgt

SEQ ID NO: 4401724 - DNA, 22 bp, Homo sapiens
tgtaaatctttttgcttctact

SEQ ID NO: 4401725 - DNA, 18 bp, Homo sapiens
tgtaaatgcctcttaaat

SEQ ID NO: 4401726 - DNA, 22 bp, Homo sapiens
tgtaaatgtgttagcactgata

SEQ ID NO: 4401727 - DNA, 15 bp, Homo sapiens
tgtaaattatatttg

SEQ ID NO: 4401728 - DNA, 18 bp, Homo sapiens
tgtaaattattttaaatt

SEQ ID NO: 4401729 - DNA, 22 bp, Homo sapiens
tgtaaattgactgtactaggcc

SEQ ID NO: 4401730 - DNA, 20 bp, Homo sapiens
tgtaaattgcagaattcaaa

SEQ ID NO: 4401731 - DNA, 16 bp, Homo sapiens
tgtaaatttatgtgat

SEQ ID NO: 4401732 - DNA, 17 bp, Homo sapiens
tgtaaatttatgtgatg

SEQ ID NO: 4401733 - DNA, 21 bp, Homo sapiens
tgtaacaagttccattatgaa

SEQ ID NO: 4401734 - DNA, 22 bp, Homo sapiens
tgtaacaagttccattatgaaa

SEQ ID NO: 4401735 - DNA, 16 bp, Homo sapiens
tgtaacacaggataaa

SEQ ID NO: 4401736 - DNA, 11 bp, Homo sapiens
tgtaacatgta

SEQ ID NO: 4401737 - DNA, 18 bp, Homo sapiens
tgtaactactttataact

SEQ ID NO: 4401738 - DNA, 13 bp, Homo sapiens
tgtaactccacca

SEQ ID NO: 4401739 - DNA, 21 bp, Homo sapiens
tgtaactgaggactgtttgca

SEQ ID NO: 4401740 - DNA, 18 bp, Homo sapiens
tgtaactgttacagtaat

SEQ ID NO: 4401741 - DNA, 13 bp, Homo sapiens
tgtaacttcaaat

SEQ ID NO: 4401742 - DNA, 16 bp, Homo sapiens
tgtaacttgcttaaat

SEQ ID NO: 4401743 - DNA, 18 bp, Homo sapiens
tgtaactttcataccact

SEQ ID NO: 4401744 - DNA, 20 bp, Homo sapiens
tgtaagaacacattttaaat

SEQ ID NO: 4401745 - DNA, 13 bp, Homo sapiens
tgtaagaactgta

SEQ ID NO: 4401746 - DNA, 14 bp, Homo sapiens
tgtaagaaggcaat

SEQ ID NO: 4401747 - DNA, 17 bp, Homo sapiens
tgtaagcactctggatg

SEQ ID NO: 4401748 - DNA, 20 bp, Homo sapiens
tgtaagccaaagaaatgaac

SEQ ID NO: 4401749 - DNA, 12 bp, Homo sapiens
tgtaaggggaag

SEQ ID NO: 4401750 - DNA, 17 bp, Homo sapiens
tgtaaggtgcttgctcc

SEQ ID NO: 4401751 - DNA, 11 bp, Homo sapiens
tgtaataaagt

SEQ ID NO: 4401752 - DNA, 13 bp, Homo sapiens
tgtaataaagtga

SEQ ID NO: 4401753 - DNA, 14 bp, Homo sapiens
tgtaataaagtgaa

SEQ ID NO: 4401754 - DNA, 16 bp, Homo sapiens
tgtaataaagtgtttt

SEQ ID NO: 4401755 - DNA, 17 bp, Homo sapiens
tgtaataaagtgttttc

SEQ ID NO: 4401756 - DNA, 18 bp, Homo sapiens
tgtaataatcattttaga

SEQ ID NO: 4401757 - DNA, 14 bp, Homo sapiens
tgtaataatgtaca

SEQ ID NO: 4401758 - DNA, 15 bp, Homo sapiens
tgtaataatgtacag

SEQ ID NO: 4401759 - DNA, 14 bp, Homo sapiens
tgtaatacttcttt

SEQ ID NO: 4401760 - DNA, 23 bp, Homo sapiens
tgtaatacttctttgttattata

SEQ ID NO: 4401761 - DNA, 18 bp, Homo sapiens
tgtaatagatgtttgata

SEQ ID NO: 4401762 - DNA, 23 bp, Homo sapiens
tgtaatagttctatccttttgcc

SEQ ID NO: 4401763 - DNA, 19 bp, Homo sapiens
tgtaatatttacaatgtat

SEQ ID NO: 4401764 - DNA, 21 bp, Homo sapiens
tgtaatatttacaatgtatta

SEQ ID NO: 4401765 - DNA, 17 bp, Homo sapiens
tgtaatatttcttcaaa

SEQ ID NO: 4401766 - DNA, 20 bp, Homo sapiens
tgtaatcaaaaggaggaatt

SEQ ID NO: 4401767 - DNA, 14 bp, Homo sapiens
tgtaatcacagcta

SEQ ID NO: 4401768 - DNA, 23 bp, Homo sapiens
tgtaatcattatctcactttgta

SEQ ID NO: 4401769 - DNA, 19 bp, Homo sapiens
tgtaatcatttgtttacat

SEQ ID NO: 4401770 - DNA, 15 bp, Homo sapiens
tgtaatcccagcact

SEQ ID NO: 4401771 - DNA, 20 bp, Homo sapiens
tgtaatcccagctactcagg

SEQ ID NO: 4401772 - DNA, 21 bp, Homo sapiens
tgtaatcccagctactcagga

SEQ ID NO: 4401773 - DNA, 21 bp, Homo sapiens
tgtaatctaagtatatgtgag

SEQ ID NO: 4401774 - DNA, 20 bp, Homo sapiens
tgtaatcttatttaggaagt

SEQ ID NO: 4401775 - DNA, 14 bp, Homo sapiens
tgtaatcttcccca

SEQ ID NO: 4401776 - DNA, 19 bp, Homo sapiens
tgtaatcttgttgataaaa

SEQ ID NO: 4401777 - DNA, 13 bp, Homo sapiens
tgtaatgtcacca

SEQ ID NO: 4401778 - DNA, 16 bp, Homo sapiens
tgtaatgtcaccacct

SEQ ID NO: 4401779 - DNA, 13 bp, Homo sapiens
tgtaatgttttct

SEQ ID NO: 4401780 - DNA, 18 bp, Homo sapiens
tgtaatgttttctttgca

SEQ ID NO: 4401781 - DNA, 21 bp, Homo sapiens
tgtaatgttttctttgcaaag

SEQ ID NO: 4401782 - DNA, 16 bp, Homo sapiens
tgtaattaaaagcaaa

SEQ ID NO: 4401783 - DNA, 15 bp, Homo sapiens
tgtaattaaactagt

SEQ ID NO: 4401784 - DNA, 23 bp, Homo sapiens
tgtaattagtgccacttaatgta

SEQ ID NO: 4401785 - DNA, 17 bp, Homo sapiens
tgtaattgtaattccaa

SEQ ID NO: 4401786 - DNA, 17 bp, Homo sapiens
tgtaatttaaaattgtg

SEQ ID NO: 4401787 - DNA, 19 bp, Homo sapiens
tgtaatttcagctagttaa

SEQ ID NO: 4401788 - DNA, 21 bp, Homo sapiens
tgtaatttcgccttaaactct

SEQ ID NO: 4401789 - DNA, 22 bp, Homo sapiens
tgtaatttcgccttaaactctg

SEQ ID NO: 4401790 - DNA, 18 bp, Homo sapiens
tgtaatttctttaaatgt

SEQ ID NO: 4401791 - DNA, 15 bp, Homo sapiens
tgtaatttgtgtaat

SEQ ID NO: 4401792 - DNA, 13 bp, Homo sapiens
tgtacaaacatgt

SEQ ID NO: 4401793 - DNA, 15 bp, Homo sapiens
tgtacaaccctgacc

SEQ ID NO: 4401794 - DNA, 18 bp, Homo sapiens
tgtacaaccctgaccgtg

SEQ ID NO: 4401795 - DNA, 13 bp, Homo sapiens
tgtacaacttttt

SEQ ID NO: 4401796 - DNA, 18 bp, Homo sapiens
tgtacaactttttaaata

SEQ ID NO: 4401797 - DNA, 16 bp, Homo sapiens
tgtacaagatgaagga

SEQ ID NO: 4401798 - DNA, 12 bp, Homo sapiens
tgtacaataaaa

SEQ ID NO: 4401799 - DNA, 16 bp, Homo sapiens
tgtacaattaaaaacc

SEQ ID NO: 4401800 - DNA, 15 bp, Homo sapiens
tgtacaattttaaag

SEQ ID NO: 4401801 - DNA, 18 bp, Homo sapiens
tgtacaattttaaagttc

SEQ ID NO: 4401802 - DNA, 21 bp, Homo sapiens
tgtacacagtgggaagatttt

SEQ ID NO: 4401803 - DNA, 14 bp, Homo sapiens
tgtacacatttctt

SEQ ID NO: 4401804 - DNA, 20 bp, Homo sapiens
tgtacacatttcttaaaaca

SEQ ID NO: 4401805 - DNA, 19 bp, Homo sapiens
tgtacagacatatttaact

SEQ ID NO: 4401806 - DNA, 22 bp, Homo sapiens
tgtacagacatatttaactggt

SEQ ID NO: 4401807 - DNA, 18 bp, Homo sapiens
tgtacagaggaagctgtt

SEQ ID NO: 4401808 - DNA, 18 bp, Homo sapiens
tgtacagtctgtcatgaa

SEQ ID NO: 4401809 - DNA, 12 bp, Homo sapiens
tgtacagtcttg

SEQ ID NO: 4401810 - DNA, 14 bp, Homo sapiens
tgtacagtcttgta

SEQ ID NO: 4401811 - DNA, 15 bp, Homo sapiens
tgtacagtcttgtat

SEQ ID NO: 4401812 - DNA, 21 bp, Homo sapiens
tgtacagtcttgtattaagtt

SEQ ID NO: 4401813 - DNA, 15 bp, Homo sapiens
tgtacataactgaaa

SEQ ID NO: 4401814 - DNA, 18 bp, Homo sapiens
tgtacataactgaaaatg

SEQ ID NO: 4401815 - DNA, 18 bp, Homo sapiens
tgtacataattgcatgaa

SEQ ID NO: 4401816 - DNA, 19 bp, Homo sapiens
tgtacataattgcatgaaa

SEQ ID NO: 4401817 - DNA, 20 bp, Homo sapiens
tgtacataattgcatgaaaa

SEQ ID NO: 4401818 - DNA, 22 bp, Homo sapiens
tgtacataattgcatgaaaata

SEQ ID NO: 4401819 - DNA, 22 bp, Homo sapiens
tgtacatagttatttttctctt

SEQ ID NO: 4401820 - DNA, 22 bp, Homo sapiens
tgtacatatcaaatagatattt

SEQ ID NO: 4401821 - DNA, 18 bp, Homo sapiens
tgtacatctattttggat

SEQ ID NO: 4401822 - DNA, 23 bp, Homo sapiens
tgtacatctattttggattgtat

SEQ ID NO: 4401823 - DNA, 11 bp, Homo sapiens
tgtacatgata

SEQ ID NO: 4401824 - DNA, 19 bp, Homo sapiens
tgtacatgataagacattt

SEQ ID NO: 4401825 - DNA, 23 bp, Homo sapiens
tgtacatgataagacattttgtt

SEQ ID NO: 4401826 - DNA, 14 bp, Homo sapiens
tgtacattcttcca

SEQ ID NO: 4401827 - DNA, 15 bp, Homo sapiens
tgtacattcttccat

SEQ ID NO: 4401828 - DNA, 18 bp, Homo sapiens
tgtacattcttccatcat

SEQ ID NO: 4401829 - DNA, 23 bp, Homo sapiens
tgtacattcttccatcatcactg

SEQ ID NO: 4401830 - DNA, 17 bp, Homo sapiens
tgtacattgtgagctct

SEQ ID NO: 4401831 - DNA, 20 bp, Homo sapiens
tgtacattttgtaaaatatt

SEQ ID NO: 4401832 - DNA, 20 bp, Homo sapiens
tgtacatttttcagcagcaa

SEQ ID NO: 4401833 - DNA, 13 bp, Homo sapiens
tgtaccaaaattt

SEQ ID NO: 4401834 - DNA, 20 bp, Homo sapiens
tgtaccaagtgcttcctaca

SEQ ID NO: 4401835 - DNA, 21 bp, Homo sapiens
tgtaccaagtgcttcctacaa

SEQ ID NO: 4401836 - DNA, 22 bp, Homo sapiens
tgtaccagtgaatttttgcaat

SEQ ID NO: 4401837 - DNA, 11 bp, Homo sapiens
tgtaccagtta

SEQ ID NO: 4401838 - DNA, 18 bp, Homo sapiens
tgtaccatagaaaaatgt

SEQ ID NO: 4401839 - DNA, 19 bp, Homo sapiens
tgtaccatagaaaaatgta

SEQ ID NO: 4401840 - DNA, 18 bp, Homo sapiens
tgtaccattttaaagtta

SEQ ID NO: 4401841 - DNA, 16 bp, Homo sapiens
tgtacccgagcacata

SEQ ID NO: 4401842 - DNA, 15 bp, Homo sapiens
tgtacctcactgtcc

SEQ ID NO: 4401843 - DNA, 18 bp, Homo sapiens
tgtacctgcccccaatcc

SEQ ID NO: 4401844 - DNA, 15 bp, Homo sapiens
tgtacctgtggctgt

SEQ ID NO: 4401845 - DNA, 18 bp, Homo sapiens
tgtacctgtggctgtgtg

SEQ ID NO: 4401846 - DNA, 20 bp, Homo sapiens
tgtaccttaagatattgaag

SEQ ID NO: 4401847 - DNA, 16 bp, Homo sapiens
tgtactaactagcatt

SEQ ID NO: 4401848 - DNA, 22 bp, Homo sapiens
tgtactacagctatatttgatt

SEQ ID NO: 4401849 - DNA, 21 bp, Homo sapiens
tgtactacgtgccagctctag

SEQ ID NO: 4401850 - DNA, 14 bp, Homo sapiens
tgtactatgtctga

SEQ ID NO: 4401851 - DNA, 20 bp, Homo sapiens
tgtactccagcctgggcaac

SEQ ID NO: 4401852 - DNA, 22 bp, Homo sapiens
tgtactcttctgactgccccct

SEQ ID NO: 4401853 - DNA, 14 bp, Homo sapiens
tgtactgaattttt

SEQ ID NO: 4401854 - DNA, 23 bp, Homo sapiens
tgtactgaatttttttgtaataa

SEQ ID NO: 4401855 - DNA, 17 bp, Homo sapiens
tgtactgatttcagtaa

SEQ ID NO: 4401856 - DNA, 15 bp, Homo sapiens
tgtactggttcattg

SEQ ID NO: 4401857 - DNA, 14 bp, Homo sapiens
tgtacttaaatgag

SEQ ID NO: 4401858 - DNA, 11 bp, Homo sapiens
tgtacttcctg

SEQ ID NO: 4401859 - DNA, 12 bp, Homo sapiens
tgtacttcctga

SEQ ID NO: 4401860 - DNA, 22 bp, Homo sapiens
tgtacttcttcatccatagaca

SEQ ID NO: 4401861 - DNA, 16 bp, Homo sapiens
tgtacttcttgaatat

SEQ ID NO: 4401862 - DNA, 21 bp, Homo sapiens
tgtacttgaaaaatgttttta

SEQ ID NO: 4401863 - DNA, 14 bp, Homo sapiens
tgtacttgtttgaa

SEQ ID NO: 4401864 - DNA, 19 bp, Homo sapiens
tgtactttatcatgaatgc

SEQ ID NO: 4401865 - DNA, 21 bp, Homo sapiens
tgtactttatcatgaatgctt

SEQ ID NO: 4401866 - DNA, 20 bp, Homo sapiens
tgtactttttagtaatttct

SEQ ID NO: 4401867 - DNA, 21 bp, Homo sapiens
tgtagaaaagggaactgaaca

SEQ ID NO: 4401868 - DNA, 15 bp, Homo sapiens
tgtagaataaatggt

SEQ ID NO: 4401869 - DNA, 15 bp, Homo sapiens
tgtagaatattcaga

SEQ ID NO: 4401870 - DNA, 20 bp, Homo sapiens
tgtagaatctcttcatgctt

SEQ ID NO: 4401871 - DNA, 14 bp, Homo sapiens
tgtagaattgaaaa

SEQ ID NO: 4401872 - DNA, 16 bp, Homo sapiens
tgtagactgtttcaca

SEQ ID NO: 4401873 - DNA, 16 bp, Homo sapiens
tgtagaggagaaactg

SEQ ID NO: 4401874 - DNA, 22 bp, Homo sapiens
tgtagagtaacacataacattg

SEQ ID NO: 4401875 - DNA, 15 bp, Homo sapiens
tgtagatatttgaaa

SEQ ID NO: 4401876 - DNA, 18 bp, Homo sapiens
tgtagattgattgtattg

SEQ ID NO: 4401877 - DNA, 12 bp, Homo sapiens
tgtagatttctg

SEQ ID NO: 4401878 - DNA, 18 bp, Homo sapiens
tgtagatttgaaaattgt

SEQ ID NO: 4401879 - DNA, 21 bp, Homo sapiens
tgtagcaaatttgtttaatct

SEQ ID NO: 4401880 - DNA, 16 bp, Homo sapiens
tgtagcaatggccaga

SEQ ID NO: 4401881 - DNA, 19 bp, Homo sapiens
tgtagcaatggccagagcc

SEQ ID NO: 4401882 - DNA, 20 bp, Homo sapiens
tgtagcacttacgtaaaaca

SEQ ID NO: 4401883 - DNA, 13 bp, Homo sapiens
tgtagcatataaa

SEQ ID NO: 4401884 - DNA, 18 bp, Homo sapiens
tgtagccagctgtgcact

SEQ ID NO: 4401885 - DNA, 15 bp, Homo sapiens
tgtagccttcacaca

SEQ ID NO: 4401886 - DNA, 15 bp, Homo sapiens
tgtagctaaaaataa

SEQ ID NO: 4401887 - DNA, 14 bp, Homo sapiens
tgtagctctgcctc

SEQ ID NO: 4401888 - DNA, 17 bp, Homo sapiens
tgtagcttatctgcccc

SEQ ID NO: 4401889 - DNA, 20 bp, Homo sapiens
tgtagcttatctgcccctcc

SEQ ID NO: 4401890 - DNA, 16 bp, Homo sapiens
tgtagcttcagtcatt

SEQ ID NO: 4401891 - DNA, 17 bp, Homo sapiens
tgtaggcacttttattt

SEQ ID NO: 4401892 - DNA, 23 bp, Homo sapiens
tgtaggtggtctggagctgtccg

SEQ ID NO: 4401893 - DNA, 16 bp, Homo sapiens
tgtaggtgtctgcctt

SEQ ID NO: 4401894 - DNA, 14 bp, Homo sapiens
tgtagtaacactaa

SEQ ID NO: 4401895 - DNA, 19 bp, Homo sapiens
tgtagtaatctgcattatt

SEQ ID NO: 4401896 - DNA, 14 bp, Homo sapiens
tgtagtaattgaca

SEQ ID NO: 4401897 - DNA, 13 bp, Homo sapiens
tgtagtaatttat

SEQ ID NO: 4401898 - DNA, 16 bp, Homo sapiens
tgtagtagcgtttttt

SEQ ID NO: 4401899 - DNA, 14 bp, Homo sapiens
tgtagtatggtata

SEQ ID NO: 4401900 - DNA, 18 bp, Homo sapiens
tgtagtattttttgtata

SEQ ID NO: 4401901 - DNA, 19 bp, Homo sapiens
tgtagtattttttgtataa

SEQ ID NO: 4401902 - DNA, 13 bp, Homo sapiens
tgtagtcccagct

SEQ ID NO: 4401903 - DNA, 23 bp, Homo sapiens
tgtagtcccagctacttgggagg

SEQ ID NO: 4401904 - DNA, 20 bp, Homo sapiens
tgtagtcctagctactcagg

SEQ ID NO: 4401905 - DNA, 22 bp, Homo sapiens
tgtagtgaatcacgtaaagcta

SEQ ID NO: 4401906 - DNA, 13 bp, Homo sapiens
tgtagtgagccaa

SEQ ID NO: 4401907 - DNA, 19 bp, Homo sapiens
tgtagtgcatttttaaact

SEQ ID NO: 4401908 - DNA, 20 bp, Homo sapiens
tgtagtgcatttttaaactt

SEQ ID NO: 4401909 - DNA, 22 bp, Homo sapiens
tgtagtgtattaatctctgtgt

SEQ ID NO: 4401910 - DNA, 16 bp, Homo sapiens
tgtagttgaataaaaa

SEQ ID NO: 4401911 - DNA, 14 bp, Homo sapiens
tgtagtttgaaagt

SEQ ID NO: 4401912 - DNA, 22 bp, Homo sapiens
tgtagtttgaaagttgtacatg

SEQ ID NO: 4401913 - DNA, 17 bp, Homo sapiens
tgtagttttattttatg

SEQ ID NO: 4401914 - DNA, 22 bp, Homo sapiens
tgtagttttccctgcactgtgt

SEQ ID NO: 4401915 - DNA, 14 bp, Homo sapiens
tgtagttttgtata

SEQ ID NO: 4401916 - DNA, 15 bp, Homo sapiens
tgtataaaaaagaaa

SEQ ID NO: 4401917 - DNA, 21 bp, Homo sapiens
tgtataaaaaagaaaacttgt

SEQ ID NO: 4401918 - DNA, 18 bp, Homo sapiens
tgtataaaaattatcaaa

SEQ ID NO: 4401919 - DNA, 13 bp, Homo sapiens
tgtataaaagtgt

SEQ ID NO: 4401920 - DNA, 13 bp, Homo sapiens
tgtataaagcatg

SEQ ID NO: 4401921 - DNA, 13 bp, Homo sapiens
tgtataaattact

SEQ ID NO: 4401922 - DNA, 20 bp, Homo sapiens
tgtataacattaagaaaata

SEQ ID NO: 4401923 - DNA, 14 bp, Homo sapiens
tgtataatattgaa

SEQ ID NO: 4401924 - DNA, 21 bp, Homo sapiens
tgtataatattgaaaattgaa

SEQ ID NO: 4401925 - DNA, 18 bp, Homo sapiens
tgtatacaagtactggta

SEQ ID NO: 4401926 - DNA, 13 bp, Homo sapiens
tgtatacagtgca

SEQ ID NO: 4401927 - DNA, 23 bp, Homo sapiens
tgtataccaatgtgttttctgta

SEQ ID NO: 4401928 - DNA, 21 bp, Homo sapiens
tgtataccagcctactgtact

SEQ ID NO: 4401929 - DNA, 14 bp, Homo sapiens
tgtatactatagta

SEQ ID NO: 4401930 - DNA, 15 bp, Homo sapiens
tgtatactatagtac

SEQ ID NO: 4401931 - DNA, 19 bp, Homo sapiens
tgtatactatagtaccagt

SEQ ID NO: 4401932 - DNA, 15 bp, Homo sapiens
tgtatagctgcttcc

SEQ ID NO: 4401933 - DNA, 21 bp, Homo sapiens
tgtatagtgttcacaaactgt

SEQ ID NO: 4401934 - DNA, 22 bp, Homo sapiens
tgtatagtgttcacaaactgtg

SEQ ID NO: 4401935 - DNA, 12 bp, Homo sapiens
tgtatataaaaa

SEQ ID NO: 4401936 - DNA, 16 bp, Homo sapiens
tgtatataaacatatt

SEQ ID NO: 4401937 - DNA, 12 bp, Homo sapiens
tgtatataaata

SEQ ID NO: 4401938 - DNA, 20 bp, Homo sapiens
tgtatataaatatattttct

SEQ ID NO: 4401939 - DNA, 21 bp, Homo sapiens
tgtatataatcatgctcatgt

SEQ ID NO: 4401940 - DNA, 20 bp, Homo sapiens
tgtatatatattcatataca

SEQ ID NO: 4401941 - DNA, 18 bp, Homo sapiens
tgtatatatcttataact

SEQ ID NO: 4401942 - DNA, 19 bp, Homo sapiens
tgtatatcgttatcactgt

SEQ ID NO: 4401943 - DNA, 17 bp, Homo sapiens
tgtatatctcttggaaa

SEQ ID NO: 4401944 - DNA, 19 bp, Homo sapiens
tgtatatctcttggaaaat

SEQ ID NO: 4401945 - DNA, 16 bp, Homo sapiens
tgtatatgtaaattac

SEQ ID NO: 4401946 - DNA, 12 bp, Homo sapiens
tgtatatgtatt

SEQ ID NO: 4401947 - DNA, 14 bp, Homo sapiens
tgtatatgtattta

SEQ ID NO: 4401948 - DNA, 22 bp, Homo sapiens
tgtatattgggtgtagatttct

SEQ ID NO: 4401949 - DNA, 17 bp, Homo sapiens
tgtatattgtaatttaa

SEQ ID NO: 4401950 - DNA, 20 bp, Homo sapiens
tgtatattgtgtttgtgtat

SEQ ID NO: 4401951 - DNA, 13 bp, Homo sapiens
tgtatatttgtat

SEQ ID NO: 4401952 - DNA, 18 bp, Homo sapiens
tgtatattttaatgtttt

SEQ ID NO: 4401953 - DNA, 15 bp, Homo sapiens
tgtatattttatata

SEQ ID NO: 4401954 - DNA, 17 bp, Homo sapiens
tgtatattttatataaa

SEQ ID NO: 4401955 - DNA, 19 bp, Homo sapiens
tgtatcaataaaattctgt

SEQ ID NO: 4401956 - DNA, 15 bp, Homo sapiens
tgtatcacaaatctt

SEQ ID NO: 4401957 - DNA, 19 bp, Homo sapiens
tgtatcgtaaccagccaga

SEQ ID NO: 4401958 - DNA, 21 bp, Homo sapiens
tgtatctgacccactttgtaa

SEQ ID NO: 4401959 - DNA, 18 bp, Homo sapiens
tgggacggaccagcatct

SEQ ID NO: 4401960 - DNA, 20 bp, Homo sapiens
tgggactaggacctgagcct

SEQ ID NO: 4401961 - DNA, 14 bp, Homo sapiens
tgggactgtacaca

SEQ ID NO: 4401962 - DNA, 22 bp, Homo sapiens
tgggactgtacacactttattt

SEQ ID NO: 4401963 - DNA, 16 bp, Homo sapiens
tgggacttctacccag

SEQ ID NO: 4401964 - DNA, 20 bp, Homo sapiens
tgggacttctacccagatgg

SEQ ID NO: 4401965 - DNA, 18 bp, Homo sapiens
tgggagaaggactatcaa

SEQ ID NO: 4401966 - DNA, 20 bp, Homo sapiens
tgggagaatgtcagtatgtg

SEQ ID NO: 4401967 - DNA, 22 bp, Homo sapiens
tgggagacaaaggaggaattta

SEQ ID NO: 4401968 - DNA, 17 bp, Homo sapiens
tgggagcagtccatgca

SEQ ID NO: 4401969 - DNA, 13 bp, Homo sapiens
tgggagccccagg

SEQ ID NO: 4401970 - DNA, 14 bp, Homo sapiens
tgggagccccaggg

SEQ ID NO: 4401971 - DNA, 16 bp, Homo sapiens
tgggagccccagggtc

SEQ ID NO: 4401972 - DNA, 15 bp, Homo sapiens
tgggagccgcagagc

SEQ ID NO: 4401973 - DNA, 16 bp, Homo sapiens
tgggagccgcagagcc

SEQ ID NO: 4401974 - DNA, 17 bp, Homo sapiens
tgggagccgcagagcct

SEQ ID NO: 4401975 - DNA, 18 bp, Homo sapiens
tgggagccgggtctgcct

SEQ ID NO: 4401976 - DNA, 23 bp, Homo sapiens
tgggagccgggtctgcctcttct

SEQ ID NO: 4401977 - DNA, 16 bp, Homo sapiens
tgggagcctaaggaag

SEQ ID NO: 4401978 - DNA, 12 bp, Homo sapiens
tgggagcctagc

SEQ ID NO: 4401979 - DNA, 18 bp, Homo sapiens
tgggagcctagctcctgc

SEQ ID NO: 4401980 - DNA, 13 bp, Homo sapiens
tgggagctcctct

SEQ ID NO: 4401981 - DNA, 16 bp, Homo sapiens
tgggagctcctctcct

SEQ ID NO: 4401982 - DNA, 17 bp, Homo sapiens
tgggagctcctctcctg

SEQ ID NO: 4401983 - DNA, 15 bp, Homo sapiens
tgggaggagatgaaa

SEQ ID NO: 4401984 - DNA, 14 bp, Homo sapiens
tgggaggagggcag

SEQ ID NO: 4401985 - DNA, 17 bp, Homo sapiens
tgggaggagggcaggca

SEQ ID NO: 4401986 - DNA, 12 bp, Homo sapiens
tgggaggcaggg

SEQ ID NO: 4401987 - DNA, 20 bp, Homo sapiens
tgggaggcagggctctcccg

SEQ ID NO: 4401988 - DNA, 14 bp, Homo sapiens
tgggaggccaaggc

SEQ ID NO: 4401989 - DNA, 19 bp, Homo sapiens
tgggaggctgagatgggag

SEQ ID NO: 4401990 - DNA, 15 bp, Homo sapiens
tgggaggctgaggca

SEQ ID NO: 4401991 - DNA, 12 bp, Homo sapiens
tgggagggagga

SEQ ID NO: 4401992 - DNA, 15 bp, Homo sapiens
tgggagggaggaggg

SEQ ID NO: 4401993 - DNA, 13 bp, Homo sapiens
tgggagggatcag

SEQ ID NO: 4401994 - DNA, 20 bp, Homo sapiens
tgggagggatcagccccgcc

SEQ ID NO: 4401995 - DNA, 22 bp, Homo sapiens
tgggagggggagatgggtggga

SEQ ID NO: 4401996 - DNA, 22 bp, Homo sapiens
tgggaggtggaagcagaggccc

SEQ ID NO: 4401997 - DNA, 16 bp, Homo sapiens
tgggagtaacagggca

SEQ ID NO: 4401998 - DNA, 23 bp, Homo sapiens
tgggagtcacacagtgttggagg

SEQ ID NO: 4401999 - DNA, 16 bp, Homo sapiens
tgggagtccaaggtgg

SEQ ID NO: 4402000 - DNA, 24 bp, Homo sapiens
tgggagtggggcctttgccagcag

SEQ ID NO: 4402001 - DNA, 11 bp, Homo sapiens
tgggagtgtgt

SEQ ID NO: 4402002 - DNA, 22 bp, Homo sapiens
tgggagttgatcgcctttccca

SEQ ID NO: 4402003 - DNA, 20 bp, Homo sapiens
tgggagtttttatgagaaac

SEQ ID NO: 4402004 - DNA, 20 bp, Homo sapiens
tgggataactgatttctatg

SEQ ID NO: 4402005 - DNA, 12 bp, Homo sapiens
tgggatagagaa

SEQ ID NO: 4402006 - DNA, 22 bp, Homo sapiens
tgggatatatggaggattcttt

SEQ ID NO: 4402007 - DNA, 19 bp, Homo sapiens
tgggatatggctgcccagg

SEQ ID NO: 4402008 - DNA, 14 bp, Homo sapiens
tgggatcctccctc

SEQ ID NO: 4402009 - DNA, 23 bp, Homo sapiens
tgggatgacaggcgcctgccatc

SEQ ID NO: 4402010 - DNA, 17 bp, Homo sapiens
tgggatgctgaaggaga

SEQ ID NO: 4402011 - DNA, 13 bp, Homo sapiens
tgggatggaggag

SEQ ID NO: 4402012 - DNA, 20 bp, Homo sapiens
tgggatggtcggatctcaca

SEQ ID NO: 4402013 - DNA, 17 bp, Homo sapiens
tgggatggtgactcctg

SEQ ID NO: 4402014 - DNA, 15 bp, Homo sapiens
tgggatgtcttattt

SEQ ID NO: 4402015 - DNA, 17 bp, Homo sapiens
tgggatgtgctgttttc

SEQ ID NO: 4402016 - DNA, 17 bp, Homo sapiens
tgggattaagaaacctt

SEQ ID NO: 4402017 - DNA, 23 bp, Homo sapiens
tgggattaagaaaccttgctctc

SEQ ID NO: 4402018 - DNA, 14 bp, Homo sapiens
tgggatttgctgtg

SEQ ID NO: 4402019 - DNA, 18 bp, Homo sapiens
tgggcaaaccctggtgct

SEQ ID NO: 4402020 - DNA, 15 bp, Homo sapiens
tgggcaatttagaaa

SEQ ID NO: 4402021 - DNA, 18 bp, Homo sapiens
tgggcaccacaaaatata

SEQ ID NO: 4402022 - DNA, 24 bp, Homo sapiens
tgggcactccgcgccgatgccacc

SEQ ID NO: 4402023 - DNA, 18 bp, Homo sapiens
tgggcactggggcctcag

SEQ ID NO: 4402024 - DNA, 13 bp, Homo sapiens
tgggcagcaccct

SEQ ID NO: 4402025 - DNA, 13 bp, Homo sapiens
tgggcagccagac

SEQ ID NO: 4402026 - DNA, 16 bp, Homo sapiens
tgggcagcccaacagc

SEQ ID NO: 4402027 - DNA, 19 bp, Homo sapiens
tgggcagcccaacagcact

SEQ ID NO: 4402028 - DNA, 15 bp, Homo sapiens
tgggcaggagggagg

SEQ ID NO: 4402029 - DNA, 15 bp, Homo sapiens
tgggcagtgccccag

SEQ ID NO: 4402030 - DNA, 18 bp, Homo sapiens
tgggcagtgccccaggga

SEQ ID NO: 4402031 - DNA, 18 bp, Homo sapiens
tgggcatcagaaaacagg

SEQ ID NO: 4402032 - DNA, 21 bp, Homo sapiens
tgggcatcagaaaacagggtc

SEQ ID NO: 4402033 - DNA, 17 bp, Homo sapiens
tgggcatcttctggctt

SEQ ID NO: 4402034 - DNA, 18 bp, Homo sapiens
tgggcatcttttgtatta

SEQ ID NO: 4402035 - DNA, 19 bp, Homo sapiens
tgggccacacccaggaagg

SEQ ID NO: 4402036 - DNA, 20 bp, Homo sapiens
tgggccacgccggccacacc

SEQ ID NO: 4402037 - DNA, 17 bp, Homo sapiens
tgggccatgtccaaaga

SEQ ID NO: 4402038 - DNA, 13 bp, Homo sapiens
tgggcccagggac

SEQ ID NO: 4402039 - DNA, 19 bp, Homo sapiens
tgggcccagggacaccagc

SEQ ID NO: 4402040 - DNA, 15 bp, Homo sapiens
tgggcccaggggctg

SEQ ID NO: 4402041 - DNA, 17 bp, Homo sapiens
tgggccccacatggctt

SEQ ID NO: 4402042 - DNA, 18 bp, Homo sapiens
tgggccccaccacctagg

SEQ ID NO: 4402043 - DNA, 17 bp, Homo sapiens
tgggccccagcccaccc

SEQ ID NO: 4402044 - DNA, 18 bp, Homo sapiens
tgggccccagcccaccct

SEQ ID NO: 4402045 - DNA, 16 bp, Homo sapiens
tgggcccctccctacc

SEQ ID NO: 4402046 - DNA, 16 bp, Homo sapiens
tgggccctctctgctc

SEQ ID NO: 4402047 - DNA, 11 bp, Homo sapiens
tgggccctgcc

SEQ ID NO: 4402048 - DNA, 12 bp, Homo sapiens
tgggccctgcct

SEQ ID NO: 4402049 - DNA, 22 bp, Homo sapiens
tgggccctgcctgcagccaggg

SEQ ID NO: 4402050 - DNA, 23 bp, Homo sapiens
tgggccctgcctgcagccagggc

SEQ ID NO: 4402051 - DNA, 12 bp, Homo sapiens
tgggccctgggc

SEQ ID NO: 4402052 - DNA, 18 bp, Homo sapiens
tgggccctgggctggcac

SEQ ID NO: 4402053 - DNA, 16 bp, Homo sapiens
tgggccctgtcgcccc

SEQ ID NO: 4402054 - DNA, 13 bp, Homo sapiens
tgggcctggccct

SEQ ID NO: 4402055 - DNA, 16 bp, Homo sapiens
tgggcctggccctgct

SEQ ID NO: 4402056 - DNA, 23 bp, Homo sapiens
tgggcgctcggtctccaccccag

SEQ ID NO: 4402057 - DNA, 13 bp, Homo sapiens
tgggcggctcctg

SEQ ID NO: 4402058 - DNA, 17 bp, Homo sapiens
tgggcggctcctggtgc

SEQ ID NO: 4402059 - DNA, 14 bp, Homo sapiens
tgggcggggccttg

SEQ ID NO: 4402060 - DNA, 23 bp, Homo sapiens
tgggctaaggaagtatcagcact

SEQ ID NO: 4402061 - DNA, 23 bp, Homo sapiens
tgggctaccccccctcctgctgc

SEQ ID NO: 4402062 - DNA, 22 bp, Homo sapiens
tgggctcaaatgatcctcccac

SEQ ID NO: 4402063 - DNA, 22 bp, Homo sapiens
tgggctcaagcaatcctcctgc

SEQ ID NO: 4402064 - DNA, 11 bp, Homo sapiens
tgggctccctg

SEQ ID NO: 4402065 - DNA, 15 bp, Homo sapiens
tgggctccctgactg

SEQ ID NO: 4402066 - DNA, 14 bp, Homo sapiens
tgggctctccacct

SEQ ID NO: 4402067 - DNA, 23 bp, Homo sapiens
tgggctctccacctcagccttgg

SEQ ID NO: 4402068 - DNA, 18 bp, Homo sapiens
tgggctgaatgtatgtaa

SEQ ID NO: 4402069 - DNA, 16 bp, Homo sapiens
tgggctgagggagcct

SEQ ID NO: 4402070 - DNA, 13 bp, Homo sapiens
tgggctgatgctg

SEQ ID NO: 4402071 - DNA, 15 bp, Homo sapiens
tgggctgatgctggg

SEQ ID NO: 4402072 - DNA, 19 bp, Homo sapiens
tgggctgatgctgggaccc

SEQ ID NO: 4402073 - DNA, 16 bp, Homo sapiens
tgggctgccaccagcc

SEQ ID NO: 4402074 - DNA, 16 bp, Homo sapiens
tgggctggagctcctc

SEQ ID NO: 4402075 - DNA, 19 bp, Homo sapiens
tgggctggcgcttggatct

SEQ ID NO: 4402076 - DNA, 19 bp, Homo sapiens
tgggctgggtgctgggaag

SEQ ID NO: 4402077 - DNA, 12 bp, Homo sapiens
tgggctgtctgt

SEQ ID NO: 4402078 - DNA, 19 bp, Homo sapiens
tgggctgtctgtcaccagc

SEQ ID NO: 4402079 - DNA, 14 bp, Homo sapiens
tgggcttaaagcag

SEQ ID NO: 4402080 - DNA, 22 bp, Homo sapiens
tgggcttatatctggcctctgc

SEQ ID NO: 4402081 - DNA, 18 bp, Homo sapiens
tgggcttcctgcccttcc

SEQ ID NO: 4402082 - DNA, 19 bp, Homo sapiens
tgggcttcctgcccttccc

SEQ ID NO: 4402083 - DNA, 18 bp, Homo sapiens
tgggcttggcctgctgtg

SEQ ID NO: 4402084 - DNA, 21 bp, Homo sapiens
tgggctttcccccaactcagg

SEQ ID NO: 4402085 - DNA, 17 bp, Homo sapiens
tggggaaaaaaatcatc

SEQ ID NO: 4402086 - DNA, 15 bp, Homo sapiens
tggggaacggaggag

SEQ ID NO: 4402087 - DNA, 19 bp, Homo sapiens
tggggaacggaggaggaca

SEQ ID NO: 4402088 - DNA, 18 bp, Homo sapiens
tggggaagaacagccccg

SEQ ID NO: 4402089 - DNA, 17 bp, Homo sapiens
tggggaagaggttttat

SEQ ID NO: 4402090 - DNA, 20 bp, Homo sapiens
tggggaagaggttttattta

SEQ ID NO: 4402091 - DNA, 23 bp, Homo sapiens
tggggaagaggttttatttacat

SEQ ID NO: 4402092 - DNA, 17 bp, Homo sapiens
tggggaatgctcccagc

SEQ ID NO: 4402093 - DNA, 21 bp, Homo sapiens
tggggacacacattctgcctt

SEQ ID NO: 4402094 - DNA, 19 bp, Homo sapiens
tggggacggggggccccag

SEQ ID NO: 4402095 - DNA, 20 bp, Homo sapiens
tggggacggggggccccagt

SEQ ID NO: 4402096 - DNA, 14 bp, Homo sapiens
tggggactcaggga

SEQ ID NO: 4402097 - DNA, 22 bp, Homo sapiens
tggggactccggctgtgctggg

SEQ ID NO: 4402098 - DNA, 19 bp, Homo sapiens
tggggactcgggggctggt

SEQ ID NO: 4402099 - DNA, 17 bp, Homo sapiens
tggggacttcaactgcc

SEQ ID NO: 4402100 - DNA, 22 bp, Homo sapiens
tggggacttcaactgcccagca

SEQ ID NO: 4402101 - DNA, 21 bp, Homo sapiens
tggggagactgggctgaggga

SEQ ID NO: 4402102 - DNA, 13 bp, Homo sapiens
tggggagagacgg

SEQ ID NO: 4402103 - DNA, 12 bp, Homo sapiens
tggggagctgtt

SEQ ID NO: 4402104 - DNA, 22 bp, Homo sapiens
tggggaggcggacgttccagcc

SEQ ID NO: 4402105 - DNA, 23 bp, Homo sapiens
tggggaggcggacgttccagccg

SEQ ID NO: 4402106 - DNA, 16 bp, Homo sapiens
tggggaggttgtgggg

SEQ ID NO: 4402107 - DNA, 23 bp, Homo sapiens
tggggagtaaacggcccaggcca

SEQ ID NO: 4402108 - DNA, 19 bp, Homo sapiens
tggggagtttagggtgggg

SEQ ID NO: 4402109 - DNA, 14 bp, Homo sapiens
tggggatcgatgtg

SEQ ID NO: 4402110 - DNA, 10 bp, Homo sapiens
tggggcagag

SEQ ID NO: 4402111 - DNA, 13 bp, Homo sapiens
tggggcagagcct

SEQ ID NO: 4402112 - DNA, 14 bp, Homo sapiens
tggggcagagcctc

SEQ ID NO: 4402113 - DNA, 17 bp, Homo sapiens
tggggcaggctgggcca

SEQ ID NO: 4402114 - DNA, 16 bp, Homo sapiens
tggggcaggggccggg

SEQ ID NO: 4402115 - DNA, 22 bp, Homo sapiens
tggggccacttggtagtgtccc

SEQ ID NO: 4402116 - DNA, 20 bp, Homo sapiens
tggggccagaggctgggagt

SEQ ID NO: 4402117 - DNA, 17 bp, Homo sapiens
tggggccctgggcctca

SEQ ID NO: 4402118 - DNA, 21 bp, Homo sapiens
tggggccggttttcctcagct

SEQ ID NO: 4402119 - DNA, 15 bp, Homo sapiens
tggggcctcaggctc

SEQ ID NO: 4402120 - DNA, 20 bp, Homo sapiens
tggggcctggggagcccact

SEQ ID NO: 4402121 - DNA, 21 bp, Homo sapiens
tggggcctggggagcccactg

SEQ ID NO: 4402122 - DNA, 20 bp, Homo sapiens
tggggccttcgggaccctgg

SEQ ID NO: 4402123 - DNA, 24 bp, Homo sapiens
tggggcctttgccagcagagccag

SEQ ID NO: 4402124 - DNA, 15 bp, Homo sapiens
tggggctaaatgaag

SEQ ID NO: 4402125 - DNA, 16 bp, Homo sapiens
tggggctaaatgaagt

SEQ ID NO: 4402126 - DNA, 17 bp, Homo sapiens
tggggctaggtcttgcc

SEQ ID NO: 4402127 - DNA, 15 bp, Homo sapiens
tggggctcagagtgg

SEQ ID NO: 4402128 - DNA, 13 bp, Homo sapiens
tggggctcccagc

SEQ ID NO: 4402129 - DNA, 14 bp, Homo sapiens
tggggctcctggga

SEQ ID NO: 4402130 - DNA, 16 bp, Homo sapiens
tggggctcctgggagg

SEQ ID NO: 4402131 - DNA, 18 bp, Homo sapiens
tggggctcctgggaggga

SEQ ID NO: 4402132 - DNA, 22 bp, Homo sapiens
tggggctcctgggagggagact

SEQ ID NO: 4402133 - DNA, 16 bp, Homo sapiens
tggggctgacacccag

SEQ ID NO: 4402134 - DNA, 17 bp, Homo sapiens
tggggctgacacccagg

SEQ ID NO: 4402135 - DNA, 24 bp, Homo sapiens
tggggctgagccctcctgagggcc

SEQ ID NO: 4402136 - DNA, 14 bp, Homo sapiens
tggggctgctcctc

SEQ ID NO: 4402137 - DNA, 16 bp, Homo sapiens
tggggctgctcctcca

SEQ ID NO: 4402138 - DNA, 21 bp, Homo sapiens
tggggctgctcctccagggcc

SEQ ID NO: 4402139 - DNA, 15 bp, Homo sapiens
tgggggaagccctgg

SEQ ID NO: 4402140 - DNA, 18 bp, Homo sapiens
tgggggaatgcacctccc

SEQ ID NO: 4402141 - DNA, 16 bp, Homo sapiens
tgggggagggctgcga

SEQ ID NO: 4402142 - DNA, 18 bp, Homo sapiens
tgggggatagaggggctg

SEQ ID NO: 4402143 - DNA, 21 bp, Homo sapiens
tgggggatgggccagggttta

SEQ ID NO: 4402144 - DNA, 18 bp, Homo sapiens
tgggggcagagggcagag

SEQ ID NO: 4402145 - DNA, 22 bp, Homo sapiens
tgggggcaggagggccctacct

SEQ ID NO: 4402146 - DNA, 17 bp, Homo sapiens
tgggggcagtctcccct

SEQ ID NO: 4402147 - DNA, 20 bp, Homo sapiens
tgggggcagtctccccttcc

SEQ ID NO: 4402148 - DNA, 15 bp, Homo sapiens
tggggggacagagac

SEQ ID NO: 4402149 - DNA, 15 bp, Homo sapiens
tgggggtctgtgtgt

SEQ ID NO: 4402150 - DNA, 13 bp, Homo sapiens
tgggggtggagga

SEQ ID NO: 4402151 - DNA, 21 bp, Homo sapiens
tgggggtggaggaccgaggct

SEQ ID NO: 4402152 - DNA, 19 bp, Homo sapiens
tgggggtggaggcttcctg

SEQ ID NO: 4402153 - DNA, 15 bp, Homo sapiens
tgggggtggcaggca

SEQ ID NO: 4402154 - DNA, 21 bp, Homo sapiens
tgggggtggccatccctgggc

SEQ ID NO: 4402155 - DNA, 10 bp, Homo sapiens
tgggggtggg

SEQ ID NO: 4402156 - DNA, 11 bp, Homo sapiens
tgggggtgggt

SEQ ID NO: 4402157 - DNA, 22 bp, Homo sapiens
tgggggtgtggctctgccctgg

SEQ ID NO: 4402158 - DNA, 15 bp, Homo sapiens
tggggtaagccagag

SEQ ID NO: 4402159 - DNA, 16 bp, Homo sapiens
tggggtagggctgact

SEQ ID NO: 4402160 - DNA, 15 bp, Homo sapiens
tggggtaggttggga

SEQ ID NO: 4402161 - DNA, 15 bp, Homo sapiens
tggggtccctccacc

SEQ ID NO: 4402162 - DNA, 21 bp, Homo sapiens
tggggtcctagcccagtgctt

SEQ ID NO: 4402163 - DNA, 22 bp, Homo sapiens
tggggtgcgggatacagctgag

SEQ ID NO: 4402164 - DNA, 14 bp, Homo sapiens
tggggtgctgccct

SEQ ID NO: 4402165 - DNA, 13 bp, Homo sapiens
tggggtgctggga

SEQ ID NO: 4402166 - DNA, 23 bp, Homo sapiens
tggggttcaagaagtaatcagta

SEQ ID NO: 4402167 - DNA, 19 bp, Homo sapiens
tggggttcagcccctcctc

SEQ ID NO: 4402168 - DNA, 21 bp, Homo sapiens
tggggttcagcccctcctctg

SEQ ID NO: 4402169 - DNA, 14 bp, Homo sapiens
tggggttgccagag

SEQ ID NO: 4402170 - DNA, 17 bp, Homo sapiens
tggggttgccagaggcc

SEQ ID NO: 4402171 - DNA, 18 bp, Homo sapiens
tggggttgccagaggccc

SEQ ID NO: 4402172 - DNA, 19 bp, Homo sapiens
tggggttgccagaggccct

SEQ ID NO: 4402173 - DNA, 14 bp, Homo sapiens
tgggtaagggaggg

SEQ ID NO: 4402174 - DNA, 13 bp, Homo sapiens
tgggtacatcaag

SEQ ID NO: 4402175 - DNA, 22 bp, Homo sapiens
tgggtacatcaagtccatctga

SEQ ID NO: 4402176 - DNA, 13 bp, Homo sapiens
tgggtagaagcct

SEQ ID NO: 4402177 - DNA, 20 bp, Homo sapiens
tgggtagaatataaaataaa

SEQ ID NO: 4402178 - DNA, 9 bp, Homo sapiens
tgggtcaga

SEQ ID NO: 4402179 - DNA, 15 bp, Homo sapiens
tgggtcagtggccag

SEQ ID NO: 4402180 - DNA, 20 bp, Homo sapiens
tgggtccaggggtctgtctg

SEQ ID NO: 4402181 - DNA, 14 bp, Homo sapiens
tgggtccatgggca

SEQ ID NO: 4402182 - DNA, 18 bp, Homo sapiens
tgggtcccgcactctgcc

SEQ ID NO: 4402183 - DNA, 17 bp, Homo sapiens
tgggtcctagcccttcc

SEQ ID NO: 4402184 - DNA, 23 bp, Homo sapiens
tgggtctaaggggttggttgagg

SEQ ID NO: 4402185 - DNA, 21 bp, Homo sapiens
tgggtctaggacacagttcct

SEQ ID NO: 4402186 - DNA, 20 bp, Homo sapiens
tgggtctgaggcccctgcct

SEQ ID NO: 4402187 - DNA, 18 bp, Homo sapiens
tgggtctgcacagattct

SEQ ID NO: 4402188 - DNA, 21 bp, Homo sapiens
tgggtctgggagtcacacagt

SEQ ID NO: 4402189 - DNA, 12 bp, Homo sapiens
tgggtctgtgtg

SEQ ID NO: 4402190 - DNA, 12 bp, Homo sapiens
tgggtcttcagc

SEQ ID NO: 4402191 - DNA, 16 bp, Homo sapiens
tgggtcttcagcttta

SEQ ID NO: 4402192 - DNA, 13 bp, Homo sapiens
tgggtcttttata

SEQ ID NO: 4402193 - DNA, 12 bp, Homo sapiens
tgggtgagagag

SEQ ID NO: 4402194 - DNA, 13 bp, Homo sapiens
tgggtgagagagg

SEQ ID NO: 4402195 - DNA, 21 bp, Homo sapiens
tgggtgagctctcaggccgag

SEQ ID NO: 4402196 - DNA, 22 bp, Homo sapiens
tgggtgatggaaactgccaaac

SEQ ID NO: 4402197 - DNA, 13 bp, Homo sapiens
tgggtgctggtcc

SEQ ID NO: 4402198 - DNA, 18 bp, Homo sapiens
tgggtgggaggagatgaa

SEQ ID NO: 4402199 - DNA, 18 bp, Homo sapiens
tgggtgggattttgcaaa

SEQ ID NO: 4402200 - DNA, 15 bp, Homo sapiens
tgggtgggctctgtg

SEQ ID NO: 4402201 - DNA, 14 bp, Homo sapiens
tgggtggggctcct

SEQ ID NO: 4402202 - DNA, 21 bp, Homo sapiens
tgggtggggctgctcctccag

SEQ ID NO: 4402203 - DNA, 15 bp, Homo sapiens
tgggtgtatgtatgt

SEQ ID NO: 4402204 - DNA, 20 bp, Homo sapiens
tgggtgtcaagtgcctgcac

SEQ ID NO: 4402205 - DNA, 14 bp, Homo sapiens
tgggtgttctttcc

SEQ ID NO: 4402206 - DNA, 17 bp, Homo sapiens
tgggtgttctttcctgc

SEQ ID NO: 4402207 - DNA, 14 bp, Homo sapiens
tgggttaagtatta

SEQ ID NO: 4402208 - DNA, 15 bp, Homo sapiens
tgggttattctggag

SEQ ID NO: 4402209 - DNA, 19 bp, Homo sapiens
tgggttcatgatgcagtct

SEQ ID NO: 4402210 - DNA, 22 bp, Homo sapiens
tgggtttattttcattctgcca

SEQ ID NO: 4402211 - DNA, 18 bp, Homo sapiens
tgggtttctcattaaagt

SEQ ID NO: 4402212 - DNA, 17 bp, Homo sapiens
tgggtttggatctccaa

SEQ ID NO: 4402213 - DNA, 14 bp, Homo sapiens
tgggttttcttccc

SEQ ID NO: 4402214 - DNA, 17 bp, Homo sapiens
tggtaaaaatgctgctc

SEQ ID NO: 4402215 - DNA, 18 bp, Homo sapiens
tggtaaaacagtttcatc

SEQ ID NO: 4402216 - DNA, 20 bp, Homo sapiens
tggtaaaacagtttcatcta

SEQ ID NO: 4402217 - DNA, 18 bp, Homo sapiens
tggtaaaacattacttat

SEQ ID NO: 4402218 - DNA, 15 bp, Homo sapiens
tggtaaaactcactg

SEQ ID NO: 4402219 - DNA, 20 bp, Homo sapiens
tggtaaaactcactgtgatc

SEQ ID NO: 4402220 - DNA, 18 bp, Homo sapiens
tggtaaacattcctccag

SEQ ID NO: 4402221 - DNA, 17 bp, Homo sapiens
tggtaaatactgtgaaa

SEQ ID NO: 4402222 - DNA, 18 bp, Homo sapiens
tggtaaatactgtgaaat

SEQ ID NO: 4402223 - DNA, 20 bp, Homo sapiens
tggtaaatactgtgaaatac

SEQ ID NO: 4402224 - DNA, 21 bp, Homo sapiens
tggtaactgattacctgccaa

SEQ ID NO: 4402225 - DNA, 22 bp, Homo sapiens
tggtaactgattacctgccaat

SEQ ID NO: 4402226 - DNA, 14 bp, Homo sapiens
tggtaacttttgtg

SEQ ID NO: 4402227 - DNA, 16 bp, Homo sapiens
tggtaacttttgtgaa

SEQ ID NO: 4402228 - DNA, 16 bp, Homo sapiens
tggtaagactgctggt

SEQ ID NO: 4402229 - DNA, 12 bp, Homo sapiens
tggtaagagaaa

SEQ ID NO: 4402230 - DNA, 13 bp, Homo sapiens
tggtaagagaaaa

SEQ ID NO: 4402231 - DNA, 13 bp, Homo sapiens
tggtaagcagagg

SEQ ID NO: 4402232 - DNA, 22 bp, Homo sapiens
tggtaaggtgtgtactcagggc

SEQ ID NO: 4402233 - DNA, 13 bp, Homo sapiens
tggtaatatacaa

SEQ ID NO: 4402234 - DNA, 18 bp, Homo sapiens
tggtaatcctcttctaaa

SEQ ID NO: 4402235 - DNA, 14 bp, Homo sapiens
tggtacaaaaataa

SEQ ID NO: 4402236 - DNA, 15 bp, Homo sapiens
tggtacaaaaataaa

SEQ ID NO: 4402237 - DNA, 18 bp, Homo sapiens
tggtacaaaaataaattt

SEQ ID NO: 4402238 - DNA, 14 bp, Homo sapiens
tggtacacatgtgt

SEQ ID NO: 4402239 - DNA, 23 bp, Homo sapiens
tggtacataggcttctattacct

SEQ ID NO: 4402240 - DNA, 18 bp, Homo sapiens
tggtacatggtgtttgtg

SEQ ID NO: 4402241 - DNA, 16 bp, Homo sapiens
tggtactaccccagcc

SEQ ID NO: 4402242 - DNA, 20 bp, Homo sapiens
tggtactataaaagctttct

SEQ ID NO: 4402243 - DNA, 13 bp, Homo sapiens
tggtacttcctct

SEQ ID NO: 4402244 - DNA, 17 bp, Homo sapiens
tggtacttcctctgtga

SEQ ID NO: 4402245 - DNA, 17 bp, Homo sapiens
tggtactttgcagctgc

SEQ ID NO: 4402246 - DNA, 16 bp, Homo sapiens
tggtagagacccccag

SEQ ID NO: 4402247 - DNA, 18 bp, Homo sapiens
tggtagatgacaaatatt

SEQ ID NO: 4402248 - DNA, 16 bp, Homo sapiens
tggtagatgcttgatt

SEQ ID NO: 4402249 - DNA, 17 bp, Homo sapiens
tggtagcagcaggctca

SEQ ID NO: 4402250 - DNA, 18 bp, Homo sapiens
tggtaggactgtagaaaa

SEQ ID NO: 4402251 - DNA, 14 bp, Homo sapiens
tggtagttctgtgc

SEQ ID NO: 4402252 - DNA, 14 bp, Homo sapiens
tggtataaattaat

SEQ ID NO: 4402253 - DNA, 22 bp, Homo sapiens
tggtatagaaatgctggttttt

SEQ ID NO: 4402254 - DNA, 18 bp, Homo sapiens
tggtatattattgcttca

SEQ ID NO: 4402255 - DNA, 17 bp, Homo sapiens
tggtatatttgaaataa

SEQ ID NO: 4402256 - DNA, 14 bp, Homo sapiens
tggtatcaaaatta

SEQ ID NO: 4402257 - DNA, 19 bp, Homo sapiens
tggtatctgggtaagaaga

SEQ ID NO: 4402258 - DNA, 16 bp, Homo sapiens
tggtatgccaacttaa

SEQ ID NO: 4402259 - DNA, 15 bp, Homo sapiens
tggtatgctggccag

SEQ ID NO: 4402260 - DNA, 19 bp, Homo sapiens
tggtatgctggccagcacc

SEQ ID NO: 4402261 - DNA, 21 bp, Homo sapiens
tggtatggagctgtgccgagg

SEQ ID NO: 4402262 - DNA, 18 bp, Homo sapiens
tggtatggggctgagccc

SEQ ID NO: 4402263 - DNA, 15 bp, Homo sapiens
tggtattaaatgcca

SEQ ID NO: 4402264 - DNA, 14 bp, Homo sapiens
tggtcaacatagtg

SEQ ID NO: 4402265 - DNA, 14 bp, Homo sapiens
tggtcaacatttct

SEQ ID NO: 4402266 - DNA, 20 bp, Homo sapiens
tggtcacagccatgaagtca

SEQ ID NO: 4402267 - DNA, 14 bp, Homo sapiens
tggtcacagctgta

SEQ ID NO: 4402268 - DNA, 17 bp, Homo sapiens
tggtcacaggaagtaga

SEQ ID NO: 4402269 - DNA, 24 bp, Homo sapiens
tggtcaccgagactcagcctctgc

SEQ ID NO: 4402270 - DNA, 15 bp, Homo sapiens
tggtcagagccactc

SEQ ID NO: 4402271 - DNA, 14 bp, Homo sapiens
tggtcagagtgcca

SEQ ID NO: 4402272 - DNA, 15 bp, Homo sapiens
tggtcagagtgccac

SEQ ID NO: 4402273 - DNA, 22 bp, Homo sapiens
tggtcagccctagggtggagag

SEQ ID NO: 4402274 - DNA, 21 bp, Homo sapiens
tggtcaggctggtctcaaact

SEQ ID NO: 4402275 - DNA, 17 bp, Homo sapiens
tggtcatatacatattg

SEQ ID NO: 4402276 - DNA, 21 bp, Homo sapiens
tggtccaaaagattgctgaaa

SEQ ID NO: 4402277 - DNA, 16 bp, Homo sapiens
tggtccaaaggacaaa

SEQ ID NO: 4402278 - DNA, 21 bp, Homo sapiens
tggtccaggtcttcagtttcc

SEQ ID NO: 4402279 - DNA, 15 bp, Homo sapiens
tggtccggtgtcctt

SEQ ID NO: 4402280 - DNA, 17 bp, Homo sapiens
tggtcctaaaagcaaaa

SEQ ID NO: 4402281 - DNA, 12 bp, Homo sapiens
tggtcctagaca

SEQ ID NO: 4402282 - DNA, 11 bp, Homo sapiens
tggtcctggtg

SEQ ID NO: 4402283 - DNA, 15 bp, Homo sapiens
tggtcctggtgctgc

SEQ ID NO: 4402284 - DNA, 17 bp, Homo sapiens
tggtcctttctggaagt

SEQ ID NO: 4402285 - DNA, 12 bp, Homo sapiens
tggtcctttggg

SEQ ID NO: 4402286 - DNA, 23 bp, Homo sapiens
tggtcgagaaagaggcaccagga

SEQ ID NO: 4402287 - DNA, 22 bp, Homo sapiens
tggtcgtcaactttcctcaaat

SEQ ID NO: 4402288 - DNA, 20 bp, Homo sapiens
tggtctaatgattcaaatgt

SEQ ID NO: 4402289 - DNA, 23 bp, Homo sapiens
tggtctataagatgaaacatcat

SEQ ID NO: 4402290 - DNA, 19 bp, Homo sapiens
tggtctcagcagcgaccac

SEQ ID NO: 4402291 - DNA, 22 bp, Homo sapiens
tggtctcagcagcgaccacccc

SEQ ID NO: 4402292 - DNA, 20 bp, Homo sapiens
tggtctcagcgggagccagt

SEQ ID NO: 4402293 - DNA, 17 bp, Homo sapiens
tggtctctgcacccagt

SEQ ID NO: 4402294 - DNA, 11 bp, Homo sapiens
tggtctgctgt

SEQ ID NO: 4402295 - DNA, 15 bp, Homo sapiens
tggtctgtgaagagc

SEQ ID NO: 4402296 - DNA, 22 bp, Homo sapiens
tggtcttatagtgtttggacag

SEQ ID NO: 4402297 - DNA, 14 bp, Homo sapiens
tggtcttccttttt

SEQ ID NO: 4402298 - DNA, 19 bp, Homo sapiens
tggtgaaacccccatctct

SEQ ID NO: 4402299 - DNA, 11 bp, Homo sapiens
tggtgaacagt

SEQ ID NO: 4402300 - DNA, 17 bp, Homo sapiens
tggtgacaaaattcatt

SEQ ID NO: 4402301 - DNA, 18 bp, Homo sapiens
tggtgacacctccccctt

SEQ ID NO: 4402302 - DNA, 19 bp, Homo sapiens
tggtgaccccatacatttg

SEQ ID NO: 4402303 - DNA, 21 bp, Homo sapiens
tggtgacgtggtagtcacttg

SEQ ID NO: 4402304 - DNA, 15 bp, Homo sapiens
tggtgactcacttca

SEQ ID NO: 4402305 - DNA, 18 bp, Homo sapiens
tggtgagagtcaaagctg

SEQ ID NO: 4402306 - DNA, 14 bp, Homo sapiens
tggtgatgtaaaaa

SEQ ID NO: 4402307 - DNA, 17 bp, Homo sapiens
tggtgatgtaaaaatgc

SEQ ID NO: 4402308 - DNA, 20 bp, Homo sapiens
tggtgatgtaaaaatgcttc

SEQ ID NO: 4402309 - DNA, 18 bp, Homo sapiens
tggtgcaaattcagaact

SEQ ID NO: 4402310 - DNA, 19 bp, Homo sapiens
tggtgcagccttcccctcc

SEQ ID NO: 4402311 - DNA, 15 bp, Homo sapiens
tggtgcaggtctcca

SEQ ID NO: 4402312 - DNA, 13 bp, Homo sapiens
tggtgcatgggct

SEQ ID NO: 4402313 - DNA, 21 bp, Homo sapiens
tggtgccatttctgaactgtt

SEQ ID NO: 4402314 - DNA, 17 bp, Homo sapiens
tggtgcccctgctcact

SEQ ID NO: 4402315 - DNA, 19 bp, Homo sapiens
tggtgcccctgctcactgg

SEQ ID NO: 4402316 - DNA, 17 bp, Homo sapiens
tggtgcccgtgcccgca

SEQ ID NO: 4402317 - DNA, 14 bp, Homo sapiens
tggtgcctgagagg

SEQ ID NO: 4402318 - DNA, 21 bp, Homo sapiens
tggtgctcaccatgcttccag

SEQ ID NO: 4402319 - DNA, 18 bp, Homo sapiens
tggtgctgcccaggcctc

SEQ ID NO: 4402320 - DNA, 17 bp, Homo sapiens
tggtgctgccgagggct

SEQ ID NO: 4402321 - DNA, 18 bp, Homo sapiens
tccagaagcctctggcta

SEQ ID NO: 4402322 - DNA, 19 bp, Homo sapiens
tccagaagcctctggctag

SEQ ID NO: 4402323 - DNA, 15 bp, Homo sapiens
tccagaagtgtgact

SEQ ID NO: 4402324 - DNA, 13 bp, Homo sapiens
tccagaatgctgt

SEQ ID NO: 4402325 - DNA, 15 bp, Homo sapiens
tccagaatgctgtac

SEQ ID NO: 4402326 - DNA, 16 bp, Homo sapiens
tggagtgaaattattt

SEQ ID NO: 4402327 - DNA, 17 bp, Homo sapiens
tggagtgtggctgagga

SEQ ID NO: 4402328 - DNA, 20 bp, Homo sapiens
tggagtgttttagttcttgg

SEQ ID NO: 4402329 - DNA, 15 bp, Homo sapiens
tggagttaaaatgca

SEQ ID NO: 4402330 - DNA, 19 bp, Homo sapiens
tggagttcttagctatcct

SEQ ID NO: 4402331 - DNA, 14 bp, Homo sapiens
tggagtttgggctg

SEQ ID NO: 4402332 - DNA, 16 bp, Homo sapiens
tggagtttgggctgga

SEQ ID NO: 4402333 - DNA, 21 bp, Homo sapiens
tggagtttgggctggagctcc

SEQ ID NO: 4402334 - DNA, 21 bp, Homo sapiens
tggagttttcaggctatcata

SEQ ID NO: 4402335 - DNA, 15 bp, Homo sapiens
tggataaattgttta

SEQ ID NO: 4402336 - DNA, 23 bp, Homo sapiens
tggataagctatccgtgttgcag

SEQ ID NO: 4402337 - DNA, 20 bp, Homo sapiens
tggataagtggctgtttcat

SEQ ID NO: 4402338 - DNA, 18 bp, Homo sapiens
tggataatgctgttgcct

SEQ ID NO: 4402339 - DNA, 13 bp, Homo sapiens
tggatacataaag

SEQ ID NO: 4402340 - DNA, 14 bp, Homo sapiens
tggatacataaaga

SEQ ID NO: 4402341 - DNA, 14 bp, Homo sapiens
tggatacttggatt

SEQ ID NO: 4402342 - DNA, 17 bp, Homo sapiens
tggatatagaaaatctt

SEQ ID NO: 4402343 - DNA, 16 bp, Homo sapiens
tggatatagttttact

SEQ ID NO: 4402344 - DNA, 17 bp, Homo sapiens
tggatatagttttactt

SEQ ID NO: 4402345 - DNA, 15 bp, Homo sapiens
tggatatatttgaaa

SEQ ID NO: 4402346 - DNA, 18 bp, Homo sapiens
tggatatatttgaaatag

SEQ ID NO: 4402347 - DNA, 19 bp, Homo sapiens
tggatatatttgaaatagt

SEQ ID NO: 4402348 - DNA, 22 bp, Homo sapiens
tggatatatttgaaatagtata

SEQ ID NO: 4402349 - DNA, 16 bp, Homo sapiens
tggatatgtaaaacat

SEQ ID NO: 4402350 - DNA, 21 bp, Homo sapiens
tggatatgtaaaacatttatt

SEQ ID NO: 4402351 - DNA, 15 bp, Homo sapiens
tggatcacaaagtgg

SEQ ID NO: 4402352 - DNA, 16 bp, Homo sapiens
tggatcaccattatat

SEQ ID NO: 4402353 - DNA, 17 bp, Homo sapiens
tggatcaccattatatt

SEQ ID NO: 4402354 - DNA, 19 bp, Homo sapiens
tggatcacctgaggtcagg

SEQ ID NO: 4402355 - DNA, 19 bp, Homo sapiens
tggatcataagacaatgga

SEQ ID NO: 4402356 - DNA, 23 bp, Homo sapiens
tggatccatcttgagccacagtc

SEQ ID NO: 4402357 - DNA, 18 bp, Homo sapiens
tggatcccaaagcaagga

SEQ ID NO: 4402358 - DNA, 13 bp, Homo sapiens
tggatcctgctgc

SEQ ID NO: 4402359 - DNA, 22 bp, Homo sapiens
tggatcgctgcacatggcctga

SEQ ID NO: 4402360 - DNA, 23 bp, Homo sapiens
tggatcgctgcacatggcctgag

SEQ ID NO: 4402361 - DNA, 23 bp, Homo sapiens
tggatctgaggaggctttggtaa

SEQ ID NO: 4402362 - DNA, 21 bp, Homo sapiens
tggatctgggaccctttcctt

SEQ ID NO: 4402363 - DNA, 15 bp, Homo sapiens
tggatctggggactg

SEQ ID NO: 4402364 - DNA, 19 bp, Homo sapiens
tggatcttcagaactgccc

SEQ ID NO: 4402365 - DNA, 19 bp, Homo sapiens
tggatgatattttttatca

SEQ ID NO: 4402366 - DNA, 15 bp, Homo sapiens
tggatgatcaatcct

SEQ ID NO: 4402367 - DNA, 14 bp, Homo sapiens
tggatgattaaatt

SEQ ID NO: 4402368 - DNA, 13 bp, Homo sapiens
tggatgcaaagta

SEQ ID NO: 4402369 - DNA, 15 bp, Homo sapiens
tggatgcatttcaaa

SEQ ID NO: 4402370 - DNA, 16 bp, Homo sapiens
tggatgcatttcaaat

SEQ ID NO: 4402371 - DNA, 20 bp, Homo sapiens
tggatgccacagcccagctt

SEQ ID NO: 4402372 - DNA, 15 bp, Homo sapiens
tggatggaaggagac

SEQ ID NO: 4402373 - DNA, 18 bp, Homo sapiens
tggatggctcaagtctgc

SEQ ID NO: 4402374 - DNA, 18 bp, Homo sapiens
tggatggtccagtgtcat

SEQ ID NO: 4402375 - DNA, 13 bp, Homo sapiens
tggatggtggcca

SEQ ID NO: 4402376 - DNA, 14 bp, Homo sapiens
tggatgtctgtagc

SEQ ID NO: 4402377 - DNA, 16 bp, Homo sapiens
tggatgtgctggaggg

SEQ ID NO: 4402378 - DNA, 14 bp, Homo sapiens
tggattaaaccttt

SEQ ID NO: 4402379 - DNA, 21 bp, Homo sapiens
tggattaaattagtttgtgaa

SEQ ID NO: 4402380 - DNA, 16 bp, Homo sapiens
tggattagcttttcct

SEQ ID NO: 4402381 - DNA, 16 bp, Homo sapiens
tggattataatcagaa

SEQ ID NO: 4402382 - DNA, 17 bp, Homo sapiens
tggattcatatttaatt

SEQ ID NO: 4402383 - DNA, 20 bp, Homo sapiens
tggattctgaggccctgccc

SEQ ID NO: 4402384 - DNA, 21 bp, Homo sapiens
tggattgggggggccaaaagg

SEQ ID NO: 4402385 - DNA, 18 bp, Homo sapiens
tggattgttaatttcagt

SEQ ID NO: 4402386 - DNA, 21 bp, Homo sapiens
tggattgttaatttcagtcct

SEQ ID NO: 4402387 - DNA, 16 bp, Homo sapiens
tggatttaaaagcctg

SEQ ID NO: 4402388 - DNA, 16 bp, Homo sapiens
tggatttagtttcagt

SEQ ID NO: 4402389 - DNA, 20 bp, Homo sapiens
tggatttcgtgtgccgctgc

SEQ ID NO: 4402390 - DNA, 14 bp, Homo sapiens
tggatttctgtgaa

SEQ ID NO: 4402391 - DNA, 15 bp, Homo sapiens
tggatttctgtgaag

SEQ ID NO: 4402392 - DNA, 15 bp, Homo sapiens
tggatttttctttaa

SEQ ID NO: 4402393 - DNA, 17 bp, Homo sapiens
tggatttttgtcttgtg

SEQ ID NO: 4402394 - DNA, 22 bp, Homo sapiens
tggattttttatgtacaaccct

SEQ ID NO: 4402395 - DNA, 23 bp, Homo sapiens
tggattttttccttcaaagttta

SEQ ID NO: 4402396 - DNA, 18 bp, Homo sapiens
tggcaaaactcaggcaga

SEQ ID NO: 4402397 - DNA, 15 bp, Homo sapiens
tggcaaacagggcct

SEQ ID NO: 4402398 - DNA, 18 bp, Homo sapiens
tggcaaacagggcctctg

SEQ ID NO: 4402399 - DNA, 15 bp, Homo sapiens
tggcaaacttttctt

SEQ ID NO: 4402400 - DNA, 20 bp, Homo sapiens
tggcaacattggacagaaaa

SEQ ID NO: 4402401 - DNA, 23 bp, Homo sapiens
tggcaacattggacagaaaatgc

SEQ ID NO: 4402402 - DNA, 21 bp, Homo sapiens
tggcaagctagaacctggagg

SEQ ID NO: 4402403 - DNA, 20 bp, Homo sapiens
tggcaaggactttgtacatt

SEQ ID NO: 4402404 - DNA, 14 bp, Homo sapiens
tggcaatgaaaatt

SEQ ID NO: 4402405 - DNA, 19 bp, Homo sapiens
tggcaattccaatatttct

SEQ ID NO: 4402406 - DNA, 18 bp, Homo sapiens
tggcaatttcctggccct

SEQ ID NO: 4402407 - DNA, 19 bp, Homo sapiens
tggcaatttcctggccctc

SEQ ID NO: 4402408 - DNA, 21 bp, Homo sapiens
tggcaatttcctggccctcca

SEQ ID NO: 4402409 - DNA, 12 bp, Homo sapiens
tggcacagcccc

SEQ ID NO: 4402410 - DNA, 14 bp, Homo sapiens
tggcacagcccctg

SEQ ID NO: 4402411 - DNA, 23 bp, Homo sapiens
tggcacattgcccctctgccttg

SEQ ID NO: 4402412 - DNA, 14 bp, Homo sapiens
tggcaccagatgca

SEQ ID NO: 4402413 - DNA, 19 bp, Homo sapiens
tggcaccatgttggcctct

SEQ ID NO: 4402414 - DNA, 20 bp, Homo sapiens
tggcacccccatgctgcctt

SEQ ID NO: 4402415 - DNA, 13 bp, Homo sapiens
tggcacctgcagc

SEQ ID NO: 4402416 - DNA, 22 bp, Homo sapiens
tggcaccttcagactttgcttc

SEQ ID NO: 4402417 - DNA, 15 bp, Homo sapiens
tggcacgttgaccca

SEQ ID NO: 4402418 - DNA, 13 bp, Homo sapiens
tggcactggcaaa

SEQ ID NO: 4402419 - DNA, 17 bp, Homo sapiens
tggcactgggaggcagg

SEQ ID NO: 4402420 - DNA, 22 bp, Homo sapiens
tggcactgtaaggtgcttgctc

SEQ ID NO: 4402421 - DNA, 22 bp, Homo sapiens
tggcacttgccattccaaaata

SEQ ID NO: 4402422 - DNA, 16 bp, Homo sapiens
tggcacttgggggact

SEQ ID NO: 4402423 - DNA, 21 bp, Homo sapiens
tggcagaagggaattgctcag

SEQ ID NO: 4402424 - DNA, 12 bp, Homo sapiens
tggcagagttac

SEQ ID NO: 4402425 - DNA, 19 bp, Homo sapiens
tggcagatgtcttccctgg

SEQ ID NO: 4402426 - DNA, 22 bp, Homo sapiens
tggcagatgtcttccctgggct

SEQ ID NO: 4402427 - DNA, 22 bp, Homo sapiens
tggcagatttagtgaaagctag

SEQ ID NO: 4402428 - DNA, 21 bp, Homo sapiens
tggcagccgggttagcatgtg

SEQ ID NO: 4402429 - DNA, 16 bp, Homo sapiens
tggcagctagtgcctt

SEQ ID NO: 4402430 - DNA, 17 bp, Homo sapiens
tggcagctgagagccct

SEQ ID NO: 4402431 - DNA, 22 bp, Homo sapiens
tggcaggcacacagcagccccc

SEQ ID NO: 4402432 - DNA, 16 bp, Homo sapiens
tggcaggcccactccc

SEQ ID NO: 4402433 - DNA, 19 bp, Homo sapiens
tggcaggcccactccccag

SEQ ID NO: 4402434 - DNA, 14 bp, Homo sapiens
tggcagggccaggc

SEQ ID NO: 4402435 - DNA, 21 bp, Homo sapiens
tggcagggggccccgccaggg

SEQ ID NO: 4402436 - DNA, 17 bp, Homo sapiens
tggcagggtgggatgga

SEQ ID NO: 4402437 - DNA, 23 bp, Homo sapiens
tggcagtggactcagaaagccaa

SEQ ID NO: 4402438 - DNA, 13 bp, Homo sapiens
tggcagttgcagt

SEQ ID NO: 4402439 - DNA, 11 bp, Homo sapiens
tggcatacaaa

SEQ ID NO: 4402440 - DNA, 13 bp, Homo sapiens
tggcatacaaaat

SEQ ID NO: 4402441 - DNA, 14 bp, Homo sapiens
tggcatagctctgg

SEQ ID NO: 4402442 - DNA, 16 bp, Homo sapiens
tggcatagctctgggg

SEQ ID NO: 4402443 - DNA, 23 bp, Homo sapiens
tggcatatatgtgatctgggcat

SEQ ID NO: 4402444 - DNA, 22 bp, Homo sapiens
tggcatcaagaggtgggagggc

SEQ ID NO: 4402445 - DNA, 23 bp, Homo sapiens
tggcatcaagaggtgggagggcc

SEQ ID NO: 4402446 - DNA, 21 bp, Homo sapiens
tggcatcacagaccccagctg

SEQ ID NO: 4402447 - DNA, 21 bp, Homo sapiens
tggcatccagagtccctgcct

SEQ ID NO: 4402448 - DNA, 20 bp, Homo sapiens
tggcatgatcatagctcact

SEQ ID NO: 4402449 - DNA, 21 bp, Homo sapiens
tggcatgatcatagctcactg

SEQ ID NO: 4402450 - DNA, 22 bp, Homo sapiens
tggcatgatcatagctcactgc

SEQ ID NO: 4402451 - DNA, 17 bp, Homo sapiens
tggcatgcttaaatttt

SEQ ID NO: 4402452 - DNA, 18 bp, Homo sapiens
tggcatgcttaaatttta

SEQ ID NO: 4402453 - DNA, 21 bp, Homo sapiens
tggcatgtcatttgcacacaa

SEQ ID NO: 4402454 - DNA, 16 bp, Homo sapiens
tggcatgtggagacac

SEQ ID NO: 4402455 - DNA, 12 bp, Homo sapiens
tggcattattag

SEQ ID NO: 4402456 - DNA, 14 bp, Homo sapiens
tggccacacaggca

SEQ ID NO: 4402457 - DNA, 19 bp, Homo sapiens
tggccacacaggcagggcc

SEQ ID NO: 4402458 - DNA, 22 bp, Homo sapiens
tggccacacaggcagggcctgg

SEQ ID NO: 4402459 - DNA, 16 bp, Homo sapiens
tggccacactggggct

SEQ ID NO: 4402460 - DNA, 11 bp, Homo sapiens
tggccacagca

SEQ ID NO: 4402461 - DNA, 23 bp, Homo sapiens
tggccacagcaagtacagcggct

SEQ ID NO: 4402462 - DNA, 11 bp, Homo sapiens
tggccaccagt

SEQ ID NO: 4402463 - DNA, 14 bp, Homo sapiens
tggccacccctccc

SEQ ID NO: 4402464 - DNA, 15 bp, Homo sapiens
tggccacccctcccc

SEQ ID NO: 4402465 - DNA, 16 bp, Homo sapiens
tggccactggatcctg

SEQ ID NO: 4402466 - DNA, 21 bp, Homo sapiens
tggccactggggtgccttcac

SEQ ID NO: 4402467 - DNA, 14 bp, Homo sapiens
tggccagagcctct

SEQ ID NO: 4402468 - DNA, 15 bp, Homo sapiens
tggccagagcctctg

SEQ ID NO: 4402469 - DNA, 17 bp, Homo sapiens
tggccagagcctctggc

SEQ ID NO: 4402470 - DNA, 18 bp, Homo sapiens
tggccagagcctctggcc

SEQ ID NO: 4402471 - DNA, 14 bp, Homo sapiens
tggccagcaccctc

SEQ ID NO: 4402472 - DNA, 23 bp, Homo sapiens
tggccagcccctggggcccagcc

SEQ ID NO: 4402473 - DNA, 20 bp, Homo sapiens
tggccagggccacgctccag

SEQ ID NO: 4402474 - DNA, 19 bp, Homo sapiens
tggccaggggtgctcctgt

SEQ ID NO: 4402475 - DNA, 12 bp, Homo sapiens
tggccaggtgcc

SEQ ID NO: 4402476 - DNA, 23 bp, Homo sapiens
tggccatatatgctgtatttctt

SEQ ID NO: 4402477 - DNA, 15 bp, Homo sapiens
tggccatccctgggc

SEQ ID NO: 4402478 - DNA, 17 bp, Homo sapiens
tggccatccctgggccc

SEQ ID NO: 4402479 - DNA, 19 bp, Homo sapiens
tggccatccctgggcccct

SEQ ID NO: 4402480 - DNA, 21 bp, Homo sapiens
tggccatccctgggcccctcc

SEQ ID NO: 4402481 - DNA, 14 bp, Homo sapiens
tggccatccctgtg

SEQ ID NO: 4402482 - DNA, 17 bp, Homo sapiens
tggccatccctgtgagg

SEQ ID NO: 4402483 - DNA, 16 bp, Homo sapiens
tggccatctccctccc

SEQ ID NO: 4402484 - DNA, 18 bp, Homo sapiens
tggccatgctcaaccccc

SEQ ID NO: 4402485 - DNA, 14 bp, Homo sapiens
tggcccagagccat

SEQ ID NO: 4402486 - DNA, 19 bp, Homo sapiens
tggcccagagccatactgc

SEQ ID NO: 4402487 - DNA, 12 bp, Homo sapiens
tggcccagccct

SEQ ID NO: 4402488 - DNA, 19 bp, Homo sapiens
tggcccagccctgctggcc

SEQ ID NO: 4402489 - DNA, 13 bp, Homo sapiens
tggcccagggcat

SEQ ID NO: 4402490 - DNA, 14 bp, Homo sapiens
tggcccagggcatc

SEQ ID NO: 4402491 - DNA, 19 bp, Homo sapiens
tggcccagggcatctggga

SEQ ID NO: 4402492 - DNA, 21 bp, Homo sapiens
tggccccaagaggggcgggct

SEQ ID NO: 4402493 - DNA, 15 bp, Homo sapiens
tggccccagcctggg

SEQ ID NO: 4402494 - DNA, 12 bp, Homo sapiens
tggccccaggcc

SEQ ID NO: 4402495 - DNA, 22 bp, Homo sapiens
tggccccaggcccacagcgtgg

SEQ ID NO: 4402496 - DNA, 18 bp, Homo sapiens
tggccccatccaaccact

SEQ ID NO: 4402497 - DNA, 23 bp, Homo sapiens
tggccccatgtctctcagaattc

SEQ ID NO: 4402498 - DNA, 13 bp, Homo sapiens
tggcccccaataa

SEQ ID NO: 4402499 - DNA, 17 bp, Homo sapiens
tggcccccaataaaggc

SEQ ID NO: 4402500 - DNA, 21 bp, Homo sapiens
tggcccccaataaaggcagct

SEQ ID NO: 4402501 - DNA, 15 bp, Homo sapiens
tggcccccatcagcc

SEQ ID NO: 4402502 - DNA, 18 bp, Homo sapiens
tggccccgcccctgcccc

SEQ ID NO: 4402503 - DNA, 19 bp, Homo sapiens
tggccccgcccctgccccc

SEQ ID NO: 4402504 - DNA, 23 bp, Homo sapiens
tggcccctcacccaccatggacc

SEQ ID NO: 4402505 - DNA, 21 bp, Homo sapiens
tggcccctcgaccctgtgcag

SEQ ID NO: 4402506 - DNA, 21 bp, Homo sapiens
tggccctacttccaggatgga

SEQ ID NO: 4402507 - DNA, 16 bp, Homo sapiens
tggccctgccttcttc

SEQ ID NO: 4402508 - DNA, 16 bp, Homo sapiens
tggccctggcctgctg

SEQ ID NO: 4402509 - DNA, 18 bp, Homo sapiens
tggccctggcctgctggg

SEQ ID NO: 4402510 - DNA, 13 bp, Homo sapiens
tggccctggggat

SEQ ID NO: 4402511 - DNA, 19 bp, Homo sapiens
tggccctggggatcttccc

SEQ ID NO: 4402512 - DNA, 18 bp, Homo sapiens
tggccctgtcccaggccg

SEQ ID NO: 4402513 - DNA, 15 bp, Homo sapiens
tggccgagctcctgg

SEQ ID NO: 4402514 - DNA, 21 bp, Homo sapiens
tggccgagctcctggggagct

SEQ ID NO: 4402515 - DNA, 12 bp, Homo sapiens
tggccggcctcc

SEQ ID NO: 4402516 - DNA, 13 bp, Homo sapiens
tggccgggcacag

SEQ ID NO: 4402517 - DNA, 16 bp, Homo sapiens
tggccgggcacagtgg

SEQ ID NO: 4402518 - DNA, 15 bp, Homo sapiens
tggccggtgccagct

SEQ ID NO: 4402519 - DNA, 16 bp, Homo sapiens
tggccggtgccagctg

SEQ ID NO: 4402520 - DNA, 17 bp, Homo sapiens
tggccggtgccagctgc

SEQ ID NO: 4402521 - DNA, 23 bp, Homo sapiens
tggcctaacctgccgagagtcca

SEQ ID NO: 4402522 - DNA, 17 bp, Homo sapiens
tggcctaagtgcctctt

SEQ ID NO: 4402523 - DNA, 19 bp, Homo sapiens
tggcctaagtgcctcttct

SEQ ID NO: 4402524 - DNA, 19 bp, Homo sapiens
tggcctacaaatcagtaat

SEQ ID NO: 4402525 - DNA, 16 bp, Homo sapiens
tggcctaggacccctc

SEQ ID NO: 4402526 - DNA, 18 bp, Homo sapiens
tggcctatccgctgccag

SEQ ID NO: 4402527 - DNA, 17 bp, Homo sapiens
tggcctatttcagctgc

SEQ ID NO: 4402528 - DNA, 18 bp, Homo sapiens
tggcctatttcagctgct

SEQ ID NO: 4402529 - DNA, 15 bp, Homo sapiens
tggcctcacccaccc

SEQ ID NO: 4402530 - DNA, 22 bp, Homo sapiens
tggcctcacccacccctgcaca

SEQ ID NO: 4402531 - DNA, 12 bp, Homo sapiens
tggcctcagccc

SEQ ID NO: 4402532 - DNA, 14 bp, Homo sapiens
tggcctcagccctc

SEQ ID NO: 4402533 - DNA, 16 bp, Homo sapiens
tggcctcagccctcag

SEQ ID NO: 4402534 - DNA, 22 bp, Homo sapiens
tggcctcagccctgctccctgc

SEQ ID NO: 4402535 - DNA, 18 bp, Homo sapiens
tggcctcagctgcctcac

SEQ ID NO: 4402536 - DNA, 19 bp, Homo sapiens
tggcctcagctgcctcact

SEQ ID NO: 4402537 - DNA, 13 bp, Homo sapiens
tggcctcccaaag

SEQ ID NO: 4402538 - DNA, 20 bp, Homo sapiens
tggcctcccaaagtgctgag

SEQ ID NO: 4402539 - DNA, 15 bp, Homo sapiens
tggcctccctgctgt

SEQ ID NO: 4402540 - DNA, 13 bp, Homo sapiens
tggcctctcccca

SEQ ID NO: 4402541 - DNA, 15 bp, Homo sapiens
tggcctcttcaggcc

SEQ ID NO: 4402542 - DNA, 16 bp, Homo sapiens
tggcctgaactgagga

SEQ ID NO: 4402543 - DNA, 14 bp, Homo sapiens
tggcctgaagaagc

SEQ ID NO: 4402544 - DNA, 22 bp, Homo sapiens
tggcctgatctctgctccctgc

SEQ ID NO: 4402545 - DNA, 12 bp, Homo sapiens
tggcctgctcat

SEQ ID NO: 4402546 - DNA, 21 bp, Homo sapiens
tggcctgctgggctctccacc

SEQ ID NO: 4402547 - DNA, 17 bp, Homo sapiens
tggcctggccaggagct

SEQ ID NO: 4402548 - DNA, 19 bp, Homo sapiens
tggcctggccatttccaag

SEQ ID NO: 4402549 - DNA, 12 bp, Homo sapiens
tggcctgtctca

SEQ ID NO: 4402550 - DNA, 24 bp, Homo sapiens
tggcctgtctcatccccaggggtc

SEQ ID NO: 4402551 - DNA, 20 bp, Homo sapiens
tggccttaagaactgtgtct

SEQ ID NO: 4402552 - DNA, 12 bp, Homo sapiens
tggcctttcctt

SEQ ID NO: 4402553 - DNA, 15 bp, Homo sapiens
tggcctttccttccc

SEQ ID NO: 4402554 - DNA, 14 bp, Homo sapiens
tggcctttggaccc

SEQ ID NO: 4402555 - DNA, 24 bp, Homo sapiens
tggcctttgtgctgcgcctgcagg

SEQ ID NO: 4402556 - DNA, 22 bp, Homo sapiens
tggcctttttcatttatctata

SEQ ID NO: 4402557 - DNA, 18 bp, Homo sapiens
tggcgaatctcaaaatta

SEQ ID NO: 4402558 - DNA, 14 bp, Homo sapiens
tggcgagccatttg

SEQ ID NO: 4402559 - DNA, 22 bp, Homo sapiens
tggcgagccatttgtcccaagt

SEQ ID NO: 4402560 - DNA, 23 bp, Homo sapiens
tggcgagccatttgtcccaagtg

SEQ ID NO: 4402561 - DNA, 22 bp, Homo sapiens
tggcgcatagtgtgctcggaca

SEQ ID NO: 4402562 - DNA, 22 bp, Homo sapiens
tggcgcccctgcctgtgcccgc

SEQ ID NO: 4402563 - DNA, 13 bp, Homo sapiens
tggcgctcagcag

SEQ ID NO: 4402564 - DNA, 18 bp, Homo sapiens
tggcgctcagcagcccta

SEQ ID NO: 4402565 - DNA, 20 bp, Homo sapiens
tggcgctcagcagccctagc

SEQ ID NO: 4402566 - DNA, 17 bp, Homo sapiens
tggcgcttggatctggg

SEQ ID NO: 4402567 - DNA, 21 bp, Homo sapiens
tggcggctactcagcagccct

SEQ ID NO: 4402568 - DNA, 22 bp, Homo sapiens
tggcggctactcagcagccctc

SEQ ID NO: 4402569 - DNA, 13 bp, Homo sapiens
tggcgggcccact

SEQ ID NO: 4402570 - DNA, 17 bp, Homo sapiens
tggcgggcctttttcct

SEQ ID NO: 4402571 - DNA, 21 bp, Homo sapiens
tggcgtgctcagacccaacag

SEQ ID NO: 4402572 - DNA, 14 bp, Homo sapiens
tggctaaccaagag

SEQ ID NO: 4402573 - DNA, 21 bp, Homo sapiens
tggctagaggccagccccacc

SEQ ID NO: 4402574 - DNA, 16 bp, Homo sapiens
tggctagagtcctcac

SEQ ID NO: 4402575 - DNA, 17 bp, Homo sapiens
tggctataagtgctcaa

SEQ ID NO: 4402576 - DNA, 15 bp, Homo sapiens
tggctataggtgcta

SEQ ID NO: 4402577 - DNA, 21 bp, Homo sapiens
tggctatctatacctgccttt

SEQ ID NO: 4402578 - DNA, 19 bp, Homo sapiens
tggctatgaaaatgagccc

SEQ ID NO: 4402579 - DNA, 12 bp, Homo sapiens
tggctattttat

SEQ ID NO: 4402580 - DNA, 15 bp, Homo sapiens
tggctatttttgaag

SEQ ID NO: 4402581 - DNA, 14 bp, Homo sapiens
tggctcacacctgt

SEQ ID NO: 4402582 - DNA, 12 bp, Homo sapiens
tggctcacactg

SEQ ID NO: 4402583 - DNA, 13 bp, Homo sapiens
tggctcacgcctg

SEQ ID NO: 4402584 - DNA, 14 bp, Homo sapiens
tggctcacgcctgt

SEQ ID NO: 4402585 - DNA, 17 bp, Homo sapiens
tggctcacgcctgtaat

SEQ ID NO: 4402586 - DNA, 21 bp, Homo sapiens
tggctcagacccctcagcccc

SEQ ID NO: 4402587 - DNA, 22 bp, Homo sapiens
tggctcagacccctcagcccca

SEQ ID NO: 4402588 - DNA, 19 bp, Homo sapiens
tggctccagtctcatcctc

SEQ ID NO: 4402589 - DNA, 23 bp, Homo sapiens
tggctcccatgaccatactgagg

SEQ ID NO: 4402590 - DNA, 17 bp, Homo sapiens
tggctccccctccccag

SEQ ID NO: 4402591 - DNA, 21 bp, Homo sapiens
tggctccccctccccaggctg

SEQ ID NO: 4402592 - DNA, 22 bp, Homo sapiens
tggctccccctccccaggctgg

SEQ ID NO: 4402593 - DNA, 23 bp, Homo sapiens
tggctccccctccccaggctgga

SEQ ID NO: 4402594 - DNA, 13 bp, Homo sapiens
tggctcccctgcc

SEQ ID NO: 4402595 - DNA, 21 bp, Homo sapiens
tggctcctgaggggcatctgc

SEQ ID NO: 4402596 - DNA, 15 bp, Homo sapiens
tggctcctgtctggc

SEQ ID NO: 4402597 - DNA, 17 bp, Homo sapiens
tggctcctgtctggctc

SEQ ID NO: 4402598 - DNA, 18 bp, Homo sapiens
tggctcggacccacccca

SEQ ID NO: 4402599 - DNA, 16 bp, Homo sapiens
tggctctgccccctcc

SEQ ID NO: 4402600 - DNA, 18 bp, Homo sapiens
tggctctgccccctcccc

SEQ ID NO: 4402601 - DNA, 15 bp, Homo sapiens
tggctctgccctgga

SEQ ID NO: 4402602 - DNA, 13 bp, Homo sapiens
tggctctgcctca

SEQ ID NO: 4402603 - DNA, 14 bp, Homo sapiens
tggctctgcctcag

SEQ ID NO: 4402604 - DNA, 15 bp, Homo sapiens
tggctcttctgccca

SEQ ID NO: 4402605 - DNA, 18 bp, Homo sapiens
tggctgaagaggaccaga

SEQ ID NO: 4402606 - DNA, 19 bp, Homo sapiens
tggctgaagaggaccagag

SEQ ID NO: 4402607 - DNA, 21 bp, Homo sapiens
tggctgaagaggaccagagga

SEQ ID NO: 4402608 - DNA, 21 bp, Homo sapiens
tggctgacccagtccctgggg

SEQ ID NO: 4402609 - DNA, 20 bp, Homo sapiens
tggctgacttacatcatgtg

SEQ ID NO: 4402610 - DNA, 17 bp, Homo sapiens
tggctgaggaggcctcc

SEQ ID NO: 4402611 - DNA, 20 bp, Homo sapiens
tggctgaggttcctctgcct

SEQ ID NO: 4402612 - DNA, 21 bp, Homo sapiens
tggctgaggttcctctgcctg

SEQ ID NO: 4402613 - DNA, 14 bp, Homo sapiens
tggctgataatttt

SEQ ID NO: 4402614 - DNA, 19 bp, Homo sapiens
tggctgataattttaaatt

SEQ ID NO: 4402615 - DNA, 12 bp, Homo sapiens
tggctgccacac

SEQ ID NO: 4402616 - DNA, 22 bp, Homo sapiens
tggctgccacacccaggggaag

SEQ ID NO: 4402617 - DNA, 16 bp, Homo sapiens
tggctgcgctaacccc

SEQ ID NO: 4402618 - DNA, 15 bp, Homo sapiens
tggctgctgccccca

SEQ ID NO: 4402619 - DNA, 16 bp, Homo sapiens
tggctggaatagtaaa

SEQ ID NO: 4402620 - DNA, 22 bp, Homo sapiens
tggctggctaactggaagcatg

SEQ ID NO: 4402621 - DNA, 14 bp, Homo sapiens
tggctggctcctag

SEQ ID NO: 4402622 - DNA, 16 bp, Homo sapiens
tggctgggggcaggag

SEQ ID NO: 4402623 - DNA, 14 bp, Homo sapiens
tggctggggtgtca

SEQ ID NO: 4402624 - DNA, 19 bp, Homo sapiens
tggctggggtgtcaataaa

SEQ ID NO: 4402625 - DNA, 17 bp, Homo sapiens
tggctggtagcagcagg

SEQ ID NO: 4402626 - DNA, 16 bp, Homo sapiens
tggctgtaatcatttg

SEQ ID NO: 4402627 - DNA, 22 bp, Homo sapiens
tggctgtgaatgccaaagccat

SEQ ID NO: 4402628 - DNA, 17 bp, Homo sapiens
tggctgtggcatccaga

SEQ ID NO: 4402629 - DNA, 20 bp, Homo sapiens
tggctgtggcctaacctgcc

SEQ ID NO: 4402630 - DNA, 15 bp, Homo sapiens
tggctgtttcatcag

SEQ ID NO: 4402631 - DNA, 18 bp, Homo sapiens
tggcttaagcctgtgtat

SEQ ID NO: 4402632 - DNA, 21 bp, Homo sapiens
tggcttaggaatgacttactt

SEQ ID NO: 4402633 - DNA, 14 bp, Homo sapiens
tggcttccagattt

SEQ ID NO: 4402634 - DNA, 18 bp, Homo sapiens
tggcttcggacaaaatat

SEQ ID NO: 4402635 - DNA, 20 bp, Homo sapiens
tggcttcggacaaaatatct

SEQ ID NO: 4402636 - DNA, 13 bp, Homo sapiens
tggcttctccagg

SEQ ID NO: 4402637 - DNA, 23 bp, Homo sapiens
tggcttctcgctgcgcagcctcc

SEQ ID NO: 4402638 - DNA, 20 bp, Homo sapiens
tggcttctgtggggcccctc

SEQ ID NO: 4402639 - DNA, 15 bp, Homo sapiens
tggcttctgtttcta

SEQ ID NO: 4402640 - DNA, 16 bp, Homo sapiens
tggcttctgtttctag

SEQ ID NO: 4402641 - DNA, 15 bp, Homo sapiens
tggcttgagaaatat

SEQ ID NO: 4402642 - DNA, 13 bp, Homo sapiens
tggctttaaataa

SEQ ID NO: 4402643 - DNA, 21 bp, Homo sapiens
tggctttaaataaattaagat

SEQ ID NO: 4402644 - DNA, 12 bp, Homo sapiens
tggctttcaaag

SEQ ID NO: 4402645 - DNA, 21 bp, Homo sapiens
tggctttccaggcaccctcag

SEQ ID NO: 4402646 - DNA, 17 bp, Homo sapiens
tggctttgaaacctcag

SEQ ID NO: 4402647 - DNA, 19 bp, Homo sapiens
tggctttgaaacctcaggg

SEQ ID NO: 4402648 - DNA, 21 bp, Homo sapiens
tggctttgcagctgctgtctg

SEQ ID NO: 4402649 - DNA, 14 bp, Homo sapiens
tggctttgcctctt

SEQ ID NO: 4402650 - DNA, 20 bp, Homo sapiens
tggctttgcctcttctttgt

SEQ ID NO: 4402651 - DNA, 12 bp, Homo sapiens
tggctttgctgt

SEQ ID NO: 4402652 - DNA, 22 bp, Homo sapiens
tggcttttattaatgcactttc

SEQ ID NO: 4402653 - DNA, 20 bp, Homo sapiens
tggcttttgcggttcaggaa

SEQ ID NO: 4402654 - DNA, 13 bp, Homo sapiens
tggctttttgaaa

SEQ ID NO: 4402655 - DNA, 17 bp, Homo sapiens
tggctttttgttcagaa

SEQ ID NO: 4402656 - DNA, 18 bp, Homo sapiens
tggctttttgttcagaat

SEQ ID NO: 4402657 - DNA, 19 bp, Homo sapiens
tgggaaatagcggccctgg

SEQ ID NO: 4402658 - DNA, 14 bp, Homo sapiens
tgggaacaaggaag

SEQ ID NO: 4402659 - DNA, 15 bp, Homo sapiens
tgggaacaaggaagg

SEQ ID NO: 4402660 - DNA, 16 bp, Homo sapiens
tgggaactatgaggag

SEQ ID NO: 4402661 - DNA, 17 bp, Homo sapiens
tgggaactatgaggagc

SEQ ID NO: 4402662 - DNA, 17 bp, Homo sapiens
tgggaacttgcgagtcc

SEQ ID NO: 4402663 - DNA, 18 bp, Homo sapiens
tgggaagaacagaattgc

SEQ ID NO: 4402664 - DNA, 13 bp, Homo sapiens
tgggaagaagaag

SEQ ID NO: 4402665 - DNA, 17 bp, Homo sapiens
tgggaagacgaggccct

SEQ ID NO: 4402666 - DNA, 22 bp, Homo sapiens
tgggaagactcaggagtctgcc

SEQ ID NO: 4402667 - DNA, 23 bp, Homo sapiens
tgggaagagaagagggcccagcc

SEQ ID NO: 4402668 - DNA, 19 bp, Homo sapiens
tgggaagcccatcctgacc

SEQ ID NO: 4402669 - DNA, 22 bp, Homo sapiens
tgggaagcccatcctgaccagc

SEQ ID NO: 4402670 - DNA, 15 bp, Homo sapiens
tgggaagctgagggc

SEQ ID NO: 4402671 - DNA, 21 bp, Homo sapiens
tgggaaggcgagtctggggac

SEQ ID NO: 4402672 - DNA, 17 bp, Homo sapiens
tgggaagtcgaggctgc

SEQ ID NO: 4402673 - DNA, 13 bp, Homo sapiens
tgggaagtgtgtt

SEQ ID NO: 4402674 - DNA, 15 bp, Homo sapiens
tgggaataaaagtat

SEQ ID NO: 4402675 - DNA, 16 bp, Homo sapiens
tgggaataattgcttt

SEQ ID NO: 4402676 - DNA, 17 bp, Homo sapiens
tgggaatgaggtgggag

SEQ ID NO: 4402677 - DNA, 19 bp, Homo sapiens
tgggaattcttgctgttaa

SEQ ID NO: 4402678 - DNA, 18 bp, Homo sapiens
tgggaattgcgctcaggg

SEQ ID NO: 4402679 - DNA, 17 bp, Homo sapiens
tgggacacagacccagg

SEQ ID NO: 4402680 - DNA, 22 bp, Homo sapiens
tgggacagaggagcaaggttta

SEQ ID NO: 4402681 - DNA, 17 bp, Homo sapiens
tgggacatggaaaagaa

SEQ ID NO: 4402682 - DNA, 21 bp, Homo sapiens
tgggaccctcagcagctctgg

SEQ ID NO: 4402683 - DNA, 23 bp, Homo sapiens
tgggaccctccagtgctggattt

SEQ ID NO: 4402684 - DNA, 19 bp, Homo sapiens
tgggacctgccaggcaggg

SEQ ID NO: 4402685 - DNA, 13 bp, Homo sapiens
tgggacggaccag

SEQ ID NO: 4402686 - DNA, 23 bp, Homo sapiens
ccccaactgtggtagctccagcg

SEQ ID NO: 4402687 - DNA, 17 bp, Homo sapiens
ccccaagactcccatga

SEQ ID NO: 4402688 - DNA, 20 bp, Homo sapiens
ccccaagaggaagttcagat

SEQ ID NO: 4402689 - DNA, 19 bp, Homo sapiens
ccccaagatgagctgcagc

SEQ ID NO: 4402690 - DNA, 21 bp, Homo sapiens
ccccaagatgagctgcagccc

SEQ ID NO: 4402691 - DNA, 15 bp, Homo sapiens
ccccaataaaccagt

SEQ ID NO: 4402692 - DNA, 19 bp, Homo sapiens
ccccaataaaccagtgtga

SEQ ID NO: 4402693 - DNA, 22 bp, Homo sapiens
ccccaataaaccagtgtgaacc

SEQ ID NO: 4402694 - DNA, 12 bp, Homo sapiens
ccccaataaagg

SEQ ID NO: 4402695 - DNA, 19 bp, Homo sapiens
ccccaataaaggcagctgc

SEQ ID NO: 4402696 - DNA, 23 bp, Homo sapiens
ccccaataaaggcagctgcctct

SEQ ID NO: 4402697 - DNA, 24 bp, Homo sapiens
ccccaataaaggcagctgcctctg

SEQ ID NO: 4402698 - DNA, 19 bp, Homo sapiens
ccccaatcgggtccagaga

SEQ ID NO: 4402699 - DNA, 20 bp, Homo sapiens
ccccaatcgggtccagagac

SEQ ID NO: 4402700 - DNA, 13 bp, Homo sapiens
ccccaattctccc

SEQ ID NO: 4402701 - DNA, 15 bp, Homo sapiens
ccccaattctcccct

SEQ ID NO: 4402702 - DNA, 22 bp, Homo sapiens
ccccacagaaccttcaacccag

SEQ ID NO: 4402703 - DNA, 12 bp, Homo sapiens
ccccacagctgg

SEQ ID NO: 4402704 - DNA, 13 bp, Homo sapiens
ccccaccagtgcc

SEQ ID NO: 4402705 - DNA, 18 bp, Homo sapiens
ccccaccagtgcctctcc

SEQ ID NO: 4402706 - DNA, 23 bp, Homo sapiens
ccccacccaactccacagggctg

SEQ ID NO: 4402707 - DNA, 16 bp, Homo sapiens
ccccaccccacacttg

SEQ ID NO: 4402708 - DNA, 17 bp, Homo sapiens
ccccaccccctccccag

SEQ ID NO: 4402709 - DNA, 17 bp, Homo sapiens
ccccacccccttcagtg

SEQ ID NO: 4402710 - DNA, 19 bp, Homo sapiens
ccccaccccggggaccctg

SEQ ID NO: 4402711 - DNA, 22 bp, Homo sapiens
ccccaccccggggaccctgtga

SEQ ID NO: 4402712 - DNA, 23 bp, Homo sapiens
ccccaccccggggaccctgtgac

SEQ ID NO: 4402713 - DNA, 13 bp, Homo sapiens
ccccacccctgcc

SEQ ID NO: 4402714 - DNA, 16 bp, Homo sapiens
ccccaccctccctgga

SEQ ID NO: 4402715 - DNA, 18 bp, Homo sapiens
ccccaccctccctggagt

SEQ ID NO: 4402716 - DNA, 12 bp, Homo sapiens
ccccacctgaag

SEQ ID NO: 4402717 - DNA, 14 bp, Homo sapiens
ccccacctgaaggg

SEQ ID NO: 4402718 - DNA, 16 bp, Homo sapiens
ccccacgagggctggc

SEQ ID NO: 4402719 - DNA, 18 bp, Homo sapiens
ccccacgagggctggctg

SEQ ID NO: 4402720 - DNA, 19 bp, Homo sapiens
ccccacggagacagaggaa

SEQ ID NO: 4402721 - DNA, 15 bp, Homo sapiens
ccccactctcattcc

SEQ ID NO: 4402722 - DNA, 15 bp, Homo sapiens
ccccactctccccac

SEQ ID NO: 4402723 - DNA, 12 bp, Homo sapiens
ccccactgcagg

SEQ ID NO: 4402724 - DNA, 16 bp, Homo sapiens
ccccactgcaggcccc

SEQ ID NO: 4402725 - DNA, 22 bp, Homo sapiens
ccccactttcaagacagatgag

SEQ ID NO: 4402726 - DNA, 14 bp, Homo sapiens
ccccagaaagcctc

SEQ ID NO: 4402727 - DNA, 21 bp, Homo sapiens
ccccagacccagaggtccagg

SEQ ID NO: 4402728 - DNA, 14 bp, Homo sapiens
ccccagaccccgcc

SEQ ID NO: 4402729 - DNA, 18 bp, Homo sapiens
ccccagactagatgtagt

SEQ ID NO: 4402730 - DNA, 15 bp, Homo sapiens
ccccagagcatctgc

SEQ ID NO: 4402731 - DNA, 19 bp, Homo sapiens
ccccagagcatctgcccca

SEQ ID NO: 4402732 - DNA, 20 bp, Homo sapiens
ccccagagcatctgccccag

SEQ ID NO: 4402733 - DNA, 14 bp, Homo sapiens
ccccagagctcccc

SEQ ID NO: 4402734 - DNA, 11 bp, Homo sapiens
ccccagagctg

SEQ ID NO: 4402735 - DNA, 12 bp, Homo sapiens
ccccagagctgt

SEQ ID NO: 4402736 - DNA, 22 bp, Homo sapiens
ccccagagctgtttatggcctc

SEQ ID NO: 4402737 - DNA, 17 bp, Homo sapiens
ccccagaggctcccaat

SEQ ID NO: 4402738 - DNA, 20 bp, Homo sapiens
ccccagaggctcccaatcag

SEQ ID NO: 4402739 - DNA, 22 bp, Homo sapiens
ccccagcaagcgggagcccgtg

SEQ ID NO: 4402740 - DNA, 16 bp, Homo sapiens
ccccagcactgaggaa

SEQ ID NO: 4402741 - DNA, 11 bp, Homo sapiens
ccccagcactt

SEQ ID NO: 4402742 - DNA, 14 bp, Homo sapiens
ccccagcattccag

SEQ ID NO: 4402743 - DNA, 23 bp, Homo sapiens
ccccagccagatggactccagcc

SEQ ID NO: 4402744 - DNA, 16 bp, Homo sapiens
ccccagccagcccttc

SEQ ID NO: 4402745 - DNA, 17 bp, Homo sapiens
ccccagccatccagggg

SEQ ID NO: 4402746 - DNA, 13 bp, Homo sapiens
ccccagcccacag

SEQ ID NO: 4402747 - DNA, 23 bp, Homo sapiens
ccccagccccctttgggcccagg

SEQ ID NO: 4402748 - DNA, 14 bp, Homo sapiens
ccccagcccctcct

SEQ ID NO: 4402749 - DNA, 15 bp, Homo sapiens
ccccagcccctcctc

SEQ ID NO: 4402750 - DNA, 16 bp, Homo sapiens
ccccagcccctcctcc

SEQ ID NO: 4402751 - DNA, 21 bp, Homo sapiens
ccccagcccctcctccctcag

SEQ ID NO: 4402752 - DNA, 20 bp, Homo sapiens
ccccagcctcattccccatt

SEQ ID NO: 4402753 - DNA, 14 bp, Homo sapiens
ccccagcctgggcc

SEQ ID NO: 4402754 - DNA, 11 bp, Homo sapiens
ccccagctccc

SEQ ID NO: 4402755 - DNA, 19 bp, Homo sapiens
ccccaggaagtggctcaga

SEQ ID NO: 4402756 - DNA, 12 bp, Homo sapiens
ccccaggacgcc

SEQ ID NO: 4402757 - DNA, 15 bp, Homo sapiens
ccccaggccagctgc

SEQ ID NO: 4402758 - DNA, 18 bp, Homo sapiens
ccccaggccccagacagg

SEQ ID NO: 4402759 - DNA, 15 bp, Homo sapiens
ccccaggccctccct

SEQ ID NO: 4402760 - DNA, 21 bp, Homo sapiens
ccccaggcctgtccaccctgc

SEQ ID NO: 4402761 - DNA, 15 bp, Homo sapiens
ccccaggctcgtgga

SEQ ID NO: 4402762 - DNA, 20 bp, Homo sapiens
ccccaggggagaaagaggag

SEQ ID NO: 4402763 - DNA, 23 bp, Homo sapiens
ccccagggggcggggtgcagaag

SEQ ID NO: 4402764 - DNA, 19 bp, Homo sapiens
ccccagggtcttccctacc

SEQ ID NO: 4402765 - DNA, 16 bp, Homo sapiens
ccccaggtacacctcc

SEQ ID NO: 4402766 - DNA, 23 bp, Homo sapiens
ccccagtcagcctctctcccagt

SEQ ID NO: 4402767 - DNA, 14 bp, Homo sapiens
ccccagtctcacct

SEQ ID NO: 4402768 - DNA, 15 bp, Homo sapiens
ccccagtgcctgcca

SEQ ID NO: 4402769 - DNA, 24 bp, Homo sapiens
ccccagtgcctgccactctctggg

SEQ ID NO: 4402770 - DNA, 17 bp, Homo sapiens
ccccagttccacagcag

SEQ ID NO: 4402771 - DNA, 23 bp, Homo sapiens
ccccagtttgcagaaaagcacct

SEQ ID NO: 4402772 - DNA, 17 bp, Homo sapiens
ccccatatataaattat

SEQ ID NO: 4402773 - DNA, 18 bp, Homo sapiens
ccccatcacccaagccac

SEQ ID NO: 4402774 - DNA, 16 bp, Homo sapiens
ccccatcagccctgct

SEQ ID NO: 4402775 - DNA, 14 bp, Homo sapiens
ccccatcagtgctc

SEQ ID NO: 4402776 - DNA, 19 bp, Homo sapiens
ccccatccagacctggctc

SEQ ID NO: 4402777 - DNA, 14 bp, Homo sapiens
ccccatccctgctt

SEQ ID NO: 4402778 - DNA, 16 bp, Homo sapiens
ccccatcctcatccct

SEQ ID NO: 4402779 - DNA, 18 bp, Homo sapiens
ccccatcctcatccctga

SEQ ID NO: 4402780 - DNA, 19 bp, Homo sapiens
ccccatctccctgcctggc

SEQ ID NO: 4402781 - DNA, 21 bp, Homo sapiens
ccccatctgtccagctggggc

SEQ ID NO: 4402782 - DNA, 22 bp, Homo sapiens
ccccatgccaaagctagggtgg

SEQ ID NO: 4402783 - DNA, 12 bp, Homo sapiens
ccccatgcctgt

SEQ ID NO: 4402784 - DNA, 15 bp, Homo sapiens
ccccatgcctgtcca

SEQ ID NO: 4402785 - DNA, 18 bp, Homo sapiens
ccccatgcctgtccagcc

SEQ ID NO: 4402786 - DNA, 24 bp, Homo sapiens
ccccatgcctgtccagcctgggca

SEQ ID NO: 4402787 - DNA, 18 bp, Homo sapiens
ccccatggccccaggccc

SEQ ID NO: 4402788 - DNA, 12 bp, Homo sapiens
ccccatgggctg

SEQ ID NO: 4402789 - DNA, 12 bp, Homo sapiens
ccccattccctc

SEQ ID NO: 4402790 - DNA, 20 bp, Homo sapiens
ccccattccttgcgcctcag

SEQ ID NO: 4402791 - DNA, 20 bp, Homo sapiens
ccccattctgtgtcccatgt

SEQ ID NO: 4402792 - DNA, 16 bp, Homo sapiens
ccccatttcccatctg

SEQ ID NO: 4402793 - DNA, 13 bp, Homo sapiens
ccccatttcctca

SEQ ID NO: 4402794 - DNA, 19 bp, Homo sapiens
ccccatttctgcctcgctc

SEQ ID NO: 4402795 - DNA, 14 bp, Homo sapiens
ccccatttgtccca

SEQ ID NO: 4402796 - DNA, 21 bp, Homo sapiens
cccccaaacatctggcatggc

SEQ ID NO: 4402797 - DNA, 23 bp, Homo sapiens
cccccaacccctcctccctcaga

SEQ ID NO: 4402798 - DNA, 15 bp, Homo sapiens
cccccaacctttccc

SEQ ID NO: 4402799 - DNA, 16 bp, Homo sapiens
cccccaactccaggaa

SEQ ID NO: 4402800 - DNA, 21 bp, Homo sapiens
cccccaacttcaccaccccct

SEQ ID NO: 4402801 - DNA, 21 bp, Homo sapiens
cccccaataaaccagtgtgaa

SEQ ID NO: 4402802 - DNA, 13 bp, Homo sapiens
cccccaataaagg

SEQ ID NO: 4402803 - DNA, 22 bp, Homo sapiens
cccccaataaaggcagctgcct

SEQ ID NO: 4402804 - DNA, 14 bp, Homo sapiens
ttcattaaataaat

SEQ ID NO: 4402805 - DNA, 16 bp, Homo sapiens
ttcattaacaaaatgt

SEQ ID NO: 4402806 - DNA, 12 bp, Homo sapiens
ttcattacttga

SEQ ID NO: 4402807 - DNA, 15 bp, Homo sapiens
ttcattacttgaatg

SEQ ID NO: 4402808 - DNA, 16 bp, Homo sapiens
ttcattatgctttgaa

SEQ ID NO: 4402809 - DNA, 17 bp, Homo sapiens
ttcattcacttctctta

SEQ ID NO: 4402810 - DNA, 22 bp, Homo sapiens
ttcattcctcacaatgaggcta

SEQ ID NO: 4402811 - DNA, 19 bp, Homo sapiens
ttcattcggtgtgaacttt

SEQ ID NO: 4402812 - DNA, 18 bp, Homo sapiens
ttcattctcataattcct

SEQ ID NO: 4402813 - DNA, 18 bp, Homo sapiens
ttcattctccctttcact

SEQ ID NO: 4402814 - DNA, 21 bp, Homo sapiens
ttcattctcgtgagtcattta

SEQ ID NO: 4402815 - DNA, 13 bp, Homo sapiens
ttcattcttgtat

SEQ ID NO: 4402816 - DNA, 14 bp, Homo sapiens
ttcattgctaagac

SEQ ID NO: 4402817 - DNA, 18 bp, Homo sapiens
ttcatttcagggtcttgg

SEQ ID NO: 4402818 - DNA, 11 bp, Homo sapiens
ttcatttcatt

SEQ ID NO: 4402819 - DNA, 12 bp, Homo sapiens
ttcatttccagc

SEQ ID NO: 4402820 - DNA, 13 bp, Homo sapiens
ttcatttctagac

SEQ ID NO: 4402821 - DNA, 15 bp, Homo sapiens
ttcatttctagactc

SEQ ID NO: 4402822 - DNA, 11 bp, Homo sapiens
ttcatttctta

SEQ ID NO: 4402823 - DNA, 18 bp, Homo sapiens
ttcatttgtaaaaatgag

SEQ ID NO: 4402824 - DNA, 18 bp, Homo sapiens
ttcattttaactggcatg

SEQ ID NO: 4402825 - DNA, 18 bp, Homo sapiens
ttcattttactgtatatt

SEQ ID NO: 4402826 - DNA, 12 bp, Homo sapiens
ttcattttagat

SEQ ID NO: 4402827 - DNA, 20 bp, Homo sapiens
ttcattttctagatacaata

SEQ ID NO: 4402828 - DNA, 21 bp, Homo sapiens
ttcattttctagatacaataa

SEQ ID NO: 4402829 - DNA, 18 bp, Homo sapiens
ttcattttgttttgctct

SEQ ID NO: 4402830 - DNA, 17 bp, Homo sapiens
ttcattttttaatgtgc

SEQ ID NO: 4402831 - DNA, 14 bp, Homo sapiens
ttcatttttttcca

SEQ ID NO: 4402832 - DNA, 20 bp, Homo sapiens
ttccaaaataatctatatta

SEQ ID NO: 4402833 - DNA, 23 bp, Homo sapiens
ttccaaaataatctatattaaat

SEQ ID NO: 4402834 - DNA, 18 bp, Homo sapiens
ttccaaaatctcccattt

SEQ ID NO: 4402835 - DNA, 19 bp, Homo sapiens
ttccaaagaatattttgat

SEQ ID NO: 4402836 - DNA, 12 bp, Homo sapiens
ttccaaagcaaa

SEQ ID NO: 4402837 - DNA, 17 bp, Homo sapiens
ttccaaataaaatgttc

SEQ ID NO: 4402838 - DNA, 20 bp, Homo sapiens
ttccaaataaaatgttccct

SEQ ID NO: 4402839 - DNA, 13 bp, Homo sapiens
ttccaaattattt

SEQ ID NO: 4402840 - DNA, 16 bp, Homo sapiens
ttccaaattatttctt

SEQ ID NO: 4402841 - DNA, 20 bp, Homo sapiens
ttccaaattcagtttcataa

SEQ ID NO: 4402842 - DNA, 14 bp, Homo sapiens
ttccaagaacctat

SEQ ID NO: 4402843 - DNA, 14 bp, Homo sapiens
ttccaagaggctgt

SEQ ID NO: 4402844 - DNA, 15 bp, Homo sapiens
ttccaagaggctgta

SEQ ID NO: 4402845 - DNA, 23 bp, Homo sapiens
ttccaagcttccatagctgctgc

SEQ ID NO: 4402846 - DNA, 17 bp, Homo sapiens
ttccaagtcatttttgt

SEQ ID NO: 4402847 - DNA, 18 bp, Homo sapiens
ttccaatagaaagaaact

SEQ ID NO: 4402848 - DNA, 24 bp, Homo sapiens
ttccaatatttctgctttctttga

SEQ ID NO: 4402849 - DNA, 12 bp, Homo sapiens
ttccacaaaatt

SEQ ID NO: 4402850 - DNA, 22 bp, Homo sapiens
ttccacaccttttattgacaca

SEQ ID NO: 4402851 - DNA, 13 bp, Homo sapiens
ttccacagcagtg

SEQ ID NO: 4402852 - DNA, 23 bp, Homo sapiens
ttccacagtggcgggcccactca

SEQ ID NO: 4402853 - DNA, 16 bp, Homo sapiens
ttccaccttaaattaa

SEQ ID NO: 4402854 - DNA, 17 bp, Homo sapiens
ttccaccttaaattaaa

SEQ ID NO: 4402855 - DNA, 18 bp, Homo sapiens
ttccaccttaaattaaac

SEQ ID NO: 4402856 - DNA, 17 bp, Homo sapiens
ttccactacacctggct

SEQ ID NO: 4402857 - DNA, 19 bp, Homo sapiens
ttccactacacctggctga

SEQ ID NO: 4402858 - DNA, 22 bp, Homo sapiens
ttccactacacctggctgaggt

SEQ ID NO: 4402859 - DNA, 14 bp, Homo sapiens
ttccactgaaaatt

SEQ ID NO: 4402860 - DNA, 18 bp, Homo sapiens
ttccactgaaaatttaac

SEQ ID NO: 4402861 - DNA, 13 bp, Homo sapiens
ttccactgtgcta

SEQ ID NO: 4402862 - DNA, 15 bp, Homo sapiens
ttccagaacagccct

SEQ ID NO: 4402863 - DNA, 19 bp, Homo sapiens
ttccagaacagccctcggc

SEQ ID NO: 4402864 - DNA, 22 bp, Homo sapiens
ttccagacattctcgcttccct

SEQ ID NO: 4402865 - DNA, 19 bp, Homo sapiens
ttccagactcaggttccag

SEQ ID NO: 4402866 - DNA, 14 bp, Homo sapiens
ttccagacttcaaa

SEQ ID NO: 4402867 - DNA, 16 bp, Homo sapiens
ttccagagcagagcct

SEQ ID NO: 4402868 - DNA, 19 bp, Homo sapiens
ttccagagttgttgtttgc

SEQ ID NO: 4402869 - DNA, 20 bp, Homo sapiens
ttccagagttgttgtttgcc

SEQ ID NO: 4402870 - DNA, 22 bp, Homo sapiens
ttccagatcccaggcccctgga

SEQ ID NO: 4402871 - DNA, 15 bp, Homo sapiens
ttccagatcctctct

SEQ ID NO: 4402872 - DNA, 22 bp, Homo sapiens
ttccagcaattctcctgcctca

SEQ ID NO: 4402873 - DNA, 24 bp, Homo sapiens
ttccagcatgaggtatctaaggat

SEQ ID NO: 4402874 - DNA, 15 bp, Homo sapiens
ttccagcatttttat

SEQ ID NO: 4402875 - DNA, 17 bp, Homo sapiens
ttccagccaaagcatgc

SEQ ID NO: 4402876 - DNA, 20 bp, Homo sapiens
ttccagccacattgagactt

SEQ ID NO: 4402877 - DNA, 21 bp, Homo sapiens
ttccagccacattgagacttt

SEQ ID NO: 4402878 - DNA, 16 bp, Homo sapiens
ttccagccttatgtgt

SEQ ID NO: 4402879 - DNA, 23 bp, Homo sapiens
ttccagctcaccccccacactca

SEQ ID NO: 4402880 - DNA, 13 bp, Homo sapiens
ttccagctctgcc

SEQ ID NO: 4402881 - DNA, 14 bp, Homo sapiens
ttccagctctgccc

SEQ ID NO: 4402882 - DNA, 16 bp, Homo sapiens
ttccagctctgccccc

SEQ ID NO: 4402883 - DNA, 23 bp, Homo sapiens
ttccaggaaactccacatctgcc

SEQ ID NO: 4402884 - DNA, 23 bp, Homo sapiens
ttccaggcttccctgacttgctt

SEQ ID NO: 4402885 - DNA, 17 bp, Homo sapiens
ttccaggggaacctgcc

SEQ ID NO: 4402886 - DNA, 21 bp, Homo sapiens
ttccaggtacccttctcgctt

SEQ ID NO: 4402887 - DNA, 18 bp, Homo sapiens
ttccaggtattaaaggtt

SEQ ID NO: 4402888 - DNA, 16 bp, Homo sapiens
ttccaggtctgcctgg

SEQ ID NO: 4402889 - DNA, 21 bp, Homo sapiens
ttccagtcctaactttctgaa

SEQ ID NO: 4402890 - DNA, 20 bp, Homo sapiens
ttccagtcttcctgacactt

SEQ ID NO: 4402891 - DNA, 19 bp, Homo sapiens
ttccagtgacttgcaatcc

SEQ ID NO: 4402892 - DNA, 22 bp, Homo sapiens
ttccagttttgtggattaaacc

SEQ ID NO: 4402893 - DNA, 16 bp, Homo sapiens
ttccatagctgctgcc

SEQ ID NO: 4402894 - DNA, 17 bp, Homo sapiens
ttccatagctgctgccc

SEQ ID NO: 4402895 - DNA, 18 bp, Homo sapiens
ttccatcatcactgtaaa

SEQ ID NO: 4402896 - DNA, 20 bp, Homo sapiens
ttccatcatcactgtaaaga

SEQ ID NO: 4402897 - DNA, 18 bp, Homo sapiens
ttccatcatgtctgtata

SEQ ID NO: 4402898 - DNA, 19 bp, Homo sapiens
ttccatctcccttggttgt

SEQ ID NO: 4402899 - DNA, 18 bp, Homo sapiens
ttccatctttacaaaact

SEQ ID NO: 4402900 - DNA, 17 bp, Homo sapiens
ttccatgattctattta

SEQ ID NO: 4402901 - DNA, 13 bp, Homo sapiens
ttccatgtgcctt

SEQ ID NO: 4402902 - DNA, 19 bp, Homo sapiens
ttccatgtgcctttctttg

SEQ ID NO: 4402903 - DNA, 23 bp, Homo sapiens
ttccatgtgcctttctttgcctc

SEQ ID NO: 4402904 - DNA, 15 bp, Homo sapiens
ttccatttggcacta

SEQ ID NO: 4402905 - DNA, 14 bp, Homo sapiens
ttccattttaagtg

SEQ ID NO: 4402906 - DNA, 23 bp, Homo sapiens
ttccatttttttctttacttatc

SEQ ID NO: 4402907 - DNA, 19 bp, Homo sapiens
ttcccaaaacaatctattt

SEQ ID NO: 4402908 - DNA, 18 bp, Homo sapiens
ttcccaaagtgaactctc

SEQ ID NO: 4402909 - DNA, 16 bp, Homo sapiens
ttcccaacatttctta

SEQ ID NO: 4402910 - DNA, 16 bp, Homo sapiens
ttcccaacctgctcat

SEQ ID NO: 4402911 - DNA, 20 bp, Homo sapiens
ttcccaacttctcttgcttt

SEQ ID NO: 4402912 - DNA, 18 bp, Homo sapiens
ttcccaatctgaaattca

SEQ ID NO: 4402913 - DNA, 15 bp, Homo sapiens
ttcccacatgcctgc

SEQ ID NO: 4402914 - DNA, 18 bp, Homo sapiens
ttcccacctctctcccca

SEQ ID NO: 4402915 - DNA, 20 bp, Homo sapiens
ttcccactgcactccagcct

SEQ ID NO: 4402916 - DNA, 20 bp, Homo sapiens
ttcccacttaaaaattaaat

SEQ ID NO: 4402917 - DNA, 22 bp, Homo sapiens
ttcccagagacaggaaaatcct

SEQ ID NO: 4402918 - DNA, 23 bp, Homo sapiens
ttcccagcccctcctccctcagg

SEQ ID NO: 4402919 - DNA, 21 bp, Homo sapiens
ttcccagcccctgcagattct

SEQ ID NO: 4402920 - DNA, 14 bp, Homo sapiens
ttcccagctctccc

SEQ ID NO: 4402921 - DNA, 20 bp, Homo sapiens
ttcccagctctccctctggc

SEQ ID NO: 4402922 - DNA, 15 bp, Homo sapiens
ttctctccccagccc

SEQ ID NO: 4402923 - DNA, 17 bp, Homo sapiens
ttctctccccagccccc

SEQ ID NO: 4402924 - DNA, 22 bp, Homo sapiens
ttctctcctgtcctccctcacc

SEQ ID NO: 4402925 - DNA, 14 bp, Homo sapiens
ttctctccttgccc

SEQ ID NO: 4402926 - DNA, 19 bp, Homo sapiens
ttctctctcctctctgctt

SEQ ID NO: 4402927 - DNA, 17 bp, Homo sapiens
ttctctctgttacacac

SEQ ID NO: 4402928 - DNA, 13 bp, Homo sapiens
ttctctcttttaa

SEQ ID NO: 4402929 - DNA, 17 bp, Homo sapiens
ttctctcttttaaagta

SEQ ID NO: 4402930 - DNA, 18 bp, Homo sapiens
ttctctgagctgtgcagg

SEQ ID NO: 4402931 - DNA, 23 bp, Homo sapiens
ttctctgatttgtaatgagcacc

SEQ ID NO: 4402932 - DNA, 19 bp, Homo sapiens
ttctctgcaattttactgt

SEQ ID NO: 4402933 - DNA, 11 bp, Homo sapiens
ttctctgcagt

SEQ ID NO: 4402934 - DNA, 12 bp, Homo sapiens
ttctctgcagta

SEQ ID NO: 4402935 - DNA, 16 bp, Homo sapiens
ttctctgcccagccgg

SEQ ID NO: 4402936 - DNA, 17 bp, Homo sapiens
ttctctggcaaactttt

SEQ ID NO: 4402937 - DNA, 18 bp, Homo sapiens
ttctctgtacttttcatt

SEQ ID NO: 4402938 - DNA, 12 bp, Homo sapiens
ttctctgtctca

SEQ ID NO: 4402939 - DNA, 13 bp, Homo sapiens
ttctctgtctcat

SEQ ID NO: 4402940 - DNA, 22 bp, Homo sapiens
ttctctgtgaaagctttggaaa

SEQ ID NO: 4402941 - DNA, 20 bp, Homo sapiens
ttctctgttgtcgtaaagat

SEQ ID NO: 4402942 - DNA, 22 bp, Homo sapiens
ttctctgttgtcgtaaagattt

SEQ ID NO: 4402943 - DNA, 23 bp, Homo sapiens
ttctctgttgtcgtaaagatttg

SEQ ID NO: 4402944 - DNA, 17 bp, Homo sapiens
ttctcttgacagtctga

SEQ ID NO: 4402945 - DNA, 20 bp, Homo sapiens
ttctcttgacagtctgaagc

SEQ ID NO: 4402946 - DNA, 15 bp, Homo sapiens
ttctcttgtaccata

SEQ ID NO: 4402947 - DNA, 20 bp, Homo sapiens
ttctctttaattttaactga

SEQ ID NO: 4402948 - DNA, 17 bp, Homo sapiens
ttctcttttctttctgt

SEQ ID NO: 4402949 - DNA, 14 bp, Homo sapiens
ttctgaaatacttt

SEQ ID NO: 4402950 - DNA, 16 bp, Homo sapiens
ttctgaaatacttttg

SEQ ID NO: 4402951 - DNA, 13 bp, Homo sapiens
ttctgaactaaag

SEQ ID NO: 4402952 - DNA, 18 bp, Homo sapiens
ttctgaagaaaaattact

SEQ ID NO: 4402953 - DNA, 17 bp, Homo sapiens
ttctgaagtgcttgtat

SEQ ID NO: 4402954 - DNA, 18 bp, Homo sapiens
ttctgaagtgcttgtata

SEQ ID NO: 4402955 - DNA, 12 bp, Homo sapiens
ttctgaagtttt

SEQ ID NO: 4402956 - DNA, 20 bp, Homo sapiens
ttctgaagttttattttaaa

SEQ ID NO: 4402957 - DNA, 21 bp, Homo sapiens
ttctgaagttttattttaaat

SEQ ID NO: 4402958 - DNA, 22 bp, Homo sapiens
ttctgaatcaccaattaaaaac

SEQ ID NO: 4402959 - DNA, 23 bp, Homo sapiens
ttctgaattggctaaaagacatg

SEQ ID NO: 4402960 - DNA, 14 bp, Homo sapiens
ttctgaatttgcaa

SEQ ID NO: 4402961 - DNA, 17 bp, Homo sapiens
ttctgaatttgcaaagt

SEQ ID NO: 4402962 - DNA, 21 bp, Homo sapiens
ttctgaatttgcaaagtactg

SEQ ID NO: 4402963 - DNA, 13 bp, Homo sapiens
ttctgacaattaa

SEQ ID NO: 4402964 - DNA, 15 bp, Homo sapiens
ttctgacaattaaca

SEQ ID NO: 4402965 - DNA, 19 bp, Homo sapiens
ttctgacatcaaaacttgg

SEQ ID NO: 4402966 - DNA, 23 bp, Homo sapiens
ttctgacatgtaagaaaatgtta

SEQ ID NO: 4402967 - DNA, 13 bp, Homo sapiens
ttctgactgcccc

SEQ ID NO: 4402968 - DNA, 15 bp, Homo sapiens
ttctgactgtccagg

SEQ ID NO: 4402969 - DNA, 13 bp, Homo sapiens
ttctgacttttac

SEQ ID NO: 4402970 - DNA, 16 bp, Homo sapiens
ttctgagaaagactat

SEQ ID NO: 4402971 - DNA, 21 bp, Homo sapiens
ttctgagattcaatattgaat

SEQ ID NO: 4402972 - DNA, 15 bp, Homo sapiens
ttctgagcaaaggcc

SEQ ID NO: 4402973 - DNA, 18 bp, Homo sapiens
ttctgagcaaaggccctg

SEQ ID NO: 4402974 - DNA, 14 bp, Homo sapiens
ttctgagttttgtg

SEQ ID NO: 4402975 - DNA, 22 bp, Homo sapiens
ttctgagttttgtgtttgttgt

SEQ ID NO: 4402976 - DNA, 14 bp, Homo sapiens
ttctgatactttag

SEQ ID NO: 4402977 - DNA, 17 bp, Homo sapiens
ttctgatatgtgaattt

SEQ ID NO: 4402978 - DNA, 16 bp, Homo sapiens
ttctgatctgtacttt

SEQ ID NO: 4402979 - DNA, 14 bp, Homo sapiens
ttctgatgaaatgt

SEQ ID NO: 4402980 - DNA, 11 bp, Homo sapiens
ttctgatttct

SEQ ID NO: 4402981 - DNA, 13 bp, Homo sapiens
ttctgatttctga

SEQ ID NO: 4402982 - DNA, 17 bp, Homo sapiens
ttctgcaaatagaaaac

SEQ ID NO: 4402983 - DNA, 19 bp, Homo sapiens
ttctgcaaatagaaaacag

SEQ ID NO: 4402984 - DNA, 23 bp, Homo sapiens
ttctgcaaatagaaaacaggaaa

SEQ ID NO: 4402985 - DNA, 18 bp, Homo sapiens
ttctgcaccacacctggc

SEQ ID NO: 4402986 - DNA, 20 bp, Homo sapiens
ttctgcagatcttccgtggt

SEQ ID NO: 4402987 - DNA, 14 bp, Homo sapiens
ttctgcagcaactc

SEQ ID NO: 4402988 - DNA, 15 bp, Homo sapiens
ttctgcagtaaatct

SEQ ID NO: 4402989 - DNA, 18 bp, Homo sapiens
ttctgcagtaaatctttt

SEQ ID NO: 4402990 - DNA, 21 bp, Homo sapiens
ttctgcatatgttgaatactt

SEQ ID NO: 4402991 - DNA, 22 bp, Homo sapiens
ttctgcatatgttgaatacttt

SEQ ID NO: 4402992 - DNA, 17 bp, Homo sapiens
ttctgccacccctaaac

SEQ ID NO: 4402993 - DNA, 13 bp, Homo sapiens
ttctgccctggct

SEQ ID NO: 4402994 - DNA, 14 bp, Homo sapiens
ttctgccctggctg

SEQ ID NO: 4402995 - DNA, 14 bp, Homo sapiens
ttctgcctcctggc

SEQ ID NO: 4402996 - DNA, 13 bp, Homo sapiens
ttctgcctccttt

SEQ ID NO: 4402997 - DNA, 17 bp, Homo sapiens
ttctgcctcctttagta

SEQ ID NO: 4402998 - DNA, 13 bp, Homo sapiens
ttctgcctctaag

SEQ ID NO: 4402999 - DNA, 12 bp, Homo sapiens
ttctgcctctcc

SEQ ID NO: 4403000 - DNA, 21 bp, Homo sapiens
ttctgcctgttataactctgc

SEQ ID NO: 4403001 - DNA, 24 bp, Homo sapiens
ttctgcctgttataactctgcact

SEQ ID NO: 4403002 - DNA, 18 bp, Homo sapiens
ttctgccttggattccta

SEQ ID NO: 4403003 - DNA, 15 bp, Homo sapiens
ttctgctaaatatca

SEQ ID NO: 4403004 - DNA, 21 bp, Homo sapiens
ttctgctactttgctgctatg

SEQ ID NO: 4403005 - DNA, 14 bp, Homo sapiens
ttctgctatgtgtg

SEQ ID NO: 4403006 - DNA, 9 bp, Homo sapiens
ttctgctcc

SEQ ID NO: 4403007 - DNA, 15 bp, Homo sapiens
ttctgctccaccctt

SEQ ID NO: 4403008 - DNA, 16 bp, Homo sapiens
ttctgctccacccttg

SEQ ID NO: 4403009 - DNA, 18 bp, Homo sapiens
ttctgctccacccttggc

SEQ ID NO: 4403010 - DNA, 22 bp, Homo sapiens
ttctgctctggttgtttctgtt

SEQ ID NO: 4403011 - DNA, 16 bp, Homo sapiens
ttctgctcttttcctg

SEQ ID NO: 4403012 - DNA, 17 bp, Homo sapiens
ttctgctcttttcctgg

SEQ ID NO: 4403013 - DNA, 17 bp, Homo sapiens
ttctgctggcatcaaga

SEQ ID NO: 4403014 - DNA, 17 bp, Homo sapiens
ttctgctgtctgggact

SEQ ID NO: 4403015 - DNA, 16 bp, Homo sapiens
ttctgcttttaagttt

SEQ ID NO: 4403016 - DNA, 19 bp, Homo sapiens
ttctggaagactgctcccg

SEQ ID NO: 4403017 - DNA, 18 bp, Homo sapiens
ttctggactctgccccaa

SEQ ID NO: 4403018 - DNA, 14 bp, Homo sapiens
ttctggagctggga

SEQ ID NO: 4403019 - DNA, 20 bp, Homo sapiens
ttctggagctgggagacaaa

SEQ ID NO: 4403020 - DNA, 17 bp, Homo sapiens
ttctggccagtgtttaa

SEQ ID NO: 4403021 - DNA, 19 bp, Homo sapiens
ttctggcgcccctgcctgt

SEQ ID NO: 4403022 - DNA, 22 bp, Homo sapiens
ttctggcgcccctgcctgtgcc

SEQ ID NO: 4403023 - DNA, 17 bp, Homo sapiens
ttctggctacctgtttg

SEQ ID NO: 4403024 - DNA, 19 bp, Homo sapiens
ttctggctgtgatcttaaa

SEQ ID NO: 4403025 - DNA, 15 bp, Homo sapiens
ttctggctgtttgag

SEQ ID NO: 4403026 - DNA, 14 bp, Homo sapiens
ttctgggaagggag

SEQ ID NO: 4403027 - DNA, 21 bp, Homo sapiens
ttctgggaagggagagttctt

SEQ ID NO: 4403028 - DNA, 23 bp, Homo sapiens
ttctgggatatatggaggattct

SEQ ID NO: 4403029 - DNA, 14 bp, Homo sapiens
ttctgggctggggc

SEQ ID NO: 4403030 - DNA, 16 bp, Homo sapiens
ttctggggctgtgtta

SEQ ID NO: 4403031 - DNA, 20 bp, Homo sapiens
ttctggtgctactccatgca

SEQ ID NO: 4403032 - DNA, 19 bp, Homo sapiens
ttctggtgttgactggact

SEQ ID NO: 4403033 - DNA, 14 bp, Homo sapiens
ttctggttctaact

SEQ ID NO: 4403034 - DNA, 21 bp, Homo sapiens
ttctggttctaactgctgtta

SEQ ID NO: 4403035 - DNA, 20 bp, Homo sapiens
ttctgtaatatttacaatgt

SEQ ID NO: 4403036 - DNA, 21 bp, Homo sapiens
ttctgtaatatttacaatgta

SEQ ID NO: 4403037 - DNA, 16 bp, Homo sapiens
ttctgtaatgtaaata

SEQ ID NO: 4403038 - DNA, 14 bp, Homo sapiens
ttctgtaatttgaa

SEQ ID NO: 4403039 - DNA, 19 bp, Homo sapiens
ttctgtacatttgcaatta

SEQ ID NO: 4403040 - DNA, 11 bp, Homo sapiens
ttctgtaccag

SEQ ID NO: 4403041 - DNA, 15 bp, Homo sapiens
aagtcaaaatatgta

SEQ ID NO: 4403042 - DNA, 22 bp, Homo sapiens
cactgtaaatatccctcccctc

SEQ ID NO: 4403043 - DNA, 17 bp, Homo sapiens
cactgtatataaacata

SEQ ID NO: 4403044 - DNA, 14 bp, Homo sapiens
cactgtatccaggt

SEQ ID NO: 4403045 - DNA, 21 bp, Homo sapiens
cactgtccaatatgaaaaccg

SEQ ID NO: 4403046 - DNA, 17 bp, Homo sapiens
cactgtctagagcaact

SEQ ID NO: 4403047 - DNA, 13 bp, Homo sapiens
cactgtgcaggtg

SEQ ID NO: 4403048 - DNA, 17 bp, Homo sapiens
cactgtgggaaggccag

SEQ ID NO: 4403049 - DNA, 18 bp, Homo sapiens
cactgtggtcgtcaactt

SEQ ID NO: 4403050 - DNA, 23 bp, Homo sapiens
cactgtggtcgtcaactttcctc

SEQ ID NO: 4403051 - DNA, 21 bp, Homo sapiens
cactgtgtactggagcctgca

SEQ ID NO: 4403052 - DNA, 15 bp, Homo sapiens
cactgttaaaataaa

SEQ ID NO: 4403053 - DNA, 17 bp, Homo sapiens
cactgttaaaataaagc

SEQ ID NO: 4403054 - DNA, 15 bp, Homo sapiens
cactgttagaacact

SEQ ID NO: 4403055 - DNA, 16 bp, Homo sapiens
cactgttagaacacta

SEQ ID NO: 4403056 - DNA, 21 bp, Homo sapiens
cactgttagaacactattttc

SEQ ID NO: 4403057 - DNA, 16 bp, Homo sapiens
cactgttctgttctca

SEQ ID NO: 4403058 - DNA, 21 bp, Homo sapiens
cactgtttaagtactgtttac

SEQ ID NO: 4403059 - DNA, 14 bp, Homo sapiens
cacttaaactttgt

SEQ ID NO: 4403060 - DNA, 17 bp, Homo sapiens
cacttaaactttgtcac

SEQ ID NO: 4403061 - DNA, 21 bp, Homo sapiens
cacttaaactttgtcacttct

SEQ ID NO: 4403062 - DNA, 21 bp, Homo sapiens
cacttaaagggtcttatgaaa

SEQ ID NO: 4403063 - DNA, 21 bp, Homo sapiens
cacttaagactgtgtattcta

SEQ ID NO: 4403064 - DNA, 13 bp, Homo sapiens
cacttaatagcaa

SEQ ID NO: 4403065 - DNA, 16 bp, Homo sapiens
cacttaatagcaacag

SEQ ID NO: 4403066 - DNA, 14 bp, Homo sapiens
cacttaatcatttt

SEQ ID NO: 4403067 - DNA, 14 bp, Homo sapiens
cacttaatgtatgt

SEQ ID NO: 4403068 - DNA, 17 bp, Homo sapiens
cacttacaagaaaggcc

SEQ ID NO: 4403069 - DNA, 15 bp, Homo sapiens
cacttacgtaaaaca

SEQ ID NO: 4403070 - DNA, 17 bp, Homo sapiens
cacttacgtaaaacatt

SEQ ID NO: 4403071 - DNA, 18 bp, Homo sapiens
cacttacgtaaaacattt

SEQ ID NO: 4403072 - DNA, 16 bp, Homo sapiens
cacttagacctgccag

SEQ ID NO: 4403073 - DNA, 18 bp, Homo sapiens
cacttagacctgccagcc

SEQ ID NO: 4403074 - DNA, 14 bp, Homo sapiens
cacttagatttaaa

SEQ ID NO: 4403075 - DNA, 16 bp, Homo sapiens
cacttagcccaagagg

SEQ ID NO: 4403076 - DNA, 23 bp, Homo sapiens
cacttagcccaagaggtctgagc

SEQ ID NO: 4403077 - DNA, 16 bp, Homo sapiens
cacttatctgatactt

SEQ ID NO: 4403078 - DNA, 14 bp, Homo sapiens
cacttatcttctgg

SEQ ID NO: 4403079 - DNA, 22 bp, Homo sapiens
cacttcaatgtgtcatttccgg

SEQ ID NO: 4403080 - DNA, 13 bp, Homo sapiens
cacttcaccccca

SEQ ID NO: 4403081 - DNA, 14 bp, Homo sapiens
cacttcacccccaa

SEQ ID NO: 4403082 - DNA, 15 bp, Homo sapiens
cacttcacccccaac

SEQ ID NO: 4403083 - DNA, 18 bp, Homo sapiens
cacttcacccccaacttc

SEQ ID NO: 4403084 - DNA, 14 bp, Homo sapiens
cacttcataatcca

SEQ ID NO: 4403085 - DNA, 14 bp, Homo sapiens
cacttccaggggaa

SEQ ID NO: 4403086 - DNA, 17 bp, Homo sapiens
cacttccaggggaacct

SEQ ID NO: 4403087 - DNA, 12 bp, Homo sapiens
cacttccaggtc

SEQ ID NO: 4403088 - DNA, 18 bp, Homo sapiens
cacttccaggtctgcctg

SEQ ID NO: 4403089 - DNA, 20 bp, Homo sapiens
cacttccaggtctgcctggt

SEQ ID NO: 4403090 - DNA, 16 bp, Homo sapiens
cacttccagtctggag

SEQ ID NO: 4403091 - DNA, 18 bp, Homo sapiens
cacttccagtctggagag

SEQ ID NO: 4403092 - DNA, 13 bp, Homo sapiens
cacttcgcacaca

SEQ ID NO: 4403093 - DNA, 11 bp, Homo sapiens
cacttctaaac

SEQ ID NO: 4403094 - DNA, 12 bp, Homo sapiens
cacttctaaatt

SEQ ID NO: 4403095 - DNA, 20 bp, Homo sapiens
cacttctaaattaatggtaa

SEQ ID NO: 4403096 - DNA, 12 bp, Homo sapiens
cacttctagaat

SEQ ID NO: 4403097 - DNA, 18 bp, Homo sapiens
gaactgttgcctaattgg

SEQ ID NO: 4403098 - DNA, 20 bp, Homo sapiens
gaacttactgtagcctcaga

SEQ ID NO: 4403099 - DNA, 22 bp, Homo sapiens
gaacttcaggtgtgactctagc

SEQ ID NO: 4403100 - DNA, 23 bp, Homo sapiens
gaacttccaggtgttactgtaat

SEQ ID NO: 4403101 - DNA, 15 bp, Homo sapiens
gaacttgaaagtttt

SEQ ID NO: 4403102 - DNA, 15 bp, Homo sapiens
gaacttgtctcttca

SEQ ID NO: 4403103 - DNA, 18 bp, Homo sapiens
gaacttgtctggctttgg

SEQ ID NO: 4403104 - DNA, 23 bp, Homo sapiens
gaacttgtctggctttggcactc

SEQ ID NO: 4403105 - DNA, 12 bp, Homo sapiens
gaactttcattt

SEQ ID NO: 4403106 - DNA, 13 bp, Homo sapiens
gaagaaaaagaag

SEQ ID NO: 4403107 - DNA, 21 bp, Homo sapiens
gaagaaaactatcctgcgggt

SEQ ID NO: 4403108 - DNA, 22 bp, Homo sapiens
gaagaaaactatcctgcgggtt

SEQ ID NO: 4403109 - DNA, 18 bp, Homo sapiens
gaagaaactttctggtgc

SEQ ID NO: 4403110 - DNA, 12 bp, Homo sapiens
gaagaaagatgt

SEQ ID NO: 4403111 - DNA, 15 bp, Homo sapiens
gaagaaagatttaaa

SEQ ID NO: 4403112 - DNA, 15 bp, Homo sapiens
gaagaaagtggaaaa

SEQ ID NO: 4403113 - DNA, 18 bp, Homo sapiens
gaagaacaacaaagacat

SEQ ID NO: 4403114 - DNA, 16 bp, Homo sapiens
gaagaacaagaaatgg

SEQ ID NO: 4403115 - DNA, 18 bp, Homo sapiens
gaagaacagccccggggc

SEQ ID NO: 4403116 - DNA, 19 bp, Homo sapiens
gaagaacatgattttacaa

SEQ ID NO: 4403117 - DNA, 15 bp, Homo sapiens
gaagaacattattca

SEQ ID NO: 4403118 - DNA, 16 bp, Homo sapiens
gaagaaccaaatacct

SEQ ID NO: 4403119 - DNA, 17 bp, Homo sapiens
gaagaaccaaatacctc

SEQ ID NO: 4403120 - DNA, 20 bp, Homo sapiens
gaagaaccaaatacctcaat

SEQ ID NO: 4403121 - DNA, 13 bp, Homo sapiens
gaagaacggggct

SEQ ID NO: 4403122 - DNA, 20 bp, Homo sapiens
gaagaacggggctcttctca

SEQ ID NO: 4403123 - DNA, 22 bp, Homo sapiens
gaagaaggaaggcctgagcccc

SEQ ID NO: 4403124 - DNA, 14 bp, Homo sapiens
gaagaagggagaag

SEQ ID NO: 4403125 - DNA, 15 bp, Homo sapiens
gaagaagggagaaga

SEQ ID NO: 4403126 - DNA, 19 bp, Homo sapiens
gaagaagggagaagaaagg

SEQ ID NO: 4403127 - DNA, 15 bp, Homo sapiens
gaagaatattgtatt

SEQ ID NO: 4403128 - DNA, 17 bp, Homo sapiens
gaagaatccagtattat

SEQ ID NO: 4403129 - DNA, 24 bp, Homo sapiens
gaagaatgcttaatcagatagata

SEQ ID NO: 4403130 - DNA, 23 bp, Homo sapiens
gaagaattgaacccaggaggtgg

SEQ ID NO: 4403131 - DNA, 20 bp, Homo sapiens
gaagaatttaagttctattc

SEQ ID NO: 4403132 - DNA, 18 bp, Homo sapiens
gaagaatttagatcttat

SEQ ID NO: 4403133 - DNA, 15 bp, Homo sapiens
gaagaattttcagac

SEQ ID NO: 4403134 - DNA, 20 bp, Homo sapiens
gaagaattttcagaccccag

SEQ ID NO: 4403135 - DNA, 13 bp, Homo sapiens
gaagacaacagaa

SEQ ID NO: 4403136 - DNA, 16 bp, Homo sapiens
gaagacattttgttac

SEQ ID NO: 4403137 - DNA, 18 bp, Homo sapiens
gaagacattttgttacat

SEQ ID NO: 4403138 - DNA, 15 bp, Homo sapiens
gaagacccacgtgct

SEQ ID NO: 4403139 - DNA, 14 bp, Homo sapiens
gaagacgaggccct

SEQ ID NO: 4403140 - DNA, 22 bp, Homo sapiens
gaagacgaggccctcgggccca

SEQ ID NO: 4403141 - DNA, 19 bp, Homo sapiens
gaagactcaggagtctgcc

SEQ ID NO: 4403142 - DNA, 22 bp, Homo sapiens
gaagactcaggagtctgccact

SEQ ID NO: 4403143 - DNA, 16 bp, Homo sapiens
gaagactgctcccggc

SEQ ID NO: 4403144 - DNA, 23 bp, Homo sapiens
gaagactgctcccggcccgcctg

SEQ ID NO: 4403145 - DNA, 17 bp, Homo sapiens
gaagactggaagctaat

SEQ ID NO: 4403146 - DNA, 13 bp, Homo sapiens
gaagacttcaaaa

SEQ ID NO: 4403147 - DNA, 13 bp, Homo sapiens
gaagagaaaagac

SEQ ID NO: 4403148 - DNA, 24 bp, Homo sapiens
gaagagaagtgaccgagagaacct

SEQ ID NO: 4403149 - DNA, 19 bp, Homo sapiens
gaagagacaaagatttctt

SEQ ID NO: 4403150 - DNA, 23 bp, Homo sapiens
gaagagacagagacaagtaattt

SEQ ID NO: 4403151 - DNA, 14 bp, Homo sapiens
gaagagcaaaagct

SEQ ID NO: 4403152 - DNA, 11 bp, Homo sapiens
gaagagccacc

SEQ ID NO: 4403153 - DNA, 14 bp, Homo sapiens
gaagagccacctgc

SEQ ID NO: 4403154 - DNA, 16 bp, Homo sapiens
gaagagccacctgcaa
